United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 127

SEQ ID NO: 5386646 - DNA, 19 bp, Homo sapiens
cagtgtctttttttgtata

SEQ ID NO: 5386647 - DNA, 11 bp, Homo sapiens
cagtgtgaacc

SEQ ID NO: 5386648 - DNA, 12 bp, Homo sapiens
cagtgtgaagcc

SEQ ID NO: 5386649 - DNA, 23 bp, Homo sapiens
cagtgtgaagtacaataattcat

SEQ ID NO: 5386650 - DNA, 15 bp, Homo sapiens
cagtgtgaagttaga

SEQ ID NO: 5386651 - DNA, 20 bp, Homo sapiens
cagtgtgaagttagaattcc

SEQ ID NO: 5386652 - DNA, 19 bp, Homo sapiens
cagtgtgaatatatggtct

SEQ ID NO: 5386653 - DNA, 18 bp, Homo sapiens
cagtgtgaatgctgggcc

SEQ ID NO: 5386654 - DNA, 17 bp, Homo sapiens
cagtgtgagatactgtg

SEQ ID NO: 5386655 - DNA, 20 bp, Homo sapiens
cagtgtgaggacctccctgt

SEQ ID NO: 5386656 - DNA, 15 bp, Homo sapiens
cagttgcacagcatc

SEQ ID NO: 5386657 - DNA, 16 bp, Homo sapiens
cagttgcacagcatct

SEQ ID NO: 5386658 - DNA, 18 bp, Homo sapiens
cagttgcacagcatctca

SEQ ID NO: 5386659 - DNA, 19 bp, Homo sapiens
cagttgcacttggcctctg

SEQ ID NO: 5386660 - DNA, 17 bp, Homo sapiens
cagttgcagaaaatgaa

SEQ ID NO: 5386661 - DNA, 21 bp, Homo sapiens
cagttgcagagaattgtttct

SEQ ID NO: 5386662 - DNA, 13 bp, Homo sapiens
cagttgcaggagc

SEQ ID NO: 5386663 - DNA, 18 bp, Homo sapiens
cagttgcatgtagtaaca

SEQ ID NO: 5386664 - DNA, 20 bp, Homo sapiens
cagttgcatgtagtaacact

SEQ ID NO: 5386665 - DNA, 21 bp, Homo sapiens
cagttgcatgtagtaacacta

SEQ ID NO: 5386666 - DNA, 21 bp, Homo sapiens
cagttgccaaagttttgctgt

SEQ ID NO: 5386667 - DNA, 14 bp, Homo sapiens
cagttgcccagcct

SEQ ID NO: 5386668 - DNA, 16 bp, Homo sapiens
cagttgccccccatca

SEQ ID NO: 5386669 - DNA, 20 bp, Homo sapiens
cagttgccctagcccagact

SEQ ID NO: 5386670 - DNA, 14 bp, Homo sapiens
cagttgcctccagg

SEQ ID NO: 5386671 - DNA, 15 bp, Homo sapiens
cagttgcctccaggg

SEQ ID NO: 5386672 - DNA, 13 bp, Homo sapiens
cagttgcctttta

SEQ ID NO: 5386673 - DNA, 22 bp, Homo sapiens
cagttgcgcgttctgaaatatt

SEQ ID NO: 5386674 - DNA, 15 bp, Homo sapiens
cagttgctaaacact

SEQ ID NO: 5386675 - DNA, 16 bp, Homo sapiens
cagttgctaaacactg

SEQ ID NO: 5386676 - DNA, 19 bp, Homo sapiens
cagttgctaaatttgtgtt

SEQ ID NO: 5386677 - DNA, 20 bp, Homo sapiens
cagttgctagcaacaactta

SEQ ID NO: 5386678 - DNA, 19 bp, Homo sapiens
cagttgctcaaaaagaaat

SEQ ID NO: 5386679 - DNA, 22 bp, Homo sapiens
cagttgctgatccctgctctct

SEQ ID NO: 5386680 - DNA, 18 bp, Homo sapiens
cagttgctgcttcaattt

SEQ ID NO: 5386681 - DNA, 19 bp, Homo sapiens
cagttgctgcttcaattta

SEQ ID NO: 5386682 - DNA, 19 bp, Homo sapiens
cagttgctggtaaaatgaa

SEQ ID NO: 5386683 - DNA, 20 bp, Homo sapiens
cagttgctggtaaaatgaag

SEQ ID NO: 5386684 - DNA, 22 bp, Homo sapiens
cagttgctggtaaaatgaagaa

SEQ ID NO: 5386685 - DNA, 21 bp, Homo sapiens
cagttgctgtcacaaaggagt

SEQ ID NO: 5386686 - DNA, 22 bp, Homo sapiens
cagttgctgtcagtcttgacct

SEQ ID NO: 5386687 - DNA, 13 bp, Homo sapiens
cagttgctgtgaa

SEQ ID NO: 5386688 - DNA, 15 bp, Homo sapiens
cagttgctgttctta

SEQ ID NO: 5386689 - DNA, 19 bp, Homo sapiens
cagttggacagtaagattt

SEQ ID NO: 5386690 - DNA, 16 bp, Homo sapiens
cagttggactctcagg

SEQ ID NO: 5386691 - DNA, 18 bp, Homo sapiens
cagttggatcttttgaag

SEQ ID NO: 5386692 - DNA, 15 bp, Homo sapiens
cagttggcagacagc

SEQ ID NO: 5386693 - DNA, 19 bp, Homo sapiens
cagttggcccgggtgcagg

SEQ ID NO: 5386694 - DNA, 23 bp, Homo sapiens
cagttggcctcagcagaaggcct

SEQ ID NO: 5386695 - DNA, 23 bp, Homo sapiens
cagttggcctgtgcttggaggcc

SEQ ID NO: 5386696 - DNA, 18 bp, Homo sapiens
cagttggcttctgtgcct

SEQ ID NO: 5386697 - DNA, 18 bp, Homo sapiens
cagttgggaaaatatgtc

SEQ ID NO: 5386698 - DNA, 17 bp, Homo sapiens
cagttgggaagtctcag

SEQ ID NO: 5386699 - DNA, 23 bp, Homo sapiens
cagttgggaagtctcagcctggg

SEQ ID NO: 5386700 - DNA, 22 bp, Homo sapiens
cagttgggacccaaaacacagg

SEQ ID NO: 5386701 - DNA, 15 bp, Homo sapiens
cagttgggactcagg

SEQ ID NO: 5386702 - DNA, 15 bp, Homo sapiens
cagttgggagcactg

SEQ ID NO: 5386703 - DNA, 16 bp, Homo sapiens
cagttgggagcactgg

SEQ ID NO: 5386704 - DNA, 15 bp, Homo sapiens
cagttgggcccccat

SEQ ID NO: 5386705 - DNA, 22 bp, Homo sapiens
cagttggggaagccaggtgagc

SEQ ID NO: 5386706 - DNA, 23 bp, Homo sapiens
cagttggggcaggggcaggaggg

SEQ ID NO: 5386707 - DNA, 21 bp, Homo sapiens
cagttggggctgttcatggca

SEQ ID NO: 5386708 - DNA, 17 bp, Homo sapiens
cagttggtaacttttgt

SEQ ID NO: 5386709 - DNA, 21 bp, Homo sapiens
cagttggtcccccttccatgg

SEQ ID NO: 5386710 - DNA, 13 bp, Homo sapiens
cagttggtggggc

SEQ ID NO: 5386711 - DNA, 14 bp, Homo sapiens
cagttggttgtgtc

SEQ ID NO: 5386712 - DNA, 17 bp, Homo sapiens
cagttggttttgcatgt

SEQ ID NO: 5386713 - DNA, 18 bp, Homo sapiens
cagttggttttgcatgtc

SEQ ID NO: 5386714 - DNA, 13 bp, Homo sapiens
cagttgtaaaatt

SEQ ID NO: 5386715 - DNA, 20 bp, Homo sapiens
cagttgtaccactgctaata

SEQ ID NO: 5386716 - DNA, 23 bp, Homo sapiens
cagttgtaccactgctaataaat

SEQ ID NO: 5386717 - DNA, 16 bp, Homo sapiens
cagttgtacttctgct

SEQ ID NO: 5386718 - DNA, 21 bp, Homo sapiens
cagttgtatgtttgctgatta

SEQ ID NO: 5386719 - DNA, 14 bp, Homo sapiens
cagttgtatttaat

SEQ ID NO: 5386720 - DNA, 23 bp, Homo sapiens
cagttgtccagatcactgaattg

SEQ ID NO: 5386721 - DNA, 12 bp, Homo sapiens
cagttgtcctcc

SEQ ID NO: 5386722 - DNA, 15 bp, Homo sapiens
cagttgtcctccttc

SEQ ID NO: 5386723 - DNA, 15 bp, Homo sapiens
cagttgtcctgattt

SEQ ID NO: 5386724 - DNA, 19 bp, Homo sapiens
cagttgtccttaaatttgt

SEQ ID NO: 5386725 - DNA, 21 bp, Homo sapiens
cagttgtcttatgtgaaaaat

SEQ ID NO: 5386726 - DNA, 22 bp, Homo sapiens
cagttgtgataatagcattttt

SEQ ID NO: 5386727 - DNA, 21 bp, Homo sapiens
cagttgtggcctcattcagca

SEQ ID NO: 5386728 - DNA, 21 bp, Homo sapiens
cagttgtggtactgtcattga

SEQ ID NO: 5386729 - DNA, 17 bp, Homo sapiens
cagttgtggtgtgagta

SEQ ID NO: 5386730 - DNA, 21 bp, Homo sapiens
cagttgtggtgtgagtatcag

SEQ ID NO: 5386731 - DNA, 14 bp, Homo sapiens
cagttgtgttcatg

SEQ ID NO: 5386732 - DNA, 15 bp, Homo sapiens
cagttgtgtttggca

SEQ ID NO: 5386733 - DNA, 15 bp, Homo sapiens
cagttgttactgaag

SEQ ID NO: 5386734 - DNA, 18 bp, Homo sapiens
cagttgttactgaagtta

SEQ ID NO: 5386735 - DNA, 21 bp, Homo sapiens
cagttgttatttattgaaatg

SEQ ID NO: 5386736 - DNA, 19 bp, Homo sapiens
cagttgttctttttagaaa

SEQ ID NO: 5386737 - DNA, 16 bp, Homo sapiens
cagttgtttgcttctt

SEQ ID NO: 5386738 - DNA, 21 bp, Homo sapiens
cagttgtttgtttttgcttgt

SEQ ID NO: 5386739 - DNA, 18 bp, Homo sapiens
cagtttaaaaagatgaaa

SEQ ID NO: 5386740 - DNA, 17 bp, Homo sapiens
cagtttaaacacatcaa

SEQ ID NO: 5386741 - DNA, 20 bp, Homo sapiens
cagtttaagtaattgcctac

SEQ ID NO: 5386742 - DNA, 21 bp, Homo sapiens
cagtttaatgaagatctaaat

SEQ ID NO: 5386743 - DNA, 18 bp, Homo sapiens
cagtttaattctgttaac

SEQ ID NO: 5386744 - DNA, 23 bp, Homo sapiens
cagtttacagacgctgctgtcac

SEQ ID NO: 5386745 - DNA, 12 bp, Homo sapiens
cagtttacagta

SEQ ID NO: 5386746 - DNA, 17 bp, Homo sapiens
cagtttacagtatttct

SEQ ID NO: 5386747 - DNA, 18 bp, Homo sapiens
cagtttactctctccctc

SEQ ID NO: 5386748 - DNA, 17 bp, Homo sapiens
cagtttagcccatctct

SEQ ID NO: 5386749 - DNA, 14 bp, Homo sapiens
cagtttagcttttt

SEQ ID NO: 5386750 - DNA, 15 bp, Homo sapiens
cagtttagtgcttta

SEQ ID NO: 5386751 - DNA, 20 bp, Homo sapiens
cagtttataaagccaagaat

SEQ ID NO: 5386752 - DNA, 18 bp, Homo sapiens
cagtttataccctagtta

SEQ ID NO: 5386753 - DNA, 14 bp, Homo sapiens
cagtttatatggaa

SEQ ID NO: 5386754 - DNA, 18 bp, Homo sapiens
cagtttatcattcaagtg

SEQ ID NO: 5386755 - DNA, 14 bp, Homo sapiens
cagtttatgaaaca

SEQ ID NO: 5386756 - DNA, 16 bp, Homo sapiens
cagtttatgttgtaca

SEQ ID NO: 5386757 - DNA, 13 bp, Homo sapiens
cagtttatgtttg

SEQ ID NO: 5386758 - DNA, 14 bp, Homo sapiens
cagtttatgttttg

SEQ ID NO: 5386759 - DNA, 19 bp, Homo sapiens
cagtttatttccactattt

SEQ ID NO: 5386760 - DNA, 21 bp, Homo sapiens
cagtttatttccactattttc

SEQ ID NO: 5386761 - DNA, 19 bp, Homo sapiens
cagtttatttgaaccaata

SEQ ID NO: 5386762 - DNA, 18 bp, Homo sapiens
cagtttattttctgtgta

SEQ ID NO: 5386763 - DNA, 19 bp, Homo sapiens
cagtttattttctgtgtaa

SEQ ID NO: 5386764 - DNA, 22 bp, Homo sapiens
cagtttattttctgtgtaaaat

SEQ ID NO: 5386765 - DNA, 21 bp, Homo sapiens
cagtttatttttaaagataga

SEQ ID NO: 5386766 - DNA, 13 bp, Homo sapiens
cagtttcaataaa

SEQ ID NO: 5386767 - DNA, 16 bp, Homo sapiens
cagtttcaataaagtt

SEQ ID NO: 5386768 - DNA, 17 bp, Homo sapiens
cagtttcaataaagttt

SEQ ID NO: 5386769 - DNA, 20 bp, Homo sapiens
cagtttcaataaagtttgat

SEQ ID NO: 5386770 - DNA, 14 bp, Homo sapiens
cagtttcacagaaa

SEQ ID NO: 5386771 - DNA, 21 bp, Homo sapiens
cagtttcacagaaaataaggc

SEQ ID NO: 5386772 - DNA, 20 bp, Homo sapiens
cagtttcaccatctttgagg

SEQ ID NO: 5386773 - DNA, 15 bp, Homo sapiens
cagtttcactccctc

SEQ ID NO: 5386774 - DNA, 15 bp, Homo sapiens
cagtttcagaagcag

SEQ ID NO: 5386775 - DNA, 20 bp, Homo sapiens
cagtttcagaagcaggcagg

SEQ ID NO: 5386776 - DNA, 14 bp, Homo sapiens
cagtttcagagatg

SEQ ID NO: 5386777 - DNA, 17 bp, Homo sapiens
cagtttcagataaatca

SEQ ID NO: 5386778 - DNA, 19 bp, Homo sapiens
cagtttcagataaatcatg

SEQ ID NO: 5386779 - DNA, 15 bp, Homo sapiens
cagtttcaggtgttt

SEQ ID NO: 5386780 - DNA, 22 bp, Homo sapiens
cagtttcaggtgtttagttgca

SEQ ID NO: 5386781 - DNA, 15 bp, Homo sapiens
cagtttcatcaggac

SEQ ID NO: 5386782 - DNA, 16 bp, Homo sapiens
cagtttcatcaggacc

SEQ ID NO: 5386783 - DNA, 18 bp, Homo sapiens
cagtttcatctaaatgaa

SEQ ID NO: 5386784 - DNA, 12 bp, Homo sapiens
cagtttccaaat

SEQ ID NO: 5386785 - DNA, 22 bp, Homo sapiens
cagtttcccaaaaaccccagtg

SEQ ID NO: 5386786 - DNA, 12 bp, Homo sapiens
cagtttcccctc

SEQ ID NO: 5386787 - DNA, 15 bp, Homo sapiens
cagtttcccctctcg

SEQ ID NO: 5386788 - DNA, 17 bp, Homo sapiens
cagtttcctcatctgtc

SEQ ID NO: 5386789 - DNA, 22 bp, Homo sapiens
cagtttcctcctcccaacagtt

SEQ ID NO: 5386790 - DNA, 23 bp, Homo sapiens
cagtttcctcctcccaacagttt

SEQ ID NO: 5386791 - DNA, 13 bp, Homo sapiens
cagtttcctctcc

SEQ ID NO: 5386792 - DNA, 19 bp, Homo sapiens
cagtttctaaactggagac

SEQ ID NO: 5386793 - DNA, 17 bp, Homo sapiens
cagtttctccatcagct

SEQ ID NO: 5386794 - DNA, 16 bp, Homo sapiens
cagtttctccttgaaa

SEQ ID NO: 5386795 - DNA, 20 bp, Homo sapiens
cagtttctcctttattgctc

SEQ ID NO: 5386796 - DNA, 17 bp, Homo sapiens
cagtttctctgccttct

SEQ ID NO: 5386797 - DNA, 14 bp, Homo sapiens
cagtttctgcctct

SEQ ID NO: 5386798 - DNA, 15 bp, Homo sapiens
cagtttctgcctggg

SEQ ID NO: 5386799 - DNA, 17 bp, Homo sapiens
cagtttctgcctgggca

SEQ ID NO: 5386800 - DNA, 15 bp, Homo sapiens
cagtttctgctgttg

SEQ ID NO: 5386801 - DNA, 22 bp, Homo sapiens
cagtttcttactgttttgtatc

SEQ ID NO: 5386802 - DNA, 16 bp, Homo sapiens
cagtttcttcatgcat

SEQ ID NO: 5386803 - DNA, 22 bp, Homo sapiens
cagtttcttctgcgcctcaggc

SEQ ID NO: 5386804 - DNA, 16 bp, Homo sapiens
cagtttcttctgtaaa

SEQ ID NO: 5386805 - DNA, 21 bp, Homo sapiens
cagtttcttgcttggaagcca

SEQ ID NO: 5386806 - DNA, 22 bp, Homo sapiens
cagtttcttgcttggaagccag

SEQ ID NO: 5386807 - DNA, 16 bp, Homo sapiens
cagtttgaaattctga

SEQ ID NO: 5386808 - DNA, 18 bp, Homo sapiens
cagtttgaaattctgaat

SEQ ID NO: 5386809 - DNA, 19 bp, Homo sapiens
cagtttgaaattctgaatt

SEQ ID NO: 5386810 - DNA, 21 bp, Homo sapiens
cagtttgaaattctgaatttg

SEQ ID NO: 5386811 - DNA, 19 bp, Homo sapiens
cagtttgaagcctgtgcct

SEQ ID NO: 5386812 - DNA, 21 bp, Homo sapiens
cagtttgaagcctgtgcctcc

SEQ ID NO: 5386813 - DNA, 24 bp, Homo sapiens
cagtttgaatgcagtctgtccagg

SEQ ID NO: 5386814 - DNA, 15 bp, Homo sapiens
cagtttgagacagga

SEQ ID NO: 5386815 - DNA, 16 bp, Homo sapiens
cagtttgagacaggag

SEQ ID NO: 5386816 - DNA, 15 bp, Homo sapiens
cagtttgagaccagc

SEQ ID NO: 5386817 - DNA, 18 bp, Homo sapiens
cagtttgagaccagcctg

SEQ ID NO: 5386818 - DNA, 23 bp, Homo sapiens
cagtttgaggattagtttagaac

SEQ ID NO: 5386819 - DNA, 20 bp, Homo sapiens
cagtttgatcacactatttt

SEQ ID NO: 5386820 - DNA, 21 bp, Homo sapiens
cagtttgatgctgagtcatgc

SEQ ID NO: 5386821 - DNA, 20 bp, Homo sapiens
cagtttgattgaggagctgc

SEQ ID NO: 5386822 - DNA, 11 bp, Homo sapiens
cagtttgcaaa

SEQ ID NO: 5386823 - DNA, 15 bp, Homo sapiens
cagtttgcaaaaaat

SEQ ID NO: 5386824 - DNA, 14 bp, Homo sapiens
cagtttgcagagta

SEQ ID NO: 5386825 - DNA, 13 bp, Homo sapiens
cagtttgccaccc

SEQ ID NO: 5386826 - DNA, 21 bp, Homo sapiens
cagtttgccggatacaaactg

SEQ ID NO: 5386827 - DNA, 16 bp, Homo sapiens
cagtttgcctgctgta

SEQ ID NO: 5386828 - DNA, 22 bp, Homo sapiens
cagtttgctatttgctttagag

SEQ ID NO: 5386829 - DNA, 12 bp, Homo sapiens
cagtttgctgta

SEQ ID NO: 5386830 - DNA, 14 bp, Homo sapiens
cagtttgctttgta

SEQ ID NO: 5386831 - DNA, 14 bp, Homo sapiens
cagtttggaagtgt

SEQ ID NO: 5386832 - DNA, 20 bp, Homo sapiens
catacaggagagctgcagtt

SEQ ID NO: 5386833 - DNA, 18 bp, Homo sapiens
catacagtcaagatacat

SEQ ID NO: 5386834 - DNA, 17 bp, Homo sapiens
catacagtctctatttg

SEQ ID NO: 5386835 - DNA, 10 bp, Homo sapiens
catacagttt

SEQ ID NO: 5386836 - DNA, 13 bp, Homo sapiens
catacagttttca

SEQ ID NO: 5386837 - DNA, 18 bp, Homo sapiens
catacataaaagaaataa

SEQ ID NO: 5386838 - DNA, 20 bp, Homo sapiens
catacataaaagaaataaac

SEQ ID NO: 5386839 - DNA, 21 bp, Homo sapiens
catacatacacacacacacat

SEQ ID NO: 5386840 - DNA, 20 bp, Homo sapiens
catacatacacatacataca

SEQ ID NO: 5386841 - DNA, 11 bp, Homo sapiens
catacatacat

SEQ ID NO: 5386842 - DNA, 15 bp, Homo sapiens
catacatacatacat

SEQ ID NO: 5386843 - DNA, 17 bp, Homo sapiens
catacatacatacatac

SEQ ID NO: 5386844 - DNA, 18 bp, Homo sapiens
catacatacatacatata

SEQ ID NO: 5386845 - DNA, 20 bp, Homo sapiens
catacatatatatatttgta

SEQ ID NO: 5386846 - DNA, 23 bp, Homo sapiens
catacatatgtagaaacatttag

SEQ ID NO: 5386847 - DNA, 19 bp, Homo sapiens
catacatatttttgtagca

SEQ ID NO: 5386848 - DNA, 19 bp, Homo sapiens
catacatgaataaaaataa

SEQ ID NO: 5386849 - DNA, 15 bp, Homo sapiens
catacatgctacttt

SEQ ID NO: 5386850 - DNA, 14 bp, Homo sapiens
catacattaaaact

SEQ ID NO: 5386851 - DNA, 14 bp, Homo sapiens
catacattatattc

SEQ ID NO: 5386852 - DNA, 19 bp, Homo sapiens
catacattatttcttccca

SEQ ID NO: 5386853 - DNA, 20 bp, Homo sapiens
catacattatttcttcccag

SEQ ID NO: 5386854 - DNA, 13 bp, Homo sapiens
catacattcctaa

SEQ ID NO: 5386855 - DNA, 18 bp, Homo sapiens
catacattcttcaagatc

SEQ ID NO: 5386856 - DNA, 19 bp, Homo sapiens
catacattggttttgaaat

SEQ ID NO: 5386857 - DNA, 17 bp, Homo sapiens
catacattgtataggcc

SEQ ID NO: 5386858 - DNA, 21 bp, Homo sapiens
catacattgtataggccatct

SEQ ID NO: 5386859 - DNA, 17 bp, Homo sapiens
catacatttaaaaaaca

SEQ ID NO: 5386860 - DNA, 22 bp, Homo sapiens
catacatttaaaaaacatttta

SEQ ID NO: 5386861 - DNA, 22 bp, Homo sapiens
catacatttataatgtttgcta

SEQ ID NO: 5386862 - DNA, 18 bp, Homo sapiens
catacattttctaagaaa

SEQ ID NO: 5386863 - DNA, 17 bp, Homo sapiens
catacattttgtaccaa

SEQ ID NO: 5386864 - DNA, 12 bp, Homo sapiens
cataccaaatgg

SEQ ID NO: 5386865 - DNA, 15 bp, Homo sapiens
cataccaaatggcac

SEQ ID NO: 5386866 - DNA, 21 bp, Homo sapiens
cataccacaagacatttcttt

SEQ ID NO: 5386867 - DNA, 16 bp, Homo sapiens
cataccacaataaaaa

SEQ ID NO: 5386868 - DNA, 13 bp, Homo sapiens
cataccacttttg

SEQ ID NO: 5386869 - DNA, 19 bp, Homo sapiens
cataccacttttgttcttg

SEQ ID NO: 5386870 - DNA, 19 bp, Homo sapiens
cataccaggggttccccag

SEQ ID NO: 5386871 - DNA, 21 bp, Homo sapiens
cataccaggggttccccagga

SEQ ID NO: 5386872 - DNA, 23 bp, Homo sapiens
cataccaggtgctagggtgcctg

SEQ ID NO: 5386873 - DNA, 16 bp, Homo sapiens
cataccagtcacctcc

SEQ ID NO: 5386874 - DNA, 18 bp, Homo sapiens
cataccagttcttgcaat

SEQ ID NO: 5386875 - DNA, 12 bp, Homo sapiens
cataccatcact

SEQ ID NO: 5386876 - DNA, 17 bp, Homo sapiens
cataccatcactgagtg

SEQ ID NO: 5386877 - DNA, 17 bp, Homo sapiens
cataccattattatgta

SEQ ID NO: 5386878 - DNA, 20 bp, Homo sapiens
cataccattattatgtaaat

SEQ ID NO: 5386879 - DNA, 17 bp, Homo sapiens
cataccattcccatgga

SEQ ID NO: 5386880 - DNA, 16 bp, Homo sapiens
cataccattgtggaat

SEQ ID NO: 5386881 - DNA, 18 bp, Homo sapiens
catacccaaaccaggtgg

SEQ ID NO: 5386882 - DNA, 19 bp, Homo sapiens
catacccacaatctgagca

SEQ ID NO: 5386883 - DNA, 23 bp, Homo sapiens
catacccacacattccagggctg

SEQ ID NO: 5386884 - DNA, 11 bp, Homo sapiens
catacccaccc

SEQ ID NO: 5386885 - DNA, 12 bp, Homo sapiens
catacccacccc

SEQ ID NO: 5386886 - DNA, 17 bp, Homo sapiens
catacccacccccaccc

SEQ ID NO: 5386887 - DNA, 15 bp, Homo sapiens
cataccccactgggc

SEQ ID NO: 5386888 - DNA, 15 bp, Homo sapiens
cataccccctccccc

SEQ ID NO: 5386889 - DNA, 21 bp, Homo sapiens
cataccccctgccccagagaa

SEQ ID NO: 5386890 - DNA, 20 bp, Homo sapiens
cataccccttacaaatgaaa

SEQ ID NO: 5386891 - DNA, 14 bp, Homo sapiens
cataccccttattg

SEQ ID NO: 5386892 - DNA, 20 bp, Homo sapiens
catacccgcctagctgctgt

SEQ ID NO: 5386893 - DNA, 15 bp, Homo sapiens
cataccctgacctgg

SEQ ID NO: 5386894 - DNA, 16 bp, Homo sapiens
cataccctgacctggc

SEQ ID NO: 5386895 - DNA, 21 bp, Homo sapiens
catacccttctttaaatcaaa

SEQ ID NO: 5386896 - DNA, 22 bp, Homo sapiens
cataccgcctcgtgccagcagc

SEQ ID NO: 5386897 - DNA, 16 bp, Homo sapiens
cataccgctggggaac

SEQ ID NO: 5386898 - DNA, 22 bp, Homo sapiens
cataccggacttgtcacacgga

SEQ ID NO: 5386899 - DNA, 17 bp, Homo sapiens
cataccgtttggtgtct

SEQ ID NO: 5386900 - DNA, 18 bp, Homo sapiens
catacctaagtactgtaa

SEQ ID NO: 5386901 - DNA, 16 bp, Homo sapiens
catacctaccagtatt

SEQ ID NO: 5386902 - DNA, 16 bp, Homo sapiens
catacctcatctcttg

SEQ ID NO: 5386903 - DNA, 15 bp, Homo sapiens
catacctcgaacatc

SEQ ID NO: 5386904 - DNA, 22 bp, Homo sapiens
catacctctctctatatataca

SEQ ID NO: 5386905 - DNA, 12 bp, Homo sapiens
catacctctctg

SEQ ID NO: 5386906 - DNA, 19 bp, Homo sapiens
catacctgttgtacacttg

SEQ ID NO: 5386907 - DNA, 18 bp, Homo sapiens
cataccttagactgaaaa

SEQ ID NO: 5386908 - DNA, 13 bp, Homo sapiens
cataccttctccc

SEQ ID NO: 5386909 - DNA, 14 bp, Homo sapiens
cataccttctccca

SEQ ID NO: 5386910 - DNA, 17 bp, Homo sapiens
cataccttctcccaggc

SEQ ID NO: 5386911 - DNA, 22 bp, Homo sapiens
cataccttctggttgcttcaga

SEQ ID NO: 5386912 - DNA, 19 bp, Homo sapiens
catacctttattgtgatct

SEQ ID NO: 5386913 - DNA, 17 bp, Homo sapiens
cataccttttatttttt

SEQ ID NO: 5386914 - DNA, 21 bp, Homo sapiens
catacgaaaaagtgattgtga

SEQ ID NO: 5386915 - DNA, 23 bp, Homo sapiens
catacgaaaaagtgattgtgaag

SEQ ID NO: 5386916 - DNA, 20 bp, Homo sapiens
catacgcattaagggcctgc

SEQ ID NO: 5386917 - DNA, 19 bp, Homo sapiens
catacgcctcttgttcatg

SEQ ID NO: 5386918 - DNA, 22 bp, Homo sapiens
catacgcttttaatgaaaagga

SEQ ID NO: 5386919 - DNA, 21 bp, Homo sapiens
catacgtgcccatttcacaca

SEQ ID NO: 5386920 - DNA, 23 bp, Homo sapiens
catacgtgttctatagagcctgg

SEQ ID NO: 5386921 - DNA, 21 bp, Homo sapiens
catacgttgatagtttacaaa

SEQ ID NO: 5386922 - DNA, 23 bp, Homo sapiens
catacgttgatagtttacaaaca

SEQ ID NO: 5386923 - DNA, 16 bp, Homo sapiens
catacgttttctgcaa

SEQ ID NO: 5386924 - DNA, 13 bp, Homo sapiens
catactaacctat

SEQ ID NO: 5386925 - DNA, 14 bp, Homo sapiens
catactaataaata

SEQ ID NO: 5386926 - DNA, 23 bp, Homo sapiens
catactaataaatataatttata

SEQ ID NO: 5386927 - DNA, 20 bp, Homo sapiens
catactaattataccccctg

SEQ ID NO: 5386928 - DNA, 15 bp, Homo sapiens
catactacctagaag

SEQ ID NO: 5386929 - DNA, 18 bp, Homo sapiens
catactacctagaagtaa

SEQ ID NO: 5386930 - DNA, 20 bp, Homo sapiens
catactactgaaacagattt

SEQ ID NO: 5386931 - DNA, 22 bp, Homo sapiens
catactactgaaacagatttca

SEQ ID NO: 5386932 - DNA, 20 bp, Homo sapiens
catactagcaagacagctct

SEQ ID NO: 5386933 - DNA, 14 bp, Homo sapiens
catactaggtgcct

SEQ ID NO: 5386934 - DNA, 15 bp, Homo sapiens
catactatgaaatat

SEQ ID NO: 5386935 - DNA, 18 bp, Homo sapiens
catactcaaatggtgtca

SEQ ID NO: 5386936 - DNA, 20 bp, Homo sapiens
catactcagcctgctgccca

SEQ ID NO: 5386937 - DNA, 20 bp, Homo sapiens
catactcatttctaaaagaa

SEQ ID NO: 5386938 - DNA, 21 bp, Homo sapiens
catactcatttctaaaagaat

SEQ ID NO: 5386939 - DNA, 17 bp, Homo sapiens
catactcctatgcttta

SEQ ID NO: 5386940 - DNA, 19 bp, Homo sapiens
catactccttgcttcctga

SEQ ID NO: 5386941 - DNA, 17 bp, Homo sapiens
catactcgagtctgagg

SEQ ID NO: 5386942 - DNA, 19 bp, Homo sapiens
catactcgagtctgaggcc

SEQ ID NO: 5386943 - DNA, 17 bp, Homo sapiens
catactctagattttgt

SEQ ID NO: 5386944 - DNA, 23 bp, Homo sapiens
catactctagattttgttttgct

SEQ ID NO: 5386945 - DNA, 14 bp, Homo sapiens
catactctccagga

SEQ ID NO: 5386946 - DNA, 15 bp, Homo sapiens
catactctccaggat

SEQ ID NO: 5386947 - DNA, 23 bp, Homo sapiens
catactctccaggattgtccaca

SEQ ID NO: 5386948 - DNA, 13 bp, Homo sapiens
catactctctgcc

SEQ ID NO: 5386949 - DNA, 16 bp, Homo sapiens
catactctctgcctgg

SEQ ID NO: 5386950 - DNA, 13 bp, Homo sapiens
catactctgtgta

SEQ ID NO: 5386951 - DNA, 14 bp, Homo sapiens
catactctgtgtaa

SEQ ID NO: 5386952 - DNA, 23 bp, Homo sapiens
catactctgtgtaatctctgatt

SEQ ID NO: 5386953 - DNA, 13 bp, Homo sapiens
catactctgttgc

SEQ ID NO: 5386954 - DNA, 14 bp, Homo sapiens
catactctgttgcc

SEQ ID NO: 5386955 - DNA, 16 bp, Homo sapiens
catactctgttgcctc

SEQ ID NO: 5386956 - DNA, 17 bp, Homo sapiens
catactctgttgcctcc

SEQ ID NO: 5386957 - DNA, 21 bp, Homo sapiens
catactctgttgcctcctctc

SEQ ID NO: 5386958 - DNA, 15 bp, Homo sapiens
catactctttctttg

SEQ ID NO: 5386959 - DNA, 22 bp, Homo sapiens
catactgaaaaaatgctgagcc

SEQ ID NO: 5386960 - DNA, 19 bp, Homo sapiens
catactgacttcagtggga

SEQ ID NO: 5386961 - DNA, 14 bp, Homo sapiens
catactgagcctgc

SEQ ID NO: 5386962 - DNA, 20 bp, Homo sapiens
catactgatgagacaacaca

SEQ ID NO: 5386963 - DNA, 23 bp, Homo sapiens
catactgattgggaggtgcgtgt

SEQ ID NO: 5386964 - DNA, 19 bp, Homo sapiens
catactgcctactgttact

SEQ ID NO: 5386965 - DNA, 19 bp, Homo sapiens
catactgcgtccaccctga

SEQ ID NO: 5386966 - DNA, 15 bp, Homo sapiens
catactggactcttc

SEQ ID NO: 5386967 - DNA, 15 bp, Homo sapiens
catactggcctcgcc

SEQ ID NO: 5386968 - DNA, 18 bp, Homo sapiens
catactggcctggactgt

SEQ ID NO: 5386969 - DNA, 17 bp, Homo sapiens
catactgtaacattcag

SEQ ID NO: 5386970 - DNA, 15 bp, Homo sapiens
catactgtacacatt

SEQ ID NO: 5386971 - DNA, 16 bp, Homo sapiens
catactgtagacactc

SEQ ID NO: 5386972 - DNA, 14 bp, Homo sapiens
catactgtattttt

SEQ ID NO: 5386973 - DNA, 21 bp, Homo sapiens
catactgtcatataatgcaac

SEQ ID NO: 5386974 - DNA, 13 bp, Homo sapiens
catactgtctctg

SEQ ID NO: 5386975 - DNA, 15 bp, Homo sapiens
catactgtctctgga

SEQ ID NO: 5386976 - DNA, 16 bp, Homo sapiens
catactgtctctggag

SEQ ID NO: 5386977 - DNA, 17 bp, Homo sapiens
catactgtctctggagt

SEQ ID NO: 5386978 - DNA, 23 bp, Homo sapiens
catactgtctgggattaagggca

SEQ ID NO: 5386979 - DNA, 18 bp, Homo sapiens
catactgtgctggagcca

SEQ ID NO: 5386980 - DNA, 18 bp, Homo sapiens
catactgttgatacaaac

SEQ ID NO: 5386981 - DNA, 22 bp, Homo sapiens
catactgtttgcccattttcat

SEQ ID NO: 5386982 - DNA, 21 bp, Homo sapiens
catactgttttgaataaattt

SEQ ID NO: 5386983 - DNA, 22 bp, Homo sapiens
catacttaaaatatctctaaaa

SEQ ID NO: 5386984 - DNA, 16 bp, Homo sapiens
catacttaacatttca

SEQ ID NO: 5386985 - DNA, 19 bp, Homo sapiens
catacttacatttcagaca

SEQ ID NO: 5386986 - DNA, 22 bp, Homo sapiens
catacttacctagtgaaacttt

SEQ ID NO: 5386987 - DNA, 16 bp, Homo sapiens
catacttagaaacaaa

SEQ ID NO: 5386988 - DNA, 18 bp, Homo sapiens
catacttatctctctgtg

SEQ ID NO: 5386989 - DNA, 15 bp, Homo sapiens
catacttcaaaagta

SEQ ID NO: 5386990 - DNA, 17 bp, Homo sapiens
catacttcaaaagtatt

SEQ ID NO: 5386991 - DNA, 16 bp, Homo sapiens
catacttcctggattt

SEQ ID NO: 5386992 - DNA, 20 bp, Homo sapiens
catacttcctggattttctt

SEQ ID NO: 5386993 - DNA, 13 bp, Homo sapiens
catacttcctggg

SEQ ID NO: 5386994 - DNA, 18 bp, Homo sapiens
catacttcttacttgtct

SEQ ID NO: 5386995 - DNA, 21 bp, Homo sapiens
catacttgaacgttttctaat

SEQ ID NO: 5386996 - DNA, 20 bp, Homo sapiens
catacttgaagggccagagc

SEQ ID NO: 5386997 - DNA, 21 bp, Homo sapiens
catacttgaagggccagagcc

SEQ ID NO: 5386998 - DNA, 14 bp, Homo sapiens
catacttggctgct

SEQ ID NO: 5386999 - DNA, 13 bp, Homo sapiens
catacttgttctg

SEQ ID NO: 5387000 - DNA, 12 bp, Homo sapiens
catactttatca

SEQ ID NO: 5387001 - DNA, 17 bp, Homo sapiens
catactttcatcctgac

SEQ ID NO: 5387002 - DNA, 21 bp, Homo sapiens
catactttccaacattatcct

SEQ ID NO: 5387003 - DNA, 19 bp, Homo sapiens
catactttgacaaggaaaa

SEQ ID NO: 5387004 - DNA, 14 bp, Homo sapiens
catactttggctgt

SEQ ID NO: 5387005 - DNA, 14 bp, Homo sapiens
catactttgtaaat

SEQ ID NO: 5387006 - DNA, 13 bp, Homo sapiens
catactttgtctg

SEQ ID NO: 5387007 - DNA, 11 bp, Homo sapiens
catacttttaa

SEQ ID NO: 5387008 - DNA, 13 bp, Homo sapiens
catacttttgcaa

SEQ ID NO: 5387009 - DNA, 18 bp, Homo sapiens
catatatatatacacata

SEQ ID NO: 5387010 - DNA, 19 bp, Homo sapiens
catatatatatacacatac

SEQ ID NO: 5387011 - DNA, 13 bp, Homo sapiens
catatatatatgt

SEQ ID NO: 5387012 - DNA, 20 bp, Homo sapiens
catatatatatttgtaacat

SEQ ID NO: 5387013 - DNA, 14 bp, Homo sapiens
catatatatgtata

SEQ ID NO: 5387014 - DNA, 16 bp, Homo sapiens
catatatatgtatatt

SEQ ID NO: 5387015 - DNA, 12 bp, Homo sapiens
catatatattac

SEQ ID NO: 5387016 - DNA, 20 bp, Homo sapiens
catatatccttttcttctat

SEQ ID NO: 5387017 - DNA, 22 bp, Homo sapiens
catatatccttttcttctatgt

SEQ ID NO: 5387018 - DNA, 21 bp, Homo sapiens
catatatctatatgtctataa

SEQ ID NO: 5387019 - DNA, 16 bp, Homo sapiens
catatatgcttccaga

SEQ ID NO: 5387020 - DNA, 17 bp, Homo sapiens
catatatgcttccagaa

SEQ ID NO: 5387021 - DNA, 22 bp, Homo sapiens
catatatgctttgcagagaact

SEQ ID NO: 5387022 - DNA, 17 bp, Homo sapiens
catatatgcttttttgc

SEQ ID NO: 5387023 - DNA, 21 bp, Homo sapiens
catatatggggggccaacacc

SEQ ID NO: 5387024 - DNA, 22 bp, Homo sapiens
catatatggggggccaacacca

SEQ ID NO: 5387025 - DNA, 16 bp, Homo sapiens
catatatgtataatat

SEQ ID NO: 5387026 - DNA, 23 bp, Homo sapiens
catatatgtataatatatatcta

SEQ ID NO: 5387027 - DNA, 23 bp, Homo sapiens
catatatgtatacgcacgcaccc

SEQ ID NO: 5387028 - DNA, 14 bp, Homo sapiens
catatatgtatatg

SEQ ID NO: 5387029 - DNA, 18 bp, Homo sapiens
catatatgtatatgtata

SEQ ID NO: 5387030 - DNA, 20 bp, Homo sapiens
catatatgtatatgtatatc

SEQ ID NO: 5387031 - DNA, 13 bp, Homo sapiens
catatatgttctt

SEQ ID NO: 5387032 - DNA, 14 bp, Homo sapiens
catatatgttcttc

SEQ ID NO: 5387033 - DNA, 19 bp, Homo sapiens
catatattaattagcaggt

SEQ ID NO: 5387034 - DNA, 13 bp, Homo sapiens
catatattatata

SEQ ID NO: 5387035 - DNA, 17 bp, Homo sapiens
catatattatatataga

SEQ ID NO: 5387036 - DNA, 21 bp, Homo sapiens
catatattatatatagaaaag

SEQ ID NO: 5387037 - DNA, 21 bp, Homo sapiens
catatattcatgtaataaatc

SEQ ID NO: 5387038 - DNA, 13 bp, Homo sapiens
catatattgcatt

SEQ ID NO: 5387039 - DNA, 15 bp, Homo sapiens
catatattgcatttc

SEQ ID NO: 5387040 - DNA, 21 bp, Homo sapiens
catatattgttatttttgtct

SEQ ID NO: 5387041 - DNA, 14 bp, Homo sapiens
catatatttaactt

SEQ ID NO: 5387042 - DNA, 12 bp, Homo sapiens
catatatttatt

SEQ ID NO: 5387043 - DNA, 13 bp, Homo sapiens
catatatttattg

SEQ ID NO: 5387044 - DNA, 21 bp, Homo sapiens
catatatttggagtttttctg

SEQ ID NO: 5387045 - DNA, 22 bp, Homo sapiens
catatatttggagtttttctga

SEQ ID NO: 5387046 - DNA, 23 bp, Homo sapiens
catatatttgtttcatttctgca

SEQ ID NO: 5387047 - DNA, 22 bp, Homo sapiens
catatatttttatatttactaa

SEQ ID NO: 5387048 - DNA, 17 bp, Homo sapiens
catatattttttagaaa

SEQ ID NO: 5387049 - DNA, 17 bp, Homo sapiens
catatcaaatgaaacag

SEQ ID NO: 5387050 - DNA, 21 bp, Homo sapiens
catatcaattggcagtgactt

SEQ ID NO: 5387051 - DNA, 23 bp, Homo sapiens
catatcaattggcagtgactttg

SEQ ID NO: 5387052 - DNA, 16 bp, Homo sapiens
catatcacatgtcagc

SEQ ID NO: 5387053 - DNA, 17 bp, Homo sapiens
catatcacccttccctg

SEQ ID NO: 5387054 - DNA, 18 bp, Homo sapiens
catatcacccttccctgc

SEQ ID NO: 5387055 - DNA, 20 bp, Homo sapiens
catatcactgaaggatattt

SEQ ID NO: 5387056 - DNA, 23 bp, Homo sapiens
catatcactgaaggatattttca

SEQ ID NO: 5387057 - DNA, 12 bp, Homo sapiens
catatcagaaaa

SEQ ID NO: 5387058 - DNA, 17 bp, Homo sapiens
catatcagaaaagtaga

SEQ ID NO: 5387059 - DNA, 22 bp, Homo sapiens
catatcagaaaagtagaattat

SEQ ID NO: 5387060 - DNA, 17 bp, Homo sapiens
catatcagaataggaag

SEQ ID NO: 5387061 - DNA, 18 bp, Homo sapiens
catatcagaataggaaga

SEQ ID NO: 5387062 - DNA, 18 bp, Homo sapiens
catatcagacctctgatc

SEQ ID NO: 5387063 - DNA, 16 bp, Homo sapiens
catatcagtctctgag

SEQ ID NO: 5387064 - DNA, 13 bp, Homo sapiens
catatcagtgacc

SEQ ID NO: 5387065 - DNA, 16 bp, Homo sapiens
catatcataggtacaa

SEQ ID NO: 5387066 - DNA, 22 bp, Homo sapiens
catatcatcaatgtgacattta

SEQ ID NO: 5387067 - DNA, 17 bp, Homo sapiens
catatcatccacacatg

SEQ ID NO: 5387068 - DNA, 20 bp, Homo sapiens
catatcatccacacatgaat

SEQ ID NO: 5387069 - DNA, 16 bp, Homo sapiens
catatcatgctaaaat

SEQ ID NO: 5387070 - DNA, 19 bp, Homo sapiens
catatcatggtaatgacag

SEQ ID NO: 5387071 - DNA, 18 bp, Homo sapiens
catatcattaaacaaata

SEQ ID NO: 5387072 - DNA, 19 bp, Homo sapiens
catatcattaaacaaataa

SEQ ID NO: 5387073 - DNA, 20 bp, Homo sapiens
catatcattaaacaaataaa

SEQ ID NO: 5387074 - DNA, 16 bp, Homo sapiens
catatcattcagaatg

SEQ ID NO: 5387075 - DNA, 16 bp, Homo sapiens
catatcatttcactgt

SEQ ID NO: 5387076 - DNA, 16 bp, Homo sapiens
catatcatttgtgaag

SEQ ID NO: 5387077 - DNA, 18 bp, Homo sapiens
catatcatttgtgaagaa

SEQ ID NO: 5387078 - DNA, 19 bp, Homo sapiens
catatcatttgtgaagaat

SEQ ID NO: 5387079 - DNA, 17 bp, Homo sapiens
catatccaaaataatga

SEQ ID NO: 5387080 - DNA, 17 bp, Homo sapiens
catatccaagtaccaat

SEQ ID NO: 5387081 - DNA, 16 bp, Homo sapiens
catatccaagtttgaa

SEQ ID NO: 5387082 - DNA, 16 bp, Homo sapiens
catatccaccacctcc

SEQ ID NO: 5387083 - DNA, 12 bp, Homo sapiens
catatcccacca

SEQ ID NO: 5387084 - DNA, 20 bp, Homo sapiens
catatccctcccgtgtgtgg

SEQ ID NO: 5387085 - DNA, 14 bp, Homo sapiens
catatccctgccca

SEQ ID NO: 5387086 - DNA, 15 bp, Homo sapiens
catatccctggttgc

SEQ ID NO: 5387087 - DNA, 14 bp, Homo sapiens
catatcccttccag

SEQ ID NO: 5387088 - DNA, 15 bp, Homo sapiens
catatcccttccaga

SEQ ID NO: 5387089 - DNA, 13 bp, Homo sapiens
catatccctttct

SEQ ID NO: 5387090 - DNA, 16 bp, Homo sapiens
catatccgggtgctca

SEQ ID NO: 5387091 - DNA, 23 bp, Homo sapiens
catatcctccgccctttttgtcc

SEQ ID NO: 5387092 - DNA, 15 bp, Homo sapiens
catatcctgagccat

SEQ ID NO: 5387093 - DNA, 15 bp, Homo sapiens
catatcctgcctcag

SEQ ID NO: 5387094 - DNA, 19 bp, Homo sapiens
catatcctggtgtctagtt

SEQ ID NO: 5387095 - DNA, 20 bp, Homo sapiens
catatcctggtgtctagttt

SEQ ID NO: 5387096 - DNA, 17 bp, Homo sapiens
catatccttctggctgt

SEQ ID NO: 5387097 - DNA, 14 bp, Homo sapiens
catatccttgccct

SEQ ID NO: 5387098 - DNA, 17 bp, Homo sapiens
catatcctttggtcctg

SEQ ID NO: 5387099 - DNA, 21 bp, Homo sapiens
catatccttttagtctgcata

SEQ ID NO: 5387100 - DNA, 17 bp, Homo sapiens
catatcgctgacttcat

SEQ ID NO: 5387101 - DNA, 22 bp, Homo sapiens
catatcgctgacttcatggaat

SEQ ID NO: 5387102 - DNA, 15 bp, Homo sapiens
catatcggaggtggt

SEQ ID NO: 5387103 - DNA, 20 bp, Homo sapiens
catatcggaggtggtggagg

SEQ ID NO: 5387104 - DNA, 15 bp, Homo sapiens
catatctagtatgaa

SEQ ID NO: 5387105 - DNA, 18 bp, Homo sapiens
catatctccatggccctg

SEQ ID NO: 5387106 - DNA, 23 bp, Homo sapiens
catatctccatggccctgtccca

SEQ ID NO: 5387107 - DNA, 18 bp, Homo sapiens
catatctctagtccctgt

SEQ ID NO: 5387108 - DNA, 14 bp, Homo sapiens
catatctctccctt

SEQ ID NO: 5387109 - DNA, 17 bp, Homo sapiens
catatctctcccttctt

SEQ ID NO: 5387110 - DNA, 13 bp, Homo sapiens
catatctctgccg

SEQ ID NO: 5387111 - DNA, 23 bp, Homo sapiens
catatctgatattaaagatttct

SEQ ID NO: 5387112 - DNA, 11 bp, Homo sapiens
catatctgcct

SEQ ID NO: 5387113 - DNA, 15 bp, Homo sapiens
catatctgcctcccc

SEQ ID NO: 5387114 - DNA, 13 bp, Homo sapiens
catatctgccttt

SEQ ID NO: 5387115 - DNA, 20 bp, Homo sapiens
catatctgcctttattgtgt

SEQ ID NO: 5387116 - DNA, 17 bp, Homo sapiens
catatctggtatatgtc

SEQ ID NO: 5387117 - DNA, 21 bp, Homo sapiens
catatctgtgcaatggaatat

SEQ ID NO: 5387118 - DNA, 19 bp, Homo sapiens
catatctgtgtgccctagg

SEQ ID NO: 5387119 - DNA, 21 bp, Homo sapiens
catatctgtgtgccctagggc

SEQ ID NO: 5387120 - DNA, 18 bp, Homo sapiens
catatcttaaagaaacag

SEQ ID NO: 5387121 - DNA, 19 bp, Homo sapiens
catatcttacagccagagg

SEQ ID NO: 5387122 - DNA, 16 bp, Homo sapiens
catatcttcctcatca

SEQ ID NO: 5387123 - DNA, 24 bp, Homo sapiens
catatcttctatatctgaagagta

SEQ ID NO: 5387124 - DNA, 22 bp, Homo sapiens
catatcttgcgaatccaagctc

SEQ ID NO: 5387125 - DNA, 16 bp, Homo sapiens
catatctttattaatc

SEQ ID NO: 5387126 - DNA, 13 bp, Homo sapiens
catatgaaatcct

SEQ ID NO: 5387127 - DNA, 23 bp, Homo sapiens
catatgaacacagacaaagtgct

SEQ ID NO: 5387128 - DNA, 20 bp, Homo sapiens
catatgaattagccaaaaga

SEQ ID NO: 5387129 - DNA, 16 bp, Homo sapiens
catatgaattgtacag

SEQ ID NO: 5387130 - DNA, 14 bp, Homo sapiens
catatgacaaatgt

SEQ ID NO: 5387131 - DNA, 19 bp, Homo sapiens
catatgacaatttcaaaat

SEQ ID NO: 5387132 - DNA, 13 bp, Homo sapiens
catatgacatgcc

SEQ ID NO: 5387133 - DNA, 19 bp, Homo sapiens
catatgacattcatgcctg

SEQ ID NO: 5387134 - DNA, 21 bp, Homo sapiens
catatgacattcatgcctggc

SEQ ID NO: 5387135 - DNA, 17 bp, Homo sapiens
catatgaccattgaaaa

SEQ ID NO: 5387136 - DNA, 22 bp, Homo sapiens
catatgaccattgaaaaaggaa

SEQ ID NO: 5387137 - DNA, 17 bp, Homo sapiens
catatgagaatatacct

SEQ ID NO: 5387138 - DNA, 20 bp, Homo sapiens
catatgagaatataccttat

SEQ ID NO: 5387139 - DNA, 16 bp, Homo sapiens
catatgagcctgccct

SEQ ID NO: 5387140 - DNA, 15 bp, Homo sapiens
catatgagggaaaac

SEQ ID NO: 5387141 - DNA, 19 bp, Homo sapiens
catatgaggggacccagcg

SEQ ID NO: 5387142 - DNA, 23 bp, Homo sapiens
catatgagtatctttaaatataa

SEQ ID NO: 5387143 - DNA, 17 bp, Homo sapiens
catatgagtgtggaagc

SEQ ID NO: 5387144 - DNA, 22 bp, Homo sapiens
catatgataggcagcactgaaa

SEQ ID NO: 5387145 - DNA, 16 bp, Homo sapiens
catatgatcaaatact

SEQ ID NO: 5387146 - DNA, 15 bp, Homo sapiens
catatgatctgtttt

SEQ ID NO: 5387147 - DNA, 15 bp, Homo sapiens
catatgatgtacatg

SEQ ID NO: 5387148 - DNA, 17 bp, Homo sapiens
catatgatgtacatgta

SEQ ID NO: 5387149 - DNA, 15 bp, Homo sapiens
catatgattgaaaag

SEQ ID NO: 5387150 - DNA, 17 bp, Homo sapiens
catatgattgaaaagaa

SEQ ID NO: 5387151 - DNA, 16 bp, Homo sapiens
catatgatttcttgct

SEQ ID NO: 5387152 - DNA, 19 bp, Homo sapiens
catatgcaccttgtgtctg

SEQ ID NO: 5387153 - DNA, 20 bp, Homo sapiens
catatgcagaaatagacaaa

SEQ ID NO: 5387154 - DNA, 14 bp, Homo sapiens
catatgcagatact

SEQ ID NO: 5387155 - DNA, 12 bp, Homo sapiens
catatgcatgcc

SEQ ID NO: 5387156 - DNA, 16 bp, Homo sapiens
catatgcatgccaggc

SEQ ID NO: 5387157 - DNA, 22 bp, Homo sapiens
catatgcatgcccttcctttct

SEQ ID NO: 5387158 - DNA, 20 bp, Homo sapiens
catatgcccacatttagtct

SEQ ID NO: 5387159 - DNA, 13 bp, Homo sapiens
catatgcctgggc

SEQ ID NO: 5387160 - DNA, 16 bp, Homo sapiens
catatgctaccaccag

SEQ ID NO: 5387161 - DNA, 18 bp, Homo sapiens
catatgctaccaccagct

SEQ ID NO: 5387162 - DNA, 19 bp, Homo sapiens
catatgctaccaccagctg

SEQ ID NO: 5387163 - DNA, 20 bp, Homo sapiens
catatgctaccaccagctgt

SEQ ID NO: 5387164 - DNA, 13 bp, Homo sapiens
catatgctatgtt

SEQ ID NO: 5387165 - DNA, 14 bp, Homo sapiens
catatgctccagga

SEQ ID NO: 5387166 - DNA, 14 bp, Homo sapiens
catatgctctgctt

SEQ ID NO: 5387167 - DNA, 15 bp, Homo sapiens
catatgctctgcttt

SEQ ID NO: 5387168 - DNA, 16 bp, Homo sapiens
catatgctgacagctc

SEQ ID NO: 5387169 - DNA, 23 bp, Homo sapiens
catatgctgatcttttaaaatca

SEQ ID NO: 5387170 - DNA, 18 bp, Homo sapiens
catatggaaaaaatgtat

SEQ ID NO: 5387171 - DNA, 18 bp, Homo sapiens
catatggactctgcacat

SEQ ID NO: 5387172 - DNA, 20 bp, Homo sapiens
catatggactctgcacatga

SEQ ID NO: 5387173 - DNA, 18 bp, Homo sapiens
catatggagcatttttca

SEQ ID NO: 5387174 - DNA, 19 bp, Homo sapiens
catatggagcatttttcag

SEQ ID NO: 5387175 - DNA, 20 bp, Homo sapiens
catatggagcatttttcaga

SEQ ID NO: 5387176 - DNA, 21 bp, Homo sapiens
catatggagcatttttcagag

SEQ ID NO: 5387177 - DNA, 18 bp, Homo sapiens
catatggagctcatgtca

SEQ ID NO: 5387178 - DNA, 19 bp, Homo sapiens
catatggagctcatgtcag

SEQ ID NO: 5387179 - DNA, 17 bp, Homo sapiens
catatggatccactggc

SEQ ID NO: 5387180 - DNA, 23 bp, Homo sapiens
catatggcaacgttcatgttcat

SEQ ID NO: 5387181 - DNA, 21 bp, Homo sapiens
catatgggatattcccaagcc

SEQ ID NO: 5387182 - DNA, 22 bp, Homo sapiens
catatgggtgggattttgcaaa

SEQ ID NO: 5387183 - DNA, 16 bp, Homo sapiens
catatgggtttgaact

SEQ ID NO: 5387184 - DNA, 23 bp, Homo sapiens
catatggtagacaatttgcctta

SEQ ID NO: 5387185 - DNA, 14 bp, Homo sapiens
catcactcagcccc

SEQ ID NO: 5387186 - DNA, 15 bp, Homo sapiens
catcactcagcccct

SEQ ID NO: 5387187 - DNA, 16 bp, Homo sapiens
catcactcagccccta

SEQ ID NO: 5387188 - DNA, 23 bp, Homo sapiens
catcactcagcccctacccctgc

SEQ ID NO: 5387189 - DNA, 14 bp, Homo sapiens
catcactcccctcc

SEQ ID NO: 5387190 - DNA, 15 bp, Homo sapiens
catcactcccctcca

SEQ ID NO: 5387191 - DNA, 15 bp, Homo sapiens
catcactccctctcc

SEQ ID NO: 5387192 - DNA, 15 bp, Homo sapiens
catcactccctggat

SEQ ID NO: 5387193 - DNA, 17 bp, Homo sapiens
catcactccctggatgt

SEQ ID NO: 5387194 - DNA, 16 bp, Homo sapiens
catcactcgcaggacc

SEQ ID NO: 5387195 - DNA, 22 bp, Homo sapiens
catcactgagaagatggcactg

SEQ ID NO: 5387196 - DNA, 21 bp, Homo sapiens
catcactgattccctctccca

SEQ ID NO: 5387197 - DNA, 12 bp, Homo sapiens
catcactgcctt

SEQ ID NO: 5387198 - DNA, 16 bp, Homo sapiens
catcactgccttggcc

SEQ ID NO: 5387199 - DNA, 16 bp, Homo sapiens
catcactgcgccactg

SEQ ID NO: 5387200 - DNA, 18 bp, Homo sapiens
catcactgcgccactgct

SEQ ID NO: 5387201 - DNA, 15 bp, Homo sapiens
catcactgctgtccc

SEQ ID NO: 5387202 - DNA, 19 bp, Homo sapiens
catcactgctgtccctcct

SEQ ID NO: 5387203 - DNA, 20 bp, Homo sapiens
catcactgcttgatgaagca

SEQ ID NO: 5387204 - DNA, 19 bp, Homo sapiens
catcactggactgcatggg

SEQ ID NO: 5387205 - DNA, 21 bp, Homo sapiens
catcactggggaggacgtgat

SEQ ID NO: 5387206 - DNA, 22 bp, Homo sapiens
catcactggggtcacttgggaa

SEQ ID NO: 5387207 - DNA, 19 bp, Homo sapiens
catcactgtatccattcta

SEQ ID NO: 5387208 - DNA, 12 bp, Homo sapiens
catcactgtggc

SEQ ID NO: 5387209 - DNA, 13 bp, Homo sapiens
catcactgtgtct

SEQ ID NO: 5387210 - DNA, 16 bp, Homo sapiens
catcactgtgtctcat

SEQ ID NO: 5387211 - DNA, 14 bp, Homo sapiens
catcactgttcatg

SEQ ID NO: 5387212 - DNA, 20 bp, Homo sapiens
catcactgttcatgctggcg

SEQ ID NO: 5387213 - DNA, 13 bp, Homo sapiens
catcacttaaaac

SEQ ID NO: 5387214 - DNA, 15 bp, Homo sapiens
catcacttaaaacac

SEQ ID NO: 5387215 - DNA, 22 bp, Homo sapiens
catcacttaacggaccaaagca

SEQ ID NO: 5387216 - DNA, 23 bp, Homo sapiens
catcacttactatccatttcttc

SEQ ID NO: 5387217 - DNA, 12 bp, Homo sapiens
catcacttccct

SEQ ID NO: 5387218 - DNA, 14 bp, Homo sapiens
catcacttggggtc

SEQ ID NO: 5387219 - DNA, 14 bp, Homo sapiens
catcactttgtgaa

SEQ ID NO: 5387220 - DNA, 15 bp, Homo sapiens
catcactttgtgaat

SEQ ID NO: 5387221 - DNA, 17 bp, Homo sapiens
catcactttgtgaatta

SEQ ID NO: 5387222 - DNA, 15 bp, Homo sapiens
catcacttttcagtg

SEQ ID NO: 5387223 - DNA, 16 bp, Homo sapiens
catcagaaaataaaat

SEQ ID NO: 5387224 - DNA, 23 bp, Homo sapiens
catcagaaagaattgatcagaat

SEQ ID NO: 5387225 - DNA, 18 bp, Homo sapiens
catcagaaaggaaaaaca

SEQ ID NO: 5387226 - DNA, 20 bp, Homo sapiens
catcagaaagggagggctct

SEQ ID NO: 5387227 - DNA, 19 bp, Homo sapiens
catcagaaataataaaaaa

SEQ ID NO: 5387228 - DNA, 13 bp, Homo sapiens
catcagaaatttt

SEQ ID NO: 5387229 - DNA, 15 bp, Homo sapiens
catcagaaattttct

SEQ ID NO: 5387230 - DNA, 12 bp, Homo sapiens
catcagaacagc

SEQ ID NO: 5387231 - DNA, 16 bp, Homo sapiens
catcagaacctgagct

SEQ ID NO: 5387232 - DNA, 17 bp, Homo sapiens
catcagaacctgagcta

SEQ ID NO: 5387233 - DNA, 19 bp, Homo sapiens
catcagaactcttcctcct

SEQ ID NO: 5387234 - DNA, 13 bp, Homo sapiens
catcagaagataa

SEQ ID NO: 5387235 - DNA, 23 bp, Homo sapiens
catcagaaggagaaggaaggaga

SEQ ID NO: 5387236 - DNA, 18 bp, Homo sapiens
catcagaagtaactccca

SEQ ID NO: 5387237 - DNA, 19 bp, Homo sapiens
catcagaagtaactcccac

SEQ ID NO: 5387238 - DNA, 22 bp, Homo sapiens
catcagaagtaactcccactcc

SEQ ID NO: 5387239 - DNA, 16 bp, Homo sapiens
catcagaatgttaatt

SEQ ID NO: 5387240 - DNA, 19 bp, Homo sapiens
catcagacctgtcttccaa

SEQ ID NO: 5387241 - DNA, 23 bp, Homo sapiens
catcagacctgtcttccaaggag

SEQ ID NO: 5387242 - DNA, 19 bp, Homo sapiens
catcagacttgcggccaca

SEQ ID NO: 5387243 - DNA, 21 bp, Homo sapiens
catcagagagtgtacatcatg

SEQ ID NO: 5387244 - DNA, 14 bp, Homo sapiens
catcagagcagcta

SEQ ID NO: 5387245 - DNA, 21 bp, Homo sapiens
catcagagcccttttgctata

SEQ ID NO: 5387246 - DNA, 20 bp, Homo sapiens
catcagaggcctagtcagcc

SEQ ID NO: 5387247 - DNA, 18 bp, Homo sapiens
catcagaggtttgcttcc

SEQ ID NO: 5387248 - DNA, 21 bp, Homo sapiens
catcagaggtttgcttcctca

SEQ ID NO: 5387249 - DNA, 20 bp, Homo sapiens
catcagagtgtatttttgta

SEQ ID NO: 5387250 - DNA, 21 bp, Homo sapiens
catcagagtgtatttttgtaa

SEQ ID NO: 5387251 - DNA, 22 bp, Homo sapiens
catcagagtgtatttttgtaat

SEQ ID NO: 5387252 - DNA, 17 bp, Homo sapiens
catcagataacaactgt

SEQ ID NO: 5387253 - DNA, 15 bp, Homo sapiens
catcagatgcctgct

SEQ ID NO: 5387254 - DNA, 16 bp, Homo sapiens
catcagatgtgttcct

SEQ ID NO: 5387255 - DNA, 12 bp, Homo sapiens
catcagatttct

SEQ ID NO: 5387256 - DNA, 22 bp, Homo sapiens
catcagatttcttaatgtctgt

SEQ ID NO: 5387257 - DNA, 11 bp, Homo sapiens
catcagcaaac

SEQ ID NO: 5387258 - DNA, 13 bp, Homo sapiens
catcagcaccatg

SEQ ID NO: 5387259 - DNA, 15 bp, Homo sapiens
catcagcaccccagt

SEQ ID NO: 5387260 - DNA, 17 bp, Homo sapiens
catcagcacgatttctg

SEQ ID NO: 5387261 - DNA, 18 bp, Homo sapiens
catcagcacgatttctgt

SEQ ID NO: 5387262 - DNA, 15 bp, Homo sapiens
catcagcagcagggt

SEQ ID NO: 5387263 - DNA, 13 bp, Homo sapiens
catcagcagcttg

SEQ ID NO: 5387264 - DNA, 14 bp, Homo sapiens
catcagcatcccac

SEQ ID NO: 5387265 - DNA, 23 bp, Homo sapiens
catcagcattgtctcgtgtacag

SEQ ID NO: 5387266 - DNA, 23 bp, Homo sapiens
catcagccagctaccccttgtgg

SEQ ID NO: 5387267 - DNA, 20 bp, Homo sapiens
catcagcccaatccctgatc

SEQ ID NO: 5387268 - DNA, 23 bp, Homo sapiens
catcagcccaggtcccagtgcca

SEQ ID NO: 5387269 - DNA, 21 bp, Homo sapiens
catcagcccctgctgctcctc

SEQ ID NO: 5387270 - DNA, 11 bp, Homo sapiens
catcagccctg

SEQ ID NO: 5387271 - DNA, 13 bp, Homo sapiens
catcagccctgct

SEQ ID NO: 5387272 - DNA, 15 bp, Homo sapiens
catcagccctgctag

SEQ ID NO: 5387273 - DNA, 12 bp, Homo sapiens
catcagcctgct

SEQ ID NO: 5387274 - DNA, 15 bp, Homo sapiens
catcagcctgcttct

SEQ ID NO: 5387275 - DNA, 20 bp, Homo sapiens
catcagcctgttccagaagg

SEQ ID NO: 5387276 - DNA, 19 bp, Homo sapiens
catcagcggcgcgccctgc

SEQ ID NO: 5387277 - DNA, 17 bp, Homo sapiens
catcagcgggtctcctc

SEQ ID NO: 5387278 - DNA, 15 bp, Homo sapiens
catcagcgtagtgtt

SEQ ID NO: 5387279 - DNA, 16 bp, Homo sapiens
catcagcgtagtgttt

SEQ ID NO: 5387280 - DNA, 17 bp, Homo sapiens
catcagctagcaaaaga

SEQ ID NO: 5387281 - DNA, 16 bp, Homo sapiens
catcagctattcagtt

SEQ ID NO: 5387282 - DNA, 15 bp, Homo sapiens
catcagctcaaaatt

SEQ ID NO: 5387283 - DNA, 11 bp, Homo sapiens
catcagctccc

SEQ ID NO: 5387284 - DNA, 14 bp, Homo sapiens
catcagctcccttt

SEQ ID NO: 5387285 - DNA, 12 bp, Homo sapiens
catcagctctgc

SEQ ID NO: 5387286 - DNA, 15 bp, Homo sapiens
catcagctgctcaga

SEQ ID NO: 5387287 - DNA, 13 bp, Homo sapiens
catcagctgctga

SEQ ID NO: 5387288 - DNA, 15 bp, Homo sapiens
catcagctgctgaaa

SEQ ID NO: 5387289 - DNA, 22 bp, Homo sapiens
catcagctgtctgtcatctgct

SEQ ID NO: 5387290 - DNA, 20 bp, Homo sapiens
catcagcttgccctgttaaa

SEQ ID NO: 5387291 - DNA, 13 bp, Homo sapiens
catcagctttata

SEQ ID NO: 5387292 - DNA, 17 bp, Homo sapiens
catcagctttccctggc

SEQ ID NO: 5387293 - DNA, 19 bp, Homo sapiens
catcagctttccctggctc

SEQ ID NO: 5387294 - DNA, 20 bp, Homo sapiens
catcagctttccctggctca

SEQ ID NO: 5387295 - DNA, 21 bp, Homo sapiens
catcagctttccctggctcag

SEQ ID NO: 5387296 - DNA, 23 bp, Homo sapiens
catcagctttccctggctcaggg

SEQ ID NO: 5387297 - DNA, 15 bp, Homo sapiens
catcagctttttgta

SEQ ID NO: 5387298 - DNA, 19 bp, Homo sapiens
catcaggaaggaaatgaca

SEQ ID NO: 5387299 - DNA, 14 bp, Homo sapiens
catcaggaccctgg

SEQ ID NO: 5387300 - DNA, 13 bp, Homo sapiens
catcaggactctt

SEQ ID NO: 5387301 - DNA, 15 bp, Homo sapiens
catcaggacttggga

SEQ ID NO: 5387302 - DNA, 17 bp, Homo sapiens
catcaggactttccctg

SEQ ID NO: 5387303 - DNA, 19 bp, Homo sapiens
catcaggagaaaaagcctc

SEQ ID NO: 5387304 - DNA, 21 bp, Homo sapiens
catcaggagactgggctctgg

SEQ ID NO: 5387305 - DNA, 16 bp, Homo sapiens
catcaggagctgctca

SEQ ID NO: 5387306 - DNA, 17 bp, Homo sapiens
catcaggagctgctcag

SEQ ID NO: 5387307 - DNA, 17 bp, Homo sapiens
catcaggatgaacccag

SEQ ID NO: 5387308 - DNA, 11 bp, Homo sapiens
catcaggcact

SEQ ID NO: 5387309 - DNA, 22 bp, Homo sapiens
catcaggcactgcgccacctgc

SEQ ID NO: 5387310 - DNA, 17 bp, Homo sapiens
catcaggcactggtggc

SEQ ID NO: 5387311 - DNA, 15 bp, Homo sapiens
catcaggcagtgtta

SEQ ID NO: 5387312 - DNA, 20 bp, Homo sapiens
catcaggctaagaccctgtg

SEQ ID NO: 5387313 - DNA, 21 bp, Homo sapiens
catcaggctaagaccctgtgt

SEQ ID NO: 5387314 - DNA, 16 bp, Homo sapiens
catcaggctctgttcc

SEQ ID NO: 5387315 - DNA, 14 bp, Homo sapiens
catcagggacagga

SEQ ID NO: 5387316 - DNA, 18 bp, Homo sapiens
catcagggatctcagagg

SEQ ID NO: 5387317 - DNA, 13 bp, Homo sapiens
catcagggccctg

SEQ ID NO: 5387318 - DNA, 14 bp, Homo sapiens
catcagggccctgc

SEQ ID NO: 5387319 - DNA, 23 bp, Homo sapiens
catcagggccctgccccaggcct

SEQ ID NO: 5387320 - DNA, 18 bp, Homo sapiens
catcagggcctttctcct

SEQ ID NO: 5387321 - DNA, 12 bp, Homo sapiens
catcagggggaa

SEQ ID NO: 5387322 - DNA, 14 bp, Homo sapiens
catcagggggaaga

SEQ ID NO: 5387323 - DNA, 19 bp, Homo sapiens
catcagggggaagaagcag

SEQ ID NO: 5387324 - DNA, 22 bp, Homo sapiens
catcagggtagcagcagaggca

SEQ ID NO: 5387325 - DNA, 22 bp, Homo sapiens
catcagggtgggccactctccc

SEQ ID NO: 5387326 - DNA, 23 bp, Homo sapiens
catcagggtgggccactctcccc

SEQ ID NO: 5387327 - DNA, 18 bp, Homo sapiens
catcaggtcccccccagg

SEQ ID NO: 5387328 - DNA, 17 bp, Homo sapiens
catcaggtctgggcaag

SEQ ID NO: 5387329 - DNA, 19 bp, Homo sapiens
catcaggtgatccacctgc

SEQ ID NO: 5387330 - DNA, 20 bp, Homo sapiens
catcaggtgatccacctgcc

SEQ ID NO: 5387331 - DNA, 15 bp, Homo sapiens
catcagtacttgttt

SEQ ID NO: 5387332 - DNA, 20 bp, Homo sapiens
catcagtagctgagtgcact

SEQ ID NO: 5387333 - DNA, 20 bp, Homo sapiens
catcagtattaatactaaaa

SEQ ID NO: 5387334 - DNA, 15 bp, Homo sapiens
catcagtattctgcc

SEQ ID NO: 5387335 - DNA, 16 bp, Homo sapiens
catcagtattgaagca

SEQ ID NO: 5387336 - DNA, 13 bp, Homo sapiens
catcagtcaattg

SEQ ID NO: 5387337 - DNA, 13 bp, Homo sapiens
catcagtccccct

SEQ ID NO: 5387338 - DNA, 19 bp, Homo sapiens
catcagtccccctgtgcat

SEQ ID NO: 5387339 - DNA, 15 bp, Homo sapiens
catcagtccctatgt

SEQ ID NO: 5387340 - DNA, 19 bp, Homo sapiens
catcagtgaggagggatgt

SEQ ID NO: 5387341 - DNA, 19 bp, Homo sapiens
catcagtgtcattttctgt

SEQ ID NO: 5387342 - DNA, 16 bp, Homo sapiens
catcagtgtttgttgg

SEQ ID NO: 5387343 - DNA, 18 bp, Homo sapiens
catcagttagagctgaca

SEQ ID NO: 5387344 - DNA, 18 bp, Homo sapiens
catcagttcccccagtac

SEQ ID NO: 5387345 - DNA, 23 bp, Homo sapiens
catcagttcctttgatctcgctg

SEQ ID NO: 5387346 - DNA, 14 bp, Homo sapiens
catcagtttgttcc

SEQ ID NO: 5387347 - DNA, 21 bp, Homo sapiens
catcagtttgttccttttgta

SEQ ID NO: 5387348 - DNA, 14 bp, Homo sapiens
catcataaaataaa

SEQ ID NO: 5387349 - DNA, 23 bp, Homo sapiens
catcataaaataaagtatatata

SEQ ID NO: 5387350 - DNA, 16 bp, Homo sapiens
catcataaaattttta

SEQ ID NO: 5387351 - DNA, 12 bp, Homo sapiens
catcataaccat

SEQ ID NO: 5387352 - DNA, 21 bp, Homo sapiens
catcataagatagttacattt

SEQ ID NO: 5387353 - DNA, 22 bp, Homo sapiens
catcataagatagttacattta

SEQ ID NO: 5387354 - DNA, 15 bp, Homo sapiens
catcataattacatt

SEQ ID NO: 5387355 - DNA, 16 bp, Homo sapiens
catcatacttaacttt

SEQ ID NO: 5387356 - DNA, 16 bp, Homo sapiens
catcatagaaggagag

SEQ ID NO: 5387357 - DNA, 17 bp, Homo sapiens
catcatagaaggagagc

SEQ ID NO: 5387358 - DNA, 14 bp, Homo sapiens
catcataggtaagg

SEQ ID NO: 5387359 - DNA, 16 bp, Homo sapiens
catcatatacctcttg

SEQ ID NO: 5387360 - DNA, 18 bp, Homo sapiens
catcatatgcctgacccc

SEQ ID NO: 5387361 - DNA, 17 bp, Homo sapiens
catcatattaaaaatat

SEQ ID NO: 5387362 - DNA, 16 bp, Homo sapiens
catcatattatacaga

SEQ ID NO: 5387363 - DNA, 12 bp, Homo sapiens
catcatattgta

SEQ ID NO: 5387364 - DNA, 18 bp, Homo sapiens
catcccgtttccctccag

SEQ ID NO: 5387365 - DNA, 19 bp, Homo sapiens
catcccgtttccctccagg

SEQ ID NO: 5387366 - DNA, 16 bp, Homo sapiens
catccctaagaattcc

SEQ ID NO: 5387367 - DNA, 17 bp, Homo sapiens
catccctaagaattccc

SEQ ID NO: 5387368 - DNA, 16 bp, Homo sapiens
catccctaccactgtg

SEQ ID NO: 5387369 - DNA, 14 bp, Homo sapiens
catccctaccccct

SEQ ID NO: 5387370 - DNA, 19 bp, Homo sapiens
catccctaccgacccaggg

SEQ ID NO: 5387371 - DNA, 23 bp, Homo sapiens
catccctaccgacccagggttcc

SEQ ID NO: 5387372 - DNA, 20 bp, Homo sapiens
catccctagaagagcacaga

SEQ ID NO: 5387373 - DNA, 20 bp, Homo sapiens
catccctatagaccactggg

SEQ ID NO: 5387374 - DNA, 16 bp, Homo sapiens
catccctatttatagt

SEQ ID NO: 5387375 - DNA, 13 bp, Homo sapiens
catccctcaccca

SEQ ID NO: 5387376 - DNA, 23 bp, Homo sapiens
catccctcagtttcttaaaatgt

SEQ ID NO: 5387377 - DNA, 13 bp, Homo sapiens
catccctccccag

SEQ ID NO: 5387378 - DNA, 15 bp, Homo sapiens
catccctccctgcct

SEQ ID NO: 5387379 - DNA, 18 bp, Homo sapiens
catccctccctgcctaag

SEQ ID NO: 5387380 - DNA, 14 bp, Homo sapiens
catccctcctgctt

SEQ ID NO: 5387381 - DNA, 16 bp, Homo sapiens
catccctcctggtacc

SEQ ID NO: 5387382 - DNA, 14 bp, Homo sapiens
catccctccttaag

SEQ ID NO: 5387383 - DNA, 16 bp, Homo sapiens
catccctccttaagag

SEQ ID NO: 5387384 - DNA, 19 bp, Homo sapiens
catccctcgggaagcagcc

SEQ ID NO: 5387385 - DNA, 20 bp, Homo sapiens
catccctcgggaagcagcca

SEQ ID NO: 5387386 - DNA, 22 bp, Homo sapiens
catccctcgggaagcagccagc

SEQ ID NO: 5387387 - DNA, 11 bp, Homo sapiens
catccctctcc

SEQ ID NO: 5387388 - DNA, 15 bp, Homo sapiens
catccctctcctctg

SEQ ID NO: 5387389 - DNA, 18 bp, Homo sapiens
catccctctcctctgccc

SEQ ID NO: 5387390 - DNA, 21 bp, Homo sapiens
catccctgaaggccccgccca

SEQ ID NO: 5387391 - DNA, 20 bp, Homo sapiens
catccctgactggccaaacc

SEQ ID NO: 5387392 - DNA, 21 bp, Homo sapiens
catccctgactggccaaaccc

SEQ ID NO: 5387393 - DNA, 19 bp, Homo sapiens
catccctgatggcagaact

SEQ ID NO: 5387394 - DNA, 14 bp, Homo sapiens
catccctgccacat

SEQ ID NO: 5387395 - DNA, 18 bp, Homo sapiens
catccctgccacatacag

SEQ ID NO: 5387396 - DNA, 15 bp, Homo sapiens
catccctgccagctc

SEQ ID NO: 5387397 - DNA, 13 bp, Homo sapiens
catccctgcctgg

SEQ ID NO: 5387398 - DNA, 17 bp, Homo sapiens
catccctgcctggaggc

SEQ ID NO: 5387399 - DNA, 13 bp, Homo sapiens
catccctgctctg

SEQ ID NO: 5387400 - DNA, 14 bp, Homo sapiens
catccctgctctgg

SEQ ID NO: 5387401 - DNA, 15 bp, Homo sapiens
catccctgctctggt

SEQ ID NO: 5387402 - DNA, 16 bp, Homo sapiens
catccctgcttctggc

SEQ ID NO: 5387403 - DNA, 15 bp, Homo sapiens
catccctggaaggtg

SEQ ID NO: 5387404 - DNA, 18 bp, Homo sapiens
catccctggacttctggg

SEQ ID NO: 5387405 - DNA, 18 bp, Homo sapiens
catccctggagcaggagc

SEQ ID NO: 5387406 - DNA, 21 bp, Homo sapiens
catccctggccccctccctgg

SEQ ID NO: 5387407 - DNA, 22 bp, Homo sapiens
catccctggccccctccctgga

SEQ ID NO: 5387408 - DNA, 23 bp, Homo sapiens
catccctggccccctccctggat

SEQ ID NO: 5387409 - DNA, 21 bp, Homo sapiens
catccctggctgacctgctgt

SEQ ID NO: 5387410 - DNA, 22 bp, Homo sapiens
catccctggctgacctgctgtg

SEQ ID NO: 5387411 - DNA, 15 bp, Homo sapiens
catccctgggcaagt

SEQ ID NO: 5387412 - DNA, 17 bp, Homo sapiens
catccctgggcccctcc

SEQ ID NO: 5387413 - DNA, 22 bp, Homo sapiens
catccctgggcccctccacgcc

SEQ ID NO: 5387414 - DNA, 24 bp, Homo sapiens
catccctgggcccctccacgcctc

SEQ ID NO: 5387415 - DNA, 14 bp, Homo sapiens
catccctgggcctg

SEQ ID NO: 5387416 - DNA, 17 bp, Homo sapiens
catccctgggcctgctg

SEQ ID NO: 5387417 - DNA, 17 bp, Homo sapiens
catccctgggccttggg

SEQ ID NO: 5387418 - DNA, 23 bp, Homo sapiens
catccctggtgaaagagtaaaac

SEQ ID NO: 5387419 - DNA, 13 bp, Homo sapiens
catccctgtcatt

SEQ ID NO: 5387420 - DNA, 12 bp, Homo sapiens
catccctgtcct

SEQ ID NO: 5387421 - DNA, 13 bp, Homo sapiens
catccctgtgagc

SEQ ID NO: 5387422 - DNA, 19 bp, Homo sapiens
catccctgtgtccactgag

SEQ ID NO: 5387423 - DNA, 18 bp, Homo sapiens
catcccttcaaccccact

SEQ ID NO: 5387424 - DNA, 19 bp, Homo sapiens
catcccttcctccccagtc

SEQ ID NO: 5387425 - DNA, 14 bp, Homo sapiens
catcccttcctcct

SEQ ID NO: 5387426 - DNA, 21 bp, Homo sapiens
catcccttcctcctctcctgg

SEQ ID NO: 5387427 - DNA, 19 bp, Homo sapiens
catcccttcctggaaacag

SEQ ID NO: 5387428 - DNA, 16 bp, Homo sapiens
catcccttctcttcca

SEQ ID NO: 5387429 - DNA, 23 bp, Homo sapiens
catcccttgaccaggcctgggcc

SEQ ID NO: 5387430 - DNA, 15 bp, Homo sapiens
catcccttggcccct

SEQ ID NO: 5387431 - DNA, 20 bp, Homo sapiens
catcccttggcccctctctg

SEQ ID NO: 5387432 - DNA, 16 bp, Homo sapiens
catccctttctcccag

SEQ ID NO: 5387433 - DNA, 21 bp, Homo sapiens
catccctttctcccagtgaaa

SEQ ID NO: 5387434 - DNA, 19 bp, Homo sapiens
catccctttgaaacaagat

SEQ ID NO: 5387435 - DNA, 12 bp, Homo sapiens
catccctttggt

SEQ ID NO: 5387436 - DNA, 13 bp, Homo sapiens
catccctttggtt

SEQ ID NO: 5387437 - DNA, 15 bp, Homo sapiens
catcccttttcctgt

SEQ ID NO: 5387438 - DNA, 16 bp, Homo sapiens
catcccttttcctgtc

SEQ ID NO: 5387439 - DNA, 15 bp, Homo sapiens
catccctttttcaat

SEQ ID NO: 5387440 - DNA, 13 bp, Homo sapiens
catccctttttga

SEQ ID NO: 5387441 - DNA, 16 bp, Homo sapiens
catccctttttgaagt

SEQ ID NO: 5387442 - DNA, 17 bp, Homo sapiens
catccctttttgaagtg

SEQ ID NO: 5387443 - DNA, 18 bp, Homo sapiens
catccctttttgaagtgt

SEQ ID NO: 5387444 - DNA, 20 bp, Homo sapiens
catccctttttgaagtgtag

SEQ ID NO: 5387445 - DNA, 18 bp, Homo sapiens
catccctttttttacatt

SEQ ID NO: 5387446 - DNA, 14 bp, Homo sapiens
catccgactgcccc

SEQ ID NO: 5387447 - DNA, 15 bp, Homo sapiens
catccgagcccctgt

SEQ ID NO: 5387448 - DNA, 20 bp, Homo sapiens
catccgcaggtgctggtccc

SEQ ID NO: 5387449 - DNA, 15 bp, Homo sapiens
catccgccagggccc

SEQ ID NO: 5387450 - DNA, 17 bp, Homo sapiens
catccgcctctgagcca

SEQ ID NO: 5387451 - DNA, 20 bp, Homo sapiens
catccgcctctgagccagga

SEQ ID NO: 5387452 - DNA, 19 bp, Homo sapiens
catccgccttttgtataca

SEQ ID NO: 5387453 - DNA, 17 bp, Homo sapiens
catccgcgtgtgcctgt

SEQ ID NO: 5387454 - DNA, 19 bp, Homo sapiens
catccggaacagccaaaga

SEQ ID NO: 5387455 - DNA, 15 bp, Homo sapiens
catccggcagcctgg

SEQ ID NO: 5387456 - DNA, 16 bp, Homo sapiens
catccggcccccagag

SEQ ID NO: 5387457 - DNA, 12 bp, Homo sapiens
catccggctcct

SEQ ID NO: 5387458 - DNA, 13 bp, Homo sapiens
catccggctcctg

SEQ ID NO: 5387459 - DNA, 21 bp, Homo sapiens
catccgggacgcttccagacc

SEQ ID NO: 5387460 - DNA, 22 bp, Homo sapiens
catccgggacgcttccagacca

SEQ ID NO: 5387461 - DNA, 18 bp, Homo sapiens
catccggggccagctccg

SEQ ID NO: 5387462 - DNA, 20 bp, Homo sapiens
catccggtcccctgcctgga

SEQ ID NO: 5387463 - DNA, 18 bp, Homo sapiens
catccgtaggacaagttt

SEQ ID NO: 5387464 - DNA, 17 bp, Homo sapiens
catccgtattctttgtg

SEQ ID NO: 5387465 - DNA, 17 bp, Homo sapiens
catccgtcattgctgct

SEQ ID NO: 5387466 - DNA, 14 bp, Homo sapiens
catccgtcctgggc

SEQ ID NO: 5387467 - DNA, 14 bp, Homo sapiens
catccgtctcccct

SEQ ID NO: 5387468 - DNA, 14 bp, Homo sapiens
catccgtctctgtc

SEQ ID NO: 5387469 - DNA, 20 bp, Homo sapiens
catccgtgagcagtgtgtct

SEQ ID NO: 5387470 - DNA, 14 bp, Homo sapiens
catccgttgtgact

SEQ ID NO: 5387471 - DNA, 20 bp, Homo sapiens
catccgtttgccaatcattg

SEQ ID NO: 5387472 - DNA, 19 bp, Homo sapiens
catcctaaggttcttgctt

SEQ ID NO: 5387473 - DNA, 17 bp, Homo sapiens
catcctaatagaaagaa

SEQ ID NO: 5387474 - DNA, 17 bp, Homo sapiens
catcctacaagacacag

SEQ ID NO: 5387475 - DNA, 19 bp, Homo sapiens
catcctacaagacacagtg

SEQ ID NO: 5387476 - DNA, 18 bp, Homo sapiens
catcctaccaatgcatgc

SEQ ID NO: 5387477 - DNA, 19 bp, Homo sapiens
catcctaccaatgcatgca

SEQ ID NO: 5387478 - DNA, 23 bp, Homo sapiens
catcctaccacaatgcagtgcct

SEQ ID NO: 5387479 - DNA, 15 bp, Homo sapiens
catcctaccccctgt

SEQ ID NO: 5387480 - DNA, 13 bp, Homo sapiens
catcctaccctcg

SEQ ID NO: 5387481 - DNA, 15 bp, Homo sapiens
catcctaccgtcttt

SEQ ID NO: 5387482 - DNA, 14 bp, Homo sapiens
catcctactaagaa

SEQ ID NO: 5387483 - DNA, 21 bp, Homo sapiens
catcctagccccacccagagg

SEQ ID NO: 5387484 - DNA, 12 bp, Homo sapiens
catcctaggaac

SEQ ID NO: 5387485 - DNA, 13 bp, Homo sapiens
catcctagtctct

SEQ ID NO: 5387486 - DNA, 16 bp, Homo sapiens
catcctatcagcctgt

SEQ ID NO: 5387487 - DNA, 24 bp, Homo sapiens
catcctatcagcctgtctcttcca

SEQ ID NO: 5387488 - DNA, 17 bp, Homo sapiens
catcctatccactgggc

SEQ ID NO: 5387489 - DNA, 15 bp, Homo sapiens
catcctatgcaatat

SEQ ID NO: 5387490 - DNA, 15 bp, Homo sapiens
catcctatgcttaat

SEQ ID NO: 5387491 - DNA, 14 bp, Homo sapiens
catcctatttggtg

SEQ ID NO: 5387492 - DNA, 16 bp, Homo sapiens
catcctcaaacactgc

SEQ ID NO: 5387493 - DNA, 17 bp, Homo sapiens
catcctcaaacactgca

SEQ ID NO: 5387494 - DNA, 21 bp, Homo sapiens
catcctcaaacgacagaggag

SEQ ID NO: 5387495 - DNA, 20 bp, Homo sapiens
catcctcaaagaaagtgtat

SEQ ID NO: 5387496 - DNA, 13 bp, Homo sapiens
catcctcacccag

SEQ ID NO: 5387497 - DNA, 17 bp, Homo sapiens
catcctcagaagcctcg

SEQ ID NO: 5387498 - DNA, 19 bp, Homo sapiens
catcctcagaggctgagcc

SEQ ID NO: 5387499 - DNA, 21 bp, Homo sapiens
catcctcagaggctgagccct

SEQ ID NO: 5387500 - DNA, 14 bp, Homo sapiens
catcctcagcagca

SEQ ID NO: 5387501 - DNA, 13 bp, Homo sapiens
catcctcagcccc

SEQ ID NO: 5387502 - DNA, 14 bp, Homo sapiens
catcctcagcccca

SEQ ID NO: 5387503 - DNA, 15 bp, Homo sapiens
catcctcagccccag

SEQ ID NO: 5387504 - DNA, 17 bp, Homo sapiens
catcctcagccccaggg

SEQ ID NO: 5387505 - DNA, 20 bp, Homo sapiens
catcctcagccccagggccc

SEQ ID NO: 5387506 - DNA, 18 bp, Homo sapiens
catcctcatacccacccc

SEQ ID NO: 5387507 - DNA, 15 bp, Homo sapiens
catcctcatccctga

SEQ ID NO: 5387508 - DNA, 14 bp, Homo sapiens
catcctcatggccc

SEQ ID NO: 5387509 - DNA, 19 bp, Homo sapiens
catcctcattgcctcctgt

SEQ ID NO: 5387510 - DNA, 11 bp, Homo sapiens
catcctccaga

SEQ ID NO: 5387511 - DNA, 12 bp, Homo sapiens
catcctccagag

SEQ ID NO: 5387512 - DNA, 13 bp, Homo sapiens
catcctccagccc

SEQ ID NO: 5387513 - DNA, 14 bp, Homo sapiens
catcctccagcccc

SEQ ID NO: 5387514 - DNA, 12 bp, Homo sapiens
catcctccagct

SEQ ID NO: 5387515 - DNA, 15 bp, Homo sapiens
catcctccagcttct

SEQ ID NO: 5387516 - DNA, 18 bp, Homo sapiens
catcctccagggggcctg

SEQ ID NO: 5387517 - DNA, 19 bp, Homo sapiens
catcctccagtaccttgct

SEQ ID NO: 5387518 - DNA, 13 bp, Homo sapiens
catcctcccaagg

SEQ ID NO: 5387519 - DNA, 16 bp, Homo sapiens
catcctcccattgccc

SEQ ID NO: 5387520 - DNA, 18 bp, Homo sapiens
catcctcccattgcccag

SEQ ID NO: 5387521 - DNA, 19 bp, Homo sapiens
catcctccccaccagagct

SEQ ID NO: 5387522 - DNA, 22 bp, Homo sapiens
catcctccccagcgccatctgt

SEQ ID NO: 5387523 - DNA, 12 bp, Homo sapiens
catcctcccctt

SEQ ID NO: 5387524 - DNA, 14 bp, Homo sapiens
catcctccccttcc

SEQ ID NO: 5387525 - DNA, 15 bp, Homo sapiens
catcctccccttccc

SEQ ID NO: 5387526 - DNA, 19 bp, Homo sapiens
catcctccccttccctgca

SEQ ID NO: 5387527 - DNA, 21 bp, Homo sapiens
catcctccccttccctgcaaa

SEQ ID NO: 5387528 - DNA, 22 bp, Homo sapiens
catcctcccgccaggagcttct

SEQ ID NO: 5387529 - DNA, 14 bp, Homo sapiens
catcctcccggctc

SEQ ID NO: 5387530 - DNA, 19 bp, Homo sapiens
catcctcccggctccctcc

SEQ ID NO: 5387531 - DNA, 12 bp, Homo sapiens
catcctccctcc

SEQ ID NO: 5387532 - DNA, 20 bp, Homo sapiens
catcctccctccacctcaag

SEQ ID NO: 5387533 - DNA, 21 bp, Homo sapiens
catcctccctccacctcaaga

SEQ ID NO: 5387534 - DNA, 14 bp, Homo sapiens
catcctccctgttc

SEQ ID NO: 5387535 - DNA, 13 bp, Homo sapiens
catcctcccttgc

SEQ ID NO: 5387536 - DNA, 19 bp, Homo sapiens
catcctcccttgccccagg

SEQ ID NO: 5387537 - DNA, 20 bp, Homo sapiens
catcctcccttgccccaggc

SEQ ID NO: 5387538 - DNA, 16 bp, Homo sapiens
catcctccgtccagcc

SEQ ID NO: 5387539 - DNA, 18 bp, Homo sapiens
catcctcctcagatcttc

SEQ ID NO: 5387540 - DNA, 16 bp, Homo sapiens
catcctcctcagcccc

SEQ ID NO: 5387541 - DNA, 20 bp, Homo sapiens
catcctcctcagcccccagg

SEQ ID NO: 5387542 - DNA, 16 bp, Homo sapiens
catcctcctcccaccc

SEQ ID NO: 5387543 - DNA, 17 bp, Homo sapiens
catctccctgcctggcc

SEQ ID NO: 5387544 - DNA, 18 bp, Homo sapiens
catctccctgcctggccc

SEQ ID NO: 5387545 - DNA, 15 bp, Homo sapiens
catctccctgctttg

SEQ ID NO: 5387546 - DNA, 14 bp, Homo sapiens
catctccctggtgc

SEQ ID NO: 5387547 - DNA, 16 bp, Homo sapiens
catctccctggtgctt

SEQ ID NO: 5387548 - DNA, 23 bp, Homo sapiens
catctccctggtgcttatgctct

SEQ ID NO: 5387549 - DNA, 17 bp, Homo sapiens
catctccgcctccacac

SEQ ID NO: 5387550 - DNA, 19 bp, Homo sapiens
catctccgcctccacactg

SEQ ID NO: 5387551 - DNA, 20 bp, Homo sapiens
catctccggggtggccacag

SEQ ID NO: 5387552 - DNA, 21 bp, Homo sapiens
catctccgtctcccaaagtgc

SEQ ID NO: 5387553 - DNA, 19 bp, Homo sapiens
catctcctataatctgtca

SEQ ID NO: 5387554 - DNA, 20 bp, Homo sapiens
catctcctccatactcagga

SEQ ID NO: 5387555 - DNA, 20 bp, Homo sapiens
catctcctcccatggccttc

SEQ ID NO: 5387556 - DNA, 16 bp, Homo sapiens
catctcctctatcaca

SEQ ID NO: 5387557 - DNA, 22 bp, Homo sapiens
catctcctgaccctcccactcc

SEQ ID NO: 5387558 - DNA, 23 bp, Homo sapiens
catctcctgaccctcccactccc

SEQ ID NO: 5387559 - DNA, 16 bp, Homo sapiens
catctcctgccttcct

SEQ ID NO: 5387560 - DNA, 16 bp, Homo sapiens
catctcctgctcacca

SEQ ID NO: 5387561 - DNA, 19 bp, Homo sapiens
catctcctgctcaccacct

SEQ ID NO: 5387562 - DNA, 13 bp, Homo sapiens
catctcctgtgca

SEQ ID NO: 5387563 - DNA, 17 bp, Homo sapiens
catctccttacctctgg

SEQ ID NO: 5387564 - DNA, 18 bp, Homo sapiens
catctccttacctctgga

SEQ ID NO: 5387565 - DNA, 22 bp, Homo sapiens
catctccttacctctggaaccc

SEQ ID NO: 5387566 - DNA, 16 bp, Homo sapiens
catctccttagaaaag

SEQ ID NO: 5387567 - DNA, 15 bp, Homo sapiens
catctccttccccca

SEQ ID NO: 5387568 - DNA, 20 bp, Homo sapiens
catctccttcccccagccca

SEQ ID NO: 5387569 - DNA, 21 bp, Homo sapiens
catctccttcccccagcccaa

SEQ ID NO: 5387570 - DNA, 21 bp, Homo sapiens
catctccttgatcatgtcttc

SEQ ID NO: 5387571 - DNA, 12 bp, Homo sapiens
catctcctttgc

SEQ ID NO: 5387572 - DNA, 13 bp, Homo sapiens
catctcctttgca

SEQ ID NO: 5387573 - DNA, 21 bp, Homo sapiens
catctcctttgcagaatgatg

SEQ ID NO: 5387574 - DNA, 15 bp, Homo sapiens
catctcctttgctag

SEQ ID NO: 5387575 - DNA, 20 bp, Homo sapiens
catctcctttgctagtgtct

SEQ ID NO: 5387576 - DNA, 16 bp, Homo sapiens
catctccttttgcgct

SEQ ID NO: 5387577 - DNA, 15 bp, Homo sapiens
catctcgagccccct

SEQ ID NO: 5387578 - DNA, 16 bp, Homo sapiens
catctcgagccccctg

SEQ ID NO: 5387579 - DNA, 18 bp, Homo sapiens
catctcgagccccctgga

SEQ ID NO: 5387580 - DNA, 21 bp, Homo sapiens
catctcgccacccctccttcc

SEQ ID NO: 5387581 - DNA, 19 bp, Homo sapiens
catctcgctccctcccagg

SEQ ID NO: 5387582 - DNA, 20 bp, Homo sapiens
catctcgctccctcccagga

SEQ ID NO: 5387583 - DNA, 17 bp, Homo sapiens
catctcggggctgctgt

SEQ ID NO: 5387584 - DNA, 16 bp, Homo sapiens
catctctaacagctca

SEQ ID NO: 5387585 - DNA, 19 bp, Homo sapiens
catctctaacagctcagga

SEQ ID NO: 5387586 - DNA, 22 bp, Homo sapiens
catctctaacagctcaggatct

SEQ ID NO: 5387587 - DNA, 14 bp, Homo sapiens
catctctaattttg

SEQ ID NO: 5387588 - DNA, 13 bp, Homo sapiens
catctctaccttc

SEQ ID NO: 5387589 - DNA, 19 bp, Homo sapiens
catctctaccttctcccca

SEQ ID NO: 5387590 - DNA, 20 bp, Homo sapiens
catctctaccttctccccag

SEQ ID NO: 5387591 - DNA, 22 bp, Homo sapiens
catctctagagaacgctttcag

SEQ ID NO: 5387592 - DNA, 23 bp, Homo sapiens
catctctagtgtagctgccacat

SEQ ID NO: 5387593 - DNA, 16 bp, Homo sapiens
catctctcatcctcca

SEQ ID NO: 5387594 - DNA, 15 bp, Homo sapiens
catctctccagagag

SEQ ID NO: 5387595 - DNA, 18 bp, Homo sapiens
catctctccagagagcaa

SEQ ID NO: 5387596 - DNA, 13 bp, Homo sapiens
catctctcccact

SEQ ID NO: 5387597 - DNA, 20 bp, Homo sapiens
catctctcccacttcctcct

SEQ ID NO: 5387598 - DNA, 13 bp, Homo sapiens
catctctccccaa

SEQ ID NO: 5387599 - DNA, 20 bp, Homo sapiens
catctctccccatatataaa

SEQ ID NO: 5387600 - DNA, 21 bp, Homo sapiens
catctctccccatatataaat

SEQ ID NO: 5387601 - DNA, 12 bp, Homo sapiens
catctctccctc

SEQ ID NO: 5387602 - DNA, 16 bp, Homo sapiens
catctctccctcccct

SEQ ID NO: 5387603 - DNA, 20 bp, Homo sapiens
catctctccctcctggtgaa

SEQ ID NO: 5387604 - DNA, 15 bp, Homo sapiens
catctctcctccttt

SEQ ID NO: 5387605 - DNA, 22 bp, Homo sapiens
catctctctactcctacctcag

SEQ ID NO: 5387606 - DNA, 14 bp, Homo sapiens
catctctctggccc

SEQ ID NO: 5387607 - DNA, 13 bp, Homo sapiens
catctctctgggg

SEQ ID NO: 5387608 - DNA, 13 bp, Homo sapiens
catctctgaaaat

SEQ ID NO: 5387609 - DNA, 19 bp, Homo sapiens
catctctgaaaattctgga

SEQ ID NO: 5387610 - DNA, 22 bp, Homo sapiens
catctctgaactggtagaaaaa

SEQ ID NO: 5387611 - DNA, 14 bp, Homo sapiens
catctctgactttc

SEQ ID NO: 5387612 - DNA, 11 bp, Homo sapiens
catctctgagt

SEQ ID NO: 5387613 - DNA, 21 bp, Homo sapiens
catctctgagtggaggaagcc

SEQ ID NO: 5387614 - DNA, 18 bp, Homo sapiens
catctctgagtgtctctg

SEQ ID NO: 5387615 - DNA, 11 bp, Homo sapiens
catctctgcac

SEQ ID NO: 5387616 - DNA, 20 bp, Homo sapiens
catctctgcctgacaaggcc

SEQ ID NO: 5387617 - DNA, 12 bp, Homo sapiens
catctctgcctt

SEQ ID NO: 5387618 - DNA, 14 bp, Homo sapiens
catctctgcctttg

SEQ ID NO: 5387619 - DNA, 12 bp, Homo sapiens
catctctgctcc

SEQ ID NO: 5387620 - DNA, 21 bp, Homo sapiens
catctctgctgcttctgggcc

SEQ ID NO: 5387621 - DNA, 22 bp, Homo sapiens
catctctgctgcttctgggcct

SEQ ID NO: 5387622 - DNA, 21 bp, Homo sapiens
catctctgcttgagtcaggtt

SEQ ID NO: 5387623 - DNA, 13 bp, Homo sapiens
catctctggagcc

SEQ ID NO: 5387624 - DNA, 16 bp, Homo sapiens
catctctggagccaga

SEQ ID NO: 5387625 - DNA, 17 bp, Homo sapiens
catctctggagccagag

SEQ ID NO: 5387626 - DNA, 18 bp, Homo sapiens
catctctgggctggatga

SEQ ID NO: 5387627 - DNA, 23 bp, Homo sapiens
catctctggttttcttgccaccc

SEQ ID NO: 5387628 - DNA, 12 bp, Homo sapiens
catctctgtaaa

SEQ ID NO: 5387629 - DNA, 21 bp, Homo sapiens
catctctgtcccattccctgg

SEQ ID NO: 5387630 - DNA, 20 bp, Homo sapiens
catctctgtgattacctctc

SEQ ID NO: 5387631 - DNA, 21 bp, Homo sapiens
catctctgtgtacccactcct

SEQ ID NO: 5387632 - DNA, 13 bp, Homo sapiens
catctcttaaatt

SEQ ID NO: 5387633 - DNA, 16 bp, Homo sapiens
catctcttagctcccc

SEQ ID NO: 5387634 - DNA, 18 bp, Homo sapiens
catctcttagctcccctc

SEQ ID NO: 5387635 - DNA, 21 bp, Homo sapiens
catctcttagctcccctccaa

SEQ ID NO: 5387636 - DNA, 12 bp, Homo sapiens
catctcttcaat

SEQ ID NO: 5387637 - DNA, 11 bp, Homo sapiens
catctcttcag

SEQ ID NO: 5387638 - DNA, 15 bp, Homo sapiens
catctcttcaggttc

SEQ ID NO: 5387639 - DNA, 15 bp, Homo sapiens
catctcttcatgcgc

SEQ ID NO: 5387640 - DNA, 21 bp, Homo sapiens
catctcttcattcaaactgca

SEQ ID NO: 5387641 - DNA, 15 bp, Homo sapiens
catctcttctgcaag

SEQ ID NO: 5387642 - DNA, 22 bp, Homo sapiens
catctcttctgggttccttcct

SEQ ID NO: 5387643 - DNA, 20 bp, Homo sapiens
catctcttgaggccaggagt

SEQ ID NO: 5387644 - DNA, 15 bp, Homo sapiens
catctctttagagaa

SEQ ID NO: 5387645 - DNA, 14 bp, Homo sapiens
catctctttgtaca

SEQ ID NO: 5387646 - DNA, 23 bp, Homo sapiens
catctcttttcccactccctttg

SEQ ID NO: 5387647 - DNA, 13 bp, Homo sapiens
catctgaaagcca

SEQ ID NO: 5387648 - DNA, 14 bp, Homo sapiens
catctgaaagccac

SEQ ID NO: 5387649 - DNA, 21 bp, Homo sapiens
catctgaaagttttgatttga

SEQ ID NO: 5387650 - DNA, 12 bp, Homo sapiens
catctgaaatct

SEQ ID NO: 5387651 - DNA, 14 bp, Homo sapiens
catctgaaatgtta

SEQ ID NO: 5387652 - DNA, 19 bp, Homo sapiens
catctgaaccactttgcct

SEQ ID NO: 5387653 - DNA, 17 bp, Homo sapiens
catctgaagccacctct

SEQ ID NO: 5387654 - DNA, 22 bp, Homo sapiens
catctgaagccacctctctgcc

SEQ ID NO: 5387655 - DNA, 21 bp, Homo sapiens
catctgaaggggcaaattctt

SEQ ID NO: 5387656 - DNA, 15 bp, Homo sapiens
catctgaatcccggg

SEQ ID NO: 5387657 - DNA, 22 bp, Homo sapiens
catctgaatgaaaataactgaa

SEQ ID NO: 5387658 - DNA, 13 bp, Homo sapiens
catctgacagcag

SEQ ID NO: 5387659 - DNA, 17 bp, Homo sapiens
catctgacagcaggcca

SEQ ID NO: 5387660 - DNA, 14 bp, Homo sapiens
catctgaccagcag

SEQ ID NO: 5387661 - DNA, 12 bp, Homo sapiens
catctgaccatc

SEQ ID NO: 5387662 - DNA, 13 bp, Homo sapiens
catctgaccatct

SEQ ID NO: 5387663 - DNA, 18 bp, Homo sapiens
catctgaccatctgtgac

SEQ ID NO: 5387664 - DNA, 15 bp, Homo sapiens
catctgaccccaagg

SEQ ID NO: 5387665 - DNA, 15 bp, Homo sapiens
catctgaccgttttc

SEQ ID NO: 5387666 - DNA, 18 bp, Homo sapiens
catctgactcacaagaag

SEQ ID NO: 5387667 - DNA, 12 bp, Homo sapiens
catctgactgcc

SEQ ID NO: 5387668 - DNA, 16 bp, Homo sapiens
catctgactgccaagc

SEQ ID NO: 5387669 - DNA, 14 bp, Homo sapiens
catctgagaaaagc

SEQ ID NO: 5387670 - DNA, 18 bp, Homo sapiens
catctgagaaggccctgt

SEQ ID NO: 5387671 - DNA, 14 bp, Homo sapiens
catctgagaatgaa

SEQ ID NO: 5387672 - DNA, 16 bp, Homo sapiens
catctgagaatgaaca

SEQ ID NO: 5387673 - DNA, 13 bp, Homo sapiens
catctgagaggct

SEQ ID NO: 5387674 - DNA, 23 bp, Homo sapiens
catctgaggaaaatggaagacct

SEQ ID NO: 5387675 - DNA, 13 bp, Homo sapiens
catctgaggacca

SEQ ID NO: 5387676 - DNA, 16 bp, Homo sapiens
catctgaggagtccaa

SEQ ID NO: 5387677 - DNA, 17 bp, Homo sapiens
catctgaggcatccagc

SEQ ID NO: 5387678 - DNA, 15 bp, Homo sapiens
catctgaggttttat

SEQ ID NO: 5387679 - DNA, 16 bp, Homo sapiens
catctgagtccagctc

SEQ ID NO: 5387680 - DNA, 18 bp, Homo sapiens
catctgagtccagctccc

SEQ ID NO: 5387681 - DNA, 21 bp, Homo sapiens
catctgagtcctggatgatac

SEQ ID NO: 5387682 - DNA, 14 bp, Homo sapiens
catctgataaagtt

SEQ ID NO: 5387683 - DNA, 21 bp, Homo sapiens
catctgatattcaaacacaca

SEQ ID NO: 5387684 - DNA, 24 bp, Homo sapiens
catctgatattcaaacacacagta

SEQ ID NO: 5387685 - DNA, 19 bp, Homo sapiens
catctgatccccatgccta

SEQ ID NO: 5387686 - DNA, 21 bp, Homo sapiens
catctgatccccatgcctagc

SEQ ID NO: 5387687 - DNA, 18 bp, Homo sapiens
catctgatctgtataaaa

SEQ ID NO: 5387688 - DNA, 20 bp, Homo sapiens
catctgatctgtataaaaat

SEQ ID NO: 5387689 - DNA, 18 bp, Homo sapiens
catctgatgccgtgatcc

SEQ ID NO: 5387690 - DNA, 17 bp, Homo sapiens
catctgatgtttcatat

SEQ ID NO: 5387691 - DNA, 11 bp, Homo sapiens
catctgattta

SEQ ID NO: 5387692 - DNA, 14 bp, Homo sapiens
catctgatttctga

SEQ ID NO: 5387693 - DNA, 15 bp, Homo sapiens
catctgatttctgaa

SEQ ID NO: 5387694 - DNA, 16 bp, Homo sapiens
catctgatttctgaac

SEQ ID NO: 5387695 - DNA, 15 bp, Homo sapiens
catctgatttgcata

SEQ ID NO: 5387696 - DNA, 20 bp, Homo sapiens
catctgcaaaaggcctcttg

SEQ ID NO: 5387697 - DNA, 11 bp, Homo sapiens
catctgcaaag

SEQ ID NO: 5387698 - DNA, 17 bp, Homo sapiens
catctgcaatatgaatt

SEQ ID NO: 5387699 - DNA, 17 bp, Homo sapiens
catctgcacccctgagt

SEQ ID NO: 5387700 - DNA, 19 bp, Homo sapiens
catctgcaccccttctctc

SEQ ID NO: 5387701 - DNA, 18 bp, Homo sapiens
catctgcacccttctttt

SEQ ID NO: 5387702 - DNA, 20 bp, Homo sapiens
catctgcacccttcttttct

SEQ ID NO: 5387703 - DNA, 21 bp, Homo sapiens
catctgcacccttcttttctc

SEQ ID NO: 5387704 - DNA, 14 bp, Homo sapiens
catctgcaggacag

SEQ ID NO: 5387705 - DNA, 18 bp, Homo sapiens
catctgcaggacagaggg

SEQ ID NO: 5387706 - DNA, 18 bp, Homo sapiens
catctgcaggcaccgggc

SEQ ID NO: 5387707 - DNA, 18 bp, Homo sapiens
catctgcagtgttctgtg

SEQ ID NO: 5387708 - DNA, 19 bp, Homo sapiens
catctgcagtgttctgtga

SEQ ID NO: 5387709 - DNA, 20 bp, Homo sapiens
catctgcagtgttctgtgaa

SEQ ID NO: 5387710 - DNA, 13 bp, Homo sapiens
catctgcatgtct

SEQ ID NO: 5387711 - DNA, 17 bp, Homo sapiens
catctgcatgtctactc

SEQ ID NO: 5387712 - DNA, 15 bp, Homo sapiens
catctgcattcctga

SEQ ID NO: 5387713 - DNA, 16 bp, Homo sapiens
catctgcattcctgat

SEQ ID NO: 5387714 - DNA, 20 bp, Homo sapiens
catctgcattttcaccccac

SEQ ID NO: 5387715 - DNA, 15 bp, Homo sapiens
catctgccaatgcca

SEQ ID NO: 5387716 - DNA, 19 bp, Homo sapiens
catctgccacaaaaatgtt

SEQ ID NO: 5387717 - DNA, 20 bp, Homo sapiens
catctgccacaaaaatgttc

SEQ ID NO: 5387718 - DNA, 23 bp, Homo sapiens
catctgccacaaaaatgttcact

SEQ ID NO: 5387719 - DNA, 12 bp, Homo sapiens
catctgccagac

SEQ ID NO: 5387720 - DNA, 14 bp, Homo sapiens
catctgccagacct

SEQ ID NO: 5387721 - DNA, 17 bp, Homo sapiens
catctgcccaactgtgt

SEQ ID NO: 5387722 - DNA, 19 bp, Homo sapiens
catgaaaacgttttattgt

SEQ ID NO: 5387723 - DNA, 16 bp, Homo sapiens
catgaaaactatttta

SEQ ID NO: 5387724 - DNA, 19 bp, Homo sapiens
catgaaaactttttaatgg

SEQ ID NO: 5387725 - DNA, 19 bp, Homo sapiens
catgaaaataccataggaa

SEQ ID NO: 5387726 - DNA, 15 bp, Homo sapiens
catgaaaatgcaaca

SEQ ID NO: 5387727 - DNA, 22 bp, Homo sapiens
catgaaaatggcatccagggct

SEQ ID NO: 5387728 - DNA, 16 bp, Homo sapiens
catgaaaatgtgtgtt

SEQ ID NO: 5387729 - DNA, 15 bp, Homo sapiens
catgaaaattcagaa

SEQ ID NO: 5387730 - DNA, 13 bp, Homo sapiens
catgaaacaaagc

SEQ ID NO: 5387731 - DNA, 11 bp, Homo sapiens
catgaaacacc

SEQ ID NO: 5387732 - DNA, 19 bp, Homo sapiens
catgaaacagaaacaaaaa

SEQ ID NO: 5387733 - DNA, 14 bp, Homo sapiens
catgaaactccacc

SEQ ID NO: 5387734 - DNA, 15 bp, Homo sapiens
catgaaactgcctat

SEQ ID NO: 5387735 - DNA, 16 bp, Homo sapiens
catgaaactgcctatt

SEQ ID NO: 5387736 - DNA, 22 bp, Homo sapiens
catgaaacttgtttcactgaaa

SEQ ID NO: 5387737 - DNA, 22 bp, Homo sapiens
catgaaagaaataaacaggagt

SEQ ID NO: 5387738 - DNA, 17 bp, Homo sapiens
catgaaagacttctcta

SEQ ID NO: 5387739 - DNA, 21 bp, Homo sapiens
catgaaagccctggaatttta

SEQ ID NO: 5387740 - DNA, 18 bp, Homo sapiens
catgaaaggtaatctgaa

SEQ ID NO: 5387741 - DNA, 13 bp, Homo sapiens
catgaaataaaat

SEQ ID NO: 5387742 - DNA, 14 bp, Homo sapiens
catgaaataaaata

SEQ ID NO: 5387743 - DNA, 18 bp, Homo sapiens
catgaaataaaatatatc

SEQ ID NO: 5387744 - DNA, 22 bp, Homo sapiens
catgaaatatagatcagttata

SEQ ID NO: 5387745 - DNA, 13 bp, Homo sapiens
catgaaatatgca

SEQ ID NO: 5387746 - DNA, 15 bp, Homo sapiens
catgaaatgaacaca

SEQ ID NO: 5387747 - DNA, 13 bp, Homo sapiens
catgaaatgaatg

SEQ ID NO: 5387748 - DNA, 14 bp, Homo sapiens
catgaaatgaatgt

SEQ ID NO: 5387749 - DNA, 18 bp, Homo sapiens
catgaaatgaatgtctga

SEQ ID NO: 5387750 - DNA, 23 bp, Homo sapiens
catgaaatgccctcctaaatgtc

SEQ ID NO: 5387751 - DNA, 19 bp, Homo sapiens
catgaaatgtgaattttta

SEQ ID NO: 5387752 - DNA, 23 bp, Homo sapiens
catgaaatgtgaatttttattgt

SEQ ID NO: 5387753 - DNA, 19 bp, Homo sapiens
catgaaattcttcctaatg

SEQ ID NO: 5387754 - DNA, 18 bp, Homo sapiens
catgaaattgtatctcag

SEQ ID NO: 5387755 - DNA, 17 bp, Homo sapiens
catgaaatttttgtaaa

SEQ ID NO: 5387756 - DNA, 22 bp, Homo sapiens
catgaacaaattctttagtact

SEQ ID NO: 5387757 - DNA, 17 bp, Homo sapiens
catgaacacactgtgtc

SEQ ID NO: 5387758 - DNA, 13 bp, Homo sapiens
catgaacacagct

SEQ ID NO: 5387759 - DNA, 14 bp, Homo sapiens
catgaacagctctg

SEQ ID NO: 5387760 - DNA, 19 bp, Homo sapiens
catgaacagctctgagatc

SEQ ID NO: 5387761 - DNA, 14 bp, Homo sapiens
catgaacagcttgc

SEQ ID NO: 5387762 - DNA, 20 bp, Homo sapiens
catgaacagggtccctggat

SEQ ID NO: 5387763 - DNA, 17 bp, Homo sapiens
catgaacatggtcagaa

SEQ ID NO: 5387764 - DNA, 16 bp, Homo sapiens
catgaaccaaatggtt

SEQ ID NO: 5387765 - DNA, 23 bp, Homo sapiens
catgaaccctcttgccatcctga

SEQ ID NO: 5387766 - DNA, 12 bp, Homo sapiens
catgaaccctgc

SEQ ID NO: 5387767 - DNA, 19 bp, Homo sapiens
catgaaccctgccccactc

SEQ ID NO: 5387768 - DNA, 13 bp, Homo sapiens
catgaactggctt

SEQ ID NO: 5387769 - DNA, 18 bp, Homo sapiens
catgaactggcttgtaca

SEQ ID NO: 5387770 - DNA, 14 bp, Homo sapiens
catgaactgtacta

SEQ ID NO: 5387771 - DNA, 17 bp, Homo sapiens
catgaactgtgtttcca

SEQ ID NO: 5387772 - DNA, 12 bp, Homo sapiens
catgaagaaaaa

SEQ ID NO: 5387773 - DNA, 20 bp, Homo sapiens
catgaagaaaaaattttaaa

SEQ ID NO: 5387774 - DNA, 12 bp, Homo sapiens
catgaagaagct

SEQ ID NO: 5387775 - DNA, 19 bp, Homo sapiens
catgaagaatgcattcaaa

SEQ ID NO: 5387776 - DNA, 17 bp, Homo sapiens
catgaagaatgtttctg

SEQ ID NO: 5387777 - DNA, 15 bp, Homo sapiens
catgaagacacgctt

SEQ ID NO: 5387778 - DNA, 16 bp, Homo sapiens
catgaagacaggacag

SEQ ID NO: 5387779 - DNA, 17 bp, Homo sapiens
catgaagacaggacagt

SEQ ID NO: 5387780 - DNA, 14 bp, Homo sapiens
catgaagacaggat

SEQ ID NO: 5387781 - DNA, 21 bp, Homo sapiens
catgaagacagtccagtagac

SEQ ID NO: 5387782 - DNA, 13 bp, Homo sapiens
catgaagaccaca

SEQ ID NO: 5387783 - DNA, 14 bp, Homo sapiens
catgaagagcaaaa

SEQ ID NO: 5387784 - DNA, 15 bp, Homo sapiens
catgaagagcaaaaa

SEQ ID NO: 5387785 - DNA, 17 bp, Homo sapiens
catgaagagcaaaaata

SEQ ID NO: 5387786 - DNA, 21 bp, Homo sapiens
catgaagaggagattggccag

SEQ ID NO: 5387787 - DNA, 17 bp, Homo sapiens
catgaagatatttttcc

SEQ ID NO: 5387788 - DNA, 19 bp, Homo sapiens
catgaagatgtagaggaga

SEQ ID NO: 5387789 - DNA, 23 bp, Homo sapiens
catgaagatgttaaaatcggttt

SEQ ID NO: 5387790 - DNA, 18 bp, Homo sapiens
catgaagattctttccca

SEQ ID NO: 5387791 - DNA, 18 bp, Homo sapiens
catgaagattttctttct

SEQ ID NO: 5387792 - DNA, 15 bp, Homo sapiens
catgaagcaacgata

SEQ ID NO: 5387793 - DNA, 19 bp, Homo sapiens
catgaagcaacgataaaat

SEQ ID NO: 5387794 - DNA, 15 bp, Homo sapiens
catgaagcagaacct

SEQ ID NO: 5387795 - DNA, 22 bp, Homo sapiens
catgaagcagaaccttctttgg

SEQ ID NO: 5387796 - DNA, 18 bp, Homo sapiens
catgaagcataatttgtt

SEQ ID NO: 5387797 - DNA, 16 bp, Homo sapiens
catgaagcatgagtta

SEQ ID NO: 5387798 - DNA, 19 bp, Homo sapiens
catgaagcatgagttatct

SEQ ID NO: 5387799 - DNA, 21 bp, Homo sapiens
catgaagccacagcccaggcc

SEQ ID NO: 5387800 - DNA, 14 bp, Homo sapiens
catgaagccttgct

SEQ ID NO: 5387801 - DNA, 19 bp, Homo sapiens
catgaagccttttgaaagg

SEQ ID NO: 5387802 - DNA, 17 bp, Homo sapiens
catgaagctcagtttgg

SEQ ID NO: 5387803 - DNA, 12 bp, Homo sapiens
catgaagctgga

SEQ ID NO: 5387804 - DNA, 16 bp, Homo sapiens
catgaaggacactctg

SEQ ID NO: 5387805 - DNA, 18 bp, Homo sapiens
catgaaggagacagcagc

SEQ ID NO: 5387806 - DNA, 22 bp, Homo sapiens
catgaaggatgccaagaagttt

SEQ ID NO: 5387807 - DNA, 17 bp, Homo sapiens
catgaaggcacctgccc

SEQ ID NO: 5387808 - DNA, 22 bp, Homo sapiens
catgaaggctggaaggcagcag

SEQ ID NO: 5387809 - DNA, 14 bp, Homo sapiens
catgaagggctgga

SEQ ID NO: 5387810 - DNA, 14 bp, Homo sapiens
catgaaggtaaata

SEQ ID NO: 5387811 - DNA, 16 bp, Homo sapiens
catgaaggtaaataaa

SEQ ID NO: 5387812 - DNA, 17 bp, Homo sapiens
catgaaggtaaataaaa

SEQ ID NO: 5387813 - DNA, 20 bp, Homo sapiens
catgaaggtaaataaaaaga

SEQ ID NO: 5387814 - DNA, 22 bp, Homo sapiens
catgaaggtaaataaaaagaaa

SEQ ID NO: 5387815 - DNA, 20 bp, Homo sapiens
catgaaggtcctagctttat

SEQ ID NO: 5387816 - DNA, 16 bp, Homo sapiens
catgaaggtgtcatac

SEQ ID NO: 5387817 - DNA, 18 bp, Homo sapiens
catgaaggtttctgaaaa

SEQ ID NO: 5387818 - DNA, 21 bp, Homo sapiens
catgaagtattttttcagtat

SEQ ID NO: 5387819 - DNA, 18 bp, Homo sapiens
catgaagtgcacaggagc

SEQ ID NO: 5387820 - DNA, 20 bp, Homo sapiens
catgaagtttccttggctgg

SEQ ID NO: 5387821 - DNA, 23 bp, Homo sapiens
catgaagtttccttggctggtgc

SEQ ID NO: 5387822 - DNA, 13 bp, Homo sapiens
catgaataaaaat

SEQ ID NO: 5387823 - DNA, 13 bp, Homo sapiens
catgaataaaaca

SEQ ID NO: 5387824 - DNA, 15 bp, Homo sapiens
catgaataaaattag

SEQ ID NO: 5387825 - DNA, 16 bp, Homo sapiens
catgaataaatggctt

SEQ ID NO: 5387826 - DNA, 21 bp, Homo sapiens
catgaatatggttggagagcc

SEQ ID NO: 5387827 - DNA, 24 bp, Homo sapiens
catgaatatggttggagagccctg

SEQ ID NO: 5387828 - DNA, 17 bp, Homo sapiens
catgaatcaaaagtgcc

SEQ ID NO: 5387829 - DNA, 18 bp, Homo sapiens
catgaatcaaaagtgcct

SEQ ID NO: 5387830 - DNA, 19 bp, Homo sapiens
catgaatcactgtgctcag

SEQ ID NO: 5387831 - DNA, 20 bp, Homo sapiens
catgaatcactgtgctcagc

SEQ ID NO: 5387832 - DNA, 12 bp, Homo sapiens
catgaatcatag

SEQ ID NO: 5387833 - DNA, 18 bp, Homo sapiens
catgaatccatcgatttg

SEQ ID NO: 5387834 - DNA, 21 bp, Homo sapiens
catgaatccatcgatttgtat

SEQ ID NO: 5387835 - DNA, 17 bp, Homo sapiens
catgaatcgcttctctt

SEQ ID NO: 5387836 - DNA, 19 bp, Homo sapiens
catgaatctgcacatctgt

SEQ ID NO: 5387837 - DNA, 14 bp, Homo sapiens
catgaatctgtctc

SEQ ID NO: 5387838 - DNA, 22 bp, Homo sapiens
catgaatctttcatacatatat

SEQ ID NO: 5387839 - DNA, 17 bp, Homo sapiens
catgaatgaacccctgg

SEQ ID NO: 5387840 - DNA, 15 bp, Homo sapiens
catgaatgaatgaac

SEQ ID NO: 5387841 - DNA, 16 bp, Homo sapiens
catgaatgatttgtgt

SEQ ID NO: 5387842 - DNA, 16 bp, Homo sapiens
catgaatgcacactag

SEQ ID NO: 5387843 - DNA, 21 bp, Homo sapiens
catgaatgcagtcatgcaaac

SEQ ID NO: 5387844 - DNA, 14 bp, Homo sapiens
catgaatggagatg

SEQ ID NO: 5387845 - DNA, 13 bp, Homo sapiens
catgaatgttttt

SEQ ID NO: 5387846 - DNA, 21 bp, Homo sapiens
catgaattatataattttcca

SEQ ID NO: 5387847 - DNA, 15 bp, Homo sapiens
catgaattcatactc

SEQ ID NO: 5387848 - DNA, 17 bp, Homo sapiens
catgaattcatactctg

SEQ ID NO: 5387849 - DNA, 22 bp, Homo sapiens
catgaattccactccttccaga

SEQ ID NO: 5387850 - DNA, 20 bp, Homo sapiens
catgaattggaactgcaatg

SEQ ID NO: 5387851 - DNA, 21 bp, Homo sapiens
catgaattggaactgcaatga

SEQ ID NO: 5387852 - DNA, 16 bp, Homo sapiens
catgaatttagaaata

SEQ ID NO: 5387853 - DNA, 23 bp, Homo sapiens
catgaatttattgcacattgttc

SEQ ID NO: 5387854 - DNA, 20 bp, Homo sapiens
catgaatttctcctttccta

SEQ ID NO: 5387855 - DNA, 14 bp, Homo sapiens
catgaatttctgcc

SEQ ID NO: 5387856 - DNA, 12 bp, Homo sapiens
catgaatttgta

SEQ ID NO: 5387857 - DNA, 17 bp, Homo sapiens
catgaattttaaagtat

SEQ ID NO: 5387858 - DNA, 16 bp, Homo sapiens
catgaattttaaataa

SEQ ID NO: 5387859 - DNA, 17 bp, Homo sapiens
catgaattttagctttt

SEQ ID NO: 5387860 - DNA, 19 bp, Homo sapiens
catgaattttagcttttgt

SEQ ID NO: 5387861 - DNA, 20 bp, Homo sapiens
catgaatttttatgatttct

SEQ ID NO: 5387862 - DNA, 21 bp, Homo sapiens
catgaatttttttcatcttct

SEQ ID NO: 5387863 - DNA, 13 bp, Homo sapiens
catgacaaagact

SEQ ID NO: 5387864 - DNA, 21 bp, Homo sapiens
catgacaactttgccagcttt

SEQ ID NO: 5387865 - DNA, 19 bp, Homo sapiens
catgacaagatgggacagc

SEQ ID NO: 5387866 - DNA, 15 bp, Homo sapiens
catgacaagccccag

SEQ ID NO: 5387867 - DNA, 17 bp, Homo sapiens
catgacaagccccaggc

SEQ ID NO: 5387868 - DNA, 19 bp, Homo sapiens
catgacaagccccaggcag

SEQ ID NO: 5387869 - DNA, 20 bp, Homo sapiens
catgacaagccccaggcagg

SEQ ID NO: 5387870 - DNA, 16 bp, Homo sapiens
catgacaagtactgta

SEQ ID NO: 5387871 - DNA, 13 bp, Homo sapiens
catgacaatcacc

SEQ ID NO: 5387872 - DNA, 15 bp, Homo sapiens
catgacaatgcaatg

SEQ ID NO: 5387873 - DNA, 12 bp, Homo sapiens
catgacacagct

SEQ ID NO: 5387874 - DNA, 22 bp, Homo sapiens
catgacacagctttatcaccag

SEQ ID NO: 5387875 - DNA, 17 bp, Homo sapiens
catgacagaatatacac

SEQ ID NO: 5387876 - DNA, 12 bp, Homo sapiens
catgacagaggc

SEQ ID NO: 5387877 - DNA, 15 bp, Homo sapiens
catgacagaggctgc

SEQ ID NO: 5387878 - DNA, 22 bp, Homo sapiens
catgacagaggctgcacccctg

SEQ ID NO: 5387879 - DNA, 13 bp, Homo sapiens
catgacagatgaa

SEQ ID NO: 5387880 - DNA, 14 bp, Homo sapiens
catgacagccagag

SEQ ID NO: 5387881 - DNA, 15 bp, Homo sapiens
catgacagccagagc

SEQ ID NO: 5387882 - DNA, 14 bp, Homo sapiens
catgacagcctcca

SEQ ID NO: 5387883 - DNA, 13 bp, Homo sapiens
catgacagcctgc

SEQ ID NO: 5387884 - DNA, 15 bp, Homo sapiens
catgacagtagcata

SEQ ID NO: 5387885 - DNA, 18 bp, Homo sapiens
catgacagtagcatactg

SEQ ID NO: 5387886 - DNA, 22 bp, Homo sapiens
catgacagtagcatactgatga

SEQ ID NO: 5387887 - DNA, 18 bp, Homo sapiens
catgacagtgcttgcatc

SEQ ID NO: 5387888 - DNA, 20 bp, Homo sapiens
catgacataacagtgcaggg

SEQ ID NO: 5387889 - DNA, 14 bp, Homo sapiens
catgacatcaaaat

SEQ ID NO: 5387890 - DNA, 14 bp, Homo sapiens
catgacatccacat

SEQ ID NO: 5387891 - DNA, 17 bp, Homo sapiens
catgacatccacatgca

SEQ ID NO: 5387892 - DNA, 18 bp, Homo sapiens
catgacatccacatgcac

SEQ ID NO: 5387893 - DNA, 15 bp, Homo sapiens
catgacatgttatat

SEQ ID NO: 5387894 - DNA, 17 bp, Homo sapiens
catgacatgttatatat

SEQ ID NO: 5387895 - DNA, 19 bp, Homo sapiens
catgacatgttatatattt

SEQ ID NO: 5387896 - DNA, 23 bp, Homo sapiens
catgacattcctaaactatcttt

SEQ ID NO: 5387897 - DNA, 17 bp, Homo sapiens
catgacatttcatctgg

SEQ ID NO: 5387898 - DNA, 13 bp, Homo sapiens
catgacatttctt

SEQ ID NO: 5387899 - DNA, 19 bp, Homo sapiens
catgacatttgtcctgcag

SEQ ID NO: 5387900 - DNA, 16 bp, Homo sapiens
catgcaccctcataca

SEQ ID NO: 5387901 - DNA, 21 bp, Homo sapiens
catgcaccctggacttctcta

SEQ ID NO: 5387902 - DNA, 17 bp, Homo sapiens
catgcacctcccttccc

SEQ ID NO: 5387903 - DNA, 19 bp, Homo sapiens
catgcacctgcaatcccag

SEQ ID NO: 5387904 - DNA, 20 bp, Homo sapiens
catgcacctgcaatcccagc

SEQ ID NO: 5387905 - DNA, 14 bp, Homo sapiens
catgcaccttgctc

SEQ ID NO: 5387906 - DNA, 16 bp, Homo sapiens
catgcaccttgctccc

SEQ ID NO: 5387907 - DNA, 17 bp, Homo sapiens
catgcacgcaccccgcc

SEQ ID NO: 5387908 - DNA, 17 bp, Homo sapiens
catgcactactgaaatt

SEQ ID NO: 5387909 - DNA, 14 bp, Homo sapiens
catgcactagccaa

SEQ ID NO: 5387910 - DNA, 19 bp, Homo sapiens
catgcactatatttgtata

SEQ ID NO: 5387911 - DNA, 22 bp, Homo sapiens
catgcactatatttgtatatat

SEQ ID NO: 5387912 - DNA, 17 bp, Homo sapiens
catgcactcacaaagat

SEQ ID NO: 5387913 - DNA, 17 bp, Homo sapiens
catgcactcacccctag

SEQ ID NO: 5387914 - DNA, 22 bp, Homo sapiens
catgcactcacccctagccctg

SEQ ID NO: 5387915 - DNA, 14 bp, Homo sapiens
catgcactcagtgt

SEQ ID NO: 5387916 - DNA, 14 bp, Homo sapiens
catgcactgaccct

SEQ ID NO: 5387917 - DNA, 17 bp, Homo sapiens
catgcactgacccttcc

SEQ ID NO: 5387918 - DNA, 15 bp, Homo sapiens
catgcactgaggtcc

SEQ ID NO: 5387919 - DNA, 14 bp, Homo sapiens
catgcactgtgaag

SEQ ID NO: 5387920 - DNA, 19 bp, Homo sapiens
catgcactgttccccctgt

SEQ ID NO: 5387921 - DNA, 14 bp, Homo sapiens
catgcacttaaaga

SEQ ID NO: 5387922 - DNA, 16 bp, Homo sapiens
catgcacttaaagaag

SEQ ID NO: 5387923 - DNA, 22 bp, Homo sapiens
catgcactttaattgaagaact

SEQ ID NO: 5387924 - DNA, 12 bp, Homo sapiens
catgcagaacac

SEQ ID NO: 5387925 - DNA, 18 bp, Homo sapiens
catgcagaataatcctgt

SEQ ID NO: 5387926 - DNA, 23 bp, Homo sapiens
catgcagacaaagccctgtcctt

SEQ ID NO: 5387927 - DNA, 16 bp, Homo sapiens
catgcagacctcatgc

SEQ ID NO: 5387928 - DNA, 22 bp, Homo sapiens
catgcagactcctcagatctga

SEQ ID NO: 5387929 - DNA, 16 bp, Homo sapiens
catgcagatctagcca

SEQ ID NO: 5387930 - DNA, 19 bp, Homo sapiens
catgcagatggggctcccg

SEQ ID NO: 5387931 - DNA, 17 bp, Homo sapiens
catgcagcaacacccaa

SEQ ID NO: 5387932 - DNA, 12 bp, Homo sapiens
catgcagcagct

SEQ ID NO: 5387933 - DNA, 13 bp, Homo sapiens
catgcagcagctt

SEQ ID NO: 5387934 - DNA, 19 bp, Homo sapiens
catgcagccacttaggaca

SEQ ID NO: 5387935 - DNA, 22 bp, Homo sapiens
catgcagcccatgcccacctgc

SEQ ID NO: 5387936 - DNA, 15 bp, Homo sapiens
catgcagcccctggg

SEQ ID NO: 5387937 - DNA, 16 bp, Homo sapiens
catgcagcccctgggc

SEQ ID NO: 5387938 - DNA, 17 bp, Homo sapiens
catgcagcccctgggcc

SEQ ID NO: 5387939 - DNA, 19 bp, Homo sapiens
catgcagcccctgggccct

SEQ ID NO: 5387940 - DNA, 17 bp, Homo sapiens
catgcagccgtgatcaa

SEQ ID NO: 5387941 - DNA, 22 bp, Homo sapiens
catgcagcctaaggctgtatga

SEQ ID NO: 5387942 - DNA, 18 bp, Homo sapiens
catgcagccttggggcat

SEQ ID NO: 5387943 - DNA, 21 bp, Homo sapiens
catgcagcgaattcagaaaga

SEQ ID NO: 5387944 - DNA, 12 bp, Homo sapiens
catgcagcgcca

SEQ ID NO: 5387945 - DNA, 20 bp, Homo sapiens
catgcagctcaactttctgt

SEQ ID NO: 5387946 - DNA, 20 bp, Homo sapiens
catgcagctcttcaacatga

SEQ ID NO: 5387947 - DNA, 15 bp, Homo sapiens
catgcagctgcaccc

SEQ ID NO: 5387948 - DNA, 20 bp, Homo sapiens
catgcagctgcaccctccct

SEQ ID NO: 5387949 - DNA, 12 bp, Homo sapiens
catgcagctgcc

SEQ ID NO: 5387950 - DNA, 13 bp, Homo sapiens
catgcagctgcct

SEQ ID NO: 5387951 - DNA, 14 bp, Homo sapiens
catgcagctgcctg

SEQ ID NO: 5387952 - DNA, 16 bp, Homo sapiens
catgcagctgcctggg

SEQ ID NO: 5387953 - DNA, 18 bp, Homo sapiens
catgcagctgcctggggc

SEQ ID NO: 5387954 - DNA, 21 bp, Homo sapiens
catgcagctgcctggggccca

SEQ ID NO: 5387955 - DNA, 17 bp, Homo sapiens
catgcagctgctcccca

SEQ ID NO: 5387956 - DNA, 18 bp, Homo sapiens
catgcagcttcatcaatt

SEQ ID NO: 5387957 - DNA, 20 bp, Homo sapiens
catgcagcttcatcaatttt

SEQ ID NO: 5387958 - DNA, 16 bp, Homo sapiens
catgcaggaagaggcc

SEQ ID NO: 5387959 - DNA, 20 bp, Homo sapiens
catgcaggaagaggcccact

SEQ ID NO: 5387960 - DNA, 13 bp, Homo sapiens
catgcaggaagga

SEQ ID NO: 5387961 - DNA, 15 bp, Homo sapiens
catgcaggaaggaaa

SEQ ID NO: 5387962 - DNA, 19 bp, Homo sapiens
catgcaggaaggaaaacta

SEQ ID NO: 5387963 - DNA, 18 bp, Homo sapiens
catgcaggcagcctgcag

SEQ ID NO: 5387964 - DNA, 12 bp, Homo sapiens
catgcaggccct

SEQ ID NO: 5387965 - DNA, 12 bp, Homo sapiens
catgcagggccc

SEQ ID NO: 5387966 - DNA, 15 bp, Homo sapiens
catgcagggccccca

SEQ ID NO: 5387967 - DNA, 17 bp, Homo sapiens
catgcagggcccccaca

SEQ ID NO: 5387968 - DNA, 20 bp, Homo sapiens
catgcagggcccccacagga

SEQ ID NO: 5387969 - DNA, 19 bp, Homo sapiens
catgcaggtggtgggacac

SEQ ID NO: 5387970 - DNA, 23 bp, Homo sapiens
catgcagtctaaaatgcttcagt

SEQ ID NO: 5387971 - DNA, 21 bp, Homo sapiens
catgcagtgctctttgtagct

SEQ ID NO: 5387972 - DNA, 9 bp, Homo sapiens
catgcagtt

SEQ ID NO: 5387973 - DNA, 15 bp, Homo sapiens
catgcagttatatat

SEQ ID NO: 5387974 - DNA, 23 bp, Homo sapiens
catgcagttcattattttgtggt

SEQ ID NO: 5387975 - DNA, 15 bp, Homo sapiens
catgcagttcctggc

SEQ ID NO: 5387976 - DNA, 10 bp, Homo sapiens
catgcagttt

SEQ ID NO: 5387977 - DNA, 17 bp, Homo sapiens
catgcataaaaattaaa

SEQ ID NO: 5387978 - DNA, 22 bp, Homo sapiens
catgcataaaagggtcaaacct

SEQ ID NO: 5387979 - DNA, 16 bp, Homo sapiens
catgcatacacacaca

SEQ ID NO: 5387980 - DNA, 23 bp, Homo sapiens
catgcatacacacacacacacag

SEQ ID NO: 5387981 - DNA, 15 bp, Homo sapiens
catgcatacatgctg

SEQ ID NO: 5387982 - DNA, 15 bp, Homo sapiens
catgcatacttcaaa

SEQ ID NO: 5387983 - DNA, 21 bp, Homo sapiens
catgcatacttcaaaagtatt

SEQ ID NO: 5387984 - DNA, 15 bp, Homo sapiens
catgcatagacaagt

SEQ ID NO: 5387985 - DNA, 20 bp, Homo sapiens
catgcatagagtgtgatgta

SEQ ID NO: 5387986 - DNA, 17 bp, Homo sapiens
catgcatagtcccagct

SEQ ID NO: 5387987 - DNA, 21 bp, Homo sapiens
catgcatatcattaaacaaat

SEQ ID NO: 5387988 - DNA, 23 bp, Homo sapiens
catgcatatcattaaacaaataa

SEQ ID NO: 5387989 - DNA, 13 bp, Homo sapiens
catgcatctgttt

SEQ ID NO: 5387990 - DNA, 22 bp, Homo sapiens
catgcatctgtttattctatag

SEQ ID NO: 5387991 - DNA, 15 bp, Homo sapiens
catgcatgacagcct

SEQ ID NO: 5387992 - DNA, 16 bp, Homo sapiens
catgcatgccctctct

SEQ ID NO: 5387993 - DNA, 15 bp, Homo sapiens
catgcatggaaattc

SEQ ID NO: 5387994 - DNA, 17 bp, Homo sapiens
catgcatggcctcccag

SEQ ID NO: 5387995 - DNA, 20 bp, Homo sapiens
catgcatggcctcccagcca

SEQ ID NO: 5387996 - DNA, 21 bp, Homo sapiens
catgcatgtcctgtaaaggtt

SEQ ID NO: 5387997 - DNA, 19 bp, Homo sapiens
catgcatgttttatgtgca

SEQ ID NO: 5387998 - DNA, 20 bp, Homo sapiens
catgcattcacatatctgct

SEQ ID NO: 5387999 - DNA, 14 bp, Homo sapiens
catgcattcagatc

SEQ ID NO: 5388000 - DNA, 18 bp, Homo sapiens
catgcattctagtgcaga

SEQ ID NO: 5388001 - DNA, 13 bp, Homo sapiens
catgcattgaaaa

SEQ ID NO: 5388002 - DNA, 15 bp, Homo sapiens
catgcattgagctgc

SEQ ID NO: 5388003 - DNA, 17 bp, Homo sapiens
catgcattgagctgcct

SEQ ID NO: 5388004 - DNA, 14 bp, Homo sapiens
catgcattgttggc

SEQ ID NO: 5388005 - DNA, 16 bp, Homo sapiens
catgcatttagcatga

SEQ ID NO: 5388006 - DNA, 13 bp, Homo sapiens
catgcatttctcg

SEQ ID NO: 5388007 - DNA, 18 bp, Homo sapiens
catgcattttatcagaca

SEQ ID NO: 5388008 - DNA, 19 bp, Homo sapiens
catgcattttcttgtatga

SEQ ID NO: 5388009 - DNA, 22 bp, Homo sapiens
catgccaacaagaatgcattga

SEQ ID NO: 5388010 - DNA, 14 bp, Homo sapiens
catgccaacttgtg

SEQ ID NO: 5388011 - DNA, 15 bp, Homo sapiens
catgccaaggcctcc

SEQ ID NO: 5388012 - DNA, 23 bp, Homo sapiens
catgccaaggcctccctcaggct

SEQ ID NO: 5388013 - DNA, 18 bp, Homo sapiens
catgccaataaagtgatc

SEQ ID NO: 5388014 - DNA, 21 bp, Homo sapiens
catgccaataaagtgatctgt

SEQ ID NO: 5388015 - DNA, 19 bp, Homo sapiens
catgccaccacccacccca

SEQ ID NO: 5388016 - DNA, 11 bp, Homo sapiens
catgccaccct

SEQ ID NO: 5388017 - DNA, 18 bp, Homo sapiens
catgccaccctcacacac

SEQ ID NO: 5388018 - DNA, 21 bp, Homo sapiens
catgccacgccccgtgtctgg

SEQ ID NO: 5388019 - DNA, 19 bp, Homo sapiens
catgccactacactccagc

SEQ ID NO: 5388020 - DNA, 13 bp, Homo sapiens
catgccactgcca

SEQ ID NO: 5388021 - DNA, 14 bp, Homo sapiens
catgccactgccag

SEQ ID NO: 5388022 - DNA, 17 bp, Homo sapiens
catgccactgccaggca

SEQ ID NO: 5388023 - DNA, 20 bp, Homo sapiens
catgccactgccaggcacct

SEQ ID NO: 5388024 - DNA, 15 bp, Homo sapiens
catgccactgcctgc

SEQ ID NO: 5388025 - DNA, 22 bp, Homo sapiens
catgccactgcctgcacctttc

SEQ ID NO: 5388026 - DNA, 16 bp, Homo sapiens
catgccagacccactg

SEQ ID NO: 5388027 - DNA, 18 bp, Homo sapiens
catgccagacccactgaa

SEQ ID NO: 5388028 - DNA, 13 bp, Homo sapiens
catgccagagagg

SEQ ID NO: 5388029 - DNA, 13 bp, Homo sapiens
catgccagcagca

SEQ ID NO: 5388030 - DNA, 14 bp, Homo sapiens
catgccagctggcc

SEQ ID NO: 5388031 - DNA, 18 bp, Homo sapiens
catgccagcttcctgtgg

SEQ ID NO: 5388032 - DNA, 18 bp, Homo sapiens
catgccaggacccgccag

SEQ ID NO: 5388033 - DNA, 20 bp, Homo sapiens
catgccaggacccgccagcc

SEQ ID NO: 5388034 - DNA, 23 bp, Homo sapiens
catgccaggacccgccagccccg

SEQ ID NO: 5388035 - DNA, 18 bp, Homo sapiens
catgccaggctaattttt

SEQ ID NO: 5388036 - DNA, 14 bp, Homo sapiens
catgccaggggcct

SEQ ID NO: 5388037 - DNA, 21 bp, Homo sapiens
catgccaggttaggaaggcag

SEQ ID NO: 5388038 - DNA, 19 bp, Homo sapiens
catgccagtaactgtgctg

SEQ ID NO: 5388039 - DNA, 14 bp, Homo sapiens
catgccagtgcatg

SEQ ID NO: 5388040 - DNA, 18 bp, Homo sapiens
catgccatccattctgcc

SEQ ID NO: 5388041 - DNA, 16 bp, Homo sapiens
catgccatctgttttc

SEQ ID NO: 5388042 - DNA, 14 bp, Homo sapiens
catgccatgaatga

SEQ ID NO: 5388043 - DNA, 19 bp, Homo sapiens
catgccatggtctttgcta

SEQ ID NO: 5388044 - DNA, 21 bp, Homo sapiens
catgccattctgcctcagcct

SEQ ID NO: 5388045 - DNA, 16 bp, Homo sapiens
catgcccaaggcctag

SEQ ID NO: 5388046 - DNA, 13 bp, Homo sapiens
catgcccaccatc

SEQ ID NO: 5388047 - DNA, 15 bp, Homo sapiens
catgcccaccccctg

SEQ ID NO: 5388048 - DNA, 16 bp, Homo sapiens
catgcccaccccctgc

SEQ ID NO: 5388049 - DNA, 20 bp, Homo sapiens
catgcccaccccctgccctg

SEQ ID NO: 5388050 - DNA, 17 bp, Homo sapiens
catgcccacctgcccat

SEQ ID NO: 5388051 - DNA, 13 bp, Homo sapiens
catgcccactccc

SEQ ID NO: 5388052 - DNA, 18 bp, Homo sapiens
catgcccactcccccagg

SEQ ID NO: 5388053 - DNA, 22 bp, Homo sapiens
catgcccactcccccaggagca

SEQ ID NO: 5388054 - DNA, 20 bp, Homo sapiens
catgcccactgctggtgcca

SEQ ID NO: 5388055 - DNA, 23 bp, Homo sapiens
catgcccactgctggtgccaggg

SEQ ID NO: 5388056 - DNA, 16 bp, Homo sapiens
catgcccagagaccca

SEQ ID NO: 5388057 - DNA, 17 bp, Homo sapiens
catgcccagagacccag

SEQ ID NO: 5388058 - DNA, 19 bp, Homo sapiens
catgcccagattcccagac

SEQ ID NO: 5388059 - DNA, 15 bp, Homo sapiens
catgcccagctctct

SEQ ID NO: 5388060 - DNA, 13 bp, Homo sapiens
catgcccagcttg

SEQ ID NO: 5388061 - DNA, 15 bp, Homo sapiens
catgcccagcttgga

SEQ ID NO: 5388062 - DNA, 22 bp, Homo sapiens
catgcccagcttggagtgccac

SEQ ID NO: 5388063 - DNA, 22 bp, Homo sapiens
catgcccagtcgatatctcact

SEQ ID NO: 5388064 - DNA, 14 bp, Homo sapiens
catgccccacccac

SEQ ID NO: 5388065 - DNA, 16 bp, Homo sapiens
catgccccacccaccc

SEQ ID NO: 5388066 - DNA, 20 bp, Homo sapiens
catgccccacccacccctcc

SEQ ID NO: 5388067 - DNA, 19 bp, Homo sapiens
catgccccacccccctcct

SEQ ID NO: 5388068 - DNA, 23 bp, Homo sapiens
catgccccacccccctcctcccc

SEQ ID NO: 5388069 - DNA, 12 bp, Homo sapiens
catgccccactc

SEQ ID NO: 5388070 - DNA, 17 bp, Homo sapiens
catgccccactctgctg

SEQ ID NO: 5388071 - DNA, 21 bp, Homo sapiens
catgccccactctgctgaggc

SEQ ID NO: 5388072 - DNA, 17 bp, Homo sapiens
catgccccagcccaccc

SEQ ID NO: 5388073 - DNA, 14 bp, Homo sapiens
catgccccaggctc

SEQ ID NO: 5388074 - DNA, 13 bp, Homo sapiens
catgccccagtcg

SEQ ID NO: 5388075 - DNA, 14 bp, Homo sapiens
catgcccccctcaa

SEQ ID NO: 5388076 - DNA, 17 bp, Homo sapiens
catgcccccgccacctc

SEQ ID NO: 5388077 - DNA, 23 bp, Homo sapiens
catgcccccgccacctccccact

SEQ ID NO: 5388078 - DNA, 17 bp, Homo sapiens
catggcactccctccag

SEQ ID NO: 5388079 - DNA, 19 bp, Homo sapiens
catggcactccctccagca

SEQ ID NO: 5388080 - DNA, 21 bp, Homo sapiens
catggcactccctccagcaca

SEQ ID NO: 5388081 - DNA, 21 bp, Homo sapiens
catggcagaagcgtctccctt

SEQ ID NO: 5388082 - DNA, 13 bp, Homo sapiens
catggcagaaggc

SEQ ID NO: 5388083 - DNA, 22 bp, Homo sapiens
catggcagaataatctttgggt

SEQ ID NO: 5388084 - DNA, 18 bp, Homo sapiens
catggcagagtttgtgtg

SEQ ID NO: 5388085 - DNA, 19 bp, Homo sapiens
catggcagatgtaggaggg

SEQ ID NO: 5388086 - DNA, 21 bp, Homo sapiens
catggcagatgtaggagggac

SEQ ID NO: 5388087 - DNA, 15 bp, Homo sapiens
catggcagcagccag

SEQ ID NO: 5388088 - DNA, 14 bp, Homo sapiens
catggcagctgggc

SEQ ID NO: 5388089 - DNA, 13 bp, Homo sapiens
catggcaggaagg

SEQ ID NO: 5388090 - DNA, 18 bp, Homo sapiens
catggcaggacagctcct

SEQ ID NO: 5388091 - DNA, 20 bp, Homo sapiens
catggcaggagtctctgcca

SEQ ID NO: 5388092 - DNA, 21 bp, Homo sapiens
catggcaggcatctgtaagaa

SEQ ID NO: 5388093 - DNA, 14 bp, Homo sapiens
catggcaggctggg

SEQ ID NO: 5388094 - DNA, 13 bp, Homo sapiens
catggcagggcca

SEQ ID NO: 5388095 - DNA, 15 bp, Homo sapiens
catggcagggcctca

SEQ ID NO: 5388096 - DNA, 16 bp, Homo sapiens
catggcagggcctcat

SEQ ID NO: 5388097 - DNA, 17 bp, Homo sapiens
catggcagggcctcatc

SEQ ID NO: 5388098 - DNA, 18 bp, Homo sapiens
catggcagggcctcatct

SEQ ID NO: 5388099 - DNA, 19 bp, Homo sapiens
catggcagggcctcatctc

SEQ ID NO: 5388100 - DNA, 13 bp, Homo sapiens
catggcagggggc

SEQ ID NO: 5388101 - DNA, 20 bp, Homo sapiens
catggcagggggctgctgct

SEQ ID NO: 5388102 - DNA, 23 bp, Homo sapiens
catggcagtgggaaaaatgtagg

SEQ ID NO: 5388103 - DNA, 15 bp, Homo sapiens
catggcatattttaa

SEQ ID NO: 5388104 - DNA, 15 bp, Homo sapiens
catggcatatttttc

SEQ ID NO: 5388105 - DNA, 19 bp, Homo sapiens
catggcatatttttcacat

SEQ ID NO: 5388106 - DNA, 23 bp, Homo sapiens
catggcatatttttcacatatct

SEQ ID NO: 5388107 - DNA, 18 bp, Homo sapiens
catggcatgcttaaattt

SEQ ID NO: 5388108 - DNA, 19 bp, Homo sapiens
catggcatgcttaaatttt

SEQ ID NO: 5388109 - DNA, 21 bp, Homo sapiens
catggcatgggggcctcaggg

SEQ ID NO: 5388110 - DNA, 15 bp, Homo sapiens
catggcatgtctttg

SEQ ID NO: 5388111 - DNA, 14 bp, Homo sapiens
catggcatgtgaaa

SEQ ID NO: 5388112 - DNA, 22 bp, Homo sapiens
catggccaaggggccagctgcc

SEQ ID NO: 5388113 - DNA, 16 bp, Homo sapiens
catggccacaaaggga

SEQ ID NO: 5388114 - DNA, 16 bp, Homo sapiens
catggccacactgtga

SEQ ID NO: 5388115 - DNA, 22 bp, Homo sapiens
catggccacactgtgacacact

SEQ ID NO: 5388116 - DNA, 12 bp, Homo sapiens
catggccacagc

SEQ ID NO: 5388117 - DNA, 13 bp, Homo sapiens
catggccacagcc

SEQ ID NO: 5388118 - DNA, 13 bp, Homo sapiens
catggccacatcc

SEQ ID NO: 5388119 - DNA, 19 bp, Homo sapiens
catggccacatcctcatgg

SEQ ID NO: 5388120 - DNA, 18 bp, Homo sapiens
catggccaccttttcagc

SEQ ID NO: 5388121 - DNA, 19 bp, Homo sapiens
catggccagactcccttgc

SEQ ID NO: 5388122 - DNA, 13 bp, Homo sapiens
catggccagcagc

SEQ ID NO: 5388123 - DNA, 14 bp, Homo sapiens
catggccagctgga

SEQ ID NO: 5388124 - DNA, 20 bp, Homo sapiens
catggccagctggaggcagg

SEQ ID NO: 5388125 - DNA, 13 bp, Homo sapiens
catggccaggagt

SEQ ID NO: 5388126 - DNA, 15 bp, Homo sapiens
catggccaggtggcc

SEQ ID NO: 5388127 - DNA, 16 bp, Homo sapiens
catggccatagaggcc

SEQ ID NO: 5388128 - DNA, 18 bp, Homo sapiens
catggccattcagcacag

SEQ ID NO: 5388129 - DNA, 12 bp, Homo sapiens
catggcccagca

SEQ ID NO: 5388130 - DNA, 21 bp, Homo sapiens
catggcccagcagcttggctg

SEQ ID NO: 5388131 - DNA, 20 bp, Homo sapiens
catggcccagcctggagccg

SEQ ID NO: 5388132 - DNA, 23 bp, Homo sapiens
catggcccatcactcggctgtgg

SEQ ID NO: 5388133 - DNA, 20 bp, Homo sapiens
catggcccatcaggggcagg

SEQ ID NO: 5388134 - DNA, 23 bp, Homo sapiens
catggcccattggagcacctggg

SEQ ID NO: 5388135 - DNA, 15 bp, Homo sapiens
catggccccagctgg

SEQ ID NO: 5388136 - DNA, 17 bp, Homo sapiens
catggccccagctggct

SEQ ID NO: 5388137 - DNA, 15 bp, Homo sapiens
catggccccaggccc

SEQ ID NO: 5388138 - DNA, 14 bp, Homo sapiens
catggcccccaata

SEQ ID NO: 5388139 - DNA, 15 bp, Homo sapiens
catggcccccaataa

SEQ ID NO: 5388140 - DNA, 18 bp, Homo sapiens
catggcccccaataaagg

SEQ ID NO: 5388141 - DNA, 19 bp, Homo sapiens
catggcccccaataaaggc

SEQ ID NO: 5388142 - DNA, 20 bp, Homo sapiens
catggcccccaataaaggca

SEQ ID NO: 5388143 - DNA, 16 bp, Homo sapiens
catggcccccaggggc

SEQ ID NO: 5388144 - DNA, 18 bp, Homo sapiens
catggcccccaggggcag

SEQ ID NO: 5388145 - DNA, 22 bp, Homo sapiens
catggcccccaggggcaggact

SEQ ID NO: 5388146 - DNA, 23 bp, Homo sapiens
catggcccccaggggcaggactg

SEQ ID NO: 5388147 - DNA, 17 bp, Homo sapiens
catggccccccactccc

SEQ ID NO: 5388148 - DNA, 14 bp, Homo sapiens
catggcccctccag

SEQ ID NO: 5388149 - DNA, 17 bp, Homo sapiens
catggcccctctgacct

SEQ ID NO: 5388150 - DNA, 15 bp, Homo sapiens
catggcccgggcctt

SEQ ID NO: 5388151 - DNA, 22 bp, Homo sapiens
catggccctcattaatgacact

SEQ ID NO: 5388152 - DNA, 14 bp, Homo sapiens
catggccctcccag

SEQ ID NO: 5388153 - DNA, 15 bp, Homo sapiens
catggccctcggagg

SEQ ID NO: 5388154 - DNA, 16 bp, Homo sapiens
catggccctgctgccc

SEQ ID NO: 5388155 - DNA, 16 bp, Homo sapiens
catggccctgtcccag

SEQ ID NO: 5388156 - DNA, 18 bp, Homo sapiens
catggcccttcctggact

SEQ ID NO: 5388157 - DNA, 21 bp, Homo sapiens
catggccgcaacttcccaggc

SEQ ID NO: 5388158 - DNA, 22 bp, Homo sapiens
catggccgcgtcacttctctga

SEQ ID NO: 5388159 - DNA, 15 bp, Homo sapiens
catggccgcttctag

SEQ ID NO: 5388160 - DNA, 17 bp, Homo sapiens
catggccggctttcagg

SEQ ID NO: 5388161 - DNA, 22 bp, Homo sapiens
catggccggctttcaggagctc

SEQ ID NO: 5388162 - DNA, 18 bp, Homo sapiens
catggcctcagccctgct

SEQ ID NO: 5388163 - DNA, 18 bp, Homo sapiens
catggcctccagaggagg

SEQ ID NO: 5388164 - DNA, 14 bp, Homo sapiens
catggcctcccagc

SEQ ID NO: 5388165 - DNA, 17 bp, Homo sapiens
catggcctcccagccac

SEQ ID NO: 5388166 - DNA, 23 bp, Homo sapiens
catggcctctaagagtgcccgtg

SEQ ID NO: 5388167 - DNA, 14 bp, Homo sapiens
catggcctctgcaa

SEQ ID NO: 5388168 - DNA, 19 bp, Homo sapiens
catggcctgcaaactggga

SEQ ID NO: 5388169 - DNA, 14 bp, Homo sapiens
catggcctgctggg

SEQ ID NO: 5388170 - DNA, 22 bp, Homo sapiens
catggcctggactgactgcagc

SEQ ID NO: 5388171 - DNA, 13 bp, Homo sapiens
catggcctgtgct

SEQ ID NO: 5388172 - DNA, 19 bp, Homo sapiens
catggccttatgaggcagg

SEQ ID NO: 5388173 - DNA, 21 bp, Homo sapiens
catggccttccacgtcttcct

SEQ ID NO: 5388174 - DNA, 12 bp, Homo sapiens
catggccttccc

SEQ ID NO: 5388175 - DNA, 14 bp, Homo sapiens
catggccttccctc

SEQ ID NO: 5388176 - DNA, 21 bp, Homo sapiens
catggcgaaaacatctcctta

SEQ ID NO: 5388177 - DNA, 16 bp, Homo sapiens
catggcgacactaaag

SEQ ID NO: 5388178 - DNA, 17 bp, Homo sapiens
catggcgccctgcctcc

SEQ ID NO: 5388179 - DNA, 20 bp, Homo sapiens
catggcggcacacatctgta

SEQ ID NO: 5388180 - DNA, 18 bp, Homo sapiens
catggcggcccctcagcc

SEQ ID NO: 5388181 - DNA, 22 bp, Homo sapiens
catggcggcccctcagcctgcc

SEQ ID NO: 5388182 - DNA, 17 bp, Homo sapiens
catggcgggactggaga

SEQ ID NO: 5388183 - DNA, 18 bp, Homo sapiens
catggcgggactggagaa

SEQ ID NO: 5388184 - DNA, 17 bp, Homo sapiens
catggcgtaatgggcct

SEQ ID NO: 5388185 - DNA, 21 bp, Homo sapiens
catggcgtaatgggcctgccc

SEQ ID NO: 5388186 - DNA, 22 bp, Homo sapiens
catggctaagcttaaaaaaaac

SEQ ID NO: 5388187 - DNA, 15 bp, Homo sapiens
catggctaagcttta

SEQ ID NO: 5388188 - DNA, 16 bp, Homo sapiens
catggctaaggcacca

SEQ ID NO: 5388189 - DNA, 18 bp, Homo sapiens
catggctaaggcaccagc

SEQ ID NO: 5388190 - DNA, 22 bp, Homo sapiens
catggctaaggcaccagccggg

SEQ ID NO: 5388191 - DNA, 13 bp, Homo sapiens
catggctacctca

SEQ ID NO: 5388192 - DNA, 14 bp, Homo sapiens
catggctattttat

SEQ ID NO: 5388193 - DNA, 15 bp, Homo sapiens
catggctattttata

SEQ ID NO: 5388194 - DNA, 16 bp, Homo sapiens
catggctcaggcaagc

SEQ ID NO: 5388195 - DNA, 20 bp, Homo sapiens
catggctcaggcaagcccct

SEQ ID NO: 5388196 - DNA, 17 bp, Homo sapiens
catggctccagaaatgt

SEQ ID NO: 5388197 - DNA, 13 bp, Homo sapiens
catggctccagtc

SEQ ID NO: 5388198 - DNA, 22 bp, Homo sapiens
catggctccagtctgctgccct

SEQ ID NO: 5388199 - DNA, 21 bp, Homo sapiens
catggctctatttcttcttca

SEQ ID NO: 5388200 - DNA, 20 bp, Homo sapiens
catggctctgaactgcacaa

SEQ ID NO: 5388201 - DNA, 16 bp, Homo sapiens
catggctcttagaaac

SEQ ID NO: 5388202 - DNA, 16 bp, Homo sapiens
catggctgagctgccc

SEQ ID NO: 5388203 - DNA, 19 bp, Homo sapiens
catggctgatcattaatta

SEQ ID NO: 5388204 - DNA, 18 bp, Homo sapiens
catggctgctgttgctta

SEQ ID NO: 5388205 - DNA, 16 bp, Homo sapiens
catggctggatgtgca

SEQ ID NO: 5388206 - DNA, 21 bp, Homo sapiens
catggctggatgtgcatctgg

SEQ ID NO: 5388207 - DNA, 15 bp, Homo sapiens
catggctggcctggt

SEQ ID NO: 5388208 - DNA, 21 bp, Homo sapiens
catggctgggaactgcagacc

SEQ ID NO: 5388209 - DNA, 23 bp, Homo sapiens
catggctgggaactgcagacctg

SEQ ID NO: 5388210 - DNA, 17 bp, Homo sapiens
catggctgggggaggga

SEQ ID NO: 5388211 - DNA, 21 bp, Homo sapiens
catggctggggggtctcagca

SEQ ID NO: 5388212 - DNA, 14 bp, Homo sapiens
catggctgtgacac

SEQ ID NO: 5388213 - DNA, 20 bp, Homo sapiens
catggctgtgtttgcagcct

SEQ ID NO: 5388214 - DNA, 23 bp, Homo sapiens
catggctgtgtttgcagcctgct

SEQ ID NO: 5388215 - DNA, 17 bp, Homo sapiens
catggcttaatgcttct

SEQ ID NO: 5388216 - DNA, 17 bp, Homo sapiens
catggcttaatgtttat

SEQ ID NO: 5388217 - DNA, 14 bp, Homo sapiens
catggcttcctcct

SEQ ID NO: 5388218 - DNA, 18 bp, Homo sapiens
catggcttcctcctccct

SEQ ID NO: 5388219 - DNA, 15 bp, Homo sapiens
catggcttctccttt

SEQ ID NO: 5388220 - DNA, 16 bp, Homo sapiens
catggcttctcctttg

SEQ ID NO: 5388221 - DNA, 21 bp, Homo sapiens
catggcttctcctttggcatg

SEQ ID NO: 5388222 - DNA, 13 bp, Homo sapiens
catggcttctgaa

SEQ ID NO: 5388223 - DNA, 12 bp, Homo sapiens
catggcttgggc

SEQ ID NO: 5388224 - DNA, 17 bp, Homo sapiens
catggcttggggagcag

SEQ ID NO: 5388225 - DNA, 20 bp, Homo sapiens
catggcttggggagcagagt

SEQ ID NO: 5388226 - DNA, 21 bp, Homo sapiens
catggcttgttctctggaacc

SEQ ID NO: 5388227 - DNA, 22 bp, Homo sapiens
catggctttcatcctgtgtccc

SEQ ID NO: 5388228 - DNA, 14 bp, Homo sapiens
catggctttttctt

SEQ ID NO: 5388229 - DNA, 14 bp, Homo sapiens
catgggaaaaagag

SEQ ID NO: 5388230 - DNA, 17 bp, Homo sapiens
catgggaaaaagagact

SEQ ID NO: 5388231 - DNA, 20 bp, Homo sapiens
catgggaaaagaccagggct

SEQ ID NO: 5388232 - DNA, 23 bp, Homo sapiens
catgggaaacgtatgtgtgcagg

SEQ ID NO: 5388233 - DNA, 17 bp, Homo sapiens
catgggaaactttccct

SEQ ID NO: 5388234 - DNA, 18 bp, Homo sapiens
catgggaaaggggaagtt

SEQ ID NO: 5388235 - DNA, 18 bp, Homo sapiens
catgggaaatgagccagc

SEQ ID NO: 5388236 - DNA, 18 bp, Homo sapiens
catgggaacgcagcctcc

SEQ ID NO: 5388237 - DNA, 19 bp, Homo sapiens
catgggaagacgaggccct

SEQ ID NO: 5388238 - DNA, 20 bp, Homo sapiens
catgggaagacgaggccctc

SEQ ID NO: 5388239 - DNA, 16 bp, Homo sapiens
catgggaaggggagga

SEQ ID NO: 5388240 - DNA, 18 bp, Homo sapiens
catgggaagtcctggcac

SEQ ID NO: 5388241 - DNA, 16 bp, Homo sapiens
catgggaatgaatgtc

SEQ ID NO: 5388242 - DNA, 18 bp, Homo sapiens
catgggaatgaatgtcag

SEQ ID NO: 5388243 - DNA, 22 bp, Homo sapiens
catgggaatgaatgtcagtgtg

SEQ ID NO: 5388244 - DNA, 16 bp, Homo sapiens
catgggaattttaact

SEQ ID NO: 5388245 - DNA, 22 bp, Homo sapiens
catgggacctataactgcccag

SEQ ID NO: 5388246 - DNA, 23 bp, Homo sapiens
catgggactttccttccctctcc

SEQ ID NO: 5388247 - DNA, 15 bp, Homo sapiens
catgggagaagaggg

SEQ ID NO: 5388248 - DNA, 12 bp, Homo sapiens
catgggagagtc

SEQ ID NO: 5388249 - DNA, 16 bp, Homo sapiens
catgggagagtccagg

SEQ ID NO: 5388250 - DNA, 17 bp, Homo sapiens
catgggagagtccaggc

SEQ ID NO: 5388251 - DNA, 13 bp, Homo sapiens
catgggagccagc

SEQ ID NO: 5388252 - DNA, 17 bp, Homo sapiens
catgggagccagctgct

SEQ ID NO: 5388253 - DNA, 21 bp, Homo sapiens
catgggagctggttagaaatg

SEQ ID NO: 5388254 - DNA, 21 bp, Homo sapiens
catgggaggaaggcccagggg

SEQ ID NO: 5388255 - DNA, 23 bp, Homo sapiens
catgtagccccagtcagaagttc

SEQ ID NO: 5388256 - DNA, 13 bp, Homo sapiens
catgtagccccct

SEQ ID NO: 5388257 - DNA, 17 bp, Homo sapiens
catgtagccccctggcc

SEQ ID NO: 5388258 - DNA, 21 bp, Homo sapiens
catgtagccccctggcctctg

SEQ ID NO: 5388259 - DNA, 18 bp, Homo sapiens
catgtagctggcaagctg

SEQ ID NO: 5388260 - DNA, 15 bp, Homo sapiens
catgtagcttcttct

SEQ ID NO: 5388261 - DNA, 17 bp, Homo sapiens
catgtagcttcttctga

SEQ ID NO: 5388262 - DNA, 16 bp, Homo sapiens
catgtaggaccctgca

SEQ ID NO: 5388263 - DNA, 14 bp, Homo sapiens
catgtaggctaaga

SEQ ID NO: 5388264 - DNA, 18 bp, Homo sapiens
catgtaggtgagcctggg

SEQ ID NO: 5388265 - DNA, 23 bp, Homo sapiens
catgtaggtgagcctgggcagct

SEQ ID NO: 5388266 - DNA, 16 bp, Homo sapiens
catgtagtaacactaa

SEQ ID NO: 5388267 - DNA, 18 bp, Homo sapiens
catgtagtatcaaatatt

SEQ ID NO: 5388268 - DNA, 21 bp, Homo sapiens
catgtataaatataagtctat

SEQ ID NO: 5388269 - DNA, 23 bp, Homo sapiens
catgtataaatgaagtttataca

SEQ ID NO: 5388270 - DNA, 14 bp, Homo sapiens
catgtataaatgtg

SEQ ID NO: 5388271 - DNA, 15 bp, Homo sapiens
catgtataaccaagt

SEQ ID NO: 5388272 - DNA, 17 bp, Homo sapiens
catgtataattttctac

SEQ ID NO: 5388273 - DNA, 22 bp, Homo sapiens
catgtataatttttttcttgta

SEQ ID NO: 5388274 - DNA, 21 bp, Homo sapiens
catgtatagtgagtgtggctt

SEQ ID NO: 5388275 - DNA, 15 bp, Homo sapiens
catgtatagttagaa

SEQ ID NO: 5388276 - DNA, 15 bp, Homo sapiens
catgtatcactcact

SEQ ID NO: 5388277 - DNA, 18 bp, Homo sapiens
catgtatcactcactgcc

SEQ ID NO: 5388278 - DNA, 19 bp, Homo sapiens
catgtatcataattaccaa

SEQ ID NO: 5388279 - DNA, 15 bp, Homo sapiens
catgtatcatctgga

SEQ ID NO: 5388280 - DNA, 16 bp, Homo sapiens
catgtatcctttcaca

SEQ ID NO: 5388281 - DNA, 19 bp, Homo sapiens
catgtatctctctgtggtg

SEQ ID NO: 5388282 - DNA, 22 bp, Homo sapiens
catgtatctctctgtggtggtt

SEQ ID NO: 5388283 - DNA, 15 bp, Homo sapiens
catgtatctgtctac

SEQ ID NO: 5388284 - DNA, 16 bp, Homo sapiens
catgtatctgtctact

SEQ ID NO: 5388285 - DNA, 22 bp, Homo sapiens
catgtatctgtctactttctct

SEQ ID NO: 5388286 - DNA, 19 bp, Homo sapiens
catgtatgagtgtatgtgt

SEQ ID NO: 5388287 - DNA, 15 bp, Homo sapiens
catgtatgatttctg

SEQ ID NO: 5388288 - DNA, 13 bp, Homo sapiens
catgtatgcaagt

SEQ ID NO: 5388289 - DNA, 12 bp, Homo sapiens
catgtatggcca

SEQ ID NO: 5388290 - DNA, 15 bp, Homo sapiens
catgtatggccagga

SEQ ID NO: 5388291 - DNA, 19 bp, Homo sapiens
catgtatggttactaaaaa

SEQ ID NO: 5388292 - DNA, 17 bp, Homo sapiens
catgtatgtaaatagct

SEQ ID NO: 5388293 - DNA, 22 bp, Homo sapiens
catgtatgtcagaagtgcagaa

SEQ ID NO: 5388294 - DNA, 21 bp, Homo sapiens
catgtatgtggatacagtcat

SEQ ID NO: 5388295 - DNA, 22 bp, Homo sapiens
catgtatgtggatacagtcatt

SEQ ID NO: 5388296 - DNA, 11 bp, Homo sapiens
catgtatgtgt

SEQ ID NO: 5388297 - DNA, 13 bp, Homo sapiens
catgtatgttatg

SEQ ID NO: 5388298 - DNA, 12 bp, Homo sapiens
catgtatgtttt

SEQ ID NO: 5388299 - DNA, 12 bp, Homo sapiens
catgtattaaat

SEQ ID NO: 5388300 - DNA, 20 bp, Homo sapiens
catgtattaaattacatttg

SEQ ID NO: 5388301 - DNA, 22 bp, Homo sapiens
catgtattaaattacatttgta

SEQ ID NO: 5388302 - DNA, 19 bp, Homo sapiens
catgtattagccagtcatt

SEQ ID NO: 5388303 - DNA, 20 bp, Homo sapiens
catgtattagctcactgaat

SEQ ID NO: 5388304 - DNA, 16 bp, Homo sapiens
catgtattatcacatc

SEQ ID NO: 5388305 - DNA, 14 bp, Homo sapiens
catgtattcacaca

SEQ ID NO: 5388306 - DNA, 14 bp, Homo sapiens
catgtattcactaa

SEQ ID NO: 5388307 - DNA, 23 bp, Homo sapiens
catgtattcatccagagttctta

SEQ ID NO: 5388308 - DNA, 14 bp, Homo sapiens
catgtattccctta

SEQ ID NO: 5388309 - DNA, 22 bp, Homo sapiens
catgtattctgttggccagcac

SEQ ID NO: 5388310 - DNA, 14 bp, Homo sapiens
catgtattggcctg

SEQ ID NO: 5388311 - DNA, 15 bp, Homo sapiens
catgtattggcctgg

SEQ ID NO: 5388312 - DNA, 17 bp, Homo sapiens
catgtattggcctggag

SEQ ID NO: 5388313 - DNA, 21 bp, Homo sapiens
catgtattgtaaacagaagga

SEQ ID NO: 5388314 - DNA, 14 bp, Homo sapiens
catgtattgtgtct

SEQ ID NO: 5388315 - DNA, 15 bp, Homo sapiens
catgtatttatctct

SEQ ID NO: 5388316 - DNA, 15 bp, Homo sapiens
catgtatttatgtaa

SEQ ID NO: 5388317 - DNA, 19 bp, Homo sapiens
catgtatttcagggacctc

SEQ ID NO: 5388318 - DNA, 20 bp, Homo sapiens
catgtatttcagggacctca

SEQ ID NO: 5388319 - DNA, 15 bp, Homo sapiens
catgtatttgagcat

SEQ ID NO: 5388320 - DNA, 18 bp, Homo sapiens
catgtatttgtttgcata

SEQ ID NO: 5388321 - DNA, 15 bp, Homo sapiens
catgtattttgtaaa

SEQ ID NO: 5388322 - DNA, 19 bp, Homo sapiens
catgtattttgtaaactga

SEQ ID NO: 5388323 - DNA, 20 bp, Homo sapiens
catgtcaaacatgagatgtg

SEQ ID NO: 5388324 - DNA, 19 bp, Homo sapiens
catgtcaacttttgactaa

SEQ ID NO: 5388325 - DNA, 21 bp, Homo sapiens
catgtcaagaggaaaagctgt

SEQ ID NO: 5388326 - DNA, 21 bp, Homo sapiens
catgtcaagagtcgctgtgcc

SEQ ID NO: 5388327 - DNA, 18 bp, Homo sapiens
catgtcaagggttcaaga

SEQ ID NO: 5388328 - DNA, 21 bp, Homo sapiens
catgtcacatgacatccacat

SEQ ID NO: 5388329 - DNA, 12 bp, Homo sapiens
catgtcacatgc

SEQ ID NO: 5388330 - DNA, 23 bp, Homo sapiens
catgtcaccggtcagtgcctttt

SEQ ID NO: 5388331 - DNA, 22 bp, Homo sapiens
catgtcaccgtggaccttcctg

SEQ ID NO: 5388332 - DNA, 13 bp, Homo sapiens
catgtcacctcag

SEQ ID NO: 5388333 - DNA, 14 bp, Homo sapiens
catgtcacctcagc

SEQ ID NO: 5388334 - DNA, 14 bp, Homo sapiens
catgtcactcccag

SEQ ID NO: 5388335 - DNA, 17 bp, Homo sapiens
catgtcagaggacccca

SEQ ID NO: 5388336 - DNA, 20 bp, Homo sapiens
catgtcagcaaaaagcaaaa

SEQ ID NO: 5388337 - DNA, 22 bp, Homo sapiens
catgtcagcaaaaagcaaaatc

SEQ ID NO: 5388338 - DNA, 21 bp, Homo sapiens
catgtcagttggccctttaat

SEQ ID NO: 5388339 - DNA, 21 bp, Homo sapiens
catgtcatccgagcaaggtgg

SEQ ID NO: 5388340 - DNA, 16 bp, Homo sapiens
catgtcattatgacat

SEQ ID NO: 5388341 - DNA, 22 bp, Homo sapiens
catgtcattgcccacttctgtg

SEQ ID NO: 5388342 - DNA, 18 bp, Homo sapiens
catgtcatttcagaagtt

SEQ ID NO: 5388343 - DNA, 13 bp, Homo sapiens
catgtcatttgca

SEQ ID NO: 5388344 - DNA, 21 bp, Homo sapiens
catgtcatttgcacacaaaaa

SEQ ID NO: 5388345 - DNA, 19 bp, Homo sapiens
catgtccaaacccatcttc

SEQ ID NO: 5388346 - DNA, 16 bp, Homo sapiens
catgtccaaagaggct

SEQ ID NO: 5388347 - DNA, 21 bp, Homo sapiens
catgtccaaagaggctgcccc

SEQ ID NO: 5388348 - DNA, 16 bp, Homo sapiens
catgtccaagaagccc

SEQ ID NO: 5388349 - DNA, 19 bp, Homo sapiens
catgtccaagaagcccagg

SEQ ID NO: 5388350 - DNA, 17 bp, Homo sapiens
catgtccacgtgtgtgt

SEQ ID NO: 5388351 - DNA, 22 bp, Homo sapiens
catgtccagagggactggacag

SEQ ID NO: 5388352 - DNA, 21 bp, Homo sapiens
catgtccagcaccttgtgcct

SEQ ID NO: 5388353 - DNA, 19 bp, Homo sapiens
catgtccatacactttgtt

SEQ ID NO: 5388354 - DNA, 13 bp, Homo sapiens
catgtccatccct

SEQ ID NO: 5388355 - DNA, 13 bp, Homo sapiens
catgtcccagatc

SEQ ID NO: 5388356 - DNA, 20 bp, Homo sapiens
catgtccccaaacctgcaag

SEQ ID NO: 5388357 - DNA, 13 bp, Homo sapiens
catgtccccctgt

SEQ ID NO: 5388358 - DNA, 16 bp, Homo sapiens
catgtccccttcctgt

SEQ ID NO: 5388359 - DNA, 17 bp, Homo sapiens
catgtccctacacccct

SEQ ID NO: 5388360 - DNA, 15 bp, Homo sapiens
catgtccctccaggg

SEQ ID NO: 5388361 - DNA, 18 bp, Homo sapiens
catgtcctaattcttctg

SEQ ID NO: 5388362 - DNA, 19 bp, Homo sapiens
catgtcctaattcttctgt

SEQ ID NO: 5388363 - DNA, 20 bp, Homo sapiens
catgtcctatagtttgtcat

SEQ ID NO: 5388364 - DNA, 15 bp, Homo sapiens
catgtcctatccctg

SEQ ID NO: 5388365 - DNA, 16 bp, Homo sapiens
catgtcctatgtgtga

SEQ ID NO: 5388366 - DNA, 18 bp, Homo sapiens
catgtcctatgtgtgact

SEQ ID NO: 5388367 - DNA, 16 bp, Homo sapiens
catgtcctgctggctt

SEQ ID NO: 5388368 - DNA, 17 bp, Homo sapiens
catgtcctgctggcttc

SEQ ID NO: 5388369 - DNA, 21 bp, Homo sapiens
catgtcctgctggcttccagc

SEQ ID NO: 5388370 - DNA, 14 bp, Homo sapiens
catgtcctgtaaag

SEQ ID NO: 5388371 - DNA, 15 bp, Homo sapiens
catgtcctgtcctgg

SEQ ID NO: 5388372 - DNA, 19 bp, Homo sapiens
catgtcctgtgtcagttta

SEQ ID NO: 5388373 - DNA, 22 bp, Homo sapiens
catgtccttgtgtgttttgaga

SEQ ID NO: 5388374 - DNA, 18 bp, Homo sapiens
catgtcctttccatctgt

SEQ ID NO: 5388375 - DNA, 22 bp, Homo sapiens
catgtcctttccatctgtccac

SEQ ID NO: 5388376 - DNA, 15 bp, Homo sapiens
catgtcgcacaatgt

SEQ ID NO: 5388377 - DNA, 19 bp, Homo sapiens
catgtcgccaaaaatacag

SEQ ID NO: 5388378 - DNA, 13 bp, Homo sapiens
catgtcgcctgcc

SEQ ID NO: 5388379 - DNA, 20 bp, Homo sapiens
catgtcgcctgcccccagca

SEQ ID NO: 5388380 - DNA, 21 bp, Homo sapiens
catgtcgctagccagtgctcc

SEQ ID NO: 5388381 - DNA, 17 bp, Homo sapiens
catgtcggagtagaaat

SEQ ID NO: 5388382 - DNA, 19 bp, Homo sapiens
catgtcggggcccctgcgt

SEQ ID NO: 5388383 - DNA, 14 bp, Homo sapiens
catgtctaattcat

SEQ ID NO: 5388384 - DNA, 19 bp, Homo sapiens
catgtctaattcatttact

SEQ ID NO: 5388385 - DNA, 12 bp, Homo sapiens
catgtctactgc

SEQ ID NO: 5388386 - DNA, 13 bp, Homo sapiens
catgtctactttt

SEQ ID NO: 5388387 - DNA, 18 bp, Homo sapiens
catgtctatgctccctct

SEQ ID NO: 5388388 - DNA, 16 bp, Homo sapiens
catgtctattcagctt

SEQ ID NO: 5388389 - DNA, 15 bp, Homo sapiens
catgtctatttttga

SEQ ID NO: 5388390 - DNA, 13 bp, Homo sapiens
catgtctcagatt

SEQ ID NO: 5388391 - DNA, 19 bp, Homo sapiens
catgtctcagcctcctcag

SEQ ID NO: 5388392 - DNA, 16 bp, Homo sapiens
catgtctcctactgag

SEQ ID NO: 5388393 - DNA, 12 bp, Homo sapiens
catgtctctctg

SEQ ID NO: 5388394 - DNA, 17 bp, Homo sapiens
catgtctctctgccaag

SEQ ID NO: 5388395 - DNA, 22 bp, Homo sapiens
catgtctctttggggagagctg

SEQ ID NO: 5388396 - DNA, 15 bp, Homo sapiens
catgtctgaaacaga

SEQ ID NO: 5388397 - DNA, 18 bp, Homo sapiens
catgtctgaaacagagaa

SEQ ID NO: 5388398 - DNA, 20 bp, Homo sapiens
catgtctgagcggcgcagag

SEQ ID NO: 5388399 - DNA, 15 bp, Homo sapiens
catgtctgcacctcc

SEQ ID NO: 5388400 - DNA, 19 bp, Homo sapiens
catgtctgcacctccgctt

SEQ ID NO: 5388401 - DNA, 17 bp, Homo sapiens
catgtctgcagtgtgcc

SEQ ID NO: 5388402 - DNA, 16 bp, Homo sapiens
catgtctgcatggcag

SEQ ID NO: 5388403 - DNA, 20 bp, Homo sapiens
catgtctgcatggcagaagc

SEQ ID NO: 5388404 - DNA, 18 bp, Homo sapiens
catgtctgccaaaatgca

SEQ ID NO: 5388405 - DNA, 13 bp, Homo sapiens
catgtctgtagtt

SEQ ID NO: 5388406 - DNA, 14 bp, Homo sapiens
catgtctgtatact

SEQ ID NO: 5388407 - DNA, 11 bp, Homo sapiens
catgtctgtga

SEQ ID NO: 5388408 - DNA, 13 bp, Homo sapiens
catgtctgtgaac

SEQ ID NO: 5388409 - DNA, 15 bp, Homo sapiens
catgtctgtgctgtg

SEQ ID NO: 5388410 - DNA, 16 bp, Homo sapiens
catgtctgtgctgtgt

SEQ ID NO: 5388411 - DNA, 15 bp, Homo sapiens
catgtcttaatgaag

SEQ ID NO: 5388412 - DNA, 16 bp, Homo sapiens
catgtcttaatgaagt

SEQ ID NO: 5388413 - DNA, 21 bp, Homo sapiens
catgtcttaatgaagtttgaa

SEQ ID NO: 5388414 - DNA, 22 bp, Homo sapiens
catgtcttaatgaagtttgaat

SEQ ID NO: 5388415 - DNA, 18 bp, Homo sapiens
catgtcttatcttgtttc

SEQ ID NO: 5388416 - DNA, 22 bp, Homo sapiens
catgtcttcattttttaatgtg

SEQ ID NO: 5388417 - DNA, 13 bp, Homo sapiens
catgtcttctgct

SEQ ID NO: 5388418 - DNA, 14 bp, Homo sapiens
catgtcttctgctg

SEQ ID NO: 5388419 - DNA, 18 bp, Homo sapiens
catgtcttctgctgttct

SEQ ID NO: 5388420 - DNA, 13 bp, Homo sapiens
catgtcttgtaca

SEQ ID NO: 5388421 - DNA, 23 bp, Homo sapiens
catgtcttgtacatgtgtagcct

SEQ ID NO: 5388422 - DNA, 17 bp, Homo sapiens
catgtcttgtgcataat

SEQ ID NO: 5388423 - DNA, 22 bp, Homo sapiens
catgtgaaaaggcaaaaagcat

SEQ ID NO: 5388424 - DNA, 16 bp, Homo sapiens
catgtgaaaataaaat

SEQ ID NO: 5388425 - DNA, 23 bp, Homo sapiens
catgtgaaaataatagccatcct

SEQ ID NO: 5388426 - DNA, 13 bp, Homo sapiens
catgtgaaactca

SEQ ID NO: 5388427 - DNA, 14 bp, Homo sapiens
catgtgaaagatag

SEQ ID NO: 5388428 - DNA, 14 bp, Homo sapiens
catgtgacacatat

SEQ ID NO: 5388429 - DNA, 15 bp, Homo sapiens
catgtgacacatatg

SEQ ID NO: 5388430 - DNA, 13 bp, Homo sapiens
catgtgacattta

SEQ ID NO: 5388431 - DNA, 14 bp, Homo sapiens
catgtgacatttat

SEQ ID NO: 5388432 - DNA, 16 bp, Homo sapiens
catgtgacatttatat

SEQ ID NO: 5388433 - DNA, 21 bp, Homo sapiens
cattagaaaccatgaaaaaat

SEQ ID NO: 5388434 - DNA, 17 bp, Homo sapiens
cattagaaatagacagt

SEQ ID NO: 5388435 - DNA, 14 bp, Homo sapiens
cattagaaatattt

SEQ ID NO: 5388436 - DNA, 14 bp, Homo sapiens
cattagaatgtgat

SEQ ID NO: 5388437 - DNA, 16 bp, Homo sapiens
cattagactcctcctc

SEQ ID NO: 5388438 - DNA, 19 bp, Homo sapiens
cattagagaacatcctggc

SEQ ID NO: 5388439 - DNA, 19 bp, Homo sapiens
cattagagcacagcttctt

SEQ ID NO: 5388440 - DNA, 12 bp, Homo sapiens
cattagagcagg

SEQ ID NO: 5388441 - DNA, 14 bp, Homo sapiens
cattagagcaggcg

SEQ ID NO: 5388442 - DNA, 23 bp, Homo sapiens
cattagagcaggcgttcagctca

SEQ ID NO: 5388443 - DNA, 19 bp, Homo sapiens
cattagagcccatttcaat

SEQ ID NO: 5388444 - DNA, 15 bp, Homo sapiens
cattagataaacaca

SEQ ID NO: 5388445 - DNA, 22 bp, Homo sapiens
cattagataaacacaggcaggt

SEQ ID NO: 5388446 - DNA, 15 bp, Homo sapiens
cattagataaattac

SEQ ID NO: 5388447 - DNA, 20 bp, Homo sapiens
cattagataaattactataa

SEQ ID NO: 5388448 - DNA, 17 bp, Homo sapiens
cattagatgtttattta

SEQ ID NO: 5388449 - DNA, 21 bp, Homo sapiens
cattagattatcaaaaagtat

SEQ ID NO: 5388450 - DNA, 18 bp, Homo sapiens
cattagcaaaaaaagttg

SEQ ID NO: 5388451 - DNA, 22 bp, Homo sapiens
cattagcaaaaaaagttgtatg

SEQ ID NO: 5388452 - DNA, 19 bp, Homo sapiens
cattagcaaggcagagcct

SEQ ID NO: 5388453 - DNA, 21 bp, Homo sapiens
cattagcacagattttaattg

SEQ ID NO: 5388454 - DNA, 22 bp, Homo sapiens
cattagcacagattttaattgt

SEQ ID NO: 5388455 - DNA, 23 bp, Homo sapiens
cattagcagttgctcacatgtct

SEQ ID NO: 5388456 - DNA, 19 bp, Homo sapiens
cattagccagatttgtctt

SEQ ID NO: 5388457 - DNA, 14 bp, Homo sapiens
cattagcccactgc

SEQ ID NO: 5388458 - DNA, 18 bp, Homo sapiens
cattagcctgagtagaaa

SEQ ID NO: 5388459 - DNA, 23 bp, Homo sapiens
cattagcctgagtagaaaggcct

SEQ ID NO: 5388460 - DNA, 19 bp, Homo sapiens
cattagctacttttcagaa

SEQ ID NO: 5388461 - DNA, 17 bp, Homo sapiens
cattagctttaattaag

SEQ ID NO: 5388462 - DNA, 22 bp, Homo sapiens
cattaggaacagagtatatatg

SEQ ID NO: 5388463 - DNA, 18 bp, Homo sapiens
cattaggaagctgaatta

SEQ ID NO: 5388464 - DNA, 21 bp, Homo sapiens
cattaggaattgtttatacac

SEQ ID NO: 5388465 - DNA, 15 bp, Homo sapiens
cattaggatggctag

SEQ ID NO: 5388466 - DNA, 17 bp, Homo sapiens
cattaggcaaagtacaa

SEQ ID NO: 5388467 - DNA, 18 bp, Homo sapiens
cattaggcaaagtacaaa

SEQ ID NO: 5388468 - DNA, 19 bp, Homo sapiens
cattaggctgtgtcaccat

SEQ ID NO: 5388469 - DNA, 17 bp, Homo sapiens
cattagggatgcctcct

SEQ ID NO: 5388470 - DNA, 21 bp, Homo sapiens
cattagggctgaggtctgttt

SEQ ID NO: 5388471 - DNA, 17 bp, Homo sapiens
cattagggggaactcta

SEQ ID NO: 5388472 - DNA, 22 bp, Homo sapiens
cattaggtgtgactgaatttct

SEQ ID NO: 5388473 - DNA, 20 bp, Homo sapiens
cattaggttgaatgaggaga

SEQ ID NO: 5388474 - DNA, 16 bp, Homo sapiens
cattagtaaaacacaa

SEQ ID NO: 5388475 - DNA, 16 bp, Homo sapiens
cattagtaaatgtctt

SEQ ID NO: 5388476 - DNA, 18 bp, Homo sapiens
cattagtaaatgtctttg

SEQ ID NO: 5388477 - DNA, 21 bp, Homo sapiens
cattagtaaatgtctttgtaa

SEQ ID NO: 5388478 - DNA, 23 bp, Homo sapiens
cattagtaaatgtctttgtaagt

SEQ ID NO: 5388479 - DNA, 21 bp, Homo sapiens
cattagtaacataataaatta

SEQ ID NO: 5388480 - DNA, 14 bp, Homo sapiens
cattagtactttat

SEQ ID NO: 5388481 - DNA, 20 bp, Homo sapiens
cattagtatagtctcccttt

SEQ ID NO: 5388482 - DNA, 21 bp, Homo sapiens
cattagtcatgtttatctgct

SEQ ID NO: 5388483 - DNA, 16 bp, Homo sapiens
cattagtgaaaattct

SEQ ID NO: 5388484 - DNA, 21 bp, Homo sapiens
cattagtgtgttgtctctttc

SEQ ID NO: 5388485 - DNA, 21 bp, Homo sapiens
cattagttgcactaactgctg

SEQ ID NO: 5388486 - DNA, 23 bp, Homo sapiens
cattagtttgaggtactacctat

SEQ ID NO: 5388487 - DNA, 17 bp, Homo sapiens
cattagttttaaaaagg

SEQ ID NO: 5388488 - DNA, 13 bp, Homo sapiens
cattagttttaga

SEQ ID NO: 5388489 - DNA, 13 bp, Homo sapiens
cattagttttgaa

SEQ ID NO: 5388490 - DNA, 14 bp, Homo sapiens
cattataaaagatc

SEQ ID NO: 5388491 - DNA, 22 bp, Homo sapiens
cattataaaccttcagaagcta

SEQ ID NO: 5388492 - DNA, 13 bp, Homo sapiens
cattataaacgct

SEQ ID NO: 5388493 - DNA, 13 bp, Homo sapiens
cattataaacgtg

SEQ ID NO: 5388494 - DNA, 13 bp, Homo sapiens
cattataaatgac

SEQ ID NO: 5388495 - DNA, 13 bp, Homo sapiens
cattataaattct

SEQ ID NO: 5388496 - DNA, 18 bp, Homo sapiens
cattataaccttaattta

SEQ ID NO: 5388497 - DNA, 18 bp, Homo sapiens
cattataataaaatttct

SEQ ID NO: 5388498 - DNA, 14 bp, Homo sapiens
cattataatttata

SEQ ID NO: 5388499 - DNA, 16 bp, Homo sapiens
cattataccgcagagt

SEQ ID NO: 5388500 - DNA, 19 bp, Homo sapiens
cattatagattttcatgtt

SEQ ID NO: 5388501 - DNA, 15 bp, Homo sapiens
cattatagcgcctgt

SEQ ID NO: 5388502 - DNA, 18 bp, Homo sapiens
cattatagcgcctgtata

SEQ ID NO: 5388503 - DNA, 17 bp, Homo sapiens
cattatagtaaatctat

SEQ ID NO: 5388504 - DNA, 21 bp, Homo sapiens
cattatagtaaatctatgagc

SEQ ID NO: 5388505 - DNA, 20 bp, Homo sapiens
cattatattctaattaaaat

SEQ ID NO: 5388506 - DNA, 16 bp, Homo sapiens
cattatattgcaatga

SEQ ID NO: 5388507 - DNA, 15 bp, Homo sapiens
cattatatttattgt

SEQ ID NO: 5388508 - DNA, 16 bp, Homo sapiens
cattatatttattgtt

SEQ ID NO: 5388509 - DNA, 19 bp, Homo sapiens
cattatatttctattttat

SEQ ID NO: 5388510 - DNA, 22 bp, Homo sapiens
cattatatttgagtttctttca

SEQ ID NO: 5388511 - DNA, 17 bp, Homo sapiens
cattatatttgcattat

SEQ ID NO: 5388512 - DNA, 10 bp, Homo sapiens
cattatcaaa

SEQ ID NO: 5388513 - DNA, 15 bp, Homo sapiens
cattatcaaaagtga

SEQ ID NO: 5388514 - DNA, 17 bp, Homo sapiens
cattatcactgaaaaaa

SEQ ID NO: 5388515 - DNA, 21 bp, Homo sapiens
cattatccattcccaagatgc

SEQ ID NO: 5388516 - DNA, 23 bp, Homo sapiens
cattatccttttatctcacaaat

SEQ ID NO: 5388517 - DNA, 17 bp, Homo sapiens
cattatcgggagcagtg

SEQ ID NO: 5388518 - DNA, 21 bp, Homo sapiens
cattatcgggagcagtgtctt

SEQ ID NO: 5388519 - DNA, 17 bp, Homo sapiens
cattatctacttgtgta

SEQ ID NO: 5388520 - DNA, 12 bp, Homo sapiens
cattatctagat

SEQ ID NO: 5388521 - DNA, 16 bp, Homo sapiens
cattatctagatactg

SEQ ID NO: 5388522 - DNA, 24 bp, Homo sapiens
cattatctagttcattgaatcatt

SEQ ID NO: 5388523 - DNA, 16 bp, Homo sapiens
cattatctcacttagt

SEQ ID NO: 5388524 - DNA, 13 bp, Homo sapiens
cattatctgagtt

SEQ ID NO: 5388525 - DNA, 16 bp, Homo sapiens
cattatctgagttgca

SEQ ID NO: 5388526 - DNA, 17 bp, Homo sapiens
cattatctgctgttcct

SEQ ID NO: 5388527 - DNA, 13 bp, Homo sapiens
cattatctggaat

SEQ ID NO: 5388528 - DNA, 20 bp, Homo sapiens
cattatctgtattaatgctt

SEQ ID NO: 5388529 - DNA, 16 bp, Homo sapiens
cattatcttatgaata

SEQ ID NO: 5388530 - DNA, 17 bp, Homo sapiens
cattatcttatgaataa

SEQ ID NO: 5388531 - DNA, 18 bp, Homo sapiens
cattatcttgctcattct

SEQ ID NO: 5388532 - DNA, 16 bp, Homo sapiens
cattatctttgctgtt

SEQ ID NO: 5388533 - DNA, 20 bp, Homo sapiens
cattatgacatttcttaaaa

SEQ ID NO: 5388534 - DNA, 12 bp, Homo sapiens
cattatgatcta

SEQ ID NO: 5388535 - DNA, 13 bp, Homo sapiens
cattatgatctaa

SEQ ID NO: 5388536 - DNA, 15 bp, Homo sapiens
cattatgatctaata

SEQ ID NO: 5388537 - DNA, 17 bp, Homo sapiens
cattatgatctaataaa

SEQ ID NO: 5388538 - DNA, 19 bp, Homo sapiens
cattatgatctaataaact

SEQ ID NO: 5388539 - DNA, 21 bp, Homo sapiens
cattatgatctaataaacttt

SEQ ID NO: 5388540 - DNA, 14 bp, Homo sapiens
cattatgattcttt

SEQ ID NO: 5388541 - DNA, 14 bp, Homo sapiens
cattatgcagctga

SEQ ID NO: 5388542 - DNA, 14 bp, Homo sapiens
cattatgctttgaa

SEQ ID NO: 5388543 - DNA, 17 bp, Homo sapiens
cattatgctttgaactt

SEQ ID NO: 5388544 - DNA, 16 bp, Homo sapiens
cattatggctttgtgc

SEQ ID NO: 5388545 - DNA, 18 bp, Homo sapiens
cattatgggttcttcccc

SEQ ID NO: 5388546 - DNA, 20 bp, Homo sapiens
cattatggtagaatcatttt

SEQ ID NO: 5388547 - DNA, 15 bp, Homo sapiens
cattatgtaaaagaa

SEQ ID NO: 5388548 - DNA, 16 bp, Homo sapiens
cattatgtaaaagaaa

SEQ ID NO: 5388549 - DNA, 16 bp, Homo sapiens
cattatgtatcttagt

SEQ ID NO: 5388550 - DNA, 17 bp, Homo sapiens
cattatgtatttataat

SEQ ID NO: 5388551 - DNA, 22 bp, Homo sapiens
cattatgtccactgtgtataga

SEQ ID NO: 5388552 - DNA, 17 bp, Homo sapiens
cattatgtggttttaga

SEQ ID NO: 5388553 - DNA, 13 bp, Homo sapiens
cattatgtgtgca

SEQ ID NO: 5388554 - DNA, 23 bp, Homo sapiens
cattatgtgtgcatgtgtgtata

SEQ ID NO: 5388555 - DNA, 20 bp, Homo sapiens
cattatgttattggaatttt

SEQ ID NO: 5388556 - DNA, 23 bp, Homo sapiens
cattatgttattggaattttctt

SEQ ID NO: 5388557 - DNA, 13 bp, Homo sapiens
cattatgttcatg

SEQ ID NO: 5388558 - DNA, 14 bp, Homo sapiens
cattatgttcatgt

SEQ ID NO: 5388559 - DNA, 16 bp, Homo sapiens
cattatgttcatgtaa

SEQ ID NO: 5388560 - DNA, 13 bp, Homo sapiens
cattatgtttgca

SEQ ID NO: 5388561 - DNA, 17 bp, Homo sapiens
cattattaaattgtaaa

SEQ ID NO: 5388562 - DNA, 17 bp, Homo sapiens
cattattaataattaat

SEQ ID NO: 5388563 - DNA, 12 bp, Homo sapiens
cattattacttt

SEQ ID NO: 5388564 - DNA, 22 bp, Homo sapiens
cattattatataaatcatgatg

SEQ ID NO: 5388565 - DNA, 22 bp, Homo sapiens
cattattatgcaaaatttagaa

SEQ ID NO: 5388566 - DNA, 16 bp, Homo sapiens
cattattatgtaaata

SEQ ID NO: 5388567 - DNA, 11 bp, Homo sapiens
cattattatta

SEQ ID NO: 5388568 - DNA, 16 bp, Homo sapiens
cattattatttctgtt

SEQ ID NO: 5388569 - DNA, 19 bp, Homo sapiens
cattattatttctgttctt

SEQ ID NO: 5388570 - DNA, 14 bp, Homo sapiens
cattattcaaagtt

SEQ ID NO: 5388571 - DNA, 18 bp, Homo sapiens
cattattcaagaatgaaa

SEQ ID NO: 5388572 - DNA, 21 bp, Homo sapiens
cattattcaagaatgaaaaat

SEQ ID NO: 5388573 - DNA, 20 bp, Homo sapiens
cattattcatctctcctccc

SEQ ID NO: 5388574 - DNA, 16 bp, Homo sapiens
cattattcatttagtg

SEQ ID NO: 5388575 - DNA, 16 bp, Homo sapiens
cattattctatgtagt

SEQ ID NO: 5388576 - DNA, 22 bp, Homo sapiens
cattattctatgtagtggtttt

SEQ ID NO: 5388577 - DNA, 23 bp, Homo sapiens
cattattctctaactattacaca

SEQ ID NO: 5388578 - DNA, 12 bp, Homo sapiens
cattattctctt

SEQ ID NO: 5388579 - DNA, 15 bp, Homo sapiens
cattattctctttta

SEQ ID NO: 5388580 - DNA, 15 bp, Homo sapiens
cattattcttcttta

SEQ ID NO: 5388581 - DNA, 20 bp, Homo sapiens
cattattgaggaaaattaat

SEQ ID NO: 5388582 - DNA, 15 bp, Homo sapiens
cattattgagtcacc

SEQ ID NO: 5388583 - DNA, 12 bp, Homo sapiens
cattattgagtt

SEQ ID NO: 5388584 - DNA, 13 bp, Homo sapiens
cattattgagttc

SEQ ID NO: 5388585 - DNA, 21 bp, Homo sapiens
cattattgccaaataagacag

SEQ ID NO: 5388586 - DNA, 16 bp, Homo sapiens
cattattgcttattgc

SEQ ID NO: 5388587 - DNA, 22 bp, Homo sapiens
cattattggaattaacctggtg

SEQ ID NO: 5388588 - DNA, 15 bp, Homo sapiens
cattattgtagagaa

SEQ ID NO: 5388589 - DNA, 15 bp, Homo sapiens
cattatttaataaga

SEQ ID NO: 5388590 - DNA, 16 bp, Homo sapiens
cattatttaatgtttg

SEQ ID NO: 5388591 - DNA, 15 bp, Homo sapiens
cattatttaatttgt

SEQ ID NO: 5388592 - DNA, 18 bp, Homo sapiens
cattatttaatttgtatg

SEQ ID NO: 5388593 - DNA, 13 bp, Homo sapiens
cattatttattaa

SEQ ID NO: 5388594 - DNA, 17 bp, Homo sapiens
cattatttattaaattt

SEQ ID NO: 5388595 - DNA, 22 bp, Homo sapiens
cattatttattcagcttcattt

SEQ ID NO: 5388596 - DNA, 15 bp, Homo sapiens
cattatttctaccat

SEQ ID NO: 5388597 - DNA, 13 bp, Homo sapiens
cattatttctgct

SEQ ID NO: 5388598 - DNA, 12 bp, Homo sapiens
cattatttctgt

SEQ ID NO: 5388599 - DNA, 20 bp, Homo sapiens
cattatttgagtttgacatt

SEQ ID NO: 5388600 - DNA, 12 bp, Homo sapiens
cattatttgtca

SEQ ID NO: 5388601 - DNA, 14 bp, Homo sapiens
cattattttacagt

SEQ ID NO: 5388602 - DNA, 17 bp, Homo sapiens
cattattttattatgaa

SEQ ID NO: 5388603 - DNA, 16 bp, Homo sapiens
cattattttattttat

SEQ ID NO: 5388604 - DNA, 14 bp, Homo sapiens
cattattttccaga

SEQ ID NO: 5388605 - DNA, 13 bp, Homo sapiens
cattattttccca

SEQ ID NO: 5388606 - DNA, 22 bp, Homo sapiens
cattattttgaggtagaggaaa

SEQ ID NO: 5388607 - DNA, 16 bp, Homo sapiens
cattattttgtcataa

SEQ ID NO: 5388608 - DNA, 21 bp, Homo sapiens
cattattttgtcataaaatgc

SEQ ID NO: 5388609 - DNA, 23 bp, Homo sapiens
cattattttgtcataaaatgcta

SEQ ID NO: 5388610 - DNA, 23 bp, Homo sapiens
cattattttgtggttctatttta

SEQ ID NO: 5388611 - DNA, 13 bp, Homo sapiens
cattcttttaaat

SEQ ID NO: 5388612 - DNA, 18 bp, Homo sapiens
cattcttttaacttcttt

SEQ ID NO: 5388613 - DNA, 23 bp, Homo sapiens
cattcttttcagcttgtttctat

SEQ ID NO: 5388614 - DNA, 18 bp, Homo sapiens
cattcttttgccacatcc

SEQ ID NO: 5388615 - DNA, 21 bp, Homo sapiens
cattcttttgccacatcccta

SEQ ID NO: 5388616 - DNA, 23 bp, Homo sapiens
cattcttttgccacatccctata

SEQ ID NO: 5388617 - DNA, 16 bp, Homo sapiens
cattcttttgtaattt

SEQ ID NO: 5388618 - DNA, 14 bp, Homo sapiens
cattctttttgaaa

SEQ ID NO: 5388619 - DNA, 19 bp, Homo sapiens
cattctttttttcttggcc

SEQ ID NO: 5388620 - DNA, 12 bp, Homo sapiens
cattgaaaaagg

SEQ ID NO: 5388621 - DNA, 17 bp, Homo sapiens
cattgaaaaatgtccac

SEQ ID NO: 5388622 - DNA, 15 bp, Homo sapiens
cattgaaaacagata

SEQ ID NO: 5388623 - DNA, 22 bp, Homo sapiens
cattgaaaattattaatcagaa

SEQ ID NO: 5388624 - DNA, 13 bp, Homo sapiens
cattgaaacattt

SEQ ID NO: 5388625 - DNA, 18 bp, Homo sapiens
cattgaaagaagagatga

SEQ ID NO: 5388626 - DNA, 16 bp, Homo sapiens
cattgaaagagaacca

SEQ ID NO: 5388627 - DNA, 22 bp, Homo sapiens
cattgaaagagaaccagtttca

SEQ ID NO: 5388628 - DNA, 22 bp, Homo sapiens
cattgaaagcttcaaagtttat

SEQ ID NO: 5388629 - DNA, 17 bp, Homo sapiens
cattgaaataataatat

SEQ ID NO: 5388630 - DNA, 13 bp, Homo sapiens
cattgaaatactt

SEQ ID NO: 5388631 - DNA, 16 bp, Homo sapiens
cattgaaatcagcatg

SEQ ID NO: 5388632 - DNA, 21 bp, Homo sapiens
cattgaaatcagcatgacaaa

SEQ ID NO: 5388633 - DNA, 22 bp, Homo sapiens
cattgaaatctaggaaaattat

SEQ ID NO: 5388634 - DNA, 14 bp, Homo sapiens
cattgaaatgtcac

SEQ ID NO: 5388635 - DNA, 15 bp, Homo sapiens
cattgaacacaaact

SEQ ID NO: 5388636 - DNA, 16 bp, Homo sapiens
cattgaacacaaactg

SEQ ID NO: 5388637 - DNA, 17 bp, Homo sapiens
cattgaacacaaactgt

SEQ ID NO: 5388638 - DNA, 18 bp, Homo sapiens
cattgaacacaaactgta

SEQ ID NO: 5388639 - DNA, 15 bp, Homo sapiens
cattgaacagctgtg

SEQ ID NO: 5388640 - DNA, 21 bp, Homo sapiens
cattgaagaagaaccagccca

SEQ ID NO: 5388641 - DNA, 22 bp, Homo sapiens
cattgaagaagaaccagcccag

SEQ ID NO: 5388642 - DNA, 15 bp, Homo sapiens
cattgaagagagagc

SEQ ID NO: 5388643 - DNA, 16 bp, Homo sapiens
cattgaagagagagct

SEQ ID NO: 5388644 - DNA, 16 bp, Homo sapiens
cattgaagccgactct

SEQ ID NO: 5388645 - DNA, 17 bp, Homo sapiens
cattgaagccgactctg

SEQ ID NO: 5388646 - DNA, 23 bp, Homo sapiens
cattgaagccgactctggccctg

SEQ ID NO: 5388647 - DNA, 21 bp, Homo sapiens
cattgaaggaaagctatatct

SEQ ID NO: 5388648 - DNA, 23 bp, Homo sapiens
cattgaaggaaagctatatctat

SEQ ID NO: 5388649 - DNA, 14 bp, Homo sapiens
cattgaaggcctgg

SEQ ID NO: 5388650 - DNA, 13 bp, Homo sapiens
cattgaaggctta

SEQ ID NO: 5388651 - DNA, 22 bp, Homo sapiens
cattgaagggggatgcaggcaa

SEQ ID NO: 5388652 - DNA, 13 bp, Homo sapiens
cattgaagtatat

SEQ ID NO: 5388653 - DNA, 18 bp, Homo sapiens
cattgaagtgtttaaaag

SEQ ID NO: 5388654 - DNA, 22 bp, Homo sapiens
cattgaatagtggaacattttc

SEQ ID NO: 5388655 - DNA, 19 bp, Homo sapiens
cattgaatctctaaaatgc

SEQ ID NO: 5388656 - DNA, 20 bp, Homo sapiens
cattgaatgcgctttattgc

SEQ ID NO: 5388657 - DNA, 22 bp, Homo sapiens
cattgaatggctatgtttttaa

SEQ ID NO: 5388658 - DNA, 21 bp, Homo sapiens
cattgaattcttggttgagga

SEQ ID NO: 5388659 - DNA, 13 bp, Homo sapiens
cattgacaaatct

SEQ ID NO: 5388660 - DNA, 16 bp, Homo sapiens
cattgacaaatctgtg

SEQ ID NO: 5388661 - DNA, 16 bp, Homo sapiens
cattgacaagaactga

SEQ ID NO: 5388662 - DNA, 23 bp, Homo sapiens
cattgacaaggtgtttctctgta

SEQ ID NO: 5388663 - DNA, 16 bp, Homo sapiens
cattgacaccaaatat

SEQ ID NO: 5388664 - DNA, 21 bp, Homo sapiens
cattgacaccaaatattttca

SEQ ID NO: 5388665 - DNA, 17 bp, Homo sapiens
cattgacatgatataca

SEQ ID NO: 5388666 - DNA, 19 bp, Homo sapiens
cattgacatgtacagagaa

SEQ ID NO: 5388667 - DNA, 12 bp, Homo sapiens
cattgacattat

SEQ ID NO: 5388668 - DNA, 21 bp, Homo sapiens
cattgacattatagacattga

SEQ ID NO: 5388669 - DNA, 15 bp, Homo sapiens
cattgaccaagaact

SEQ ID NO: 5388670 - DNA, 19 bp, Homo sapiens
cattgaccaagaactgcat

SEQ ID NO: 5388671 - DNA, 23 bp, Homo sapiens
cattgaccaagatgatcacatgg

SEQ ID NO: 5388672 - DNA, 20 bp, Homo sapiens
cattgacctaattgttaaat

SEQ ID NO: 5388673 - DNA, 15 bp, Homo sapiens
cattgacctatttcc

SEQ ID NO: 5388674 - DNA, 15 bp, Homo sapiens
cattgacctcagctg

SEQ ID NO: 5388675 - DNA, 20 bp, Homo sapiens
cattgacctctcagggcctg

SEQ ID NO: 5388676 - DNA, 22 bp, Homo sapiens
cattgacctctcagggcctggc

SEQ ID NO: 5388677 - DNA, 14 bp, Homo sapiens
cattgacctgaggc

SEQ ID NO: 5388678 - DNA, 13 bp, Homo sapiens
cattgacctggag

SEQ ID NO: 5388679 - DNA, 14 bp, Homo sapiens
cattgacctggagg

SEQ ID NO: 5388680 - DNA, 19 bp, Homo sapiens
cattgacctggaggggaga

SEQ ID NO: 5388681 - DNA, 13 bp, Homo sapiens
cattgaccttcat

SEQ ID NO: 5388682 - DNA, 18 bp, Homo sapiens
cattgactatcaaactga

SEQ ID NO: 5388683 - DNA, 19 bp, Homo sapiens
cattgactatcaaactgaa

SEQ ID NO: 5388684 - DNA, 15 bp, Homo sapiens
cattgactcttgcgt

SEQ ID NO: 5388685 - DNA, 15 bp, Homo sapiens
cattgactgaactgc

SEQ ID NO: 5388686 - DNA, 14 bp, Homo sapiens
cattgacttcttgg

SEQ ID NO: 5388687 - DNA, 16 bp, Homo sapiens
cattgacttttataaa

SEQ ID NO: 5388688 - DNA, 18 bp, Homo sapiens
cattgacttttataaagc

SEQ ID NO: 5388689 - DNA, 13 bp, Homo sapiens
cattgagaaggaa

SEQ ID NO: 5388690 - DNA, 16 bp, Homo sapiens
cattgagatcttcctg

SEQ ID NO: 5388691 - DNA, 15 bp, Homo sapiens
cattgagcatatttt

SEQ ID NO: 5388692 - DNA, 13 bp, Homo sapiens
cattgagcctggc

SEQ ID NO: 5388693 - DNA, 20 bp, Homo sapiens
cattgagctgatataaattc

SEQ ID NO: 5388694 - DNA, 13 bp, Homo sapiens
cattgagctgcct

SEQ ID NO: 5388695 - DNA, 21 bp, Homo sapiens
cattgaggaaatattaatttt

SEQ ID NO: 5388696 - DNA, 16 bp, Homo sapiens
cattgaggaagagtct

SEQ ID NO: 5388697 - DNA, 17 bp, Homo sapiens
cattgaggaagagtctt

SEQ ID NO: 5388698 - DNA, 16 bp, Homo sapiens
cattgaggataaattg

SEQ ID NO: 5388699 - DNA, 22 bp, Homo sapiens
cattgaggataaattgccataa

SEQ ID NO: 5388700 - DNA, 23 bp, Homo sapiens
cattgaggatggaaactggactc

SEQ ID NO: 5388701 - DNA, 9 bp, Homo sapiens
cattgagta

SEQ ID NO: 5388702 - DNA, 23 bp, Homo sapiens
cattgagtagacacatttaagga

SEQ ID NO: 5388703 - DNA, 15 bp, Homo sapiens
cattgagtattgttt

SEQ ID NO: 5388704 - DNA, 17 bp, Homo sapiens
cattgagtgctggggga

SEQ ID NO: 5388705 - DNA, 16 bp, Homo sapiens
cattgagttggttact

SEQ ID NO: 5388706 - DNA, 18 bp, Homo sapiens
cattgagttggttacttc

SEQ ID NO: 5388707 - DNA, 19 bp, Homo sapiens
cattgagtttacttataaa

SEQ ID NO: 5388708 - DNA, 16 bp, Homo sapiens
cattgataagatggtt

SEQ ID NO: 5388709 - DNA, 18 bp, Homo sapiens
cattgataagatggtttc

SEQ ID NO: 5388710 - DNA, 22 bp, Homo sapiens
cattgataagatggtttccgtg

SEQ ID NO: 5388711 - DNA, 15 bp, Homo sapiens
cattgataatcttca

SEQ ID NO: 5388712 - DNA, 17 bp, Homo sapiens
cattgataatcttcagg

SEQ ID NO: 5388713 - DNA, 20 bp, Homo sapiens
cattgataatcttcaggtga

SEQ ID NO: 5388714 - DNA, 22 bp, Homo sapiens
cattgatacaaagtacagaaaa

SEQ ID NO: 5388715 - DNA, 13 bp, Homo sapiens
cattgatagaact

SEQ ID NO: 5388716 - DNA, 15 bp, Homo sapiens
cattgatcacagatg

SEQ ID NO: 5388717 - DNA, 17 bp, Homo sapiens
cattgatcacagatgtg

SEQ ID NO: 5388718 - DNA, 18 bp, Homo sapiens
cattgatcacagatgtgc

SEQ ID NO: 5388719 - DNA, 19 bp, Homo sapiens
cattgatccaggagataat

SEQ ID NO: 5388720 - DNA, 13 bp, Homo sapiens
cattgatgaatga

SEQ ID NO: 5388721 - DNA, 14 bp, Homo sapiens
cattgatggttttt

SEQ ID NO: 5388722 - DNA, 14 bp, Homo sapiens
cattgatgtaagga

SEQ ID NO: 5388723 - DNA, 20 bp, Homo sapiens
cattgattcaccttgttttt

SEQ ID NO: 5388724 - DNA, 19 bp, Homo sapiens
cattgatttagtaagtgtt

SEQ ID NO: 5388725 - DNA, 21 bp, Homo sapiens
cattgatttagtaagtgttct

SEQ ID NO: 5388726 - DNA, 17 bp, Homo sapiens
cattgatttcctgtgtc

SEQ ID NO: 5388727 - DNA, 18 bp, Homo sapiens
cattgatttcctgtgtca

SEQ ID NO: 5388728 - DNA, 18 bp, Homo sapiens
cattgcaaaaatatttta

SEQ ID NO: 5388729 - DNA, 16 bp, Homo sapiens
cattgcaaaaggttaa

SEQ ID NO: 5388730 - DNA, 17 bp, Homo sapiens
cattgcaaaatagaaga

SEQ ID NO: 5388731 - DNA, 17 bp, Homo sapiens
cattgcaaacaactgaa

SEQ ID NO: 5388732 - DNA, 20 bp, Homo sapiens
cattgcaaacaactgaaatg

SEQ ID NO: 5388733 - DNA, 17 bp, Homo sapiens
cattgcacaatatattt

SEQ ID NO: 5388734 - DNA, 17 bp, Homo sapiens
cattgcacagggagacg

SEQ ID NO: 5388735 - DNA, 19 bp, Homo sapiens
cattgcacataagcttcca

SEQ ID NO: 5388736 - DNA, 13 bp, Homo sapiens
cattgcactaaaa

SEQ ID NO: 5388737 - DNA, 16 bp, Homo sapiens
cattgcactaaaagtg

SEQ ID NO: 5388738 - DNA, 15 bp, Homo sapiens
cattgcactccagcc

SEQ ID NO: 5388739 - DNA, 14 bp, Homo sapiens
cattgcactggaat

SEQ ID NO: 5388740 - DNA, 18 bp, Homo sapiens
cattgcactttataaaca

SEQ ID NO: 5388741 - DNA, 13 bp, Homo sapiens
cattgcactttcc

SEQ ID NO: 5388742 - DNA, 21 bp, Homo sapiens
cattgcagaacatgagtgctg

SEQ ID NO: 5388743 - DNA, 22 bp, Homo sapiens
cattgcagaataatgttctatt

SEQ ID NO: 5388744 - DNA, 18 bp, Homo sapiens
cattgcagatcccagccc

SEQ ID NO: 5388745 - DNA, 22 bp, Homo sapiens
cattgcagatcccagcccaccc

SEQ ID NO: 5388746 - DNA, 20 bp, Homo sapiens
cattgcagcctaagaagaag

SEQ ID NO: 5388747 - DNA, 13 bp, Homo sapiens
cattgcagccttg

SEQ ID NO: 5388748 - DNA, 19 bp, Homo sapiens
cattgcagccttgcgctgt

SEQ ID NO: 5388749 - DNA, 13 bp, Homo sapiens
cattgcagcttca

SEQ ID NO: 5388750 - DNA, 22 bp, Homo sapiens
cattgcaggaagagatgctcta

SEQ ID NO: 5388751 - DNA, 17 bp, Homo sapiens
cattgcaggccagtgga

SEQ ID NO: 5388752 - DNA, 18 bp, Homo sapiens
cattgcagtctgcttctg

SEQ ID NO: 5388753 - DNA, 22 bp, Homo sapiens
cattgcatcacctctgtaattt

SEQ ID NO: 5388754 - DNA, 22 bp, Homo sapiens
cattgcatcatgaaactctttg

SEQ ID NO: 5388755 - DNA, 14 bp, Homo sapiens
cattgcattcatgt

SEQ ID NO: 5388756 - DNA, 11 bp, Homo sapiens
cattgcatttc

SEQ ID NO: 5388757 - DNA, 15 bp, Homo sapiens
cattgcatttccaga

SEQ ID NO: 5388758 - DNA, 17 bp, Homo sapiens
cattgccaagccccccg

SEQ ID NO: 5388759 - DNA, 21 bp, Homo sapiens
cattgccaaggcatccccagt

SEQ ID NO: 5388760 - DNA, 15 bp, Homo sapiens
cattgccaagggctt

SEQ ID NO: 5388761 - DNA, 13 bp, Homo sapiens
cattgccaccagg

SEQ ID NO: 5388762 - DNA, 15 bp, Homo sapiens
cattgccaccaggag

SEQ ID NO: 5388763 - DNA, 20 bp, Homo sapiens
cattgccaccaggagaacca

SEQ ID NO: 5388764 - DNA, 21 bp, Homo sapiens
cattgccacggaaacatacag

SEQ ID NO: 5388765 - DNA, 13 bp, Homo sapiens
cattgccaggaga

SEQ ID NO: 5388766 - DNA, 14 bp, Homo sapiens
cattgccagtgtct

SEQ ID NO: 5388767 - DNA, 16 bp, Homo sapiens
cattgccagtgtcttt

SEQ ID NO: 5388768 - DNA, 18 bp, Homo sapiens
cattgccagtgtctttct

SEQ ID NO: 5388769 - DNA, 15 bp, Homo sapiens
cattgccattccctg

SEQ ID NO: 5388770 - DNA, 16 bp, Homo sapiens
cattgccattccctgc

SEQ ID NO: 5388771 - DNA, 19 bp, Homo sapiens
cattgcccacttctgtgta

SEQ ID NO: 5388772 - DNA, 14 bp, Homo sapiens
cattgcccagtctt

SEQ ID NO: 5388773 - DNA, 20 bp, Homo sapiens
cattgcccagtctttcatgt

SEQ ID NO: 5388774 - DNA, 16 bp, Homo sapiens
cattgcccagtgagcc

SEQ ID NO: 5388775 - DNA, 17 bp, Homo sapiens
cattgcccagtgagccc

SEQ ID NO: 5388776 - DNA, 11 bp, Homo sapiens
cattgccccaa

SEQ ID NO: 5388777 - DNA, 17 bp, Homo sapiens
cattgccccatgagaca

SEQ ID NO: 5388778 - DNA, 18 bp, Homo sapiens
cattgcccccagggcact

SEQ ID NO: 5388779 - DNA, 23 bp, Homo sapiens
cattgcccctccgatgctgaggc

SEQ ID NO: 5388780 - DNA, 15 bp, Homo sapiens
cattgccctgagggg

SEQ ID NO: 5388781 - DNA, 21 bp, Homo sapiens
cattgccgaagtccagctttc

SEQ ID NO: 5388782 - DNA, 22 bp, Homo sapiens
cattgccgctgtataaagcatg

SEQ ID NO: 5388783 - DNA, 22 bp, Homo sapiens
cattgcctaactactagttttt

SEQ ID NO: 5388784 - DNA, 16 bp, Homo sapiens
cattgcctagctcttt

SEQ ID NO: 5388785 - DNA, 14 bp, Homo sapiens
cattgcctccacct

SEQ ID NO: 5388786 - DNA, 18 bp, Homo sapiens
cattgcctcctccttccc

SEQ ID NO: 5388787 - DNA, 16 bp, Homo sapiens
cattgcctcctgttct

SEQ ID NO: 5388788 - DNA, 18 bp, Homo sapiens
cattgcctcctgttctgc

SEQ ID NO: 5388789 - DNA, 12 bp, Homo sapiens
catttaatttag

SEQ ID NO: 5388790 - DNA, 15 bp, Homo sapiens
catttaatttagata

SEQ ID NO: 5388791 - DNA, 17 bp, Homo sapiens
catttaatttcatgtat

SEQ ID NO: 5388792 - DNA, 18 bp, Homo sapiens
catttacaaaagatttat

SEQ ID NO: 5388793 - DNA, 16 bp, Homo sapiens
catttacaaactgaag

SEQ ID NO: 5388794 - DNA, 13 bp, Homo sapiens
catttacaaataa

SEQ ID NO: 5388795 - DNA, 23 bp, Homo sapiens
catttacaacccggttcactctt

SEQ ID NO: 5388796 - DNA, 16 bp, Homo sapiens
catttacaacttccag

SEQ ID NO: 5388797 - DNA, 24 bp, Homo sapiens
catttacacattctcacaattgta

SEQ ID NO: 5388798 - DNA, 21 bp, Homo sapiens
catttacaccacactttcaaa

SEQ ID NO: 5388799 - DNA, 19 bp, Homo sapiens
catttacacttttgagact

SEQ ID NO: 5388800 - DNA, 16 bp, Homo sapiens
catttacaggagggcc

SEQ ID NO: 5388801 - DNA, 17 bp, Homo sapiens
catttacagtctctttc

SEQ ID NO: 5388802 - DNA, 23 bp, Homo sapiens
catttacatagtgcaaaactgtg

SEQ ID NO: 5388803 - DNA, 20 bp, Homo sapiens
catttacatgtattatttca

SEQ ID NO: 5388804 - DNA, 16 bp, Homo sapiens
catttacatgttttaa

SEQ ID NO: 5388805 - DNA, 19 bp, Homo sapiens
catttaccaaattgcttga

SEQ ID NO: 5388806 - DNA, 19 bp, Homo sapiens
catttaccaacatgtatct

SEQ ID NO: 5388807 - DNA, 22 bp, Homo sapiens
catttaccaacatgtatctgtc

SEQ ID NO: 5388808 - DNA, 13 bp, Homo sapiens
catttaccactgt

SEQ ID NO: 5388809 - DNA, 14 bp, Homo sapiens
catttacctggaaa

SEQ ID NO: 5388810 - DNA, 17 bp, Homo sapiens
catttacgcctgtaaat

SEQ ID NO: 5388811 - DNA, 13 bp, Homo sapiens
catttactaaaca

SEQ ID NO: 5388812 - DNA, 17 bp, Homo sapiens
catttactaaacatatg

SEQ ID NO: 5388813 - DNA, 20 bp, Homo sapiens
catttactaaacatatgatt

SEQ ID NO: 5388814 - DNA, 22 bp, Homo sapiens
catttactagctgtgcaacctt

SEQ ID NO: 5388815 - DNA, 17 bp, Homo sapiens
catttactatgcacaac

SEQ ID NO: 5388816 - DNA, 20 bp, Homo sapiens
catttactcaccatatttga

SEQ ID NO: 5388817 - DNA, 23 bp, Homo sapiens
catttactcaccatatttgaatt

SEQ ID NO: 5388818 - DNA, 15 bp, Homo sapiens
catttactcttgaga

SEQ ID NO: 5388819 - DNA, 20 bp, Homo sapiens
catttactgatcatctgctg

SEQ ID NO: 5388820 - DNA, 20 bp, Homo sapiens
catttactgcattcttctga

SEQ ID NO: 5388821 - DNA, 22 bp, Homo sapiens
catttactgcattcttctgatc

SEQ ID NO: 5388822 - DNA, 12 bp, Homo sapiens
catttactgtgg

SEQ ID NO: 5388823 - DNA, 15 bp, Homo sapiens
catttactgtggctt

SEQ ID NO: 5388824 - DNA, 17 bp, Homo sapiens
catttactgtgtctttg

SEQ ID NO: 5388825 - DNA, 17 bp, Homo sapiens
catttactttgtgttca

SEQ ID NO: 5388826 - DNA, 12 bp, Homo sapiens
catttagaaaat

SEQ ID NO: 5388827 - DNA, 19 bp, Homo sapiens
catttagaacctgcattta

SEQ ID NO: 5388828 - DNA, 23 bp, Homo sapiens
catttagaacctgcatttaagaa

SEQ ID NO: 5388829 - DNA, 21 bp, Homo sapiens
catttagaacgagcctggaag

SEQ ID NO: 5388830 - DNA, 22 bp, Homo sapiens
catttagaacgagcctggaagc

SEQ ID NO: 5388831 - DNA, 15 bp, Homo sapiens
catttagaagcctga

SEQ ID NO: 5388832 - DNA, 12 bp, Homo sapiens
catttagaatgg

SEQ ID NO: 5388833 - DNA, 15 bp, Homo sapiens
catttagaatttgaa

SEQ ID NO: 5388834 - DNA, 23 bp, Homo sapiens
catttagagaactgtggccgtta

SEQ ID NO: 5388835 - DNA, 12 bp, Homo sapiens
catttagataat

SEQ ID NO: 5388836 - DNA, 20 bp, Homo sapiens
catttagataatttgaaaaa

SEQ ID NO: 5388837 - DNA, 20 bp, Homo sapiens
catttagattgaaaactttt

SEQ ID NO: 5388838 - DNA, 20 bp, Homo sapiens
catttagcaataaataacac

SEQ ID NO: 5388839 - DNA, 21 bp, Homo sapiens
catttagcacaatttgagact

SEQ ID NO: 5388840 - DNA, 15 bp, Homo sapiens
catttagcacagtat

SEQ ID NO: 5388841 - DNA, 22 bp, Homo sapiens
catttagcacagtatttaacat

SEQ ID NO: 5388842 - DNA, 16 bp, Homo sapiens
catttagcatgttgtt

SEQ ID NO: 5388843 - DNA, 18 bp, Homo sapiens
catttagctgtattcata

SEQ ID NO: 5388844 - DNA, 22 bp, Homo sapiens
catttagctgtattcatatatt

SEQ ID NO: 5388845 - DNA, 23 bp, Homo sapiens
catttagctgtattcatatattg

SEQ ID NO: 5388846 - DNA, 21 bp, Homo sapiens
catttagcttgttccactgca

SEQ ID NO: 5388847 - DNA, 20 bp, Homo sapiens
catttagcttttttatttta

SEQ ID NO: 5388848 - DNA, 21 bp, Homo sapiens
catttagcttttttattttaa

SEQ ID NO: 5388849 - DNA, 13 bp, Homo sapiens
catttaggagaag

SEQ ID NO: 5388850 - DNA, 16 bp, Homo sapiens
catttaggagaagttg

SEQ ID NO: 5388851 - DNA, 18 bp, Homo sapiens
catttaggagaagttggt

SEQ ID NO: 5388852 - DNA, 20 bp, Homo sapiens
catttaggagaatagcagag

SEQ ID NO: 5388853 - DNA, 17 bp, Homo sapiens
catttaggccatgggac

SEQ ID NO: 5388854 - DNA, 18 bp, Homo sapiens
catttaggtgaggaagca

SEQ ID NO: 5388855 - DNA, 17 bp, Homo sapiens
catttagtaaggatttt

SEQ ID NO: 5388856 - DNA, 21 bp, Homo sapiens
catttagtaaggattttatga

SEQ ID NO: 5388857 - DNA, 18 bp, Homo sapiens
catttagtaccctgcagg

SEQ ID NO: 5388858 - DNA, 20 bp, Homo sapiens
catttagtaccttcaaataa

SEQ ID NO: 5388859 - DNA, 22 bp, Homo sapiens
catttagtaccttcaaataatt

SEQ ID NO: 5388860 - DNA, 14 bp, Homo sapiens
catttagtcctcac

SEQ ID NO: 5388861 - DNA, 18 bp, Homo sapiens
catttagtcctcaccttc

SEQ ID NO: 5388862 - DNA, 15 bp, Homo sapiens
catttagtcctgtac

SEQ ID NO: 5388863 - DNA, 13 bp, Homo sapiens
catttagtctctt

SEQ ID NO: 5388864 - DNA, 15 bp, Homo sapiens
catttagtctcttta

SEQ ID NO: 5388865 - DNA, 21 bp, Homo sapiens
catttagtctctttattccta

SEQ ID NO: 5388866 - DNA, 22 bp, Homo sapiens
catttagtctctttattcctag

SEQ ID NO: 5388867 - DNA, 22 bp, Homo sapiens
catttagtggtggtagaaatga

SEQ ID NO: 5388868 - DNA, 15 bp, Homo sapiens
catttagtgtgaata

SEQ ID NO: 5388869 - DNA, 17 bp, Homo sapiens
catttagtttgattatt

SEQ ID NO: 5388870 - DNA, 14 bp, Homo sapiens
catttagttttatg

SEQ ID NO: 5388871 - DNA, 21 bp, Homo sapiens
catttagttttatggcatgat

SEQ ID NO: 5388872 - DNA, 18 bp, Homo sapiens
catttataaagctaaaat

SEQ ID NO: 5388873 - DNA, 20 bp, Homo sapiens
catttataaccccagcctga

SEQ ID NO: 5388874 - DNA, 16 bp, Homo sapiens
catttataagaagaga

SEQ ID NO: 5388875 - DNA, 16 bp, Homo sapiens
catttataatactgtt

SEQ ID NO: 5388876 - DNA, 21 bp, Homo sapiens
catttataatgtttgctattg

SEQ ID NO: 5388877 - DNA, 15 bp, Homo sapiens
catttatacaaatta

SEQ ID NO: 5388878 - DNA, 17 bp, Homo sapiens
catttatacaaattaga

SEQ ID NO: 5388879 - DNA, 19 bp, Homo sapiens
catttataccagttttctt

SEQ ID NO: 5388880 - DNA, 21 bp, Homo sapiens
catttataccagttttcttta

SEQ ID NO: 5388881 - DNA, 15 bp, Homo sapiens
catttatagatcatt

SEQ ID NO: 5388882 - DNA, 16 bp, Homo sapiens
catttatataaaactt

SEQ ID NO: 5388883 - DNA, 18 bp, Homo sapiens
catttatatatatatgta

SEQ ID NO: 5388884 - DNA, 19 bp, Homo sapiens
catttatatatatatgtat

SEQ ID NO: 5388885 - DNA, 21 bp, Homo sapiens
catttatatatatatgtatat

SEQ ID NO: 5388886 - DNA, 22 bp, Homo sapiens
catttatatatatatgtatatg

SEQ ID NO: 5388887 - DNA, 14 bp, Homo sapiens
catttatatatgaa

SEQ ID NO: 5388888 - DNA, 15 bp, Homo sapiens
catttatatattgtc

SEQ ID NO: 5388889 - DNA, 17 bp, Homo sapiens
catttatatattgtctg

SEQ ID NO: 5388890 - DNA, 21 bp, Homo sapiens
catttatatctgcttctagct

SEQ ID NO: 5388891 - DNA, 15 bp, Homo sapiens
catttatattaaata

SEQ ID NO: 5388892 - DNA, 17 bp, Homo sapiens
catttatatttgtgtat

SEQ ID NO: 5388893 - DNA, 20 bp, Homo sapiens
catttatcaatcagtataat

SEQ ID NO: 5388894 - DNA, 14 bp, Homo sapiens
catttatcactctg

SEQ ID NO: 5388895 - DNA, 12 bp, Homo sapiens
catttatcattc

SEQ ID NO: 5388896 - DNA, 15 bp, Homo sapiens
catttatcattcttg

SEQ ID NO: 5388897 - DNA, 18 bp, Homo sapiens
catttatccaggaattga

SEQ ID NO: 5388898 - DNA, 15 bp, Homo sapiens
catttatcctagaaa

SEQ ID NO: 5388899 - DNA, 20 bp, Homo sapiens
catttatctaaatatggact

SEQ ID NO: 5388900 - DNA, 23 bp, Homo sapiens
catttatctacccaagggcagaa

SEQ ID NO: 5388901 - DNA, 18 bp, Homo sapiens
catttatctactatttga

SEQ ID NO: 5388902 - DNA, 21 bp, Homo sapiens
catttatctcttttgtggact

SEQ ID NO: 5388903 - DNA, 12 bp, Homo sapiens
catttatctgta

SEQ ID NO: 5388904 - DNA, 13 bp, Homo sapiens
catttatcttctg

SEQ ID NO: 5388905 - DNA, 16 bp, Homo sapiens
catttatcttctgttt

SEQ ID NO: 5388906 - DNA, 15 bp, Homo sapiens
catttatcttgaagg

SEQ ID NO: 5388907 - DNA, 17 bp, Homo sapiens
catttatctttgtattc

SEQ ID NO: 5388908 - DNA, 23 bp, Homo sapiens
catttatcttttgggtctgtcct

SEQ ID NO: 5388909 - DNA, 14 bp, Homo sapiens
catttatgacctaa

SEQ ID NO: 5388910 - DNA, 18 bp, Homo sapiens
catttatgacctaagtca

SEQ ID NO: 5388911 - DNA, 19 bp, Homo sapiens
catttatgacctaagtcag

SEQ ID NO: 5388912 - DNA, 20 bp, Homo sapiens
catttatgagctcttcatgt

SEQ ID NO: 5388913 - DNA, 15 bp, Homo sapiens
catttatgatttaat

SEQ ID NO: 5388914 - DNA, 21 bp, Homo sapiens
catttatgatttaataaaata

SEQ ID NO: 5388915 - DNA, 13 bp, Homo sapiens
catttatgcatga

SEQ ID NO: 5388916 - DNA, 20 bp, Homo sapiens
catttatggtaatcatatta

SEQ ID NO: 5388917 - DNA, 22 bp, Homo sapiens
catttatggtaatcatattaga

SEQ ID NO: 5388918 - DNA, 13 bp, Homo sapiens
catttatgtacaa

SEQ ID NO: 5388919 - DNA, 14 bp, Homo sapiens
catttatgtagaca

SEQ ID NO: 5388920 - DNA, 17 bp, Homo sapiens
catttatgtagacattg

SEQ ID NO: 5388921 - DNA, 19 bp, Homo sapiens
catttatgtagacattgta

SEQ ID NO: 5388922 - DNA, 20 bp, Homo sapiens
catttatgtagacattgtaa

SEQ ID NO: 5388923 - DNA, 23 bp, Homo sapiens
catttatgtagacattgtaaata

SEQ ID NO: 5388924 - DNA, 13 bp, Homo sapiens
catttatgtctca

SEQ ID NO: 5388925 - DNA, 22 bp, Homo sapiens
catttatgtgctgttagaatat

SEQ ID NO: 5388926 - DNA, 12 bp, Homo sapiens
catttatgttat

SEQ ID NO: 5388927 - DNA, 16 bp, Homo sapiens
catttatgttatttat

SEQ ID NO: 5388928 - DNA, 16 bp, Homo sapiens
catttatgttccttta

SEQ ID NO: 5388929 - DNA, 23 bp, Homo sapiens
catttattaagtatatttgtaaa

SEQ ID NO: 5388930 - DNA, 16 bp, Homo sapiens
catttattattttaat

SEQ ID NO: 5388931 - DNA, 17 bp, Homo sapiens
catttattattttaata

SEQ ID NO: 5388932 - DNA, 22 bp, Homo sapiens
catttattattttaatatttat

SEQ ID NO: 5388933 - DNA, 15 bp, Homo sapiens
catttattccttcca

SEQ ID NO: 5388934 - DNA, 22 bp, Homo sapiens
catttattgcactcagcttttt

SEQ ID NO: 5388935 - DNA, 15 bp, Homo sapiens
catttattgcagttt

SEQ ID NO: 5388936 - DNA, 17 bp, Homo sapiens
catttattgcagtttat

SEQ ID NO: 5388937 - DNA, 18 bp, Homo sapiens
catttattgtttatgtaa

SEQ ID NO: 5388938 - DNA, 18 bp, Homo sapiens
catttatttacactcttg

SEQ ID NO: 5388939 - DNA, 23 bp, Homo sapiens
catttatttatacagtgccttgc

SEQ ID NO: 5388940 - DNA, 15 bp, Homo sapiens
catttatttattact

SEQ ID NO: 5388941 - DNA, 18 bp, Homo sapiens
catttatttattactgtc

SEQ ID NO: 5388942 - DNA, 21 bp, Homo sapiens
catttatttattcatgtgtac

SEQ ID NO: 5388943 - DNA, 23 bp, Homo sapiens
catttatttattcatgtgtacag

SEQ ID NO: 5388944 - DNA, 14 bp, Homo sapiens
catttatttcatga

SEQ ID NO: 5388945 - DNA, 19 bp, Homo sapiens
catttatttccatattaaa

SEQ ID NO: 5388946 - DNA, 20 bp, Homo sapiens
catttatttccatattaaaa

SEQ ID NO: 5388947 - DNA, 21 bp, Homo sapiens
catttatttccatattaaaat

SEQ ID NO: 5388948 - DNA, 22 bp, Homo sapiens
catttatttgactaaagcatca

SEQ ID NO: 5388949 - DNA, 13 bp, Homo sapiens
catttattttata

SEQ ID NO: 5388950 - DNA, 13 bp, Homo sapiens
catttattttgac

SEQ ID NO: 5388951 - DNA, 18 bp, Homo sapiens
catttatttttagttaaa

SEQ ID NO: 5388952 - DNA, 13 bp, Homo sapiens
catttcaaaatat

SEQ ID NO: 5388953 - DNA, 17 bp, Homo sapiens
catttcaaaattaatag

SEQ ID NO: 5388954 - DNA, 18 bp, Homo sapiens
catttcaaagccctgcct

SEQ ID NO: 5388955 - DNA, 19 bp, Homo sapiens
catttcaaagccctgcctc

SEQ ID NO: 5388956 - DNA, 20 bp, Homo sapiens
catttcaaagccctgcctct

SEQ ID NO: 5388957 - DNA, 21 bp, Homo sapiens
catttcaaagccctgcctctg

SEQ ID NO: 5388958 - DNA, 22 bp, Homo sapiens
catttcaaagccctgcctctgt

SEQ ID NO: 5388959 - DNA, 16 bp, Homo sapiens
catttcaaagctgagt

SEQ ID NO: 5388960 - DNA, 12 bp, Homo sapiens
catttcaaatgt

SEQ ID NO: 5388961 - DNA, 13 bp, Homo sapiens
catttcaaatgtt

SEQ ID NO: 5388962 - DNA, 20 bp, Homo sapiens
catttcaaattgaatttgca

SEQ ID NO: 5388963 - DNA, 15 bp, Homo sapiens
catttcaactccaga

SEQ ID NO: 5388964 - DNA, 17 bp, Homo sapiens
catttcaactccagaag

SEQ ID NO: 5388965 - DNA, 21 bp, Homo sapiens
cattttatcaggggaatttca

SEQ ID NO: 5388966 - DNA, 18 bp, Homo sapiens
cattttatcatcctttca

SEQ ID NO: 5388967 - DNA, 14 bp, Homo sapiens
cattttatgtcttt

SEQ ID NO: 5388968 - DNA, 19 bp, Homo sapiens
cattttattaaacacaggg

SEQ ID NO: 5388969 - DNA, 22 bp, Homo sapiens
cattttattaagctttttggaa

SEQ ID NO: 5388970 - DNA, 23 bp, Homo sapiens
cattttattaagctttttggaat

SEQ ID NO: 5388971 - DNA, 13 bp, Homo sapiens
cattttattaata

SEQ ID NO: 5388972 - DNA, 20 bp, Homo sapiens
cattttattaataatattta

SEQ ID NO: 5388973 - DNA, 21 bp, Homo sapiens
cattttattcacatatgtctt

SEQ ID NO: 5388974 - DNA, 19 bp, Homo sapiens
cattttattgtcagaattt

SEQ ID NO: 5388975 - DNA, 19 bp, Homo sapiens
cattttatttaagaataaa

SEQ ID NO: 5388976 - DNA, 19 bp, Homo sapiens
cattttattttattatgca

SEQ ID NO: 5388977 - DNA, 14 bp, Homo sapiens
cattttatttttga

SEQ ID NO: 5388978 - DNA, 14 bp, Homo sapiens
cattttcaatccag

SEQ ID NO: 5388979 - DNA, 16 bp, Homo sapiens
cattttcaatgcacat

SEQ ID NO: 5388980 - DNA, 18 bp, Homo sapiens
cattttcactaaaagtgt

SEQ ID NO: 5388981 - DNA, 19 bp, Homo sapiens
cattttcactgcaatgtca

SEQ ID NO: 5388982 - DNA, 14 bp, Homo sapiens
cattttcagactgc

SEQ ID NO: 5388983 - DNA, 14 bp, Homo sapiens
cattttcagagtga

SEQ ID NO: 5388984 - DNA, 17 bp, Homo sapiens
cattttcagtcttgtag

SEQ ID NO: 5388985 - DNA, 18 bp, Homo sapiens
cattttcagttccctcct

SEQ ID NO: 5388986 - DNA, 15 bp, Homo sapiens
cattttcatatgctt

SEQ ID NO: 5388987 - DNA, 16 bp, Homo sapiens
cattttcatcctgagc

SEQ ID NO: 5388988 - DNA, 17 bp, Homo sapiens
cattttcattatttcaa

SEQ ID NO: 5388989 - DNA, 19 bp, Homo sapiens
cattttccacggaaacaga

SEQ ID NO: 5388990 - DNA, 23 bp, Homo sapiens
cattttccacggaaacagaactc

SEQ ID NO: 5388991 - DNA, 11 bp, Homo sapiens
cattttccagt

SEQ ID NO: 5388992 - DNA, 17 bp, Homo sapiens
cattttccatatcctgg

SEQ ID NO: 5388993 - DNA, 20 bp, Homo sapiens
cattttcccatcatcctttg

SEQ ID NO: 5388994 - DNA, 21 bp, Homo sapiens
cattttcccccactactgcag

SEQ ID NO: 5388995 - DNA, 21 bp, Homo sapiens
cattttcccccgtcctgtccc

SEQ ID NO: 5388996 - DNA, 15 bp, Homo sapiens
cattttccccctgtg

SEQ ID NO: 5388997 - DNA, 15 bp, Homo sapiens
cattttccccttcct

SEQ ID NO: 5388998 - DNA, 17 bp, Homo sapiens
cattttcctacaggcag

SEQ ID NO: 5388999 - DNA, 18 bp, Homo sapiens
cattttcctacaggcagt

SEQ ID NO: 5389000 - DNA, 11 bp, Homo sapiens
cattttcctcc

SEQ ID NO: 5389001 - DNA, 14 bp, Homo sapiens
cattttcctctgct

SEQ ID NO: 5389002 - DNA, 15 bp, Homo sapiens
cattttcctctgctt

SEQ ID NO: 5389003 - DNA, 19 bp, Homo sapiens
cattttcctgacatttgtt

SEQ ID NO: 5389004 - DNA, 12 bp, Homo sapiens
cattttcctggg

SEQ ID NO: 5389005 - DNA, 13 bp, Homo sapiens
cattttcctggga

SEQ ID NO: 5389006 - DNA, 13 bp, Homo sapiens
cattttcctgtgt

SEQ ID NO: 5389007 - DNA, 15 bp, Homo sapiens
cattttcctgttcag

SEQ ID NO: 5389008 - DNA, 18 bp, Homo sapiens
cattttcctgtttactga

SEQ ID NO: 5389009 - DNA, 19 bp, Homo sapiens
cattttcctgtttactgat

SEQ ID NO: 5389010 - DNA, 12 bp, Homo sapiens
cattttcctttc

SEQ ID NO: 5389011 - DNA, 20 bp, Homo sapiens
cattttcctttccttgtggt

SEQ ID NO: 5389012 - DNA, 21 bp, Homo sapiens
cattttcgctttcctctggtt

SEQ ID NO: 5389013 - DNA, 15 bp, Homo sapiens
cattttcgtcctgta

SEQ ID NO: 5389014 - DNA, 15 bp, Homo sapiens
cattttcgtttttaa

SEQ ID NO: 5389015 - DNA, 18 bp, Homo sapiens
cattttctaaactgtttt

SEQ ID NO: 5389016 - DNA, 14 bp, Homo sapiens
cattttctaagaaa

SEQ ID NO: 5389017 - DNA, 17 bp, Homo sapiens
cattttctaagaaacat

SEQ ID NO: 5389018 - DNA, 23 bp, Homo sapiens
cattttctaattctcttttcaaa

SEQ ID NO: 5389019 - DNA, 18 bp, Homo sapiens
cattttctagatacaata

SEQ ID NO: 5389020 - DNA, 21 bp, Homo sapiens
cattttctagatacaataaat

SEQ ID NO: 5389021 - DNA, 20 bp, Homo sapiens
cattttctagccctctccct

SEQ ID NO: 5389022 - DNA, 14 bp, Homo sapiens
cattttctccacct

SEQ ID NO: 5389023 - DNA, 13 bp, Homo sapiens
cattttctccctg

SEQ ID NO: 5389024 - DNA, 12 bp, Homo sapiens
cattttctctaa

SEQ ID NO: 5389025 - DNA, 15 bp, Homo sapiens
cattttctctagctg

SEQ ID NO: 5389026 - DNA, 20 bp, Homo sapiens
cattttctctattctttcca

SEQ ID NO: 5389027 - DNA, 21 bp, Homo sapiens
cattttctctattctttccat

SEQ ID NO: 5389028 - DNA, 22 bp, Homo sapiens
cattttctctattctttccatg

SEQ ID NO: 5389029 - DNA, 14 bp, Homo sapiens
cattttctctcagg

SEQ ID NO: 5389030 - DNA, 12 bp, Homo sapiens
cattttctctta

SEQ ID NO: 5389031 - DNA, 12 bp, Homo sapiens
cattttctcttt

SEQ ID NO: 5389032 - DNA, 15 bp, Homo sapiens
cattttctgcaagcc

SEQ ID NO: 5389033 - DNA, 17 bp, Homo sapiens
cattttctgcatctcca

SEQ ID NO: 5389034 - DNA, 10 bp, Homo sapiens
cattttctgg

SEQ ID NO: 5389035 - DNA, 18 bp, Homo sapiens
cattttctgggtgaaaga

SEQ ID NO: 5389036 - DNA, 20 bp, Homo sapiens
cattttctgtgtgtacatgt

SEQ ID NO: 5389037 - DNA, 17 bp, Homo sapiens
cattttctgttatacac

SEQ ID NO: 5389038 - DNA, 16 bp, Homo sapiens
cattttcttaatccag

SEQ ID NO: 5389039 - DNA, 23 bp, Homo sapiens
cattttcttattgcgctgctacc

SEQ ID NO: 5389040 - DNA, 17 bp, Homo sapiens
cattttcttcacagtgc

SEQ ID NO: 5389041 - DNA, 16 bp, Homo sapiens
cattttcttcagaatt

SEQ ID NO: 5389042 - DNA, 13 bp, Homo sapiens
cattttcttgaaa

SEQ ID NO: 5389043 - DNA, 16 bp, Homo sapiens
cattttcttgaatttt

SEQ ID NO: 5389044 - DNA, 12 bp, Homo sapiens
cattttcttgtc

SEQ ID NO: 5389045 - DNA, 12 bp, Homo sapiens
cattttctttcc

SEQ ID NO: 5389046 - DNA, 16 bp, Homo sapiens
cattttctttcctttc

SEQ ID NO: 5389047 - DNA, 23 bp, Homo sapiens
cattttgaaaagtattggttact

SEQ ID NO: 5389048 - DNA, 16 bp, Homo sapiens
cattttgaaaatatgt

SEQ ID NO: 5389049 - DNA, 19 bp, Homo sapiens
cattttgaaaatatgtact

SEQ ID NO: 5389050 - DNA, 13 bp, Homo sapiens
cattttgaagcta

SEQ ID NO: 5389051 - DNA, 16 bp, Homo sapiens
cattttgaaggaaaat

SEQ ID NO: 5389052 - DNA, 15 bp, Homo sapiens
cattttgacaacatg

SEQ ID NO: 5389053 - DNA, 16 bp, Homo sapiens
cattttgagaacattc

SEQ ID NO: 5389054 - DNA, 13 bp, Homo sapiens
cattttgagaatg

SEQ ID NO: 5389055 - DNA, 18 bp, Homo sapiens
cattttgagctatttcct

SEQ ID NO: 5389056 - DNA, 16 bp, Homo sapiens
cattttgaggccagag

SEQ ID NO: 5389057 - DNA, 19 bp, Homo sapiens
cattttgaggttttgtaaa

SEQ ID NO: 5389058 - DNA, 22 bp, Homo sapiens
cattttgaggttttgtaaaact

SEQ ID NO: 5389059 - DNA, 15 bp, Homo sapiens
cattttgagtatttt

SEQ ID NO: 5389060 - DNA, 20 bp, Homo sapiens
cattttgagtgactcgaggg

SEQ ID NO: 5389061 - DNA, 17 bp, Homo sapiens
cattttgatgtattatt

SEQ ID NO: 5389062 - DNA, 12 bp, Homo sapiens
cattttgcaaaa

SEQ ID NO: 5389063 - DNA, 13 bp, Homo sapiens
cattttgcactgt

SEQ ID NO: 5389064 - DNA, 16 bp, Homo sapiens
cattttgcagaaggaa

SEQ ID NO: 5389065 - DNA, 21 bp, Homo sapiens
cattttgcagaaggaaatgat

SEQ ID NO: 5389066 - DNA, 20 bp, Homo sapiens
cattttgcagcagtgagtct

SEQ ID NO: 5389067 - DNA, 20 bp, Homo sapiens
cattttgccaaaattattaa

SEQ ID NO: 5389068 - DNA, 12 bp, Homo sapiens
cattttgcctct

SEQ ID NO: 5389069 - DNA, 13 bp, Homo sapiens
cattttgcctctg

SEQ ID NO: 5389070 - DNA, 17 bp, Homo sapiens
cattttgcgatgtgttt

SEQ ID NO: 5389071 - DNA, 18 bp, Homo sapiens
cattttgcgatgtgtttt

SEQ ID NO: 5389072 - DNA, 19 bp, Homo sapiens
cattttgcgatgtgtttta

SEQ ID NO: 5389073 - DNA, 19 bp, Homo sapiens
cattttgctattgtaaata

SEQ ID NO: 5389074 - DNA, 17 bp, Homo sapiens
cattttgctctgtgaac

SEQ ID NO: 5389075 - DNA, 13 bp, Homo sapiens
cattttgcttccc

SEQ ID NO: 5389076 - DNA, 16 bp, Homo sapiens
cattttgcttcccatc

SEQ ID NO: 5389077 - DNA, 13 bp, Homo sapiens
cattttgctttat

SEQ ID NO: 5389078 - DNA, 16 bp, Homo sapiens
cattttggaaagcaag

SEQ ID NO: 5389079 - DNA, 20 bp, Homo sapiens
cattttggaaagcaaggttt

SEQ ID NO: 5389080 - DNA, 14 bp, Homo sapiens
cattttggaaattg

SEQ ID NO: 5389081 - DNA, 15 bp, Homo sapiens
cattttggaaattgt

SEQ ID NO: 5389082 - DNA, 12 bp, Homo sapiens
cattttggagct

SEQ ID NO: 5389083 - DNA, 17 bp, Homo sapiens
cattttggatttcttta

SEQ ID NO: 5389084 - DNA, 19 bp, Homo sapiens
cattttggatttctttata

SEQ ID NO: 5389085 - DNA, 18 bp, Homo sapiens
cattttggcatctgcaaa

SEQ ID NO: 5389086 - DNA, 21 bp, Homo sapiens
cattttggcgctattacaaat

SEQ ID NO: 5389087 - DNA, 22 bp, Homo sapiens
cattttggcgctattacaaata

SEQ ID NO: 5389088 - DNA, 19 bp, Homo sapiens
cattttggcgctcgaagtt

SEQ ID NO: 5389089 - DNA, 19 bp, Homo sapiens
cattttggctcagagtcca

SEQ ID NO: 5389090 - DNA, 18 bp, Homo sapiens
cattttgggatccttcag

SEQ ID NO: 5389091 - DNA, 23 bp, Homo sapiens
cattttggggctatatttacatg

SEQ ID NO: 5389092 - DNA, 20 bp, Homo sapiens
cattttgggggtttttaatc

SEQ ID NO: 5389093 - DNA, 17 bp, Homo sapiens
cattttggggttttata

SEQ ID NO: 5389094 - DNA, 16 bp, Homo sapiens
cattttggtactttgg

SEQ ID NO: 5389095 - DNA, 16 bp, Homo sapiens
cattttggtctgtttt

SEQ ID NO: 5389096 - DNA, 22 bp, Homo sapiens
cattttggtgtctttctctttt

SEQ ID NO: 5389097 - DNA, 21 bp, Homo sapiens
cattttggtgtgcatctgtgt

SEQ ID NO: 5389098 - DNA, 16 bp, Homo sapiens
cattttggttcttctc

SEQ ID NO: 5389099 - DNA, 14 bp, Homo sapiens
cattttggtttatt

SEQ ID NO: 5389100 - DNA, 20 bp, Homo sapiens
cattttggttttgtgttttg

SEQ ID NO: 5389101 - DNA, 16 bp, Homo sapiens
cattttggtttttcct

SEQ ID NO: 5389102 - DNA, 16 bp, Homo sapiens
cattttgtaaaatatt

SEQ ID NO: 5389103 - DNA, 12 bp, Homo sapiens
cattttgtaaac

SEQ ID NO: 5389104 - DNA, 16 bp, Homo sapiens
cattttgtaaatctgt

SEQ ID NO: 5389105 - DNA, 18 bp, Homo sapiens
cattttgtaaatctgtac

SEQ ID NO: 5389106 - DNA, 23 bp, Homo sapiens
cattttgtaaatctgtacttttt

SEQ ID NO: 5389107 - DNA, 14 bp, Homo sapiens
cattttgtaactgc

SEQ ID NO: 5389108 - DNA, 16 bp, Homo sapiens
cattttgtaataataa

SEQ ID NO: 5389109 - DNA, 13 bp, Homo sapiens
cattttgtacaaa

SEQ ID NO: 5389110 - DNA, 13 bp, Homo sapiens
cattttgtacatt

SEQ ID NO: 5389111 - DNA, 22 bp, Homo sapiens
cattttgtaccaaccatccaat

SEQ ID NO: 5389112 - DNA, 17 bp, Homo sapiens
cattttgtagcctctct

SEQ ID NO: 5389113 - DNA, 20 bp, Homo sapiens
cattttgtataattgtatcg

SEQ ID NO: 5389114 - DNA, 21 bp, Homo sapiens
cattttgtataattgtatcgt

SEQ ID NO: 5389115 - DNA, 19 bp, Homo sapiens
cattttgtatattaacttt

SEQ ID NO: 5389116 - DNA, 22 bp, Homo sapiens
cattttgtatggagttaaataa

SEQ ID NO: 5389117 - DNA, 13 bp, Homo sapiens
cattttgtatgta

SEQ ID NO: 5389118 - DNA, 16 bp, Homo sapiens
cattttgtatgtatgt

SEQ ID NO: 5389119 - DNA, 20 bp, Homo sapiens
cattttgtgaagccctgttg

SEQ ID NO: 5389120 - DNA, 12 bp, Homo sapiens
cattttgtgaat

SEQ ID NO: 5389121 - DNA, 14 bp, Homo sapiens
cattttgtgaatgg

SEQ ID NO: 5389122 - DNA, 18 bp, Homo sapiens
cattttgtgcagtgatta

SEQ ID NO: 5389123 - DNA, 20 bp, Homo sapiens
cattttgtggcaaaatattc

SEQ ID NO: 5389124 - DNA, 14 bp, Homo sapiens
cattttgtgtacag

SEQ ID NO: 5389125 - DNA, 22 bp, Homo sapiens
cattttgtgtcttaagaaaaat

SEQ ID NO: 5389126 - DNA, 12 bp, Homo sapiens
cattttgttaca

SEQ ID NO: 5389127 - DNA, 15 bp, Homo sapiens
cattttgttcttaca

SEQ ID NO: 5389128 - DNA, 18 bp, Homo sapiens
cattttgttcttacacat

SEQ ID NO: 5389129 - DNA, 13 bp, Homo sapiens
cattttgttgtaa

SEQ ID NO: 5389130 - DNA, 14 bp, Homo sapiens
cattttgttgtaaa

SEQ ID NO: 5389131 - DNA, 18 bp, Homo sapiens
cattttgttgtaaaaaga

SEQ ID NO: 5389132 - DNA, 12 bp, Homo sapiens
cattttgtttca

SEQ ID NO: 5389133 - DNA, 17 bp, Homo sapiens
cattttgtttcactctt

SEQ ID NO: 5389134 - DNA, 17 bp, Homo sapiens
cattttgtttccaaagc

SEQ ID NO: 5389135 - DNA, 12 bp, Homo sapiens
cattttgtttct

SEQ ID NO: 5389136 - DNA, 13 bp, Homo sapiens
cattttgtttgaa

SEQ ID NO: 5389137 - DNA, 20 bp, Homo sapiens
cattttgtttggtattgtat

SEQ ID NO: 5389138 - DNA, 21 bp, Homo sapiens
cattttgtttggtattgtatt

SEQ ID NO: 5389139 - DNA, 17 bp, Homo sapiens
cattttgtttttactgt

SEQ ID NO: 5389140 - DNA, 18 bp, Homo sapiens
cattttgtttttactgta

SEQ ID NO: 5389141 - DNA, 14 bp, Homo sapiens
catttttaaaacaa

SEQ ID NO: 5389142 - DNA, 13 bp, Homo sapiens
catttttaaaact

SEQ ID NO: 5389143 - DNA, 14 bp, Homo sapiens
catttttaaaacta

SEQ ID NO: 5389144 - DNA, 15 bp, Homo sapiens
catttttaaacttga

SEQ ID NO: 5389145 - DNA, 18 bp, Homo sapiens
ccaaagatccacccaaat

SEQ ID NO: 5389146 - DNA, 17 bp, Homo sapiens
ccaaagatcccacggga

SEQ ID NO: 5389147 - DNA, 19 bp, Homo sapiens
ccaaagatctgctcctcgc

SEQ ID NO: 5389148 - DNA, 12 bp, Homo sapiens
ccaaagatgact

SEQ ID NO: 5389149 - DNA, 16 bp, Homo sapiens
ccaaagatgcagccgc

SEQ ID NO: 5389150 - DNA, 13 bp, Homo sapiens
ccaaagatgttaa

SEQ ID NO: 5389151 - DNA, 21 bp, Homo sapiens
ccaaagatgttaacagtattt

SEQ ID NO: 5389152 - DNA, 23 bp, Homo sapiens
ccaaagattaggtcgttttccaa

SEQ ID NO: 5389153 - DNA, 20 bp, Homo sapiens
ccaaagcaaaacatcacatt

SEQ ID NO: 5389154 - DNA, 16 bp, Homo sapiens
ccaaagcaagcaagag

SEQ ID NO: 5389155 - DNA, 17 bp, Homo sapiens
ccaaagcaagcaagagg

SEQ ID NO: 5389156 - DNA, 16 bp, Homo sapiens
ccaaagcaaggtacag

SEQ ID NO: 5389157 - DNA, 20 bp, Homo sapiens
ccaaagcaatgtgagtccca

SEQ ID NO: 5389158 - DNA, 23 bp, Homo sapiens
ccaaagcaatgtgagtcccagag

SEQ ID NO: 5389159 - DNA, 13 bp, Homo sapiens
ccaaagcagacat

SEQ ID NO: 5389160 - DNA, 19 bp, Homo sapiens
ccaaagcagcaggcctctg

SEQ ID NO: 5389161 - DNA, 14 bp, Homo sapiens
ccaaagcagctaca

SEQ ID NO: 5389162 - DNA, 18 bp, Homo sapiens
ccaaagcagctacaataa

SEQ ID NO: 5389163 - DNA, 12 bp, Homo sapiens
ccaaagcagggt

SEQ ID NO: 5389164 - DNA, 23 bp, Homo sapiens
ccaaagcagtggagcccaggagt

SEQ ID NO: 5389165 - DNA, 14 bp, Homo sapiens
ccaaagcatggact

SEQ ID NO: 5389166 - DNA, 15 bp, Homo sapiens
ccaaagcatttctag

SEQ ID NO: 5389167 - DNA, 19 bp, Homo sapiens
ccaaagccaaagctaggcc

SEQ ID NO: 5389168 - DNA, 20 bp, Homo sapiens
ccaaagccacctctgtcatt

SEQ ID NO: 5389169 - DNA, 13 bp, Homo sapiens
ccaaagccacctg

SEQ ID NO: 5389170 - DNA, 16 bp, Homo sapiens
ccaaagccactggaag

SEQ ID NO: 5389171 - DNA, 21 bp, Homo sapiens
ccaaagccactggaaggagca

SEQ ID NO: 5389172 - DNA, 15 bp, Homo sapiens
ccaaagccagagtgg

SEQ ID NO: 5389173 - DNA, 19 bp, Homo sapiens
ccaaagccagtgaaatgtg

SEQ ID NO: 5389174 - DNA, 22 bp, Homo sapiens
ccaaagccagtgaaatgtgaag

SEQ ID NO: 5389175 - DNA, 12 bp, Homo sapiens
ccaaagcccagc

SEQ ID NO: 5389176 - DNA, 13 bp, Homo sapiens
ccaaagcccagcc

SEQ ID NO: 5389177 - DNA, 15 bp, Homo sapiens
ccaaagcccagcccg

SEQ ID NO: 5389178 - DNA, 18 bp, Homo sapiens
ccaaagcccagcccggct

SEQ ID NO: 5389179 - DNA, 12 bp, Homo sapiens
ccaaagccccat

SEQ ID NO: 5389180 - DNA, 23 bp, Homo sapiens
ccaaagccccatgtgccttgtcc

SEQ ID NO: 5389181 - DNA, 13 bp, Homo sapiens
ccaaagccctggt

SEQ ID NO: 5389182 - DNA, 17 bp, Homo sapiens
ccaaagcctcctccagc

SEQ ID NO: 5389183 - DNA, 14 bp, Homo sapiens
ccaaagcctgagga

SEQ ID NO: 5389184 - DNA, 21 bp, Homo sapiens
ccaaagcctgggcagaaatgt

SEQ ID NO: 5389185 - DNA, 12 bp, Homo sapiens
ccaaagcctgtc

SEQ ID NO: 5389186 - DNA, 17 bp, Homo sapiens
ccaaagcctgtcccagg

SEQ ID NO: 5389187 - DNA, 16 bp, Homo sapiens
ccaaagcgctgaggct

SEQ ID NO: 5389188 - DNA, 16 bp, Homo sapiens
ccaaagcggtccctgt

SEQ ID NO: 5389189 - DNA, 16 bp, Homo sapiens
ccaaagctaggcctgg

SEQ ID NO: 5389190 - DNA, 19 bp, Homo sapiens
ccaaagctagggtggccct

SEQ ID NO: 5389191 - DNA, 20 bp, Homo sapiens
ccaaagctgacgaggctggg

SEQ ID NO: 5389192 - DNA, 14 bp, Homo sapiens
ccaaagctgagcct

SEQ ID NO: 5389193 - DNA, 15 bp, Homo sapiens
ccaaagctgagcctg

SEQ ID NO: 5389194 - DNA, 21 bp, Homo sapiens
ccaaagctgcccactgtttct

SEQ ID NO: 5389195 - DNA, 12 bp, Homo sapiens
ccaaagctgctt

SEQ ID NO: 5389196 - DNA, 14 bp, Homo sapiens
ccaaagctgctttc

SEQ ID NO: 5389197 - DNA, 14 bp, Homo sapiens
ccaaagctggagcc

SEQ ID NO: 5389198 - DNA, 18 bp, Homo sapiens
ccaaagcttattttgtaa

SEQ ID NO: 5389199 - DNA, 19 bp, Homo sapiens
ccaaagcttattttgtaag

SEQ ID NO: 5389200 - DNA, 21 bp, Homo sapiens
ccaaagctttactactgtgga

SEQ ID NO: 5389201 - DNA, 16 bp, Homo sapiens
ccaaagctttcctgcc

SEQ ID NO: 5389202 - DNA, 17 bp, Homo sapiens
ccaaagctttcctgccc

SEQ ID NO: 5389203 - DNA, 23 bp, Homo sapiens
ccaaaggaaaaagcacaagaagc

SEQ ID NO: 5389204 - DNA, 14 bp, Homo sapiens
ccaaaggaaaatgt

SEQ ID NO: 5389205 - DNA, 16 bp, Homo sapiens
ccaaaggaaggggttt

SEQ ID NO: 5389206 - DNA, 19 bp, Homo sapiens
ccaaaggaagtagcaggcc

SEQ ID NO: 5389207 - DNA, 12 bp, Homo sapiens
ccaaaggaatcg

SEQ ID NO: 5389208 - DNA, 21 bp, Homo sapiens
ccaaaggaatttgcatccagc

SEQ ID NO: 5389209 - DNA, 23 bp, Homo sapiens
ccaaaggagacccgccccagggc

SEQ ID NO: 5389210 - DNA, 18 bp, Homo sapiens
ccaaaggaggctggcagg

SEQ ID NO: 5389211 - DNA, 21 bp, Homo sapiens
ccaaaggagtgcatggccaca

SEQ ID NO: 5389212 - DNA, 19 bp, Homo sapiens
ccaaaggcatcccagcctg

SEQ ID NO: 5389213 - DNA, 15 bp, Homo sapiens
ccaaaggccagcggt

SEQ ID NO: 5389214 - DNA, 20 bp, Homo sapiens
ccaaaggccatggagagctg

SEQ ID NO: 5389215 - DNA, 14 bp, Homo sapiens
ccaaaggcccaggg

SEQ ID NO: 5389216 - DNA, 17 bp, Homo sapiens
ccaaaggcccagggagg

SEQ ID NO: 5389217 - DNA, 12 bp, Homo sapiens
ccaaaggctggt

SEQ ID NO: 5389218 - DNA, 18 bp, Homo sapiens
ccaaagggaagtgaggcc

SEQ ID NO: 5389219 - DNA, 19 bp, Homo sapiens
ccaaagggagtctgccagg

SEQ ID NO: 5389220 - DNA, 18 bp, Homo sapiens
ccaaaggggacaggcctc

SEQ ID NO: 5389221 - DNA, 18 bp, Homo sapiens
ccaaaggggacctggaag

SEQ ID NO: 5389222 - DNA, 15 bp, Homo sapiens
ccaaaggggagccag

SEQ ID NO: 5389223 - DNA, 18 bp, Homo sapiens
ccaaaggggcctctcctt

SEQ ID NO: 5389224 - DNA, 16 bp, Homo sapiens
ccaaaggggctgctgg

SEQ ID NO: 5389225 - DNA, 18 bp, Homo sapiens
ccaaagggggccctggct

SEQ ID NO: 5389226 - DNA, 15 bp, Homo sapiens
ccaaaggtgaaggaa

SEQ ID NO: 5389227 - DNA, 22 bp, Homo sapiens
ccaaaggtgaaggaatatatgg

SEQ ID NO: 5389228 - DNA, 17 bp, Homo sapiens
ccaaagtaaaagaaacc

SEQ ID NO: 5389229 - DNA, 18 bp, Homo sapiens
ccaaagtaaactgtgtag

SEQ ID NO: 5389230 - DNA, 15 bp, Homo sapiens
ccaaagtacactgtt

SEQ ID NO: 5389231 - DNA, 17 bp, Homo sapiens
ccaaagtaccacactga

SEQ ID NO: 5389232 - DNA, 17 bp, Homo sapiens
ccaaagtattcttcttt

SEQ ID NO: 5389233 - DNA, 14 bp, Homo sapiens
ccaaagtattgtac

SEQ ID NO: 5389234 - DNA, 13 bp, Homo sapiens
ccaaagtattttt

SEQ ID NO: 5389235 - DNA, 18 bp, Homo sapiens
ccaaagtcagtaggagag

SEQ ID NO: 5389236 - DNA, 19 bp, Homo sapiens
ccaaagtcagtaggagagg

SEQ ID NO: 5389237 - DNA, 19 bp, Homo sapiens
ccaaagtcataattgcatt

SEQ ID NO: 5389238 - DNA, 14 bp, Homo sapiens
ccaaagtccaggct

SEQ ID NO: 5389239 - DNA, 16 bp, Homo sapiens
ccaaagtcccttcctg

SEQ ID NO: 5389240 - DNA, 17 bp, Homo sapiens
ccaaagtcccttcctgc

SEQ ID NO: 5389241 - DNA, 14 bp, Homo sapiens
ccaaagtcctctgc

SEQ ID NO: 5389242 - DNA, 15 bp, Homo sapiens
ccaaagtctctaatt

SEQ ID NO: 5389243 - DNA, 18 bp, Homo sapiens
ccaaagtctctaattcta

SEQ ID NO: 5389244 - DNA, 21 bp, Homo sapiens
ccaaagtctgccgcccacctc

SEQ ID NO: 5389245 - DNA, 17 bp, Homo sapiens
ccaaagtgaactctcaa

SEQ ID NO: 5389246 - DNA, 20 bp, Homo sapiens
ccaaagtgcatgtcacatgc

SEQ ID NO: 5389247 - DNA, 21 bp, Homo sapiens
ccaaagtgcatgtcacatgcc

SEQ ID NO: 5389248 - DNA, 22 bp, Homo sapiens
ccaaagtgcatgtcacatgcca

SEQ ID NO: 5389249 - DNA, 18 bp, Homo sapiens
ccaaagtgccttctgagc

SEQ ID NO: 5389250 - DNA, 18 bp, Homo sapiens
ccaaagtgctgggattaa

SEQ ID NO: 5389251 - DNA, 19 bp, Homo sapiens
ccaaagtgctgggattaca

SEQ ID NO: 5389252 - DNA, 16 bp, Homo sapiens
ccaaagtggagctggg

SEQ ID NO: 5389253 - DNA, 18 bp, Homo sapiens
ccaaagtggagctgggag

SEQ ID NO: 5389254 - DNA, 23 bp, Homo sapiens
ccaaagtggggagggacaaggga

SEQ ID NO: 5389255 - DNA, 19 bp, Homo sapiens
ccaaagtggtatagaaatg

SEQ ID NO: 5389256 - DNA, 22 bp, Homo sapiens
ccaaagtggtatagaaatgctg

SEQ ID NO: 5389257 - DNA, 19 bp, Homo sapiens
ccaaagtgtcttttgacat

SEQ ID NO: 5389258 - DNA, 22 bp, Homo sapiens
ccaaagtgttaggattacaggc

SEQ ID NO: 5389259 - DNA, 22 bp, Homo sapiens
ccaaagtgttgggattacaggc

SEQ ID NO: 5389260 - DNA, 16 bp, Homo sapiens
ccaaagttaaatgtat

SEQ ID NO: 5389261 - DNA, 16 bp, Homo sapiens
ccaaagttagttcagt

SEQ ID NO: 5389262 - DNA, 11 bp, Homo sapiens
ccaaagttcta

SEQ ID NO: 5389263 - DNA, 19 bp, Homo sapiens
ccaaagttctaataatttc

SEQ ID NO: 5389264 - DNA, 11 bp, Homo sapiens
ccaaataaaaa

SEQ ID NO: 5389265 - DNA, 14 bp, Homo sapiens
ccaaataaaaaaca

SEQ ID NO: 5389266 - DNA, 14 bp, Homo sapiens
ccaaataaaaataa

SEQ ID NO: 5389267 - DNA, 19 bp, Homo sapiens
ccaaataaacagctattta

SEQ ID NO: 5389268 - DNA, 23 bp, Homo sapiens
ccaaataaacattttttaagaaa

SEQ ID NO: 5389269 - DNA, 17 bp, Homo sapiens
ccaaataaatgtgtaaa

SEQ ID NO: 5389270 - DNA, 17 bp, Homo sapiens
ccaaataaattcaataa

SEQ ID NO: 5389271 - DNA, 12 bp, Homo sapiens
ccaaataacagt

SEQ ID NO: 5389272 - DNA, 15 bp, Homo sapiens
ccaaataacttcagt

SEQ ID NO: 5389273 - DNA, 18 bp, Homo sapiens
ccaaataacttcagtcct

SEQ ID NO: 5389274 - DNA, 15 bp, Homo sapiens
ccaaataagaaacct

SEQ ID NO: 5389275 - DNA, 23 bp, Homo sapiens
ccaaataatatgtttccttccct

SEQ ID NO: 5389276 - DNA, 15 bp, Homo sapiens
ccaaataatgtctct

SEQ ID NO: 5389277 - DNA, 16 bp, Homo sapiens
ccaaataatgtctctg

SEQ ID NO: 5389278 - DNA, 13 bp, Homo sapiens
ccaaatacacatt

SEQ ID NO: 5389279 - DNA, 15 bp, Homo sapiens
ccaaatacacatttc

SEQ ID NO: 5389280 - DNA, 17 bp, Homo sapiens
ccaaatacacatttcac

SEQ ID NO: 5389281 - DNA, 17 bp, Homo sapiens
ccaaatacccaaatgtc

SEQ ID NO: 5389282 - DNA, 15 bp, Homo sapiens
ccaaatagccacctt

SEQ ID NO: 5389283 - DNA, 22 bp, Homo sapiens
ccaaatagcctctcctttgtag

SEQ ID NO: 5389284 - DNA, 18 bp, Homo sapiens
ccaaatagcttttcactt

SEQ ID NO: 5389285 - DNA, 23 bp, Homo sapiens
ccaaataggatcatatgaattgc

SEQ ID NO: 5389286 - DNA, 16 bp, Homo sapiens
ccaaatataacatgaa

SEQ ID NO: 5389287 - DNA, 15 bp, Homo sapiens
ccaaatataagacat

SEQ ID NO: 5389288 - DNA, 20 bp, Homo sapiens
ccaaatataagacatttgtt

SEQ ID NO: 5389289 - DNA, 23 bp, Homo sapiens
ccaaatatatcaaaacgttttat

SEQ ID NO: 5389290 - DNA, 18 bp, Homo sapiens
ccaaatatatgccttact

SEQ ID NO: 5389291 - DNA, 19 bp, Homo sapiens
ccaaatatcagtgggctct

SEQ ID NO: 5389292 - DNA, 13 bp, Homo sapiens
ccaaatatgcact

SEQ ID NO: 5389293 - DNA, 17 bp, Homo sapiens
ccaaatatgcactttcc

SEQ ID NO: 5389294 - DNA, 23 bp, Homo sapiens
ccaaatatgcactttccctagaa

SEQ ID NO: 5389295 - DNA, 14 bp, Homo sapiens
ccaaatattctcct

SEQ ID NO: 5389296 - DNA, 12 bp, Homo sapiens
ccaaatattgtg

SEQ ID NO: 5389297 - DNA, 14 bp, Homo sapiens
ccaaatcaaaataa

SEQ ID NO: 5389298 - DNA, 13 bp, Homo sapiens
ccaaatcaaggat

SEQ ID NO: 5389299 - DNA, 15 bp, Homo sapiens
ccaaatcaaggatct

SEQ ID NO: 5389300 - DNA, 18 bp, Homo sapiens
ccaaatcacccaatccca

SEQ ID NO: 5389301 - DNA, 15 bp, Homo sapiens
ccaaatcagctgcta

SEQ ID NO: 5389302 - DNA, 16 bp, Homo sapiens
ccaaatcatcctgaat

SEQ ID NO: 5389303 - DNA, 20 bp, Homo sapiens
ccaaatccctttcatgtctt

SEQ ID NO: 5389304 - DNA, 24 bp, Homo sapiens
ccaaatccgaacctcctctgtgaa

SEQ ID NO: 5389305 - DNA, 19 bp, Homo sapiens
ccaaatccgccagtgtttc

SEQ ID NO: 5389306 - DNA, 16 bp, Homo sapiens
ccaaatccgctctctt

SEQ ID NO: 5389307 - DNA, 18 bp, Homo sapiens
ccaaatccgctctcttcc

SEQ ID NO: 5389308 - DNA, 22 bp, Homo sapiens
ccaaatccgctctcttcctgcc

SEQ ID NO: 5389309 - DNA, 24 bp, Homo sapiens
ccaaatcctagactgctcctgggc

SEQ ID NO: 5389310 - DNA, 14 bp, Homo sapiens
ccaaatcctattta

SEQ ID NO: 5389311 - DNA, 18 bp, Homo sapiens
ccaaatcctctccagcta

SEQ ID NO: 5389312 - DNA, 19 bp, Homo sapiens
ccaaatcctgtctgaaaag

SEQ ID NO: 5389313 - DNA, 20 bp, Homo sapiens
ccaaatccttagatctggca

SEQ ID NO: 5389314 - DNA, 13 bp, Homo sapiens
ccaaatccttccc

SEQ ID NO: 5389315 - DNA, 22 bp, Homo sapiens
ccaaatcgtggcacgtattgct

SEQ ID NO: 5389316 - DNA, 24 bp, Homo sapiens
ccaaatctaaatagatacttttga

SEQ ID NO: 5389317 - DNA, 20 bp, Homo sapiens
ccaaatctcttgcttgtcat

SEQ ID NO: 5389318 - DNA, 10 bp, Homo sapiens
ccaaatctga

SEQ ID NO: 5389319 - DNA, 18 bp, Homo sapiens
ccaaatctgacatattat

SEQ ID NO: 5389320 - DNA, 20 bp, Homo sapiens
ccaaatctgacctaaaagtt

SEQ ID NO: 5389321 - DNA, 15 bp, Homo sapiens
ccaaatctgtcctct

SEQ ID NO: 5389322 - DNA, 16 bp, Homo sapiens
ccaaatctgtcctctg

SEQ ID NO: 5389323 - DNA, 11 bp, Homo sapiens
ccaactcagga

SEQ ID NO: 5389324 - DNA, 13 bp, Homo sapiens
ccaactccagcaa

SEQ ID NO: 5389325 - DNA, 15 bp, Homo sapiens
ccaactccagcaact

SEQ ID NO: 5389326 - DNA, 20 bp, Homo sapiens
ccaactccaggaaagagcag

SEQ ID NO: 5389327 - DNA, 14 bp, Homo sapiens
ccaactccaggggc

SEQ ID NO: 5389328 - DNA, 16 bp, Homo sapiens
ccaactccaggggcac

SEQ ID NO: 5389329 - DNA, 18 bp, Homo sapiens
ccaactccaggggcacct

SEQ ID NO: 5389330 - DNA, 19 bp, Homo sapiens
ccaactccatgaccaggcc

SEQ ID NO: 5389331 - DNA, 20 bp, Homo sapiens
ccaactccatgaccaggcca

SEQ ID NO: 5389332 - DNA, 21 bp, Homo sapiens
ccaactccatgaccaggccac

SEQ ID NO: 5389333 - DNA, 14 bp, Homo sapiens
ccaactcccagcct

SEQ ID NO: 5389334 - DNA, 14 bp, Homo sapiens
ccaactcccttctg

SEQ ID NO: 5389335 - DNA, 19 bp, Homo sapiens
ccaactccgcccagcctct

SEQ ID NO: 5389336 - DNA, 15 bp, Homo sapiens
ccaactcctagttct

SEQ ID NO: 5389337 - DNA, 19 bp, Homo sapiens
ccaactcctagttctagaa

SEQ ID NO: 5389338 - DNA, 19 bp, Homo sapiens
ccaactcctggaagctgtg

SEQ ID NO: 5389339 - DNA, 22 bp, Homo sapiens
ccaactcctggaagctgtgtcc

SEQ ID NO: 5389340 - DNA, 18 bp, Homo sapiens
ccaactcctggagatttc

SEQ ID NO: 5389341 - DNA, 14 bp, Homo sapiens
ccaactccttccag

SEQ ID NO: 5389342 - DNA, 13 bp, Homo sapiens
ccaactccttcct

SEQ ID NO: 5389343 - DNA, 19 bp, Homo sapiens
ccaactcctttcagccaca

SEQ ID NO: 5389344 - DNA, 11 bp, Homo sapiens
ccaactctaat

SEQ ID NO: 5389345 - DNA, 20 bp, Homo sapiens
ccaactctatactcaatcaa

SEQ ID NO: 5389346 - DNA, 19 bp, Homo sapiens
ccaactctccccagtgcct

SEQ ID NO: 5389347 - DNA, 13 bp, Homo sapiens
ccaactctcctgg

SEQ ID NO: 5389348 - DNA, 14 bp, Homo sapiens
ccaactctcctggc

SEQ ID NO: 5389349 - DNA, 23 bp, Homo sapiens
ccaactctcctggcctggccatc

SEQ ID NO: 5389350 - DNA, 14 bp, Homo sapiens
ccaactctctctgc

SEQ ID NO: 5389351 - DNA, 15 bp, Homo sapiens
ccaactctctgagag

SEQ ID NO: 5389352 - DNA, 15 bp, Homo sapiens
ccaactctgcactcc

SEQ ID NO: 5389353 - DNA, 14 bp, Homo sapiens
ccaactctgtattt

SEQ ID NO: 5389354 - DNA, 19 bp, Homo sapiens
ccaactcttccacctctgg

SEQ ID NO: 5389355 - DNA, 19 bp, Homo sapiens
ccaactcttcctcccctct

SEQ ID NO: 5389356 - DNA, 11 bp, Homo sapiens
ccaactgaatt

SEQ ID NO: 5389357 - DNA, 18 bp, Homo sapiens
ccaactgaattaaactta

SEQ ID NO: 5389358 - DNA, 17 bp, Homo sapiens
ccaactgacttctgcta

SEQ ID NO: 5389359 - DNA, 22 bp, Homo sapiens
ccaactgagaaaacgaaactgc

SEQ ID NO: 5389360 - DNA, 22 bp, Homo sapiens
ccaactgatcctgctccagcag

SEQ ID NO: 5389361 - DNA, 14 bp, Homo sapiens
ccaactgattttgt

SEQ ID NO: 5389362 - DNA, 18 bp, Homo sapiens
ccaactgattttgtatgt

SEQ ID NO: 5389363 - DNA, 19 bp, Homo sapiens
ccaactgcaaaaaaagcct

SEQ ID NO: 5389364 - DNA, 16 bp, Homo sapiens
ccaactgccaggctgc

SEQ ID NO: 5389365 - DNA, 13 bp, Homo sapiens
ccaactgccccag

SEQ ID NO: 5389366 - DNA, 15 bp, Homo sapiens
ccaactgccccaggg

SEQ ID NO: 5389367 - DNA, 18 bp, Homo sapiens
ccaactgcctaaggccct

SEQ ID NO: 5389368 - DNA, 16 bp, Homo sapiens
ccaactgcctccttgc

SEQ ID NO: 5389369 - DNA, 23 bp, Homo sapiens
ccaactgcctccttgccagcccc

SEQ ID NO: 5389370 - DNA, 15 bp, Homo sapiens
ccaactgctccagcc

SEQ ID NO: 5389371 - DNA, 19 bp, Homo sapiens
ccaactgctccagcctctg

SEQ ID NO: 5389372 - DNA, 23 bp, Homo sapiens
ccaactgctgcttaaaatgcaag

SEQ ID NO: 5389373 - DNA, 12 bp, Homo sapiens
ccaactgctttg

SEQ ID NO: 5389374 - DNA, 18 bp, Homo sapiens
ccaactggccctcttctt

SEQ ID NO: 5389375 - DNA, 17 bp, Homo sapiens
ccaactggcttctgtgc

SEQ ID NO: 5389376 - DNA, 19 bp, Homo sapiens
ccaactgggcatttcaatc

SEQ ID NO: 5389377 - DNA, 13 bp, Homo sapiens
ccaactggtcact

SEQ ID NO: 5389378 - DNA, 19 bp, Homo sapiens
ccaactggttcaggctcaa

SEQ ID NO: 5389379 - DNA, 22 bp, Homo sapiens
ccaactgtagccaccctggcat

SEQ ID NO: 5389380 - DNA, 10 bp, Homo sapiens
ccaactgtgt

SEQ ID NO: 5389381 - DNA, 23 bp, Homo sapiens
ccaactgttcagctgtcctccct

SEQ ID NO: 5389382 - DNA, 11 bp, Homo sapiens
ccaacttccca

SEQ ID NO: 5389383 - DNA, 12 bp, Homo sapiens
ccaacttcccct

SEQ ID NO: 5389384 - DNA, 17 bp, Homo sapiens
ccaacttcctctgccat

SEQ ID NO: 5389385 - DNA, 12 bp, Homo sapiens
ccaacttcctgt

SEQ ID NO: 5389386 - DNA, 15 bp, Homo sapiens
ccaacttcctgtggc

SEQ ID NO: 5389387 - DNA, 19 bp, Homo sapiens
ccaacttcctgtggcctga

SEQ ID NO: 5389388 - DNA, 22 bp, Homo sapiens
ccaacttctcccaccccttggc

SEQ ID NO: 5389389 - DNA, 23 bp, Homo sapiens
ccaacttctcccaccccttggcc

SEQ ID NO: 5389390 - DNA, 18 bp, Homo sapiens
ccaacttcttcagagctg

SEQ ID NO: 5389391 - DNA, 23 bp, Homo sapiens
ccaacttgaaggattgcatcctg

SEQ ID NO: 5389392 - DNA, 20 bp, Homo sapiens
ccaacttgccaaaatgttgg

SEQ ID NO: 5389393 - DNA, 13 bp, Homo sapiens
ccaacttgccaca

SEQ ID NO: 5389394 - DNA, 16 bp, Homo sapiens
ccaacttgccacatgt

SEQ ID NO: 5389395 - DNA, 13 bp, Homo sapiens
ccaacttgccttt

SEQ ID NO: 5389396 - DNA, 22 bp, Homo sapiens
ccaacttggcagctttttctgt

SEQ ID NO: 5389397 - DNA, 11 bp, Homo sapiens
ccaacttgtaa

SEQ ID NO: 5389398 - DNA, 16 bp, Homo sapiens
ccaacttgtctgggaa

SEQ ID NO: 5389399 - DNA, 17 bp, Homo sapiens
ccaactttatcatggaa

SEQ ID NO: 5389400 - DNA, 14 bp, Homo sapiens
ccaactttcacagt

SEQ ID NO: 5389401 - DNA, 21 bp, Homo sapiens
ccaactttctcactgctgtca

SEQ ID NO: 5389402 - DNA, 22 bp, Homo sapiens
ccaactttctcactgctgtcag

SEQ ID NO: 5389403 - DNA, 13 bp, Homo sapiens
ccaactttctgta

SEQ ID NO: 5389404 - DNA, 17 bp, Homo sapiens
ccaactttctgtaaact

SEQ ID NO: 5389405 - DNA, 22 bp, Homo sapiens
ccaactttgtggatgtcttcct

SEQ ID NO: 5389406 - DNA, 11 bp, Homo sapiens
ccaacttttct

SEQ ID NO: 5389407 - DNA, 17 bp, Homo sapiens
ccaactttttcatagta

SEQ ID NO: 5389408 - DNA, 19 bp, Homo sapiens
ccaactttttcattccctg

SEQ ID NO: 5389409 - DNA, 13 bp, Homo sapiens
ccaagaaaatatc

SEQ ID NO: 5389410 - DNA, 20 bp, Homo sapiens
ccaagaaaccaaagtctgcc

SEQ ID NO: 5389411 - DNA, 15 bp, Homo sapiens
ccaagaaacctgact

SEQ ID NO: 5389412 - DNA, 19 bp, Homo sapiens
ccaagaaacgtggatctcc

SEQ ID NO: 5389413 - DNA, 16 bp, Homo sapiens
ccaagaaagaaaccag

SEQ ID NO: 5389414 - DNA, 22 bp, Homo sapiens
ccaagaaagatgaatacatttt

SEQ ID NO: 5389415 - DNA, 21 bp, Homo sapiens
ccaagaaagctcactgtagct

SEQ ID NO: 5389416 - DNA, 19 bp, Homo sapiens
ccaagaaagcttcttcaga

SEQ ID NO: 5389417 - DNA, 15 bp, Homo sapiens
ccaagaaatggaatc

SEQ ID NO: 5389418 - DNA, 18 bp, Homo sapiens
ccaagaacacaagaagac

SEQ ID NO: 5389419 - DNA, 19 bp, Homo sapiens
ccaagaacctatatcttac

SEQ ID NO: 5389420 - DNA, 17 bp, Homo sapiens
ccaagaactcctgaaat

SEQ ID NO: 5389421 - DNA, 17 bp, Homo sapiens
ccaagaactgaaaacat

SEQ ID NO: 5389422 - DNA, 14 bp, Homo sapiens
ccaagaactgcatg

SEQ ID NO: 5389423 - DNA, 15 bp, Homo sapiens
ccaagaactgcatgg

SEQ ID NO: 5389424 - DNA, 15 bp, Homo sapiens
ccaagaagcccagga

SEQ ID NO: 5389425 - DNA, 19 bp, Homo sapiens
ccaagaagcccaggaaagg

SEQ ID NO: 5389426 - DNA, 15 bp, Homo sapiens
ccaagaagccctcct

SEQ ID NO: 5389427 - DNA, 16 bp, Homo sapiens
ccaagaagcctgcagg

SEQ ID NO: 5389428 - DNA, 13 bp, Homo sapiens
ccaagaaggctgg

SEQ ID NO: 5389429 - DNA, 14 bp, Homo sapiens
ccaagaaggctggg

SEQ ID NO: 5389430 - DNA, 12 bp, Homo sapiens
ccaagaagggct

SEQ ID NO: 5389431 - DNA, 22 bp, Homo sapiens
ccaagaagggctagaacctgga

SEQ ID NO: 5389432 - DNA, 16 bp, Homo sapiens
ccaagaagtgaggcct

SEQ ID NO: 5389433 - DNA, 19 bp, Homo sapiens
ccaagaatagatgctgact

SEQ ID NO: 5389434 - DNA, 20 bp, Homo sapiens
ccaagaatagatgctgactg

SEQ ID NO: 5389435 - DNA, 22 bp, Homo sapiens
ccaagaatagcatctgtacaaa

SEQ ID NO: 5389436 - DNA, 22 bp, Homo sapiens
ccaagaatattgcaaaatacat

SEQ ID NO: 5389437 - DNA, 23 bp, Homo sapiens
ccaagaatattgcaaaatacatg

SEQ ID NO: 5389438 - DNA, 18 bp, Homo sapiens
ccaagaatccacatttct

SEQ ID NO: 5389439 - DNA, 12 bp, Homo sapiens
ccaagaatgcaa

SEQ ID NO: 5389440 - DNA, 14 bp, Homo sapiens
ccaagaatgctgaa

SEQ ID NO: 5389441 - DNA, 16 bp, Homo sapiens
ccaagacaaatcaaca

SEQ ID NO: 5389442 - DNA, 18 bp, Homo sapiens
ccaagacaaatcaacaga

SEQ ID NO: 5389443 - DNA, 14 bp, Homo sapiens
ccaagacagagtct

SEQ ID NO: 5389444 - DNA, 18 bp, Homo sapiens
ccaagacagatgccccag

SEQ ID NO: 5389445 - DNA, 22 bp, Homo sapiens
ccaagacagatgccccagagct

SEQ ID NO: 5389446 - DNA, 18 bp, Homo sapiens
ccaagacagatggacact

SEQ ID NO: 5389447 - DNA, 15 bp, Homo sapiens
ccaagacagcagcag

SEQ ID NO: 5389448 - DNA, 19 bp, Homo sapiens
ccaagacagcagcagcctg

SEQ ID NO: 5389449 - DNA, 22 bp, Homo sapiens
ccaagacagcagcagcctgcac

SEQ ID NO: 5389450 - DNA, 12 bp, Homo sapiens
ccaagacagtct

SEQ ID NO: 5389451 - DNA, 17 bp, Homo sapiens
ccaagacagtggcagca

SEQ ID NO: 5389452 - DNA, 17 bp, Homo sapiens
ccaagacataatgcact

SEQ ID NO: 5389453 - DNA, 19 bp, Homo sapiens
ccaagacataatgcactgg

SEQ ID NO: 5389454 - DNA, 21 bp, Homo sapiens
ccaagacatgtctgttctaca

SEQ ID NO: 5389455 - DNA, 17 bp, Homo sapiens
ccaagacattgtcaata

SEQ ID NO: 5389456 - DNA, 14 bp, Homo sapiens
ccaagaccaccagg

SEQ ID NO: 5389457 - DNA, 15 bp, Homo sapiens
ccaagaccaccaggg

SEQ ID NO: 5389458 - DNA, 14 bp, Homo sapiens
ccaagaccccagct

SEQ ID NO: 5389459 - DNA, 19 bp, Homo sapiens
ccaagaccctgccccctgc

SEQ ID NO: 5389460 - DNA, 17 bp, Homo sapiens
ccaagacctcagggcac

SEQ ID NO: 5389461 - DNA, 16 bp, Homo sapiens
ccaagacctcatctgc

SEQ ID NO: 5389462 - DNA, 21 bp, Homo sapiens
ccaagacggaggaggggaagg

SEQ ID NO: 5389463 - DNA, 15 bp, Homo sapiens
ccaagactcccatga

SEQ ID NO: 5389464 - DNA, 15 bp, Homo sapiens
ccaagactcctcagg

SEQ ID NO: 5389465 - DNA, 17 bp, Homo sapiens
ccaagactcctcaggca

SEQ ID NO: 5389466 - DNA, 13 bp, Homo sapiens
ccaagactcctgc

SEQ ID NO: 5389467 - DNA, 14 bp, Homo sapiens
ccaagactctgctc

SEQ ID NO: 5389468 - DNA, 19 bp, Homo sapiens
ccaagactctgctctcctc

SEQ ID NO: 5389469 - DNA, 10 bp, Homo sapiens
ccaagactga

SEQ ID NO: 5389470 - DNA, 15 bp, Homo sapiens
ccaagactgaagact

SEQ ID NO: 5389471 - DNA, 17 bp, Homo sapiens
ccaagactgctgtggcc

SEQ ID NO: 5389472 - DNA, 18 bp, Homo sapiens
ccaagactgctgtggcca

SEQ ID NO: 5389473 - DNA, 21 bp, Homo sapiens
ccaagactgctgtggccagga

SEQ ID NO: 5389474 - DNA, 23 bp, Homo sapiens
ccaagactgctgtggccaggagg

SEQ ID NO: 5389475 - DNA, 19 bp, Homo sapiens
ccaagacttcattgtccct

SEQ ID NO: 5389476 - DNA, 22 bp, Homo sapiens
ccaagacttggcaacagaagca

SEQ ID NO: 5389477 - DNA, 15 bp, Homo sapiens
ccaagagaaacttcc

SEQ ID NO: 5389478 - DNA, 17 bp, Homo sapiens
ccaagagaactaaagct

SEQ ID NO: 5389479 - DNA, 20 bp, Homo sapiens
ccaagagaactaaagctgga

SEQ ID NO: 5389480 - DNA, 22 bp, Homo sapiens
ccaagagaaggtggacctggca

SEQ ID NO: 5389481 - DNA, 23 bp, Homo sapiens
ccaagagaaggtggacctggcag

SEQ ID NO: 5389482 - DNA, 22 bp, Homo sapiens
ccaagagaataggggagccaag

SEQ ID NO: 5389483 - DNA, 11 bp, Homo sapiens
ccaagagacat

SEQ ID NO: 5389484 - DNA, 12 bp, Homo sapiens
ccaagagacatg

SEQ ID NO: 5389485 - DNA, 24 bp, Homo sapiens
ccaagagactccttgagagaccag

SEQ ID NO: 5389486 - DNA, 12 bp, Homo sapiens
ccaagagagaaa

SEQ ID NO: 5389487 - DNA, 15 bp, Homo sapiens
ccaagagagaaagaa

SEQ ID NO: 5389488 - DNA, 18 bp, Homo sapiens
ccaagagagagacacaag

SEQ ID NO: 5389489 - DNA, 16 bp, Homo sapiens
ccaagagagcctcttg

SEQ ID NO: 5389490 - DNA, 13 bp, Homo sapiens
ccaagagaggaag

SEQ ID NO: 5389491 - DNA, 21 bp, Homo sapiens
ccaagagaggaaggacccctc

SEQ ID NO: 5389492 - DNA, 22 bp, Homo sapiens
ccaagagaggaaggacccctca

SEQ ID NO: 5389493 - DNA, 20 bp, Homo sapiens
ccaagagagggccatgcaat

SEQ ID NO: 5389494 - DNA, 21 bp, Homo sapiens
ccaagagattgctaattgctg

SEQ ID NO: 5389495 - DNA, 18 bp, Homo sapiens
ccaagagcaatttacctg

SEQ ID NO: 5389496 - DNA, 19 bp, Homo sapiens
ccaagagcagaggcagcga

SEQ ID NO: 5389497 - DNA, 21 bp, Homo sapiens
ccaagagcagagtctgggcct

SEQ ID NO: 5389498 - DNA, 16 bp, Homo sapiens
ccaagagcaggaggtg

SEQ ID NO: 5389499 - DNA, 17 bp, Homo sapiens
ccaagagcatcatgcct

SEQ ID NO: 5389500 - DNA, 22 bp, Homo sapiens
ccaagagctacgtatttaatag

SEQ ID NO: 5389501 - DNA, 19 bp, Homo sapiens
ccaaggggaatcagaactc

SEQ ID NO: 5389502 - DNA, 22 bp, Homo sapiens
ccaaggggaatgtttgcctctg

SEQ ID NO: 5389503 - DNA, 17 bp, Homo sapiens
ccaaggggacttgtgcc

SEQ ID NO: 5389504 - DNA, 21 bp, Homo sapiens
ccaaggggcaaatttttattt

SEQ ID NO: 5389505 - DNA, 16 bp, Homo sapiens
ccaaggggcagtcttg

SEQ ID NO: 5389506 - DNA, 13 bp, Homo sapiens
ccaaggggcccac

SEQ ID NO: 5389507 - DNA, 14 bp, Homo sapiens
ccaaggggcccaca

SEQ ID NO: 5389508 - DNA, 15 bp, Homo sapiens
ccaaggggcccacaa

SEQ ID NO: 5389509 - DNA, 22 bp, Homo sapiens
ccaaggggcccacaaaggggag

SEQ ID NO: 5389510 - DNA, 14 bp, Homo sapiens
ccaaggggcctgag

SEQ ID NO: 5389511 - DNA, 14 bp, Homo sapiens
ccaaggggctgcgc

SEQ ID NO: 5389512 - DNA, 20 bp, Homo sapiens
ccaaggggctgcgctagcag

SEQ ID NO: 5389513 - DNA, 22 bp, Homo sapiens
ccaaggggctgcgctagcagcc

SEQ ID NO: 5389514 - DNA, 16 bp, Homo sapiens
ccaaggggcttcaggt

SEQ ID NO: 5389515 - DNA, 19 bp, Homo sapiens
ccaaggggcttcgttttca

SEQ ID NO: 5389516 - DNA, 20 bp, Homo sapiens
ccaagggggacctcgggctg

SEQ ID NO: 5389517 - DNA, 23 bp, Homo sapiens
ccaagggggcagagggctttcag

SEQ ID NO: 5389518 - DNA, 14 bp, Homo sapiens
ccaagggggcgggg

SEQ ID NO: 5389519 - DNA, 14 bp, Homo sapiens
ccaagggggctgct

SEQ ID NO: 5389520 - DNA, 17 bp, Homo sapiens
ccaagggggctgctgct

SEQ ID NO: 5389521 - DNA, 18 bp, Homo sapiens
ccaaggggtctgctcctg

SEQ ID NO: 5389522 - DNA, 22 bp, Homo sapiens
ccaaggggtctgtatatacatt

SEQ ID NO: 5389523 - DNA, 20 bp, Homo sapiens
ccaagggtaactcttggcca

SEQ ID NO: 5389524 - DNA, 22 bp, Homo sapiens
ccaagggtacagatccccagcc

SEQ ID NO: 5389525 - DNA, 23 bp, Homo sapiens
ccaagggtacagatccccagccc

SEQ ID NO: 5389526 - DNA, 20 bp, Homo sapiens
ccaagggtatctgctgcctc

SEQ ID NO: 5389527 - DNA, 20 bp, Homo sapiens
ccaagggttgagagccagtg

SEQ ID NO: 5389528 - DNA, 22 bp, Homo sapiens
ccaagggtttcgactggtccag

SEQ ID NO: 5389529 - DNA, 16 bp, Homo sapiens
ccaaggtaccatccta

SEQ ID NO: 5389530 - DNA, 20 bp, Homo sapiens
ccaaggtaccgatttctgct

SEQ ID NO: 5389531 - DNA, 17 bp, Homo sapiens
ccaaggtacctaggttg

SEQ ID NO: 5389532 - DNA, 16 bp, Homo sapiens
ccaaggtcaggaggcc

SEQ ID NO: 5389533 - DNA, 14 bp, Homo sapiens
ccaaggtcctgctc

SEQ ID NO: 5389534 - DNA, 16 bp, Homo sapiens
ccaaggtcctgctcaa

SEQ ID NO: 5389535 - DNA, 16 bp, Homo sapiens
ccaaggtctcacactc

SEQ ID NO: 5389536 - DNA, 18 bp, Homo sapiens
ccaaggtctcacactcct

SEQ ID NO: 5389537 - DNA, 20 bp, Homo sapiens
ccaaggtctcacactcctcc

SEQ ID NO: 5389538 - DNA, 22 bp, Homo sapiens
ccaaggtgaggtgaactccagg

SEQ ID NO: 5389539 - DNA, 15 bp, Homo sapiens
ccaaggtgatgttgt

SEQ ID NO: 5389540 - DNA, 22 bp, Homo sapiens
ccaaggtgcatatagaaaacaa

SEQ ID NO: 5389541 - DNA, 23 bp, Homo sapiens
ccaaggtgcatatagaaaacaaa

SEQ ID NO: 5389542 - DNA, 22 bp, Homo sapiens
ccaaggtgctaaaaggaatagg

SEQ ID NO: 5389543 - DNA, 17 bp, Homo sapiens
ccaaggtgctctgtgtc

SEQ ID NO: 5389544 - DNA, 12 bp, Homo sapiens
ccaaggtgctgg

SEQ ID NO: 5389545 - DNA, 16 bp, Homo sapiens
ccaaggtggcacggtg

SEQ ID NO: 5389546 - DNA, 13 bp, Homo sapiens
ccaaggtggcttc

SEQ ID NO: 5389547 - DNA, 18 bp, Homo sapiens
ccaaggtgggaggattgc

SEQ ID NO: 5389548 - DNA, 14 bp, Homo sapiens
ccaaggtgggcgga

SEQ ID NO: 5389549 - DNA, 16 bp, Homo sapiens
ccaaggtggtcttgga

SEQ ID NO: 5389550 - DNA, 18 bp, Homo sapiens
ccaaggtggtcttggaga

SEQ ID NO: 5389551 - DNA, 20 bp, Homo sapiens
ccaaggtgtcctacagaaaa

SEQ ID NO: 5389552 - DNA, 16 bp, Homo sapiens
ccaaggttacttaatt

SEQ ID NO: 5389553 - DNA, 16 bp, Homo sapiens
ccaaggttcccttgtg

SEQ ID NO: 5389554 - DNA, 20 bp, Homo sapiens
ccaaggttctagtctctgtt

SEQ ID NO: 5389555 - DNA, 14 bp, Homo sapiens
ccaaggttgcacag

SEQ ID NO: 5389556 - DNA, 20 bp, Homo sapiens
ccaaggttggagcccagggc

SEQ ID NO: 5389557 - DNA, 15 bp, Homo sapiens
ccaaggttgtcctgg

SEQ ID NO: 5389558 - DNA, 21 bp, Homo sapiens
ccaaggtttaaacttctctga

SEQ ID NO: 5389559 - DNA, 23 bp, Homo sapiens
ccaaggtttcccagtgagcctct

SEQ ID NO: 5389560 - DNA, 17 bp, Homo sapiens
ccaaggtttgagtccct

SEQ ID NO: 5389561 - DNA, 21 bp, Homo sapiens
ccaaggttttataaggctgat

SEQ ID NO: 5389562 - DNA, 23 bp, Homo sapiens
ccaagtaaaaatttcttctgggc

SEQ ID NO: 5389563 - DNA, 16 bp, Homo sapiens
ccaagtaaatttgtat

SEQ ID NO: 5389564 - DNA, 21 bp, Homo sapiens
ccaagtaaccaggccccagcc

SEQ ID NO: 5389565 - DNA, 16 bp, Homo sapiens
ccaagtaagaggctgg

SEQ ID NO: 5389566 - DNA, 22 bp, Homo sapiens
ccaagtacagccttcactggag

SEQ ID NO: 5389567 - DNA, 19 bp, Homo sapiens
ccaagtacttaactatctg

SEQ ID NO: 5389568 - DNA, 15 bp, Homo sapiens
ccaagtagctgggat

SEQ ID NO: 5389569 - DNA, 15 bp, Homo sapiens
ccaagtagtctgctc

SEQ ID NO: 5389570 - DNA, 18 bp, Homo sapiens
ccaagtagtctgctcaca

SEQ ID NO: 5389571 - DNA, 21 bp, Homo sapiens
ccaagtatagcctatggcaga

SEQ ID NO: 5389572 - DNA, 21 bp, Homo sapiens
ccaagtattttatctgtgttg

SEQ ID NO: 5389573 - DNA, 13 bp, Homo sapiens
ccaagtattttgc

SEQ ID NO: 5389574 - DNA, 20 bp, Homo sapiens
ccaagtcaaacagtgtggct

SEQ ID NO: 5389575 - DNA, 19 bp, Homo sapiens
ccaagtcacaaagagatgt

SEQ ID NO: 5389576 - DNA, 13 bp, Homo sapiens
ccaagtcacacag

SEQ ID NO: 5389577 - DNA, 20 bp, Homo sapiens
ccaagtcacacccactccct

SEQ ID NO: 5389578 - DNA, 14 bp, Homo sapiens
ccaagtcagacaga

SEQ ID NO: 5389579 - DNA, 12 bp, Homo sapiens
ccaagtcatggg

SEQ ID NO: 5389580 - DNA, 15 bp, Homo sapiens
ccaagtcatgggaga

SEQ ID NO: 5389581 - DNA, 14 bp, Homo sapiens
ccaagtccactgtc

SEQ ID NO: 5389582 - DNA, 15 bp, Homo sapiens
ccaagtccaggtcct

SEQ ID NO: 5389583 - DNA, 16 bp, Homo sapiens
ccaagtccaggtcctg

SEQ ID NO: 5389584 - DNA, 13 bp, Homo sapiens
ccaagtccctgtt

SEQ ID NO: 5389585 - DNA, 18 bp, Homo sapiens
ccaagtcctagctcctcc

SEQ ID NO: 5389586 - DNA, 20 bp, Homo sapiens
ccaagtcctcctagaactcc

SEQ ID NO: 5389587 - DNA, 15 bp, Homo sapiens
ccaagtcctgaagag

SEQ ID NO: 5389588 - DNA, 16 bp, Homo sapiens
ccaagtcctgaagagg

SEQ ID NO: 5389589 - DNA, 16 bp, Homo sapiens
ccaagtcctgcctttg

SEQ ID NO: 5389590 - DNA, 22 bp, Homo sapiens
ccaagtcctggctacatcccag

SEQ ID NO: 5389591 - DNA, 23 bp, Homo sapiens
ccaagtctaggaactccctcaga

SEQ ID NO: 5389592 - DNA, 16 bp, Homo sapiens
ccaagtctcaggagga

SEQ ID NO: 5389593 - DNA, 16 bp, Homo sapiens
ccaagtctccagagag

SEQ ID NO: 5389594 - DNA, 14 bp, Homo sapiens
ccaagtctctctgt

SEQ ID NO: 5389595 - DNA, 17 bp, Homo sapiens
ccaagtctctctgtgaa

SEQ ID NO: 5389596 - DNA, 15 bp, Homo sapiens
ccaagtctggcacca

SEQ ID NO: 5389597 - DNA, 17 bp, Homo sapiens
ccaagtgaggcagccga

SEQ ID NO: 5389598 - DNA, 20 bp, Homo sapiens
ccaagtgagtctctctgggc

SEQ ID NO: 5389599 - DNA, 16 bp, Homo sapiens
ccaagtgcaaaagaaa

SEQ ID NO: 5389600 - DNA, 16 bp, Homo sapiens
ccaagtgcactttcta

SEQ ID NO: 5389601 - DNA, 17 bp, Homo sapiens
ccaagtgcactttctaa

SEQ ID NO: 5389602 - DNA, 22 bp, Homo sapiens
ccaagtgcatttttatctgtga

SEQ ID NO: 5389603 - DNA, 14 bp, Homo sapiens
ccaagtgccagagg

SEQ ID NO: 5389604 - DNA, 15 bp, Homo sapiens
ccaagtgccagaggt

SEQ ID NO: 5389605 - DNA, 16 bp, Homo sapiens
ccaagtgccagtcttg

SEQ ID NO: 5389606 - DNA, 11 bp, Homo sapiens
ccaagtgccat

SEQ ID NO: 5389607 - DNA, 16 bp, Homo sapiens
ccaagtgccccctcac

SEQ ID NO: 5389608 - DNA, 21 bp, Homo sapiens
ccaagtgccccctcacctctc

SEQ ID NO: 5389609 - DNA, 13 bp, Homo sapiens
ccaagtgcctcac

SEQ ID NO: 5389610 - DNA, 20 bp, Homo sapiens
ccaagtgccttgagctgcct

SEQ ID NO: 5389611 - DNA, 13 bp, Homo sapiens
ccaagtgcgtgcc

SEQ ID NO: 5389612 - DNA, 15 bp, Homo sapiens
ccaagtgctggccca

SEQ ID NO: 5389613 - DNA, 19 bp, Homo sapiens
ccaagtggaaatcctattt

SEQ ID NO: 5389614 - DNA, 20 bp, Homo sapiens
ccaagtggaagccactggac

SEQ ID NO: 5389615 - DNA, 14 bp, Homo sapiens
ccaagtggcagagc

SEQ ID NO: 5389616 - DNA, 20 bp, Homo sapiens
ccaagtggcagtttttaaaa

SEQ ID NO: 5389617 - DNA, 16 bp, Homo sapiens
ccaagtggctcccaca

SEQ ID NO: 5389618 - DNA, 20 bp, Homo sapiens
ccaagtggctgggtgccctc

SEQ ID NO: 5389619 - DNA, 13 bp, Homo sapiens
ccaagtgggcagt

SEQ ID NO: 5389620 - DNA, 23 bp, Homo sapiens
ccaagtgggctggtattctctct

SEQ ID NO: 5389621 - DNA, 19 bp, Homo sapiens
ccaagtggggatggggcct

SEQ ID NO: 5389622 - DNA, 23 bp, Homo sapiens
ccaagtggggatggggcctccct

SEQ ID NO: 5389623 - DNA, 16 bp, Homo sapiens
ccaagtgggggcagag

SEQ ID NO: 5389624 - DNA, 14 bp, Homo sapiens
ccaagtggggtgct

SEQ ID NO: 5389625 - DNA, 22 bp, Homo sapiens
ccaagtggggtgctgggaggag

SEQ ID NO: 5389626 - DNA, 18 bp, Homo sapiens
ccaagtgggtcaattcct

SEQ ID NO: 5389627 - DNA, 14 bp, Homo sapiens
ccaagtggtccagc

SEQ ID NO: 5389628 - DNA, 14 bp, Homo sapiens
ccaagtggtgagca

SEQ ID NO: 5389629 - DNA, 22 bp, Homo sapiens
ccaagtggtgagcaagcaccaa

SEQ ID NO: 5389630 - DNA, 23 bp, Homo sapiens
ccaagtggtttccacatgctctg

SEQ ID NO: 5389631 - DNA, 10 bp, Homo sapiens
ccaagtgtat

SEQ ID NO: 5389632 - DNA, 17 bp, Homo sapiens
ccaagtgtattgtaatg

SEQ ID NO: 5389633 - DNA, 12 bp, Homo sapiens
ccaagtgtcctg

SEQ ID NO: 5389634 - DNA, 18 bp, Homo sapiens
ccaagtgtcctggaccct

SEQ ID NO: 5389635 - DNA, 16 bp, Homo sapiens
ccaagtgtctcttgac

SEQ ID NO: 5389636 - DNA, 22 bp, Homo sapiens
ccaagtgtctcttgactggctc

SEQ ID NO: 5389637 - DNA, 23 bp, Homo sapiens
ccaagtgtctcttgactggctca

SEQ ID NO: 5389638 - DNA, 22 bp, Homo sapiens
ccaagtgtgcatattgtacact

SEQ ID NO: 5389639 - DNA, 12 bp, Homo sapiens
ccaagtgtgtgt

SEQ ID NO: 5389640 - DNA, 22 bp, Homo sapiens
ccaagttataaatcaatgtcac

SEQ ID NO: 5389641 - DNA, 17 bp, Homo sapiens
ccaagttatctgtttcc

SEQ ID NO: 5389642 - DNA, 18 bp, Homo sapiens
ccaagttatctttccctc

SEQ ID NO: 5389643 - DNA, 16 bp, Homo sapiens
ccaagttcaaagaacc

SEQ ID NO: 5389644 - DNA, 19 bp, Homo sapiens
ccaagttccgtcagtccaa

SEQ ID NO: 5389645 - DNA, 11 bp, Homo sapiens
ccaagttcctc

SEQ ID NO: 5389646 - DNA, 13 bp, Homo sapiens
ccaagttcctcta

SEQ ID NO: 5389647 - DNA, 21 bp, Homo sapiens
ccaagttcctgcactccagaa

SEQ ID NO: 5389648 - DNA, 19 bp, Homo sapiens
ccaagttcttcacctctat

SEQ ID NO: 5389649 - DNA, 14 bp, Homo sapiens
ccaagttgcagtga

SEQ ID NO: 5389650 - DNA, 13 bp, Homo sapiens
ccaagttgctctg

SEQ ID NO: 5389651 - DNA, 20 bp, Homo sapiens
ccaagttgtgcttgagccag

SEQ ID NO: 5389652 - DNA, 18 bp, Homo sapiens
ccaagttgtggtgctgac

SEQ ID NO: 5389653 - DNA, 16 bp, Homo sapiens
ccaagtttatttctct

SEQ ID NO: 5389654 - DNA, 16 bp, Homo sapiens
ccaagtttccatagca

SEQ ID NO: 5389655 - DNA, 20 bp, Homo sapiens
ccaagtttccatagcaacag

SEQ ID NO: 5389656 - DNA, 16 bp, Homo sapiens
ccaagttttgtgaaat

SEQ ID NO: 5389657 - DNA, 10 bp, Homo sapiens
ccaataaaaa

SEQ ID NO: 5389658 - DNA, 13 bp, Homo sapiens
ccaataaaaacat

SEQ ID NO: 5389659 - DNA, 23 bp, Homo sapiens
ccaataaaaatcaggagcctgct

SEQ ID NO: 5389660 - DNA, 22 bp, Homo sapiens
ccaataaaagcaattccaacct

SEQ ID NO: 5389661 - DNA, 13 bp, Homo sapiens
ccaataaaagtga

SEQ ID NO: 5389662 - DNA, 22 bp, Homo sapiens
ccaataaaagttttctccaact

SEQ ID NO: 5389663 - DNA, 11 bp, Homo sapiens
ccaataaacca

SEQ ID NO: 5389664 - DNA, 14 bp, Homo sapiens
ccaataaaccaggt

SEQ ID NO: 5389665 - DNA, 16 bp, Homo sapiens
ccaataaaccagtgtg

SEQ ID NO: 5389666 - DNA, 12 bp, Homo sapiens
ccaataaactga

SEQ ID NO: 5389667 - DNA, 16 bp, Homo sapiens
ccaataaactgagcga

SEQ ID NO: 5389668 - DNA, 14 bp, Homo sapiens
ccaataaagccttt

SEQ ID NO: 5389669 - DNA, 13 bp, Homo sapiens
ccaataaagctgg

SEQ ID NO: 5389670 - DNA, 14 bp, Homo sapiens
ccaataaagctgga

SEQ ID NO: 5389671 - DNA, 18 bp, Homo sapiens
ccaataaagcttttggaa

SEQ ID NO: 5389672 - DNA, 16 bp, Homo sapiens
ccaataaaggaggaat

SEQ ID NO: 5389673 - DNA, 17 bp, Homo sapiens
ccaataaaggcagctgc

SEQ ID NO: 5389674 - DNA, 18 bp, Homo sapiens
ccaataaaggcagctgcc

SEQ ID NO: 5389675 - DNA, 14 bp, Homo sapiens
ccaataaaggtccc

SEQ ID NO: 5389676 - DNA, 13 bp, Homo sapiens
ccaataaataata

SEQ ID NO: 5389677 - DNA, 16 bp, Homo sapiens
ccaataaatttgtaac

SEQ ID NO: 5389678 - DNA, 11 bp, Homo sapiens
ccaataaccaa

SEQ ID NO: 5389679 - DNA, 22 bp, Homo sapiens
ccacgagggctggctggcctca

SEQ ID NO: 5389680 - DNA, 18 bp, Homo sapiens
ccacgaggggacccatgg

SEQ ID NO: 5389681 - DNA, 20 bp, Homo sapiens
ccacgaggggacccatgggg

SEQ ID NO: 5389682 - DNA, 16 bp, Homo sapiens
ccacgagggtcaggac

SEQ ID NO: 5389683 - DNA, 13 bp, Homo sapiens
ccacgagggtctc

SEQ ID NO: 5389684 - DNA, 22 bp, Homo sapiens
ccacgaggtggtagctctgagc

SEQ ID NO: 5389685 - DNA, 23 bp, Homo sapiens
ccacgaggttaaagaagctgcat

SEQ ID NO: 5389686 - DNA, 15 bp, Homo sapiens
ccacgagtcacctgc

SEQ ID NO: 5389687 - DNA, 19 bp, Homo sapiens
ccacgagtcacctgcaagc

SEQ ID NO: 5389688 - DNA, 23 bp, Homo sapiens
ccacgagtcacctgcaagcccca

SEQ ID NO: 5389689 - DNA, 15 bp, Homo sapiens
ccacgatcccctccc

SEQ ID NO: 5389690 - DNA, 22 bp, Homo sapiens
ccacgatgacgcctctggacct

SEQ ID NO: 5389691 - DNA, 15 bp, Homo sapiens
ccacgatgcctttga

SEQ ID NO: 5389692 - DNA, 17 bp, Homo sapiens
ccacgatgcctttgagt

SEQ ID NO: 5389693 - DNA, 18 bp, Homo sapiens
ccacgatgtggccctggc

SEQ ID NO: 5389694 - DNA, 13 bp, Homo sapiens
ccacgatttgtct

SEQ ID NO: 5389695 - DNA, 14 bp, Homo sapiens
ccacgatttgtctt

SEQ ID NO: 5389696 - DNA, 14 bp, Homo sapiens
ccacgcacctccac

SEQ ID NO: 5389697 - DNA, 21 bp, Homo sapiens
ccacgcacctccacgccactg

SEQ ID NO: 5389698 - DNA, 21 bp, Homo sapiens
ccacgcacgacgtcagcctct

SEQ ID NO: 5389699 - DNA, 21 bp, Homo sapiens
ccacgcactgggccacggagg

SEQ ID NO: 5389700 - DNA, 14 bp, Homo sapiens
ccacgcagagaggg

SEQ ID NO: 5389701 - DNA, 13 bp, Homo sapiens
ccacgcagagccc

SEQ ID NO: 5389702 - DNA, 14 bp, Homo sapiens
ccacgcagagcccc

SEQ ID NO: 5389703 - DNA, 17 bp, Homo sapiens
ccacgcagagccccgga

SEQ ID NO: 5389704 - DNA, 18 bp, Homo sapiens
ccacgcagctggcagaga

SEQ ID NO: 5389705 - DNA, 20 bp, Homo sapiens
ccacgcaggccacccgggct

SEQ ID NO: 5389706 - DNA, 12 bp, Homo sapiens
ccacgcagggcc

SEQ ID NO: 5389707 - DNA, 16 bp, Homo sapiens
ccacgcagggccatcc

SEQ ID NO: 5389708 - DNA, 12 bp, Homo sapiens
ccacgcagttct

SEQ ID NO: 5389709 - DNA, 13 bp, Homo sapiens
ccacgccacagcc

SEQ ID NO: 5389710 - DNA, 21 bp, Homo sapiens
ccacgccacagcccttttgtc

SEQ ID NO: 5389711 - DNA, 15 bp, Homo sapiens
ccacgccactgcctc

SEQ ID NO: 5389712 - DNA, 16 bp, Homo sapiens
ccacgccactgcctcc

SEQ ID NO: 5389713 - DNA, 14 bp, Homo sapiens
ccacgccagctggc

SEQ ID NO: 5389714 - DNA, 13 bp, Homo sapiens
ccacgccaggcca

SEQ ID NO: 5389715 - DNA, 18 bp, Homo sapiens
ccacgcccccactggtga

SEQ ID NO: 5389716 - DNA, 12 bp, Homo sapiens
ccacgcccccat

SEQ ID NO: 5389717 - DNA, 22 bp, Homo sapiens
ccacgccccgtgtctggatgca

SEQ ID NO: 5389718 - DNA, 12 bp, Homo sapiens
ccacgcccgcac

SEQ ID NO: 5389719 - DNA, 13 bp, Homo sapiens
ccacgcccgcacc

SEQ ID NO: 5389720 - DNA, 13 bp, Homo sapiens
ccacgcccggcta

SEQ ID NO: 5389721 - DNA, 19 bp, Homo sapiens
ccacgcccgtctctttctc

SEQ ID NO: 5389722 - DNA, 23 bp, Homo sapiens
ccacgccctcattacggctcctc

SEQ ID NO: 5389723 - DNA, 21 bp, Homo sapiens
ccacgccctcccctcccctgc

SEQ ID NO: 5389724 - DNA, 19 bp, Homo sapiens
ccacgccctccctctccca

SEQ ID NO: 5389725 - DNA, 17 bp, Homo sapiens
ccacgccctccctgcta

SEQ ID NO: 5389726 - DNA, 19 bp, Homo sapiens
ccacgccctccctgctagc

SEQ ID NO: 5389727 - DNA, 22 bp, Homo sapiens
ccacgccctcctccctccgcta

SEQ ID NO: 5389728 - DNA, 19 bp, Homo sapiens
ccacgccctctcctccccc

SEQ ID NO: 5389729 - DNA, 15 bp, Homo sapiens
ccacgccctggggag

SEQ ID NO: 5389730 - DNA, 14 bp, Homo sapiens
ccacgccctgttca

SEQ ID NO: 5389731 - DNA, 20 bp, Homo sapiens
ccacgccgatataagccata

SEQ ID NO: 5389732 - DNA, 21 bp, Homo sapiens
ccacgccgatataagccatag

SEQ ID NO: 5389733 - DNA, 15 bp, Homo sapiens
ccacgccgccctcca

SEQ ID NO: 5389734 - DNA, 16 bp, Homo sapiens
ccacgccggcctctgc

SEQ ID NO: 5389735 - DNA, 22 bp, Homo sapiens
ccacgccggcctctgctgcccc

SEQ ID NO: 5389736 - DNA, 22 bp, Homo sapiens
ccacgccgggtcgcctgccctg

SEQ ID NO: 5389737 - DNA, 21 bp, Homo sapiens
ccacgcctcaccagccccccg

SEQ ID NO: 5389738 - DNA, 14 bp, Homo sapiens
ccacgcctcctggc

SEQ ID NO: 5389739 - DNA, 16 bp, Homo sapiens
ccacgcctcctggcca

SEQ ID NO: 5389740 - DNA, 15 bp, Homo sapiens
ccacgcctctctcag

SEQ ID NO: 5389741 - DNA, 19 bp, Homo sapiens
ccacgcctcttgaccaggc

SEQ ID NO: 5389742 - DNA, 22 bp, Homo sapiens
ccacgcctgcgatggtgctgca

SEQ ID NO: 5389743 - DNA, 24 bp, Homo sapiens
ccacgcggccacctcaccctctcc

SEQ ID NO: 5389744 - DNA, 22 bp, Homo sapiens
ccacgcggctgctgcttctccc

SEQ ID NO: 5389745 - DNA, 20 bp, Homo sapiens
ccacgcgtgccgtggcacca

SEQ ID NO: 5389746 - DNA, 15 bp, Homo sapiens
ccacgcgtgttctga

SEQ ID NO: 5389747 - DNA, 14 bp, Homo sapiens
ccacgctagggcgg

SEQ ID NO: 5389748 - DNA, 22 bp, Homo sapiens
ccacgctagggcggggcacaga

SEQ ID NO: 5389749 - DNA, 15 bp, Homo sapiens
ccacgctcagtgccc

SEQ ID NO: 5389750 - DNA, 20 bp, Homo sapiens
ccacgctcctctgtttgttt

SEQ ID NO: 5389751 - DNA, 23 bp, Homo sapiens
ccacgctcttgaggaagcccagg

SEQ ID NO: 5389752 - DNA, 21 bp, Homo sapiens
ccacgctgaccatgcgtcagg

SEQ ID NO: 5389753 - DNA, 20 bp, Homo sapiens
ccacgctgactacagggccg

SEQ ID NO: 5389754 - DNA, 19 bp, Homo sapiens
ccacgctggagtgcagtga

SEQ ID NO: 5389755 - DNA, 20 bp, Homo sapiens
ccacgctggccaatttttgt

SEQ ID NO: 5389756 - DNA, 14 bp, Homo sapiens
ccacgctggccttc

SEQ ID NO: 5389757 - DNA, 16 bp, Homo sapiens
ccacgctgggacacag

SEQ ID NO: 5389758 - DNA, 14 bp, Homo sapiens
ccacgctgggtatt

SEQ ID NO: 5389759 - DNA, 12 bp, Homo sapiens
ccacgctgtcct

SEQ ID NO: 5389760 - DNA, 21 bp, Homo sapiens
ccacgctgtcctctcgagccc

SEQ ID NO: 5389761 - DNA, 15 bp, Homo sapiens
ccacgctgtctccag

SEQ ID NO: 5389762 - DNA, 14 bp, Homo sapiens
ccacgctgtgtccc

SEQ ID NO: 5389763 - DNA, 14 bp, Homo sapiens
ccacgcttctccgg

SEQ ID NO: 5389764 - DNA, 16 bp, Homo sapiens
ccacgcttctggaggt

SEQ ID NO: 5389765 - DNA, 14 bp, Homo sapiens
ccacggaaacagaa

SEQ ID NO: 5389766 - DNA, 19 bp, Homo sapiens
ccacggaaggcgggctgag

SEQ ID NO: 5389767 - DNA, 12 bp, Homo sapiens
ccacggaccccc

SEQ ID NO: 5389768 - DNA, 18 bp, Homo sapiens
ccacggaccgcatcctcc

SEQ ID NO: 5389769 - DNA, 22 bp, Homo sapiens
ccacggagcagttcagagtgga

SEQ ID NO: 5389770 - DNA, 20 bp, Homo sapiens
ccacggagcatctcagaaga

SEQ ID NO: 5389771 - DNA, 12 bp, Homo sapiens
ccacggagccac

SEQ ID NO: 5389772 - DNA, 21 bp, Homo sapiens
ccacggagccactcctctgac

SEQ ID NO: 5389773 - DNA, 22 bp, Homo sapiens
ccacggaggagggatgctgctc

SEQ ID NO: 5389774 - DNA, 20 bp, Homo sapiens
ccacggatgcgtgggcagag

SEQ ID NO: 5389775 - DNA, 17 bp, Homo sapiens
ccacggcagccaccctg

SEQ ID NO: 5389776 - DNA, 16 bp, Homo sapiens
ccacggccaccactgc

SEQ ID NO: 5389777 - DNA, 15 bp, Homo sapiens
ccacggccacccacc

SEQ ID NO: 5389778 - DNA, 13 bp, Homo sapiens
ccacggccaccct

SEQ ID NO: 5389779 - DNA, 17 bp, Homo sapiens
ccacggccaccctcctt

SEQ ID NO: 5389780 - DNA, 13 bp, Homo sapiens
ccacggccactgc

SEQ ID NO: 5389781 - DNA, 13 bp, Homo sapiens
ccacggccagaag

SEQ ID NO: 5389782 - DNA, 14 bp, Homo sapiens
ccacggccaggcca

SEQ ID NO: 5389783 - DNA, 23 bp, Homo sapiens
ccacggccaggccagagggagtg

SEQ ID NO: 5389784 - DNA, 16 bp, Homo sapiens
ccacggcccagggagg

SEQ ID NO: 5389785 - DNA, 18 bp, Homo sapiens
ccacggccccgggtccag

SEQ ID NO: 5389786 - DNA, 15 bp, Homo sapiens
ccacggccgctccag

SEQ ID NO: 5389787 - DNA, 16 bp, Homo sapiens
ccacggccgctccagg

SEQ ID NO: 5389788 - DNA, 17 bp, Homo sapiens
ccacggccgtccctgac

SEQ ID NO: 5389789 - DNA, 16 bp, Homo sapiens
ccacggcctcctttcc

SEQ ID NO: 5389790 - DNA, 23 bp, Homo sapiens
ccacggctcactgcagcctcagc

SEQ ID NO: 5389791 - DNA, 17 bp, Homo sapiens
ccacggctctgtgcccg

SEQ ID NO: 5389792 - DNA, 19 bp, Homo sapiens
ccacggctctgtgcccggt

SEQ ID NO: 5389793 - DNA, 18 bp, Homo sapiens
ccacgggaagtttagaga

SEQ ID NO: 5389794 - DNA, 18 bp, Homo sapiens
ccacgggactctggtggc

SEQ ID NO: 5389795 - DNA, 16 bp, Homo sapiens
ccacgggccggccagc

SEQ ID NO: 5389796 - DNA, 13 bp, Homo sapiens
ccacgggcctcag

SEQ ID NO: 5389797 - DNA, 18 bp, Homo sapiens
ccacgggcctcagtttcc

SEQ ID NO: 5389798 - DNA, 22 bp, Homo sapiens
ccacgggctgcgccgtctgctc

SEQ ID NO: 5389799 - DNA, 16 bp, Homo sapiens
ccacggggaccactgg

SEQ ID NO: 5389800 - DNA, 17 bp, Homo sapiens
ccacggggaccactggg

SEQ ID NO: 5389801 - DNA, 19 bp, Homo sapiens
ccacggggaccactgggcc

SEQ ID NO: 5389802 - DNA, 20 bp, Homo sapiens
ccacggggaccactgggccc

SEQ ID NO: 5389803 - DNA, 21 bp, Homo sapiens
ccacggggaccactgggcccc

SEQ ID NO: 5389804 - DNA, 17 bp, Homo sapiens
ccacggggactcagccc

SEQ ID NO: 5389805 - DNA, 20 bp, Homo sapiens
ccacggggatcacagcgttt

SEQ ID NO: 5389806 - DNA, 15 bp, Homo sapiens
ccacggggcaaagct

SEQ ID NO: 5389807 - DNA, 20 bp, Homo sapiens
ccacggggcagttagagcag

SEQ ID NO: 5389808 - DNA, 18 bp, Homo sapiens
ccacggggtcgggggagg

SEQ ID NO: 5389809 - DNA, 17 bp, Homo sapiens
ccacggtgaaagtgctg

SEQ ID NO: 5389810 - DNA, 21 bp, Homo sapiens
ccacggtgcgtggctgtggca

SEQ ID NO: 5389811 - DNA, 24 bp, Homo sapiens
ccacggtgcgtggctgtggcacag

SEQ ID NO: 5389812 - DNA, 21 bp, Homo sapiens
ccacggtggacttagctctga

SEQ ID NO: 5389813 - DNA, 19 bp, Homo sapiens
ccacgtaccaagccaccgc

SEQ ID NO: 5389814 - DNA, 23 bp, Homo sapiens
ccacgtaccaagccaccgcagct

SEQ ID NO: 5389815 - DNA, 16 bp, Homo sapiens
ccacgtactgcagcct

SEQ ID NO: 5389816 - DNA, 16 bp, Homo sapiens
ccacgtagggggctct

SEQ ID NO: 5389817 - DNA, 21 bp, Homo sapiens
ccacgtcagctgggacacccc

SEQ ID NO: 5389818 - DNA, 20 bp, Homo sapiens
ccacgtcccaccccacctct

SEQ ID NO: 5389819 - DNA, 22 bp, Homo sapiens
ccacgtcccaccccacctcttg

SEQ ID NO: 5389820 - DNA, 15 bp, Homo sapiens
ccacgtcccagcatc

SEQ ID NO: 5389821 - DNA, 22 bp, Homo sapiens
ccacgtccccctggggcttctc

SEQ ID NO: 5389822 - DNA, 15 bp, Homo sapiens
ccacgtcccgctgcc

SEQ ID NO: 5389823 - DNA, 18 bp, Homo sapiens
ccacgtcccgctgcctcc

SEQ ID NO: 5389824 - DNA, 19 bp, Homo sapiens
ccacgtcccgctgcctcct

SEQ ID NO: 5389825 - DNA, 19 bp, Homo sapiens
ccacgtccctgcggaagcc

SEQ ID NO: 5389826 - DNA, 23 bp, Homo sapiens
ccacgtcctcgaattctcagacg

SEQ ID NO: 5389827 - DNA, 14 bp, Homo sapiens
ccacgtcctgggtg

SEQ ID NO: 5389828 - DNA, 15 bp, Homo sapiens
ccacgtcctgggtgc

SEQ ID NO: 5389829 - DNA, 16 bp, Homo sapiens
ccacgtcctgtcagtg

SEQ ID NO: 5389830 - DNA, 18 bp, Homo sapiens
ccacgtcgtggggtaaca

SEQ ID NO: 5389831 - DNA, 14 bp, Homo sapiens
ccacgtctccctgg

SEQ ID NO: 5389832 - DNA, 15 bp, Homo sapiens
ccacgtctcctcctc

SEQ ID NO: 5389833 - DNA, 18 bp, Homo sapiens
ccacgtctctctgcctgc

SEQ ID NO: 5389834 - DNA, 23 bp, Homo sapiens
ccacgtctctctgcctgctgggc

SEQ ID NO: 5389835 - DNA, 14 bp, Homo sapiens
ccacgtctgccagg

SEQ ID NO: 5389836 - DNA, 17 bp, Homo sapiens
ccacgtctgccaggccc

SEQ ID NO: 5389837 - DNA, 22 bp, Homo sapiens
ccacgtctgccaggcccatctc

SEQ ID NO: 5389838 - DNA, 15 bp, Homo sapiens
ccacgtctggccagg

SEQ ID NO: 5389839 - DNA, 17 bp, Homo sapiens
ccacgtctggccaggca

SEQ ID NO: 5389840 - DNA, 14 bp, Homo sapiens
ccacgtcttcctcc

SEQ ID NO: 5389841 - DNA, 16 bp, Homo sapiens
ccacgtctttcctgct

SEQ ID NO: 5389842 - DNA, 17 bp, Homo sapiens
ccacgtctttcctgcta

SEQ ID NO: 5389843 - DNA, 19 bp, Homo sapiens
ccacgtgaaatttgcctct

SEQ ID NO: 5389844 - DNA, 20 bp, Homo sapiens
ccacgtgaaatttgcctctg

SEQ ID NO: 5389845 - DNA, 20 bp, Homo sapiens
ccacgtgagagaatctgcct

SEQ ID NO: 5389846 - DNA, 22 bp, Homo sapiens
ccacgtgagagaatctgcctgt

SEQ ID NO: 5389847 - DNA, 15 bp, Homo sapiens
ccacgtgcagcacct

SEQ ID NO: 5389848 - DNA, 17 bp, Homo sapiens
ccacgtgcagcacctgt

SEQ ID NO: 5389849 - DNA, 18 bp, Homo sapiens
ccacgtgcagcacctgtc

SEQ ID NO: 5389850 - DNA, 14 bp, Homo sapiens
ccacgtgccaggcc

SEQ ID NO: 5389851 - DNA, 21 bp, Homo sapiens
ccacgtgccattgtctttcct

SEQ ID NO: 5389852 - DNA, 16 bp, Homo sapiens
ccacgtgccttaggaa

SEQ ID NO: 5389853 - DNA, 17 bp, Homo sapiens
ccacgtgccttaggaat

SEQ ID NO: 5389854 - DNA, 17 bp, Homo sapiens
ccacgtgcgtgttttct

SEQ ID NO: 5389855 - DNA, 23 bp, Homo sapiens
ccacgtgctcgcctctgcccagc

SEQ ID NO: 5389856 - DNA, 16 bp, Homo sapiens
ccactgcagcagaaaa

SEQ ID NO: 5389857 - DNA, 13 bp, Homo sapiens
ccactgcaggccc

SEQ ID NO: 5389858 - DNA, 17 bp, Homo sapiens
ccactgcaggccccgct

SEQ ID NO: 5389859 - DNA, 17 bp, Homo sapiens
ccactgcagtcacccct

SEQ ID NO: 5389860 - DNA, 18 bp, Homo sapiens
ccactgcataccaacctg

SEQ ID NO: 5389861 - DNA, 11 bp, Homo sapiens
ccactgcatcc

SEQ ID NO: 5389862 - DNA, 21 bp, Homo sapiens
ccactgcatcgtttcatcttc

SEQ ID NO: 5389863 - DNA, 20 bp, Homo sapiens
ccactgccacaccctcccca

SEQ ID NO: 5389864 - DNA, 11 bp, Homo sapiens
ccactgccagg

SEQ ID NO: 5389865 - DNA, 14 bp, Homo sapiens
ccactgccaggcac

SEQ ID NO: 5389866 - DNA, 17 bp, Homo sapiens
ccactgccaggcacctg

SEQ ID NO: 5389867 - DNA, 21 bp, Homo sapiens
ccactgccaggcacctggcct

SEQ ID NO: 5389868 - DNA, 23 bp, Homo sapiens
ccactgccaggcacctggcctgc

SEQ ID NO: 5389869 - DNA, 16 bp, Homo sapiens
ccactgccataacttg

SEQ ID NO: 5389870 - DNA, 22 bp, Homo sapiens
ccactgccataacttgtttgta

SEQ ID NO: 5389871 - DNA, 11 bp, Homo sapiens
ccactgccatg

SEQ ID NO: 5389872 - DNA, 19 bp, Homo sapiens
ccactgcccaccccctcaa

SEQ ID NO: 5389873 - DNA, 15 bp, Homo sapiens
ccactgcccatggca

SEQ ID NO: 5389874 - DNA, 14 bp, Homo sapiens
ccactgccccacgt

SEQ ID NO: 5389875 - DNA, 16 bp, Homo sapiens
ccactgcccgagctgg

SEQ ID NO: 5389876 - DNA, 17 bp, Homo sapiens
ccactgcccgagctggt

SEQ ID NO: 5389877 - DNA, 16 bp, Homo sapiens
ccactgccctccaggg

SEQ ID NO: 5389878 - DNA, 17 bp, Homo sapiens
ccactgccctccagggc

SEQ ID NO: 5389879 - DNA, 19 bp, Homo sapiens
ccactgccctccagggcca

SEQ ID NO: 5389880 - DNA, 20 bp, Homo sapiens
ccactgccctctccacaccc

SEQ ID NO: 5389881 - DNA, 13 bp, Homo sapiens
ccactgccctgcc

SEQ ID NO: 5389882 - DNA, 15 bp, Homo sapiens
ccactgccctgcctg

SEQ ID NO: 5389883 - DNA, 16 bp, Homo sapiens
ccactgccctgcctgc

SEQ ID NO: 5389884 - DNA, 13 bp, Homo sapiens
ccactgccctggc

SEQ ID NO: 5389885 - DNA, 16 bp, Homo sapiens
ccactgccctggcagc

SEQ ID NO: 5389886 - DNA, 19 bp, Homo sapiens
ccactgccctggcagcagc

SEQ ID NO: 5389887 - DNA, 16 bp, Homo sapiens
ccactgccgatgccca

SEQ ID NO: 5389888 - DNA, 17 bp, Homo sapiens
ccactgccgcctccttc

SEQ ID NO: 5389889 - DNA, 14 bp, Homo sapiens
ccactgcctactgc

SEQ ID NO: 5389890 - DNA, 16 bp, Homo sapiens
ccactgcctactgcat

SEQ ID NO: 5389891 - DNA, 16 bp, Homo sapiens
ccactgcctcaggttc

SEQ ID NO: 5389892 - DNA, 12 bp, Homo sapiens
ccactgcctcct

SEQ ID NO: 5389893 - DNA, 22 bp, Homo sapiens
ccactgcctcctccctggctgc

SEQ ID NO: 5389894 - DNA, 11 bp, Homo sapiens
ccactgcctct

SEQ ID NO: 5389895 - DNA, 16 bp, Homo sapiens
ccactgcctctccctc

SEQ ID NO: 5389896 - DNA, 14 bp, Homo sapiens
ccactgcctctgcc

SEQ ID NO: 5389897 - DNA, 16 bp, Homo sapiens
ccactgcctctgcctt

SEQ ID NO: 5389898 - DNA, 17 bp, Homo sapiens
ccactgcctctgcctta

SEQ ID NO: 5389899 - DNA, 15 bp, Homo sapiens
ccactgcctgcccac

SEQ ID NO: 5389900 - DNA, 17 bp, Homo sapiens
ccactgcctgcccaccc

SEQ ID NO: 5389901 - DNA, 18 bp, Homo sapiens
ccactgcctgcctcccct

SEQ ID NO: 5389902 - DNA, 22 bp, Homo sapiens
ccactgcctttgacctgcctcc

SEQ ID NO: 5389903 - DNA, 13 bp, Homo sapiens
ccactgcgcccag

SEQ ID NO: 5389904 - DNA, 21 bp, Homo sapiens
ccactgcgggagctctgtatg

SEQ ID NO: 5389905 - DNA, 23 bp, Homo sapiens
ccactgcgggagctctgtatggt

SEQ ID NO: 5389906 - DNA, 21 bp, Homo sapiens
ccactgctaaggctgctggct

SEQ ID NO: 5389907 - DNA, 18 bp, Homo sapiens
ccactgctaataaatgac

SEQ ID NO: 5389908 - DNA, 23 bp, Homo sapiens
ccactgctaataaatgaccagtt

SEQ ID NO: 5389909 - DNA, 20 bp, Homo sapiens
ccactgctccctaagccagc

SEQ ID NO: 5389910 - DNA, 21 bp, Homo sapiens
ccactgctcgtggactgtgct

SEQ ID NO: 5389911 - DNA, 15 bp, Homo sapiens
ccactgctctcagcc

SEQ ID NO: 5389912 - DNA, 18 bp, Homo sapiens
ccactgctctcagcctcc

SEQ ID NO: 5389913 - DNA, 20 bp, Homo sapiens
ccactgctctcagcctccca

SEQ ID NO: 5389914 - DNA, 19 bp, Homo sapiens
ccactgctctccagcctgg

SEQ ID NO: 5389915 - DNA, 13 bp, Homo sapiens
ccactgctctggt

SEQ ID NO: 5389916 - DNA, 14 bp, Homo sapiens
ccactgctgagctg

SEQ ID NO: 5389917 - DNA, 18 bp, Homo sapiens
ccactgctgatattttct

SEQ ID NO: 5389918 - DNA, 19 bp, Homo sapiens
ccactgctgatattttctc

SEQ ID NO: 5389919 - DNA, 20 bp, Homo sapiens
ccactgctgatattttctct

SEQ ID NO: 5389920 - DNA, 22 bp, Homo sapiens
ccactgctgatattttctctag

SEQ ID NO: 5389921 - DNA, 23 bp, Homo sapiens
ccactgctggaggcagcgctggt

SEQ ID NO: 5389922 - DNA, 14 bp, Homo sapiens
ccactgctggctgc

SEQ ID NO: 5389923 - DNA, 11 bp, Homo sapiens
ccactgctggt

SEQ ID NO: 5389924 - DNA, 13 bp, Homo sapiens
ccactgctggtgc

SEQ ID NO: 5389925 - DNA, 15 bp, Homo sapiens
ccactgctggtgcca

SEQ ID NO: 5389926 - DNA, 14 bp, Homo sapiens
ccactgcttcccac

SEQ ID NO: 5389927 - DNA, 16 bp, Homo sapiens
ccactgcttcccactg

SEQ ID NO: 5389928 - DNA, 18 bp, Homo sapiens
ccactgcttgcactgatg

SEQ ID NO: 5389929 - DNA, 18 bp, Homo sapiens
ccactgctttccagcctg

SEQ ID NO: 5389930 - DNA, 22 bp, Homo sapiens
ccactgcttttggtctgtgtga

SEQ ID NO: 5389931 - DNA, 14 bp, Homo sapiens
ccactggaagatcc

SEQ ID NO: 5389932 - DNA, 13 bp, Homo sapiens
ccactggaaggag

SEQ ID NO: 5389933 - DNA, 15 bp, Homo sapiens
ccactggaaggagca

SEQ ID NO: 5389934 - DNA, 16 bp, Homo sapiens
ccactggacaacactg

SEQ ID NO: 5389935 - DNA, 17 bp, Homo sapiens
ccactggacagacccag

SEQ ID NO: 5389936 - DNA, 20 bp, Homo sapiens
ccactggacagacccaggtc

SEQ ID NO: 5389937 - DNA, 23 bp, Homo sapiens
ccactggacagacccaggtcttc

SEQ ID NO: 5389938 - DNA, 13 bp, Homo sapiens
ccactggactgac

SEQ ID NO: 5389939 - DNA, 21 bp, Homo sapiens
ccactggacttgagcttggca

SEQ ID NO: 5389940 - DNA, 18 bp, Homo sapiens
ccactggagcagaagggg

SEQ ID NO: 5389941 - DNA, 17 bp, Homo sapiens
ccactggagcgtgtact

SEQ ID NO: 5389942 - DNA, 21 bp, Homo sapiens
ccactggaggggtcatccttg

SEQ ID NO: 5389943 - DNA, 18 bp, Homo sapiens
ccactggagttcactttc

SEQ ID NO: 5389944 - DNA, 15 bp, Homo sapiens
ccactggatcctgct

SEQ ID NO: 5389945 - DNA, 14 bp, Homo sapiens
ccactggatcttca

SEQ ID NO: 5389946 - DNA, 20 bp, Homo sapiens
ccactggcacttgcctgctg

SEQ ID NO: 5389947 - DNA, 20 bp, Homo sapiens
ccactggcagaaacaggagg

SEQ ID NO: 5389948 - DNA, 20 bp, Homo sapiens
ccactggcatctctggagtg

SEQ ID NO: 5389949 - DNA, 13 bp, Homo sapiens
ccactggccacca

SEQ ID NO: 5389950 - DNA, 14 bp, Homo sapiens
ccactggccaccag

SEQ ID NO: 5389951 - DNA, 11 bp, Homo sapiens
ccactggccag

SEQ ID NO: 5389952 - DNA, 22 bp, Homo sapiens
ccactggccagtcctagagctc

SEQ ID NO: 5389953 - DNA, 13 bp, Homo sapiens
ccactggccctgg

SEQ ID NO: 5389954 - DNA, 14 bp, Homo sapiens
ccactggccgctga

SEQ ID NO: 5389955 - DNA, 16 bp, Homo sapiens
ccactggccgctgagc

SEQ ID NO: 5389956 - DNA, 20 bp, Homo sapiens
ccactggccgctgagcgccc

SEQ ID NO: 5389957 - DNA, 11 bp, Homo sapiens
ccactggctcc

SEQ ID NO: 5389958 - DNA, 14 bp, Homo sapiens
ccactggctccatg

SEQ ID NO: 5389959 - DNA, 13 bp, Homo sapiens
ccactggctcctc

SEQ ID NO: 5389960 - DNA, 18 bp, Homo sapiens
ccactggctgtgcctccc

SEQ ID NO: 5389961 - DNA, 16 bp, Homo sapiens
ccactggctgtgggct

SEQ ID NO: 5389962 - DNA, 17 bp, Homo sapiens
ccactggctgtgggctc

SEQ ID NO: 5389963 - DNA, 16 bp, Homo sapiens
ccactggcttttgcct

SEQ ID NO: 5389964 - DNA, 14 bp, Homo sapiens
ccactgggacagct

SEQ ID NO: 5389965 - DNA, 17 bp, Homo sapiens
ccactgggacagctggc

SEQ ID NO: 5389966 - DNA, 22 bp, Homo sapiens
ccactgggacagctggctgggc

SEQ ID NO: 5389967 - DNA, 13 bp, Homo sapiens
ccactgggactcc

SEQ ID NO: 5389968 - DNA, 22 bp, Homo sapiens
ccactgggagagtccttagcct

SEQ ID NO: 5389969 - DNA, 11 bp, Homo sapiens
ccactgggagg

SEQ ID NO: 5389970 - DNA, 17 bp, Homo sapiens
ccactgggcacacgcac

SEQ ID NO: 5389971 - DNA, 14 bp, Homo sapiens
ccactgggcacctg

SEQ ID NO: 5389972 - DNA, 17 bp, Homo sapiens
ccactgggcacctgcgc

SEQ ID NO: 5389973 - DNA, 19 bp, Homo sapiens
ccactgggcacctgcgcac

SEQ ID NO: 5389974 - DNA, 22 bp, Homo sapiens
ccactgggcacctgcgcacagg

SEQ ID NO: 5389975 - DNA, 17 bp, Homo sapiens
ccactgggccagccctg

SEQ ID NO: 5389976 - DNA, 20 bp, Homo sapiens
ccactgggccagccctgcag

SEQ ID NO: 5389977 - DNA, 13 bp, Homo sapiens
ccactgggcccca

SEQ ID NO: 5389978 - DNA, 20 bp, Homo sapiens
ccactgggcccctgtcccca

SEQ ID NO: 5389979 - DNA, 13 bp, Homo sapiens
ccactgggccctg

SEQ ID NO: 5389980 - DNA, 18 bp, Homo sapiens
ccactgggccctgagcca

SEQ ID NO: 5389981 - DNA, 19 bp, Homo sapiens
ccactgggccctgagccag

SEQ ID NO: 5389982 - DNA, 14 bp, Homo sapiens
ccactgggccctgg

SEQ ID NO: 5389983 - DNA, 17 bp, Homo sapiens
ccactgggccctggggc

SEQ ID NO: 5389984 - DNA, 19 bp, Homo sapiens
ccactgggccctggggctg

SEQ ID NO: 5389985 - DNA, 22 bp, Homo sapiens
ccactgggccctggggctgccc

SEQ ID NO: 5389986 - DNA, 17 bp, Homo sapiens
ccactgggcctgctagt

SEQ ID NO: 5389987 - DNA, 13 bp, Homo sapiens
ccactgggctctg

SEQ ID NO: 5389988 - DNA, 14 bp, Homo sapiens
ccactgggctctgg

SEQ ID NO: 5389989 - DNA, 16 bp, Homo sapiens
ccactgggctctggac

SEQ ID NO: 5389990 - DNA, 20 bp, Homo sapiens
ccactgggctctggacctca

SEQ ID NO: 5389991 - DNA, 21 bp, Homo sapiens
ccactgggctctggacctcag

SEQ ID NO: 5389992 - DNA, 11 bp, Homo sapiens
ccactggggaa

SEQ ID NO: 5389993 - DNA, 22 bp, Homo sapiens
ccactggggaatgctcccagct

SEQ ID NO: 5389994 - DNA, 21 bp, Homo sapiens
ccactggggaggaatcctgga

SEQ ID NO: 5389995 - DNA, 18 bp, Homo sapiens
ccactggggagtgctgga

SEQ ID NO: 5389996 - DNA, 22 bp, Homo sapiens
ccactggggccggcggggccca

SEQ ID NO: 5389997 - DNA, 18 bp, Homo sapiens
ccactggggtccagggag

SEQ ID NO: 5389998 - DNA, 22 bp, Homo sapiens
ccactggggtccagggagcagg

SEQ ID NO: 5389999 - DNA, 20 bp, Homo sapiens
ccactggggtgccttcactg

SEQ ID NO: 5390000 - DNA, 12 bp, Homo sapiens
ccactggggtgg

SEQ ID NO: 5390001 - DNA, 21 bp, Homo sapiens
ccactggggtggcctgactcc

SEQ ID NO: 5390002 - DNA, 16 bp, Homo sapiens
ccactgggtctcactc

SEQ ID NO: 5390003 - DNA, 18 bp, Homo sapiens
ccactggtaacatgtgac

SEQ ID NO: 5390004 - DNA, 20 bp, Homo sapiens
ccactggtccccaacaatgt

SEQ ID NO: 5390005 - DNA, 21 bp, Homo sapiens
ccactggttaaaataaagcct

SEQ ID NO: 5390006 - DNA, 15 bp, Homo sapiens
ccactggttcttctt

SEQ ID NO: 5390007 - DNA, 15 bp, Homo sapiens
ccactggtttctcag

SEQ ID NO: 5390008 - DNA, 18 bp, Homo sapiens
ccactgtaaaatgaaatt

SEQ ID NO: 5390009 - DNA, 14 bp, Homo sapiens
ccactgtacatata

SEQ ID NO: 5390010 - DNA, 11 bp, Homo sapiens
ccactgtagct

SEQ ID NO: 5390011 - DNA, 21 bp, Homo sapiens
ccactgtaggggttggggttt

SEQ ID NO: 5390012 - DNA, 21 bp, Homo sapiens
ccactgtatatgcatatagtg

SEQ ID NO: 5390013 - DNA, 14 bp, Homo sapiens
ccactgtcacaggc

SEQ ID NO: 5390014 - DNA, 22 bp, Homo sapiens
ccactgtcactgtttctctgct

SEQ ID NO: 5390015 - DNA, 23 bp, Homo sapiens
ccactgtcactgtttctctgctg

SEQ ID NO: 5390016 - DNA, 24 bp, Homo sapiens
ccactgtcactgtttctctgctgt

SEQ ID NO: 5390017 - DNA, 19 bp, Homo sapiens
ccactgtcagccctcactg

SEQ ID NO: 5390018 - DNA, 15 bp, Homo sapiens
ccactgtcaggcctc

SEQ ID NO: 5390019 - DNA, 21 bp, Homo sapiens
ccactgtcaggcctctgagcc

SEQ ID NO: 5390020 - DNA, 12 bp, Homo sapiens
ccactgtccctg

SEQ ID NO: 5390021 - DNA, 14 bp, Homo sapiens
ccactgtccctgtc

SEQ ID NO: 5390022 - DNA, 15 bp, Homo sapiens
ccactgtccctgtcc

SEQ ID NO: 5390023 - DNA, 15 bp, Homo sapiens
ccactgtcctccttg

SEQ ID NO: 5390024 - DNA, 17 bp, Homo sapiens
ccactgtcctccttggc

SEQ ID NO: 5390025 - DNA, 14 bp, Homo sapiens
ccactgtcctgggc

SEQ ID NO: 5390026 - DNA, 11 bp, Homo sapiens
ccactgtcctt

SEQ ID NO: 5390027 - DNA, 22 bp, Homo sapiens
ccactgtcctttctccaggccc

SEQ ID NO: 5390028 - DNA, 20 bp, Homo sapiens
ccactgtctgtccctgaact

SEQ ID NO: 5390029 - DNA, 16 bp, Homo sapiens
ccactgtcttgcctgc

SEQ ID NO: 5390030 - DNA, 12 bp, Homo sapiens
ccactgtctttt

SEQ ID NO: 5390031 - DNA, 20 bp, Homo sapiens
ccactgtgaaccggctccca

SEQ ID NO: 5390032 - DNA, 14 bp, Homo sapiens
ccactgtgaagaga

SEQ ID NO: 5390033 - DNA, 18 bp, Homo sapiens
ccactgtgccactgactt

SEQ ID NO: 5390034 - DNA, 16 bp, Homo sapiens
ccactgtgccatgtgc

SEQ ID NO: 5390035 - DNA, 15 bp, Homo sapiens
ccactttgttcttta

SEQ ID NO: 5390036 - DNA, 21 bp, Homo sapiens
ccactttgttggcccttccag

SEQ ID NO: 5390037 - DNA, 22 bp, Homo sapiens
ccactttgtttcgtggggaggt

SEQ ID NO: 5390038 - DNA, 21 bp, Homo sapiens
ccacttttaaaggaatgtgaa

SEQ ID NO: 5390039 - DNA, 14 bp, Homo sapiens
ccacttttatttat

SEQ ID NO: 5390040 - DNA, 14 bp, Homo sapiens
ccacttttcttctt

SEQ ID NO: 5390041 - DNA, 22 bp, Homo sapiens
ccacttttgaagtcttccctca

SEQ ID NO: 5390042 - DNA, 18 bp, Homo sapiens
ccacttttgcccacctct

SEQ ID NO: 5390043 - DNA, 22 bp, Homo sapiens
ccacttttgcccacctcttctg

SEQ ID NO: 5390044 - DNA, 11 bp, Homo sapiens
ccacttttgtt

SEQ ID NO: 5390045 - DNA, 13 bp, Homo sapiens
ccacttttgttct

SEQ ID NO: 5390046 - DNA, 19 bp, Homo sapiens
ccactttttcagaggtgaa

SEQ ID NO: 5390047 - DNA, 20 bp, Homo sapiens
ccactttttggtaatatata

SEQ ID NO: 5390048 - DNA, 23 bp, Homo sapiens
ccactttttttttttctgcctga

SEQ ID NO: 5390049 - DNA, 21 bp, Homo sapiens
ccagaaaaaagtgtttataat

SEQ ID NO: 5390050 - DNA, 16 bp, Homo sapiens
ccagaaaaaataaatg

SEQ ID NO: 5390051 - DNA, 17 bp, Homo sapiens
ccagaaaaaataaatgt

SEQ ID NO: 5390052 - DNA, 15 bp, Homo sapiens
ccagaaaaagaagaa

SEQ ID NO: 5390053 - DNA, 19 bp, Homo sapiens
ccagaaaaagaagaaggag

SEQ ID NO: 5390054 - DNA, 17 bp, Homo sapiens
ccagaaaaatcaatcat

SEQ ID NO: 5390055 - DNA, 13 bp, Homo sapiens
ccagaaaacaaaa

SEQ ID NO: 5390056 - DNA, 21 bp, Homo sapiens
ccagaaaacctctcctgaccc

SEQ ID NO: 5390057 - DNA, 15 bp, Homo sapiens
ccagaaaaggacaga

SEQ ID NO: 5390058 - DNA, 17 bp, Homo sapiens
ccagaaaaggcagccag

SEQ ID NO: 5390059 - DNA, 19 bp, Homo sapiens
ccagaaaaggcagccagat

SEQ ID NO: 5390060 - DNA, 20 bp, Homo sapiens
ccagaaaaggcagccagatc

SEQ ID NO: 5390061 - DNA, 20 bp, Homo sapiens
ccagaaaatagggtggacag

SEQ ID NO: 5390062 - DNA, 16 bp, Homo sapiens
ccagaaaatataaatg

SEQ ID NO: 5390063 - DNA, 21 bp, Homo sapiens
ccagaaaatatgatatatatg

SEQ ID NO: 5390064 - DNA, 13 bp, Homo sapiens
ccagaaaatgaaa

SEQ ID NO: 5390065 - DNA, 12 bp, Homo sapiens
ccagaaacaaca

SEQ ID NO: 5390066 - DNA, 18 bp, Homo sapiens
ccagaaacacccctctgt

SEQ ID NO: 5390067 - DNA, 18 bp, Homo sapiens
ccagaaacagctgcttct

SEQ ID NO: 5390068 - DNA, 22 bp, Homo sapiens
ccagaaacagtgggagccctga

SEQ ID NO: 5390069 - DNA, 15 bp, Homo sapiens
ccagaaacctgggag

SEQ ID NO: 5390070 - DNA, 22 bp, Homo sapiens
ccagaaacctgggagagacttg

SEQ ID NO: 5390071 - DNA, 18 bp, Homo sapiens
ccagaaacctttgtttgc

SEQ ID NO: 5390072 - DNA, 15 bp, Homo sapiens
ccagaaactcctgtt

SEQ ID NO: 5390073 - DNA, 19 bp, Homo sapiens
ccagaaactgaaccaacag

SEQ ID NO: 5390074 - DNA, 24 bp, Homo sapiens
ccagaaactgttcccacctgctgg

SEQ ID NO: 5390075 - DNA, 15 bp, Homo sapiens
ccagaaagaaaatga

SEQ ID NO: 5390076 - DNA, 18 bp, Homo sapiens
ccagaaagaggaataaaa

SEQ ID NO: 5390077 - DNA, 19 bp, Homo sapiens
ccagaaagcaggagcagct

SEQ ID NO: 5390078 - DNA, 17 bp, Homo sapiens
ccagaaagccctcttgg

SEQ ID NO: 5390079 - DNA, 15 bp, Homo sapiens
ccagaaagcctcctg

SEQ ID NO: 5390080 - DNA, 16 bp, Homo sapiens
ccagaaagcctctctc

SEQ ID NO: 5390081 - DNA, 23 bp, Homo sapiens
ccagaaagcctctctctccctcc

SEQ ID NO: 5390082 - DNA, 14 bp, Homo sapiens
ccagaaagctgcca

SEQ ID NO: 5390083 - DNA, 17 bp, Homo sapiens
ccagaaaggatatttaa

SEQ ID NO: 5390084 - DNA, 13 bp, Homo sapiens
ccagaaagggtgc

SEQ ID NO: 5390085 - DNA, 22 bp, Homo sapiens
ccagaaaggtgattccaggagg

SEQ ID NO: 5390086 - DNA, 24 bp, Homo sapiens
ccagaaaggtgtgaggagagagga

SEQ ID NO: 5390087 - DNA, 21 bp, Homo sapiens
ccagaaagtgaggaagcctaa

SEQ ID NO: 5390088 - DNA, 18 bp, Homo sapiens
ccagaaataaagggacca

SEQ ID NO: 5390089 - DNA, 16 bp, Homo sapiens
ccagaaatacaacaga

SEQ ID NO: 5390090 - DNA, 17 bp, Homo sapiens
ccagaaatacctgtcta

SEQ ID NO: 5390091 - DNA, 22 bp, Homo sapiens
ccagaaatatcgctgatgcaga

SEQ ID NO: 5390092 - DNA, 15 bp, Homo sapiens
ccagaaatcactgtg

SEQ ID NO: 5390093 - DNA, 19 bp, Homo sapiens
ccagaaatgccgctgtgtc

SEQ ID NO: 5390094 - DNA, 20 bp, Homo sapiens
ccagaaatgccgctgtgtcc

SEQ ID NO: 5390095 - DNA, 15 bp, Homo sapiens
ccagaaatgggcagt

SEQ ID NO: 5390096 - DNA, 18 bp, Homo sapiens
ccagaaatgtccctttct

SEQ ID NO: 5390097 - DNA, 23 bp, Homo sapiens
ccagaaatgtttatggaaatatt

SEQ ID NO: 5390098 - DNA, 13 bp, Homo sapiens
ccagaaattctgg

SEQ ID NO: 5390099 - DNA, 22 bp, Homo sapiens
ccagaaattgtgtgtgcaagaa

SEQ ID NO: 5390100 - DNA, 14 bp, Homo sapiens
ccagaacaaaaaga

SEQ ID NO: 5390101 - DNA, 22 bp, Homo sapiens
ccagaacaaggttccctctgag

SEQ ID NO: 5390102 - DNA, 16 bp, Homo sapiens
ccagaacaattctgca

SEQ ID NO: 5390103 - DNA, 17 bp, Homo sapiens
ccagaacacactccatc

SEQ ID NO: 5390104 - DNA, 19 bp, Homo sapiens
ccagaacacactccatcag

SEQ ID NO: 5390105 - DNA, 21 bp, Homo sapiens
ccagaacacatggctgggcct

SEQ ID NO: 5390106 - DNA, 13 bp, Homo sapiens
ccagaacagccct

SEQ ID NO: 5390107 - DNA, 13 bp, Homo sapiens
ccagaacagtatg

SEQ ID NO: 5390108 - DNA, 22 bp, Homo sapiens
ccagaacatggattccactgaa

SEQ ID NO: 5390109 - DNA, 17 bp, Homo sapiens
ccagaacctctaagtgc

SEQ ID NO: 5390110 - DNA, 21 bp, Homo sapiens
ccagaacctctaagtgctgct

SEQ ID NO: 5390111 - DNA, 23 bp, Homo sapiens
ccagaacctctaagtgctgctgt

SEQ ID NO: 5390112 - DNA, 15 bp, Homo sapiens
ccagaacctgtcctt

SEQ ID NO: 5390113 - DNA, 14 bp, Homo sapiens
ccagaaccttactg

SEQ ID NO: 5390114 - DNA, 20 bp, Homo sapiens
ccagaaccttactggcactg

SEQ ID NO: 5390115 - DNA, 21 bp, Homo sapiens
ccagaaccttgatggggtgag

SEQ ID NO: 5390116 - DNA, 16 bp, Homo sapiens
ccagaacgccctgtgt

SEQ ID NO: 5390117 - DNA, 23 bp, Homo sapiens
ccagaacgccctgtgtccacagt

SEQ ID NO: 5390118 - DNA, 19 bp, Homo sapiens
ccagaactcactggggcct

SEQ ID NO: 5390119 - DNA, 14 bp, Homo sapiens
ccagaactcttcct

SEQ ID NO: 5390120 - DNA, 13 bp, Homo sapiens
ccagaactgcaca

SEQ ID NO: 5390121 - DNA, 17 bp, Homo sapiens
ccagaactggctgggcc

SEQ ID NO: 5390122 - DNA, 20 bp, Homo sapiens
ccagaacttgaccctgagct

SEQ ID NO: 5390123 - DNA, 12 bp, Homo sapiens
ccagaagaaaag

SEQ ID NO: 5390124 - DNA, 14 bp, Homo sapiens
ccagaagaaattat

SEQ ID NO: 5390125 - DNA, 20 bp, Homo sapiens
ccagaagaagagaagctgct

SEQ ID NO: 5390126 - DNA, 23 bp, Homo sapiens
ccagaagaagagaagctgctgac

SEQ ID NO: 5390127 - DNA, 14 bp, Homo sapiens
ccagaagaccccac

SEQ ID NO: 5390128 - DNA, 22 bp, Homo sapiens
ccagaagacgtggtctagacca

SEQ ID NO: 5390129 - DNA, 15 bp, Homo sapiens
ccagaagactggatc

SEQ ID NO: 5390130 - DNA, 21 bp, Homo sapiens
ccagaagagaattaagcccta

SEQ ID NO: 5390131 - DNA, 13 bp, Homo sapiens
ccagaagagccca

SEQ ID NO: 5390132 - DNA, 18 bp, Homo sapiens
ccagaagagcttgtcagc

SEQ ID NO: 5390133 - DNA, 22 bp, Homo sapiens
ccagaagatagcttcaccccaa

SEQ ID NO: 5390134 - DNA, 16 bp, Homo sapiens
ccagaagatgaaaaaa

SEQ ID NO: 5390135 - DNA, 18 bp, Homo sapiens
ccagaagatgaacagact

SEQ ID NO: 5390136 - DNA, 19 bp, Homo sapiens
ccagaagatgaacagactg

SEQ ID NO: 5390137 - DNA, 16 bp, Homo sapiens
ccagaagatgactgag

SEQ ID NO: 5390138 - DNA, 21 bp, Homo sapiens
ccagaagatgactgagggtga

SEQ ID NO: 5390139 - DNA, 17 bp, Homo sapiens
ccagaagatgccagctt

SEQ ID NO: 5390140 - DNA, 21 bp, Homo sapiens
ccagaagatgccagcttctct

SEQ ID NO: 5390141 - DNA, 17 bp, Homo sapiens
ccagaagatgccctcca

SEQ ID NO: 5390142 - DNA, 23 bp, Homo sapiens
ccagaagatgtattcagagccac

SEQ ID NO: 5390143 - DNA, 20 bp, Homo sapiens
ccagaagcagagagcacagc

SEQ ID NO: 5390144 - DNA, 15 bp, Homo sapiens
ccagaagcccagaat

SEQ ID NO: 5390145 - DNA, 22 bp, Homo sapiens
ccagaagcctccttacattaaa

SEQ ID NO: 5390146 - DNA, 12 bp, Homo sapiens
ccagaagcctct

SEQ ID NO: 5390147 - DNA, 15 bp, Homo sapiens
ccagaagcctctggc

SEQ ID NO: 5390148 - DNA, 23 bp, Homo sapiens
ccagaagccttggaaccagcccc

SEQ ID NO: 5390149 - DNA, 20 bp, Homo sapiens
ccagaagctcaaggctgcag

SEQ ID NO: 5390150 - DNA, 16 bp, Homo sapiens
ccagaagctcccccag

SEQ ID NO: 5390151 - DNA, 20 bp, Homo sapiens
ccagaagctgagcaccaggg

SEQ ID NO: 5390152 - DNA, 11 bp, Homo sapiens
ccagaagctgc

SEQ ID NO: 5390153 - DNA, 20 bp, Homo sapiens
ccagaaggaacccggtccca

SEQ ID NO: 5390154 - DNA, 23 bp, Homo sapiens
ccagaaggaacccggtcccaggc

SEQ ID NO: 5390155 - DNA, 13 bp, Homo sapiens
ccagaaggaagcc

SEQ ID NO: 5390156 - DNA, 21 bp, Homo sapiens
ccagaaggaatcttctcatct

SEQ ID NO: 5390157 - DNA, 17 bp, Homo sapiens
ccagaaggagcaggccc

SEQ ID NO: 5390158 - DNA, 18 bp, Homo sapiens
ccagaaggagggcagagc

SEQ ID NO: 5390159 - DNA, 19 bp, Homo sapiens
ccagaaggagggcagagcc

SEQ ID NO: 5390160 - DNA, 21 bp, Homo sapiens
ccagaaggagggcagagccat

SEQ ID NO: 5390161 - DNA, 23 bp, Homo sapiens
ccagaaggagggcagagccatgg

SEQ ID NO: 5390162 - DNA, 23 bp, Homo sapiens
ccagaaggagggggtgacctccg

SEQ ID NO: 5390163 - DNA, 18 bp, Homo sapiens
ccagaaggatccaagaca

SEQ ID NO: 5390164 - DNA, 22 bp, Homo sapiens
ccagaaggcatatcagtctctg

SEQ ID NO: 5390165 - DNA, 22 bp, Homo sapiens
ccagaaggccacaggccactgc

SEQ ID NO: 5390166 - DNA, 13 bp, Homo sapiens
ccagaaggccaga

SEQ ID NO: 5390167 - DNA, 14 bp, Homo sapiens
ccagaaggccagaa

SEQ ID NO: 5390168 - DNA, 18 bp, Homo sapiens
ccagaagggagttgctca

SEQ ID NO: 5390169 - DNA, 20 bp, Homo sapiens
ccagaagggagttgctcact

SEQ ID NO: 5390170 - DNA, 21 bp, Homo sapiens
ccagaagggagttgctcactc

SEQ ID NO: 5390171 - DNA, 14 bp, Homo sapiens
ccagaagggcttca

SEQ ID NO: 5390172 - DNA, 19 bp, Homo sapiens
ccagaaggggctgcttgct

SEQ ID NO: 5390173 - DNA, 21 bp, Homo sapiens
ccagaaggggctgcttgcttt

SEQ ID NO: 5390174 - DNA, 12 bp, Homo sapiens
ccagaagggtag

SEQ ID NO: 5390175 - DNA, 20 bp, Homo sapiens
ccagaagtaacttattttgt

SEQ ID NO: 5390176 - DNA, 15 bp, Homo sapiens
ccagaagtagctttg

SEQ ID NO: 5390177 - DNA, 16 bp, Homo sapiens
ccagaagtattgttta

SEQ ID NO: 5390178 - DNA, 19 bp, Homo sapiens
ccagaagtattgtttacat

SEQ ID NO: 5390179 - DNA, 21 bp, Homo sapiens
ccagaagtattgtttacatta

SEQ ID NO: 5390180 - DNA, 20 bp, Homo sapiens
ccagaagtcaagcccagcca

SEQ ID NO: 5390181 - DNA, 21 bp, Homo sapiens
ccagaagtcctccctcctgca

SEQ ID NO: 5390182 - DNA, 17 bp, Homo sapiens
ccagaagtggcaggagg

SEQ ID NO: 5390183 - DNA, 21 bp, Homo sapiens
ccagaagtggcaggaggacag

SEQ ID NO: 5390184 - DNA, 19 bp, Homo sapiens
ccagaagtggctactgact

SEQ ID NO: 5390185 - DNA, 22 bp, Homo sapiens
ccagaagtgtattcatattacc

SEQ ID NO: 5390186 - DNA, 23 bp, Homo sapiens
ccagaagtgtattcatattacca

SEQ ID NO: 5390187 - DNA, 12 bp, Homo sapiens
ccagaagtgtga

SEQ ID NO: 5390188 - DNA, 18 bp, Homo sapiens
ccagaagtgtgactggct

SEQ ID NO: 5390189 - DNA, 12 bp, Homo sapiens
ccagaagtgttt

SEQ ID NO: 5390190 - DNA, 20 bp, Homo sapiens
ccagaagttgggggaaagtt

SEQ ID NO: 5390191 - DNA, 20 bp, Homo sapiens
ccagaagtttgtcaagtcaa

SEQ ID NO: 5390192 - DNA, 17 bp, Homo sapiens
ccagaataagtgctgtt

SEQ ID NO: 5390193 - DNA, 21 bp, Homo sapiens
ccagaataagtgctgtttgag

SEQ ID NO: 5390194 - DNA, 15 bp, Homo sapiens
ccagaataagttatt

SEQ ID NO: 5390195 - DNA, 19 bp, Homo sapiens
ccagaataagttattgcag

SEQ ID NO: 5390196 - DNA, 21 bp, Homo sapiens
ccagaataagttattgcagtt

SEQ ID NO: 5390197 - DNA, 22 bp, Homo sapiens
ccagaataagttattgcagttt

SEQ ID NO: 5390198 - DNA, 23 bp, Homo sapiens
ccagaataagttattgcagttta

SEQ ID NO: 5390199 - DNA, 12 bp, Homo sapiens
ccagaatactga

SEQ ID NO: 5390200 - DNA, 21 bp, Homo sapiens
ccagaatactgatggaatttt

SEQ ID NO: 5390201 - DNA, 12 bp, Homo sapiens
ccagaatcaaag

SEQ ID NO: 5390202 - DNA, 18 bp, Homo sapiens
ccagaatcagattcagga

SEQ ID NO: 5390203 - DNA, 18 bp, Homo sapiens
ccagaatccataaatgtg

SEQ ID NO: 5390204 - DNA, 20 bp, Homo sapiens
ccagaatccccaagtgcctg

SEQ ID NO: 5390205 - DNA, 21 bp, Homo sapiens
ccagaatccccaagtgcctgc

SEQ ID NO: 5390206 - DNA, 14 bp, Homo sapiens
ccagaatcccctgg

SEQ ID NO: 5390207 - DNA, 16 bp, Homo sapiens
ccagaatcccctgggg

SEQ ID NO: 5390208 - DNA, 21 bp, Homo sapiens
ccagaatccctctacatggac

SEQ ID NO: 5390209 - DNA, 20 bp, Homo sapiens
ccagaatctagagcaaagcc

SEQ ID NO: 5390210 - DNA, 19 bp, Homo sapiens
ccagagtggccacggccca

SEQ ID NO: 5390211 - DNA, 22 bp, Homo sapiens
ccagagtggccacggcccaggg

SEQ ID NO: 5390212 - DNA, 23 bp, Homo sapiens
ccagagtggccacggcccaggga

SEQ ID NO: 5390213 - DNA, 18 bp, Homo sapiens
ccagagtggcctggccag

SEQ ID NO: 5390214 - DNA, 19 bp, Homo sapiens
ccagagtggcctggccagg

SEQ ID NO: 5390215 - DNA, 21 bp, Homo sapiens
ccagagtggcctggccaggag

SEQ ID NO: 5390216 - DNA, 23 bp, Homo sapiens
ccagagtggcctggccaggagct

SEQ ID NO: 5390217 - DNA, 18 bp, Homo sapiens
ccagagtgggagaggctg

SEQ ID NO: 5390218 - DNA, 20 bp, Homo sapiens
ccagagtgggagaggctggg

SEQ ID NO: 5390219 - DNA, 21 bp, Homo sapiens
ccagagtgggagaggctggga

SEQ ID NO: 5390220 - DNA, 24 bp, Homo sapiens
ccagagtgggagaggctgggaggt

SEQ ID NO: 5390221 - DNA, 14 bp, Homo sapiens
ccagagtgtagggg

SEQ ID NO: 5390222 - DNA, 12 bp, Homo sapiens
ccagagtgtcct

SEQ ID NO: 5390223 - DNA, 13 bp, Homo sapiens
ccagagtgtcctg

SEQ ID NO: 5390224 - DNA, 21 bp, Homo sapiens
ccagagtgtgggaagggagag

SEQ ID NO: 5390225 - DNA, 15 bp, Homo sapiens
ccagagttaaagcat

SEQ ID NO: 5390226 - DNA, 16 bp, Homo sapiens
ccagagttatttccca

SEQ ID NO: 5390227 - DNA, 19 bp, Homo sapiens
ccagagttccccatgcaga

SEQ ID NO: 5390228 - DNA, 15 bp, Homo sapiens
ccagagttcttaaag

SEQ ID NO: 5390229 - DNA, 11 bp, Homo sapiens
ccagagttgct

SEQ ID NO: 5390230 - DNA, 12 bp, Homo sapiens
ccagagttgctg

SEQ ID NO: 5390231 - DNA, 23 bp, Homo sapiens
ccagagttgggggctaggggagg

SEQ ID NO: 5390232 - DNA, 18 bp, Homo sapiens
ccagagttgttctcaggg

SEQ ID NO: 5390233 - DNA, 19 bp, Homo sapiens
ccagagttgttctcagggg

SEQ ID NO: 5390234 - DNA, 23 bp, Homo sapiens
ccagagttgttctcaggggtgct

SEQ ID NO: 5390235 - DNA, 18 bp, Homo sapiens
ccagagtttgcctccctg

SEQ ID NO: 5390236 - DNA, 19 bp, Homo sapiens
ccagagttttggtttttga

SEQ ID NO: 5390237 - DNA, 18 bp, Homo sapiens
ccagagtttttaaagcct

SEQ ID NO: 5390238 - DNA, 22 bp, Homo sapiens
ccagagtttttaaagccttctg

SEQ ID NO: 5390239 - DNA, 22 bp, Homo sapiens
ccagataaaatgttcagtgcaa

SEQ ID NO: 5390240 - DNA, 16 bp, Homo sapiens
ccagataaatagaact

SEQ ID NO: 5390241 - DNA, 20 bp, Homo sapiens
ccagataaatagaactatct

SEQ ID NO: 5390242 - DNA, 23 bp, Homo sapiens
ccagataaccaagtgagatgtct

SEQ ID NO: 5390243 - DNA, 19 bp, Homo sapiens
ccagataactctctttcct

SEQ ID NO: 5390244 - DNA, 24 bp, Homo sapiens
ccagataactctctttccttgagc

SEQ ID NO: 5390245 - DNA, 13 bp, Homo sapiens
ccagataactttt

SEQ ID NO: 5390246 - DNA, 17 bp, Homo sapiens
ccagataaggcaagcca

SEQ ID NO: 5390247 - DNA, 20 bp, Homo sapiens
ccagataagtgaagtaattt

SEQ ID NO: 5390248 - DNA, 12 bp, Homo sapiens
ccagataccatg

SEQ ID NO: 5390249 - DNA, 17 bp, Homo sapiens
ccagatacctgtgagga

SEQ ID NO: 5390250 - DNA, 22 bp, Homo sapiens
ccagatacggacagagaccaag

SEQ ID NO: 5390251 - DNA, 15 bp, Homo sapiens
ccagatagagctggg

SEQ ID NO: 5390252 - DNA, 18 bp, Homo sapiens
ccagatagagctgggtgg

SEQ ID NO: 5390253 - DNA, 21 bp, Homo sapiens
ccagatagcctagggtgaggg

SEQ ID NO: 5390254 - DNA, 16 bp, Homo sapiens
ccagatagtcccagca

SEQ ID NO: 5390255 - DNA, 14 bp, Homo sapiens
ccagatataaaata

SEQ ID NO: 5390256 - DNA, 14 bp, Homo sapiens
ccagatataactgt

SEQ ID NO: 5390257 - DNA, 19 bp, Homo sapiens
ccagatataactgtcttgt

SEQ ID NO: 5390258 - DNA, 22 bp, Homo sapiens
ccagatatccacataaatgctc

SEQ ID NO: 5390259 - DNA, 19 bp, Homo sapiens
ccagatatgaacagggccc

SEQ ID NO: 5390260 - DNA, 16 bp, Homo sapiens
ccagatatggaaacag

SEQ ID NO: 5390261 - DNA, 18 bp, Homo sapiens
ccagatatggaaacagaa

SEQ ID NO: 5390262 - DNA, 21 bp, Homo sapiens
ccagatattgcactaggtcaa

SEQ ID NO: 5390263 - DNA, 16 bp, Homo sapiens
ccagatcactgccaca

SEQ ID NO: 5390264 - DNA, 13 bp, Homo sapiens
ccagatcagccag

SEQ ID NO: 5390265 - DNA, 15 bp, Homo sapiens
ccagatcagccagaa

SEQ ID NO: 5390266 - DNA, 19 bp, Homo sapiens
ccagatcaggaaccagggc

SEQ ID NO: 5390267 - DNA, 21 bp, Homo sapiens
ccagatcatgccgccgcagct

SEQ ID NO: 5390268 - DNA, 22 bp, Homo sapiens
ccagatcatgccgccgcagctg

SEQ ID NO: 5390269 - DNA, 17 bp, Homo sapiens
ccagatcatgttttggt

SEQ ID NO: 5390270 - DNA, 13 bp, Homo sapiens
ccagatccaccct

SEQ ID NO: 5390271 - DNA, 18 bp, Homo sapiens
ccagatccagactgtaag

SEQ ID NO: 5390272 - DNA, 14 bp, Homo sapiens
ccagatccagcctg

SEQ ID NO: 5390273 - DNA, 15 bp, Homo sapiens
ccagatccaggaaca

SEQ ID NO: 5390274 - DNA, 21 bp, Homo sapiens
ccagatccaggaacacatgca

SEQ ID NO: 5390275 - DNA, 16 bp, Homo sapiens
ccagatccccagggca

SEQ ID NO: 5390276 - DNA, 22 bp, Homo sapiens
ccagatccccagggcagcctcg

SEQ ID NO: 5390277 - DNA, 17 bp, Homo sapiens
ccagatccgctccagcg

SEQ ID NO: 5390278 - DNA, 17 bp, Homo sapiens
ccagatcctcacaacca

SEQ ID NO: 5390279 - DNA, 17 bp, Homo sapiens
ccagatcctctgctgac

SEQ ID NO: 5390280 - DNA, 21 bp, Homo sapiens
ccagatcctctgctgactcca

SEQ ID NO: 5390281 - DNA, 14 bp, Homo sapiens
ccagatcctcttgg

SEQ ID NO: 5390282 - DNA, 23 bp, Homo sapiens
ccagatcctctttccccactgaa

SEQ ID NO: 5390283 - DNA, 22 bp, Homo sapiens
ccagatccttttccatcccact

SEQ ID NO: 5390284 - DNA, 18 bp, Homo sapiens
ccagatcgatcctggatt

SEQ ID NO: 5390285 - DNA, 22 bp, Homo sapiens
ccagatcggatctgttgcaaac

SEQ ID NO: 5390286 - DNA, 23 bp, Homo sapiens
ccagatctacttggttgtcaagt

SEQ ID NO: 5390287 - DNA, 14 bp, Homo sapiens
ccagatctcatgga

SEQ ID NO: 5390288 - DNA, 14 bp, Homo sapiens
ccagatctgcaccg

SEQ ID NO: 5390289 - DNA, 16 bp, Homo sapiens
ccagatctgcctgggc

SEQ ID NO: 5390290 - DNA, 14 bp, Homo sapiens
ccagatctgtcctg

SEQ ID NO: 5390291 - DNA, 17 bp, Homo sapiens
ccagatctgtctccaag

SEQ ID NO: 5390292 - DNA, 13 bp, Homo sapiens
ccagatctttctc

SEQ ID NO: 5390293 - DNA, 14 bp, Homo sapiens
ccagatctttctct

SEQ ID NO: 5390294 - DNA, 23 bp, Homo sapiens
ccagatgaactgagaaggtcaga

SEQ ID NO: 5390295 - DNA, 17 bp, Homo sapiens
ccagatgaagctttggc

SEQ ID NO: 5390296 - DNA, 19 bp, Homo sapiens
ccagatgaagctttggccc

SEQ ID NO: 5390297 - DNA, 20 bp, Homo sapiens
ccagatgacacataaatctg

SEQ ID NO: 5390298 - DNA, 15 bp, Homo sapiens
ccagatgagaagtta

SEQ ID NO: 5390299 - DNA, 19 bp, Homo sapiens
ccagatgaggctggccaag

SEQ ID NO: 5390300 - DNA, 21 bp, Homo sapiens
ccagatgatccttgcacagac

SEQ ID NO: 5390301 - DNA, 23 bp, Homo sapiens
ccagatgatccttgcacagacaa

SEQ ID NO: 5390302 - DNA, 22 bp, Homo sapiens
ccagatgatctcttaggaagcc

SEQ ID NO: 5390303 - DNA, 19 bp, Homo sapiens
ccagatgatgggggagggg

SEQ ID NO: 5390304 - DNA, 14 bp, Homo sapiens
ccagatgatgtccc

SEQ ID NO: 5390305 - DNA, 15 bp, Homo sapiens
ccagatgattttcct

SEQ ID NO: 5390306 - DNA, 16 bp, Homo sapiens
ccagatgattttcctc

SEQ ID NO: 5390307 - DNA, 14 bp, Homo sapiens
ccagatgcaacctc

SEQ ID NO: 5390308 - DNA, 17 bp, Homo sapiens
ccagatgcaccagccct

SEQ ID NO: 5390309 - DNA, 18 bp, Homo sapiens
ccagatgcaccagccctt

SEQ ID NO: 5390310 - DNA, 19 bp, Homo sapiens
ccagatgcaggacaggagg

SEQ ID NO: 5390311 - DNA, 22 bp, Homo sapiens
ccagatgcaggacaggaggcgg

SEQ ID NO: 5390312 - DNA, 14 bp, Homo sapiens
ccagatgcagggca

SEQ ID NO: 5390313 - DNA, 17 bp, Homo sapiens
ccagatgcccctttctg

SEQ ID NO: 5390314 - DNA, 23 bp, Homo sapiens
ccagatgcctacaaccatccctg

SEQ ID NO: 5390315 - DNA, 14 bp, Homo sapiens
ccagatgcctcccc

SEQ ID NO: 5390316 - DNA, 19 bp, Homo sapiens
ccagatgcctcctctgtcc

SEQ ID NO: 5390317 - DNA, 23 bp, Homo sapiens
ccagatgcctcctctgtcctcat

SEQ ID NO: 5390318 - DNA, 23 bp, Homo sapiens
ccagatgccttctagattcactg

SEQ ID NO: 5390319 - DNA, 17 bp, Homo sapiens
ccagatgctactggact

SEQ ID NO: 5390320 - DNA, 21 bp, Homo sapiens
ccagatgctctactttttcct

SEQ ID NO: 5390321 - DNA, 15 bp, Homo sapiens
ccagatgctgatgtt

SEQ ID NO: 5390322 - DNA, 19 bp, Homo sapiens
ccagatgctgcagagtcac

SEQ ID NO: 5390323 - DNA, 14 bp, Homo sapiens
ccagatgctgggga

SEQ ID NO: 5390324 - DNA, 16 bp, Homo sapiens
ccagatggaacactgg

SEQ ID NO: 5390325 - DNA, 16 bp, Homo sapiens
ccagatggagaaacag

SEQ ID NO: 5390326 - DNA, 15 bp, Homo sapiens
ccagatggcaggcta

SEQ ID NO: 5390327 - DNA, 17 bp, Homo sapiens
ccagatggcccccagct

SEQ ID NO: 5390328 - DNA, 19 bp, Homo sapiens
ccagatggcccccagctgg

SEQ ID NO: 5390329 - DNA, 21 bp, Homo sapiens
ccagatggctccctgggctgg

SEQ ID NO: 5390330 - DNA, 21 bp, Homo sapiens
ccagatggcttcggagggccg

SEQ ID NO: 5390331 - DNA, 17 bp, Homo sapiens
ccagatggtcatccaga

SEQ ID NO: 5390332 - DNA, 18 bp, Homo sapiens
ccagatggtcatccagac

SEQ ID NO: 5390333 - DNA, 20 bp, Homo sapiens
ccagatgtcgctgggtcctc

SEQ ID NO: 5390334 - DNA, 20 bp, Homo sapiens
ccagatgtgcttttatttag

SEQ ID NO: 5390335 - DNA, 14 bp, Homo sapiens
ccagatgttgtctg

SEQ ID NO: 5390336 - DNA, 18 bp, Homo sapiens
ccagatgttgtctgaact

SEQ ID NO: 5390337 - DNA, 19 bp, Homo sapiens
ccagatgttgttcctggct

SEQ ID NO: 5390338 - DNA, 21 bp, Homo sapiens
ccagatgttgttcctggctag

SEQ ID NO: 5390339 - DNA, 19 bp, Homo sapiens
ccagatgttttacgtctgg

SEQ ID NO: 5390340 - DNA, 16 bp, Homo sapiens
ccagattaggcctgga

SEQ ID NO: 5390341 - DNA, 14 bp, Homo sapiens
ccagattcccagct

SEQ ID NO: 5390342 - DNA, 16 bp, Homo sapiens
ccagattcccaggcca

SEQ ID NO: 5390343 - DNA, 17 bp, Homo sapiens
ccagattcccaggccag

SEQ ID NO: 5390344 - DNA, 16 bp, Homo sapiens
ccagattctgcctctc

SEQ ID NO: 5390345 - DNA, 13 bp, Homo sapiens
ccagattcttcag

SEQ ID NO: 5390346 - DNA, 18 bp, Homo sapiens
ccagattctttcctgagg

SEQ ID NO: 5390347 - DNA, 15 bp, Homo sapiens
ccagattgaaaagtg

SEQ ID NO: 5390348 - DNA, 13 bp, Homo sapiens
ccagattgacgac

SEQ ID NO: 5390349 - DNA, 14 bp, Homo sapiens
ccagattgcaacag

SEQ ID NO: 5390350 - DNA, 16 bp, Homo sapiens
ccagattgcaacaggc

SEQ ID NO: 5390351 - DNA, 23 bp, Homo sapiens
ccagattgcaacaggctgggctt

SEQ ID NO: 5390352 - DNA, 15 bp, Homo sapiens
ccagattgctctgcc

SEQ ID NO: 5390353 - DNA, 17 bp, Homo sapiens
ccagattgctctgcccc

SEQ ID NO: 5390354 - DNA, 17 bp, Homo sapiens
ccagattggagtcagag

SEQ ID NO: 5390355 - DNA, 14 bp, Homo sapiens
ccagattggccaat

SEQ ID NO: 5390356 - DNA, 22 bp, Homo sapiens
ccagattggctcacactgagaa

SEQ ID NO: 5390357 - DNA, 20 bp, Homo sapiens
ccagattggggctagtttaa

SEQ ID NO: 5390358 - DNA, 22 bp, Homo sapiens
ccagattgtatcatgtgctaga

SEQ ID NO: 5390359 - DNA, 16 bp, Homo sapiens
ccagattgtggggtgc

SEQ ID NO: 5390360 - DNA, 16 bp, Homo sapiens
ccagattgtgtacata

SEQ ID NO: 5390361 - DNA, 13 bp, Homo sapiens
ccagatttatgca

SEQ ID NO: 5390362 - DNA, 23 bp, Homo sapiens
ccagatttgaagacaaaaatact

SEQ ID NO: 5390363 - DNA, 23 bp, Homo sapiens
ccagatttggggtataggtctca

SEQ ID NO: 5390364 - DNA, 23 bp, Homo sapiens
ccagatttgtctttttgttgtaa

SEQ ID NO: 5390365 - DNA, 18 bp, Homo sapiens
ccagattttgctgtatat

SEQ ID NO: 5390366 - DNA, 18 bp, Homo sapiens
ccagattttgggattaca

SEQ ID NO: 5390367 - DNA, 16 bp, Homo sapiens
ccagatttttacacat

SEQ ID NO: 5390368 - DNA, 21 bp, Homo sapiens
ccagcaaaacagattcaaagc

SEQ ID NO: 5390369 - DNA, 10 bp, Homo sapiens
ccagcaaaat

SEQ ID NO: 5390370 - DNA, 12 bp, Homo sapiens
ccagcaaaatcc

SEQ ID NO: 5390371 - DNA, 15 bp, Homo sapiens
ccagcaaaatccaaa

SEQ ID NO: 5390372 - DNA, 19 bp, Homo sapiens
ccagcaaaccaggactctg

SEQ ID NO: 5390373 - DNA, 15 bp, Homo sapiens
ccagcaacacaagct

SEQ ID NO: 5390374 - DNA, 16 bp, Homo sapiens
ccagcaacacctgccg

SEQ ID NO: 5390375 - DNA, 19 bp, Homo sapiens
ccagcaactgcccttccag

SEQ ID NO: 5390376 - DNA, 18 bp, Homo sapiens
ccagcaacttgtcttttt

SEQ ID NO: 5390377 - DNA, 16 bp, Homo sapiens
ccagcaagaaggcgag

SEQ ID NO: 5390378 - DNA, 14 bp, Homo sapiens
ccagcaagacctca

SEQ ID NO: 5390379 - DNA, 18 bp, Homo sapiens
ccagcaagagggaacaaa

SEQ ID NO: 5390380 - DNA, 22 bp, Homo sapiens
ccagcaagcaaacagggtggcc

SEQ ID NO: 5390381 - DNA, 22 bp, Homo sapiens
ccagcaagcagtctaccctgtc

SEQ ID NO: 5390382 - DNA, 17 bp, Homo sapiens
ccagcaagcgggagccc

SEQ ID NO: 5390383 - DNA, 16 bp, Homo sapiens
ccagcaaggcacaggc

SEQ ID NO: 5390384 - DNA, 19 bp, Homo sapiens
ccagcaaggcacaggctcc

SEQ ID NO: 5390385 - DNA, 13 bp, Homo sapiens
ccagcaaggcagg

SEQ ID NO: 5390386 - DNA, 14 bp, Homo sapiens
ccagcccaagtcca

SEQ ID NO: 5390387 - DNA, 13 bp, Homo sapiens
ccagcccaataaa

SEQ ID NO: 5390388 - DNA, 12 bp, Homo sapiens
ccagcccaatcc

SEQ ID NO: 5390389 - DNA, 15 bp, Homo sapiens
ccagcccaatccagg

SEQ ID NO: 5390390 - DNA, 13 bp, Homo sapiens
ccagcccacagag

SEQ ID NO: 5390391 - DNA, 17 bp, Homo sapiens
ccagcccacatccagtg

SEQ ID NO: 5390392 - DNA, 12 bp, Homo sapiens
ccagcccacatt

SEQ ID NO: 5390393 - DNA, 14 bp, Homo sapiens
ccagcccacccccg

SEQ ID NO: 5390394 - DNA, 18 bp, Homo sapiens
ccagcccacccccggcag

SEQ ID NO: 5390395 - DNA, 13 bp, Homo sapiens
ccagcccaccctc

SEQ ID NO: 5390396 - DNA, 14 bp, Homo sapiens
ccagcccaccctcc

SEQ ID NO: 5390397 - DNA, 22 bp, Homo sapiens
ccagcccaccctgctcctcctg

SEQ ID NO: 5390398 - DNA, 19 bp, Homo sapiens
ccagcccacctgctcccag

SEQ ID NO: 5390399 - DNA, 14 bp, Homo sapiens
ccagcccactgggc

SEQ ID NO: 5390400 - DNA, 15 bp, Homo sapiens
ccagcccactgggcc

SEQ ID NO: 5390401 - DNA, 19 bp, Homo sapiens
ccagcccactgggccctgg

SEQ ID NO: 5390402 - DNA, 22 bp, Homo sapiens
ccagcccagagacatacttgaa

SEQ ID NO: 5390403 - DNA, 23 bp, Homo sapiens
ccagcccagagacatacttgaag

SEQ ID NO: 5390404 - DNA, 17 bp, Homo sapiens
ccagcccagagccacct

SEQ ID NO: 5390405 - DNA, 15 bp, Homo sapiens
ccagcccagagcccg

SEQ ID NO: 5390406 - DNA, 16 bp, Homo sapiens
ccagcccagaggccga

SEQ ID NO: 5390407 - DNA, 14 bp, Homo sapiens
ccagcccagatgtt

SEQ ID NO: 5390408 - DNA, 10 bp, Homo sapiens
ccagcccagc

SEQ ID NO: 5390409 - DNA, 15 bp, Homo sapiens
ccagcccagccaggc

SEQ ID NO: 5390410 - DNA, 12 bp, Homo sapiens
ccagcccagccc

SEQ ID NO: 5390411 - DNA, 18 bp, Homo sapiens
ccagcccagcccagctgg

SEQ ID NO: 5390412 - DNA, 15 bp, Homo sapiens
ccagcccagcctgca

SEQ ID NO: 5390413 - DNA, 15 bp, Homo sapiens
ccagcccagcctgcc

SEQ ID NO: 5390414 - DNA, 14 bp, Homo sapiens
ccagcccagctgct

SEQ ID NO: 5390415 - DNA, 17 bp, Homo sapiens
ccagcccagctgctctg

SEQ ID NO: 5390416 - DNA, 18 bp, Homo sapiens
ccagcccagctgctctgc

SEQ ID NO: 5390417 - DNA, 22 bp, Homo sapiens
ccagcccagctgctctgcccag

SEQ ID NO: 5390418 - DNA, 12 bp, Homo sapiens
ccagcccaggaa

SEQ ID NO: 5390419 - DNA, 12 bp, Homo sapiens
ccagcccaggat

SEQ ID NO: 5390420 - DNA, 11 bp, Homo sapiens
ccagcccaggc

SEQ ID NO: 5390421 - DNA, 17 bp, Homo sapiens
ccagcccaggcaatagt

SEQ ID NO: 5390422 - DNA, 14 bp, Homo sapiens
ccagcccaggcctg

SEQ ID NO: 5390423 - DNA, 17 bp, Homo sapiens
ccagcccaggcctggtg

SEQ ID NO: 5390424 - DNA, 19 bp, Homo sapiens
ccagcccagggctcctgca

SEQ ID NO: 5390425 - DNA, 21 bp, Homo sapiens
ccagcccagggctcctgcact

SEQ ID NO: 5390426 - DNA, 12 bp, Homo sapiens
ccagcccagggt

SEQ ID NO: 5390427 - DNA, 14 bp, Homo sapiens
ccagcccagggtgg

SEQ ID NO: 5390428 - DNA, 18 bp, Homo sapiens
ccagcccagggttccccc

SEQ ID NO: 5390429 - DNA, 19 bp, Homo sapiens
ccagcccatcttgcctcca

SEQ ID NO: 5390430 - DNA, 17 bp, Homo sapiens
ccagcccatgctggctg

SEQ ID NO: 5390431 - DNA, 20 bp, Homo sapiens
ccagcccatgctggctgggg

SEQ ID NO: 5390432 - DNA, 18 bp, Homo sapiens
ccagcccatggcccccaa

SEQ ID NO: 5390433 - DNA, 22 bp, Homo sapiens
ccagcccattctctctcctgtc

SEQ ID NO: 5390434 - DNA, 17 bp, Homo sapiens
ccagcccatttgggcag

SEQ ID NO: 5390435 - DNA, 22 bp, Homo sapiens
ccagcccatttgggcagagagg

SEQ ID NO: 5390436 - DNA, 19 bp, Homo sapiens
ccagccccaaaactctcct

SEQ ID NO: 5390437 - DNA, 23 bp, Homo sapiens
ccagccccaaaactctcctctgc

SEQ ID NO: 5390438 - DNA, 16 bp, Homo sapiens
ccagccccaagctggg

SEQ ID NO: 5390439 - DNA, 17 bp, Homo sapiens
ccagccccaatccagag

SEQ ID NO: 5390440 - DNA, 15 bp, Homo sapiens
ccagccccacacagc

SEQ ID NO: 5390441 - DNA, 15 bp, Homo sapiens
ccagccccacaccct

SEQ ID NO: 5390442 - DNA, 14 bp, Homo sapiens
ccagccccacagcc

SEQ ID NO: 5390443 - DNA, 22 bp, Homo sapiens
ccagccccacagcccacgtcct

SEQ ID NO: 5390444 - DNA, 15 bp, Homo sapiens
ccagccccacccagg

SEQ ID NO: 5390445 - DNA, 19 bp, Homo sapiens
ccagccccacccccagcca

SEQ ID NO: 5390446 - DNA, 19 bp, Homo sapiens
ccagccccactcctctgct

SEQ ID NO: 5390447 - DNA, 14 bp, Homo sapiens
ccagccccactgcc

SEQ ID NO: 5390448 - DNA, 21 bp, Homo sapiens
ccagccccactgccagcagca

SEQ ID NO: 5390449 - DNA, 15 bp, Homo sapiens
ccagccccagcaaga

SEQ ID NO: 5390450 - DNA, 16 bp, Homo sapiens
ccagccccagccaggg

SEQ ID NO: 5390451 - DNA, 17 bp, Homo sapiens
ccagccccagcgagtct

SEQ ID NO: 5390452 - DNA, 18 bp, Homo sapiens
ccagccccaggcctggcc

SEQ ID NO: 5390453 - DNA, 19 bp, Homo sapiens
ccagccccaggcctggcct

SEQ ID NO: 5390454 - DNA, 21 bp, Homo sapiens
ccagccccaggcctggcctcg

SEQ ID NO: 5390455 - DNA, 15 bp, Homo sapiens
ccagccccaggtctc

SEQ ID NO: 5390456 - DNA, 13 bp, Homo sapiens
ccagccccagtgc

SEQ ID NO: 5390457 - DNA, 15 bp, Homo sapiens
ccagccccagtgccc

SEQ ID NO: 5390458 - DNA, 18 bp, Homo sapiens
ccagccccatagaaaaca

SEQ ID NO: 5390459 - DNA, 23 bp, Homo sapiens
ccagccccatcagaacctgagct

SEQ ID NO: 5390460 - DNA, 15 bp, Homo sapiens
ccagccccatccctg

SEQ ID NO: 5390461 - DNA, 19 bp, Homo sapiens
ccagccccatcttggtcct

SEQ ID NO: 5390462 - DNA, 18 bp, Homo sapiens
ccagcccccacagtgctg

SEQ ID NO: 5390463 - DNA, 21 bp, Homo sapiens
ccagcccccacagtgctgtct

SEQ ID NO: 5390464 - DNA, 17 bp, Homo sapiens
ccagcccccacccatgc

SEQ ID NO: 5390465 - DNA, 21 bp, Homo sapiens
ccagcccccaggaagacatta

SEQ ID NO: 5390466 - DNA, 15 bp, Homo sapiens
ccagcccccagggcc

SEQ ID NO: 5390467 - DNA, 15 bp, Homo sapiens
ccagccccccaggct

SEQ ID NO: 5390468 - DNA, 18 bp, Homo sapiens
ccagccccccaggctgcc

SEQ ID NO: 5390469 - DNA, 17 bp, Homo sapiens
ccagcccccgccccaga

SEQ ID NO: 5390470 - DNA, 11 bp, Homo sapiens
ccagccccctc

SEQ ID NO: 5390471 - DNA, 19 bp, Homo sapiens
ccagccccctcccaccgct

SEQ ID NO: 5390472 - DNA, 14 bp, Homo sapiens
ccagccccctggat

SEQ ID NO: 5390473 - DNA, 17 bp, Homo sapiens
ccagccccctggcccct

SEQ ID NO: 5390474 - DNA, 15 bp, Homo sapiens
ccagccccctttggg

SEQ ID NO: 5390475 - DNA, 21 bp, Homo sapiens
ccagccccctttgggcccagg

SEQ ID NO: 5390476 - DNA, 22 bp, Homo sapiens
ccagccccctttgggcccaggg

SEQ ID NO: 5390477 - DNA, 20 bp, Homo sapiens
ccagccccgactccagccag

SEQ ID NO: 5390478 - DNA, 17 bp, Homo sapiens
ccagccccgctcaggcc

SEQ ID NO: 5390479 - DNA, 24 bp, Homo sapiens
ccagccccgctcccacctagtgcc

SEQ ID NO: 5390480 - DNA, 17 bp, Homo sapiens
ccagccccggccctggg

SEQ ID NO: 5390481 - DNA, 18 bp, Homo sapiens
ccagccccggtggctggg

SEQ ID NO: 5390482 - DNA, 22 bp, Homo sapiens
ccagcccctaccttgagaccct

SEQ ID NO: 5390483 - DNA, 15 bp, Homo sapiens
ccagcccctactgct

SEQ ID NO: 5390484 - DNA, 22 bp, Homo sapiens
ccagcccctagaaacccaagct

SEQ ID NO: 5390485 - DNA, 13 bp, Homo sapiens
ccagcccctagcc

SEQ ID NO: 5390486 - DNA, 15 bp, Homo sapiens
ccagcccctagccca

SEQ ID NO: 5390487 - DNA, 17 bp, Homo sapiens
ccagcccctagcccagg

SEQ ID NO: 5390488 - DNA, 22 bp, Homo sapiens
ccagcccctagcccaggagaga

SEQ ID NO: 5390489 - DNA, 23 bp, Homo sapiens
ccagcccctagcccaggagagag

SEQ ID NO: 5390490 - DNA, 20 bp, Homo sapiens
ccagcccctccccagactct

SEQ ID NO: 5390491 - DNA, 16 bp, Homo sapiens
ccagcccctcccccat

SEQ ID NO: 5390492 - DNA, 24 bp, Homo sapiens
ccagcccctccccgcctcctccct

SEQ ID NO: 5390493 - DNA, 13 bp, Homo sapiens
ccagcccctcctc

SEQ ID NO: 5390494 - DNA, 16 bp, Homo sapiens
ccagcccctcctcccc

SEQ ID NO: 5390495 - DNA, 22 bp, Homo sapiens
ccagcccctcctccccttcctg

SEQ ID NO: 5390496 - DNA, 18 bp, Homo sapiens
ccagcccctcctccctca

SEQ ID NO: 5390497 - DNA, 19 bp, Homo sapiens
ccagcccctcctccctcag

SEQ ID NO: 5390498 - DNA, 21 bp, Homo sapiens
ccagcccctcctccctcagac

SEQ ID NO: 5390499 - DNA, 22 bp, Homo sapiens
ccagcccctcctccctcagacc

SEQ ID NO: 5390500 - DNA, 17 bp, Homo sapiens
ccagcccctcctccctg

SEQ ID NO: 5390501 - DNA, 13 bp, Homo sapiens
ccagcccctcttg

SEQ ID NO: 5390502 - DNA, 10 bp, Homo sapiens
ccagcccctg

SEQ ID NO: 5390503 - DNA, 13 bp, Homo sapiens
ccagcccctgcag

SEQ ID NO: 5390504 - DNA, 15 bp, Homo sapiens
ccagcccctgcagat

SEQ ID NO: 5390505 - DNA, 20 bp, Homo sapiens
ccagcccctgccccagccca

SEQ ID NO: 5390506 - DNA, 13 bp, Homo sapiens
ccagcccctgcct

SEQ ID NO: 5390507 - DNA, 17 bp, Homo sapiens
ccagcccctgcctgggt

SEQ ID NO: 5390508 - DNA, 13 bp, Homo sapiens
ccagcccctggat

SEQ ID NO: 5390509 - DNA, 15 bp, Homo sapiens
ccagcccctggatgc

SEQ ID NO: 5390510 - DNA, 21 bp, Homo sapiens
ccagcccctggatgcagcctc

SEQ ID NO: 5390511 - DNA, 15 bp, Homo sapiens
ccagcccctggggcc

SEQ ID NO: 5390512 - DNA, 17 bp, Homo sapiens
ccagcccctgtcccacc

SEQ ID NO: 5390513 - DNA, 22 bp, Homo sapiens
ccagcccctgtttactggttct

SEQ ID NO: 5390514 - DNA, 18 bp, Homo sapiens
ccagccccttcccctggg

SEQ ID NO: 5390515 - DNA, 16 bp, Homo sapiens
ccagccccttctccca

SEQ ID NO: 5390516 - DNA, 18 bp, Homo sapiens
ccagccccttctgaccca

SEQ ID NO: 5390517 - DNA, 18 bp, Homo sapiens
ccagccccttttctctgc

SEQ ID NO: 5390518 - DNA, 21 bp, Homo sapiens
ccagccccttttctctgctct

SEQ ID NO: 5390519 - DNA, 17 bp, Homo sapiens
ccagcccgacagtgcca

SEQ ID NO: 5390520 - DNA, 21 bp, Homo sapiens
ccagcccgacagtgccatccc

SEQ ID NO: 5390521 - DNA, 22 bp, Homo sapiens
ccagcccgcagaggtggggtgc

SEQ ID NO: 5390522 - DNA, 20 bp, Homo sapiens
ccagcccgcccaaggggact

SEQ ID NO: 5390523 - DNA, 17 bp, Homo sapiens
ccagcccgcggcctgga

SEQ ID NO: 5390524 - DNA, 15 bp, Homo sapiens
ccagcccggcctgct

SEQ ID NO: 5390525 - DNA, 19 bp, Homo sapiens
ccagcccggcctgctccca

SEQ ID NO: 5390526 - DNA, 17 bp, Homo sapiens
ccagcccggctggtttt

SEQ ID NO: 5390527 - DNA, 14 bp, Homo sapiens
ccagcccgggagcc

SEQ ID NO: 5390528 - DNA, 22 bp, Homo sapiens
ccagcccgggagcctaggacca

SEQ ID NO: 5390529 - DNA, 17 bp, Homo sapiens
ccagcccggggccagct

SEQ ID NO: 5390530 - DNA, 21 bp, Homo sapiens
ccagcccggggccagcttggc

SEQ ID NO: 5390531 - DNA, 22 bp, Homo sapiens
ccagcccggggccagcttggca

SEQ ID NO: 5390532 - DNA, 9 bp, Homo sapiens
ccagcccta

SEQ ID NO: 5390533 - DNA, 18 bp, Homo sapiens
ccagccctacatcttcag

SEQ ID NO: 5390534 - DNA, 19 bp, Homo sapiens
ccagccctacatcttcagc

SEQ ID NO: 5390535 - DNA, 16 bp, Homo sapiens
ccagccctactcctgc

SEQ ID NO: 5390536 - DNA, 17 bp, Homo sapiens
ccagccctactctgtgt

SEQ ID NO: 5390537 - DNA, 17 bp, Homo sapiens
ccagccctaggctaccc

SEQ ID NO: 5390538 - DNA, 18 bp, Homo sapiens
ccagccctaggctaccct

SEQ ID NO: 5390539 - DNA, 17 bp, Homo sapiens
ccagccctcaggccagt

SEQ ID NO: 5390540 - DNA, 23 bp, Homo sapiens
ccagccctcaggccagtgccagg

SEQ ID NO: 5390541 - DNA, 14 bp, Homo sapiens
ccagccctcatccc

SEQ ID NO: 5390542 - DNA, 12 bp, Homo sapiens
ccagccctccag

SEQ ID NO: 5390543 - DNA, 18 bp, Homo sapiens
ccagccctccagagcagg

SEQ ID NO: 5390544 - DNA, 21 bp, Homo sapiens
ccagccctccccacctgctca

SEQ ID NO: 5390545 - DNA, 20 bp, Homo sapiens
ccagccctccccatggagcc

SEQ ID NO: 5390546 - DNA, 13 bp, Homo sapiens
ccagccctccctg

SEQ ID NO: 5390547 - DNA, 16 bp, Homo sapiens
ccagccctccctggct

SEQ ID NO: 5390548 - DNA, 14 bp, Homo sapiens
ccagccctccctgt

SEQ ID NO: 5390549 - DNA, 20 bp, Homo sapiens
ccagccctccctgtcctcct

SEQ ID NO: 5390550 - DNA, 21 bp, Homo sapiens
ccagccctccctgtcctcctc

SEQ ID NO: 5390551 - DNA, 12 bp, Homo sapiens
ccagccctcctt

SEQ ID NO: 5390552 - DNA, 15 bp, Homo sapiens
ccagccctccttcag

SEQ ID NO: 5390553 - DNA, 20 bp, Homo sapiens
ccagccctctcactgtgtcc

SEQ ID NO: 5390554 - DNA, 21 bp, Homo sapiens
ccagccctctgtggccaggag

SEQ ID NO: 5390555 - DNA, 22 bp, Homo sapiens
ccagccctctgtggccaggagc

SEQ ID NO: 5390556 - DNA, 14 bp, Homo sapiens
ccagccctcttctg

SEQ ID NO: 5390557 - DNA, 12 bp, Homo sapiens
ccagccctgagc

SEQ ID NO: 5390558 - DNA, 13 bp, Homo sapiens
ccagccctgagcc

SEQ ID NO: 5390559 - DNA, 12 bp, Homo sapiens
ccagccctgagg

SEQ ID NO: 5390560 - DNA, 14 bp, Homo sapiens
ccagccctgagggg

SEQ ID NO: 5390561 - DNA, 18 bp, Homo sapiens
ccagccctgagttcctag

SEQ ID NO: 5390562 - DNA, 11 bp, Homo sapiens
ccagccctgca

SEQ ID NO: 5390563 - DNA, 13 bp, Homo sapiens
ccagccctgccag

SEQ ID NO: 5390564 - DNA, 16 bp, Homo sapiens
ccagccctgccaggag

SEQ ID NO: 5390565 - DNA, 22 bp, Homo sapiens
ccagctctgtcaccctggccac

SEQ ID NO: 5390566 - DNA, 16 bp, Homo sapiens
ccagctctgtggcctg

SEQ ID NO: 5390567 - DNA, 17 bp, Homo sapiens
ccagctctgtggcctgt

SEQ ID NO: 5390568 - DNA, 18 bp, Homo sapiens
ccagctctgtggcctgtg

SEQ ID NO: 5390569 - DNA, 19 bp, Homo sapiens
ccagctctgtggcctgtgt

SEQ ID NO: 5390570 - DNA, 20 bp, Homo sapiens
ccagctctgtggcctgtgtc

SEQ ID NO: 5390571 - DNA, 15 bp, Homo sapiens
ccagctctgtgggcc

SEQ ID NO: 5390572 - DNA, 17 bp, Homo sapiens
ccagctctgtgggccct

SEQ ID NO: 5390573 - DNA, 21 bp, Homo sapiens
ccagctctgtgggccctaccc

SEQ ID NO: 5390574 - DNA, 20 bp, Homo sapiens
ccagctctgttcttcctcag

SEQ ID NO: 5390575 - DNA, 22 bp, Homo sapiens
ccagctctgttcttcctcagcc

SEQ ID NO: 5390576 - DNA, 19 bp, Homo sapiens
ccagctcttctccccaggt

SEQ ID NO: 5390577 - DNA, 22 bp, Homo sapiens
ccagctcttctcttcctagatc

SEQ ID NO: 5390578 - DNA, 15 bp, Homo sapiens
ccagctcttgctctc

SEQ ID NO: 5390579 - DNA, 16 bp, Homo sapiens
ccagctcttggcccct

SEQ ID NO: 5390580 - DNA, 14 bp, Homo sapiens
ccagctctttcctc

SEQ ID NO: 5390581 - DNA, 20 bp, Homo sapiens
ccagctctttgttcagttga

SEQ ID NO: 5390582 - DNA, 15 bp, Homo sapiens
ccagctgacagtcct

SEQ ID NO: 5390583 - DNA, 17 bp, Homo sapiens
ccagctgacatcttgaa

SEQ ID NO: 5390584 - DNA, 13 bp, Homo sapiens
ccagctgactgtg

SEQ ID NO: 5390585 - DNA, 15 bp, Homo sapiens
ccagctgactgtggc

SEQ ID NO: 5390586 - DNA, 20 bp, Homo sapiens
ccagctgagcgccaggatgg

SEQ ID NO: 5390587 - DNA, 18 bp, Homo sapiens
ccagctgaggcaggggga

SEQ ID NO: 5390588 - DNA, 16 bp, Homo sapiens
ccagctgagtcctggg

SEQ ID NO: 5390589 - DNA, 18 bp, Homo sapiens
ccagctgagtcctggggt

SEQ ID NO: 5390590 - DNA, 13 bp, Homo sapiens
ccagctgagtgag

SEQ ID NO: 5390591 - DNA, 19 bp, Homo sapiens
ccagctgatcatgtcagcc

SEQ ID NO: 5390592 - DNA, 15 bp, Homo sapiens
ccagctgatgactca

SEQ ID NO: 5390593 - DNA, 17 bp, Homo sapiens
ccagctgatgactcaag

SEQ ID NO: 5390594 - DNA, 15 bp, Homo sapiens
ccagctgcaaagtgt

SEQ ID NO: 5390595 - DNA, 14 bp, Homo sapiens
ccagctgcacccct

SEQ ID NO: 5390596 - DNA, 19 bp, Homo sapiens
ccagctgcaccccttcctg

SEQ ID NO: 5390597 - DNA, 22 bp, Homo sapiens
ccagctgcaccccttcctgggc

SEQ ID NO: 5390598 - DNA, 23 bp, Homo sapiens
ccagctgcaccccttcctgggca

SEQ ID NO: 5390599 - DNA, 19 bp, Homo sapiens
ccagctgcacctgccagcc

SEQ ID NO: 5390600 - DNA, 20 bp, Homo sapiens
ccagctgcacctgccagcct

SEQ ID NO: 5390601 - DNA, 19 bp, Homo sapiens
ccagctgcactgatgctgc

SEQ ID NO: 5390602 - DNA, 12 bp, Homo sapiens
ccagctgcagaa

SEQ ID NO: 5390603 - DNA, 12 bp, Homo sapiens
ccagctgcagat

SEQ ID NO: 5390604 - DNA, 18 bp, Homo sapiens
ccagctgcagccccttgc

SEQ ID NO: 5390605 - DNA, 14 bp, Homo sapiens
ccagctgcagcctg

SEQ ID NO: 5390606 - DNA, 19 bp, Homo sapiens
ccagctgcaggaatcaaaa

SEQ ID NO: 5390607 - DNA, 23 bp, Homo sapiens
ccagctgcaggaatcaaaaattg

SEQ ID NO: 5390608 - DNA, 14 bp, Homo sapiens
ccagctgcagggca

SEQ ID NO: 5390609 - DNA, 16 bp, Homo sapiens
ccagctgcagggcacg

SEQ ID NO: 5390610 - DNA, 18 bp, Homo sapiens
ccagctgcagggcacggg

SEQ ID NO: 5390611 - DNA, 23 bp, Homo sapiens
ccagctgcagggcacggggacct

SEQ ID NO: 5390612 - DNA, 12 bp, Homo sapiens
ccagctgccagg

SEQ ID NO: 5390613 - DNA, 13 bp, Homo sapiens
ccagctgccaggc

SEQ ID NO: 5390614 - DNA, 14 bp, Homo sapiens
ccagctgccaggcg

SEQ ID NO: 5390615 - DNA, 16 bp, Homo sapiens
ccagctgccaggcggc

SEQ ID NO: 5390616 - DNA, 17 bp, Homo sapiens
ccagctgccaggcggcc

SEQ ID NO: 5390617 - DNA, 16 bp, Homo sapiens
ccagctgccagggaag

SEQ ID NO: 5390618 - DNA, 22 bp, Homo sapiens
ccagctgccagggaagacagag

SEQ ID NO: 5390619 - DNA, 17 bp, Homo sapiens
ccagctgcccccagagc

SEQ ID NO: 5390620 - DNA, 23 bp, Homo sapiens
ccagctgccccgggatgcgaggc

SEQ ID NO: 5390621 - DNA, 23 bp, Homo sapiens
ccagctgcccctccctcagggag

SEQ ID NO: 5390622 - DNA, 17 bp, Homo sapiens
ccagctgcccttccgca

SEQ ID NO: 5390623 - DNA, 20 bp, Homo sapiens
ccagctgcccttccgcagtg

SEQ ID NO: 5390624 - DNA, 21 bp, Homo sapiens
ccagctgcccttccgcagtgt

SEQ ID NO: 5390625 - DNA, 21 bp, Homo sapiens
ccagctgcccttgcagggtgg

SEQ ID NO: 5390626 - DNA, 19 bp, Homo sapiens
ccagctgccgaccagagcc

SEQ ID NO: 5390627 - DNA, 17 bp, Homo sapiens
ccagctgccgcaccagc

SEQ ID NO: 5390628 - DNA, 12 bp, Homo sapiens
ccagctgccgcc

SEQ ID NO: 5390629 - DNA, 21 bp, Homo sapiens
ccagctgccggcagtgctggt

SEQ ID NO: 5390630 - DNA, 16 bp, Homo sapiens
ccagctgcctgggccc

SEQ ID NO: 5390631 - DNA, 19 bp, Homo sapiens
ccagctgcctgggcccgga

SEQ ID NO: 5390632 - DNA, 18 bp, Homo sapiens
ccagctgcctgtgcctgc

SEQ ID NO: 5390633 - DNA, 11 bp, Homo sapiens
ccagctgcctt

SEQ ID NO: 5390634 - DNA, 14 bp, Homo sapiens
ccagctgccttcct

SEQ ID NO: 5390635 - DNA, 19 bp, Homo sapiens
ccagctgcgcttgcttttc

SEQ ID NO: 5390636 - DNA, 20 bp, Homo sapiens
ccagctgcgcttgcttttct

SEQ ID NO: 5390637 - DNA, 21 bp, Homo sapiens
ccagctgcgcttgcttttctg

SEQ ID NO: 5390638 - DNA, 22 bp, Homo sapiens
ccagctgcggcatccctgtgtt

SEQ ID NO: 5390639 - DNA, 15 bp, Homo sapiens
ccagctgcggccagg

SEQ ID NO: 5390640 - DNA, 14 bp, Homo sapiens
ccagctgctcccca

SEQ ID NO: 5390641 - DNA, 19 bp, Homo sapiens
ccagctgctcccctccctc

SEQ ID NO: 5390642 - DNA, 18 bp, Homo sapiens
ccagctgctcccctggag

SEQ ID NO: 5390643 - DNA, 22 bp, Homo sapiens
ccagctgctctaagcccaggat

SEQ ID NO: 5390644 - DNA, 23 bp, Homo sapiens
ccagctgctctaagcccaggatc

SEQ ID NO: 5390645 - DNA, 12 bp, Homo sapiens
ccagctgctctg

SEQ ID NO: 5390646 - DNA, 13 bp, Homo sapiens
ccagctgctctgc

SEQ ID NO: 5390647 - DNA, 17 bp, Homo sapiens
ccagctgctctgcccag

SEQ ID NO: 5390648 - DNA, 18 bp, Homo sapiens
ccagctgctctgcccaga

SEQ ID NO: 5390649 - DNA, 20 bp, Homo sapiens
ccagctgctctgcccagagc

SEQ ID NO: 5390650 - DNA, 21 bp, Homo sapiens
ccagctgctctgcccagagct

SEQ ID NO: 5390651 - DNA, 22 bp, Homo sapiens
ccagctgctctgcccagagctg

SEQ ID NO: 5390652 - DNA, 16 bp, Homo sapiens
ccagctgctctgcccc

SEQ ID NO: 5390653 - DNA, 20 bp, Homo sapiens
ccagctgctgagatcctgga

SEQ ID NO: 5390654 - DNA, 15 bp, Homo sapiens
ccagctgctgtcagg

SEQ ID NO: 5390655 - DNA, 15 bp, Homo sapiens
ccagctgctgtgccc

SEQ ID NO: 5390656 - DNA, 17 bp, Homo sapiens
ccagctgctgtgcccca

SEQ ID NO: 5390657 - DNA, 18 bp, Homo sapiens
ccagctgctgtgccccac

SEQ ID NO: 5390658 - DNA, 19 bp, Homo sapiens
ccagctgcttcagggaggt

SEQ ID NO: 5390659 - DNA, 12 bp, Homo sapiens
ccagctgcttct

SEQ ID NO: 5390660 - DNA, 15 bp, Homo sapiens
ccagctgcttgacct

SEQ ID NO: 5390661 - DNA, 15 bp, Homo sapiens
ccagctgcttgggct

SEQ ID NO: 5390662 - DNA, 12 bp, Homo sapiens
ccagctgctttt

SEQ ID NO: 5390663 - DNA, 19 bp, Homo sapiens
ccagctggagtgagggcct

SEQ ID NO: 5390664 - DNA, 13 bp, Homo sapiens
ccagctggcagca

SEQ ID NO: 5390665 - DNA, 15 bp, Homo sapiens
ccagctggcagcaga

SEQ ID NO: 5390666 - DNA, 16 bp, Homo sapiens
ccagctggcagcagag

SEQ ID NO: 5390667 - DNA, 16 bp, Homo sapiens
ccagctggcagcgcct

SEQ ID NO: 5390668 - DNA, 17 bp, Homo sapiens
ccagctggcagcgcctc

SEQ ID NO: 5390669 - DNA, 19 bp, Homo sapiens
ccagctggccacctagaag

SEQ ID NO: 5390670 - DNA, 12 bp, Homo sapiens
ccagctggccgg

SEQ ID NO: 5390671 - DNA, 20 bp, Homo sapiens
ccagctggccgggagcctga

SEQ ID NO: 5390672 - DNA, 13 bp, Homo sapiens
ccagctggcctct

SEQ ID NO: 5390673 - DNA, 17 bp, Homo sapiens
ccagctggcctctagaa

SEQ ID NO: 5390674 - DNA, 13 bp, Homo sapiens
ccagctggcctgg

SEQ ID NO: 5390675 - DNA, 12 bp, Homo sapiens
ccagctggcctt

SEQ ID NO: 5390676 - DNA, 13 bp, Homo sapiens
ccagctggccttt

SEQ ID NO: 5390677 - DNA, 14 bp, Homo sapiens
ccagctggctgggt

SEQ ID NO: 5390678 - DNA, 22 bp, Homo sapiens
ccagctggctgggtcgcccctc

SEQ ID NO: 5390679 - DNA, 14 bp, Homo sapiens
ccagctgggaccta

SEQ ID NO: 5390680 - DNA, 17 bp, Homo sapiens
ccagctgggagcactgg

SEQ ID NO: 5390681 - DNA, 12 bp, Homo sapiens
ccagctgggagg

SEQ ID NO: 5390682 - DNA, 19 bp, Homo sapiens
ccagctgggaggcaagagg

SEQ ID NO: 5390683 - DNA, 15 bp, Homo sapiens
ccagctgggcccagc

SEQ ID NO: 5390684 - DNA, 16 bp, Homo sapiens
ccagctgggcccagca

SEQ ID NO: 5390685 - DNA, 23 bp, Homo sapiens
ccagctgggctagaggctgagca

SEQ ID NO: 5390686 - DNA, 15 bp, Homo sapiens
ccagctgggctctgc

SEQ ID NO: 5390687 - DNA, 17 bp, Homo sapiens
ccagctgggctctgcca

SEQ ID NO: 5390688 - DNA, 15 bp, Homo sapiens
ccagctggggagatg

SEQ ID NO: 5390689 - DNA, 15 bp, Homo sapiens
ccagctggggccaga

SEQ ID NO: 5390690 - DNA, 16 bp, Homo sapiens
ccagctggggccagag

SEQ ID NO: 5390691 - DNA, 19 bp, Homo sapiens
ccagctggggccagaggct

SEQ ID NO: 5390692 - DNA, 17 bp, Homo sapiens
ccagctggggccaggct

SEQ ID NO: 5390693 - DNA, 20 bp, Homo sapiens
ccagctggggcccctcggct

SEQ ID NO: 5390694 - DNA, 16 bp, Homo sapiens
ccagctggggcgtggg

SEQ ID NO: 5390695 - DNA, 19 bp, Homo sapiens
ccagctggggcgtggggag

SEQ ID NO: 5390696 - DNA, 20 bp, Homo sapiens
ccagctggggcgtggggagg

SEQ ID NO: 5390697 - DNA, 17 bp, Homo sapiens
ccagctggggggcaggg

SEQ ID NO: 5390698 - DNA, 12 bp, Homo sapiens
ccagctgggtct

SEQ ID NO: 5390699 - DNA, 15 bp, Homo sapiens
ccagctgggtgcccc

SEQ ID NO: 5390700 - DNA, 16 bp, Homo sapiens
ccagctgggtgcccca

SEQ ID NO: 5390701 - DNA, 16 bp, Homo sapiens
ccagctgggttggaaa

SEQ ID NO: 5390702 - DNA, 18 bp, Homo sapiens
ccagctggtcctgtggat

SEQ ID NO: 5390703 - DNA, 22 bp, Homo sapiens
ccagctggtcctgtggatggga

SEQ ID NO: 5390704 - DNA, 21 bp, Homo sapiens
ccagctggtcttttgggagtg

SEQ ID NO: 5390705 - DNA, 17 bp, Homo sapiens
ccagctggtgctgcaag

SEQ ID NO: 5390706 - DNA, 20 bp, Homo sapiens
ccagctggtgctgcaaggaa

SEQ ID NO: 5390707 - DNA, 22 bp, Homo sapiens
ccagctggtgtcactctgcctc

SEQ ID NO: 5390708 - DNA, 23 bp, Homo sapiens
ccagctggtgtcactctgcctct

SEQ ID NO: 5390709 - DNA, 21 bp, Homo sapiens
ccagctggttgtaccctctcc

SEQ ID NO: 5390710 - DNA, 20 bp, Homo sapiens
ccagctgtaccggccactgc

SEQ ID NO: 5390711 - DNA, 21 bp, Homo sapiens
ccagctgtaccggccactgca

SEQ ID NO: 5390712 - DNA, 16 bp, Homo sapiens
ccagctgtactgagtt

SEQ ID NO: 5390713 - DNA, 17 bp, Homo sapiens
ccagctgtagccatggc

SEQ ID NO: 5390714 - DNA, 16 bp, Homo sapiens
ccagctgtatgaggag

SEQ ID NO: 5390715 - DNA, 14 bp, Homo sapiens
ccagctgtcagcct

SEQ ID NO: 5390716 - DNA, 15 bp, Homo sapiens
ccagctgtcccccca

SEQ ID NO: 5390717 - DNA, 19 bp, Homo sapiens
ccagctgtccccccactcc

SEQ ID NO: 5390718 - DNA, 17 bp, Homo sapiens
ccagctgtctcccacgt

SEQ ID NO: 5390719 - DNA, 22 bp, Homo sapiens
ccagctgtctgtgtcagcctgt

SEQ ID NO: 5390720 - DNA, 15 bp, Homo sapiens
ccagctgtgactgag

SEQ ID NO: 5390721 - DNA, 19 bp, Homo sapiens
ccagctgtgactgagggcc

SEQ ID NO: 5390722 - DNA, 17 bp, Homo sapiens
ccagctgtgagccttgg

SEQ ID NO: 5390723 - DNA, 18 bp, Homo sapiens
ccagctgtgagccttggc

SEQ ID NO: 5390724 - DNA, 20 bp, Homo sapiens
ccagctgtgagccttggctg

SEQ ID NO: 5390725 - DNA, 18 bp, Homo sapiens
ccagctgtgctctggaca

SEQ ID NO: 5390726 - DNA, 23 bp, Homo sapiens
ccagctgtgctctggacaggcat

SEQ ID NO: 5390727 - DNA, 14 bp, Homo sapiens
ccagctgtgctggg

SEQ ID NO: 5390728 - DNA, 14 bp, Homo sapiens
ccagctgtgctgtg

SEQ ID NO: 5390729 - DNA, 14 bp, Homo sapiens
ccagctgtgcttat

SEQ ID NO: 5390730 - DNA, 21 bp, Homo sapiens
ccagctgtgcttatggtacca

SEQ ID NO: 5390731 - DNA, 14 bp, Homo sapiens
ccagctgtgggcgg

SEQ ID NO: 5390732 - DNA, 21 bp, Homo sapiens
ccagctgtgggcggctcctgg

SEQ ID NO: 5390733 - DNA, 23 bp, Homo sapiens
ccagctgtggttttcttttgcca

SEQ ID NO: 5390734 - DNA, 13 bp, Homo sapiens
ccagctgtgtcct

SEQ ID NO: 5390735 - DNA, 18 bp, Homo sapiens
ccagctgtgtccttcggg

SEQ ID NO: 5390736 - DNA, 16 bp, Homo sapiens
ccagctgttacctgag

SEQ ID NO: 5390737 - DNA, 21 bp, Homo sapiens
ccagcttaaacccatacaatg

SEQ ID NO: 5390738 - DNA, 21 bp, Homo sapiens
ccagcttaaagtaaccggatg

SEQ ID NO: 5390739 - DNA, 20 bp, Homo sapiens
ccagcttaagcgttcatatg

SEQ ID NO: 5390740 - DNA, 23 bp, Homo sapiens
ccagcttagagttcttctttctt

SEQ ID NO: 5390741 - DNA, 23 bp, Homo sapiens
ccagcttattgtgtgcgctgcct

SEQ ID NO: 5390742 - DNA, 19 bp, Homo sapiens
ccaggagggtaacagaaga

SEQ ID NO: 5390743 - DNA, 22 bp, Homo sapiens
ccaggagggtaacagaagagga

SEQ ID NO: 5390744 - DNA, 23 bp, Homo sapiens
ccaggagggtctcgaactcctgg

SEQ ID NO: 5390745 - DNA, 16 bp, Homo sapiens
ccaggaggtagtttct

SEQ ID NO: 5390746 - DNA, 19 bp, Homo sapiens
ccaggaggtcctcctctct

SEQ ID NO: 5390747 - DNA, 19 bp, Homo sapiens
ccaggaggtgccactggag

SEQ ID NO: 5390748 - DNA, 15 bp, Homo sapiens
ccaggaggtgcttga

SEQ ID NO: 5390749 - DNA, 21 bp, Homo sapiens
ccaggaggtgcttgaggcccc

SEQ ID NO: 5390750 - DNA, 22 bp, Homo sapiens
ccaggaggtggctatggccacc

SEQ ID NO: 5390751 - DNA, 20 bp, Homo sapiens
ccaggagtaagcccaagcta

SEQ ID NO: 5390752 - DNA, 15 bp, Homo sapiens
ccaggagtccagacc

SEQ ID NO: 5390753 - DNA, 13 bp, Homo sapiens
ccaggagtccagc

SEQ ID NO: 5390754 - DNA, 15 bp, Homo sapiens
ccaggagtccagccc

SEQ ID NO: 5390755 - DNA, 22 bp, Homo sapiens
ccaggagtccaggcccccagcc

SEQ ID NO: 5390756 - DNA, 23 bp, Homo sapiens
ccaggagtcccactccaagccag

SEQ ID NO: 5390757 - DNA, 13 bp, Homo sapiens
ccaggagtctgag

SEQ ID NO: 5390758 - DNA, 15 bp, Homo sapiens
ccaggagtctgtgct

SEQ ID NO: 5390759 - DNA, 18 bp, Homo sapiens
ccaggagtgcccccggga

SEQ ID NO: 5390760 - DNA, 12 bp, Homo sapiens
ccaggagtgggg

SEQ ID NO: 5390761 - DNA, 16 bp, Homo sapiens
ccaggagttgacgcat

SEQ ID NO: 5390762 - DNA, 23 bp, Homo sapiens
ccaggagttgacgcatcctgcag

SEQ ID NO: 5390763 - DNA, 21 bp, Homo sapiens
ccaggagtttaagaccagcct

SEQ ID NO: 5390764 - DNA, 23 bp, Homo sapiens
ccaggagtttgagacaagccctg

SEQ ID NO: 5390765 - DNA, 18 bp, Homo sapiens
ccaggagtttgagaccag

SEQ ID NO: 5390766 - DNA, 20 bp, Homo sapiens
ccaggagtttgaggttacag

SEQ ID NO: 5390767 - DNA, 14 bp, Homo sapiens
ccaggagtttggcc

SEQ ID NO: 5390768 - DNA, 17 bp, Homo sapiens
ccaggatactggcacag

SEQ ID NO: 5390769 - DNA, 16 bp, Homo sapiens
ccaggatagagactgg

SEQ ID NO: 5390770 - DNA, 18 bp, Homo sapiens
ccaggatagagactggaa

SEQ ID NO: 5390771 - DNA, 16 bp, Homo sapiens
ccaggatatattttat

SEQ ID NO: 5390772 - DNA, 23 bp, Homo sapiens
ccaggatatattttatttttaga

SEQ ID NO: 5390773 - DNA, 17 bp, Homo sapiens
ccaggatatctgaaaat

SEQ ID NO: 5390774 - DNA, 19 bp, Homo sapiens
ccaggatatctgaaaatat

SEQ ID NO: 5390775 - DNA, 16 bp, Homo sapiens
ccaggatatttctgag

SEQ ID NO: 5390776 - DNA, 21 bp, Homo sapiens
ccaggatcactctctgctggc

SEQ ID NO: 5390777 - DNA, 18 bp, Homo sapiens
ccaggatcagattgcatg

SEQ ID NO: 5390778 - DNA, 21 bp, Homo sapiens
ccaggatcagattgcatgtga

SEQ ID NO: 5390779 - DNA, 15 bp, Homo sapiens
ccaggatcatggtgt

SEQ ID NO: 5390780 - DNA, 17 bp, Homo sapiens
ccaggatcatggtgtaa

SEQ ID NO: 5390781 - DNA, 17 bp, Homo sapiens
ccaggatccagaagggg

SEQ ID NO: 5390782 - DNA, 21 bp, Homo sapiens
ccaggatcccaagcctcctgc

SEQ ID NO: 5390783 - DNA, 15 bp, Homo sapiens
ccaggatcccagagc

SEQ ID NO: 5390784 - DNA, 16 bp, Homo sapiens
ccaggatcccagagct

SEQ ID NO: 5390785 - DNA, 21 bp, Homo sapiens
ccaggatccctcccagatcct

SEQ ID NO: 5390786 - DNA, 18 bp, Homo sapiens
ccaggatcctgcaggaac

SEQ ID NO: 5390787 - DNA, 14 bp, Homo sapiens
ccaggatctcctgc

SEQ ID NO: 5390788 - DNA, 23 bp, Homo sapiens
ccaggatctcctgccagcccagc

SEQ ID NO: 5390789 - DNA, 17 bp, Homo sapiens
ccaggatctttgactga

SEQ ID NO: 5390790 - DNA, 20 bp, Homo sapiens
ccaggatctttgactgaaaa

SEQ ID NO: 5390791 - DNA, 21 bp, Homo sapiens
ccaggatgaaggcgtgcaagg

SEQ ID NO: 5390792 - DNA, 18 bp, Homo sapiens
ccaggatgaaggggccag

SEQ ID NO: 5390793 - DNA, 22 bp, Homo sapiens
ccaggatgaaggggccagacca

SEQ ID NO: 5390794 - DNA, 17 bp, Homo sapiens
ccaggatgacacctcca

SEQ ID NO: 5390795 - DNA, 16 bp, Homo sapiens
ccaggatgcatgcagg

SEQ ID NO: 5390796 - DNA, 22 bp, Homo sapiens
ccaggatgccacgcctggaagg

SEQ ID NO: 5390797 - DNA, 19 bp, Homo sapiens
ccaggatgcctgagccccc

SEQ ID NO: 5390798 - DNA, 20 bp, Homo sapiens
ccaggatgcctgagccccct

SEQ ID NO: 5390799 - DNA, 22 bp, Homo sapiens
ccaggatgctcccccagggaag

SEQ ID NO: 5390800 - DNA, 18 bp, Homo sapiens
ccaggatgctgggtggcc

SEQ ID NO: 5390801 - DNA, 21 bp, Homo sapiens
ccaggatggaacacggccaca

SEQ ID NO: 5390802 - DNA, 14 bp, Homo sapiens
ccaggatggagcaa

SEQ ID NO: 5390803 - DNA, 16 bp, Homo sapiens
ccaggatggagcaagc

SEQ ID NO: 5390804 - DNA, 19 bp, Homo sapiens
ccaggatggagcaagctct

SEQ ID NO: 5390805 - DNA, 21 bp, Homo sapiens
ccaggatggagcaagctcttc

SEQ ID NO: 5390806 - DNA, 22 bp, Homo sapiens
ccaggatggagcaagctcttcc

SEQ ID NO: 5390807 - DNA, 23 bp, Homo sapiens
ccaggatggagcaagctcttccc

SEQ ID NO: 5390808 - DNA, 14 bp, Homo sapiens
ccaggatggcagca

SEQ ID NO: 5390809 - DNA, 11 bp, Homo sapiens
ccaggatgggg

SEQ ID NO: 5390810 - DNA, 13 bp, Homo sapiens
ccaggatggggag

SEQ ID NO: 5390811 - DNA, 23 bp, Homo sapiens
ccaggatggtctcgatctcctga

SEQ ID NO: 5390812 - DNA, 23 bp, Homo sapiens
ccaggattaatctctaaaattct

SEQ ID NO: 5390813 - DNA, 15 bp, Homo sapiens
ccaggattcaggcct

SEQ ID NO: 5390814 - DNA, 18 bp, Homo sapiens
ccaggattcccagagaga

SEQ ID NO: 5390815 - DNA, 19 bp, Homo sapiens
ccaggattcccagagagac

SEQ ID NO: 5390816 - DNA, 20 bp, Homo sapiens
ccaggattcccagagagacg

SEQ ID NO: 5390817 - DNA, 23 bp, Homo sapiens
ccaggattcccagagagacgctg

SEQ ID NO: 5390818 - DNA, 15 bp, Homo sapiens
ccaggattcctctct

SEQ ID NO: 5390819 - DNA, 16 bp, Homo sapiens
ccaggattcctctctc

SEQ ID NO: 5390820 - DNA, 15 bp, Homo sapiens
ccaggattcctcttt

SEQ ID NO: 5390821 - DNA, 16 bp, Homo sapiens
ccaggattgaagagca

SEQ ID NO: 5390822 - DNA, 20 bp, Homo sapiens
ccaggattgtacgtgggaga

SEQ ID NO: 5390823 - DNA, 23 bp, Homo sapiens
ccaggattgtacgtgggagaggc

SEQ ID NO: 5390824 - DNA, 19 bp, Homo sapiens
ccaggattgtcactccaaa

SEQ ID NO: 5390825 - DNA, 13 bp, Homo sapiens
ccaggattgtcca

SEQ ID NO: 5390826 - DNA, 22 bp, Homo sapiens
ccaggattgtccacaaatgtcc

SEQ ID NO: 5390827 - DNA, 18 bp, Homo sapiens
ccaggatttataaagcaa

SEQ ID NO: 5390828 - DNA, 23 bp, Homo sapiens
ccaggattttaatttcaggaaaa

SEQ ID NO: 5390829 - DNA, 15 bp, Homo sapiens
ccaggattttgtgtt

SEQ ID NO: 5390830 - DNA, 15 bp, Homo sapiens
ccaggcaaagctgga

SEQ ID NO: 5390831 - DNA, 12 bp, Homo sapiens
ccaggcaaatca

SEQ ID NO: 5390832 - DNA, 14 bp, Homo sapiens
ccaggcaacctccc

SEQ ID NO: 5390833 - DNA, 17 bp, Homo sapiens
ccaggcaacctcccatc

SEQ ID NO: 5390834 - DNA, 21 bp, Homo sapiens
ccaggcaacttcagtcctggg

SEQ ID NO: 5390835 - DNA, 17 bp, Homo sapiens
ccaggcaacttgggaac

SEQ ID NO: 5390836 - DNA, 16 bp, Homo sapiens
ccaggcaagaaagctt

SEQ ID NO: 5390837 - DNA, 15 bp, Homo sapiens
ccaggcaagcagctg

SEQ ID NO: 5390838 - DNA, 20 bp, Homo sapiens
ccaggcaagcagctggtcag

SEQ ID NO: 5390839 - DNA, 17 bp, Homo sapiens
ccaggcaaggaacagaa

SEQ ID NO: 5390840 - DNA, 14 bp, Homo sapiens
ccaggcaaggctga

SEQ ID NO: 5390841 - DNA, 17 bp, Homo sapiens
ccaggcaaggctgactt

SEQ ID NO: 5390842 - DNA, 15 bp, Homo sapiens
ccaggcaaggctgtg

SEQ ID NO: 5390843 - DNA, 22 bp, Homo sapiens
ccaggcaatagtgttgaggagg

SEQ ID NO: 5390844 - DNA, 14 bp, Homo sapiens
ccaggcacaggcag

SEQ ID NO: 5390845 - DNA, 15 bp, Homo sapiens
ccaggcacaggcagg

SEQ ID NO: 5390846 - DNA, 12 bp, Homo sapiens
ccaggcacaggg

SEQ ID NO: 5390847 - DNA, 15 bp, Homo sapiens
ccaggcacagggccc

SEQ ID NO: 5390848 - DNA, 16 bp, Homo sapiens
ccaggcaccacagcct

SEQ ID NO: 5390849 - DNA, 19 bp, Homo sapiens
ccaggcaccacagcctcca

SEQ ID NO: 5390850 - DNA, 21 bp, Homo sapiens
ccaggcaccaccaggagcagc

SEQ ID NO: 5390851 - DNA, 22 bp, Homo sapiens
ccaggcaccaccaggagcagca

SEQ ID NO: 5390852 - DNA, 17 bp, Homo sapiens
ccaggcacccatgtggg

SEQ ID NO: 5390853 - DNA, 19 bp, Homo sapiens
ccaggcacccatgtgggcg

SEQ ID NO: 5390854 - DNA, 14 bp, Homo sapiens
ccaggcaccctcag

SEQ ID NO: 5390855 - DNA, 17 bp, Homo sapiens
ccaggcaccctcaggga

SEQ ID NO: 5390856 - DNA, 18 bp, Homo sapiens
ccaggcaccctcagggag

SEQ ID NO: 5390857 - DNA, 19 bp, Homo sapiens
ccaggcaccctcagggagc

SEQ ID NO: 5390858 - DNA, 13 bp, Homo sapiens
ccaggcacccttc

SEQ ID NO: 5390859 - DNA, 14 bp, Homo sapiens
ccaggcacccttct

SEQ ID NO: 5390860 - DNA, 14 bp, Homo sapiens
ccaggcaccgccag

SEQ ID NO: 5390861 - DNA, 16 bp, Homo sapiens
ccaggcaccgcctgcc

SEQ ID NO: 5390862 - DNA, 17 bp, Homo sapiens
ccaggcaccgcctgccc

SEQ ID NO: 5390863 - DNA, 22 bp, Homo sapiens
ccaggcaccgcctgcccccagc

SEQ ID NO: 5390864 - DNA, 12 bp, Homo sapiens
ccaggcacctgg

SEQ ID NO: 5390865 - DNA, 17 bp, Homo sapiens
ccaggcacctggcctgc

SEQ ID NO: 5390866 - DNA, 19 bp, Homo sapiens
ccaggcacctggcctgctg

SEQ ID NO: 5390867 - DNA, 20 bp, Homo sapiens
ccaggcacgaacccacctgc

SEQ ID NO: 5390868 - DNA, 12 bp, Homo sapiens
ccaggcactgca

SEQ ID NO: 5390869 - DNA, 13 bp, Homo sapiens
ccaggcactgcaa

SEQ ID NO: 5390870 - DNA, 13 bp, Homo sapiens
ccaggcactgcct

SEQ ID NO: 5390871 - DNA, 19 bp, Homo sapiens
ccaggcactgccttctcct

SEQ ID NO: 5390872 - DNA, 16 bp, Homo sapiens
ccaggcagaaatagtt

SEQ ID NO: 5390873 - DNA, 19 bp, Homo sapiens
ccaggcagaaatagttgtc

SEQ ID NO: 5390874 - DNA, 17 bp, Homo sapiens
ccaggcagagaacagaa

SEQ ID NO: 5390875 - DNA, 12 bp, Homo sapiens
ccaggcagagct

SEQ ID NO: 5390876 - DNA, 20 bp, Homo sapiens
ccaggcagagctgagggccc

SEQ ID NO: 5390877 - DNA, 17 bp, Homo sapiens
ccaggcagaggggcgtt

SEQ ID NO: 5390878 - DNA, 17 bp, Homo sapiens
ccaggcagagttctgtg

SEQ ID NO: 5390879 - DNA, 22 bp, Homo sapiens
ccaggcagatcctctggacacg

SEQ ID NO: 5390880 - DNA, 17 bp, Homo sapiens
ccaggcagatctgtgcc

SEQ ID NO: 5390881 - DNA, 20 bp, Homo sapiens
ccaggcagatctgtgcccca

SEQ ID NO: 5390882 - DNA, 21 bp, Homo sapiens
ccaggcagatctgtgccccat

SEQ ID NO: 5390883 - DNA, 23 bp, Homo sapiens
ccaggcagatctgtgccccatgc

SEQ ID NO: 5390884 - DNA, 15 bp, Homo sapiens
ccaggcagcacctgg

SEQ ID NO: 5390885 - DNA, 18 bp, Homo sapiens
ccaggcagcacctggagc

SEQ ID NO: 5390886 - DNA, 15 bp, Homo sapiens
ccaggcagcagacac

SEQ ID NO: 5390887 - DNA, 17 bp, Homo sapiens
ccaggcagcagacacat

SEQ ID NO: 5390888 - DNA, 12 bp, Homo sapiens
ccaggcagccac

SEQ ID NO: 5390889 - DNA, 12 bp, Homo sapiens
ccaggcagcctc

SEQ ID NO: 5390890 - DNA, 14 bp, Homo sapiens
ccaggcagcctctg

SEQ ID NO: 5390891 - DNA, 22 bp, Homo sapiens
ccaggcagcgccactgtccgct

SEQ ID NO: 5390892 - DNA, 22 bp, Homo sapiens
ccaggcagctatttcagcctcc

SEQ ID NO: 5390893 - DNA, 23 bp, Homo sapiens
ccaggcagctatttcagcctcct

SEQ ID NO: 5390894 - DNA, 17 bp, Homo sapiens
ccaggcagctccagctg

SEQ ID NO: 5390895 - DNA, 19 bp, Homo sapiens
ccaggcagctccctcctgc

SEQ ID NO: 5390896 - DNA, 16 bp, Homo sapiens
ccaggcagctcctgtt

SEQ ID NO: 5390897 - DNA, 17 bp, Homo sapiens
ccaggcagctgagacca

SEQ ID NO: 5390898 - DNA, 13 bp, Homo sapiens
ccaggcagctggc

SEQ ID NO: 5390899 - DNA, 15 bp, Homo sapiens
ccaggcagctggcag

SEQ ID NO: 5390900 - DNA, 16 bp, Homo sapiens
ccaggcagctggcagg

SEQ ID NO: 5390901 - DNA, 18 bp, Homo sapiens
ccaggcaggaaaccccga

SEQ ID NO: 5390902 - DNA, 18 bp, Homo sapiens
ccaggcaggagcccttct

SEQ ID NO: 5390903 - DNA, 15 bp, Homo sapiens
ccaggcaggcacctg

SEQ ID NO: 5390904 - DNA, 12 bp, Homo sapiens
ccaggcaggccc

SEQ ID NO: 5390905 - DNA, 13 bp, Homo sapiens
ccaggcaggccca

SEQ ID NO: 5390906 - DNA, 16 bp, Homo sapiens
ccaggcaggcccagcc

SEQ ID NO: 5390907 - DNA, 17 bp, Homo sapiens
ccaggcaggcccagcct

SEQ ID NO: 5390908 - DNA, 18 bp, Homo sapiens
ccaggcaggcccagcctc

SEQ ID NO: 5390909 - DNA, 20 bp, Homo sapiens
ccaggcaggcccagcctctg

SEQ ID NO: 5390910 - DNA, 23 bp, Homo sapiens
ccaggcaggcccagcctctgccc

SEQ ID NO: 5390911 - DNA, 13 bp, Homo sapiens
ccaggcaggcgat

SEQ ID NO: 5390912 - DNA, 11 bp, Homo sapiens
ccaggcaggga

SEQ ID NO: 5390913 - DNA, 13 bp, Homo sapiens
ccaggcagggaga

SEQ ID NO: 5390914 - DNA, 22 bp, Homo sapiens
ccaggcagggagagagtagctg

SEQ ID NO: 5390915 - DNA, 22 bp, Homo sapiens
ccaggcagggagtgtctgcagt

SEQ ID NO: 5390916 - DNA, 23 bp, Homo sapiens
ccaggcagggccaacccttctcc

SEQ ID NO: 5390917 - DNA, 16 bp, Homo sapiens
ccaggcaggggtggga

SEQ ID NO: 5390918 - DNA, 22 bp, Homo sapiens
ccaggcaggggtgggggtggag

SEQ ID NO: 5390919 - DNA, 19 bp, Homo sapiens
ccagggcatcttgctggct

SEQ ID NO: 5390920 - DNA, 18 bp, Homo sapiens
ccagggcatgtgtatgtg

SEQ ID NO: 5390921 - DNA, 22 bp, Homo sapiens
ccagggcattcgggccacaggg

SEQ ID NO: 5390922 - DNA, 18 bp, Homo sapiens
ccagggcattgctcagcc

SEQ ID NO: 5390923 - DNA, 23 bp, Homo sapiens
ccagggcattgctcagcccgctt

SEQ ID NO: 5390924 - DNA, 16 bp, Homo sapiens
ccagggccacgctcca

SEQ ID NO: 5390925 - DNA, 18 bp, Homo sapiens
ccagggccacgctccagc

SEQ ID NO: 5390926 - DNA, 20 bp, Homo sapiens
ccagggccactctgcctctg

SEQ ID NO: 5390927 - DNA, 18 bp, Homo sapiens
ccagggccagcaggcagc

SEQ ID NO: 5390928 - DNA, 16 bp, Homo sapiens
ccagggccagggccct

SEQ ID NO: 5390929 - DNA, 18 bp, Homo sapiens
ccagggccatgaactttg

SEQ ID NO: 5390930 - DNA, 14 bp, Homo sapiens
ccagggcccacccc

SEQ ID NO: 5390931 - DNA, 12 bp, Homo sapiens
ccagggcccaga

SEQ ID NO: 5390932 - DNA, 18 bp, Homo sapiens
ccagggcccagagcccag

SEQ ID NO: 5390933 - DNA, 22 bp, Homo sapiens
ccagggcccagagcccagctcc

SEQ ID NO: 5390934 - DNA, 17 bp, Homo sapiens
ccagggcccagagccct

SEQ ID NO: 5390935 - DNA, 13 bp, Homo sapiens
ccagggcccagga

SEQ ID NO: 5390936 - DNA, 16 bp, Homo sapiens
ccagggcccaggccat

SEQ ID NO: 5390937 - DNA, 17 bp, Homo sapiens
ccagggcccaggccatg

SEQ ID NO: 5390938 - DNA, 20 bp, Homo sapiens
ccagggcccccaaagagcaa

SEQ ID NO: 5390939 - DNA, 16 bp, Homo sapiens
ccagggcccccaccga

SEQ ID NO: 5390940 - DNA, 16 bp, Homo sapiens
ccagggcccccctccc

SEQ ID NO: 5390941 - DNA, 16 bp, Homo sapiens
ccagggccccggggcc

SEQ ID NO: 5390942 - DNA, 22 bp, Homo sapiens
ccagggcccctccctctgcccc

SEQ ID NO: 5390943 - DNA, 17 bp, Homo sapiens
ccagggcccctggatct

SEQ ID NO: 5390944 - DNA, 18 bp, Homo sapiens
ccagggcccctggatctc

SEQ ID NO: 5390945 - DNA, 20 bp, Homo sapiens
ccagggcccgagcgcgtgcc

SEQ ID NO: 5390946 - DNA, 22 bp, Homo sapiens
ccagggcccgagcgcgtgcctt

SEQ ID NO: 5390947 - DNA, 23 bp, Homo sapiens
ccagggcccgagcgcgtgccttc

SEQ ID NO: 5390948 - DNA, 14 bp, Homo sapiens
ccagggcccgcacc

SEQ ID NO: 5390949 - DNA, 20 bp, Homo sapiens
ccagggcccgggcacccaca

SEQ ID NO: 5390950 - DNA, 11 bp, Homo sapiens
ccagggcccta

SEQ ID NO: 5390951 - DNA, 18 bp, Homo sapiens
ccagggccctcccagccc

SEQ ID NO: 5390952 - DNA, 13 bp, Homo sapiens
ccagggccctcgg

SEQ ID NO: 5390953 - DNA, 12 bp, Homo sapiens
ccagggccctgc

SEQ ID NO: 5390954 - DNA, 14 bp, Homo sapiens
ccagggccctgcag

SEQ ID NO: 5390955 - DNA, 15 bp, Homo sapiens
ccagggccctgctca

SEQ ID NO: 5390956 - DNA, 13 bp, Homo sapiens
ccagggccctggc

SEQ ID NO: 5390957 - DNA, 14 bp, Homo sapiens
ccagggccctggcc

SEQ ID NO: 5390958 - DNA, 15 bp, Homo sapiens
ccagggccctggcca

SEQ ID NO: 5390959 - DNA, 17 bp, Homo sapiens
ccagggccctggccagc

SEQ ID NO: 5390960 - DNA, 14 bp, Homo sapiens
ccagggccctgggc

SEQ ID NO: 5390961 - DNA, 14 bp, Homo sapiens
ccagggccgcttct

SEQ ID NO: 5390962 - DNA, 13 bp, Homo sapiens
ccagggcctagga

SEQ ID NO: 5390963 - DNA, 15 bp, Homo sapiens
ccagggcctccaggg

SEQ ID NO: 5390964 - DNA, 16 bp, Homo sapiens
ccagggcctccagggc

SEQ ID NO: 5390965 - DNA, 14 bp, Homo sapiens
ccagggcctctggc

SEQ ID NO: 5390966 - DNA, 15 bp, Homo sapiens
ccagggcctgacacc

SEQ ID NO: 5390967 - DNA, 16 bp, Homo sapiens
ccagggcctgacaccc

SEQ ID NO: 5390968 - DNA, 13 bp, Homo sapiens
ccagggcctgact

SEQ ID NO: 5390969 - DNA, 18 bp, Homo sapiens
ccagggcctgagcctggc

SEQ ID NO: 5390970 - DNA, 23 bp, Homo sapiens
ccagggcctgcaggacctgcctg

SEQ ID NO: 5390971 - DNA, 19 bp, Homo sapiens
ccagggcctggaagacaga

SEQ ID NO: 5390972 - DNA, 15 bp, Homo sapiens
ccagggcctggctgg

SEQ ID NO: 5390973 - DNA, 13 bp, Homo sapiens
ccagggcctgggg

SEQ ID NO: 5390974 - DNA, 21 bp, Homo sapiens
ccagggcctggtgtgaggctg

SEQ ID NO: 5390975 - DNA, 13 bp, Homo sapiens
ccagggcctgtct

SEQ ID NO: 5390976 - DNA, 19 bp, Homo sapiens
ccagggcgggagtgggggc

SEQ ID NO: 5390977 - DNA, 16 bp, Homo sapiens
ccagggctacacagac

SEQ ID NO: 5390978 - DNA, 19 bp, Homo sapiens
ccagggctagtgaagtggc

SEQ ID NO: 5390979 - DNA, 18 bp, Homo sapiens
ccagggctcacccactgc

SEQ ID NO: 5390980 - DNA, 14 bp, Homo sapiens
ccagggctcagcct

SEQ ID NO: 5390981 - DNA, 23 bp, Homo sapiens
ccagggctccacgggggcctagt

SEQ ID NO: 5390982 - DNA, 19 bp, Homo sapiens
ccagggctccagcccctct

SEQ ID NO: 5390983 - DNA, 13 bp, Homo sapiens
ccagggctccagg

SEQ ID NO: 5390984 - DNA, 22 bp, Homo sapiens
ccagggctcccttatgtccacc

SEQ ID NO: 5390985 - DNA, 13 bp, Homo sapiens
ccagggctcctgc

SEQ ID NO: 5390986 - DNA, 20 bp, Homo sapiens
ccagggctcctgcacttact

SEQ ID NO: 5390987 - DNA, 15 bp, Homo sapiens
ccagggctcctgtgg

SEQ ID NO: 5390988 - DNA, 16 bp, Homo sapiens
ccagggctcctgtggc

SEQ ID NO: 5390989 - DNA, 22 bp, Homo sapiens
ccagggctcctgtggcagctgc

SEQ ID NO: 5390990 - DNA, 16 bp, Homo sapiens
ccagggctctctggac

SEQ ID NO: 5390991 - DNA, 15 bp, Homo sapiens
ccagggctctgcagc

SEQ ID NO: 5390992 - DNA, 19 bp, Homo sapiens
ccagggctctgccccagtc

SEQ ID NO: 5390993 - DNA, 15 bp, Homo sapiens
ccagggctctggcag

SEQ ID NO: 5390994 - DNA, 20 bp, Homo sapiens
ccagggctctgggggcagat

SEQ ID NO: 5390995 - DNA, 13 bp, Homo sapiens
ccagggctgccag

SEQ ID NO: 5390996 - DNA, 13 bp, Homo sapiens
ccagggctgcccc

SEQ ID NO: 5390997 - DNA, 14 bp, Homo sapiens
ccagggctgctctt

SEQ ID NO: 5390998 - DNA, 19 bp, Homo sapiens
ccagggctggactgaggcc

SEQ ID NO: 5390999 - DNA, 12 bp, Homo sapiens
ccagggctggcc

SEQ ID NO: 5391000 - DNA, 14 bp, Homo sapiens
ccagggctggccct

SEQ ID NO: 5391001 - DNA, 15 bp, Homo sapiens
ccagggctggcccta

SEQ ID NO: 5391002 - DNA, 13 bp, Homo sapiens
ccagggctggctc

SEQ ID NO: 5391003 - DNA, 19 bp, Homo sapiens
ccagggctgggaggaagga

SEQ ID NO: 5391004 - DNA, 12 bp, Homo sapiens
ccagggctgggg

SEQ ID NO: 5391005 - DNA, 19 bp, Homo sapiens
ccagggctggggtgagcct

SEQ ID NO: 5391006 - DNA, 14 bp, Homo sapiens
ccagggctgggtca

SEQ ID NO: 5391007 - DNA, 17 bp, Homo sapiens
ccagggctgggtcacag

SEQ ID NO: 5391008 - DNA, 20 bp, Homo sapiens
ccagggctgggtcacaggaa

SEQ ID NO: 5391009 - DNA, 22 bp, Homo sapiens
ccagggctgggtcacaggaagg

SEQ ID NO: 5391010 - DNA, 20 bp, Homo sapiens
ccagggctgtaactgccagg

SEQ ID NO: 5391011 - DNA, 14 bp, Homo sapiens
ccagggctgtgggt

SEQ ID NO: 5391012 - DNA, 20 bp, Homo sapiens
ccagggctgttggaggaccc

SEQ ID NO: 5391013 - DNA, 20 bp, Homo sapiens
ccagggcttacctgtacact

SEQ ID NO: 5391014 - DNA, 22 bp, Homo sapiens
ccagggcttccccatcagctcc

SEQ ID NO: 5391015 - DNA, 16 bp, Homo sapiens
ccagggcttgtggact

SEQ ID NO: 5391016 - DNA, 23 bp, Homo sapiens
ccagggcttgtggactctctgcc

SEQ ID NO: 5391017 - DNA, 21 bp, Homo sapiens
ccaggggaaaatcagcctgct

SEQ ID NO: 5391018 - DNA, 13 bp, Homo sapiens
ccaggggaacctg

SEQ ID NO: 5391019 - DNA, 18 bp, Homo sapiens
ccaggggaccacacctcc

SEQ ID NO: 5391020 - DNA, 22 bp, Homo sapiens
ccaggggaccagagggatggga

SEQ ID NO: 5391021 - DNA, 15 bp, Homo sapiens
ccaggggacccctgc

SEQ ID NO: 5391022 - DNA, 18 bp, Homo sapiens
ccaggggacgcgctggaa

SEQ ID NO: 5391023 - DNA, 16 bp, Homo sapiens
ccaggggacgtgggcc

SEQ ID NO: 5391024 - DNA, 20 bp, Homo sapiens
ccaggggacgtgggccctgc

SEQ ID NO: 5391025 - DNA, 17 bp, Homo sapiens
ccaggggactgttcctt

SEQ ID NO: 5391026 - DNA, 18 bp, Homo sapiens
ccaggggagagggtctgg

SEQ ID NO: 5391027 - DNA, 17 bp, Homo sapiens
ccaggggagccagctgc

SEQ ID NO: 5391028 - DNA, 19 bp, Homo sapiens
ccaggggagccagctgctt

SEQ ID NO: 5391029 - DNA, 17 bp, Homo sapiens
ccaggggagggaaaagc

SEQ ID NO: 5391030 - DNA, 16 bp, Homo sapiens
ccaggggatgggaggt

SEQ ID NO: 5391031 - DNA, 12 bp, Homo sapiens
ccaggggatttc

SEQ ID NO: 5391032 - DNA, 17 bp, Homo sapiens
ccaggggcacacttccc

SEQ ID NO: 5391033 - DNA, 15 bp, Homo sapiens
ccaggggcagcaagg

SEQ ID NO: 5391034 - DNA, 16 bp, Homo sapiens
ccaggggcagccccag

SEQ ID NO: 5391035 - DNA, 12 bp, Homo sapiens
ccaggggcagga

SEQ ID NO: 5391036 - DNA, 13 bp, Homo sapiens
ccaggggcaggac

SEQ ID NO: 5391037 - DNA, 16 bp, Homo sapiens
ccaggggcaggactga

SEQ ID NO: 5391038 - DNA, 15 bp, Homo sapiens
ccaggggcaggcaca

SEQ ID NO: 5391039 - DNA, 14 bp, Homo sapiens
ccaggggcaggcag

SEQ ID NO: 5391040 - DNA, 16 bp, Homo sapiens
ccaggggcaggcagct

SEQ ID NO: 5391041 - DNA, 16 bp, Homo sapiens
ccaggggcaggcaggg

SEQ ID NO: 5391042 - DNA, 20 bp, Homo sapiens
ccaggggcaggcagggctgc

SEQ ID NO: 5391043 - DNA, 22 bp, Homo sapiens
ccaggggcaggcagggctgcag

SEQ ID NO: 5391044 - DNA, 21 bp, Homo sapiens
ccaggggcagttttagcagca

SEQ ID NO: 5391045 - DNA, 22 bp, Homo sapiens
ccaggggcagttttagcagcac

SEQ ID NO: 5391046 - DNA, 21 bp, Homo sapiens
ccaggggcatgtattggcctg

SEQ ID NO: 5391047 - DNA, 15 bp, Homo sapiens
ccaggggccatgaat

SEQ ID NO: 5391048 - DNA, 19 bp, Homo sapiens
ccaggggcccacagggaac

SEQ ID NO: 5391049 - DNA, 21 bp, Homo sapiens
ccaggggcccccgtgttcagg

SEQ ID NO: 5391050 - DNA, 12 bp, Homo sapiens
ccaggggcccct

SEQ ID NO: 5391051 - DNA, 14 bp, Homo sapiens
ccaggggcccctcc

SEQ ID NO: 5391052 - DNA, 20 bp, Homo sapiens
ccaggggcccctccagcttg

SEQ ID NO: 5391053 - DNA, 17 bp, Homo sapiens
ccaggggccctacctgg

SEQ ID NO: 5391054 - DNA, 23 bp, Homo sapiens
ccaggggcctttgggtgctgttt

SEQ ID NO: 5391055 - DNA, 14 bp, Homo sapiens
ccaggggcgaggtc

SEQ ID NO: 5391056 - DNA, 15 bp, Homo sapiens
ccaggggctccctcc

SEQ ID NO: 5391057 - DNA, 22 bp, Homo sapiens
ccaggggctccctccgccccca

SEQ ID NO: 5391058 - DNA, 14 bp, Homo sapiens
ccaggggctcctgg

SEQ ID NO: 5391059 - DNA, 19 bp, Homo sapiens
ccaggggctgcagccccct

SEQ ID NO: 5391060 - DNA, 20 bp, Homo sapiens
ccaggggctgcagccccctg

SEQ ID NO: 5391061 - DNA, 14 bp, Homo sapiens
ccaggggctgctca

SEQ ID NO: 5391062 - DNA, 23 bp, Homo sapiens
ccaggggctgctcatcacccagt

SEQ ID NO: 5391063 - DNA, 13 bp, Homo sapiens
ccaggggcttctc

SEQ ID NO: 5391064 - DNA, 23 bp, Homo sapiens
ccaggggcttctccccctcagct

SEQ ID NO: 5391065 - DNA, 22 bp, Homo sapiens
ccaggggctttggtggcccctc

SEQ ID NO: 5391066 - DNA, 19 bp, Homo sapiens
ccagggggaagcaccagcc

SEQ ID NO: 5391067 - DNA, 19 bp, Homo sapiens
ccagggggaaggccaaggg

SEQ ID NO: 5391068 - DNA, 19 bp, Homo sapiens
ccagggggactagcccctg

SEQ ID NO: 5391069 - DNA, 13 bp, Homo sapiens
ccagggggagctg

SEQ ID NO: 5391070 - DNA, 22 bp, Homo sapiens
ccagggggatatgggtcctctg

SEQ ID NO: 5391071 - DNA, 23 bp, Homo sapiens
ccagggggatatgggtcctctgg

SEQ ID NO: 5391072 - DNA, 20 bp, Homo sapiens
ccagggggcaaggagaaagc

SEQ ID NO: 5391073 - DNA, 19 bp, Homo sapiens
ccagggggcctgcaggccc

SEQ ID NO: 5391074 - DNA, 17 bp, Homo sapiens
ccagggggcctggagca

SEQ ID NO: 5391075 - DNA, 15 bp, Homo sapiens
ccagggggctgaaac

SEQ ID NO: 5391076 - DNA, 15 bp, Homo sapiens
ccaggggggcctcct

SEQ ID NO: 5391077 - DNA, 17 bp, Homo sapiens
ccaggggggtgaggagc

SEQ ID NO: 5391078 - DNA, 19 bp, Homo sapiens
ccaggggtaacctggccac

SEQ ID NO: 5391079 - DNA, 21 bp, Homo sapiens
ccaggggtaccaggcacatgg

SEQ ID NO: 5391080 - DNA, 16 bp, Homo sapiens
ccaggggtccaggccc

SEQ ID NO: 5391081 - DNA, 14 bp, Homo sapiens
ccaggggtcccagc

SEQ ID NO: 5391082 - DNA, 17 bp, Homo sapiens
ccaggggtcccagccac

SEQ ID NO: 5391083 - DNA, 18 bp, Homo sapiens
ccaggggtcccctggcag

SEQ ID NO: 5391084 - DNA, 22 bp, Homo sapiens
ccaggggtcccctggcagggga

SEQ ID NO: 5391085 - DNA, 17 bp, Homo sapiens
ccaggggtctccctgga

SEQ ID NO: 5391086 - DNA, 18 bp, Homo sapiens
ccaggggtctccctggag

SEQ ID NO: 5391087 - DNA, 18 bp, Homo sapiens
ccaggggtctccctggct

SEQ ID NO: 5391088 - DNA, 18 bp, Homo sapiens
ccaggggtgagccccgcc

SEQ ID NO: 5391089 - DNA, 20 bp, Homo sapiens
ccaggggtgatttcagagag

SEQ ID NO: 5391090 - DNA, 17 bp, Homo sapiens
ccaggggtgccccctcc

SEQ ID NO: 5391091 - DNA, 20 bp, Homo sapiens
ccaggggtgcctgtgggggt

SEQ ID NO: 5391092 - DNA, 16 bp, Homo sapiens
ccaggggtgctcctgt

SEQ ID NO: 5391093 - DNA, 23 bp, Homo sapiens
ccaggggtggaacaactctggga

SEQ ID NO: 5391094 - DNA, 15 bp, Homo sapiens
ccaggggtggaggga

SEQ ID NO: 5391095 - DNA, 14 bp, Homo sapiens
ccaggggtgggaca

SEQ ID NO: 5391096 - DNA, 17 bp, Homo sapiens
ccaggggtgggacaccc

SEQ ID NO: 5391097 - DNA, 15 bp, Homo sapiens
ccagtcatctgtaag

SEQ ID NO: 5391098 - DNA, 18 bp, Homo sapiens
ccagtcatggaatcttgc

SEQ ID NO: 5391099 - DNA, 22 bp, Homo sapiens
ccagtcatggctgtcccctgca

SEQ ID NO: 5391100 - DNA, 22 bp, Homo sapiens
ccagtcattatgttaatatttc

SEQ ID NO: 5391101 - DNA, 14 bp, Homo sapiens
ccagtccaaggaaa

SEQ ID NO: 5391102 - DNA, 15 bp, Homo sapiens
ccagtccaggctgcc

SEQ ID NO: 5391103 - DNA, 15 bp, Homo sapiens
ccagtccatgctcca

SEQ ID NO: 5391104 - DNA, 15 bp, Homo sapiens
ccagtcccacactgt

SEQ ID NO: 5391105 - DNA, 18 bp, Homo sapiens
ccagtcccacggctctgt

SEQ ID NO: 5391106 - DNA, 15 bp, Homo sapiens
ccagtcccagagcag

SEQ ID NO: 5391107 - DNA, 20 bp, Homo sapiens
ccagtcccagcctctggggc

SEQ ID NO: 5391108 - DNA, 22 bp, Homo sapiens
ccagtcccagcctctggggcag

SEQ ID NO: 5391109 - DNA, 14 bp, Homo sapiens
ccagtccccacccg

SEQ ID NO: 5391110 - DNA, 23 bp, Homo sapiens
ccagtccccacccgcctgcagag

SEQ ID NO: 5391111 - DNA, 19 bp, Homo sapiens
ccagtccccagaagcagag

SEQ ID NO: 5391112 - DNA, 20 bp, Homo sapiens
ccagtccccagaagcagaga

SEQ ID NO: 5391113 - DNA, 15 bp, Homo sapiens
ccagtccccagccct

SEQ ID NO: 5391114 - DNA, 16 bp, Homo sapiens
ccagtccccagccctg

SEQ ID NO: 5391115 - DNA, 22 bp, Homo sapiens
ccagtccccagccctgggcttg

SEQ ID NO: 5391116 - DNA, 15 bp, Homo sapiens
ccagtcccccaaccc

SEQ ID NO: 5391117 - DNA, 16 bp, Homo sapiens
ccagtcccccaacccc

SEQ ID NO: 5391118 - DNA, 17 bp, Homo sapiens
ccagtccccccaccctc

SEQ ID NO: 5391119 - DNA, 15 bp, Homo sapiens
ccagtccccctatcc

SEQ ID NO: 5391120 - DNA, 18 bp, Homo sapiens
ccagtccccctgccccag

SEQ ID NO: 5391121 - DNA, 22 bp, Homo sapiens
ccagtccccgaggagctgggcc

SEQ ID NO: 5391122 - DNA, 19 bp, Homo sapiens
ccagtccccgggaaaggcc

SEQ ID NO: 5391123 - DNA, 14 bp, Homo sapiens
ccagtccctctgag

SEQ ID NO: 5391124 - DNA, 12 bp, Homo sapiens
ccagtccctgga

SEQ ID NO: 5391125 - DNA, 16 bp, Homo sapiens
ccagtccctggagctg

SEQ ID NO: 5391126 - DNA, 17 bp, Homo sapiens
ccagtccctggagctgt

SEQ ID NO: 5391127 - DNA, 19 bp, Homo sapiens
ccagtccctgggggaagcc

SEQ ID NO: 5391128 - DNA, 22 bp, Homo sapiens
ccagtccctgggggaagccctg

SEQ ID NO: 5391129 - DNA, 17 bp, Homo sapiens
ccagtccgccccgtgct

SEQ ID NO: 5391130 - DNA, 18 bp, Homo sapiens
ccagtccgccccgtgctc

SEQ ID NO: 5391131 - DNA, 16 bp, Homo sapiens
ccagtccggtgccttc

SEQ ID NO: 5391132 - DNA, 17 bp, Homo sapiens
ccagtccggtgccttcc

SEQ ID NO: 5391133 - DNA, 18 bp, Homo sapiens
ccagtccggtgccttcca

SEQ ID NO: 5391134 - DNA, 20 bp, Homo sapiens
ccagtccggtgccttccacc

SEQ ID NO: 5391135 - DNA, 21 bp, Homo sapiens
ccagtccggtgccttccaccc

SEQ ID NO: 5391136 - DNA, 21 bp, Homo sapiens
ccagtcctagagctcctgtcc

SEQ ID NO: 5391137 - DNA, 21 bp, Homo sapiens
ccagtcctaggcccctgccct

SEQ ID NO: 5391138 - DNA, 17 bp, Homo sapiens
ccagtcctatctgggct

SEQ ID NO: 5391139 - DNA, 18 bp, Homo sapiens
ccagtcctatctgggctt

SEQ ID NO: 5391140 - DNA, 21 bp, Homo sapiens
ccagtcctatctgggcttcct

SEQ ID NO: 5391141 - DNA, 17 bp, Homo sapiens
ccagtcctcactgtcct

SEQ ID NO: 5391142 - DNA, 21 bp, Homo sapiens
ccagtcctccactcgacccag

SEQ ID NO: 5391143 - DNA, 19 bp, Homo sapiens
ccagtcctccagaccacca

SEQ ID NO: 5391144 - DNA, 13 bp, Homo sapiens
ccagtcctcccta

SEQ ID NO: 5391145 - DNA, 14 bp, Homo sapiens
ccagtcctccctag

SEQ ID NO: 5391146 - DNA, 15 bp, Homo sapiens
ccagtcctcctggga

SEQ ID NO: 5391147 - DNA, 22 bp, Homo sapiens
ccagtcctctcccaagtccaca

SEQ ID NO: 5391148 - DNA, 21 bp, Homo sapiens
ccagtcctgccaccaccctgt

SEQ ID NO: 5391149 - DNA, 13 bp, Homo sapiens
ccagtcctgcctg

SEQ ID NO: 5391150 - DNA, 15 bp, Homo sapiens
ccagtcctgcctgaa

SEQ ID NO: 5391151 - DNA, 15 bp, Homo sapiens
ccagtcctgcctggc

SEQ ID NO: 5391152 - DNA, 13 bp, Homo sapiens
ccagtcctgctct

SEQ ID NO: 5391153 - DNA, 15 bp, Homo sapiens
ccagtcctgctgcct

SEQ ID NO: 5391154 - DNA, 18 bp, Homo sapiens
ccagtcctgctgcctgga

SEQ ID NO: 5391155 - DNA, 22 bp, Homo sapiens
ccagtcctgctgcctggagtca

SEQ ID NO: 5391156 - DNA, 14 bp, Homo sapiens
ccagtcctgctggc

SEQ ID NO: 5391157 - DNA, 16 bp, Homo sapiens
ccagtcctgctggcct

SEQ ID NO: 5391158 - DNA, 21 bp, Homo sapiens
ccagtcctgctggcctgctct

SEQ ID NO: 5391159 - DNA, 13 bp, Homo sapiens
ccagtcctggcct

SEQ ID NO: 5391160 - DNA, 15 bp, Homo sapiens
ccagtcctggtcctg

SEQ ID NO: 5391161 - DNA, 22 bp, Homo sapiens
ccagtcctggttcagtgggaat

SEQ ID NO: 5391162 - DNA, 18 bp, Homo sapiens
ccagtcctggttgtctga

SEQ ID NO: 5391163 - DNA, 23 bp, Homo sapiens
ccagtccttagcaaggggctcag

SEQ ID NO: 5391164 - DNA, 11 bp, Homo sapiens
ccagtccttgg

SEQ ID NO: 5391165 - DNA, 14 bp, Homo sapiens
ccagtcgaccccaa

SEQ ID NO: 5391166 - DNA, 15 bp, Homo sapiens
ccagtcgagacctca

SEQ ID NO: 5391167 - DNA, 18 bp, Homo sapiens
ccagtcgatatctcactt

SEQ ID NO: 5391168 - DNA, 16 bp, Homo sapiens
ccagtcgccctctgtg

SEQ ID NO: 5391169 - DNA, 19 bp, Homo sapiens
ccagtcgccctctgtgcct

SEQ ID NO: 5391170 - DNA, 20 bp, Homo sapiens
ccagtcgggagagccaggct

SEQ ID NO: 5391171 - DNA, 21 bp, Homo sapiens
ccagtcgggagagccaggctt

SEQ ID NO: 5391172 - DNA, 19 bp, Homo sapiens
ccagtcgtccgctcagcca

SEQ ID NO: 5391173 - DNA, 22 bp, Homo sapiens
ccagtcgtgatgtggaggaaga

SEQ ID NO: 5391174 - DNA, 15 bp, Homo sapiens
ccagtcgttatttct

SEQ ID NO: 5391175 - DNA, 14 bp, Homo sapiens
ccagtctaaaaata

SEQ ID NO: 5391176 - DNA, 19 bp, Homo sapiens
ccagtctacgttctccagc

SEQ ID NO: 5391177 - DNA, 22 bp, Homo sapiens
ccagtctacgttctccagccca

SEQ ID NO: 5391178 - DNA, 23 bp, Homo sapiens
ccagtctacgttctccagcccac

SEQ ID NO: 5391179 - DNA, 13 bp, Homo sapiens
ccagtctatttcc

SEQ ID NO: 5391180 - DNA, 20 bp, Homo sapiens
ccagtctatttccactgaac

SEQ ID NO: 5391181 - DNA, 21 bp, Homo sapiens
ccagtctatttccactgaaca

SEQ ID NO: 5391182 - DNA, 22 bp, Homo sapiens
ccagtctatttccactgaacaa

SEQ ID NO: 5391183 - DNA, 19 bp, Homo sapiens
ccagtctcacccactagga

SEQ ID NO: 5391184 - DNA, 13 bp, Homo sapiens
ccagtctcagaga

SEQ ID NO: 5391185 - DNA, 17 bp, Homo sapiens
ccagtctcatcctccca

SEQ ID NO: 5391186 - DNA, 18 bp, Homo sapiens
ccagtctcatcctcccat

SEQ ID NO: 5391187 - DNA, 23 bp, Homo sapiens
ccagtctcatcctcccattgccc

SEQ ID NO: 5391188 - DNA, 15 bp, Homo sapiens
ccagtctcatctcct

SEQ ID NO: 5391189 - DNA, 23 bp, Homo sapiens
ccagtctcatctcctgaccctcc

SEQ ID NO: 5391190 - DNA, 13 bp, Homo sapiens
ccagtctcattgt

SEQ ID NO: 5391191 - DNA, 21 bp, Homo sapiens
ccagtctccaccaggaacctc

SEQ ID NO: 5391192 - DNA, 14 bp, Homo sapiens
ccagtctcccaggc

SEQ ID NO: 5391193 - DNA, 23 bp, Homo sapiens
ccagtctctgctccacctttcag

SEQ ID NO: 5391194 - DNA, 12 bp, Homo sapiens
ccagtctcttct

SEQ ID NO: 5391195 - DNA, 15 bp, Homo sapiens
ccagtctgaagatgt

SEQ ID NO: 5391196 - DNA, 12 bp, Homo sapiens
ccagtctgaagt

SEQ ID NO: 5391197 - DNA, 21 bp, Homo sapiens
ccagtctgaagtgcctactgg

SEQ ID NO: 5391198 - DNA, 21 bp, Homo sapiens
ccagtctgaagtttcatttat

SEQ ID NO: 5391199 - DNA, 16 bp, Homo sapiens
ccagtctgctctcagc

SEQ ID NO: 5391200 - DNA, 17 bp, Homo sapiens
ccagtctgctgccctcc

SEQ ID NO: 5391201 - DNA, 18 bp, Homo sapiens
ccagtctgctgccctcca

SEQ ID NO: 5391202 - DNA, 23 bp, Homo sapiens
ccagtctgctgccctccatcccg

SEQ ID NO: 5391203 - DNA, 14 bp, Homo sapiens
ccagtctgtctact

SEQ ID NO: 5391204 - DNA, 15 bp, Homo sapiens
ccagtctgtctactg

SEQ ID NO: 5391205 - DNA, 21 bp, Homo sapiens
ccagtctgtggatcagagatg

SEQ ID NO: 5391206 - DNA, 14 bp, Homo sapiens
ccagtctgttgctg

SEQ ID NO: 5391207 - DNA, 15 bp, Homo sapiens
ccagtcttccagaaa

SEQ ID NO: 5391208 - DNA, 18 bp, Homo sapiens
ccagtcttccagaaagca

SEQ ID NO: 5391209 - DNA, 20 bp, Homo sapiens
ccagtcttccagaaagcaag

SEQ ID NO: 5391210 - DNA, 19 bp, Homo sapiens
ccagtcttcctcttagcct

SEQ ID NO: 5391211 - DNA, 16 bp, Homo sapiens
ccagtcttccttgtct

SEQ ID NO: 5391212 - DNA, 14 bp, Homo sapiens
ccagtcttctagtg

SEQ ID NO: 5391213 - DNA, 15 bp, Homo sapiens
ccagtcttctccctg

SEQ ID NO: 5391214 - DNA, 16 bp, Homo sapiens
ccagtcttctccctgt

SEQ ID NO: 5391215 - DNA, 20 bp, Homo sapiens
ccagtctttaaaggcccagc

SEQ ID NO: 5391216 - DNA, 17 bp, Homo sapiens
ccagtctttcttcactc

SEQ ID NO: 5391217 - DNA, 20 bp, Homo sapiens
ccagtctttggagagctcag

SEQ ID NO: 5391218 - DNA, 15 bp, Homo sapiens
ccagtgaaaaaatgt

SEQ ID NO: 5391219 - DNA, 15 bp, Homo sapiens
ccagtgaaatagaac

SEQ ID NO: 5391220 - DNA, 20 bp, Homo sapiens
ccagtgaaatcagttactct

SEQ ID NO: 5391221 - DNA, 16 bp, Homo sapiens
ccagtgaaatgtgaag

SEQ ID NO: 5391222 - DNA, 17 bp, Homo sapiens
ccagtgaacattcccag

SEQ ID NO: 5391223 - DNA, 18 bp, Homo sapiens
ccagtgaacattcccagc

SEQ ID NO: 5391224 - DNA, 22 bp, Homo sapiens
ccagtgaacattcccagcccag

SEQ ID NO: 5391225 - DNA, 17 bp, Homo sapiens
ccagtgaactcctgcca

SEQ ID NO: 5391226 - DNA, 22 bp, Homo sapiens
ccagtgaactcctgccaggcac

SEQ ID NO: 5391227 - DNA, 21 bp, Homo sapiens
ccagtgaagacgtcaggggca

SEQ ID NO: 5391228 - DNA, 12 bp, Homo sapiens
ccagtgaagcct

SEQ ID NO: 5391229 - DNA, 15 bp, Homo sapiens
ccagtgaagcctctg

SEQ ID NO: 5391230 - DNA, 22 bp, Homo sapiens
ccagtgaagggttttgtgtgtt

SEQ ID NO: 5391231 - DNA, 16 bp, Homo sapiens
ccagtgaatctgtttc

SEQ ID NO: 5391232 - DNA, 20 bp, Homo sapiens
ccagtgaattcttgaaggaa

SEQ ID NO: 5391233 - DNA, 19 bp, Homo sapiens
ccagtgacaaagactcctc

SEQ ID NO: 5391234 - DNA, 17 bp, Homo sapiens
ccagtgacacaactcat

SEQ ID NO: 5391235 - DNA, 18 bp, Homo sapiens
ccagtgacagacaggctc

SEQ ID NO: 5391236 - DNA, 15 bp, Homo sapiens
ccagtgaccccagaa

SEQ ID NO: 5391237 - DNA, 17 bp, Homo sapiens
ccagtgacccctgacct

SEQ ID NO: 5391238 - DNA, 14 bp, Homo sapiens
ccagtgaccctgga

SEQ ID NO: 5391239 - DNA, 19 bp, Homo sapiens
ccagtgaccctggagctag

SEQ ID NO: 5391240 - DNA, 15 bp, Homo sapiens
ccagtgacctgagga

SEQ ID NO: 5391241 - DNA, 16 bp, Homo sapiens
ccagtgacgtggttca

SEQ ID NO: 5391242 - DNA, 10 bp, Homo sapiens
ccagtgactc

SEQ ID NO: 5391243 - DNA, 13 bp, Homo sapiens
ccagtgactccag

SEQ ID NO: 5391244 - DNA, 15 bp, Homo sapiens
ccagtgactccaggg

SEQ ID NO: 5391245 - DNA, 18 bp, Homo sapiens
ccagtgactgctgcgctg

SEQ ID NO: 5391246 - DNA, 19 bp, Homo sapiens
ccagtgactgctgcgctgt

SEQ ID NO: 5391247 - DNA, 21 bp, Homo sapiens
ccagtgactgctgcgctgtgc

SEQ ID NO: 5391248 - DNA, 20 bp, Homo sapiens
ccagtgacttaggaggctga

SEQ ID NO: 5391249 - DNA, 16 bp, Homo sapiens
ccagtgagaaattaca

SEQ ID NO: 5391250 - DNA, 20 bp, Homo sapiens
ccagtgagaactctctccct

SEQ ID NO: 5391251 - DNA, 21 bp, Homo sapiens
ccagtgagaagctgaggccta

SEQ ID NO: 5391252 - DNA, 20 bp, Homo sapiens
ccagtgagaagggcctgctc

SEQ ID NO: 5391253 - DNA, 22 bp, Homo sapiens
ccagtgagaagggcctgctctg

SEQ ID NO: 5391254 - DNA, 13 bp, Homo sapiens
ccagtgagactgt

SEQ ID NO: 5391255 - DNA, 13 bp, Homo sapiens
ccagtgagatgca

SEQ ID NO: 5391256 - DNA, 19 bp, Homo sapiens
ccagtgagcagcctggagc

SEQ ID NO: 5391257 - DNA, 15 bp, Homo sapiens
ccagtgagcagtgtt

SEQ ID NO: 5391258 - DNA, 12 bp, Homo sapiens
ccagtgagccct

SEQ ID NO: 5391259 - DNA, 14 bp, Homo sapiens
ccagtgagccctgc

SEQ ID NO: 5391260 - DNA, 15 bp, Homo sapiens
ccagtgagccctgct

SEQ ID NO: 5391261 - DNA, 17 bp, Homo sapiens
ccagtgagccctgctct

SEQ ID NO: 5391262 - DNA, 14 bp, Homo sapiens
ccagtgagcctctg

SEQ ID NO: 5391263 - DNA, 15 bp, Homo sapiens
ccagtgagctggaat

SEQ ID NO: 5391264 - DNA, 16 bp, Homo sapiens
ccagtgaggacctcga

SEQ ID NO: 5391265 - DNA, 14 bp, Homo sapiens
ccagtgaggcatct

SEQ ID NO: 5391266 - DNA, 20 bp, Homo sapiens
ccagtgaggcatctctctgg

SEQ ID NO: 5391267 - DNA, 13 bp, Homo sapiens
ccagtgaggctct

SEQ ID NO: 5391268 - DNA, 15 bp, Homo sapiens
ccagtgaggctctgc

SEQ ID NO: 5391269 - DNA, 19 bp, Homo sapiens
ccagtgaggctctgccctt

SEQ ID NO: 5391270 - DNA, 14 bp, Homo sapiens
ccagtgagggctgg

SEQ ID NO: 5391271 - DNA, 18 bp, Homo sapiens
ccagtgagtacctgcaaa

SEQ ID NO: 5391272 - DNA, 23 bp, Homo sapiens
ccagtgagtacctgcaaaaatga

SEQ ID NO: 5391273 - DNA, 17 bp, Homo sapiens
ccagtgataatgcccca

SEQ ID NO: 5391274 - DNA, 13 bp, Homo sapiens
ccagtgatgatgt

SEQ ID NO: 5391275 - DNA, 12 bp, Homo sapiens
ccataatgccac

SEQ ID NO: 5391276 - DNA, 23 bp, Homo sapiens
ccataatgctaatttaaagagac

SEQ ID NO: 5391277 - DNA, 19 bp, Homo sapiens
ccataatgtataaagaaca

SEQ ID NO: 5391278 - DNA, 21 bp, Homo sapiens
ccataatgtctttaaatcact

SEQ ID NO: 5391279 - DNA, 14 bp, Homo sapiens
ccataattatgaaa

SEQ ID NO: 5391280 - DNA, 20 bp, Homo sapiens
ccataattatgacagttata

SEQ ID NO: 5391281 - DNA, 19 bp, Homo sapiens
ccataattgctttgccaaa

SEQ ID NO: 5391282 - DNA, 17 bp, Homo sapiens
ccataattttcttcatg

SEQ ID NO: 5391283 - DNA, 21 bp, Homo sapiens
ccataattttcttcatgcaat

SEQ ID NO: 5391284 - DNA, 23 bp, Homo sapiens
ccataattttcttcatgcaatga

SEQ ID NO: 5391285 - DNA, 20 bp, Homo sapiens
ccataattttgcatactgaa

SEQ ID NO: 5391286 - DNA, 23 bp, Homo sapiens
ccataattttgcatactgaaaat

SEQ ID NO: 5391287 - DNA, 16 bp, Homo sapiens
ccatacaatgtatgta

SEQ ID NO: 5391288 - DNA, 17 bp, Homo sapiens
ccatacaatgtatgtac

SEQ ID NO: 5391289 - DNA, 19 bp, Homo sapiens
ccatacaatttcatcctcc

SEQ ID NO: 5391290 - DNA, 12 bp, Homo sapiens
ccatacacacgc

SEQ ID NO: 5391291 - DNA, 18 bp, Homo sapiens
ccatacacacgctgcctt

SEQ ID NO: 5391292 - DNA, 15 bp, Homo sapiens
ccatacacagaggag

SEQ ID NO: 5391293 - DNA, 16 bp, Homo sapiens
ccatacacagaggagt

SEQ ID NO: 5391294 - DNA, 16 bp, Homo sapiens
ccatacagacagcaca

SEQ ID NO: 5391295 - DNA, 13 bp, Homo sapiens
ccatacagctcta

SEQ ID NO: 5391296 - DNA, 20 bp, Homo sapiens
ccatacagggtctcttcctt

SEQ ID NO: 5391297 - DNA, 22 bp, Homo sapiens
ccataccacccaatgctgatgt

SEQ ID NO: 5391298 - DNA, 14 bp, Homo sapiens
ccataccagctcgc

SEQ ID NO: 5391299 - DNA, 14 bp, Homo sapiens
ccataccagggtga

SEQ ID NO: 5391300 - DNA, 15 bp, Homo sapiens
ccataccaggtgcta

SEQ ID NO: 5391301 - DNA, 16 bp, Homo sapiens
ccataccagtcacctc

SEQ ID NO: 5391302 - DNA, 19 bp, Homo sapiens
ccataccagtcacctcctg

SEQ ID NO: 5391303 - DNA, 12 bp, Homo sapiens
ccatacccagct

SEQ ID NO: 5391304 - DNA, 23 bp, Homo sapiens
ccatacccagtctaggagctcct

SEQ ID NO: 5391305 - DNA, 15 bp, Homo sapiens
ccataccccctgccc

SEQ ID NO: 5391306 - DNA, 17 bp, Homo sapiens
ccataccccctgcccca

SEQ ID NO: 5391307 - DNA, 15 bp, Homo sapiens
ccatacccctgcctg

SEQ ID NO: 5391308 - DNA, 19 bp, Homo sapiens
ccataccccttattgctgc

SEQ ID NO: 5391309 - DNA, 23 bp, Homo sapiens
ccataccccttattgctgccaaa

SEQ ID NO: 5391310 - DNA, 17 bp, Homo sapiens
ccataccgaccatcgtc

SEQ ID NO: 5391311 - DNA, 22 bp, Homo sapiens
ccataccgaccatcgtccagcc

SEQ ID NO: 5391312 - DNA, 14 bp, Homo sapiens
ccataccgctgggg

SEQ ID NO: 5391313 - DNA, 16 bp, Homo sapiens
ccataccgctggggaa

SEQ ID NO: 5391314 - DNA, 13 bp, Homo sapiens
ccataccttctcc

SEQ ID NO: 5391315 - DNA, 19 bp, Homo sapiens
ccataccttctcccaggcc

SEQ ID NO: 5391316 - DNA, 13 bp, Homo sapiens
ccataccttttct

SEQ ID NO: 5391317 - DNA, 23 bp, Homo sapiens
ccatacgcgttctaggcatacaa

SEQ ID NO: 5391318 - DNA, 17 bp, Homo sapiens
ccatactaataaatata

SEQ ID NO: 5391319 - DNA, 14 bp, Homo sapiens
ccatactaatgatg

SEQ ID NO: 5391320 - DNA, 22 bp, Homo sapiens
ccatactcaaatggtgtcatgg

SEQ ID NO: 5391321 - DNA, 13 bp, Homo sapiens
ccatactcagcct

SEQ ID NO: 5391322 - DNA, 17 bp, Homo sapiens
ccatactggcctcgcct

SEQ ID NO: 5391323 - DNA, 15 bp, Homo sapiens
ccatactgtagacac

SEQ ID NO: 5391324 - DNA, 16 bp, Homo sapiens
ccatactgtagacact

SEQ ID NO: 5391325 - DNA, 14 bp, Homo sapiens
ccatactgtctctg

SEQ ID NO: 5391326 - DNA, 16 bp, Homo sapiens
ccatactgtctctgga

SEQ ID NO: 5391327 - DNA, 18 bp, Homo sapiens
ccatactgtctctggagt

SEQ ID NO: 5391328 - DNA, 17 bp, Homo sapiens
ccatacttatctctctg

SEQ ID NO: 5391329 - DNA, 18 bp, Homo sapiens
ccatacttccagcgaaat

SEQ ID NO: 5391330 - DNA, 14 bp, Homo sapiens
ccatacttcctggg

SEQ ID NO: 5391331 - DNA, 14 bp, Homo sapiens
ccatacttctctca

SEQ ID NO: 5391332 - DNA, 13 bp, Homo sapiens
ccatactttggat

SEQ ID NO: 5391333 - DNA, 20 bp, Homo sapiens
ccatagaaaaatgtataaaa

SEQ ID NO: 5391334 - DNA, 21 bp, Homo sapiens
ccatagaaaacaatctgccca

SEQ ID NO: 5391335 - DNA, 20 bp, Homo sapiens
ccatagaaaacttgacatgt

SEQ ID NO: 5391336 - DNA, 11 bp, Homo sapiens
ccatagaaaag

SEQ ID NO: 5391337 - DNA, 13 bp, Homo sapiens
ccatagaaacatg

SEQ ID NO: 5391338 - DNA, 19 bp, Homo sapiens
ccatagaagaacagcagat

SEQ ID NO: 5391339 - DNA, 19 bp, Homo sapiens
ccatagaccctgaggccct

SEQ ID NO: 5391340 - DNA, 12 bp, Homo sapiens
ccatagacctaa

SEQ ID NO: 5391341 - DNA, 17 bp, Homo sapiens
ccatagagaccaggagg

SEQ ID NO: 5391342 - DNA, 12 bp, Homo sapiens
ccatagagcagt

SEQ ID NO: 5391343 - DNA, 22 bp, Homo sapiens
ccatagagcccctcctggttga

SEQ ID NO: 5391344 - DNA, 14 bp, Homo sapiens
ccatagaggcccag

SEQ ID NO: 5391345 - DNA, 19 bp, Homo sapiens
ccatagaggcccaggcacc

SEQ ID NO: 5391346 - DNA, 21 bp, Homo sapiens
ccatagaggcccaggcaccac

SEQ ID NO: 5391347 - DNA, 18 bp, Homo sapiens
ccatagagtaatgatgta

SEQ ID NO: 5391348 - DNA, 16 bp, Homo sapiens
ccatagataggcccct

SEQ ID NO: 5391349 - DNA, 20 bp, Homo sapiens
ccatagataggcccctgggg

SEQ ID NO: 5391350 - DNA, 21 bp, Homo sapiens
ccatagatcttctgaaatgaa

SEQ ID NO: 5391351 - DNA, 14 bp, Homo sapiens
ccatagcaacagga

SEQ ID NO: 5391352 - DNA, 18 bp, Homo sapiens
ccatagcaagattgctta

SEQ ID NO: 5391353 - DNA, 13 bp, Homo sapiens
ccatagccccagg

SEQ ID NO: 5391354 - DNA, 14 bp, Homo sapiens
ccatagccccaggc

SEQ ID NO: 5391355 - DNA, 17 bp, Homo sapiens
ccatagccccaggcccg

SEQ ID NO: 5391356 - DNA, 23 bp, Homo sapiens
ccatagccccaggcccgccctgc

SEQ ID NO: 5391357 - DNA, 14 bp, Homo sapiens
ccatagccccagta

SEQ ID NO: 5391358 - DNA, 19 bp, Homo sapiens
ccatagcccttacctagag

SEQ ID NO: 5391359 - DNA, 17 bp, Homo sapiens
ccatagctattttcctt

SEQ ID NO: 5391360 - DNA, 15 bp, Homo sapiens
ccatagctcctgctc

SEQ ID NO: 5391361 - DNA, 19 bp, Homo sapiens
ccatagctcctgctccaca

SEQ ID NO: 5391362 - DNA, 14 bp, Homo sapiens
ccatagctgctgcc

SEQ ID NO: 5391363 - DNA, 19 bp, Homo sapiens
ccatagctggtttttccca

SEQ ID NO: 5391364 - DNA, 15 bp, Homo sapiens
ccatagcttccatga

SEQ ID NO: 5391365 - DNA, 20 bp, Homo sapiens
ccataggaagacataaaact

SEQ ID NO: 5391366 - DNA, 23 bp, Homo sapiens
ccataggaagacataaaacttta

SEQ ID NO: 5391367 - DNA, 15 bp, Homo sapiens
ccataggaatcatgt

SEQ ID NO: 5391368 - DNA, 21 bp, Homo sapiens
ccataggactaccgcaggccc

SEQ ID NO: 5391369 - DNA, 12 bp, Homo sapiens
ccataggagagg

SEQ ID NO: 5391370 - DNA, 17 bp, Homo sapiens
ccataggccaaggtgca

SEQ ID NO: 5391371 - DNA, 19 bp, Homo sapiens
ccataggcccacacacagg

SEQ ID NO: 5391372 - DNA, 14 bp, Homo sapiens
ccataggccctttc

SEQ ID NO: 5391373 - DNA, 20 bp, Homo sapiens
ccatagggtctgcagcctgc

SEQ ID NO: 5391374 - DNA, 23 bp, Homo sapiens
ccatagggtctgcagcctgctgg

SEQ ID NO: 5391375 - DNA, 15 bp, Homo sapiens
ccataggtagaatgt

SEQ ID NO: 5391376 - DNA, 16 bp, Homo sapiens
ccataggtttctctcc

SEQ ID NO: 5391377 - DNA, 18 bp, Homo sapiens
ccataggtttctctccct

SEQ ID NO: 5391378 - DNA, 20 bp, Homo sapiens
ccataggtttctctccctcc

SEQ ID NO: 5391379 - DNA, 16 bp, Homo sapiens
ccatagtaactgacat

SEQ ID NO: 5391380 - DNA, 21 bp, Homo sapiens
ccatagtaactgacatgatta

SEQ ID NO: 5391381 - DNA, 19 bp, Homo sapiens
ccatagtaccatttataca

SEQ ID NO: 5391382 - DNA, 14 bp, Homo sapiens
ccatagtagtatga

SEQ ID NO: 5391383 - DNA, 19 bp, Homo sapiens
ccatagtatatgatagatt

SEQ ID NO: 5391384 - DNA, 15 bp, Homo sapiens
ccatagtatattaaa

SEQ ID NO: 5391385 - DNA, 21 bp, Homo sapiens
ccatagtatgggactggcctc

SEQ ID NO: 5391386 - DNA, 15 bp, Homo sapiens
ccatagtcacatggc

SEQ ID NO: 5391387 - DNA, 14 bp, Homo sapiens
ccatagtccctgcc

SEQ ID NO: 5391388 - DNA, 15 bp, Homo sapiens
ccatagtcttaactg

SEQ ID NO: 5391389 - DNA, 18 bp, Homo sapiens
ccatagtcttaactggtc

SEQ ID NO: 5391390 - DNA, 12 bp, Homo sapiens
ccatagtgctgg

SEQ ID NO: 5391391 - DNA, 21 bp, Homo sapiens
ccatagtggatcactcaccat

SEQ ID NO: 5391392 - DNA, 20 bp, Homo sapiens
ccatagtggggcctgggagg

SEQ ID NO: 5391393 - DNA, 22 bp, Homo sapiens
ccatagttatttacttgaaaga

SEQ ID NO: 5391394 - DNA, 17 bp, Homo sapiens
ccatagttctgaggtcc

SEQ ID NO: 5391395 - DNA, 14 bp, Homo sapiens
ccatatactttaaa

SEQ ID NO: 5391396 - DNA, 16 bp, Homo sapiens
ccatatagctcgagca

SEQ ID NO: 5391397 - DNA, 22 bp, Homo sapiens
ccatatagctcgagcaaaattc

SEQ ID NO: 5391398 - DNA, 21 bp, Homo sapiens
ccatatagtttgttttctttt

SEQ ID NO: 5391399 - DNA, 12 bp, Homo sapiens
ccatatataaat

SEQ ID NO: 5391400 - DNA, 14 bp, Homo sapiens
ccatatataaatta

SEQ ID NO: 5391401 - DNA, 17 bp, Homo sapiens
ccatatataaattatta

SEQ ID NO: 5391402 - DNA, 22 bp, Homo sapiens
ccatatataaattattacttta

SEQ ID NO: 5391403 - DNA, 23 bp, Homo sapiens
ccatatataaattattactttaa

SEQ ID NO: 5391404 - DNA, 16 bp, Homo sapiens
ccatatataacagata

SEQ ID NO: 5391405 - DNA, 18 bp, Homo sapiens
ccatatatgctgtatttc

SEQ ID NO: 5391406 - DNA, 19 bp, Homo sapiens
ccatatatgctgtatttct

SEQ ID NO: 5391407 - DNA, 23 bp, Homo sapiens
ccatatatgctgtatttctttgt

SEQ ID NO: 5391408 - DNA, 23 bp, Homo sapiens
ccatatattaccccttcatgtcc

SEQ ID NO: 5391409 - DNA, 21 bp, Homo sapiens
ccatatcaaaagttgatttct

SEQ ID NO: 5391410 - DNA, 19 bp, Homo sapiens
ccatatcagacctctgatc

SEQ ID NO: 5391411 - DNA, 19 bp, Homo sapiens
ccatatccatagtgacttt

SEQ ID NO: 5391412 - DNA, 20 bp, Homo sapiens
ccatatccgggtgctcaata

SEQ ID NO: 5391413 - DNA, 14 bp, Homo sapiens
ccatatctccttcc

SEQ ID NO: 5391414 - DNA, 11 bp, Homo sapiens
ccatatctgtg

SEQ ID NO: 5391415 - DNA, 14 bp, Homo sapiens
ccatatctgtgcaa

SEQ ID NO: 5391416 - DNA, 17 bp, Homo sapiens
ccatatctgtgtgccct

SEQ ID NO: 5391417 - DNA, 20 bp, Homo sapiens
ccatatcttctgtttcataa

SEQ ID NO: 5391418 - DNA, 14 bp, Homo sapiens
ccatatcttgcgaa

SEQ ID NO: 5391419 - DNA, 22 bp, Homo sapiens
ccatatcttgcgaatccaagct

SEQ ID NO: 5391420 - DNA, 13 bp, Homo sapiens
ccatatgaatgaa

SEQ ID NO: 5391421 - DNA, 17 bp, Homo sapiens
ccatatgattgaaaaga

SEQ ID NO: 5391422 - DNA, 19 bp, Homo sapiens
ccatatgctaccaccagct

SEQ ID NO: 5391423 - DNA, 22 bp, Homo sapiens
ccatatgctaccaccagctgtg

SEQ ID NO: 5391424 - DNA, 23 bp, Homo sapiens
ccatatggaatagggatccactt

SEQ ID NO: 5391425 - DNA, 17 bp, Homo sapiens
ccatatggacactgtga

SEQ ID NO: 5391426 - DNA, 22 bp, Homo sapiens
ccatatggagcatttttcagag

SEQ ID NO: 5391427 - DNA, 16 bp, Homo sapiens
ccatatggaggactgt

SEQ ID NO: 5391428 - DNA, 22 bp, Homo sapiens
ccatatgtcagtgtaaatcctt

SEQ ID NO: 5391429 - DNA, 17 bp, Homo sapiens
ccatatgtctgcttctg

SEQ ID NO: 5391430 - DNA, 23 bp, Homo sapiens
ccatattaaaatcacaaactcat

SEQ ID NO: 5391431 - DNA, 14 bp, Homo sapiens
ccatattaaaatct

SEQ ID NO: 5391432 - DNA, 23 bp, Homo sapiens
ccatattaaattttttgttgaca

SEQ ID NO: 5391433 - DNA, 15 bp, Homo sapiens
ccatattaacaaatt

SEQ ID NO: 5391434 - DNA, 22 bp, Homo sapiens
ccatattaacaaattgcatttg

SEQ ID NO: 5391435 - DNA, 16 bp, Homo sapiens
ccatattacctggatt

SEQ ID NO: 5391436 - DNA, 16 bp, Homo sapiens
ccatattacgttgttt

SEQ ID NO: 5391437 - DNA, 17 bp, Homo sapiens
ccatattcacaatggaa

SEQ ID NO: 5391438 - DNA, 22 bp, Homo sapiens
ccatattcagtgctgtggcctg

SEQ ID NO: 5391439 - DNA, 19 bp, Homo sapiens
ccatattctggttcttgaa

SEQ ID NO: 5391440 - DNA, 15 bp, Homo sapiens
ccatattgctcttaa

SEQ ID NO: 5391441 - DNA, 19 bp, Homo sapiens
ccatattgctcttaaaaat

SEQ ID NO: 5391442 - DNA, 22 bp, Homo sapiens
ccatattgctcttaaaaatctt

SEQ ID NO: 5391443 - DNA, 12 bp, Homo sapiens
ccatattgtgta

SEQ ID NO: 5391444 - DNA, 15 bp, Homo sapiens
ccatatttacctcag

SEQ ID NO: 5391445 - DNA, 19 bp, Homo sapiens
ccatatttacctcagcctg

SEQ ID NO: 5391446 - DNA, 16 bp, Homo sapiens
ccatatttacttactg

SEQ ID NO: 5391447 - DNA, 14 bp, Homo sapiens
ccatatttatagaa

SEQ ID NO: 5391448 - DNA, 12 bp, Homo sapiens
ccatatttattc

SEQ ID NO: 5391449 - DNA, 14 bp, Homo sapiens
ccatatttgaattg

SEQ ID NO: 5391450 - DNA, 20 bp, Homo sapiens
ccatatttgaattggcctga

SEQ ID NO: 5391451 - DNA, 13 bp, Homo sapiens
ccatatttgtaaa

SEQ ID NO: 5391452 - DNA, 15 bp, Homo sapiens
ccatatttgtaaaat

SEQ ID NO: 5391453 - DNA, 19 bp, Homo sapiens
ccatctccaccctgagcct

SEQ ID NO: 5391454 - DNA, 24 bp, Homo sapiens
ccatctccaccctgagcctgacct

SEQ ID NO: 5391455 - DNA, 11 bp, Homo sapiens
ccatctccagc

SEQ ID NO: 5391456 - DNA, 18 bp, Homo sapiens
ccatctccagcatcctgc

SEQ ID NO: 5391457 - DNA, 14 bp, Homo sapiens
ccatctccagggag

SEQ ID NO: 5391458 - DNA, 14 bp, Homo sapiens
ccatctcccaaggc

SEQ ID NO: 5391459 - DNA, 15 bp, Homo sapiens
ccatctcccaaggct

SEQ ID NO: 5391460 - DNA, 16 bp, Homo sapiens
ccatctccccaggcct

SEQ ID NO: 5391461 - DNA, 18 bp, Homo sapiens
ccatctccccaggcctcc

SEQ ID NO: 5391462 - DNA, 23 bp, Homo sapiens
ccatctccccaggcctccagcct

SEQ ID NO: 5391463 - DNA, 13 bp, Homo sapiens
ccatctcccccat

SEQ ID NO: 5391464 - DNA, 23 bp, Homo sapiens
ccatctcccccatcccccactgc

SEQ ID NO: 5391465 - DNA, 16 bp, Homo sapiens
ccatctccctccccag

SEQ ID NO: 5391466 - DNA, 22 bp, Homo sapiens
ccatctccctccccagaaacag

SEQ ID NO: 5391467 - DNA, 13 bp, Homo sapiens
ccatctccctgcc

SEQ ID NO: 5391468 - DNA, 14 bp, Homo sapiens
ccatctccctgcct

SEQ ID NO: 5391469 - DNA, 18 bp, Homo sapiens
ccatctccctgcctggcc

SEQ ID NO: 5391470 - DNA, 16 bp, Homo sapiens
ccatctccctgctttg

SEQ ID NO: 5391471 - DNA, 19 bp, Homo sapiens
ccatctccctggtgcttat

SEQ ID NO: 5391472 - DNA, 19 bp, Homo sapiens
ccatctccgctgttttggg

SEQ ID NO: 5391473 - DNA, 22 bp, Homo sapiens
ccatctcctataatctgtcaaa

SEQ ID NO: 5391474 - DNA, 23 bp, Homo sapiens
ccatctcctataatctgtcaaaa

SEQ ID NO: 5391475 - DNA, 16 bp, Homo sapiens
ccatctccttacctct

SEQ ID NO: 5391476 - DNA, 21 bp, Homo sapiens
ccatctccttacctctggaac

SEQ ID NO: 5391477 - DNA, 16 bp, Homo sapiens
ccatctccttccccca

SEQ ID NO: 5391478 - DNA, 23 bp, Homo sapiens
ccatctccttcccccagcccaat

SEQ ID NO: 5391479 - DNA, 16 bp, Homo sapiens
ccatctcctttcaggg

SEQ ID NO: 5391480 - DNA, 18 bp, Homo sapiens
ccatctcctttcagggaa

SEQ ID NO: 5391481 - DNA, 19 bp, Homo sapiens
ccatctcctttctctggta

SEQ ID NO: 5391482 - DNA, 21 bp, Homo sapiens
ccatctcggagcatcccggag

SEQ ID NO: 5391483 - DNA, 17 bp, Homo sapiens
ccatctcggggctgctg

SEQ ID NO: 5391484 - DNA, 16 bp, Homo sapiens
ccatctctaccccctc

SEQ ID NO: 5391485 - DNA, 18 bp, Homo sapiens
ccatctctcccacttcct

SEQ ID NO: 5391486 - DNA, 21 bp, Homo sapiens
ccatctctcccacttcctcct

SEQ ID NO: 5391487 - DNA, 18 bp, Homo sapiens
ccatctctccctcctggt

SEQ ID NO: 5391488 - DNA, 14 bp, Homo sapiens
ccatctctcttccc

SEQ ID NO: 5391489 - DNA, 13 bp, Homo sapiens
ccatctctgaact

SEQ ID NO: 5391490 - DNA, 18 bp, Homo sapiens
ccatctctgaacttcagc

SEQ ID NO: 5391491 - DNA, 19 bp, Homo sapiens
ccatctctgaacttcagct

SEQ ID NO: 5391492 - DNA, 13 bp, Homo sapiens
ccatctctgctcc

SEQ ID NO: 5391493 - DNA, 20 bp, Homo sapiens
ccatctctgctgcttctggg

SEQ ID NO: 5391494 - DNA, 18 bp, Homo sapiens
ccatctctggatgcctga

SEQ ID NO: 5391495 - DNA, 12 bp, Homo sapiens
ccatctctgtag

SEQ ID NO: 5391496 - DNA, 18 bp, Homo sapiens
ccatctctgtctggggct

SEQ ID NO: 5391497 - DNA, 23 bp, Homo sapiens
ccatctctgtctggggctacaga

SEQ ID NO: 5391498 - DNA, 13 bp, Homo sapiens
ccatctcttcctt

SEQ ID NO: 5391499 - DNA, 14 bp, Homo sapiens
ccatctcttccttc

SEQ ID NO: 5391500 - DNA, 15 bp, Homo sapiens
ccatctcttccttca

SEQ ID NO: 5391501 - DNA, 15 bp, Homo sapiens
ccatctcttcctttc

SEQ ID NO: 5391502 - DNA, 13 bp, Homo sapiens
ccatctgaagagt

SEQ ID NO: 5391503 - DNA, 16 bp, Homo sapiens
ccatctgaccgttttc

SEQ ID NO: 5391504 - DNA, 14 bp, Homo sapiens
ccatctgactgcca

SEQ ID NO: 5391505 - DNA, 12 bp, Homo sapiens
ccatctgagctg

SEQ ID NO: 5391506 - DNA, 16 bp, Homo sapiens
ccatctgatatctata

SEQ ID NO: 5391507 - DNA, 14 bp, Homo sapiens
ccatctgcacccct

SEQ ID NO: 5391508 - DNA, 17 bp, Homo sapiens
ccatctgcaccccttct

SEQ ID NO: 5391509 - DNA, 16 bp, Homo sapiens
ccatctgccaatgcca

SEQ ID NO: 5391510 - DNA, 16 bp, Homo sapiens
ccatctgcccaggacg

SEQ ID NO: 5391511 - DNA, 17 bp, Homo sapiens
ccatctgcccaggggtg

SEQ ID NO: 5391512 - DNA, 20 bp, Homo sapiens
ccatctgccccacagtctcc

SEQ ID NO: 5391513 - DNA, 18 bp, Homo sapiens
ccatctgcccgcctgccc

SEQ ID NO: 5391514 - DNA, 21 bp, Homo sapiens
ccatctgcgggggcagtgctc

SEQ ID NO: 5391515 - DNA, 22 bp, Homo sapiens
ccatctgcgggggcagtgctca

SEQ ID NO: 5391516 - DNA, 22 bp, Homo sapiens
ccatctgcgtgacaataaaaca

SEQ ID NO: 5391517 - DNA, 23 bp, Homo sapiens
ccatctgcgtgacaataaaacat

SEQ ID NO: 5391518 - DNA, 11 bp, Homo sapiens
ccatctgctga

SEQ ID NO: 5391519 - DNA, 13 bp, Homo sapiens
ccatctgctgcag

SEQ ID NO: 5391520 - DNA, 22 bp, Homo sapiens
ccatctgctgtcttttctttgc

SEQ ID NO: 5391521 - DNA, 23 bp, Homo sapiens
ccatctgcttttattaaatttgt

SEQ ID NO: 5391522 - DNA, 19 bp, Homo sapiens
ccatctggagagcccagag

SEQ ID NO: 5391523 - DNA, 14 bp, Homo sapiens
ccatctggaggctc

SEQ ID NO: 5391524 - DNA, 18 bp, Homo sapiens
ccatctggaggctcccat

SEQ ID NO: 5391525 - DNA, 15 bp, Homo sapiens
ccatctggatgtaaa

SEQ ID NO: 5391526 - DNA, 16 bp, Homo sapiens
ccatctggatgtaaat

SEQ ID NO: 5391527 - DNA, 14 bp, Homo sapiens
ccatctggcagggt

SEQ ID NO: 5391528 - DNA, 15 bp, Homo sapiens
ccatctggcccaggc

SEQ ID NO: 5391529 - DNA, 17 bp, Homo sapiens
ccatctggcccaggctg

SEQ ID NO: 5391530 - DNA, 18 bp, Homo sapiens
ccatctggcccaggctgg

SEQ ID NO: 5391531 - DNA, 12 bp, Homo sapiens
ccatctggcctg

SEQ ID NO: 5391532 - DNA, 16 bp, Homo sapiens
ccatctggcctggcct

SEQ ID NO: 5391533 - DNA, 17 bp, Homo sapiens
ccatctggcctggcctg

SEQ ID NO: 5391534 - DNA, 18 bp, Homo sapiens
ccatctggcctggcctgg

SEQ ID NO: 5391535 - DNA, 21 bp, Homo sapiens
ccatctggctttttctgccac

SEQ ID NO: 5391536 - DNA, 16 bp, Homo sapiens
ccatctgggagtcccc

SEQ ID NO: 5391537 - DNA, 12 bp, Homo sapiens
ccatctgggctc

SEQ ID NO: 5391538 - DNA, 15 bp, Homo sapiens
ccatctggggatgga

SEQ ID NO: 5391539 - DNA, 16 bp, Homo sapiens
ccatctggtcatttgg

SEQ ID NO: 5391540 - DNA, 16 bp, Homo sapiens
ccatctggtgcctttc

SEQ ID NO: 5391541 - DNA, 16 bp, Homo sapiens
ccatctggttttctct

SEQ ID NO: 5391542 - DNA, 11 bp, Homo sapiens
ccatctgtaaa

SEQ ID NO: 5391543 - DNA, 19 bp, Homo sapiens
ccatctgtaaaggggcagc

SEQ ID NO: 5391544 - DNA, 13 bp, Homo sapiens
ccatctgtaaata

SEQ ID NO: 5391545 - DNA, 20 bp, Homo sapiens
ccatctgtccagctggggcc

SEQ ID NO: 5391546 - DNA, 21 bp, Homo sapiens
ccatctgtccatcctcctctc

SEQ ID NO: 5391547 - DNA, 19 bp, Homo sapiens
ccatctgtctaaagataga

SEQ ID NO: 5391548 - DNA, 12 bp, Homo sapiens
ccatctgtctgt

SEQ ID NO: 5391549 - DNA, 11 bp, Homo sapiens
ccatctgtctt

SEQ ID NO: 5391550 - DNA, 20 bp, Homo sapiens
ccatctgtcttgccagccag

SEQ ID NO: 5391551 - DNA, 21 bp, Homo sapiens
ccatctgtcttgccagccaga

SEQ ID NO: 5391552 - DNA, 12 bp, Homo sapiens
ccatctgtgaat

SEQ ID NO: 5391553 - DNA, 14 bp, Homo sapiens
ccatctgtgaataa

SEQ ID NO: 5391554 - DNA, 22 bp, Homo sapiens
ccatctgtgactataaagctgt

SEQ ID NO: 5391555 - DNA, 15 bp, Homo sapiens
ccatctgtgcacact

SEQ ID NO: 5391556 - DNA, 12 bp, Homo sapiens
ccatctgtggga

SEQ ID NO: 5391557 - DNA, 22 bp, Homo sapiens
ccatctgtgggcacgctgtggg

SEQ ID NO: 5391558 - DNA, 16 bp, Homo sapiens
ccatctgtgtgtgaat

SEQ ID NO: 5391559 - DNA, 13 bp, Homo sapiens
ccatctgtgttct

SEQ ID NO: 5391560 - DNA, 14 bp, Homo sapiens
ccatctgtgttcta

SEQ ID NO: 5391561 - DNA, 16 bp, Homo sapiens
ccatctgtttgttttt

SEQ ID NO: 5391562 - DNA, 17 bp, Homo sapiens
ccatcttaaatttctaa

SEQ ID NO: 5391563 - DNA, 15 bp, Homo sapiens
ccatcttaatcttta

SEQ ID NO: 5391564 - DNA, 20 bp, Homo sapiens
ccatcttacagagactctcc

SEQ ID NO: 5391565 - DNA, 23 bp, Homo sapiens
ccatcttacagagactctccctg

SEQ ID NO: 5391566 - DNA, 18 bp, Homo sapiens
ccatcttactctgcccta

SEQ ID NO: 5391567 - DNA, 16 bp, Homo sapiens
ccatcttcacccaggc

SEQ ID NO: 5391568 - DNA, 13 bp, Homo sapiens
ccatcttcactct

SEQ ID NO: 5391569 - DNA, 17 bp, Homo sapiens
ccatcttcactcttcac

SEQ ID NO: 5391570 - DNA, 14 bp, Homo sapiens
ccatcttcatccca

SEQ ID NO: 5391571 - DNA, 24 bp, Homo sapiens
ccatcttcatcccaacagcccagc

SEQ ID NO: 5391572 - DNA, 19 bp, Homo sapiens
ccatcttccacctgtgccc

SEQ ID NO: 5391573 - DNA, 15 bp, Homo sapiens
ccatcttccaggtgg

SEQ ID NO: 5391574 - DNA, 17 bp, Homo sapiens
ccatcttccatatccgg

SEQ ID NO: 5391575 - DNA, 13 bp, Homo sapiens
ccatcttcccagc

SEQ ID NO: 5391576 - DNA, 19 bp, Homo sapiens
ccatcttcccgcctcagcc

SEQ ID NO: 5391577 - DNA, 21 bp, Homo sapiens
ccatcttcccgcctcagcctc

SEQ ID NO: 5391578 - DNA, 21 bp, Homo sapiens
ccatcttccctacccttcctg

SEQ ID NO: 5391579 - DNA, 22 bp, Homo sapiens
ccatcttccctacccttcctgc

SEQ ID NO: 5391580 - DNA, 14 bp, Homo sapiens
ccatcttcctgctg

SEQ ID NO: 5391581 - DNA, 18 bp, Homo sapiens
ccatcttcgggaccagga

SEQ ID NO: 5391582 - DNA, 16 bp, Homo sapiens
ccatcttctccccaca

SEQ ID NO: 5391583 - DNA, 12 bp, Homo sapiens
ccatcttctttc

SEQ ID NO: 5391584 - DNA, 18 bp, Homo sapiens
ccatcttctttcttccac

SEQ ID NO: 5391585 - DNA, 22 bp, Homo sapiens
ccatcttctttcttccacccac

SEQ ID NO: 5391586 - DNA, 14 bp, Homo sapiens
ccatcttgagatgg

SEQ ID NO: 5391587 - DNA, 22 bp, Homo sapiens
ccatcttgagatggtgaggctg

SEQ ID NO: 5391588 - DNA, 16 bp, Homo sapiens
ccatcttgagccacag

SEQ ID NO: 5391589 - DNA, 19 bp, Homo sapiens
ccatcttgcccgctcaggc

SEQ ID NO: 5391590 - DNA, 15 bp, Homo sapiens
ccatcttgcttccaa

SEQ ID NO: 5391591 - DNA, 17 bp, Homo sapiens
ccatcttggcagggtta

SEQ ID NO: 5391592 - DNA, 12 bp, Homo sapiens
ccatcttgggat

SEQ ID NO: 5391593 - DNA, 22 bp, Homo sapiens
ccatcttgggggtcacccatgg

SEQ ID NO: 5391594 - DNA, 14 bp, Homo sapiens
ccatcttggtaaat

SEQ ID NO: 5391595 - DNA, 22 bp, Homo sapiens
ccatcttggtagttctgtgcct

SEQ ID NO: 5391596 - DNA, 19 bp, Homo sapiens
ccatcttgtggggccagga

SEQ ID NO: 5391597 - DNA, 15 bp, Homo sapiens
ccatcttgtttcatt

SEQ ID NO: 5391598 - DNA, 22 bp, Homo sapiens
ccatcttgtttcatttgcttgc

SEQ ID NO: 5391599 - DNA, 15 bp, Homo sapiens
ccatctttagcagtt

SEQ ID NO: 5391600 - DNA, 19 bp, Homo sapiens
ccatctttagcagtttcct

SEQ ID NO: 5391601 - DNA, 21 bp, Homo sapiens
ccatctttagcagtttcctca

SEQ ID NO: 5391602 - DNA, 23 bp, Homo sapiens
ccatctttagcagtttcctcagt

SEQ ID NO: 5391603 - DNA, 24 bp, Homo sapiens
ccatctttatagaaggaatttgta

SEQ ID NO: 5391604 - DNA, 14 bp, Homo sapiens
ccatctttgaactt

SEQ ID NO: 5391605 - DNA, 18 bp, Homo sapiens
ccatctttgcaggttgct

SEQ ID NO: 5391606 - DNA, 15 bp, Homo sapiens
ccatctttttcttgg

SEQ ID NO: 5391607 - DNA, 21 bp, Homo sapiens
ccatgaaaacgttttattgtg

SEQ ID NO: 5391608 - DNA, 17 bp, Homo sapiens
ccatgaaaagttttcaa

SEQ ID NO: 5391609 - DNA, 13 bp, Homo sapiens
ccatgaaacaaag

SEQ ID NO: 5391610 - DNA, 10 bp, Homo sapiens
ccatgaaaga

SEQ ID NO: 5391611 - DNA, 14 bp, Homo sapiens
ccatgaaagaaaac

SEQ ID NO: 5391612 - DNA, 15 bp, Homo sapiens
ccatgaaattgaccc

SEQ ID NO: 5391613 - DNA, 12 bp, Homo sapiens
ccatgaacaaat

SEQ ID NO: 5391614 - DNA, 15 bp, Homo sapiens
ccatgaacaaattct

SEQ ID NO: 5391615 - DNA, 21 bp, Homo sapiens
ccatgaacacactgtgtcctg

SEQ ID NO: 5391616 - DNA, 22 bp, Homo sapiens
ccatgaacagaaaacattctga

SEQ ID NO: 5391617 - DNA, 15 bp, Homo sapiens
ccatgaaccaagacc

SEQ ID NO: 5391618 - DNA, 13 bp, Homo sapiens
ccatgaactggag

SEQ ID NO: 5391619 - DNA, 22 bp, Homo sapiens
ccatgaactgtcaagtgtgtgt

SEQ ID NO: 5391620 - DNA, 14 bp, Homo sapiens
ccatgaacttgata

SEQ ID NO: 5391621 - DNA, 17 bp, Homo sapiens
ccatgaagaaagcccct

SEQ ID NO: 5391622 - DNA, 20 bp, Homo sapiens
ccatgaagacacgcttaaaa

SEQ ID NO: 5391623 - DNA, 19 bp, Homo sapiens
ccatgaagacaggacagtg

SEQ ID NO: 5391624 - DNA, 14 bp, Homo sapiens
ccatgaagagactc

SEQ ID NO: 5391625 - DNA, 19 bp, Homo sapiens
ccatgaagaggatgctgtg

SEQ ID NO: 5391626 - DNA, 13 bp, Homo sapiens
ccatgaagcatta

SEQ ID NO: 5391627 - DNA, 16 bp, Homo sapiens
ccatgaagccacagcc

SEQ ID NO: 5391628 - DNA, 19 bp, Homo sapiens
ccatgaagccacagcccag

SEQ ID NO: 5391629 - DNA, 11 bp, Homo sapiens
ccatgaagcct

SEQ ID NO: 5391630 - DNA, 13 bp, Homo sapiens
ccatgaagccttt

SEQ ID NO: 5391631 - DNA, 18 bp, Homo sapiens
ccatgaagctggaagcac

SEQ ID NO: 5391632 - DNA, 17 bp, Homo sapiens
ccatgtgtcctggttcc

SEQ ID NO: 5391633 - DNA, 17 bp, Homo sapiens
ccatgtgtgatgctgac

SEQ ID NO: 5391634 - DNA, 21 bp, Homo sapiens
ccatgtgtgctaatatacttt

SEQ ID NO: 5391635 - DNA, 20 bp, Homo sapiens
ccatgtgtgtcagcccatgt

SEQ ID NO: 5391636 - DNA, 12 bp, Homo sapiens
ccatgtgtgtgc

SEQ ID NO: 5391637 - DNA, 16 bp, Homo sapiens
ccatgtgtgtgccaag

SEQ ID NO: 5391638 - DNA, 17 bp, Homo sapiens
ccatgtgtgtgccaagc

SEQ ID NO: 5391639 - DNA, 12 bp, Homo sapiens
ccatgtgttcca

SEQ ID NO: 5391640 - DNA, 14 bp, Homo sapiens
ccatgttaaatgac

SEQ ID NO: 5391641 - DNA, 16 bp, Homo sapiens
ccatgttaaatgactt

SEQ ID NO: 5391642 - DNA, 20 bp, Homo sapiens
ccatgttaagtcctccctga

SEQ ID NO: 5391643 - DNA, 21 bp, Homo sapiens
ccatgttaatacatcattttt

SEQ ID NO: 5391644 - DNA, 16 bp, Homo sapiens
ccatgttaatatttga

SEQ ID NO: 5391645 - DNA, 20 bp, Homo sapiens
ccatgttaatatttgaattg

SEQ ID NO: 5391646 - DNA, 22 bp, Homo sapiens
ccatgttaatttcatgtgtcaa

SEQ ID NO: 5391647 - DNA, 14 bp, Homo sapiens
ccatgttacttctc

SEQ ID NO: 5391648 - DNA, 15 bp, Homo sapiens
ccatgttacttctct

SEQ ID NO: 5391649 - DNA, 21 bp, Homo sapiens
ccatgttagggttatgttttt

SEQ ID NO: 5391650 - DNA, 19 bp, Homo sapiens
ccatgttatattgcttcct

SEQ ID NO: 5391651 - DNA, 13 bp, Homo sapiens
ccatgttcattat

SEQ ID NO: 5391652 - DNA, 18 bp, Homo sapiens
ccatgttcattataatct

SEQ ID NO: 5391653 - DNA, 18 bp, Homo sapiens
ccatgttccaataaacag

SEQ ID NO: 5391654 - DNA, 12 bp, Homo sapiens
ccatgttccctt

SEQ ID NO: 5391655 - DNA, 23 bp, Homo sapiens
ccatgttctatttcagtgccaat

SEQ ID NO: 5391656 - DNA, 17 bp, Homo sapiens
ccatgttctatttttga

SEQ ID NO: 5391657 - DNA, 14 bp, Homo sapiens
ccatgttctgcccc

SEQ ID NO: 5391658 - DNA, 17 bp, Homo sapiens
ccatgttctgcccccag

SEQ ID NO: 5391659 - DNA, 21 bp, Homo sapiens
ccatgttctgcccccagccca

SEQ ID NO: 5391660 - DNA, 19 bp, Homo sapiens
ccatgttgacgagactggt

SEQ ID NO: 5391661 - DNA, 22 bp, Homo sapiens
ccatgttgacgagactggtctc

SEQ ID NO: 5391662 - DNA, 16 bp, Homo sapiens
ccatgttgactgtctt

SEQ ID NO: 5391663 - DNA, 19 bp, Homo sapiens
ccatgttgcactgtttgca

SEQ ID NO: 5391664 - DNA, 19 bp, Homo sapiens
ccatgttgcatgcctatgt

SEQ ID NO: 5391665 - DNA, 13 bp, Homo sapiens
ccatgttgcccag

SEQ ID NO: 5391666 - DNA, 15 bp, Homo sapiens
ccatgttgcccagaa

SEQ ID NO: 5391667 - DNA, 14 bp, Homo sapiens
ccatgttgcgttca

SEQ ID NO: 5391668 - DNA, 13 bp, Homo sapiens
ccatgttgctgcc

SEQ ID NO: 5391669 - DNA, 14 bp, Homo sapiens
ccatgttgctgcca

SEQ ID NO: 5391670 - DNA, 14 bp, Homo sapiens
ccatgttggccagg

SEQ ID NO: 5391671 - DNA, 20 bp, Homo sapiens
ccatgttggccaggatggtc

SEQ ID NO: 5391672 - DNA, 22 bp, Homo sapiens
ccatgttggccaggatggtctc

SEQ ID NO: 5391673 - DNA, 15 bp, Homo sapiens
ccatgttggccaggc

SEQ ID NO: 5391674 - DNA, 20 bp, Homo sapiens
ccatgttggccaggctgctc

SEQ ID NO: 5391675 - DNA, 21 bp, Homo sapiens
ccatgttggccaggctgctct

SEQ ID NO: 5391676 - DNA, 13 bp, Homo sapiens
ccatgttggcctc

SEQ ID NO: 5391677 - DNA, 17 bp, Homo sapiens
ccatgttggcctcttca

SEQ ID NO: 5391678 - DNA, 13 bp, Homo sapiens
ccatgttggctag

SEQ ID NO: 5391679 - DNA, 18 bp, Homo sapiens
ccatgttggtcaggctgg

SEQ ID NO: 5391680 - DNA, 18 bp, Homo sapiens
ccatgttgtaatgctgca

SEQ ID NO: 5391681 - DNA, 13 bp, Homo sapiens
ccatgttgtgttc

SEQ ID NO: 5391682 - DNA, 14 bp, Homo sapiens
ccatgtttaagatt

SEQ ID NO: 5391683 - DNA, 13 bp, Homo sapiens
ccatgtttagtga

SEQ ID NO: 5391684 - DNA, 21 bp, Homo sapiens
ccatgtttagtgaatgacttt

SEQ ID NO: 5391685 - DNA, 13 bp, Homo sapiens
ccatgtttattac

SEQ ID NO: 5391686 - DNA, 20 bp, Homo sapiens
ccatgtttattacagtataa

SEQ ID NO: 5391687 - DNA, 14 bp, Homo sapiens
ccatgtttgtaaaa

SEQ ID NO: 5391688 - DNA, 21 bp, Homo sapiens
ccatgtttgtggctattaaaa

SEQ ID NO: 5391689 - DNA, 12 bp, Homo sapiens
ccatgttttaaa

SEQ ID NO: 5391690 - DNA, 21 bp, Homo sapiens
ccatgttttaaaattatatag

SEQ ID NO: 5391691 - DNA, 18 bp, Homo sapiens
ccatgttttgtttacggt

SEQ ID NO: 5391692 - DNA, 20 bp, Homo sapiens
ccatgtttttcccctgctcc

SEQ ID NO: 5391693 - DNA, 20 bp, Homo sapiens
ccattaaaactgaagtctga

SEQ ID NO: 5391694 - DNA, 14 bp, Homo sapiens
ccattaaaataaaa

SEQ ID NO: 5391695 - DNA, 16 bp, Homo sapiens
ccattaaaataaaaca

SEQ ID NO: 5391696 - DNA, 23 bp, Homo sapiens
ccattaaaataaaacaagcctta

SEQ ID NO: 5391697 - DNA, 19 bp, Homo sapiens
ccattaaaccatctccctg

SEQ ID NO: 5391698 - DNA, 12 bp, Homo sapiens
ccattaaagaat

SEQ ID NO: 5391699 - DNA, 20 bp, Homo sapiens
ccattaaagaatatgaaaca

SEQ ID NO: 5391700 - DNA, 15 bp, Homo sapiens
ccattaaagttctca

SEQ ID NO: 5391701 - DNA, 20 bp, Homo sapiens
ccattaaatccgcaaacagc

SEQ ID NO: 5391702 - DNA, 13 bp, Homo sapiens
ccattaacatttt

SEQ ID NO: 5391703 - DNA, 14 bp, Homo sapiens
ccattaactgcttt

SEQ ID NO: 5391704 - DNA, 20 bp, Homo sapiens
ccattaagtaaacaataaaa

SEQ ID NO: 5391705 - DNA, 12 bp, Homo sapiens
ccattaataaag

SEQ ID NO: 5391706 - DNA, 22 bp, Homo sapiens
ccattaatacttccttataaaa

SEQ ID NO: 5391707 - DNA, 23 bp, Homo sapiens
ccattaatacttccttataaaaa

SEQ ID NO: 5391708 - DNA, 14 bp, Homo sapiens
ccattaatcttgat

SEQ ID NO: 5391709 - DNA, 21 bp, Homo sapiens
ccattaatcttgatcattccg

SEQ ID NO: 5391710 - DNA, 12 bp, Homo sapiens
ccattaatttaa

SEQ ID NO: 5391711 - DNA, 23 bp, Homo sapiens
ccattacagaggtattaaaacta

SEQ ID NO: 5391712 - DNA, 15 bp, Homo sapiens
ccattacatgtttaa

SEQ ID NO: 5391713 - DNA, 16 bp, Homo sapiens
ccattaccatgtaatg

SEQ ID NO: 5391714 - DNA, 14 bp, Homo sapiens
ccattacccagtgc

SEQ ID NO: 5391715 - DNA, 22 bp, Homo sapiens
ccattacctccatccatccttc

SEQ ID NO: 5391716 - DNA, 23 bp, Homo sapiens
ccattactctgcggtggtgccag

SEQ ID NO: 5391717 - DNA, 21 bp, Homo sapiens
ccattactgtgatttctggct

SEQ ID NO: 5391718 - DNA, 14 bp, Homo sapiens
ccattagaatgtga

SEQ ID NO: 5391719 - DNA, 15 bp, Homo sapiens
ccattagcataattt

SEQ ID NO: 5391720 - DNA, 15 bp, Homo sapiens
ccattaggcatgcct

SEQ ID NO: 5391721 - DNA, 14 bp, Homo sapiens
ccattaggccagca

SEQ ID NO: 5391722 - DNA, 16 bp, Homo sapiens
ccattatagcgcctgt

SEQ ID NO: 5391723 - DNA, 19 bp, Homo sapiens
ccattatatttattgttta

SEQ ID NO: 5391724 - DNA, 23 bp, Homo sapiens
ccattatatttattgtttatttt

SEQ ID NO: 5391725 - DNA, 21 bp, Homo sapiens
ccattatccctgaatccccct

SEQ ID NO: 5391726 - DNA, 15 bp, Homo sapiens
ccattatctgctgtt

SEQ ID NO: 5391727 - DNA, 17 bp, Homo sapiens
ccattatctgctgttcc

SEQ ID NO: 5391728 - DNA, 14 bp, Homo sapiens
ccattatgaaaatc

SEQ ID NO: 5391729 - DNA, 19 bp, Homo sapiens
ccattatgcaaatggagat

SEQ ID NO: 5391730 - DNA, 15 bp, Homo sapiens
ccattatgtcctagt

SEQ ID NO: 5391731 - DNA, 19 bp, Homo sapiens
ccattattaacccattttt

SEQ ID NO: 5391732 - DNA, 14 bp, Homo sapiens
ccattattatttct

SEQ ID NO: 5391733 - DNA, 11 bp, Homo sapiens
ccattattcaa

SEQ ID NO: 5391734 - DNA, 16 bp, Homo sapiens
ccattatttaataaga

SEQ ID NO: 5391735 - DNA, 19 bp, Homo sapiens
ccattattttacagtctct

SEQ ID NO: 5391736 - DNA, 18 bp, Homo sapiens
ccattatttttaggatgt

SEQ ID NO: 5391737 - DNA, 22 bp, Homo sapiens
ccattcaaacaggtcgagctgt

SEQ ID NO: 5391738 - DNA, 13 bp, Homo sapiens
ccattcaattagt

SEQ ID NO: 5391739 - DNA, 16 bp, Homo sapiens
ccattcacaagcctcc

SEQ ID NO: 5391740 - DNA, 17 bp, Homo sapiens
ccattcacaagcctcct

SEQ ID NO: 5391741 - DNA, 18 bp, Homo sapiens
ccattcacaagcctcctg

SEQ ID NO: 5391742 - DNA, 19 bp, Homo sapiens
ccattcacaataaaagctt

SEQ ID NO: 5391743 - DNA, 13 bp, Homo sapiens
ccattcacatttt

SEQ ID NO: 5391744 - DNA, 14 bp, Homo sapiens
ccattcacatttta

SEQ ID NO: 5391745 - DNA, 23 bp, Homo sapiens
ccattcacggcctggcatgcagc

SEQ ID NO: 5391746 - DNA, 21 bp, Homo sapiens
ccattcactactcatgcgtga

SEQ ID NO: 5391747 - DNA, 13 bp, Homo sapiens
ccattcactccca

SEQ ID NO: 5391748 - DNA, 17 bp, Homo sapiens
ccattcactcttccaga

SEQ ID NO: 5391749 - DNA, 17 bp, Homo sapiens
ccattcactttcaggaa

SEQ ID NO: 5391750 - DNA, 20 bp, Homo sapiens
ccattcagaaagcttcaaat

SEQ ID NO: 5391751 - DNA, 18 bp, Homo sapiens
ccattcagaactctcaga

SEQ ID NO: 5391752 - DNA, 20 bp, Homo sapiens
ccattcagaatatcatcttt

SEQ ID NO: 5391753 - DNA, 16 bp, Homo sapiens
ccattcagacacttca

SEQ ID NO: 5391754 - DNA, 22 bp, Homo sapiens
ccattcagcccatttcacacct

SEQ ID NO: 5391755 - DNA, 12 bp, Homo sapiens
ccattcagcctc

SEQ ID NO: 5391756 - DNA, 13 bp, Homo sapiens
ccattcagcctcg

SEQ ID NO: 5391757 - DNA, 21 bp, Homo sapiens
ccattcaggaacctggaccaa

SEQ ID NO: 5391758 - DNA, 11 bp, Homo sapiens
ccattcagtca

SEQ ID NO: 5391759 - DNA, 18 bp, Homo sapiens
ccattcagtctatgctgt

SEQ ID NO: 5391760 - DNA, 16 bp, Homo sapiens
ccattcagtctgcagc

SEQ ID NO: 5391761 - DNA, 20 bp, Homo sapiens
ccattcagtgattactgtca

SEQ ID NO: 5391762 - DNA, 15 bp, Homo sapiens
ccattcatacacaac

SEQ ID NO: 5391763 - DNA, 20 bp, Homo sapiens
ccattcatactaaataaaac

SEQ ID NO: 5391764 - DNA, 18 bp, Homo sapiens
ccattcatctctaacata

SEQ ID NO: 5391765 - DNA, 18 bp, Homo sapiens
ccattcatctgggctggc

SEQ ID NO: 5391766 - DNA, 15 bp, Homo sapiens
ccattcatgtcctgt

SEQ ID NO: 5391767 - DNA, 13 bp, Homo sapiens
ccattcattccat

SEQ ID NO: 5391768 - DNA, 20 bp, Homo sapiens
ccattcattccattctggaa

SEQ ID NO: 5391769 - DNA, 22 bp, Homo sapiens
ccattcattctggtcatttccc

SEQ ID NO: 5391770 - DNA, 16 bp, Homo sapiens
ccattcatttacaact

SEQ ID NO: 5391771 - DNA, 11 bp, Homo sapiens
ccattccaaaa

SEQ ID NO: 5391772 - DNA, 15 bp, Homo sapiens
ccattccaaaataca

SEQ ID NO: 5391773 - DNA, 21 bp, Homo sapiens
ccattccaaaatattatgccc

SEQ ID NO: 5391774 - DNA, 16 bp, Homo sapiens
ccattccaaagcttta

SEQ ID NO: 5391775 - DNA, 18 bp, Homo sapiens
ccattccactccactcag

SEQ ID NO: 5391776 - DNA, 16 bp, Homo sapiens
ccattccagaatatct

SEQ ID NO: 5391777 - DNA, 19 bp, Homo sapiens
ccattccagagctgcagaa

SEQ ID NO: 5391778 - DNA, 20 bp, Homo sapiens
ccattccagtacagtattct

SEQ ID NO: 5391779 - DNA, 15 bp, Homo sapiens
ccattccatggaaat

SEQ ID NO: 5391780 - DNA, 18 bp, Homo sapiens
ccattccatggaaataaa

SEQ ID NO: 5391781 - DNA, 14 bp, Homo sapiens
ccattcccaagcca

SEQ ID NO: 5391782 - DNA, 15 bp, Homo sapiens
ccattcccatggagt

SEQ ID NO: 5391783 - DNA, 18 bp, Homo sapiens
ccattccccagcctctct

SEQ ID NO: 5391784 - DNA, 17 bp, Homo sapiens
ccattcccccatgtggc

SEQ ID NO: 5391785 - DNA, 17 bp, Homo sapiens
ccattcccgtggtctcc

SEQ ID NO: 5391786 - DNA, 11 bp, Homo sapiens
ccattccctag

SEQ ID NO: 5391787 - DNA, 15 bp, Homo sapiens
ccattccctagtcat

SEQ ID NO: 5391788 - DNA, 15 bp, Homo sapiens
ccattccctgcctgg

SEQ ID NO: 5391789 - DNA, 22 bp, Homo sapiens
ccattccctgccttgctgacaa

SEQ ID NO: 5391790 - DNA, 13 bp, Homo sapiens
ccattccctgtag

SEQ ID NO: 5391791 - DNA, 14 bp, Homo sapiens
ccattcccttggaa

SEQ ID NO: 5391792 - DNA, 15 bp, Homo sapiens
ccattccgaccttca

SEQ ID NO: 5391793 - DNA, 22 bp, Homo sapiens
ccattcctgagttacttccctt

SEQ ID NO: 5391794 - DNA, 12 bp, Homo sapiens
ccattcctgcct

SEQ ID NO: 5391795 - DNA, 19 bp, Homo sapiens
ccattcctgcctggtccag

SEQ ID NO: 5391796 - DNA, 12 bp, Homo sapiens
ccattcctgctc

SEQ ID NO: 5391797 - DNA, 22 bp, Homo sapiens
ccattcctggaaaccacagtcc

SEQ ID NO: 5391798 - DNA, 13 bp, Homo sapiens
ccattccttagct

SEQ ID NO: 5391799 - DNA, 20 bp, Homo sapiens
ccattccttcaaataaagaa

SEQ ID NO: 5391800 - DNA, 21 bp, Homo sapiens
ccattccttgcgcctcagccc

SEQ ID NO: 5391801 - DNA, 22 bp, Homo sapiens
ccattcctttaaattctccaac

SEQ ID NO: 5391802 - DNA, 17 bp, Homo sapiens
ccattctagatcctgca

SEQ ID NO: 5391803 - DNA, 19 bp, Homo sapiens
ccattctagatcctgcacc

SEQ ID NO: 5391804 - DNA, 15 bp, Homo sapiens
ccattctagatgctt

SEQ ID NO: 5391805 - DNA, 12 bp, Homo sapiens
ccattctatgtg

SEQ ID NO: 5391806 - DNA, 15 bp, Homo sapiens
ccattctattctcca

SEQ ID NO: 5391807 - DNA, 19 bp, Homo sapiens
ccattctattctccagaca

SEQ ID NO: 5391808 - DNA, 17 bp, Homo sapiens
ccattctattttagaat

SEQ ID NO: 5391809 - DNA, 16 bp, Homo sapiens
ccattctcatctgcac

SEQ ID NO: 5391810 - DNA, 22 bp, Homo sapiens
ccattctcatctgcacccttct

SEQ ID NO: 5391811 - DNA, 21 bp, Homo sapiens
cccaaaggcccagggaggcag

SEQ ID NO: 5391812 - DNA, 15 bp, Homo sapiens
cccaaaggctgcagc

SEQ ID NO: 5391813 - DNA, 22 bp, Homo sapiens
cccaaaggggacaggcctcacc

SEQ ID NO: 5391814 - DNA, 20 bp, Homo sapiens
cccaaaggtccgcaccctgt

SEQ ID NO: 5391815 - DNA, 22 bp, Homo sapiens
cccaaagtaccacactgagttc

SEQ ID NO: 5391816 - DNA, 14 bp, Homo sapiens
cccaaagtcctctg

SEQ ID NO: 5391817 - DNA, 19 bp, Homo sapiens
cccaaagtcctctgctcca

SEQ ID NO: 5391818 - DNA, 16 bp, Homo sapiens
cccaaagtctgtgtga

SEQ ID NO: 5391819 - DNA, 20 bp, Homo sapiens
cccaaagtgctgagattaca

SEQ ID NO: 5391820 - DNA, 19 bp, Homo sapiens
cccaaagtggggagggaca

SEQ ID NO: 5391821 - DNA, 21 bp, Homo sapiens
cccaaatcccacagggccaga

SEQ ID NO: 5391822 - DNA, 18 bp, Homo sapiens
cccaaatccgaacctcct

SEQ ID NO: 5391823 - DNA, 23 bp, Homo sapiens
cccaaatccgaacctcctctgtg

SEQ ID NO: 5391824 - DNA, 17 bp, Homo sapiens
cccaaatccgccagtgt

SEQ ID NO: 5391825 - DNA, 24 bp, Homo sapiens
cccaaatcctagactgctcctggg

SEQ ID NO: 5391826 - DNA, 18 bp, Homo sapiens
cccaaatctactgagcca

SEQ ID NO: 5391827 - DNA, 19 bp, Homo sapiens
cccaaatctactgagccac

SEQ ID NO: 5391828 - DNA, 16 bp, Homo sapiens
cccaaatctcttccac

SEQ ID NO: 5391829 - DNA, 17 bp, Homo sapiens
cccaaatcttgtttaca

SEQ ID NO: 5391830 - DNA, 14 bp, Homo sapiens
cccaaatgagccat

SEQ ID NO: 5391831 - DNA, 17 bp, Homo sapiens
cccaaatgatggatcac

SEQ ID NO: 5391832 - DNA, 14 bp, Homo sapiens
cccaaatgctggct

SEQ ID NO: 5391833 - DNA, 18 bp, Homo sapiens
cccaaatggaaatgggca

SEQ ID NO: 5391834 - DNA, 19 bp, Homo sapiens
cccaaattataagggccct

SEQ ID NO: 5391835 - DNA, 19 bp, Homo sapiens
cccaaattatcaagctaat

SEQ ID NO: 5391836 - DNA, 15 bp, Homo sapiens
cccaaattgccttca

SEQ ID NO: 5391837 - DNA, 21 bp, Homo sapiens
cccaaattgtcacctgcttct

SEQ ID NO: 5391838 - DNA, 16 bp, Homo sapiens
cccaaatttccctggg

SEQ ID NO: 5391839 - DNA, 14 bp, Homo sapiens
cccaacaaacttta

SEQ ID NO: 5391840 - DNA, 20 bp, Homo sapiens
cccaacaacatgaaactgcc

SEQ ID NO: 5391841 - DNA, 22 bp, Homo sapiens
cccaacaacatgaaactgccta

SEQ ID NO: 5391842 - DNA, 21 bp, Homo sapiens
cccaacaagtgctctttccac

SEQ ID NO: 5391843 - DNA, 21 bp, Homo sapiens
cccaacaatactttgtgtctt

SEQ ID NO: 5391844 - DNA, 14 bp, Homo sapiens
cccaacacaggcaa

SEQ ID NO: 5391845 - DNA, 12 bp, Homo sapiens
cccaacaccaaa

SEQ ID NO: 5391846 - DNA, 13 bp, Homo sapiens
cccaacaccaccc

SEQ ID NO: 5391847 - DNA, 15 bp, Homo sapiens
cccaacaccacccct

SEQ ID NO: 5391848 - DNA, 20 bp, Homo sapiens
cccaacaccagcccctgccc

SEQ ID NO: 5391849 - DNA, 17 bp, Homo sapiens
cccaacaccccgcctgc

SEQ ID NO: 5391850 - DNA, 20 bp, Homo sapiens
cccaacaccccgcctgcctc

SEQ ID NO: 5391851 - DNA, 12 bp, Homo sapiens
cccaacacctgc

SEQ ID NO: 5391852 - DNA, 16 bp, Homo sapiens
cccaacacctgctgcg

SEQ ID NO: 5391853 - DNA, 18 bp, Homo sapiens
cccaacacctgctgcgct

SEQ ID NO: 5391854 - DNA, 13 bp, Homo sapiens
cccaacacgggta

SEQ ID NO: 5391855 - DNA, 15 bp, Homo sapiens
cccaacactccaggc

SEQ ID NO: 5391856 - DNA, 16 bp, Homo sapiens
cccaacactccaggcc

SEQ ID NO: 5391857 - DNA, 15 bp, Homo sapiens
cccaacactgccagc

SEQ ID NO: 5391858 - DNA, 16 bp, Homo sapiens
cccaacactgccagca

SEQ ID NO: 5391859 - DNA, 12 bp, Homo sapiens
cccaacactgtg

SEQ ID NO: 5391860 - DNA, 20 bp, Homo sapiens
cccaacactgtgccctggtg

SEQ ID NO: 5391861 - DNA, 21 bp, Homo sapiens
cccaacactgtgccctggtgg

SEQ ID NO: 5391862 - DNA, 22 bp, Homo sapiens
cccaacactgtgccctggtgga

SEQ ID NO: 5391863 - DNA, 19 bp, Homo sapiens
cccaacagatgcttttctg

SEQ ID NO: 5391864 - DNA, 13 bp, Homo sapiens
cccaacagcccag

SEQ ID NO: 5391865 - DNA, 23 bp, Homo sapiens
cccaacagccttagctgccagtg

SEQ ID NO: 5391866 - DNA, 19 bp, Homo sapiens
cccaacagcgacatagccc

SEQ ID NO: 5391867 - DNA, 17 bp, Homo sapiens
cccaacaggaattttta

SEQ ID NO: 5391868 - DNA, 17 bp, Homo sapiens
cccaacaggaggacaat

SEQ ID NO: 5391869 - DNA, 13 bp, Homo sapiens
cccaacaggccct

SEQ ID NO: 5391870 - DNA, 16 bp, Homo sapiens
cccaacagtgtgaagt

SEQ ID NO: 5391871 - DNA, 19 bp, Homo sapiens
cccaacagtgtgaagttag

SEQ ID NO: 5391872 - DNA, 14 bp, Homo sapiens
cccaacatataaaa

SEQ ID NO: 5391873 - DNA, 19 bp, Homo sapiens
cccaacatataaaataatg

SEQ ID NO: 5391874 - DNA, 14 bp, Homo sapiens
cccaacatgggagg

SEQ ID NO: 5391875 - DNA, 23 bp, Homo sapiens
cccaacatggggcccctctcatc

SEQ ID NO: 5391876 - DNA, 15 bp, Homo sapiens
cccaaccaaccagca

SEQ ID NO: 5391877 - DNA, 16 bp, Homo sapiens
cccaaccaaggaagga

SEQ ID NO: 5391878 - DNA, 20 bp, Homo sapiens
cccaaccaaggaaggagccc

SEQ ID NO: 5391879 - DNA, 23 bp, Homo sapiens
cccaaccaaggaaggagcccctg

SEQ ID NO: 5391880 - DNA, 13 bp, Homo sapiens
cccaaccaggagg

SEQ ID NO: 5391881 - DNA, 15 bp, Homo sapiens
cccaaccaggagggg

SEQ ID NO: 5391882 - DNA, 16 bp, Homo sapiens
cccaaccagggccccg

SEQ ID NO: 5391883 - DNA, 18 bp, Homo sapiens
cccaaccagtgccaagga

SEQ ID NO: 5391884 - DNA, 14 bp, Homo sapiens
cccaacccaaacca

SEQ ID NO: 5391885 - DNA, 16 bp, Homo sapiens
cccaacccaaaccatg

SEQ ID NO: 5391886 - DNA, 13 bp, Homo sapiens
cccaacccaacca

SEQ ID NO: 5391887 - DNA, 19 bp, Homo sapiens
cccaacccacctctggccc

SEQ ID NO: 5391888 - DNA, 21 bp, Homo sapiens
cccaacccacctctggccctg

SEQ ID NO: 5391889 - DNA, 12 bp, Homo sapiens
cccaacccccac

SEQ ID NO: 5391890 - DNA, 14 bp, Homo sapiens
cccaacccccagca

SEQ ID NO: 5391891 - DNA, 21 bp, Homo sapiens
cccaaccccgcggtgctctgg

SEQ ID NO: 5391892 - DNA, 16 bp, Homo sapiens
cccaacccctcctccc

SEQ ID NO: 5391893 - DNA, 23 bp, Homo sapiens
cccaacccctcctccctcagact

SEQ ID NO: 5391894 - DNA, 22 bp, Homo sapiens
cccaacccctctccaggcctgt

SEQ ID NO: 5391895 - DNA, 14 bp, Homo sapiens
cccaacccctgagg

SEQ ID NO: 5391896 - DNA, 15 bp, Homo sapiens
cccaacccctgagga

SEQ ID NO: 5391897 - DNA, 23 bp, Homo sapiens
cccaacccgtggaggctgctcgg

SEQ ID NO: 5391898 - DNA, 20 bp, Homo sapiens
cccaaccctatctcctgaca

SEQ ID NO: 5391899 - DNA, 13 bp, Homo sapiens
cccaaccctgccc

SEQ ID NO: 5391900 - DNA, 18 bp, Homo sapiens
cccaaccctgcccagcct

SEQ ID NO: 5391901 - DNA, 15 bp, Homo sapiens
cccaaccctgcccct

SEQ ID NO: 5391902 - DNA, 17 bp, Homo sapiens
cccaacccttccctcac

SEQ ID NO: 5391903 - DNA, 13 bp, Homo sapiens
cccaacccttctt

SEQ ID NO: 5391904 - DNA, 15 bp, Homo sapiens
cccaacccttcttca

SEQ ID NO: 5391905 - DNA, 12 bp, Homo sapiens
cccaacctacat

SEQ ID NO: 5391906 - DNA, 18 bp, Homo sapiens
cccaacctcaatgccctg

SEQ ID NO: 5391907 - DNA, 20 bp, Homo sapiens
cccaacctcaatgccctgcc

SEQ ID NO: 5391908 - DNA, 21 bp, Homo sapiens
cccaacctcaatgccctgcca

SEQ ID NO: 5391909 - DNA, 13 bp, Homo sapiens
cccaacctcaccc

SEQ ID NO: 5391910 - DNA, 14 bp, Homo sapiens
cccaacctcaccct

SEQ ID NO: 5391911 - DNA, 13 bp, Homo sapiens
cccaacctcaggg

SEQ ID NO: 5391912 - DNA, 16 bp, Homo sapiens
cccaacctcctgacct

SEQ ID NO: 5391913 - DNA, 12 bp, Homo sapiens
cccaacctcgcc

SEQ ID NO: 5391914 - DNA, 14 bp, Homo sapiens
cccaacctcgccct

SEQ ID NO: 5391915 - DNA, 13 bp, Homo sapiens
cccaacctgcacg

SEQ ID NO: 5391916 - DNA, 17 bp, Homo sapiens
cccaacctgctctcctc

SEQ ID NO: 5391917 - DNA, 19 bp, Homo sapiens
cccaacctgctctcctctt

SEQ ID NO: 5391918 - DNA, 15 bp, Homo sapiens
cccaacctttccctc

SEQ ID NO: 5391919 - DNA, 17 bp, Homo sapiens
cccaacggggtggggag

SEQ ID NO: 5391920 - DNA, 18 bp, Homo sapiens
cccaacggggtggggagg

SEQ ID NO: 5391921 - DNA, 19 bp, Homo sapiens
cccaacgttccacaacagt

SEQ ID NO: 5391922 - DNA, 23 bp, Homo sapiens
cccaactactattgtagagtggt

SEQ ID NO: 5391923 - DNA, 19 bp, Homo sapiens
cccaactactgagctgaga

SEQ ID NO: 5391924 - DNA, 15 bp, Homo sapiens
cccaactcaccccag

SEQ ID NO: 5391925 - DNA, 16 bp, Homo sapiens
cccaactcactgtgct

SEQ ID NO: 5391926 - DNA, 15 bp, Homo sapiens
cccaactcagcctgt

SEQ ID NO: 5391927 - DNA, 16 bp, Homo sapiens
cccaactcagcctgtt

SEQ ID NO: 5391928 - DNA, 21 bp, Homo sapiens
cccaactcagcctgttccttc

SEQ ID NO: 5391929 - DNA, 14 bp, Homo sapiens
cccaactccacagg

SEQ ID NO: 5391930 - DNA, 12 bp, Homo sapiens
cccaactcccag

SEQ ID NO: 5391931 - DNA, 13 bp, Homo sapiens
cccaactcccagc

SEQ ID NO: 5391932 - DNA, 14 bp, Homo sapiens
cccaactcccagcc

SEQ ID NO: 5391933 - DNA, 15 bp, Homo sapiens
cccaactcccagcca

SEQ ID NO: 5391934 - DNA, 17 bp, Homo sapiens
cccaactcctggaagct

SEQ ID NO: 5391935 - DNA, 18 bp, Homo sapiens
cccaactccttccagcta

SEQ ID NO: 5391936 - DNA, 15 bp, Homo sapiens
cccaactctagctgg

SEQ ID NO: 5391937 - DNA, 17 bp, Homo sapiens
cccaactctccccagtg

SEQ ID NO: 5391938 - DNA, 19 bp, Homo sapiens
cccaactctccccagtgcc

SEQ ID NO: 5391939 - DNA, 22 bp, Homo sapiens
cccaactctccccagtgcctgc

SEQ ID NO: 5391940 - DNA, 20 bp, Homo sapiens
cccaactctcccctgacctg

SEQ ID NO: 5391941 - DNA, 16 bp, Homo sapiens
cccaactcttcctccc

SEQ ID NO: 5391942 - DNA, 18 bp, Homo sapiens
cccaactcttcctcccct

SEQ ID NO: 5391943 - DNA, 19 bp, Homo sapiens
cccaactgacttctgctag

SEQ ID NO: 5391944 - DNA, 17 bp, Homo sapiens
cccaactgatcctgctc

SEQ ID NO: 5391945 - DNA, 20 bp, Homo sapiens
cccaactgatttttgtattt

SEQ ID NO: 5391946 - DNA, 17 bp, Homo sapiens
cccaactgctccagcct

SEQ ID NO: 5391947 - DNA, 15 bp, Homo sapiens
cccaactgctctgcc

SEQ ID NO: 5391948 - DNA, 17 bp, Homo sapiens
cccaactgctctgccca

SEQ ID NO: 5391949 - DNA, 13 bp, Homo sapiens
cccaactggggtt

SEQ ID NO: 5391950 - DNA, 17 bp, Homo sapiens
cccaactggttcaggct

SEQ ID NO: 5391951 - DNA, 19 bp, Homo sapiens
cccaactgtggtagctcca

SEQ ID NO: 5391952 - DNA, 15 bp, Homo sapiens
cccaacttcaccacc

SEQ ID NO: 5391953 - DNA, 19 bp, Homo sapiens
cccaacttcatactggcag

SEQ ID NO: 5391954 - DNA, 13 bp, Homo sapiens
cccaacttcccct

SEQ ID NO: 5391955 - DNA, 21 bp, Homo sapiens
cccaagaaaccaaagtctgcc

SEQ ID NO: 5391956 - DNA, 16 bp, Homo sapiens
cccaagaaacctgact

SEQ ID NO: 5391957 - DNA, 21 bp, Homo sapiens
cccaagaatagatgctgactg

SEQ ID NO: 5391958 - DNA, 16 bp, Homo sapiens
cccaagacacttcccc

SEQ ID NO: 5391959 - DNA, 20 bp, Homo sapiens
cccaagacagatgccccaga

SEQ ID NO: 5391960 - DNA, 20 bp, Homo sapiens
cccaagaccatccctgaaga

SEQ ID NO: 5391961 - DNA, 16 bp, Homo sapiens
cccaagactcccatga

SEQ ID NO: 5391962 - DNA, 17 bp, Homo sapiens
cccaagactctgctctc

SEQ ID NO: 5391963 - DNA, 18 bp, Homo sapiens
cccaagactctgctctcc

SEQ ID NO: 5391964 - DNA, 23 bp, Homo sapiens
cccaagactgtcattgcccctcc

SEQ ID NO: 5391965 - DNA, 17 bp, Homo sapiens
cccaagacttgacgcag

SEQ ID NO: 5391966 - DNA, 21 bp, Homo sapiens
cccaagagaaggggaagcact

SEQ ID NO: 5391967 - DNA, 12 bp, Homo sapiens
cccaagagagac

SEQ ID NO: 5391968 - DNA, 21 bp, Homo sapiens
cccaagagagacagcacaggc

SEQ ID NO: 5391969 - DNA, 17 bp, Homo sapiens
cccaagagaggaaggac

SEQ ID NO: 5391970 - DNA, 15 bp, Homo sapiens
cccaagagatgaaga

SEQ ID NO: 5391971 - DNA, 14 bp, Homo sapiens
cccaagagcaaggg

SEQ ID NO: 5391972 - DNA, 17 bp, Homo sapiens
cccaagagcagagtctg

SEQ ID NO: 5391973 - DNA, 23 bp, Homo sapiens
cccaagagcaggaggtgcctgaa

SEQ ID NO: 5391974 - DNA, 20 bp, Homo sapiens
cccaagagcatcatgcctct

SEQ ID NO: 5391975 - DNA, 21 bp, Homo sapiens
cccaagagcatcatgcctctg

SEQ ID NO: 5391976 - DNA, 23 bp, Homo sapiens
cccaagagccataagggggtggg

SEQ ID NO: 5391977 - DNA, 23 bp, Homo sapiens
cccaagaggggcgggctcagagc

SEQ ID NO: 5391978 - DNA, 18 bp, Homo sapiens
cccaagaggtctgagccc

SEQ ID NO: 5391979 - DNA, 19 bp, Homo sapiens
cccaagataggggcacact

SEQ ID NO: 5391980 - DNA, 19 bp, Homo sapiens
cccaagatctgccagacct

SEQ ID NO: 5391981 - DNA, 20 bp, Homo sapiens
cccaagatctgccagacctg

SEQ ID NO: 5391982 - DNA, 18 bp, Homo sapiens
cccaagatgagctgcagc

SEQ ID NO: 5391983 - DNA, 17 bp, Homo sapiens
cccaagatgcctgatca

SEQ ID NO: 5391984 - DNA, 20 bp, Homo sapiens
cccaagatgggcatcttttg

SEQ ID NO: 5391985 - DNA, 20 bp, Homo sapiens
cccaagattcacacctgact

SEQ ID NO: 5391986 - DNA, 11 bp, Homo sapiens
cccaagattct

SEQ ID NO: 5391987 - DNA, 18 bp, Homo sapiens
cccaagcagaagaccaga

SEQ ID NO: 5391988 - DNA, 16 bp, Homo sapiens
cccaagcagccagcca

SEQ ID NO: 5391989 - DNA, 23 bp, Homo sapiens
cccaccaaggtctcacactcctc

SEQ ID NO: 5391990 - DNA, 13 bp, Homo sapiens
cccaccacacaac

SEQ ID NO: 5391991 - DNA, 15 bp, Homo sapiens
cccaccacacacacc

SEQ ID NO: 5391992 - DNA, 17 bp, Homo sapiens
cccaccacacatcccag

SEQ ID NO: 5391993 - DNA, 22 bp, Homo sapiens
cccaccaccaagccctgcaaat

SEQ ID NO: 5391994 - DNA, 15 bp, Homo sapiens
cccaccaccccagct

SEQ ID NO: 5391995 - DNA, 18 bp, Homo sapiens
cccaccaccccctcaagc

SEQ ID NO: 5391996 - DNA, 20 bp, Homo sapiens
cccaccaccctcccaccatg

SEQ ID NO: 5391997 - DNA, 15 bp, Homo sapiens
cccaccaccctggca

SEQ ID NO: 5391998 - DNA, 19 bp, Homo sapiens
cccaccacctaggccactc

SEQ ID NO: 5391999 - DNA, 23 bp, Homo sapiens
cccaccactaggactctgaggct

SEQ ID NO: 5392000 - DNA, 12 bp, Homo sapiens
cccaccactccc

SEQ ID NO: 5392001 - DNA, 23 bp, Homo sapiens
cccaccactctcaggaccaccct

SEQ ID NO: 5392002 - DNA, 20 bp, Homo sapiens
cccaccagaacgcaccccac

SEQ ID NO: 5392003 - DNA, 21 bp, Homo sapiens
cccaccagaacgcaccccact

SEQ ID NO: 5392004 - DNA, 20 bp, Homo sapiens
cccaccagagccgggaggaa

SEQ ID NO: 5392005 - DNA, 22 bp, Homo sapiens
cccaccagagctgcctccccaa

SEQ ID NO: 5392006 - DNA, 12 bp, Homo sapiens
cccaccagcaga

SEQ ID NO: 5392007 - DNA, 13 bp, Homo sapiens
cccaccagcagca

SEQ ID NO: 5392008 - DNA, 12 bp, Homo sapiens
cccaccagccac

SEQ ID NO: 5392009 - DNA, 24 bp, Homo sapiens
cccaccagccacagcctccccacc

SEQ ID NO: 5392010 - DNA, 17 bp, Homo sapiens
cccaccagccacctctt

SEQ ID NO: 5392011 - DNA, 13 bp, Homo sapiens
cccaccagccagc

SEQ ID NO: 5392012 - DNA, 17 bp, Homo sapiens
cccaccagccagccctg

SEQ ID NO: 5392013 - DNA, 15 bp, Homo sapiens
cccaccagccttgct

SEQ ID NO: 5392014 - DNA, 16 bp, Homo sapiens
cccaccagccttgctc

SEQ ID NO: 5392015 - DNA, 19 bp, Homo sapiens
cccaccagccttgctctct

SEQ ID NO: 5392016 - DNA, 23 bp, Homo sapiens
cccaccagccttgctctcttcaa

SEQ ID NO: 5392017 - DNA, 12 bp, Homo sapiens
cccaccagctcc

SEQ ID NO: 5392018 - DNA, 13 bp, Homo sapiens
cccaccagctcgt

SEQ ID NO: 5392019 - DNA, 16 bp, Homo sapiens
cccaccagctgcagcc

SEQ ID NO: 5392020 - DNA, 14 bp, Homo sapiens
cccaccagcttcac

SEQ ID NO: 5392021 - DNA, 12 bp, Homo sapiens
cccaccaggagc

SEQ ID NO: 5392022 - DNA, 17 bp, Homo sapiens
cccaccaggccagctca

SEQ ID NO: 5392023 - DNA, 17 bp, Homo sapiens
cccaccaggctgctcag

SEQ ID NO: 5392024 - DNA, 13 bp, Homo sapiens
cccaccagggtcc

SEQ ID NO: 5392025 - DNA, 23 bp, Homo sapiens
cccaccagtcagggacagcagcc

SEQ ID NO: 5392026 - DNA, 15 bp, Homo sapiens
cccaccagtgcctct

SEQ ID NO: 5392027 - DNA, 14 bp, Homo sapiens
cccaccagtgcctt

SEQ ID NO: 5392028 - DNA, 16 bp, Homo sapiens
cccaccagtgtagcat

SEQ ID NO: 5392029 - DNA, 22 bp, Homo sapiens
cccaccagtgtagcatcttcct

SEQ ID NO: 5392030 - DNA, 14 bp, Homo sapiens
cccaccagttgctg

SEQ ID NO: 5392031 - DNA, 22 bp, Homo sapiens
cccaccatcaccaccgcctctg

SEQ ID NO: 5392032 - DNA, 21 bp, Homo sapiens
cccaccatccttccatcctga

SEQ ID NO: 5392033 - DNA, 14 bp, Homo sapiens
cccaccatctgctg

SEQ ID NO: 5392034 - DNA, 15 bp, Homo sapiens
cccaccatctgctgt

SEQ ID NO: 5392035 - DNA, 17 bp, Homo sapiens
cccaccatctgctgtct

SEQ ID NO: 5392036 - DNA, 21 bp, Homo sapiens
cccaccatctgctgtcttttc

SEQ ID NO: 5392037 - DNA, 19 bp, Homo sapiens
cccaccatgcacccctgat

SEQ ID NO: 5392038 - DNA, 13 bp, Homo sapiens
cccaccatgcagc

SEQ ID NO: 5392039 - DNA, 19 bp, Homo sapiens
cccaccatgcagcccctgg

SEQ ID NO: 5392040 - DNA, 22 bp, Homo sapiens
cccaccatgcagcccctgggcc

SEQ ID NO: 5392041 - DNA, 17 bp, Homo sapiens
cccaccattcccggccg

SEQ ID NO: 5392042 - DNA, 13 bp, Homo sapiens
cccaccattcctg

SEQ ID NO: 5392043 - DNA, 23 bp, Homo sapiens
cccaccatttggcatccctgggc

SEQ ID NO: 5392044 - DNA, 12 bp, Homo sapiens
cccacccaagag

SEQ ID NO: 5392045 - DNA, 17 bp, Homo sapiens
cccacccaagagaggaa

SEQ ID NO: 5392046 - DNA, 20 bp, Homo sapiens
cccacccaagggcctggcct

SEQ ID NO: 5392047 - DNA, 22 bp, Homo sapiens
cccacccaagggcctggcctga

SEQ ID NO: 5392048 - DNA, 14 bp, Homo sapiens
cccacccaattggc

SEQ ID NO: 5392049 - DNA, 16 bp, Homo sapiens
cccacccacaccccgt

SEQ ID NO: 5392050 - DNA, 18 bp, Homo sapiens
cccacccacagccataga

SEQ ID NO: 5392051 - DNA, 15 bp, Homo sapiens
cccacccacatgact

SEQ ID NO: 5392052 - DNA, 15 bp, Homo sapiens
cccacccacatgtga

SEQ ID NO: 5392053 - DNA, 12 bp, Homo sapiens
cccacccacctt

SEQ ID NO: 5392054 - DNA, 17 bp, Homo sapiens
cccacccacctttgcag

SEQ ID NO: 5392055 - DNA, 12 bp, Homo sapiens
cccacccacgca

SEQ ID NO: 5392056 - DNA, 20 bp, Homo sapiens
cccacccagacctgcctgtc

SEQ ID NO: 5392057 - DNA, 12 bp, Homo sapiens
cccacccagagg

SEQ ID NO: 5392058 - DNA, 17 bp, Homo sapiens
cccacccagattctgaa

SEQ ID NO: 5392059 - DNA, 13 bp, Homo sapiens
cccacccagcagc

SEQ ID NO: 5392060 - DNA, 12 bp, Homo sapiens
cccacccagccc

SEQ ID NO: 5392061 - DNA, 12 bp, Homo sapiens
cccacccagctc

SEQ ID NO: 5392062 - DNA, 14 bp, Homo sapiens
cccacccagctcca

SEQ ID NO: 5392063 - DNA, 14 bp, Homo sapiens
cccacccagctggt

SEQ ID NO: 5392064 - DNA, 16 bp, Homo sapiens
cccacccagctggtcc

SEQ ID NO: 5392065 - DNA, 17 bp, Homo sapiens
cccacccagctggtcct

SEQ ID NO: 5392066 - DNA, 15 bp, Homo sapiens
cccacccaggaaagg

SEQ ID NO: 5392067 - DNA, 15 bp, Homo sapiens
cccacccaggccagg

SEQ ID NO: 5392068 - DNA, 21 bp, Homo sapiens
cccacccaggccaggcatgtg

SEQ ID NO: 5392069 - DNA, 15 bp, Homo sapiens
cccacccagggagct

SEQ ID NO: 5392070 - DNA, 14 bp, Homo sapiens
cccacccagggccc

SEQ ID NO: 5392071 - DNA, 18 bp, Homo sapiens
cccacccagggcccggca

SEQ ID NO: 5392072 - DNA, 23 bp, Homo sapiens
cccacccagggctccctcctgga

SEQ ID NO: 5392073 - DNA, 13 bp, Homo sapiens
cccacccatctcc

SEQ ID NO: 5392074 - DNA, 14 bp, Homo sapiens
cccacccatcttcc

SEQ ID NO: 5392075 - DNA, 15 bp, Homo sapiens
cccacccatgccagc

SEQ ID NO: 5392076 - DNA, 18 bp, Homo sapiens
cccaccccaacctgctct

SEQ ID NO: 5392077 - DNA, 14 bp, Homo sapiens
cccaccccacactt

SEQ ID NO: 5392078 - DNA, 13 bp, Homo sapiens
cccaccccacaga

SEQ ID NO: 5392079 - DNA, 18 bp, Homo sapiens
cccaccccacagactccg

SEQ ID NO: 5392080 - DNA, 15 bp, Homo sapiens
cccaccccactccag

SEQ ID NO: 5392081 - DNA, 13 bp, Homo sapiens
cccaccccagaag

SEQ ID NO: 5392082 - DNA, 13 bp, Homo sapiens
cccaccccagagt

SEQ ID NO: 5392083 - DNA, 15 bp, Homo sapiens
cccaccccagcacag

SEQ ID NO: 5392084 - DNA, 17 bp, Homo sapiens
cccaccccagcacagcc

SEQ ID NO: 5392085 - DNA, 20 bp, Homo sapiens
cccaccccagcacagccacc

SEQ ID NO: 5392086 - DNA, 15 bp, Homo sapiens
cccaccccagcctcg

SEQ ID NO: 5392087 - DNA, 20 bp, Homo sapiens
cccaccccagcctcgcctgt

SEQ ID NO: 5392088 - DNA, 17 bp, Homo sapiens
cccaccccaggccctgc

SEQ ID NO: 5392089 - DNA, 13 bp, Homo sapiens
cccaccccataag

SEQ ID NO: 5392090 - DNA, 13 bp, Homo sapiens
cccaccccattcc

SEQ ID NO: 5392091 - DNA, 12 bp, Homo sapiens
cccacccccacc

SEQ ID NO: 5392092 - DNA, 15 bp, Homo sapiens
cccacccccacccaa

SEQ ID NO: 5392093 - DNA, 14 bp, Homo sapiens
cccacccccaccct

SEQ ID NO: 5392094 - DNA, 14 bp, Homo sapiens
cccacccccacttc

SEQ ID NO: 5392095 - DNA, 18 bp, Homo sapiens
cccacccccacttcatgc

SEQ ID NO: 5392096 - DNA, 16 bp, Homo sapiens
cccacccccagccagg

SEQ ID NO: 5392097 - DNA, 18 bp, Homo sapiens
cccacccccagccccgac

SEQ ID NO: 5392098 - DNA, 13 bp, Homo sapiens
cccacccccaggc

SEQ ID NO: 5392099 - DNA, 22 bp, Homo sapiens
cccacccccaggcctcctaggg

SEQ ID NO: 5392100 - DNA, 13 bp, Homo sapiens
cccacccccctcc

SEQ ID NO: 5392101 - DNA, 15 bp, Homo sapiens
cccacccccctcctc

SEQ ID NO: 5392102 - DNA, 20 bp, Homo sapiens
cccacccccctctctttctc

SEQ ID NO: 5392103 - DNA, 14 bp, Homo sapiens
cccacccccggcag

SEQ ID NO: 5392104 - DNA, 20 bp, Homo sapiens
cccacccccgggatcctgcc

SEQ ID NO: 5392105 - DNA, 12 bp, Homo sapiens
cccaccccctcc

SEQ ID NO: 5392106 - DNA, 19 bp, Homo sapiens
cccaccccctccccagggg

SEQ ID NO: 5392107 - DNA, 17 bp, Homo sapiens
cccaccccctccccggg

SEQ ID NO: 5392108 - DNA, 17 bp, Homo sapiens
cccaccccctctggaga

SEQ ID NO: 5392109 - DNA, 23 bp, Homo sapiens
cccaccccctctggagaaggcct

SEQ ID NO: 5392110 - DNA, 15 bp, Homo sapiens
cccaccccctgccct

SEQ ID NO: 5392111 - DNA, 15 bp, Homo sapiens
cccaccccctgctgg

SEQ ID NO: 5392112 - DNA, 18 bp, Homo sapiens
cccaccccctgctggtgc

SEQ ID NO: 5392113 - DNA, 16 bp, Homo sapiens
cccaccccctgggcag

SEQ ID NO: 5392114 - DNA, 23 bp, Homo sapiens
cccacccccttcagtgcccacca

SEQ ID NO: 5392115 - DNA, 22 bp, Homo sapiens
cccacccccttctctgctccac

SEQ ID NO: 5392116 - DNA, 19 bp, Homo sapiens
cccaccccctttgactctg

SEQ ID NO: 5392117 - DNA, 19 bp, Homo sapiens
cccaccccgccgttccctg

SEQ ID NO: 5392118 - DNA, 17 bp, Homo sapiens
cccaccccgcctctggg

SEQ ID NO: 5392119 - DNA, 14 bp, Homo sapiens
cccaccccggggac

SEQ ID NO: 5392120 - DNA, 21 bp, Homo sapiens
cccaccccggggaccctgtga

SEQ ID NO: 5392121 - DNA, 18 bp, Homo sapiens
cccacccctaagtgccca

SEQ ID NO: 5392122 - DNA, 13 bp, Homo sapiens
cccacccctacac

SEQ ID NO: 5392123 - DNA, 18 bp, Homo sapiens
cccacccctacacacaca

SEQ ID NO: 5392124 - DNA, 16 bp, Homo sapiens
cccacccctacagcct

SEQ ID NO: 5392125 - DNA, 13 bp, Homo sapiens
cccacccctagcc

SEQ ID NO: 5392126 - DNA, 16 bp, Homo sapiens
cccacccctagccacc

SEQ ID NO: 5392127 - DNA, 13 bp, Homo sapiens
cccacccctagga

SEQ ID NO: 5392128 - DNA, 17 bp, Homo sapiens
cccacccctcactcccc

SEQ ID NO: 5392129 - DNA, 16 bp, Homo sapiens
cccacccctccccacc

SEQ ID NO: 5392130 - DNA, 11 bp, Homo sapiens
cccacccctct

SEQ ID NO: 5392131 - DNA, 15 bp, Homo sapiens
cccacccctcttccc

SEQ ID NO: 5392132 - DNA, 18 bp, Homo sapiens
cccacccctcttccccct

SEQ ID NO: 5392133 - DNA, 12 bp, Homo sapiens
cccacccctgca

SEQ ID NO: 5392134 - DNA, 12 bp, Homo sapiens
cccacccctgcc

SEQ ID NO: 5392135 - DNA, 21 bp, Homo sapiens
cccacccctgcctcccatgcc

SEQ ID NO: 5392136 - DNA, 13 bp, Homo sapiens
cccacccctgtac

SEQ ID NO: 5392137 - DNA, 22 bp, Homo sapiens
cccacccctgtacccagccacc

SEQ ID NO: 5392138 - DNA, 15 bp, Homo sapiens
cccacccctgtgctc

SEQ ID NO: 5392139 - DNA, 16 bp, Homo sapiens
cccaccccttaggccc

SEQ ID NO: 5392140 - DNA, 12 bp, Homo sapiens
cccaccccttcc

SEQ ID NO: 5392141 - DNA, 15 bp, Homo sapiens
cccaccccttcccca

SEQ ID NO: 5392142 - DNA, 15 bp, Homo sapiens
cccaccccttcccta

SEQ ID NO: 5392143 - DNA, 18 bp, Homo sapiens
cccacccgagtacctcca

SEQ ID NO: 5392144 - DNA, 23 bp, Homo sapiens
cccacccgagtacctccagtcac

SEQ ID NO: 5392145 - DNA, 14 bp, Homo sapiens
cccacccgatgctg

SEQ ID NO: 5392146 - DNA, 18 bp, Homo sapiens
cccacccgccccagagac

SEQ ID NO: 5392147 - DNA, 22 bp, Homo sapiens
cccacccgccgcctcccacggc

SEQ ID NO: 5392148 - DNA, 23 bp, Homo sapiens
cccacccgccgcctcccacggca

SEQ ID NO: 5392149 - DNA, 14 bp, Homo sapiens
cccacccgccttgt

SEQ ID NO: 5392150 - DNA, 21 bp, Homo sapiens
cccacccggccacagctgctg

SEQ ID NO: 5392151 - DNA, 14 bp, Homo sapiens
cccacccggcccat

SEQ ID NO: 5392152 - DNA, 23 bp, Homo sapiens
cccacccggcggcggccagggac

SEQ ID NO: 5392153 - DNA, 13 bp, Homo sapiens
cccacccggtggg

SEQ ID NO: 5392154 - DNA, 21 bp, Homo sapiens
cccacccgtcttcaatctctg

SEQ ID NO: 5392155 - DNA, 16 bp, Homo sapiens
cccacccgtgttctcc

SEQ ID NO: 5392156 - DNA, 13 bp, Homo sapiens
cccaccctaaggg

SEQ ID NO: 5392157 - DNA, 17 bp, Homo sapiens
cccaccctaatttgccc

SEQ ID NO: 5392158 - DNA, 14 bp, Homo sapiens
cccaccctaccccc

SEQ ID NO: 5392159 - DNA, 21 bp, Homo sapiens
cccaccctatggccactggcc

SEQ ID NO: 5392160 - DNA, 19 bp, Homo sapiens
cccaccctccacctctcac

SEQ ID NO: 5392161 - DNA, 16 bp, Homo sapiens
cccaccctccatgctc

SEQ ID NO: 5392162 - DNA, 20 bp, Homo sapiens
cccaccctcccctctcctga

SEQ ID NO: 5392163 - DNA, 14 bp, Homo sapiens
cccaccctcctgcc

SEQ ID NO: 5392164 - DNA, 13 bp, Homo sapiens
cccaccctcctgt

SEQ ID NO: 5392165 - DNA, 19 bp, Homo sapiens
cccaccctcctgtcttccc

SEQ ID NO: 5392166 - DNA, 23 bp, Homo sapiens
cccaccctcgtggacacctgccc

SEQ ID NO: 5392167 - DNA, 13 bp, Homo sapiens
cccaccctctgcc

SEQ ID NO: 5392168 - DNA, 12 bp, Homo sapiens
cccaccctctgg

SEQ ID NO: 5392169 - DNA, 18 bp, Homo sapiens
cccaccctgcccactccc

SEQ ID NO: 5392170 - DNA, 21 bp, Homo sapiens
cccacgctgactacagggccg

SEQ ID NO: 5392171 - DNA, 19 bp, Homo sapiens
cccacgctggagtgcagtg

SEQ ID NO: 5392172 - DNA, 21 bp, Homo sapiens
cccacgctggagtgcagtgag

SEQ ID NO: 5392173 - DNA, 18 bp, Homo sapiens
cccacgctgggacacaga

SEQ ID NO: 5392174 - DNA, 19 bp, Homo sapiens
cccacgctgggacacagac

SEQ ID NO: 5392175 - DNA, 21 bp, Homo sapiens
cccacggaaggcgggctgagg

SEQ ID NO: 5392176 - DNA, 15 bp, Homo sapiens
cccacggagccctcc

SEQ ID NO: 5392177 - DNA, 20 bp, Homo sapiens
cccacggagtcgtggggtgt

SEQ ID NO: 5392178 - DNA, 13 bp, Homo sapiens
cccacggccaccc

SEQ ID NO: 5392179 - DNA, 12 bp, Homo sapiens
cccacggccact

SEQ ID NO: 5392180 - DNA, 16 bp, Homo sapiens
cccacggccgctccag

SEQ ID NO: 5392181 - DNA, 15 bp, Homo sapiens
cccacggctaagagg

SEQ ID NO: 5392182 - DNA, 19 bp, Homo sapiens
cccacggctaagaggctgc

SEQ ID NO: 5392183 - DNA, 23 bp, Homo sapiens
cccacggctctcgtccctctgct

SEQ ID NO: 5392184 - DNA, 16 bp, Homo sapiens
cccacggctctgtgcc

SEQ ID NO: 5392185 - DNA, 22 bp, Homo sapiens
cccacgggccggccagctgggt

SEQ ID NO: 5392186 - DNA, 15 bp, Homo sapiens
cccacggggcaaagc

SEQ ID NO: 5392187 - DNA, 19 bp, Homo sapiens
cccacggggcaaagctgct

SEQ ID NO: 5392188 - DNA, 20 bp, Homo sapiens
cccacggggcaaagctgctg

SEQ ID NO: 5392189 - DNA, 23 bp, Homo sapiens
cccacggggcaaagctgctgggc

SEQ ID NO: 5392190 - DNA, 21 bp, Homo sapiens
cccacggggcagttagagcag

SEQ ID NO: 5392191 - DNA, 15 bp, Homo sapiens
cccacggtctgagct

SEQ ID NO: 5392192 - DNA, 15 bp, Homo sapiens
cccacggtttcagct

SEQ ID NO: 5392193 - DNA, 19 bp, Homo sapiens
cccacgtcaggcctggcct

SEQ ID NO: 5392194 - DNA, 15 bp, Homo sapiens
cccacgtcctgggtg

SEQ ID NO: 5392195 - DNA, 16 bp, Homo sapiens
cccacgtcctgggtgc

SEQ ID NO: 5392196 - DNA, 21 bp, Homo sapiens
cccacgtctcctcctcgaagc

SEQ ID NO: 5392197 - DNA, 12 bp, Homo sapiens
cccacgtctctc

SEQ ID NO: 5392198 - DNA, 13 bp, Homo sapiens
cccacgtctctct

SEQ ID NO: 5392199 - DNA, 18 bp, Homo sapiens
cccacgtctctctgcctg

SEQ ID NO: 5392200 - DNA, 19 bp, Homo sapiens
cccacgtctctctgcctgc

SEQ ID NO: 5392201 - DNA, 24 bp, Homo sapiens
cccacgtctctctgcctgctgggc

SEQ ID NO: 5392202 - DNA, 21 bp, Homo sapiens
cccacgtctgtcctcctttct

SEQ ID NO: 5392203 - DNA, 22 bp, Homo sapiens
cccacgtcttcttgctgcagcc

SEQ ID NO: 5392204 - DNA, 20 bp, Homo sapiens
cccacgtgagagaatctgcc

SEQ ID NO: 5392205 - DNA, 15 bp, Homo sapiens
cccacgtgcacagct

SEQ ID NO: 5392206 - DNA, 16 bp, Homo sapiens
cccacgtgcagcacct

SEQ ID NO: 5392207 - DNA, 17 bp, Homo sapiens
cccacgtgcagcacctg

SEQ ID NO: 5392208 - DNA, 18 bp, Homo sapiens
cccacgtggactctgtgc

SEQ ID NO: 5392209 - DNA, 20 bp, Homo sapiens
cccacgtggactctgtgctc

SEQ ID NO: 5392210 - DNA, 16 bp, Homo sapiens
cccacgtggagacagc

SEQ ID NO: 5392211 - DNA, 19 bp, Homo sapiens
cccacgtgtcttccacttt

SEQ ID NO: 5392212 - DNA, 16 bp, Homo sapiens
cccacgtgtgcagact

SEQ ID NO: 5392213 - DNA, 17 bp, Homo sapiens
cccacgtgtgcagactg

SEQ ID NO: 5392214 - DNA, 18 bp, Homo sapiens
cccacgttctctctgcct

SEQ ID NO: 5392215 - DNA, 18 bp, Homo sapiens
cccacgttctgttaattt

SEQ ID NO: 5392216 - DNA, 16 bp, Homo sapiens
cccacgttgtccctga

SEQ ID NO: 5392217 - DNA, 23 bp, Homo sapiens
cccactaaaacaaaacaaaaaac

SEQ ID NO: 5392218 - DNA, 17 bp, Homo sapiens
cccactaatgcaaactg

SEQ ID NO: 5392219 - DNA, 20 bp, Homo sapiens
cccactaccatacagacagc

SEQ ID NO: 5392220 - DNA, 20 bp, Homo sapiens
cccactacccttctcctttc

SEQ ID NO: 5392221 - DNA, 16 bp, Homo sapiens
cccactagagggccca

SEQ ID NO: 5392222 - DNA, 15 bp, Homo sapiens
cccactagccctctt

SEQ ID NO: 5392223 - DNA, 23 bp, Homo sapiens
cccactagccctctttctctctg

SEQ ID NO: 5392224 - DNA, 18 bp, Homo sapiens
cccactagcctaggtcat

SEQ ID NO: 5392225 - DNA, 15 bp, Homo sapiens
cccactagctcttgt

SEQ ID NO: 5392226 - DNA, 22 bp, Homo sapiens
cccactagctcttgttgagccg

SEQ ID NO: 5392227 - DNA, 23 bp, Homo sapiens
cccactcaagccaagcagccaag

SEQ ID NO: 5392228 - DNA, 14 bp, Homo sapiens
cccactcacagaga

SEQ ID NO: 5392229 - DNA, 18 bp, Homo sapiens
cccactcaccagccctag

SEQ ID NO: 5392230 - DNA, 16 bp, Homo sapiens
cccactcaccagggtc

SEQ ID NO: 5392231 - DNA, 17 bp, Homo sapiens
cccactcaccagggtcc

SEQ ID NO: 5392232 - DNA, 17 bp, Homo sapiens
cccactcacctttctcc

SEQ ID NO: 5392233 - DNA, 16 bp, Homo sapiens
cccactcagcagtgag

SEQ ID NO: 5392234 - DNA, 22 bp, Homo sapiens
cccactcagcatttcggtgctt

SEQ ID NO: 5392235 - DNA, 16 bp, Homo sapiens
cccactcattccttct

SEQ ID NO: 5392236 - DNA, 19 bp, Homo sapiens
cccactccaccctgttagt

SEQ ID NO: 5392237 - DNA, 14 bp, Homo sapiens
cccactccagccct

SEQ ID NO: 5392238 - DNA, 18 bp, Homo sapiens
cccactccagcctgggga

SEQ ID NO: 5392239 - DNA, 18 bp, Homo sapiens
cccactccatctggtaga

SEQ ID NO: 5392240 - DNA, 16 bp, Homo sapiens
cccactcccatctcct

SEQ ID NO: 5392241 - DNA, 17 bp, Homo sapiens
cccactcccatctcctt

SEQ ID NO: 5392242 - DNA, 18 bp, Homo sapiens
cccactcccatctcctta

SEQ ID NO: 5392243 - DNA, 14 bp, Homo sapiens
cccactcccatggc

SEQ ID NO: 5392244 - DNA, 17 bp, Homo sapiens
cccactcccatggctct

SEQ ID NO: 5392245 - DNA, 13 bp, Homo sapiens
cccactcccccac

SEQ ID NO: 5392246 - DNA, 22 bp, Homo sapiens
cccactcccccaggagcagctg

SEQ ID NO: 5392247 - DNA, 22 bp, Homo sapiens
cccactcccccgtttctccttt

SEQ ID NO: 5392248 - DNA, 15 bp, Homo sapiens
cccactcccgcctca

SEQ ID NO: 5392249 - DNA, 23 bp, Homo sapiens
cccactcccgcctcagggccagg

SEQ ID NO: 5392250 - DNA, 22 bp, Homo sapiens
cccactcccggcctaggcacct

SEQ ID NO: 5392251 - DNA, 12 bp, Homo sapiens
cccactcccgtg

SEQ ID NO: 5392252 - DNA, 19 bp, Homo sapiens
cccactccctatctccttc

SEQ ID NO: 5392253 - DNA, 13 bp, Homo sapiens
cccactccctgca

SEQ ID NO: 5392254 - DNA, 16 bp, Homo sapiens
cccactccctgccacc

SEQ ID NO: 5392255 - DNA, 15 bp, Homo sapiens
cccactccctggcca

SEQ ID NO: 5392256 - DNA, 15 bp, Homo sapiens
cccactccctgtcca

SEQ ID NO: 5392257 - DNA, 16 bp, Homo sapiens
cccactccctgtccat

SEQ ID NO: 5392258 - DNA, 14 bp, Homo sapiens
cccactccctttcc

SEQ ID NO: 5392259 - DNA, 20 bp, Homo sapiens
cccactccctttccaacctc

SEQ ID NO: 5392260 - DNA, 17 bp, Homo sapiens
cccactccgactccccc

SEQ ID NO: 5392261 - DNA, 18 bp, Homo sapiens
cccactccgactccccct

SEQ ID NO: 5392262 - DNA, 20 bp, Homo sapiens
cccactccgccagccacagg

SEQ ID NO: 5392263 - DNA, 12 bp, Homo sapiens
cccactcctccg

SEQ ID NO: 5392264 - DNA, 14 bp, Homo sapiens
cccactcctcctcc

SEQ ID NO: 5392265 - DNA, 14 bp, Homo sapiens
cccactcctgctct

SEQ ID NO: 5392266 - DNA, 16 bp, Homo sapiens
cccactcctgctgcac

SEQ ID NO: 5392267 - DNA, 13 bp, Homo sapiens
cccactcctggga

SEQ ID NO: 5392268 - DNA, 20 bp, Homo sapiens
cccactcctgtcagcccctc

SEQ ID NO: 5392269 - DNA, 19 bp, Homo sapiens
cccactctacctccttagc

SEQ ID NO: 5392270 - DNA, 14 bp, Homo sapiens
cccactctactgcc

SEQ ID NO: 5392271 - DNA, 17 bp, Homo sapiens
cccactctactgcccca

SEQ ID NO: 5392272 - DNA, 12 bp, Homo sapiens
cccactctcaga

SEQ ID NO: 5392273 - DNA, 14 bp, Homo sapiens
cccactctcagagg

SEQ ID NO: 5392274 - DNA, 17 bp, Homo sapiens
cccactctcagaggccc

SEQ ID NO: 5392275 - DNA, 15 bp, Homo sapiens
cccactctccacctc

SEQ ID NO: 5392276 - DNA, 17 bp, Homo sapiens
cccactctccacctcac

SEQ ID NO: 5392277 - DNA, 22 bp, Homo sapiens
cccactctccacctcactagct

SEQ ID NO: 5392278 - DNA, 17 bp, Homo sapiens
cccactctccccacact

SEQ ID NO: 5392279 - DNA, 16 bp, Homo sapiens
cccactctctcaccca

SEQ ID NO: 5392280 - DNA, 18 bp, Homo sapiens
cccactctgctcccagcc

SEQ ID NO: 5392281 - DNA, 14 bp, Homo sapiens
cccactctgctgag

SEQ ID NO: 5392282 - DNA, 14 bp, Homo sapiens
cccactctgtaata

SEQ ID NO: 5392283 - DNA, 16 bp, Homo sapiens
cccactcttgaagagg

SEQ ID NO: 5392284 - DNA, 23 bp, Homo sapiens
cccactctttgctacaataaatg

SEQ ID NO: 5392285 - DNA, 23 bp, Homo sapiens
cccactgaattgacatgaccctc

SEQ ID NO: 5392286 - DNA, 16 bp, Homo sapiens
cccactgacagcctcc

SEQ ID NO: 5392287 - DNA, 10 bp, Homo sapiens
cccactgacc

SEQ ID NO: 5392288 - DNA, 12 bp, Homo sapiens
cccactgaccca

SEQ ID NO: 5392289 - DNA, 17 bp, Homo sapiens
cccactgaggggccagg

SEQ ID NO: 5392290 - DNA, 22 bp, Homo sapiens
cccactgatctctactaccaca

SEQ ID NO: 5392291 - DNA, 12 bp, Homo sapiens
cccactgatgct

SEQ ID NO: 5392292 - DNA, 19 bp, Homo sapiens
cccactgcaacttgtgaac

SEQ ID NO: 5392293 - DNA, 16 bp, Homo sapiens
cccactgcacacacct

SEQ ID NO: 5392294 - DNA, 12 bp, Homo sapiens
cccactgcaccc

SEQ ID NO: 5392295 - DNA, 14 bp, Homo sapiens
cccactgcaccccc

SEQ ID NO: 5392296 - DNA, 23 bp, Homo sapiens
cccactgcacccccctgtgcctg

SEQ ID NO: 5392297 - DNA, 17 bp, Homo sapiens
cccactgcaccccctcc

SEQ ID NO: 5392298 - DNA, 18 bp, Homo sapiens
cccactgcaccccctcct

SEQ ID NO: 5392299 - DNA, 19 bp, Homo sapiens
cccactgcaccccctcctg

SEQ ID NO: 5392300 - DNA, 14 bp, Homo sapiens
cccactgcactcca

SEQ ID NO: 5392301 - DNA, 15 bp, Homo sapiens
cccactgcactccag

SEQ ID NO: 5392302 - DNA, 19 bp, Homo sapiens
cccactgcactccagcctg

SEQ ID NO: 5392303 - DNA, 23 bp, Homo sapiens
cccactgcacttggtgctgcttt

SEQ ID NO: 5392304 - DNA, 19 bp, Homo sapiens
cccactgcaggccccgctt

SEQ ID NO: 5392305 - DNA, 15 bp, Homo sapiens
cccactgccagcagc

SEQ ID NO: 5392306 - DNA, 18 bp, Homo sapiens
cccactgccctccagggc

SEQ ID NO: 5392307 - DNA, 19 bp, Homo sapiens
cccactgccctccagggcc

SEQ ID NO: 5392308 - DNA, 13 bp, Homo sapiens
cccactgccgcct

SEQ ID NO: 5392309 - DNA, 17 bp, Homo sapiens
cccactgccgcctcctt

SEQ ID NO: 5392310 - DNA, 15 bp, Homo sapiens
cccactgcctcaggt

SEQ ID NO: 5392311 - DNA, 16 bp, Homo sapiens
cccactgcctcaggtt

SEQ ID NO: 5392312 - DNA, 12 bp, Homo sapiens
cccactgcctcc

SEQ ID NO: 5392313 - DNA, 16 bp, Homo sapiens
cccactgcctgcccac

SEQ ID NO: 5392314 - DNA, 14 bp, Homo sapiens
cccactgcctttga

SEQ ID NO: 5392315 - DNA, 15 bp, Homo sapiens
cccactgcgcacagc

SEQ ID NO: 5392316 - DNA, 23 bp, Homo sapiens
cccactgcggggagacagaagcc

SEQ ID NO: 5392317 - DNA, 19 bp, Homo sapiens
cccactgctgaaaaagaaa

SEQ ID NO: 5392318 - DNA, 16 bp, Homo sapiens
cccactgctggctgca

SEQ ID NO: 5392319 - DNA, 13 bp, Homo sapiens
cccactgctggtg

SEQ ID NO: 5392320 - DNA, 16 bp, Homo sapiens
cccactgctggtgcca

SEQ ID NO: 5392321 - DNA, 23 bp, Homo sapiens
cccactgcttttggtctgtgtga

SEQ ID NO: 5392322 - DNA, 12 bp, Homo sapiens
cccactggagca

SEQ ID NO: 5392323 - DNA, 13 bp, Homo sapiens
cccactggagcag

SEQ ID NO: 5392324 - DNA, 16 bp, Homo sapiens
cccactggagtctctc

SEQ ID NO: 5392325 - DNA, 16 bp, Homo sapiens
cccactggccgctgag

SEQ ID NO: 5392326 - DNA, 13 bp, Homo sapiens
cccactggccggc

SEQ ID NO: 5392327 - DNA, 18 bp, Homo sapiens
cccactggctcctccagc

SEQ ID NO: 5392328 - DNA, 19 bp, Homo sapiens
cccactggctcctccagca

SEQ ID NO: 5392329 - DNA, 20 bp, Homo sapiens
cccactggctcctcccagca

SEQ ID NO: 5392330 - DNA, 16 bp, Homo sapiens
cccactggctgagaat

SEQ ID NO: 5392331 - DNA, 16 bp, Homo sapiens
cccactggctgtgggc

SEQ ID NO: 5392332 - DNA, 19 bp, Homo sapiens
cccactgggaccaaccctg

SEQ ID NO: 5392333 - DNA, 12 bp, Homo sapiens
cccactgggaga

SEQ ID NO: 5392334 - DNA, 23 bp, Homo sapiens
cccactgggcacacgcacaaaca

SEQ ID NO: 5392335 - DNA, 16 bp, Homo sapiens
cccactgtaacaatac

SEQ ID NO: 5392336 - DNA, 19 bp, Homo sapiens
cccactgtacttgctcttg

SEQ ID NO: 5392337 - DNA, 12 bp, Homo sapiens
cccactgtatga

SEQ ID NO: 5392338 - DNA, 21 bp, Homo sapiens
cccactgtcaggcctctgagc

SEQ ID NO: 5392339 - DNA, 17 bp, Homo sapiens
cccactgtcctgggcgc

SEQ ID NO: 5392340 - DNA, 18 bp, Homo sapiens
cccactgtcctgggcgcc

SEQ ID NO: 5392341 - DNA, 23 bp, Homo sapiens
cccactgtcctgggcgccctgga

SEQ ID NO: 5392342 - DNA, 13 bp, Homo sapiens
cccactgtccttt

SEQ ID NO: 5392343 - DNA, 17 bp, Homo sapiens
cccactgtcctttctcc

SEQ ID NO: 5392344 - DNA, 19 bp, Homo sapiens
cccactgtcctttctccag

SEQ ID NO: 5392345 - DNA, 15 bp, Homo sapiens
cccactgtgcctcag

SEQ ID NO: 5392346 - DNA, 20 bp, Homo sapiens
cccactgtgcgtggggctcc

SEQ ID NO: 5392347 - DNA, 17 bp, Homo sapiens
cccactgtggggcaagc

SEQ ID NO: 5392348 - DNA, 21 bp, Homo sapiens
cccagcccctagaaacccaag

SEQ ID NO: 5392349 - DNA, 13 bp, Homo sapiens
cccagcccctagc

SEQ ID NO: 5392350 - DNA, 19 bp, Homo sapiens
cccagcccctagcccagga

SEQ ID NO: 5392351 - DNA, 20 bp, Homo sapiens
cccagcccctagcccaggag

SEQ ID NO: 5392352 - DNA, 17 bp, Homo sapiens
cccagcccctcctccct

SEQ ID NO: 5392353 - DNA, 18 bp, Homo sapiens
cccagcccctcctccctc

SEQ ID NO: 5392354 - DNA, 12 bp, Homo sapiens
cccagcccctgc

SEQ ID NO: 5392355 - DNA, 13 bp, Homo sapiens
cccagcccctgca

SEQ ID NO: 5392356 - DNA, 16 bp, Homo sapiens
cccagcccctgcagat

SEQ ID NO: 5392357 - DNA, 14 bp, Homo sapiens
cccagcccctgccc

SEQ ID NO: 5392358 - DNA, 16 bp, Homo sapiens
cccagcccctgcccct

SEQ ID NO: 5392359 - DNA, 23 bp, Homo sapiens
cccagcccctgcccctcatgcca

SEQ ID NO: 5392360 - DNA, 17 bp, Homo sapiens
cccagcccctggtggtg

SEQ ID NO: 5392361 - DNA, 15 bp, Homo sapiens
cccagccccttcccc

SEQ ID NO: 5392362 - DNA, 17 bp, Homo sapiens
cccagccccttcccctg

SEQ ID NO: 5392363 - DNA, 20 bp, Homo sapiens
cccagccccttctcccagca

SEQ ID NO: 5392364 - DNA, 23 bp, Homo sapiens
cccagccccttttctctgctctt

SEQ ID NO: 5392365 - DNA, 16 bp, Homo sapiens
cccagcccggctccca

SEQ ID NO: 5392366 - DNA, 17 bp, Homo sapiens
cccagccctatggatgt

SEQ ID NO: 5392367 - DNA, 17 bp, Homo sapiens
cccagccctcaggccag

SEQ ID NO: 5392368 - DNA, 18 bp, Homo sapiens
cccagccctcaggccagt

SEQ ID NO: 5392369 - DNA, 14 bp, Homo sapiens
cccagccctcagtc

SEQ ID NO: 5392370 - DNA, 19 bp, Homo sapiens
cccagccctcatcccgagc

SEQ ID NO: 5392371 - DNA, 15 bp, Homo sapiens
cccagccctccagta

SEQ ID NO: 5392372 - DNA, 17 bp, Homo sapiens
cccagccctccagtacc

SEQ ID NO: 5392373 - DNA, 24 bp, Homo sapiens
cccagccctccccacctgctcacc

SEQ ID NO: 5392374 - DNA, 18 bp, Homo sapiens
cccagccctccttcaggg

SEQ ID NO: 5392375 - DNA, 21 bp, Homo sapiens
cccagccctctgtggccagga

SEQ ID NO: 5392376 - DNA, 22 bp, Homo sapiens
cccagccctctgtggccaggag

SEQ ID NO: 5392377 - DNA, 18 bp, Homo sapiens
cccagccctgaggggtgg

SEQ ID NO: 5392378 - DNA, 20 bp, Homo sapiens
cccagccctgctggccgcct

SEQ ID NO: 5392379 - DNA, 12 bp, Homo sapiens
cccagccctggc

SEQ ID NO: 5392380 - DNA, 14 bp, Homo sapiens
cccagccctggccc

SEQ ID NO: 5392381 - DNA, 15 bp, Homo sapiens
cccagccctggccca

SEQ ID NO: 5392382 - DNA, 15 bp, Homo sapiens
cccagccctggcccc

SEQ ID NO: 5392383 - DNA, 18 bp, Homo sapiens
cccagccctggctctgca

SEQ ID NO: 5392384 - DNA, 22 bp, Homo sapiens
cccagccctgggcaaggaagct

SEQ ID NO: 5392385 - DNA, 14 bp, Homo sapiens
cccagccctgggct

SEQ ID NO: 5392386 - DNA, 15 bp, Homo sapiens
cccagccctgggctt

SEQ ID NO: 5392387 - DNA, 14 bp, Homo sapiens
cccagccctggggg

SEQ ID NO: 5392388 - DNA, 19 bp, Homo sapiens
cccagccctggtctcagca

SEQ ID NO: 5392389 - DNA, 20 bp, Homo sapiens
cccagccctgtcctggttcc

SEQ ID NO: 5392390 - DNA, 13 bp, Homo sapiens
cccagcccttagc

SEQ ID NO: 5392391 - DNA, 15 bp, Homo sapiens
cccagcccttagcac

SEQ ID NO: 5392392 - DNA, 19 bp, Homo sapiens
cccagcccttcctctgctc

SEQ ID NO: 5392393 - DNA, 18 bp, Homo sapiens
cccagcccttccttgggc

SEQ ID NO: 5392394 - DNA, 24 bp, Homo sapiens
cccagcccttccttgggcgtctcc

SEQ ID NO: 5392395 - DNA, 14 bp, Homo sapiens
cccagcccttctgc

SEQ ID NO: 5392396 - DNA, 18 bp, Homo sapiens
cccagcccttctgccttt

SEQ ID NO: 5392397 - DNA, 20 bp, Homo sapiens
cccagcccttctgcctttct

SEQ ID NO: 5392398 - DNA, 19 bp, Homo sapiens
cccagccgaccccctctcc

SEQ ID NO: 5392399 - DNA, 23 bp, Homo sapiens
cccagccgcttggcgatgccagc

SEQ ID NO: 5392400 - DNA, 18 bp, Homo sapiens
cccagccggccaatggaa

SEQ ID NO: 5392401 - DNA, 15 bp, Homo sapiens
cccagccggcctctc

SEQ ID NO: 5392402 - DNA, 21 bp, Homo sapiens
cccagccggcctctctggcct

SEQ ID NO: 5392403 - DNA, 22 bp, Homo sapiens
cccagccggcctctctggcctc

SEQ ID NO: 5392404 - DNA, 15 bp, Homo sapiens
cccagccggggtggg

SEQ ID NO: 5392405 - DNA, 22 bp, Homo sapiens
cccagccgtcgtctccctcgac

SEQ ID NO: 5392406 - DNA, 19 bp, Homo sapiens
cccagcctaagggagacag

SEQ ID NO: 5392407 - DNA, 19 bp, Homo sapiens
cccagcctaggcttggctc

SEQ ID NO: 5392408 - DNA, 22 bp, Homo sapiens
cccagcctagtcagggcacagc

SEQ ID NO: 5392409 - DNA, 17 bp, Homo sapiens
cccagcctatctctctt

SEQ ID NO: 5392410 - DNA, 9 bp, Homo sapiens
cccagcctc

SEQ ID NO: 5392411 - DNA, 21 bp, Homo sapiens
cccagcctcaaatccaggacc

SEQ ID NO: 5392412 - DNA, 12 bp, Homo sapiens
cccagcctcact

SEQ ID NO: 5392413 - DNA, 22 bp, Homo sapiens
cccagcctcagaagccttcttg

SEQ ID NO: 5392414 - DNA, 14 bp, Homo sapiens
cccagcctcagccc

SEQ ID NO: 5392415 - DNA, 15 bp, Homo sapiens
cccagcctcagccca

SEQ ID NO: 5392416 - DNA, 16 bp, Homo sapiens
cccagcctcagcccaa

SEQ ID NO: 5392417 - DNA, 14 bp, Homo sapiens
cccagcctcagcgc

SEQ ID NO: 5392418 - DNA, 12 bp, Homo sapiens
cccagcctcagt

SEQ ID NO: 5392419 - DNA, 18 bp, Homo sapiens
cccagcctccagagaagc

SEQ ID NO: 5392420 - DNA, 18 bp, Homo sapiens
cccagcctcccccaggct

SEQ ID NO: 5392421 - DNA, 20 bp, Homo sapiens
cccagcctcccccaggctgc

SEQ ID NO: 5392422 - DNA, 18 bp, Homo sapiens
cccagcctccctgaagcc

SEQ ID NO: 5392423 - DNA, 23 bp, Homo sapiens
cccagcctcgcatgccagagcct

SEQ ID NO: 5392424 - DNA, 19 bp, Homo sapiens
cccagcctcgcctgtcacc

SEQ ID NO: 5392425 - DNA, 15 bp, Homo sapiens
cccagcctctcctcc

SEQ ID NO: 5392426 - DNA, 12 bp, Homo sapiens
cccagcctctct

SEQ ID NO: 5392427 - DNA, 13 bp, Homo sapiens
cccagcctctctg

SEQ ID NO: 5392428 - DNA, 21 bp, Homo sapiens
cccagcctctcttcctatccc

SEQ ID NO: 5392429 - DNA, 23 bp, Homo sapiens
cccagcctctggggcagagcttg

SEQ ID NO: 5392430 - DNA, 16 bp, Homo sapiens
cccagcctctgtccct

SEQ ID NO: 5392431 - DNA, 17 bp, Homo sapiens
cccagcctctgtccctc

SEQ ID NO: 5392432 - DNA, 18 bp, Homo sapiens
cccagcctcttccattcc

SEQ ID NO: 5392433 - DNA, 21 bp, Homo sapiens
cccagcctcttctagagccgt

SEQ ID NO: 5392434 - DNA, 16 bp, Homo sapiens
cccagcctctttccct

SEQ ID NO: 5392435 - DNA, 10 bp, Homo sapiens
cccagcctga

SEQ ID NO: 5392436 - DNA, 12 bp, Homo sapiens
cccagcctgaaa

SEQ ID NO: 5392437 - DNA, 16 bp, Homo sapiens
cccagcctgacctgag

SEQ ID NO: 5392438 - DNA, 20 bp, Homo sapiens
cccagcctgccccagcctcc

SEQ ID NO: 5392439 - DNA, 21 bp, Homo sapiens
cccagcctgccccagcctccc

SEQ ID NO: 5392440 - DNA, 11 bp, Homo sapiens
cccagcctgcg

SEQ ID NO: 5392441 - DNA, 21 bp, Homo sapiens
cccagcctgctagctagctca

SEQ ID NO: 5392442 - DNA, 15 bp, Homo sapiens
cccagcctgctgaga

SEQ ID NO: 5392443 - DNA, 14 bp, Homo sapiens
cccagcctggatgc

SEQ ID NO: 5392444 - DNA, 13 bp, Homo sapiens
cccagcctggcca

SEQ ID NO: 5392445 - DNA, 20 bp, Homo sapiens
cccagcctggccacgcagcc

SEQ ID NO: 5392446 - DNA, 14 bp, Homo sapiens
cccagcctggccca

SEQ ID NO: 5392447 - DNA, 15 bp, Homo sapiens
cccagcctggcccca

SEQ ID NO: 5392448 - DNA, 11 bp, Homo sapiens
cccagcctggg

SEQ ID NO: 5392449 - DNA, 13 bp, Homo sapiens
cccagcctggggc

SEQ ID NO: 5392450 - DNA, 17 bp, Homo sapiens
cccagcctgggggccag

SEQ ID NO: 5392451 - DNA, 11 bp, Homo sapiens
cccagcctggt

SEQ ID NO: 5392452 - DNA, 14 bp, Homo sapiens
cccagcctgtcaga

SEQ ID NO: 5392453 - DNA, 18 bp, Homo sapiens
cccagcctgtcagatcca

SEQ ID NO: 5392454 - DNA, 12 bp, Homo sapiens
cccagcctgtcc

SEQ ID NO: 5392455 - DNA, 13 bp, Homo sapiens
cccagcctgtcct

SEQ ID NO: 5392456 - DNA, 19 bp, Homo sapiens
cccagcctgtcctggtaca

SEQ ID NO: 5392457 - DNA, 22 bp, Homo sapiens
cccagcctgtcctggtacagca

SEQ ID NO: 5392458 - DNA, 13 bp, Homo sapiens
cccagcctgtggc

SEQ ID NO: 5392459 - DNA, 18 bp, Homo sapiens
cccagcctgtggcctcag

SEQ ID NO: 5392460 - DNA, 21 bp, Homo sapiens
cccagcctgtggcctcagcat

SEQ ID NO: 5392461 - DNA, 22 bp, Homo sapiens
cccagcctgtggcctcagcatc

SEQ ID NO: 5392462 - DNA, 17 bp, Homo sapiens
cccagccttgcccagct

SEQ ID NO: 5392463 - DNA, 18 bp, Homo sapiens
cccagccttgcccagctt

SEQ ID NO: 5392464 - DNA, 12 bp, Homo sapiens
cccagccttggt

SEQ ID NO: 5392465 - DNA, 13 bp, Homo sapiens
cccagccttgttt

SEQ ID NO: 5392466 - DNA, 22 bp, Homo sapiens
cccagcctttgttccccactgg

SEQ ID NO: 5392467 - DNA, 20 bp, Homo sapiens
cccagcgacatttctccaag

SEQ ID NO: 5392468 - DNA, 13 bp, Homo sapiens
cccagcgagccac

SEQ ID NO: 5392469 - DNA, 16 bp, Homo sapiens
cccagcgagccacagg

SEQ ID NO: 5392470 - DNA, 18 bp, Homo sapiens
cccagcgagccacaggaa

SEQ ID NO: 5392471 - DNA, 23 bp, Homo sapiens
cccagcgagccacaggaacggcc

SEQ ID NO: 5392472 - DNA, 14 bp, Homo sapiens
cccagcgagccctg

SEQ ID NO: 5392473 - DNA, 19 bp, Homo sapiens
cccagcgagccctggtggc

SEQ ID NO: 5392474 - DNA, 16 bp, Homo sapiens
cccagcgagggcccca

SEQ ID NO: 5392475 - DNA, 23 bp, Homo sapiens
cccagcgattccctctcccaggc

SEQ ID NO: 5392476 - DNA, 15 bp, Homo sapiens
cccagcgccatcctg

SEQ ID NO: 5392477 - DNA, 23 bp, Homo sapiens
cccagcgccggggggagggagga

SEQ ID NO: 5392478 - DNA, 15 bp, Homo sapiens
cccagcgcggccagc

SEQ ID NO: 5392479 - DNA, 14 bp, Homo sapiens
cccagcgcggcttg

SEQ ID NO: 5392480 - DNA, 17 bp, Homo sapiens
cccagcgcggcttggcc

SEQ ID NO: 5392481 - DNA, 21 bp, Homo sapiens
cccagcgcggcttggccgcca

SEQ ID NO: 5392482 - DNA, 23 bp, Homo sapiens
cccagcgcggcttggccgccatc

SEQ ID NO: 5392483 - DNA, 21 bp, Homo sapiens
cccagcgctcgccacgctcag

SEQ ID NO: 5392484 - DNA, 15 bp, Homo sapiens
cccagcgctctcctg

SEQ ID NO: 5392485 - DNA, 21 bp, Homo sapiens
cccagcgctgacgtgtcagga

SEQ ID NO: 5392486 - DNA, 15 bp, Homo sapiens
cccagcggacacacg

SEQ ID NO: 5392487 - DNA, 20 bp, Homo sapiens
cccagcggacagtggcagga

SEQ ID NO: 5392488 - DNA, 18 bp, Homo sapiens
cccagcggcagatgggcc

SEQ ID NO: 5392489 - DNA, 19 bp, Homo sapiens
cccagcggccccccgcaca

SEQ ID NO: 5392490 - DNA, 14 bp, Homo sapiens
cccagcggcccctc

SEQ ID NO: 5392491 - DNA, 15 bp, Homo sapiens
cccagcggcccctcc

SEQ ID NO: 5392492 - DNA, 19 bp, Homo sapiens
cccagcggcccctcccaca

SEQ ID NO: 5392493 - DNA, 16 bp, Homo sapiens
cccagcggctcttcct

SEQ ID NO: 5392494 - DNA, 17 bp, Homo sapiens
cccagcggctcttcctg

SEQ ID NO: 5392495 - DNA, 15 bp, Homo sapiens
cccagcggctggtgc

SEQ ID NO: 5392496 - DNA, 22 bp, Homo sapiens
cccagcggcttagccaagccct

SEQ ID NO: 5392497 - DNA, 21 bp, Homo sapiens
cccagcggtccaatgccacct

SEQ ID NO: 5392498 - DNA, 18 bp, Homo sapiens
cccagcggttcctgtgca

SEQ ID NO: 5392499 - DNA, 20 bp, Homo sapiens
cccagcggttcctgtgcaga

SEQ ID NO: 5392500 - DNA, 18 bp, Homo sapiens
cccagcggtttccacttg

SEQ ID NO: 5392501 - DNA, 15 bp, Homo sapiens
cccagcgtctgcagg

SEQ ID NO: 5392502 - DNA, 15 bp, Homo sapiens
cccagcgtggcctcc

SEQ ID NO: 5392503 - DNA, 19 bp, Homo sapiens
cccagctaaagcagtcctc

SEQ ID NO: 5392504 - DNA, 15 bp, Homo sapiens
cccagctaaataatc

SEQ ID NO: 5392505 - DNA, 17 bp, Homo sapiens
cccagctaagaacctgg

SEQ ID NO: 5392506 - DNA, 18 bp, Homo sapiens
cccagctaagaacctgga

SEQ ID NO: 5392507 - DNA, 22 bp, Homo sapiens
cccagctaagaacctggaactt

SEQ ID NO: 5392508 - DNA, 18 bp, Homo sapiens
cccagctaattgagacca

SEQ ID NO: 5392509 - DNA, 14 bp, Homo sapiens
cccagctacacctg

SEQ ID NO: 5392510 - DNA, 15 bp, Homo sapiens
cccagctacattcct

SEQ ID NO: 5392511 - DNA, 19 bp, Homo sapiens
cccagctacattcctcagc

SEQ ID NO: 5392512 - DNA, 20 bp, Homo sapiens
cccagctacattcctcagct

SEQ ID NO: 5392513 - DNA, 23 bp, Homo sapiens
cccagctacattcctcagctgcc

SEQ ID NO: 5392514 - DNA, 20 bp, Homo sapiens
cccagctacgtgggaggctg

SEQ ID NO: 5392515 - DNA, 23 bp, Homo sapiens
cccagctactcagaagcctgagg

SEQ ID NO: 5392516 - DNA, 20 bp, Homo sapiens
cccagctactcaggaggctg

SEQ ID NO: 5392517 - DNA, 21 bp, Homo sapiens
cccagctactcaggaggctga

SEQ ID NO: 5392518 - DNA, 22 bp, Homo sapiens
cccagctactcaggaggctgag

SEQ ID NO: 5392519 - DNA, 14 bp, Homo sapiens
cccagctactcgat

SEQ ID NO: 5392520 - DNA, 20 bp, Homo sapiens
cccagctactgtatgccccc

SEQ ID NO: 5392521 - DNA, 17 bp, Homo sapiens
cccagctacttgggagc

SEQ ID NO: 5392522 - DNA, 23 bp, Homo sapiens
cccagctacttgggaggctgagg

SEQ ID NO: 5392523 - DNA, 23 bp, Homo sapiens
cccagctaggaagagcaggactc

SEQ ID NO: 5392524 - DNA, 15 bp, Homo sapiens
cccagctagggctgg

SEQ ID NO: 5392525 - DNA, 18 bp, Homo sapiens
cccaggggacgtggcgct

SEQ ID NO: 5392526 - DNA, 21 bp, Homo sapiens
cccaggggagagggtctggag

SEQ ID NO: 5392527 - DNA, 22 bp, Homo sapiens
cccaggggagagggtctggaga

SEQ ID NO: 5392528 - DNA, 18 bp, Homo sapiens
cccaggggagccagctgc

SEQ ID NO: 5392529 - DNA, 15 bp, Homo sapiens
cccaggggagccctc

SEQ ID NO: 5392530 - DNA, 16 bp, Homo sapiens
cccaggggagccctcc

SEQ ID NO: 5392531 - DNA, 19 bp, Homo sapiens
cccaggggagccctccacg

SEQ ID NO: 5392532 - DNA, 15 bp, Homo sapiens
cccaggggaggcaca

SEQ ID NO: 5392533 - DNA, 16 bp, Homo sapiens
cccaggggcagcaagg

SEQ ID NO: 5392534 - DNA, 22 bp, Homo sapiens
cccaggggcatgtattggcctg

SEQ ID NO: 5392535 - DNA, 23 bp, Homo sapiens
cccaggggcatgtattggcctgg

SEQ ID NO: 5392536 - DNA, 17 bp, Homo sapiens
cccaggggcccacaggg

SEQ ID NO: 5392537 - DNA, 18 bp, Homo sapiens
cccaggggcccacaggga

SEQ ID NO: 5392538 - DNA, 15 bp, Homo sapiens
cccaggggcctttgc

SEQ ID NO: 5392539 - DNA, 17 bp, Homo sapiens
cccaggggcctttgcag

SEQ ID NO: 5392540 - DNA, 21 bp, Homo sapiens
cccaggggctggcttcaggag

SEQ ID NO: 5392541 - DNA, 13 bp, Homo sapiens
cccaggggctttg

SEQ ID NO: 5392542 - DNA, 18 bp, Homo sapiens
cccagggggcctggagca

SEQ ID NO: 5392543 - DNA, 16 bp, Homo sapiens
cccagggggctgaaac

SEQ ID NO: 5392544 - DNA, 22 bp, Homo sapiens
cccagggggcttcctgagggga

SEQ ID NO: 5392545 - DNA, 16 bp, Homo sapiens
cccaggggggcctcct

SEQ ID NO: 5392546 - DNA, 17 bp, Homo sapiens
cccaggggggcctcctc

SEQ ID NO: 5392547 - DNA, 14 bp, Homo sapiens
cccaggggtccagg

SEQ ID NO: 5392548 - DNA, 18 bp, Homo sapiens
cccaggggtcccagccac

SEQ ID NO: 5392549 - DNA, 20 bp, Homo sapiens
cccaggggtcccagccaccc

SEQ ID NO: 5392550 - DNA, 15 bp, Homo sapiens
cccaggggtcccctg

SEQ ID NO: 5392551 - DNA, 19 bp, Homo sapiens
cccaggggtctccctgagc

SEQ ID NO: 5392552 - DNA, 21 bp, Homo sapiens
cccaggggtctccctgagcct

SEQ ID NO: 5392553 - DNA, 22 bp, Homo sapiens
cccaggggtctccctgagcctg

SEQ ID NO: 5392554 - DNA, 23 bp, Homo sapiens
cccaggggtctccctgagcctgc

SEQ ID NO: 5392555 - DNA, 17 bp, Homo sapiens
cccaggggtctccctgg

SEQ ID NO: 5392556 - DNA, 16 bp, Homo sapiens
cccaggggtgagcccc

SEQ ID NO: 5392557 - DNA, 17 bp, Homo sapiens
cccaggggtgccccctc

SEQ ID NO: 5392558 - DNA, 20 bp, Homo sapiens
cccagggtacccgcctgagc

SEQ ID NO: 5392559 - DNA, 21 bp, Homo sapiens
cccagggtagcccgcctgcca

SEQ ID NO: 5392560 - DNA, 22 bp, Homo sapiens
cccagggtagcccgcctgccag

SEQ ID NO: 5392561 - DNA, 23 bp, Homo sapiens
cccagggtcataagtggggagag

SEQ ID NO: 5392562 - DNA, 14 bp, Homo sapiens
cccagggtcccacc

SEQ ID NO: 5392563 - DNA, 15 bp, Homo sapiens
cccagggtcccaccc

SEQ ID NO: 5392564 - DNA, 22 bp, Homo sapiens
cccagggtcccacccccaaccc

SEQ ID NO: 5392565 - DNA, 14 bp, Homo sapiens
cccagggtcccctc

SEQ ID NO: 5392566 - DNA, 18 bp, Homo sapiens
cccagggtcccctcccca

SEQ ID NO: 5392567 - DNA, 14 bp, Homo sapiens
cccagggtcccctg

SEQ ID NO: 5392568 - DNA, 15 bp, Homo sapiens
cccagggtcccctgc

SEQ ID NO: 5392569 - DNA, 13 bp, Homo sapiens
cccagggtcctgg

SEQ ID NO: 5392570 - DNA, 17 bp, Homo sapiens
cccagggtcctgggagg

SEQ ID NO: 5392571 - DNA, 18 bp, Homo sapiens
cccagggtcctgggagga

SEQ ID NO: 5392572 - DNA, 15 bp, Homo sapiens
cccagggtcttccct

SEQ ID NO: 5392573 - DNA, 18 bp, Homo sapiens
cccagggtcttccctacc

SEQ ID NO: 5392574 - DNA, 23 bp, Homo sapiens
cccagggtcttccctacctcagg

SEQ ID NO: 5392575 - DNA, 13 bp, Homo sapiens
cccagggtgcagg

SEQ ID NO: 5392576 - DNA, 17 bp, Homo sapiens
cccagggtgcagtgtga

SEQ ID NO: 5392577 - DNA, 18 bp, Homo sapiens
cccagggtggagtgcagt

SEQ ID NO: 5392578 - DNA, 19 bp, Homo sapiens
cccagggttaatagggcct

SEQ ID NO: 5392579 - DNA, 18 bp, Homo sapiens
cccagggttcccccagcc

SEQ ID NO: 5392580 - DNA, 14 bp, Homo sapiens
cccagggttcccgc

SEQ ID NO: 5392581 - DNA, 19 bp, Homo sapiens
cccaggtaagcaggaggag

SEQ ID NO: 5392582 - DNA, 14 bp, Homo sapiens
cccaggtacacctc

SEQ ID NO: 5392583 - DNA, 16 bp, Homo sapiens
cccaggtacacctccc

SEQ ID NO: 5392584 - DNA, 22 bp, Homo sapiens
cccaggtacacctccccctgcg

SEQ ID NO: 5392585 - DNA, 19 bp, Homo sapiens
cccaggtaccagctgcgct

SEQ ID NO: 5392586 - DNA, 20 bp, Homo sapiens
cccaggtagctgggattaca

SEQ ID NO: 5392587 - DNA, 17 bp, Homo sapiens
cccaggtaggccaaggt

SEQ ID NO: 5392588 - DNA, 21 bp, Homo sapiens
cccaggtaggggcccctctca

SEQ ID NO: 5392589 - DNA, 22 bp, Homo sapiens
cccaggtaggggcccctctcag

SEQ ID NO: 5392590 - DNA, 15 bp, Homo sapiens
cccaggtcaccggga

SEQ ID NO: 5392591 - DNA, 18 bp, Homo sapiens
cccaggtccagctctgga

SEQ ID NO: 5392592 - DNA, 15 bp, Homo sapiens
cccaggtccccaaac

SEQ ID NO: 5392593 - DNA, 14 bp, Homo sapiens
cccaggtcccgagc

SEQ ID NO: 5392594 - DNA, 14 bp, Homo sapiens
cccaggtcctgtct

SEQ ID NO: 5392595 - DNA, 13 bp, Homo sapiens
cccaggtccttcc

SEQ ID NO: 5392596 - DNA, 18 bp, Homo sapiens
cccaggtctcctgggcat

SEQ ID NO: 5392597 - DNA, 19 bp, Homo sapiens
cccaggtctctccactgct

SEQ ID NO: 5392598 - DNA, 20 bp, Homo sapiens
cccaggtctctccactgctc

SEQ ID NO: 5392599 - DNA, 22 bp, Homo sapiens
cccaggtctctccactgctctc

SEQ ID NO: 5392600 - DNA, 20 bp, Homo sapiens
cccaggtctcttcctttgct

SEQ ID NO: 5392601 - DNA, 14 bp, Homo sapiens
cccaggtctgggtg

SEQ ID NO: 5392602 - DNA, 21 bp, Homo sapiens
cccaggtctgggtggggccca

SEQ ID NO: 5392603 - DNA, 17 bp, Homo sapiens
cccaggtcttccagacc

SEQ ID NO: 5392604 - DNA, 18 bp, Homo sapiens
cccaggtcttccagacct

SEQ ID NO: 5392605 - DNA, 14 bp, Homo sapiens
cccaggtcttcctg

SEQ ID NO: 5392606 - DNA, 13 bp, Homo sapiens
cccaggtcttttc

SEQ ID NO: 5392607 - DNA, 20 bp, Homo sapiens
cccaggtgacacgcttctga

SEQ ID NO: 5392608 - DNA, 23 bp, Homo sapiens
cccaggtgacacgcttctgagca

SEQ ID NO: 5392609 - DNA, 14 bp, Homo sapiens
cccaggtgagacct

SEQ ID NO: 5392610 - DNA, 19 bp, Homo sapiens
cccaggtgaggaatttgaa

SEQ ID NO: 5392611 - DNA, 22 bp, Homo sapiens
cccaggtgaggaatttgaagct

SEQ ID NO: 5392612 - DNA, 19 bp, Homo sapiens
cccaggtgagggaaggaga

SEQ ID NO: 5392613 - DNA, 15 bp, Homo sapiens
cccaggtgcagccag

SEQ ID NO: 5392614 - DNA, 14 bp, Homo sapiens
cccaggtgcagccc

SEQ ID NO: 5392615 - DNA, 19 bp, Homo sapiens
cccaggtgccaccaataaa

SEQ ID NO: 5392616 - DNA, 22 bp, Homo sapiens
cccaggtgcgtgtgtctctgtc

SEQ ID NO: 5392617 - DNA, 18 bp, Homo sapiens
cccaggtgctggaggcag

SEQ ID NO: 5392618 - DNA, 20 bp, Homo sapiens
cccaggtgctggaggcagac

SEQ ID NO: 5392619 - DNA, 21 bp, Homo sapiens
cccaggtggagggcacagccc

SEQ ID NO: 5392620 - DNA, 19 bp, Homo sapiens
cccaggtggaggtgccagg

SEQ ID NO: 5392621 - DNA, 13 bp, Homo sapiens
cccaggtggcctg

SEQ ID NO: 5392622 - DNA, 20 bp, Homo sapiens
cccaggtggcctgcgtcttt

SEQ ID NO: 5392623 - DNA, 15 bp, Homo sapiens
cccaggtggcctgga

SEQ ID NO: 5392624 - DNA, 12 bp, Homo sapiens
cccaggtggcta

SEQ ID NO: 5392625 - DNA, 16 bp, Homo sapiens
cccaggtggctgaccc

SEQ ID NO: 5392626 - DNA, 14 bp, Homo sapiens
cccaggtggctgtg

SEQ ID NO: 5392627 - DNA, 14 bp, Homo sapiens
cccaggtgggactt

SEQ ID NO: 5392628 - DNA, 20 bp, Homo sapiens
cccaggtggggtttcctgca

SEQ ID NO: 5392629 - DNA, 21 bp, Homo sapiens
cccaggtggggtttcctgcat

SEQ ID NO: 5392630 - DNA, 15 bp, Homo sapiens
cccaggtgtgcctgt

SEQ ID NO: 5392631 - DNA, 14 bp, Homo sapiens
cccaggtgtgtgct

SEQ ID NO: 5392632 - DNA, 19 bp, Homo sapiens
cccaggtgttaacattcca

SEQ ID NO: 5392633 - DNA, 21 bp, Homo sapiens
cccaggtgttaacattccaag

SEQ ID NO: 5392634 - DNA, 23 bp, Homo sapiens
cccaggtgttgtccgtgtctgtt

SEQ ID NO: 5392635 - DNA, 23 bp, Homo sapiens
cccaggttcaagcgactctcctg

SEQ ID NO: 5392636 - DNA, 17 bp, Homo sapiens
cccaggttcgagaccca

SEQ ID NO: 5392637 - DNA, 18 bp, Homo sapiens
cccaggttggagtgcagt

SEQ ID NO: 5392638 - DNA, 19 bp, Homo sapiens
cccaggttggagtgcagtg

SEQ ID NO: 5392639 - DNA, 17 bp, Homo sapiens
cccaggttggcctggtg

SEQ ID NO: 5392640 - DNA, 20 bp, Homo sapiens
cccaggttggcctggtggcc

SEQ ID NO: 5392641 - DNA, 18 bp, Homo sapiens
cccaggttggctctgcca

SEQ ID NO: 5392642 - DNA, 20 bp, Homo sapiens
cccaggttggctctgccagt

SEQ ID NO: 5392643 - DNA, 19 bp, Homo sapiens
cccaggtttcttctctgga

SEQ ID NO: 5392644 - DNA, 21 bp, Homo sapiens
cccaggtttcttctctggaga

SEQ ID NO: 5392645 - DNA, 13 bp, Homo sapiens
cccaggttttctg

SEQ ID NO: 5392646 - DNA, 17 bp, Homo sapiens
cccaggtttttgcccat

SEQ ID NO: 5392647 - DNA, 22 bp, Homo sapiens
cccaggtttttgcccatcctcc

SEQ ID NO: 5392648 - DNA, 23 bp, Homo sapiens
cccaggtttttgcccatcctccc

SEQ ID NO: 5392649 - DNA, 18 bp, Homo sapiens
cccagtaaaatttcagga

SEQ ID NO: 5392650 - DNA, 21 bp, Homo sapiens
cccagtaagtttcccctctgg

SEQ ID NO: 5392651 - DNA, 18 bp, Homo sapiens
cccagtacaccccacctc

SEQ ID NO: 5392652 - DNA, 14 bp, Homo sapiens
cccagtacctcctg

SEQ ID NO: 5392653 - DNA, 21 bp, Homo sapiens
cccagtacctcctgtctctgg

SEQ ID NO: 5392654 - DNA, 16 bp, Homo sapiens
cccagtagaccttgtt

SEQ ID NO: 5392655 - DNA, 22 bp, Homo sapiens
cccagtagccattttgtaactg

SEQ ID NO: 5392656 - DNA, 22 bp, Homo sapiens
cccagtagccccaatatggtgg

SEQ ID NO: 5392657 - DNA, 20 bp, Homo sapiens
cccagtagctacggttccct

SEQ ID NO: 5392658 - DNA, 23 bp, Homo sapiens
cccagtagggtttgacatttcat

SEQ ID NO: 5392659 - DNA, 24 bp, Homo sapiens
cccagtagtcagaagcaggttctt

SEQ ID NO: 5392660 - DNA, 21 bp, Homo sapiens
cccagtatacctcatttttca

SEQ ID NO: 5392661 - DNA, 18 bp, Homo sapiens
cccagtatgttttaacaa

SEQ ID NO: 5392662 - DNA, 20 bp, Homo sapiens
cccagtcacctccccacatc

SEQ ID NO: 5392663 - DNA, 19 bp, Homo sapiens
cccagtcactcctctctag

SEQ ID NO: 5392664 - DNA, 15 bp, Homo sapiens
cccagtcacttcctg

SEQ ID NO: 5392665 - DNA, 12 bp, Homo sapiens
cccagtcagaaa

SEQ ID NO: 5392666 - DNA, 13 bp, Homo sapiens
cccagtcagaaat

SEQ ID NO: 5392667 - DNA, 21 bp, Homo sapiens
cccagtcagaagttctgggtg

SEQ ID NO: 5392668 - DNA, 19 bp, Homo sapiens
cccagtcagcctggctggg

SEQ ID NO: 5392669 - DNA, 21 bp, Homo sapiens
cccagtcagcctggctgggct

SEQ ID NO: 5392670 - DNA, 13 bp, Homo sapiens
cccagtcatccag

SEQ ID NO: 5392671 - DNA, 17 bp, Homo sapiens
cccagtcattctgggaa

SEQ ID NO: 5392672 - DNA, 19 bp, Homo sapiens
cccagtccaaatgtcctcc

SEQ ID NO: 5392673 - DNA, 13 bp, Homo sapiens
cccagtccatgct

SEQ ID NO: 5392674 - DNA, 16 bp, Homo sapiens
cccagtccatgctcca

SEQ ID NO: 5392675 - DNA, 22 bp, Homo sapiens
cccagtccatgctccagggtca

SEQ ID NO: 5392676 - DNA, 13 bp, Homo sapiens
cccagtccatttc

SEQ ID NO: 5392677 - DNA, 16 bp, Homo sapiens
cccagtcccacactgt

SEQ ID NO: 5392678 - DNA, 21 bp, Homo sapiens
cccagtcccaccctgctgctg

SEQ ID NO: 5392679 - DNA, 21 bp, Homo sapiens
cccagtcccagaaccacactg

SEQ ID NO: 5392680 - DNA, 13 bp, Homo sapiens
cccagtcccagca

SEQ ID NO: 5392681 - DNA, 19 bp, Homo sapiens
cccagtcccagcagccagc

SEQ ID NO: 5392682 - DNA, 17 bp, Homo sapiens
cccagtcccagcctctg

SEQ ID NO: 5392683 - DNA, 18 bp, Homo sapiens
cccagtcccagcctctgg

SEQ ID NO: 5392684 - DNA, 21 bp, Homo sapiens
cccagtcccagcctctggggc

SEQ ID NO: 5392685 - DNA, 14 bp, Homo sapiens
cccagtcccaggga

SEQ ID NO: 5392686 - DNA, 20 bp, Homo sapiens
cccagtccccacccctgccc

SEQ ID NO: 5392687 - DNA, 23 bp, Homo sapiens
cccagtccccacccctgccccca

SEQ ID NO: 5392688 - DNA, 15 bp, Homo sapiens
cccagtccccacccg

SEQ ID NO: 5392689 - DNA, 19 bp, Homo sapiens
cccagtccccacccgcctg

SEQ ID NO: 5392690 - DNA, 16 bp, Homo sapiens
cccagtccccagccct

SEQ ID NO: 5392691 - DNA, 14 bp, Homo sapiens
cccagtcccccaac

SEQ ID NO: 5392692 - DNA, 12 bp, Homo sapiens
cccagtcccccc

SEQ ID NO: 5392693 - DNA, 15 bp, Homo sapiens
cccagtccccgggaa

SEQ ID NO: 5392694 - DNA, 15 bp, Homo sapiens
cccagtccctggagc

SEQ ID NO: 5392695 - DNA, 16 bp, Homo sapiens
cccagtccctggggga

SEQ ID NO: 5392696 - DNA, 13 bp, Homo sapiens
cccagtccgccaa

SEQ ID NO: 5392697 - DNA, 15 bp, Homo sapiens
cccagtccggtgcct

SEQ ID NO: 5392698 - DNA, 21 bp, Homo sapiens
cccagtccggtgccttccacc

SEQ ID NO: 5392699 - DNA, 22 bp, Homo sapiens
cccagtccggtgccttccaccc

SEQ ID NO: 5392700 - DNA, 13 bp, Homo sapiens
cccagtcctcact

SEQ ID NO: 5392701 - DNA, 20 bp, Homo sapiens
cccatgagagcgcagcccgc

SEQ ID NO: 5392702 - DNA, 14 bp, Homo sapiens
cccatgagcctcag

SEQ ID NO: 5392703 - DNA, 13 bp, Homo sapiens
cccatgagcctgc

SEQ ID NO: 5392704 - DNA, 18 bp, Homo sapiens
cccatgagcgtccaggtg

SEQ ID NO: 5392705 - DNA, 19 bp, Homo sapiens
cccatgagcgtccaggtga

SEQ ID NO: 5392706 - DNA, 15 bp, Homo sapiens
cccatgagctcctta

SEQ ID NO: 5392707 - DNA, 19 bp, Homo sapiens
cccatgagctcggggtcca

SEQ ID NO: 5392708 - DNA, 24 bp, Homo sapiens
cccatgagctcggggtccaccagt

SEQ ID NO: 5392709 - DNA, 23 bp, Homo sapiens
cccatgaggcttgtggccacagt

SEQ ID NO: 5392710 - DNA, 19 bp, Homo sapiens
cccatgagggtgttttttt

SEQ ID NO: 5392711 - DNA, 23 bp, Homo sapiens
cccatgagttggggtctggcagc

SEQ ID NO: 5392712 - DNA, 20 bp, Homo sapiens
cccatgagttgtcagctttg

SEQ ID NO: 5392713 - DNA, 17 bp, Homo sapiens
cccatgataaaataagt

SEQ ID NO: 5392714 - DNA, 21 bp, Homo sapiens
cccatgatgccgctcttctgt

SEQ ID NO: 5392715 - DNA, 23 bp, Homo sapiens
cccatgatgccgctcttctgtca

SEQ ID NO: 5392716 - DNA, 16 bp, Homo sapiens
cccatgatttcatgta

SEQ ID NO: 5392717 - DNA, 18 bp, Homo sapiens
cccatgcaagcagaggac

SEQ ID NO: 5392718 - DNA, 22 bp, Homo sapiens
cccatgcacacaaacacctcct

SEQ ID NO: 5392719 - DNA, 16 bp, Homo sapiens
cccatgcaccttccag

SEQ ID NO: 5392720 - DNA, 14 bp, Homo sapiens
cccatgcaggccct

SEQ ID NO: 5392721 - DNA, 22 bp, Homo sapiens
cccatgcatacgtacattcctg

SEQ ID NO: 5392722 - DNA, 16 bp, Homo sapiens
cccatgcatggcctcc

SEQ ID NO: 5392723 - DNA, 19 bp, Homo sapiens
cccatgcatggcctcccag

SEQ ID NO: 5392724 - DNA, 14 bp, Homo sapiens
cccatgccaaggcc

SEQ ID NO: 5392725 - DNA, 19 bp, Homo sapiens
cccatgccaaggcctccct

SEQ ID NO: 5392726 - DNA, 14 bp, Homo sapiens
cccatgccaccacc

SEQ ID NO: 5392727 - DNA, 14 bp, Homo sapiens
cccatgccagcgca

SEQ ID NO: 5392728 - DNA, 15 bp, Homo sapiens
cccatgccagcgcag

SEQ ID NO: 5392729 - DNA, 17 bp, Homo sapiens
cccatgccccactctgc

SEQ ID NO: 5392730 - DNA, 20 bp, Homo sapiens
cccatgcccccttcgctcct

SEQ ID NO: 5392731 - DNA, 17 bp, Homo sapiens
cccatgcccctgacaga

SEQ ID NO: 5392732 - DNA, 13 bp, Homo sapiens
cccatgccctccc

SEQ ID NO: 5392733 - DNA, 17 bp, Homo sapiens
cccatgccctgccaagc

SEQ ID NO: 5392734 - DNA, 19 bp, Homo sapiens
cccatgccggtacacagcc

SEQ ID NO: 5392735 - DNA, 22 bp, Homo sapiens
cccatgcctaaagcccattgct

SEQ ID NO: 5392736 - DNA, 22 bp, Homo sapiens
cccatgcctagcagagtgctgg

SEQ ID NO: 5392737 - DNA, 15 bp, Homo sapiens
cccatgcctccagct

SEQ ID NO: 5392738 - DNA, 14 bp, Homo sapiens
cccatgcctgtcca

SEQ ID NO: 5392739 - DNA, 16 bp, Homo sapiens
cccatgcctgtccagc

SEQ ID NO: 5392740 - DNA, 20 bp, Homo sapiens
cccatgcctgtccagcctgg

SEQ ID NO: 5392741 - DNA, 17 bp, Homo sapiens
cccatgcctgtggctgc

SEQ ID NO: 5392742 - DNA, 21 bp, Homo sapiens
cccatgcgtgccgcctgctcc

SEQ ID NO: 5392743 - DNA, 12 bp, Homo sapiens
cccatgctctgc

SEQ ID NO: 5392744 - DNA, 15 bp, Homo sapiens
cccatgctctgcccc

SEQ ID NO: 5392745 - DNA, 17 bp, Homo sapiens
cccatgctctgccccaa

SEQ ID NO: 5392746 - DNA, 12 bp, Homo sapiens
cccatgctgccc

SEQ ID NO: 5392747 - DNA, 15 bp, Homo sapiens
cccatgctgccctgt

SEQ ID NO: 5392748 - DNA, 18 bp, Homo sapiens
cccatgctgccctgtgag

SEQ ID NO: 5392749 - DNA, 17 bp, Homo sapiens
cccatgctggagcctgt

SEQ ID NO: 5392750 - DNA, 19 bp, Homo sapiens
cccatgctggagcctgtgt

SEQ ID NO: 5392751 - DNA, 21 bp, Homo sapiens
cccatgctggagcctgtgtaa

SEQ ID NO: 5392752 - DNA, 12 bp, Homo sapiens
cccatgctgggc

SEQ ID NO: 5392753 - DNA, 15 bp, Homo sapiens
cccatgctgggctca

SEQ ID NO: 5392754 - DNA, 14 bp, Homo sapiens
cccatgctggtcag

SEQ ID NO: 5392755 - DNA, 17 bp, Homo sapiens
cccatgctgtccggcct

SEQ ID NO: 5392756 - DNA, 17 bp, Homo sapiens
cccatggaacagccctg

SEQ ID NO: 5392757 - DNA, 18 bp, Homo sapiens
cccatggaacagccctgc

SEQ ID NO: 5392758 - DNA, 16 bp, Homo sapiens
cccatggacactccag

SEQ ID NO: 5392759 - DNA, 21 bp, Homo sapiens
cccatggacactccagtgcca

SEQ ID NO: 5392760 - DNA, 22 bp, Homo sapiens
cccatggacactccagtgccag

SEQ ID NO: 5392761 - DNA, 19 bp, Homo sapiens
cccatggagacaataaaca

SEQ ID NO: 5392762 - DNA, 23 bp, Homo sapiens
cccatggagattgacctggatgg

SEQ ID NO: 5392763 - DNA, 13 bp, Homo sapiens
cccatggagcccc

SEQ ID NO: 5392764 - DNA, 12 bp, Homo sapiens
cccatggagggt

SEQ ID NO: 5392765 - DNA, 23 bp, Homo sapiens
cccatggagggtatactgagggg

SEQ ID NO: 5392766 - DNA, 18 bp, Homo sapiens
cccatggatgtttcttct

SEQ ID NO: 5392767 - DNA, 17 bp, Homo sapiens
cccatggcagctcctga

SEQ ID NO: 5392768 - DNA, 22 bp, Homo sapiens
cccatggcagtgggaaaaatgt

SEQ ID NO: 5392769 - DNA, 22 bp, Homo sapiens
cccatggccacatcctcatggc

SEQ ID NO: 5392770 - DNA, 14 bp, Homo sapiens
cccatggcccagca

SEQ ID NO: 5392771 - DNA, 19 bp, Homo sapiens
cccatggcccagcagcttg

SEQ ID NO: 5392772 - DNA, 12 bp, Homo sapiens
cccatggcccca

SEQ ID NO: 5392773 - DNA, 18 bp, Homo sapiens
cccatggcccccaataaa

SEQ ID NO: 5392774 - DNA, 19 bp, Homo sapiens
cccatggcccccaataaag

SEQ ID NO: 5392775 - DNA, 22 bp, Homo sapiens
cccatggcccccaataaaggca

SEQ ID NO: 5392776 - DNA, 23 bp, Homo sapiens
cccatggcccccaataaaggcag

SEQ ID NO: 5392777 - DNA, 14 bp, Homo sapiens
cccatggccctgtg

SEQ ID NO: 5392778 - DNA, 15 bp, Homo sapiens
cccatggccctgtgc

SEQ ID NO: 5392779 - DNA, 21 bp, Homo sapiens
cccatggccctgtgctaatcc

SEQ ID NO: 5392780 - DNA, 14 bp, Homo sapiens
cccatggcctcaga

SEQ ID NO: 5392781 - DNA, 21 bp, Homo sapiens
cccatggcctcagccctgctc

SEQ ID NO: 5392782 - DNA, 13 bp, Homo sapiens
cccatggcctgct

SEQ ID NO: 5392783 - DNA, 18 bp, Homo sapiens
cccatggctcctcaccac

SEQ ID NO: 5392784 - DNA, 13 bp, Homo sapiens
cccatggctctat

SEQ ID NO: 5392785 - DNA, 21 bp, Homo sapiens
cccatggctctatttcttctt

SEQ ID NO: 5392786 - DNA, 13 bp, Homo sapiens
cccatggctctgg

SEQ ID NO: 5392787 - DNA, 20 bp, Homo sapiens
cccatggctttgtgctgctg

SEQ ID NO: 5392788 - DNA, 22 bp, Homo sapiens
cccatgggaagacgaggccctc

SEQ ID NO: 5392789 - DNA, 16 bp, Homo sapiens
cccatgggaggctgga

SEQ ID NO: 5392790 - DNA, 21 bp, Homo sapiens
cccatgggcactgctgggtgg

SEQ ID NO: 5392791 - DNA, 13 bp, Homo sapiens
cccatgggcccct

SEQ ID NO: 5392792 - DNA, 15 bp, Homo sapiens
cccatgggccctcag

SEQ ID NO: 5392793 - DNA, 14 bp, Homo sapiens
cccatgggctagga

SEQ ID NO: 5392794 - DNA, 17 bp, Homo sapiens
cccatgggctcctgccc

SEQ ID NO: 5392795 - DNA, 18 bp, Homo sapiens
cccatgggctcctgcccc

SEQ ID NO: 5392796 - DNA, 19 bp, Homo sapiens
cccatgggctcctgcccct

SEQ ID NO: 5392797 - DNA, 18 bp, Homo sapiens
cccatgggctctggcccc

SEQ ID NO: 5392798 - DNA, 15 bp, Homo sapiens
cccatgggctgtgtc

SEQ ID NO: 5392799 - DNA, 21 bp, Homo sapiens
cccatgggcttggacttcctg

SEQ ID NO: 5392800 - DNA, 22 bp, Homo sapiens
cccatggggaaaccctggagcc

SEQ ID NO: 5392801 - DNA, 13 bp, Homo sapiens
cccatggggagga

SEQ ID NO: 5392802 - DNA, 18 bp, Homo sapiens
cccatgggggctgtcttt

SEQ ID NO: 5392803 - DNA, 18 bp, Homo sapiens
cccatggggtccttggag

SEQ ID NO: 5392804 - DNA, 20 bp, Homo sapiens
cccatggtagtttaaaacat

SEQ ID NO: 5392805 - DNA, 21 bp, Homo sapiens
cccatggtcacagacccctgg

SEQ ID NO: 5392806 - DNA, 15 bp, Homo sapiens
cccatggtccatccc

SEQ ID NO: 5392807 - DNA, 16 bp, Homo sapiens
cccatggtgtatgtgg

SEQ ID NO: 5392808 - DNA, 14 bp, Homo sapiens
cccatgtagctggc

SEQ ID NO: 5392809 - DNA, 23 bp, Homo sapiens
cccatgtatttatctctatttaa

SEQ ID NO: 5392810 - DNA, 16 bp, Homo sapiens
cccatgtcaccggtca

SEQ ID NO: 5392811 - DNA, 21 bp, Homo sapiens
cccatgtcaccggtcagtgcc

SEQ ID NO: 5392812 - DNA, 13 bp, Homo sapiens
cccatgtcacctc

SEQ ID NO: 5392813 - DNA, 14 bp, Homo sapiens
cccatgtcacctca

SEQ ID NO: 5392814 - DNA, 17 bp, Homo sapiens
cccatgtcacctcagct

SEQ ID NO: 5392815 - DNA, 20 bp, Homo sapiens
cccatgtccagagggactgg

SEQ ID NO: 5392816 - DNA, 22 bp, Homo sapiens
cccatgtcccagcctggcctgt

SEQ ID NO: 5392817 - DNA, 17 bp, Homo sapiens
cccatgtctcgactcat

SEQ ID NO: 5392818 - DNA, 17 bp, Homo sapiens
cccatgtcttctgctgt

SEQ ID NO: 5392819 - DNA, 16 bp, Homo sapiens
cccatgtgagctgctg

SEQ ID NO: 5392820 - DNA, 22 bp, Homo sapiens
cccatgtgcctgcaccaggaga

SEQ ID NO: 5392821 - DNA, 13 bp, Homo sapiens
cccatgtgccttg

SEQ ID NO: 5392822 - DNA, 14 bp, Homo sapiens
cccatgtgccttta

SEQ ID NO: 5392823 - DNA, 16 bp, Homo sapiens
cccatgtggctgaaga

SEQ ID NO: 5392824 - DNA, 16 bp, Homo sapiens
cccatgtgggctgaag

SEQ ID NO: 5392825 - DNA, 19 bp, Homo sapiens
cccatgtgtacattctgcc

SEQ ID NO: 5392826 - DNA, 12 bp, Homo sapiens
cccatgtgtatg

SEQ ID NO: 5392827 - DNA, 22 bp, Homo sapiens
cccatgtgtcccctcactctgt

SEQ ID NO: 5392828 - DNA, 21 bp, Homo sapiens
cccatgtgtcctggttcccgt

SEQ ID NO: 5392829 - DNA, 14 bp, Homo sapiens
cccatgtgtgagtg

SEQ ID NO: 5392830 - DNA, 19 bp, Homo sapiens
cccatgtgtgagtgtgtgc

SEQ ID NO: 5392831 - DNA, 20 bp, Homo sapiens
cccatgtgtgagtgtgtgca

SEQ ID NO: 5392832 - DNA, 17 bp, Homo sapiens
cccatgtgtgatgctga

SEQ ID NO: 5392833 - DNA, 22 bp, Homo sapiens
cccatgtgtgatgctgacacca

SEQ ID NO: 5392834 - DNA, 21 bp, Homo sapiens
cccatgttctgtcccttgccc

SEQ ID NO: 5392835 - DNA, 14 bp, Homo sapiens
cccatgttgggaaa

SEQ ID NO: 5392836 - DNA, 21 bp, Homo sapiens
cccatgttgggaaaaactggc

SEQ ID NO: 5392837 - DNA, 20 bp, Homo sapiens
cccatgttgtaatgctgcac

SEQ ID NO: 5392838 - DNA, 23 bp, Homo sapiens
cccatgtttaaactttgtgcctt

SEQ ID NO: 5392839 - DNA, 14 bp, Homo sapiens
cccattaatcttga

SEQ ID NO: 5392840 - DNA, 16 bp, Homo sapiens
cccattagcaaaaatt

SEQ ID NO: 5392841 - DNA, 16 bp, Homo sapiens
cccattaggacaatca

SEQ ID NO: 5392842 - DNA, 18 bp, Homo sapiens
cccattaggcatgcctaa

SEQ ID NO: 5392843 - DNA, 17 bp, Homo sapiens
cccattattatttctgt

SEQ ID NO: 5392844 - DNA, 18 bp, Homo sapiens
cccattattatttctgtt

SEQ ID NO: 5392845 - DNA, 18 bp, Homo sapiens
cccattattcaaagttgc

SEQ ID NO: 5392846 - DNA, 14 bp, Homo sapiens
cccattcacagagc

SEQ ID NO: 5392847 - DNA, 15 bp, Homo sapiens
cccattcacagagcc

SEQ ID NO: 5392848 - DNA, 18 bp, Homo sapiens
cccattcacggcctggca

SEQ ID NO: 5392849 - DNA, 19 bp, Homo sapiens
cccattcacggcctggcat

SEQ ID NO: 5392850 - DNA, 22 bp, Homo sapiens
cccattcacggcctggcatgca

SEQ ID NO: 5392851 - DNA, 14 bp, Homo sapiens
cccattcagacact

SEQ ID NO: 5392852 - DNA, 13 bp, Homo sapiens
cccattcagcctc

SEQ ID NO: 5392853 - DNA, 15 bp, Homo sapiens
cccattcagtgacat

SEQ ID NO: 5392854 - DNA, 21 bp, Homo sapiens
cccattcattccattctggaa

SEQ ID NO: 5392855 - DNA, 22 bp, Homo sapiens
cccattccagctctcccatgga

SEQ ID NO: 5392856 - DNA, 18 bp, Homo sapiens
cccattcccagcctgact

SEQ ID NO: 5392857 - DNA, 15 bp, Homo sapiens
cccattcccgcagtg

SEQ ID NO: 5392858 - DNA, 15 bp, Homo sapiens
cccattccctccatt

SEQ ID NO: 5392859 - DNA, 18 bp, Homo sapiens
cccattcctgaagaacca

SEQ ID NO: 5392860 - DNA, 13 bp, Homo sapiens
cccattcctgcct

SEQ ID NO: 5392861 - DNA, 14 bp, Homo sapiens
cccattcctgggaa

SEQ ID NO: 5392862 - DNA, 14 bp, Homo sapiens
cccattccttagct

SEQ ID NO: 5392863 - DNA, 18 bp, Homo sapiens
cccattccttcccagagg

SEQ ID NO: 5392864 - DNA, 20 bp, Homo sapiens
cccattcgcgctctgctcag

SEQ ID NO: 5392865 - DNA, 19 bp, Homo sapiens
cccattctacacagagcag

SEQ ID NO: 5392866 - DNA, 18 bp, Homo sapiens
cccattctacttgctctg

SEQ ID NO: 5392867 - DNA, 19 bp, Homo sapiens
cccattctacttgctctgg

SEQ ID NO: 5392868 - DNA, 23 bp, Homo sapiens
cccattctacttgctctggacct

SEQ ID NO: 5392869 - DNA, 24 bp, Homo sapiens
cccattctacttgctctggacctg

SEQ ID NO: 5392870 - DNA, 12 bp, Homo sapiens
cccattctagat

SEQ ID NO: 5392871 - DNA, 15 bp, Homo sapiens
cccattctcatctgc

SEQ ID NO: 5392872 - DNA, 19 bp, Homo sapiens
cccattctcccagtctctg

SEQ ID NO: 5392873 - DNA, 14 bp, Homo sapiens
cccattctccctcc

SEQ ID NO: 5392874 - DNA, 18 bp, Homo sapiens
cccattctgccctgtggg

SEQ ID NO: 5392875 - DNA, 13 bp, Homo sapiens
cccattctgcctg

SEQ ID NO: 5392876 - DNA, 14 bp, Homo sapiens
cccattctgggact

SEQ ID NO: 5392877 - DNA, 21 bp, Homo sapiens
cccattctgtgtcccatgtcc

SEQ ID NO: 5392878 - DNA, 21 bp, Homo sapiens
ccccacggacgacgcgagggc

SEQ ID NO: 5392879 - DNA, 21 bp, Homo sapiens
ccccacggagacagaggaaag

SEQ ID NO: 5392880 - DNA, 15 bp, Homo sapiens
ccccacggccgtccc

SEQ ID NO: 5392881 - DNA, 16 bp, Homo sapiens
ccccacggccgtccct

SEQ ID NO: 5392882 - DNA, 15 bp, Homo sapiens
ccccacgtctctctg

SEQ ID NO: 5392883 - DNA, 22 bp, Homo sapiens
ccccacgtctctctgcctgctg

SEQ ID NO: 5392884 - DNA, 23 bp, Homo sapiens
ccccacgtctctctgcctgctgg

SEQ ID NO: 5392885 - DNA, 20 bp, Homo sapiens
ccccacgtggactctgtgct

SEQ ID NO: 5392886 - DNA, 14 bp, Homo sapiens
ccccacgtggagct

SEQ ID NO: 5392887 - DNA, 19 bp, Homo sapiens
ccccactactgcagcacct

SEQ ID NO: 5392888 - DNA, 21 bp, Homo sapiens
ccccactcacagagacacagg

SEQ ID NO: 5392889 - DNA, 15 bp, Homo sapiens
ccccactcaccccct

SEQ ID NO: 5392890 - DNA, 15 bp, Homo sapiens
ccccactcagccttt

SEQ ID NO: 5392891 - DNA, 19 bp, Homo sapiens
ccccactcaggggacccca

SEQ ID NO: 5392892 - DNA, 11 bp, Homo sapiens
ccccactcagt

SEQ ID NO: 5392893 - DNA, 14 bp, Homo sapiens
ccccactcagtagg

SEQ ID NO: 5392894 - DNA, 12 bp, Homo sapiens
ccccactccagc

SEQ ID NO: 5392895 - DNA, 14 bp, Homo sapiens
ccccactccagccc

SEQ ID NO: 5392896 - DNA, 15 bp, Homo sapiens
ccccactccagcctg

SEQ ID NO: 5392897 - DNA, 16 bp, Homo sapiens
ccccactccagcctgg

SEQ ID NO: 5392898 - DNA, 21 bp, Homo sapiens
ccccactccagcctggggacc

SEQ ID NO: 5392899 - DNA, 13 bp, Homo sapiens
ccccactccagct

SEQ ID NO: 5392900 - DNA, 13 bp, Homo sapiens
ccccactcccagc

SEQ ID NO: 5392901 - DNA, 16 bp, Homo sapiens
ccccactcccctcaca

SEQ ID NO: 5392902 - DNA, 13 bp, Homo sapiens
ccccactccctgc

SEQ ID NO: 5392903 - DNA, 16 bp, Homo sapiens
ccccactccctggcca

SEQ ID NO: 5392904 - DNA, 12 bp, Homo sapiens
ccccactcctca

SEQ ID NO: 5392905 - DNA, 13 bp, Homo sapiens
ccccactcctgtc

SEQ ID NO: 5392906 - DNA, 13 bp, Homo sapiens
ccccactctcaga

SEQ ID NO: 5392907 - DNA, 19 bp, Homo sapiens
ccccactctgctgaggcca

SEQ ID NO: 5392908 - DNA, 15 bp, Homo sapiens
ccccactgacaccca

SEQ ID NO: 5392909 - DNA, 15 bp, Homo sapiens
ccccactgacagcct

SEQ ID NO: 5392910 - DNA, 14 bp, Homo sapiens
ccccactgaccaga

SEQ ID NO: 5392911 - DNA, 13 bp, Homo sapiens
ccccactgatgct

SEQ ID NO: 5392912 - DNA, 17 bp, Homo sapiens
ccccactgccaagtggg

SEQ ID NO: 5392913 - DNA, 16 bp, Homo sapiens
ccccactgccagcagc

SEQ ID NO: 5392914 - DNA, 17 bp, Homo sapiens
ccccactgccagcagca

SEQ ID NO: 5392915 - DNA, 14 bp, Homo sapiens
ccccactgcccttc

SEQ ID NO: 5392916 - DNA, 16 bp, Homo sapiens
ccccactgcctgccca

SEQ ID NO: 5392917 - DNA, 15 bp, Homo sapiens
ccccactgctgagct

SEQ ID NO: 5392918 - DNA, 18 bp, Homo sapiens
ccccactggacaacactg

SEQ ID NO: 5392919 - DNA, 19 bp, Homo sapiens
ccccactggactgacctgg

SEQ ID NO: 5392920 - DNA, 24 bp, Homo sapiens
ccccactggagcagaaggggagat

SEQ ID NO: 5392921 - DNA, 13 bp, Homo sapiens
ccccactggctgg

SEQ ID NO: 5392922 - DNA, 22 bp, Homo sapiens
ccccactggctgtgggctccct

SEQ ID NO: 5392923 - DNA, 23 bp, Homo sapiens
ccccactggctgtgggctccctt

SEQ ID NO: 5392924 - DNA, 22 bp, Homo sapiens
ccccactgggagagtccttagc

SEQ ID NO: 5392925 - DNA, 14 bp, Homo sapiens
ccccactgggccag

SEQ ID NO: 5392926 - DNA, 19 bp, Homo sapiens
ccccactgggccagccctg

SEQ ID NO: 5392927 - DNA, 13 bp, Homo sapiens
ccccactggtgac

SEQ ID NO: 5392928 - DNA, 22 bp, Homo sapiens
ccccactgtccccctacccacc

SEQ ID NO: 5392929 - DNA, 19 bp, Homo sapiens
ccccacttatgctgctgtg

SEQ ID NO: 5392930 - DNA, 12 bp, Homo sapiens
ccccacttctgg

SEQ ID NO: 5392931 - DNA, 16 bp, Homo sapiens
ccccacttctggcatg

SEQ ID NO: 5392932 - DNA, 13 bp, Homo sapiens
ccccacttctgtg

SEQ ID NO: 5392933 - DNA, 14 bp, Homo sapiens
ccccacttgcctct

SEQ ID NO: 5392934 - DNA, 15 bp, Homo sapiens
ccccactttctttct

SEQ ID NO: 5392935 - DNA, 14 bp, Homo sapiens
ccccagaaagcctc

SEQ ID NO: 5392936 - DNA, 19 bp, Homo sapiens
ccccagaaatcactgtgaa

SEQ ID NO: 5392937 - DNA, 22 bp, Homo sapiens
ccccagaaatgccgctgtgtcc

SEQ ID NO: 5392938 - DNA, 15 bp, Homo sapiens
ccccagaactctgcc

SEQ ID NO: 5392939 - DNA, 16 bp, Homo sapiens
ccccagaatgacctgg

SEQ ID NO: 5392940 - DNA, 17 bp, Homo sapiens
ccccagacaacagccca

SEQ ID NO: 5392941 - DNA, 21 bp, Homo sapiens
ccccagacacaccccccagtc

SEQ ID NO: 5392942 - DNA, 12 bp, Homo sapiens
ccccagacacat

SEQ ID NO: 5392943 - DNA, 23 bp, Homo sapiens
ccccagacagctgctcagagcca

SEQ ID NO: 5392944 - DNA, 11 bp, Homo sapiens
ccccagacagg

SEQ ID NO: 5392945 - DNA, 21 bp, Homo sapiens
ccccagacagttcttttctac

SEQ ID NO: 5392946 - DNA, 12 bp, Homo sapiens
ccccagacccag

SEQ ID NO: 5392947 - DNA, 21 bp, Homo sapiens
ccccagacccagaggtccagg

SEQ ID NO: 5392948 - DNA, 23 bp, Homo sapiens
ccccagaccccatccagccaggg

SEQ ID NO: 5392949 - DNA, 18 bp, Homo sapiens
ccccagaccgatccttcc

SEQ ID NO: 5392950 - DNA, 13 bp, Homo sapiens
ccccagacctctg

SEQ ID NO: 5392951 - DNA, 15 bp, Homo sapiens
ccccagacctgagct

SEQ ID NO: 5392952 - DNA, 14 bp, Homo sapiens
ccccagactcagct

SEQ ID NO: 5392953 - DNA, 16 bp, Homo sapiens
ccccagactctgccta

SEQ ID NO: 5392954 - DNA, 20 bp, Homo sapiens
ccccagactgagctctccag

SEQ ID NO: 5392955 - DNA, 11 bp, Homo sapiens
ccccagactgg

SEQ ID NO: 5392956 - DNA, 15 bp, Homo sapiens
ccccagactgtagag

SEQ ID NO: 5392957 - DNA, 19 bp, Homo sapiens
ccccagacttctctttctt

SEQ ID NO: 5392958 - DNA, 20 bp, Homo sapiens
ccccagacttctctttctta

SEQ ID NO: 5392959 - DNA, 16 bp, Homo sapiens
ccccagacttgcactg

SEQ ID NO: 5392960 - DNA, 17 bp, Homo sapiens
ccccagagaagcctcag

SEQ ID NO: 5392961 - DNA, 17 bp, Homo sapiens
ccccagagactgcccac

SEQ ID NO: 5392962 - DNA, 18 bp, Homo sapiens
ccccagagactgcccacc

SEQ ID NO: 5392963 - DNA, 14 bp, Homo sapiens
ccccagagagcagg

SEQ ID NO: 5392964 - DNA, 18 bp, Homo sapiens
ccccagagaggcactcag

SEQ ID NO: 5392965 - DNA, 15 bp, Homo sapiens
ccccagagcatctgc

SEQ ID NO: 5392966 - DNA, 20 bp, Homo sapiens
ccccagagcatctgccccag

SEQ ID NO: 5392967 - DNA, 15 bp, Homo sapiens
ccccagagccacaca

SEQ ID NO: 5392968 - DNA, 16 bp, Homo sapiens
ccccagagccagggct

SEQ ID NO: 5392969 - DNA, 13 bp, Homo sapiens
ccccagagcccag

SEQ ID NO: 5392970 - DNA, 17 bp, Homo sapiens
ccccagagcccagctct

SEQ ID NO: 5392971 - DNA, 19 bp, Homo sapiens
ccccagagcccagctcttg

SEQ ID NO: 5392972 - DNA, 20 bp, Homo sapiens
ccccagagcccagctcttgc

SEQ ID NO: 5392973 - DNA, 22 bp, Homo sapiens
ccccagagcccagctcttgctc

SEQ ID NO: 5392974 - DNA, 14 bp, Homo sapiens
ccccagagcccagg

SEQ ID NO: 5392975 - DNA, 21 bp, Homo sapiens
ccccagagcccctcctccagc

SEQ ID NO: 5392976 - DNA, 12 bp, Homo sapiens
ccccagagctgc

SEQ ID NO: 5392977 - DNA, 23 bp, Homo sapiens
ccccagagctgtttatggcctca

SEQ ID NO: 5392978 - DNA, 12 bp, Homo sapiens
ccccagaggcag

SEQ ID NO: 5392979 - DNA, 12 bp, Homo sapiens
ccccagaggccc

SEQ ID NO: 5392980 - DNA, 16 bp, Homo sapiens
ccccagaggccctgga

SEQ ID NO: 5392981 - DNA, 17 bp, Homo sapiens
ccccagaggccctggag

SEQ ID NO: 5392982 - DNA, 18 bp, Homo sapiens
ccccagaggcctctctct

SEQ ID NO: 5392983 - DNA, 15 bp, Homo sapiens
ccccagaggctccca

SEQ ID NO: 5392984 - DNA, 16 bp, Homo sapiens
ccccagaggctcccaa

SEQ ID NO: 5392985 - DNA, 17 bp, Homo sapiens
ccccagaggctcccaat

SEQ ID NO: 5392986 - DNA, 20 bp, Homo sapiens
ccccagaggctcccaatcag

SEQ ID NO: 5392987 - DNA, 13 bp, Homo sapiens
ccccagagggacc

SEQ ID NO: 5392988 - DNA, 16 bp, Homo sapiens
ccccagagggaccagc

SEQ ID NO: 5392989 - DNA, 21 bp, Homo sapiens
ccccagagggaccagctgggg

SEQ ID NO: 5392990 - DNA, 20 bp, Homo sapiens
ccccagaggtcgcagctacc

SEQ ID NO: 5392991 - DNA, 18 bp, Homo sapiens
ccccagaggtggcccttg

SEQ ID NO: 5392992 - DNA, 22 bp, Homo sapiens
ccccagagtgtgggaagggaga

SEQ ID NO: 5392993 - DNA, 18 bp, Homo sapiens
ccccagatacccatcttg

SEQ ID NO: 5392994 - DNA, 17 bp, Homo sapiens
ccccagatacctgtgag

SEQ ID NO: 5392995 - DNA, 19 bp, Homo sapiens
ccccagatacctgtgagga

SEQ ID NO: 5392996 - DNA, 17 bp, Homo sapiens
ccccagatctgcctggg

SEQ ID NO: 5392997 - DNA, 20 bp, Homo sapiens
ccccagatctgcctgggcct

SEQ ID NO: 5392998 - DNA, 22 bp, Homo sapiens
ccccagatctgcctgggcctgt

SEQ ID NO: 5392999 - DNA, 24 bp, Homo sapiens
ccccagatctgcctgggcctgtgc

SEQ ID NO: 5393000 - DNA, 15 bp, Homo sapiens
ccccagatggctttg

SEQ ID NO: 5393001 - DNA, 23 bp, Homo sapiens
ccccagattgcaacaggctgggc

SEQ ID NO: 5393002 - DNA, 14 bp, Homo sapiens
ccccagcaaagccc

SEQ ID NO: 5393003 - DNA, 22 bp, Homo sapiens
ccccagcaagcgggagcccgtg

SEQ ID NO: 5393004 - DNA, 19 bp, Homo sapiens
ccccagcaagtgagagctg

SEQ ID NO: 5393005 - DNA, 19 bp, Homo sapiens
ccccagcacaaagcactgg

SEQ ID NO: 5393006 - DNA, 22 bp, Homo sapiens
ccccagcacaaagcactggcct

SEQ ID NO: 5393007 - DNA, 14 bp, Homo sapiens
ccccagcacagctc

SEQ ID NO: 5393008 - DNA, 17 bp, Homo sapiens
ccccagcacagctcctc

SEQ ID NO: 5393009 - DNA, 23 bp, Homo sapiens
ccccagcacctaggtggggcctg

SEQ ID NO: 5393010 - DNA, 18 bp, Homo sapiens
ccccagcacctcagcctg

SEQ ID NO: 5393011 - DNA, 22 bp, Homo sapiens
ccccagcactaaggccgtgtct

SEQ ID NO: 5393012 - DNA, 15 bp, Homo sapiens
ccccagcactcacac

SEQ ID NO: 5393013 - DNA, 16 bp, Homo sapiens
ccccagcactcctctg

SEQ ID NO: 5393014 - DNA, 19 bp, Homo sapiens
ccccagcactcctctgtct

SEQ ID NO: 5393015 - DNA, 12 bp, Homo sapiens
ccccagcactga

SEQ ID NO: 5393016 - DNA, 13 bp, Homo sapiens
ccccagcactgag

SEQ ID NO: 5393017 - DNA, 14 bp, Homo sapiens
ccccagcagaggca

SEQ ID NO: 5393018 - DNA, 15 bp, Homo sapiens
ccccagcagaggcag

SEQ ID NO: 5393019 - DNA, 22 bp, Homo sapiens
ccccagcagcccctcagcgccc

SEQ ID NO: 5393020 - DNA, 13 bp, Homo sapiens
ccccagcagccct

SEQ ID NO: 5393021 - DNA, 12 bp, Homo sapiens
ccccagcagctc

SEQ ID NO: 5393022 - DNA, 16 bp, Homo sapiens
ccccagcatcactccc

SEQ ID NO: 5393023 - DNA, 21 bp, Homo sapiens
ccccagcatcgggggcctgca

SEQ ID NO: 5393024 - DNA, 16 bp, Homo sapiens
ccccagcattccagct

SEQ ID NO: 5393025 - DNA, 19 bp, Homo sapiens
ccccagcattccagctctg

SEQ ID NO: 5393026 - DNA, 22 bp, Homo sapiens
ccccagcattctcaggcaccag

SEQ ID NO: 5393027 - DNA, 9 bp, Homo sapiens
ccccagcca

SEQ ID NO: 5393028 - DNA, 17 bp, Homo sapiens
ccccagccaagcctgac

SEQ ID NO: 5393029 - DNA, 12 bp, Homo sapiens
ccccagccaagt

SEQ ID NO: 5393030 - DNA, 14 bp, Homo sapiens
ccccagccactccc

SEQ ID NO: 5393031 - DNA, 21 bp, Homo sapiens
ccccagccactccccagccag

SEQ ID NO: 5393032 - DNA, 22 bp, Homo sapiens
ccccagccactcctcaaccttg

SEQ ID NO: 5393033 - DNA, 23 bp, Homo sapiens
ccccagccagatggactccagcc

SEQ ID NO: 5393034 - DNA, 14 bp, Homo sapiens
ccccagccagccct

SEQ ID NO: 5393035 - DNA, 21 bp, Homo sapiens
ccccagccagcccttcccagg

SEQ ID NO: 5393036 - DNA, 23 bp, Homo sapiens
ccccagccagcccttccctggcc

SEQ ID NO: 5393037 - DNA, 17 bp, Homo sapiens
ccccagccatccagggg

SEQ ID NO: 5393038 - DNA, 11 bp, Homo sapiens
ccccagcccac

SEQ ID NO: 5393039 - DNA, 20 bp, Homo sapiens
ccccagcccacagagcctga

SEQ ID NO: 5393040 - DNA, 19 bp, Homo sapiens
ccccagcccaccctcctgt

SEQ ID NO: 5393041 - DNA, 20 bp, Homo sapiens
ccccagcccaccctcctgtc

SEQ ID NO: 5393042 - DNA, 15 bp, Homo sapiens
ccccagcccagagac

SEQ ID NO: 5393043 - DNA, 12 bp, Homo sapiens
ccccagcccagc

SEQ ID NO: 5393044 - DNA, 15 bp, Homo sapiens
ccccagcccagcacc

SEQ ID NO: 5393045 - DNA, 18 bp, Homo sapiens
ccccagcccagcccagct

SEQ ID NO: 5393046 - DNA, 15 bp, Homo sapiens
ccccagcccagggct

SEQ ID NO: 5393047 - DNA, 21 bp, Homo sapiens
ccccagcccagggttccccca

SEQ ID NO: 5393048 - DNA, 14 bp, Homo sapiens
ccccagccccactt

SEQ ID NO: 5393049 - DNA, 17 bp, Homo sapiens
ccccagccccagcccct

SEQ ID NO: 5393050 - DNA, 13 bp, Homo sapiens
ccccagcccccac

SEQ ID NO: 5393051 - DNA, 19 bp, Homo sapiens
ccccagcccccacagccct

SEQ ID NO: 5393052 - DNA, 14 bp, Homo sapiens
ccccagcccccacc

SEQ ID NO: 5393053 - DNA, 18 bp, Homo sapiens
ccccagcccccagggccc

SEQ ID NO: 5393054 - DNA, 16 bp, Homo sapiens
ccccagccccctaaga

SEQ ID NO: 5393055 - DNA, 16 bp, Homo sapiens
ccccagccccctccca

SEQ ID NO: 5393056 - DNA, 17 bp, Homo sapiens
ccccagccccgactcca

SEQ ID NO: 5393057 - DNA, 19 bp, Homo sapiens
ccccagccccgactccagc

SEQ ID NO: 5393058 - DNA, 17 bp, Homo sapiens
ccccatgataaaataag

SEQ ID NO: 5393059 - DNA, 14 bp, Homo sapiens
ccccatgcccctcc

SEQ ID NO: 5393060 - DNA, 15 bp, Homo sapiens
ccccatgcccctccc

SEQ ID NO: 5393061 - DNA, 15 bp, Homo sapiens
ccccatgccctccct

SEQ ID NO: 5393062 - DNA, 21 bp, Homo sapiens
ccccatgccctccctgctgcc

SEQ ID NO: 5393063 - DNA, 15 bp, Homo sapiens
ccccatgcctgtcca

SEQ ID NO: 5393064 - DNA, 18 bp, Homo sapiens
ccccatgcctgtccagcc

SEQ ID NO: 5393065 - DNA, 13 bp, Homo sapiens
ccccatgctctgc

SEQ ID NO: 5393066 - DNA, 17 bp, Homo sapiens
ccccatgctctgcccca

SEQ ID NO: 5393067 - DNA, 15 bp, Homo sapiens
ccccatgctggagcc

SEQ ID NO: 5393068 - DNA, 12 bp, Homo sapiens
ccccatgctggg

SEQ ID NO: 5393069 - DNA, 13 bp, Homo sapiens
ccccatgctgggc

SEQ ID NO: 5393070 - DNA, 17 bp, Homo sapiens
ccccatgcttccttgcc

SEQ ID NO: 5393071 - DNA, 17 bp, Homo sapiens
ccccatggaacagccct

SEQ ID NO: 5393072 - DNA, 23 bp, Homo sapiens
ccccatggcttgttctctggaac

SEQ ID NO: 5393073 - DNA, 16 bp, Homo sapiens
ccccatgggccctcag

SEQ ID NO: 5393074 - DNA, 18 bp, Homo sapiens
ccccatgggccctcagcg

SEQ ID NO: 5393075 - DNA, 18 bp, Homo sapiens
ccccatgggctcccactg

SEQ ID NO: 5393076 - DNA, 22 bp, Homo sapiens
ccccatgggcttggacttcctg

SEQ ID NO: 5393077 - DNA, 17 bp, Homo sapiens
ccccatggtcacagacc

SEQ ID NO: 5393078 - DNA, 18 bp, Homo sapiens
ccccatggtcacagaccc

SEQ ID NO: 5393079 - DNA, 22 bp, Homo sapiens
ccccatggtcacagacccctgg

SEQ ID NO: 5393080 - DNA, 15 bp, Homo sapiens
ccccatgtccttgga

SEQ ID NO: 5393081 - DNA, 17 bp, Homo sapiens
ccccatgtgcctgtcac

SEQ ID NO: 5393082 - DNA, 18 bp, Homo sapiens
ccccatgtgccttgtcca

SEQ ID NO: 5393083 - DNA, 22 bp, Homo sapiens
ccccatgtgccttgtccaggaa

SEQ ID NO: 5393084 - DNA, 16 bp, Homo sapiens
ccccatgtggcagccc

SEQ ID NO: 5393085 - DNA, 17 bp, Homo sapiens
ccccatgtggcagccca

SEQ ID NO: 5393086 - DNA, 14 bp, Homo sapiens
ccccatgtgtcctg

SEQ ID NO: 5393087 - DNA, 23 bp, Homo sapiens
ccccatgtgtcctggttcccgtt

SEQ ID NO: 5393088 - DNA, 21 bp, Homo sapiens
ccccatgttgtaatgctgcac

SEQ ID NO: 5393089 - DNA, 22 bp, Homo sapiens
ccccatgttgtaatgctgcact

SEQ ID NO: 5393090 - DNA, 17 bp, Homo sapiens
ccccattagagtcagcc

SEQ ID NO: 5393091 - DNA, 20 bp, Homo sapiens
ccccattagtatcctgttag

SEQ ID NO: 5393092 - DNA, 16 bp, Homo sapiens
ccccattcacagagcc

SEQ ID NO: 5393093 - DNA, 18 bp, Homo sapiens
ccccattcacggcctggc

SEQ ID NO: 5393094 - DNA, 14 bp, Homo sapiens
ccccattcagaact

SEQ ID NO: 5393095 - DNA, 16 bp, Homo sapiens
ccccattcagaactct

SEQ ID NO: 5393096 - DNA, 13 bp, Homo sapiens
ccccattcccagc

SEQ ID NO: 5393097 - DNA, 16 bp, Homo sapiens
ccccattcccgcagtg

SEQ ID NO: 5393098 - DNA, 21 bp, Homo sapiens
ccccattcctgatcccatggc

SEQ ID NO: 5393099 - DNA, 20 bp, Homo sapiens
ccccattccttgcgcctcag

SEQ ID NO: 5393100 - DNA, 22 bp, Homo sapiens
ccccattcgcgctctgctcagt

SEQ ID NO: 5393101 - DNA, 16 bp, Homo sapiens
ccccattctcatctgc

SEQ ID NO: 5393102 - DNA, 13 bp, Homo sapiens
ccccattctccct

SEQ ID NO: 5393103 - DNA, 14 bp, Homo sapiens
ccccattctgggac

SEQ ID NO: 5393104 - DNA, 21 bp, Homo sapiens
ccccattctgtgtcccatgtc

SEQ ID NO: 5393105 - DNA, 19 bp, Homo sapiens
ccccattctttccttctct

SEQ ID NO: 5393106 - DNA, 21 bp, Homo sapiens
ccccattctttgcttgaacac

SEQ ID NO: 5393107 - DNA, 23 bp, Homo sapiens
ccccattgagatcttcctgctga

SEQ ID NO: 5393108 - DNA, 19 bp, Homo sapiens
ccccattgccttctgggga

SEQ ID NO: 5393109 - DNA, 17 bp, Homo sapiens
ccccattgctccattca

SEQ ID NO: 5393110 - DNA, 19 bp, Homo sapiens
ccccattggagcaagcttg

SEQ ID NO: 5393111 - DNA, 21 bp, Homo sapiens
ccccatttcagagttatcaag

SEQ ID NO: 5393112 - DNA, 16 bp, Homo sapiens
ccccatttcctcttcc

SEQ ID NO: 5393113 - DNA, 22 bp, Homo sapiens
ccccatttcctcttccttctct

SEQ ID NO: 5393114 - DNA, 23 bp, Homo sapiens
ccccatttcctcttccttctcta

SEQ ID NO: 5393115 - DNA, 17 bp, Homo sapiens
ccccatttctatttatt

SEQ ID NO: 5393116 - DNA, 14 bp, Homo sapiens
ccccatttctgcct

SEQ ID NO: 5393117 - DNA, 17 bp, Homo sapiens
ccccatttctgcctcgc

SEQ ID NO: 5393118 - DNA, 13 bp, Homo sapiens
ccccatttgattt

SEQ ID NO: 5393119 - DNA, 20 bp, Homo sapiens
ccccatttgtttgtgcttca

SEQ ID NO: 5393120 - DNA, 16 bp, Homo sapiens
ccccattttctttaca

SEQ ID NO: 5393121 - DNA, 18 bp, Homo sapiens
cccccaaaatccaaaact

SEQ ID NO: 5393122 - DNA, 14 bp, Homo sapiens
cccccaaaccctgc

SEQ ID NO: 5393123 - DNA, 19 bp, Homo sapiens
cccccaaagatagacaggt

SEQ ID NO: 5393124 - DNA, 22 bp, Homo sapiens
cccccaaagcagcccttccccc

SEQ ID NO: 5393125 - DNA, 18 bp, Homo sapiens
cccccaaatcttcctctg

SEQ ID NO: 5393126 - DNA, 22 bp, Homo sapiens
cccccaaatggaaatgggcaga

SEQ ID NO: 5393127 - DNA, 19 bp, Homo sapiens
cccccaaattgccttcagc

SEQ ID NO: 5393128 - DNA, 14 bp, Homo sapiens
cccccaacaccacc

SEQ ID NO: 5393129 - DNA, 19 bp, Homo sapiens
cccccaacaccccgcctgc

SEQ ID NO: 5393130 - DNA, 20 bp, Homo sapiens
cccccaacacctgctgcgct

SEQ ID NO: 5393131 - DNA, 14 bp, Homo sapiens
cccccaacactcca

SEQ ID NO: 5393132 - DNA, 21 bp, Homo sapiens
cccccaacactgtgccctggt

SEQ ID NO: 5393133 - DNA, 20 bp, Homo sapiens
cccccaaccatttcctcaga

SEQ ID NO: 5393134 - DNA, 18 bp, Homo sapiens
cccccaacccacctctgg

SEQ ID NO: 5393135 - DNA, 15 bp, Homo sapiens
cccccaacctttccc

SEQ ID NO: 5393136 - DNA, 15 bp, Homo sapiens
cccccaactcaggac

SEQ ID NO: 5393137 - DNA, 21 bp, Homo sapiens
cccccaagaaacctccatcct

SEQ ID NO: 5393138 - DNA, 18 bp, Homo sapiens
cccccaagccaaccactt

SEQ ID NO: 5393139 - DNA, 12 bp, Homo sapiens
cccccaagcctc

SEQ ID NO: 5393140 - DNA, 13 bp, Homo sapiens
cccccaagcctgg

SEQ ID NO: 5393141 - DNA, 20 bp, Homo sapiens
cccccaagggaggctgctgc

SEQ ID NO: 5393142 - DNA, 18 bp, Homo sapiens
cccccaaggttctccaac

SEQ ID NO: 5393143 - DNA, 19 bp, Homo sapiens
cccccaaggttctggttcc

SEQ ID NO: 5393144 - DNA, 18 bp, Homo sapiens
cccccaaggttttggagt

SEQ ID NO: 5393145 - DNA, 22 bp, Homo sapiens
cccccaagtgtcctggaccctg

SEQ ID NO: 5393146 - DNA, 12 bp, Homo sapiens
cccccaagttct

SEQ ID NO: 5393147 - DNA, 14 bp, Homo sapiens
cccccaataaaggc

SEQ ID NO: 5393148 - DNA, 17 bp, Homo sapiens
cccccaataaaggcagc

SEQ ID NO: 5393149 - DNA, 21 bp, Homo sapiens
cccccaataaaggcagctgcc

SEQ ID NO: 5393150 - DNA, 14 bp, Homo sapiens
cccccaatccctca

SEQ ID NO: 5393151 - DNA, 15 bp, Homo sapiens
cccccaatccctcaa

SEQ ID NO: 5393152 - DNA, 19 bp, Homo sapiens
cccccaatcggactgccaa

SEQ ID NO: 5393153 - DNA, 13 bp, Homo sapiens
cccccaatgtctg

SEQ ID NO: 5393154 - DNA, 11 bp, Homo sapiens
cccccacacac

SEQ ID NO: 5393155 - DNA, 14 bp, Homo sapiens
cccccacacacaca

SEQ ID NO: 5393156 - DNA, 14 bp, Homo sapiens
cccccacagctcct

SEQ ID NO: 5393157 - DNA, 12 bp, Homo sapiens
cccccacaggag

SEQ ID NO: 5393158 - DNA, 12 bp, Homo sapiens
cccccacaggcc

SEQ ID NO: 5393159 - DNA, 16 bp, Homo sapiens
cccccacatggtgatg

SEQ ID NO: 5393160 - DNA, 15 bp, Homo sapiens
cccccaccactagga

SEQ ID NO: 5393161 - DNA, 15 bp, Homo sapiens
cccccaccactcagg

SEQ ID NO: 5393162 - DNA, 21 bp, Homo sapiens
cccccaccactcaggccacag

SEQ ID NO: 5393163 - DNA, 15 bp, Homo sapiens
cccccaccagctgca

SEQ ID NO: 5393164 - DNA, 20 bp, Homo sapiens
cccccaccattccacatccc

SEQ ID NO: 5393165 - DNA, 14 bp, Homo sapiens
cccccaccccactc

SEQ ID NO: 5393166 - DNA, 14 bp, Homo sapiens
cccccaccccaggc

SEQ ID NO: 5393167 - DNA, 12 bp, Homo sapiens
cccccaccccta

SEQ ID NO: 5393168 - DNA, 12 bp, Homo sapiens
cccccacccctc

SEQ ID NO: 5393169 - DNA, 13 bp, Homo sapiens
cccccacccctgt

SEQ ID NO: 5393170 - DNA, 21 bp, Homo sapiens
cccccaccccttcctgtctca

SEQ ID NO: 5393171 - DNA, 13 bp, Homo sapiens
cccccaccctgct

SEQ ID NO: 5393172 - DNA, 14 bp, Homo sapiens
cccccaccctgctt

SEQ ID NO: 5393173 - DNA, 12 bp, Homo sapiens
cccccaccctgt

SEQ ID NO: 5393174 - DNA, 19 bp, Homo sapiens
cccccaccggaactgggct

SEQ ID NO: 5393175 - DNA, 20 bp, Homo sapiens
cccccaccggaactgggctg

SEQ ID NO: 5393176 - DNA, 19 bp, Homo sapiens
cccccaccggtccagctgg

SEQ ID NO: 5393177 - DNA, 21 bp, Homo sapiens
cccccaccggtccagctggcc

SEQ ID NO: 5393178 - DNA, 14 bp, Homo sapiens
cccccacctcccgg

SEQ ID NO: 5393179 - DNA, 19 bp, Homo sapiens
cccccacctccctgcagct

SEQ ID NO: 5393180 - DNA, 23 bp, Homo sapiens
cccccacctccgccccagacaca

SEQ ID NO: 5393181 - DNA, 22 bp, Homo sapiens
cccccacctctccctgaccctg

SEQ ID NO: 5393182 - DNA, 15 bp, Homo sapiens
cccccacctctgtga

SEQ ID NO: 5393183 - DNA, 23 bp, Homo sapiens
cccccaccttggtccctctcaga

SEQ ID NO: 5393184 - DNA, 18 bp, Homo sapiens
cccccacgcttctggagg

SEQ ID NO: 5393185 - DNA, 21 bp, Homo sapiens
cccccacgggacgcggcaggc

SEQ ID NO: 5393186 - DNA, 13 bp, Homo sapiens
cccccactcacac

SEQ ID NO: 5393187 - DNA, 17 bp, Homo sapiens
cccccactcagtgcctc

SEQ ID NO: 5393188 - DNA, 11 bp, Homo sapiens
cccccactccc

SEQ ID NO: 5393189 - DNA, 12 bp, Homo sapiens
cccccactccct

SEQ ID NO: 5393190 - DNA, 19 bp, Homo sapiens
cccccactctctcacccac

SEQ ID NO: 5393191 - DNA, 15 bp, Homo sapiens
cccccactgcctgga

SEQ ID NO: 5393192 - DNA, 17 bp, Homo sapiens
cccccactgcctttgac

SEQ ID NO: 5393193 - DNA, 12 bp, Homo sapiens
cccccactgcta

SEQ ID NO: 5393194 - DNA, 20 bp, Homo sapiens
cccccactggtgagacagtt

SEQ ID NO: 5393195 - DNA, 21 bp, Homo sapiens
cccccactttcaagacagatg

SEQ ID NO: 5393196 - DNA, 22 bp, Homo sapiens
cccccagaaaagaaagctacag

SEQ ID NO: 5393197 - DNA, 12 bp, Homo sapiens
cccccagaaagc

SEQ ID NO: 5393198 - DNA, 15 bp, Homo sapiens
cccccagaaagcctc

SEQ ID NO: 5393199 - DNA, 20 bp, Homo sapiens
cccccagaaagcctcctgcc

SEQ ID NO: 5393200 - DNA, 17 bp, Homo sapiens
cccccagaaagctgcca

SEQ ID NO: 5393201 - DNA, 20 bp, Homo sapiens
cccccagaaagctgccagag

SEQ ID NO: 5393202 - DNA, 22 bp, Homo sapiens
cccccagaacctgtccttgcac

SEQ ID NO: 5393203 - DNA, 15 bp, Homo sapiens
cccccagagaccttt

SEQ ID NO: 5393204 - DNA, 18 bp, Homo sapiens
cccccagagacctttgcc

SEQ ID NO: 5393205 - DNA, 23 bp, Homo sapiens
cccccagagacctttgcccacac

SEQ ID NO: 5393206 - DNA, 18 bp, Homo sapiens
cccccagagagagctctg

SEQ ID NO: 5393207 - DNA, 18 bp, Homo sapiens
cccccagagccagggctg

SEQ ID NO: 5393208 - DNA, 22 bp, Homo sapiens
cccccagagccagggctgtcct

SEQ ID NO: 5393209 - DNA, 23 bp, Homo sapiens
cccccagagccagggctgtcctt

SEQ ID NO: 5393210 - DNA, 17 bp, Homo sapiens
cccccagagcgtccttg

SEQ ID NO: 5393211 - DNA, 18 bp, Homo sapiens
cccccagaggtggccctt

SEQ ID NO: 5393212 - DNA, 16 bp, Homo sapiens
cccccagatagagctg

SEQ ID NO: 5393213 - DNA, 20 bp, Homo sapiens
cccccagatagagctgggtg

SEQ ID NO: 5393214 - DNA, 13 bp, Homo sapiens
cccccagcactga

SEQ ID NO: 5393215 - DNA, 15 bp, Homo sapiens
cccccagcactgagg

SEQ ID NO: 5393216 - DNA, 22 bp, Homo sapiens
cccccagcatcgggggcctgca

SEQ ID NO: 5393217 - DNA, 11 bp, Homo sapiens
cccccagccag

SEQ ID NO: 5393218 - DNA, 13 bp, Homo sapiens
cccccagccaggc

SEQ ID NO: 5393219 - DNA, 19 bp, Homo sapiens
cccccagccatgccagctg

SEQ ID NO: 5393220 - DNA, 15 bp, Homo sapiens
cccccagcccaaagg

SEQ ID NO: 5393221 - DNA, 19 bp, Homo sapiens
cccccagcccacagagcct

SEQ ID NO: 5393222 - DNA, 13 bp, Homo sapiens
cccccagcccagg

SEQ ID NO: 5393223 - DNA, 14 bp, Homo sapiens
cccccagcccaggg

SEQ ID NO: 5393224 - DNA, 12 bp, Homo sapiens
cccccagccctg

SEQ ID NO: 5393225 - DNA, 13 bp, Homo sapiens
cccccagccctgg

SEQ ID NO: 5393226 - DNA, 14 bp, Homo sapiens
cccccagccctggc

SEQ ID NO: 5393227 - DNA, 14 bp, Homo sapiens
cccccagccctgtg

SEQ ID NO: 5393228 - DNA, 12 bp, Homo sapiens
cccccagcctat

SEQ ID NO: 5393229 - DNA, 14 bp, Homo sapiens
cccccagcctccag

SEQ ID NO: 5393230 - DNA, 16 bp, Homo sapiens
cccccagcctccagag

SEQ ID NO: 5393231 - DNA, 21 bp, Homo sapiens
cccccagcctcccccaggctg

SEQ ID NO: 5393232 - DNA, 15 bp, Homo sapiens
cccccagcctctggc

SEQ ID NO: 5393233 - DNA, 14 bp, Homo sapiens
cccccagcctggcc

SEQ ID NO: 5393234 - DNA, 13 bp, Homo sapiens
cccccagcctggg

SEQ ID NO: 5393235 - DNA, 20 bp, Homo sapiens
cccccagccttgcccagctt

SEQ ID NO: 5393236 - DNA, 23 bp, Homo sapiens
cccccagccttgtttctgatgac

SEQ ID NO: 5393237 - DNA, 21 bp, Homo sapiens
cccctcaacctcctgtggaac

SEQ ID NO: 5393238 - DNA, 14 bp, Homo sapiens
cccctcacactgca

SEQ ID NO: 5393239 - DNA, 17 bp, Homo sapiens
cccctcacagcctctga

SEQ ID NO: 5393240 - DNA, 15 bp, Homo sapiens
cccctcaccacctct

SEQ ID NO: 5393241 - DNA, 12 bp, Homo sapiens
cccctcaccatc

SEQ ID NO: 5393242 - DNA, 13 bp, Homo sapiens
cccctcaccatcc

SEQ ID NO: 5393243 - DNA, 21 bp, Homo sapiens
cccctcacccgctgcccagcc

SEQ ID NO: 5393244 - DNA, 11 bp, Homo sapiens
cccctcaccct

SEQ ID NO: 5393245 - DNA, 16 bp, Homo sapiens
cccctcaccctgcctt

SEQ ID NO: 5393246 - DNA, 14 bp, Homo sapiens
cccctcacctctcc

SEQ ID NO: 5393247 - DNA, 21 bp, Homo sapiens
cccctcacctctccaggtgct

SEQ ID NO: 5393248 - DNA, 15 bp, Homo sapiens
cccctcacctgggcc

SEQ ID NO: 5393249 - DNA, 18 bp, Homo sapiens
cccctcacctgggccttt

SEQ ID NO: 5393250 - DNA, 15 bp, Homo sapiens
cccctcaccttgcaa

SEQ ID NO: 5393251 - DNA, 21 bp, Homo sapiens
cccctcactctgtcagccagc

SEQ ID NO: 5393252 - DNA, 22 bp, Homo sapiens
cccctcactctgtcagccagcc

SEQ ID NO: 5393253 - DNA, 17 bp, Homo sapiens
cccctcagaacaccctg

SEQ ID NO: 5393254 - DNA, 18 bp, Homo sapiens
cccctcagacagccccct

SEQ ID NO: 5393255 - DNA, 13 bp, Homo sapiens
cccctcagagcat

SEQ ID NO: 5393256 - DNA, 21 bp, Homo sapiens
cccctcagatgatctctccac

SEQ ID NO: 5393257 - DNA, 13 bp, Homo sapiens
cccctcagcctct

SEQ ID NO: 5393258 - DNA, 23 bp, Homo sapiens
cccctcagcctctcccctgcctg

SEQ ID NO: 5393259 - DNA, 16 bp, Homo sapiens
cccctcagcctcttct

SEQ ID NO: 5393260 - DNA, 15 bp, Homo sapiens
cccctcagcgcaggc

SEQ ID NO: 5393261 - DNA, 19 bp, Homo sapiens
cccctcagcgcaggctgca

SEQ ID NO: 5393262 - DNA, 20 bp, Homo sapiens
cccctcagcgcaggctgcag

SEQ ID NO: 5393263 - DNA, 21 bp, Homo sapiens
cccctcagcgcaggctgcaga

SEQ ID NO: 5393264 - DNA, 22 bp, Homo sapiens
cccctcagcgcaggctgcagag

SEQ ID NO: 5393265 - DNA, 20 bp, Homo sapiens
cccctcagcgctccctgtcg

SEQ ID NO: 5393266 - DNA, 13 bp, Homo sapiens
cccctcagctcca

SEQ ID NO: 5393267 - DNA, 17 bp, Homo sapiens
cccctcagctccagacg

SEQ ID NO: 5393268 - DNA, 13 bp, Homo sapiens
cccctcagctccc

SEQ ID NO: 5393269 - DNA, 15 bp, Homo sapiens
cccctcagctcggct

SEQ ID NO: 5393270 - DNA, 16 bp, Homo sapiens
cccctcagctctccct

SEQ ID NO: 5393271 - DNA, 15 bp, Homo sapiens
cccctcaggactgca

SEQ ID NO: 5393272 - DNA, 22 bp, Homo sapiens
cccctcaggggaagctgctagg

SEQ ID NO: 5393273 - DNA, 17 bp, Homo sapiens
cccctcagggggccagc

SEQ ID NO: 5393274 - DNA, 19 bp, Homo sapiens
cccctcagggggccagctg

SEQ ID NO: 5393275 - DNA, 20 bp, Homo sapiens
cccctcagggggccagctgg

SEQ ID NO: 5393276 - DNA, 23 bp, Homo sapiens
cccctcagggggccagctgggga

SEQ ID NO: 5393277 - DNA, 16 bp, Homo sapiens
cccctcagggtccctg

SEQ ID NO: 5393278 - DNA, 18 bp, Homo sapiens
cccctcagggtccctggt

SEQ ID NO: 5393279 - DNA, 22 bp, Homo sapiens
cccctcagggtccctggtggca

SEQ ID NO: 5393280 - DNA, 18 bp, Homo sapiens
cccctcagttgtgcagct

SEQ ID NO: 5393281 - DNA, 17 bp, Homo sapiens
cccctcattcagagact

SEQ ID NO: 5393282 - DNA, 22 bp, Homo sapiens
cccctcattcagagactgccct

SEQ ID NO: 5393283 - DNA, 13 bp, Homo sapiens
cccctccaaacct

SEQ ID NO: 5393284 - DNA, 20 bp, Homo sapiens
cccctccaaacctccagcct

SEQ ID NO: 5393285 - DNA, 23 bp, Homo sapiens
cccctccaatcccaccaaccctc

SEQ ID NO: 5393286 - DNA, 19 bp, Homo sapiens
cccctccacaaagagacca

SEQ ID NO: 5393287 - DNA, 12 bp, Homo sapiens
cccctccacagc

SEQ ID NO: 5393288 - DNA, 20 bp, Homo sapiens
cccctccacagctgcagctg

SEQ ID NO: 5393289 - DNA, 14 bp, Homo sapiens
cccctccacatccc

SEQ ID NO: 5393290 - DNA, 20 bp, Homo sapiens
cccctccacatcccagcagc

SEQ ID NO: 5393291 - DNA, 18 bp, Homo sapiens
cccctccacgtgtccgtc

SEQ ID NO: 5393292 - DNA, 17 bp, Homo sapiens
cccctccactctttctt

SEQ ID NO: 5393293 - DNA, 12 bp, Homo sapiens
cccctccactgc

SEQ ID NO: 5393294 - DNA, 14 bp, Homo sapiens
cccctccactgtca

SEQ ID NO: 5393295 - DNA, 14 bp, Homo sapiens
cccctccagacccc

SEQ ID NO: 5393296 - DNA, 17 bp, Homo sapiens
cccctccagaccctgcc

SEQ ID NO: 5393297 - DNA, 11 bp, Homo sapiens
cccctccagct

SEQ ID NO: 5393298 - DNA, 15 bp, Homo sapiens
cccctccagctccag

SEQ ID NO: 5393299 - DNA, 13 bp, Homo sapiens
cccctccagcttg

SEQ ID NO: 5393300 - DNA, 21 bp, Homo sapiens
cccctccaggagggaccaccc

SEQ ID NO: 5393301 - DNA, 13 bp, Homo sapiens
cccctccagtgct

SEQ ID NO: 5393302 - DNA, 13 bp, Homo sapiens
cccctccattccc

SEQ ID NO: 5393303 - DNA, 16 bp, Homo sapiens
cccctcccaatcctct

SEQ ID NO: 5393304 - DNA, 11 bp, Homo sapiens
cccctcccacc

SEQ ID NO: 5393305 - DNA, 12 bp, Homo sapiens
cccctcccaccc

SEQ ID NO: 5393306 - DNA, 17 bp, Homo sapiens
cccctcccacccccagc

SEQ ID NO: 5393307 - DNA, 13 bp, Homo sapiens
cccctcccaccgc

SEQ ID NO: 5393308 - DNA, 13 bp, Homo sapiens
cccctcccacctc

SEQ ID NO: 5393309 - DNA, 15 bp, Homo sapiens
cccctcccacggtgc

SEQ ID NO: 5393310 - DNA, 13 bp, Homo sapiens
cccctcccagaac

SEQ ID NO: 5393311 - DNA, 12 bp, Homo sapiens
cccctcccagac

SEQ ID NO: 5393312 - DNA, 13 bp, Homo sapiens
cccctcccagagg

SEQ ID NO: 5393313 - DNA, 14 bp, Homo sapiens
cccctcccagaggc

SEQ ID NO: 5393314 - DNA, 11 bp, Homo sapiens
cccctcccagc

SEQ ID NO: 5393315 - DNA, 14 bp, Homo sapiens
cccctcccagctga

SEQ ID NO: 5393316 - DNA, 14 bp, Homo sapiens
cccctcccagggcc

SEQ ID NO: 5393317 - DNA, 22 bp, Homo sapiens
cccctcccaggggagccagctg

SEQ ID NO: 5393318 - DNA, 13 bp, Homo sapiens
cccctcccatctg

SEQ ID NO: 5393319 - DNA, 14 bp, Homo sapiens
cccctcccatctgg

SEQ ID NO: 5393320 - DNA, 11 bp, Homo sapiens
cccctcccatt

SEQ ID NO: 5393321 - DNA, 14 bp, Homo sapiens
cccctccccaccca

SEQ ID NO: 5393322 - DNA, 15 bp, Homo sapiens
cccctccccagggga

SEQ ID NO: 5393323 - DNA, 13 bp, Homo sapiens
cccctccccatct

SEQ ID NO: 5393324 - DNA, 14 bp, Homo sapiens
cccctccccatctg

SEQ ID NO: 5393325 - DNA, 15 bp, Homo sapiens
cccctccccatctgt

SEQ ID NO: 5393326 - DNA, 16 bp, Homo sapiens
cccctcccccaacccc

SEQ ID NO: 5393327 - DNA, 15 bp, Homo sapiens
cccctcccccacgtc

SEQ ID NO: 5393328 - DNA, 22 bp, Homo sapiens
cccctcccccacgtctctctgc

SEQ ID NO: 5393329 - DNA, 17 bp, Homo sapiens
cccctcccccactcctc

SEQ ID NO: 5393330 - DNA, 13 bp, Homo sapiens
cccctcccccagc

SEQ ID NO: 5393331 - DNA, 15 bp, Homo sapiens
cccctccccccactt

SEQ ID NO: 5393332 - DNA, 17 bp, Homo sapiens
cccctccccccagactc

SEQ ID NO: 5393333 - DNA, 18 bp, Homo sapiens
cccctccccccagactct

SEQ ID NO: 5393334 - DNA, 16 bp, Homo sapiens
cccctcccccgcagac

SEQ ID NO: 5393335 - DNA, 18 bp, Homo sapiens
cccctcccccgcagacag

SEQ ID NO: 5393336 - DNA, 15 bp, Homo sapiens
cccctcccccgtcct

SEQ ID NO: 5393337 - DNA, 20 bp, Homo sapiens
cccctccccctcctgctgtg

SEQ ID NO: 5393338 - DNA, 20 bp, Homo sapiens
cccctccccctgagattcag

SEQ ID NO: 5393339 - DNA, 14 bp, Homo sapiens
cccctcccccttct

SEQ ID NO: 5393340 - DNA, 15 bp, Homo sapiens
cccctccccgcctcc

SEQ ID NO: 5393341 - DNA, 18 bp, Homo sapiens
cccctccccgcctcctcc

SEQ ID NO: 5393342 - DNA, 21 bp, Homo sapiens
cccctccccgcctcctccctg

SEQ ID NO: 5393343 - DNA, 13 bp, Homo sapiens
cccctccccgtgt

SEQ ID NO: 5393344 - DNA, 13 bp, Homo sapiens
cccctcccctcag

SEQ ID NO: 5393345 - DNA, 12 bp, Homo sapiens
cccctcccctcc

SEQ ID NO: 5393346 - DNA, 13 bp, Homo sapiens
cccctcccctgaa

SEQ ID NO: 5393347 - DNA, 13 bp, Homo sapiens
cccctcccctgca

SEQ ID NO: 5393348 - DNA, 12 bp, Homo sapiens
cccctcccctgg

SEQ ID NO: 5393349 - DNA, 17 bp, Homo sapiens
cccctcccgccccttcc

SEQ ID NO: 5393350 - DNA, 13 bp, Homo sapiens
cccctcccgcttc

SEQ ID NO: 5393351 - DNA, 19 bp, Homo sapiens
cccctcccgtcttcctcct

SEQ ID NO: 5393352 - DNA, 12 bp, Homo sapiens
cccctccctacc

SEQ ID NO: 5393353 - DNA, 16 bp, Homo sapiens
cccctccctagatcca

SEQ ID NO: 5393354 - DNA, 10 bp, Homo sapiens
cccctccctc

SEQ ID NO: 5393355 - DNA, 15 bp, Homo sapiens
cccctccctcccaca

SEQ ID NO: 5393356 - DNA, 20 bp, Homo sapiens
cccctccctcctctggccca

SEQ ID NO: 5393357 - DNA, 13 bp, Homo sapiens
cccctccctcgtg

SEQ ID NO: 5393358 - DNA, 14 bp, Homo sapiens
cccctccctcgtgg

SEQ ID NO: 5393359 - DNA, 14 bp, Homo sapiens
cccctccctctgcc

SEQ ID NO: 5393360 - DNA, 15 bp, Homo sapiens
cccctccctctgctc

SEQ ID NO: 5393361 - DNA, 20 bp, Homo sapiens
cccctccctcttccttcccc

SEQ ID NO: 5393362 - DNA, 17 bp, Homo sapiens
cccctccctcttctgcc

SEQ ID NO: 5393363 - DNA, 14 bp, Homo sapiens
cccctccctgccca

SEQ ID NO: 5393364 - DNA, 16 bp, Homo sapiens
cccctccctgcccaaa

SEQ ID NO: 5393365 - DNA, 14 bp, Homo sapiens
cccctccctgctcc

SEQ ID NO: 5393366 - DNA, 16 bp, Homo sapiens
cccctccctgctccca

SEQ ID NO: 5393367 - DNA, 14 bp, Homo sapiens
cccctccctgcttg

SEQ ID NO: 5393368 - DNA, 17 bp, Homo sapiens
cccctccctggcctgtt

SEQ ID NO: 5393369 - DNA, 12 bp, Homo sapiens
cccctccctggg

SEQ ID NO: 5393370 - DNA, 14 bp, Homo sapiens
cccctccctgggtt

SEQ ID NO: 5393371 - DNA, 20 bp, Homo sapiens
cccctccctgtaatgcactc

SEQ ID NO: 5393372 - DNA, 15 bp, Homo sapiens
cccctccctttctcc

SEQ ID NO: 5393373 - DNA, 23 bp, Homo sapiens
cccctccctttttaaacaaatgg

SEQ ID NO: 5393374 - DNA, 17 bp, Homo sapiens
cccctccgatgctgagg

SEQ ID NO: 5393375 - DNA, 13 bp, Homo sapiens
cccctccgcagca

SEQ ID NO: 5393376 - DNA, 20 bp, Homo sapiens
cccctccgcgagggctactc

SEQ ID NO: 5393377 - DNA, 17 bp, Homo sapiens
cccctccggactggtgc

SEQ ID NO: 5393378 - DNA, 18 bp, Homo sapiens
cccctccggactggtgcc

SEQ ID NO: 5393379 - DNA, 18 bp, Homo sapiens
cccctccgtccccagggt

SEQ ID NO: 5393380 - DNA, 20 bp, Homo sapiens
cccctccgtccccagggtgc

SEQ ID NO: 5393381 - DNA, 23 bp, Homo sapiens
cccctcctacccctcccagctga

SEQ ID NO: 5393382 - DNA, 13 bp, Homo sapiens
cccctcctcagcc

SEQ ID NO: 5393383 - DNA, 21 bp, Homo sapiens
cccctcctccagagcctgggc

SEQ ID NO: 5393384 - DNA, 13 bp, Homo sapiens
cccctcctccagt

SEQ ID NO: 5393385 - DNA, 15 bp, Homo sapiens
cccctcctccatgct

SEQ ID NO: 5393386 - DNA, 22 bp, Homo sapiens
cccctcctccatgctgtccctg

SEQ ID NO: 5393387 - DNA, 18 bp, Homo sapiens
cccctcctccccctttgg

SEQ ID NO: 5393388 - DNA, 19 bp, Homo sapiens
cccctcctccctcagaccc

SEQ ID NO: 5393389 - DNA, 21 bp, Homo sapiens
cccctcctccctcagacccag

SEQ ID NO: 5393390 - DNA, 16 bp, Homo sapiens
cccctcctctagctct

SEQ ID NO: 5393391 - DNA, 21 bp, Homo sapiens
cccctcctctagctgtggggg

SEQ ID NO: 5393392 - DNA, 11 bp, Homo sapiens
cccctcctctc

SEQ ID NO: 5393393 - DNA, 15 bp, Homo sapiens
cccctcctctcccat

SEQ ID NO: 5393394 - DNA, 18 bp, Homo sapiens
cccctcctctcccatccc

SEQ ID NO: 5393395 - DNA, 17 bp, Homo sapiens
cccctcctctctgccct

SEQ ID NO: 5393396 - DNA, 22 bp, Homo sapiens
cccctcctctgaaacagctgcc

SEQ ID NO: 5393397 - DNA, 15 bp, Homo sapiens
cccctcctctgagca

SEQ ID NO: 5393398 - DNA, 12 bp, Homo sapiens
cccctcctgcac

SEQ ID NO: 5393399 - DNA, 13 bp, Homo sapiens
cccctcctgcaca

SEQ ID NO: 5393400 - DNA, 12 bp, Homo sapiens
cccctcctgcgc

SEQ ID NO: 5393401 - DNA, 18 bp, Homo sapiens
cccctcctgctcctccct

SEQ ID NO: 5393402 - DNA, 13 bp, Homo sapiens
cccctcctgctgc

SEQ ID NO: 5393403 - DNA, 14 bp, Homo sapiens
cccctcctgctgtg

SEQ ID NO: 5393404 - DNA, 11 bp, Homo sapiens
cccctcctggc

SEQ ID NO: 5393405 - DNA, 12 bp, Homo sapiens
cccctcctggca

SEQ ID NO: 5393406 - DNA, 18 bp, Homo sapiens
cccctcctggcaatcaat

SEQ ID NO: 5393407 - DNA, 14 bp, Homo sapiens
cccctcctgggccc

SEQ ID NO: 5393408 - DNA, 18 bp, Homo sapiens
cccctcctggggccaggc

SEQ ID NO: 5393409 - DNA, 11 bp, Homo sapiens
cccctcctgta

SEQ ID NO: 5393410 - DNA, 9 bp, Homo sapiens
cccctcctt

SEQ ID NO: 5393411 - DNA, 14 bp, Homo sapiens
cccctccttcccaa

SEQ ID NO: 5393412 - DNA, 20 bp, Homo sapiens
cccctccttcccagctgccc

SEQ ID NO: 5393413 - DNA, 18 bp, Homo sapiens
cccctccttccctcaccc

SEQ ID NO: 5393414 - DNA, 22 bp, Homo sapiens
cccctccttccctgtgtctttt

SEQ ID NO: 5393415 - DNA, 17 bp, Homo sapiens
cccctccttccttgacc

SEQ ID NO: 5393416 - DNA, 20 bp, Homo sapiens
cccctccttccttgaccagc

SEQ ID NO: 5393417 - DNA, 14 bp, Homo sapiens
cccctccttgctct

SEQ ID NO: 5393418 - DNA, 13 bp, Homo sapiens
cccctccttgggc

SEQ ID NO: 5393419 - DNA, 15 bp, Homo sapiens
cccctccttgggcac

SEQ ID NO: 5393420 - DNA, 19 bp, Homo sapiens
cccctgtgcagccgctgag

SEQ ID NO: 5393421 - DNA, 12 bp, Homo sapiens
cccctgtgcata

SEQ ID NO: 5393422 - DNA, 14 bp, Homo sapiens
cccctgtgccagct

SEQ ID NO: 5393423 - DNA, 16 bp, Homo sapiens
cccctgtgccagctca

SEQ ID NO: 5393424 - DNA, 15 bp, Homo sapiens
cccctgtgcctgctg

SEQ ID NO: 5393425 - DNA, 16 bp, Homo sapiens
cccctgtgcctgctgg

SEQ ID NO: 5393426 - DNA, 14 bp, Homo sapiens
cccctgtgccttgt

SEQ ID NO: 5393427 - DNA, 11 bp, Homo sapiens
cccctgtgctc

SEQ ID NO: 5393428 - DNA, 20 bp, Homo sapiens
cccctgtgctcccctgccac

SEQ ID NO: 5393429 - DNA, 19 bp, Homo sapiens
cccctgtgctccgtgcctc

SEQ ID NO: 5393430 - DNA, 17 bp, Homo sapiens
cccctgtggccctggcc

SEQ ID NO: 5393431 - DNA, 22 bp, Homo sapiens
cccctgtgggactcatccttgc

SEQ ID NO: 5393432 - DNA, 20 bp, Homo sapiens
cccctgtggggaacaggtct

SEQ ID NO: 5393433 - DNA, 11 bp, Homo sapiens
cccctgtgtag

SEQ ID NO: 5393434 - DNA, 19 bp, Homo sapiens
cccctgtgtattcaccacc

SEQ ID NO: 5393435 - DNA, 18 bp, Homo sapiens
cccctgtgtgggagggcg

SEQ ID NO: 5393436 - DNA, 15 bp, Homo sapiens
cccctgttcactcta

SEQ ID NO: 5393437 - DNA, 16 bp, Homo sapiens
cccctgttcccctctc

SEQ ID NO: 5393438 - DNA, 11 bp, Homo sapiens
cccctgttcta

SEQ ID NO: 5393439 - DNA, 13 bp, Homo sapiens
cccctgttctaag

SEQ ID NO: 5393440 - DNA, 18 bp, Homo sapiens
cccctgttggaggtgagt

SEQ ID NO: 5393441 - DNA, 20 bp, Homo sapiens
cccctgtttcaatcactgtc

SEQ ID NO: 5393442 - DNA, 18 bp, Homo sapiens
cccctgtttctcctccat

SEQ ID NO: 5393443 - DNA, 19 bp, Homo sapiens
cccctgtttctcctccatt

SEQ ID NO: 5393444 - DNA, 17 bp, Homo sapiens
ccccttaaacttccaaa

SEQ ID NO: 5393445 - DNA, 22 bp, Homo sapiens
ccccttaaagaaaattgcatga

SEQ ID NO: 5393446 - DNA, 23 bp, Homo sapiens
ccccttaaatttctgccctgagc

SEQ ID NO: 5393447 - DNA, 13 bp, Homo sapiens
ccccttacccatc

SEQ ID NO: 5393448 - DNA, 14 bp, Homo sapiens
ccccttatcctccc

SEQ ID NO: 5393449 - DNA, 17 bp, Homo sapiens
ccccttattgctgccaa

SEQ ID NO: 5393450 - DNA, 16 bp, Homo sapiens
ccccttcaaacctaaa

SEQ ID NO: 5393451 - DNA, 20 bp, Homo sapiens
ccccttcactccctccctgg

SEQ ID NO: 5393452 - DNA, 17 bp, Homo sapiens
ccccttcacttctgacc

SEQ ID NO: 5393453 - DNA, 19 bp, Homo sapiens
ccccttcacttctgaccac

SEQ ID NO: 5393454 - DNA, 23 bp, Homo sapiens
ccccttcacttctgaccacactt

SEQ ID NO: 5393455 - DNA, 17 bp, Homo sapiens
ccccttcagaccttgca

SEQ ID NO: 5393456 - DNA, 18 bp, Homo sapiens
ccccttcagctcctgagt

SEQ ID NO: 5393457 - DNA, 11 bp, Homo sapiens
ccccttcagga

SEQ ID NO: 5393458 - DNA, 15 bp, Homo sapiens
ccccttcaggagcct

SEQ ID NO: 5393459 - DNA, 20 bp, Homo sapiens
ccccttcaggagcctggcca

SEQ ID NO: 5393460 - DNA, 14 bp, Homo sapiens
ccccttcagtgccc

SEQ ID NO: 5393461 - DNA, 16 bp, Homo sapiens
ccccttcatcctctga

SEQ ID NO: 5393462 - DNA, 17 bp, Homo sapiens
ccccttccaaataataa

SEQ ID NO: 5393463 - DNA, 15 bp, Homo sapiens
ccccttccagctccc

SEQ ID NO: 5393464 - DNA, 17 bp, Homo sapiens
ccccttccagctccctc

SEQ ID NO: 5393465 - DNA, 18 bp, Homo sapiens
ccccttccagctccctcc

SEQ ID NO: 5393466 - DNA, 19 bp, Homo sapiens
ccccttccagctccctccc

SEQ ID NO: 5393467 - DNA, 11 bp, Homo sapiens
ccccttcccac

SEQ ID NO: 5393468 - DNA, 15 bp, Homo sapiens
ccccttcccacatat

SEQ ID NO: 5393469 - DNA, 13 bp, Homo sapiens
ccccttcccaccc

SEQ ID NO: 5393470 - DNA, 15 bp, Homo sapiens
ccccttccccatctc

SEQ ID NO: 5393471 - DNA, 16 bp, Homo sapiens
ccccttccccatggga

SEQ ID NO: 5393472 - DNA, 13 bp, Homo sapiens
ccccttcccctcc

SEQ ID NO: 5393473 - DNA, 13 bp, Homo sapiens
ccccttcccctgc

SEQ ID NO: 5393474 - DNA, 18 bp, Homo sapiens
ccccttcccctgcgccct

SEQ ID NO: 5393475 - DNA, 14 bp, Homo sapiens
ccccttcccctgct

SEQ ID NO: 5393476 - DNA, 16 bp, Homo sapiens
ccccttcccctgggaa

SEQ ID NO: 5393477 - DNA, 18 bp, Homo sapiens
ccccttcccctgggaact

SEQ ID NO: 5393478 - DNA, 17 bp, Homo sapiens
ccccttcccgccttcca

SEQ ID NO: 5393479 - DNA, 18 bp, Homo sapiens
ccccttcccgtgacctgg

SEQ ID NO: 5393480 - DNA, 18 bp, Homo sapiens
ccccttccctctctccct

SEQ ID NO: 5393481 - DNA, 12 bp, Homo sapiens
ccccttccctgg

SEQ ID NO: 5393482 - DNA, 13 bp, Homo sapiens
ccccttccctggg

SEQ ID NO: 5393483 - DNA, 19 bp, Homo sapiens
ccccttccctggggagccc

SEQ ID NO: 5393484 - DNA, 13 bp, Homo sapiens
ccccttccctgtc

SEQ ID NO: 5393485 - DNA, 17 bp, Homo sapiens
ccccttcccttggaggg

SEQ ID NO: 5393486 - DNA, 12 bp, Homo sapiens
ccccttcctaag

SEQ ID NO: 5393487 - DNA, 17 bp, Homo sapiens
ccccttcctactcccag

SEQ ID NO: 5393488 - DNA, 21 bp, Homo sapiens
ccccttcctcagcctggggtt

SEQ ID NO: 5393489 - DNA, 19 bp, Homo sapiens
ccccttcctcttgtctgat

SEQ ID NO: 5393490 - DNA, 16 bp, Homo sapiens
ccccttcctgcacccg

SEQ ID NO: 5393491 - DNA, 11 bp, Homo sapiens
ccccttcctgg

SEQ ID NO: 5393492 - DNA, 14 bp, Homo sapiens
ccccttcctggaca

SEQ ID NO: 5393493 - DNA, 15 bp, Homo sapiens
ccccttcctggacac

SEQ ID NO: 5393494 - DNA, 13 bp, Homo sapiens
ccccttcctggcc

SEQ ID NO: 5393495 - DNA, 14 bp, Homo sapiens
ccccttcctgggca

SEQ ID NO: 5393496 - DNA, 11 bp, Homo sapiens
ccccttcctgt

SEQ ID NO: 5393497 - DNA, 22 bp, Homo sapiens
ccccttcctgtcccacctcttc

SEQ ID NO: 5393498 - DNA, 19 bp, Homo sapiens
ccccttcctgtcctgcctc

SEQ ID NO: 5393499 - DNA, 19 bp, Homo sapiens
ccccttcctgtgtccatgt

SEQ ID NO: 5393500 - DNA, 17 bp, Homo sapiens
ccccttcctgtttcaga

SEQ ID NO: 5393501 - DNA, 20 bp, Homo sapiens
ccccttccttgctctgcacc

SEQ ID NO: 5393502 - DNA, 23 bp, Homo sapiens
ccccttcctttggtgcctcactg

SEQ ID NO: 5393503 - DNA, 23 bp, Homo sapiens
ccccttcgaggttgccccttccc

SEQ ID NO: 5393504 - DNA, 14 bp, Homo sapiens
ccccttcgctcctc

SEQ ID NO: 5393505 - DNA, 19 bp, Homo sapiens
ccccttcgctcctgtgtct

SEQ ID NO: 5393506 - DNA, 22 bp, Homo sapiens
ccccttctaggtggcaaggctg

SEQ ID NO: 5393507 - DNA, 16 bp, Homo sapiens
ccccttctcagaatct

SEQ ID NO: 5393508 - DNA, 16 bp, Homo sapiens
ccccttctcccagcac

SEQ ID NO: 5393509 - DNA, 12 bp, Homo sapiens
ccccttctcccc

SEQ ID NO: 5393510 - DNA, 18 bp, Homo sapiens
ccccttctcccctgcact

SEQ ID NO: 5393511 - DNA, 22 bp, Homo sapiens
ccccttctccccttcctggaca

SEQ ID NO: 5393512 - DNA, 16 bp, Homo sapiens
ccccttctctcatctc

SEQ ID NO: 5393513 - DNA, 17 bp, Homo sapiens
ccccttctctctccaga

SEQ ID NO: 5393514 - DNA, 13 bp, Homo sapiens
ccccttctctgct

SEQ ID NO: 5393515 - DNA, 13 bp, Homo sapiens
ccccttctctgta

SEQ ID NO: 5393516 - DNA, 13 bp, Homo sapiens
ccccttctgaccc

SEQ ID NO: 5393517 - DNA, 14 bp, Homo sapiens
ccccttctgaccca

SEQ ID NO: 5393518 - DNA, 17 bp, Homo sapiens
ccccttctgacccatgc

SEQ ID NO: 5393519 - DNA, 23 bp, Homo sapiens
ccccttctgggcatctgttctgg

SEQ ID NO: 5393520 - DNA, 17 bp, Homo sapiens
ccccttctgtgtcacag

SEQ ID NO: 5393521 - DNA, 13 bp, Homo sapiens
ccccttcttgggc

SEQ ID NO: 5393522 - DNA, 22 bp, Homo sapiens
ccccttcttgtgtcctggctgg

SEQ ID NO: 5393523 - DNA, 22 bp, Homo sapiens
ccccttgaaggagaatcatcag

SEQ ID NO: 5393524 - DNA, 12 bp, Homo sapiens
ccccttgcaagc

SEQ ID NO: 5393525 - DNA, 13 bp, Homo sapiens
ccccttgcaagcc

SEQ ID NO: 5393526 - DNA, 13 bp, Homo sapiens
ccccttgcagcct

SEQ ID NO: 5393527 - DNA, 20 bp, Homo sapiens
ccccttgccaaattccatgt

SEQ ID NO: 5393528 - DNA, 16 bp, Homo sapiens
ccccttgccagctgct

SEQ ID NO: 5393529 - DNA, 19 bp, Homo sapiens
ccccttgccagctgctgag

SEQ ID NO: 5393530 - DNA, 17 bp, Homo sapiens
ccccttgcccagggctc

SEQ ID NO: 5393531 - DNA, 20 bp, Homo sapiens
ccccttgcccagggctcagc

SEQ ID NO: 5393532 - DNA, 21 bp, Homo sapiens
ccccttgcccagggctcagcc

SEQ ID NO: 5393533 - DNA, 18 bp, Homo sapiens
ccccttgcccatgcctcc

SEQ ID NO: 5393534 - DNA, 18 bp, Homo sapiens
ccccttgcccgccagcca

SEQ ID NO: 5393535 - DNA, 12 bp, Homo sapiens
ccccttgccctc

SEQ ID NO: 5393536 - DNA, 17 bp, Homo sapiens
ccccttgccctccgcct

SEQ ID NO: 5393537 - DNA, 15 bp, Homo sapiens
ccccttgcccttcct

SEQ ID NO: 5393538 - DNA, 18 bp, Homo sapiens
ccccttgcccttgccctg

SEQ ID NO: 5393539 - DNA, 19 bp, Homo sapiens
ccccttgcccttgccctga

SEQ ID NO: 5393540 - DNA, 11 bp, Homo sapiens
ccccttgcctg

SEQ ID NO: 5393541 - DNA, 13 bp, Homo sapiens
ccccttgctgctg

SEQ ID NO: 5393542 - DNA, 15 bp, Homo sapiens
ccccttgctgctggc

SEQ ID NO: 5393543 - DNA, 12 bp, Homo sapiens
ccccttgcttct

SEQ ID NO: 5393544 - DNA, 21 bp, Homo sapiens
ccccttggaaatgtctgctgg

SEQ ID NO: 5393545 - DNA, 16 bp, Homo sapiens
ccccttggacctccag

SEQ ID NO: 5393546 - DNA, 18 bp, Homo sapiens
ccccttggattcctgcac

SEQ ID NO: 5393547 - DNA, 17 bp, Homo sapiens
ccccttggcaggtcctg

SEQ ID NO: 5393548 - DNA, 20 bp, Homo sapiens
ccccttgggatgggcacagg

SEQ ID NO: 5393549 - DNA, 22 bp, Homo sapiens
ccccttgggatgggcacaggct

SEQ ID NO: 5393550 - DNA, 13 bp, Homo sapiens
ccccttgggcatc

SEQ ID NO: 5393551 - DNA, 23 bp, Homo sapiens
ccccttgggcatccacccagtgc

SEQ ID NO: 5393552 - DNA, 15 bp, Homo sapiens
ccccttgggcctccc

SEQ ID NO: 5393553 - DNA, 17 bp, Homo sapiens
ccccttgggcctcccac

SEQ ID NO: 5393554 - DNA, 13 bp, Homo sapiens
ccccttgggcggc

SEQ ID NO: 5393555 - DNA, 18 bp, Homo sapiens
ccccttggggagcagtgg

SEQ ID NO: 5393556 - DNA, 20 bp, Homo sapiens
ccccttgtccctggggcact

SEQ ID NO: 5393557 - DNA, 15 bp, Homo sapiens
ccccttgtcctctca

SEQ ID NO: 5393558 - DNA, 16 bp, Homo sapiens
ccccttgtcctctcag

SEQ ID NO: 5393559 - DNA, 19 bp, Homo sapiens
ccccttgtcctctcagagc

SEQ ID NO: 5393560 - DNA, 21 bp, Homo sapiens
ccccttgtcctctcagagcct

SEQ ID NO: 5393561 - DNA, 16 bp, Homo sapiens
ccccttgtctccctgg

SEQ ID NO: 5393562 - DNA, 19 bp, Homo sapiens
ccccttgtcttcccccctc

SEQ ID NO: 5393563 - DNA, 22 bp, Homo sapiens
ccccttgtcttcccccctctcc

SEQ ID NO: 5393564 - DNA, 20 bp, Homo sapiens
cccctttaccctctttgctg

SEQ ID NO: 5393565 - DNA, 20 bp, Homo sapiens
cccctttagatctctgaagc

SEQ ID NO: 5393566 - DNA, 14 bp, Homo sapiens
cccctttcacactg

SEQ ID NO: 5393567 - DNA, 14 bp, Homo sapiens
cccctttcacctgg

SEQ ID NO: 5393568 - DNA, 23 bp, Homo sapiens
cccctttccaattccaaaattcc

SEQ ID NO: 5393569 - DNA, 13 bp, Homo sapiens
cccctttcccacc

SEQ ID NO: 5393570 - DNA, 13 bp, Homo sapiens
cccctttcccggg

SEQ ID NO: 5393571 - DNA, 18 bp, Homo sapiens
cccctttcccgggctgtc

SEQ ID NO: 5393572 - DNA, 19 bp, Homo sapiens
cccctttcctccccataca

SEQ ID NO: 5393573 - DNA, 23 bp, Homo sapiens
cccctttcctccccatacacaca

SEQ ID NO: 5393574 - DNA, 22 bp, Homo sapiens
cccctttcctggacactcagac

SEQ ID NO: 5393575 - DNA, 15 bp, Homo sapiens
cccctttcctggggg

SEQ ID NO: 5393576 - DNA, 13 bp, Homo sapiens
cccctttcctgtc

SEQ ID NO: 5393577 - DNA, 12 bp, Homo sapiens
cccctttccttc

SEQ ID NO: 5393578 - DNA, 13 bp, Homo sapiens
cccctttccttca

SEQ ID NO: 5393579 - DNA, 21 bp, Homo sapiens
cccctttccttcactgcccca

SEQ ID NO: 5393580 - DNA, 22 bp, Homo sapiens
cccctttctaaggatagccttt

SEQ ID NO: 5393581 - DNA, 10 bp, Homo sapiens
cccctttctc

SEQ ID NO: 5393582 - DNA, 17 bp, Homo sapiens
cccctttctccagccct

SEQ ID NO: 5393583 - DNA, 15 bp, Homo sapiens
cccctttctctgcct

SEQ ID NO: 5393584 - DNA, 20 bp, Homo sapiens
cccctttctctgcctggcaa

SEQ ID NO: 5393585 - DNA, 14 bp, Homo sapiens
cccctttgccttcc

SEQ ID NO: 5393586 - DNA, 18 bp, Homo sapiens
cccctttggacctgcagt

SEQ ID NO: 5393587 - DNA, 13 bp, Homo sapiens
cccctttgggccc

SEQ ID NO: 5393588 - DNA, 20 bp, Homo sapiens
cccctttgggcccagggaca

SEQ ID NO: 5393589 - DNA, 16 bp, Homo sapiens
cccctttgggccctgc

SEQ ID NO: 5393590 - DNA, 15 bp, Homo sapiens
cccctttgtcctgcg

SEQ ID NO: 5393591 - DNA, 14 bp, Homo sapiens
ccccttttaccact

SEQ ID NO: 5393592 - DNA, 21 bp, Homo sapiens
ccccttttcagctgagccctg

SEQ ID NO: 5393593 - DNA, 23 bp, Homo sapiens
ccccttttcagctgagccctggg

SEQ ID NO: 5393594 - DNA, 14 bp, Homo sapiens
ccccttttctatgt

SEQ ID NO: 5393595 - DNA, 17 bp, Homo sapiens
ccccttttctccccacg

SEQ ID NO: 5393596 - DNA, 12 bp, Homo sapiens
ccccttttctct

SEQ ID NO: 5393597 - DNA, 14 bp, Homo sapiens
ccccttttctctgc

SEQ ID NO: 5393598 - DNA, 18 bp, Homo sapiens
ccccttttctctgctctt

SEQ ID NO: 5393599 - DNA, 19 bp, Homo sapiens
ccccttttctctgctcttg

SEQ ID NO: 5393600 - DNA, 17 bp, Homo sapiens
ccccttttcttttctac

SEQ ID NO: 5393601 - DNA, 18 bp, Homo sapiens
cccgcttccccacagaac

SEQ ID NO: 5393602 - DNA, 15 bp, Homo sapiens
cccgcttcctggcct

SEQ ID NO: 5393603 - DNA, 17 bp, Homo sapiens
cccgcttcctggcctcc

SEQ ID NO: 5393604 - DNA, 21 bp, Homo sapiens
cccgcttctgaagctgctgca

SEQ ID NO: 5393605 - DNA, 11 bp, Homo sapiens
cccgcttgcct

SEQ ID NO: 5393606 - DNA, 17 bp, Homo sapiens
cccgcttgcctcggctc

SEQ ID NO: 5393607 - DNA, 20 bp, Homo sapiens
cccgcttgcctcggctcctg

SEQ ID NO: 5393608 - DNA, 21 bp, Homo sapiens
cccgcttgcctcggctcctgc

SEQ ID NO: 5393609 - DNA, 23 bp, Homo sapiens
cccgcttgcctcggctcctgctg

SEQ ID NO: 5393610 - DNA, 16 bp, Homo sapiens
cccgcttgctctcctg

SEQ ID NO: 5393611 - DNA, 20 bp, Homo sapiens
cccgcttgctctcctggagc

SEQ ID NO: 5393612 - DNA, 14 bp, Homo sapiens
cccgcttggcttct

SEQ ID NO: 5393613 - DNA, 16 bp, Homo sapiens
cccgcttggcttcttc

SEQ ID NO: 5393614 - DNA, 14 bp, Homo sapiens
cccgcttgtccagc

SEQ ID NO: 5393615 - DNA, 18 bp, Homo sapiens
cccgcttgtccagcgcct

SEQ ID NO: 5393616 - DNA, 19 bp, Homo sapiens
cccgcttttgcagcagagg

SEQ ID NO: 5393617 - DNA, 20 bp, Homo sapiens
cccgcttttgcagcagagga

SEQ ID NO: 5393618 - DNA, 20 bp, Homo sapiens
cccgcttttgttcttcccca

SEQ ID NO: 5393619 - DNA, 16 bp, Homo sapiens
cccggaaagactgaaa

SEQ ID NO: 5393620 - DNA, 14 bp, Homo sapiens
cccggaacaagcct

SEQ ID NO: 5393621 - DNA, 19 bp, Homo sapiens
cccggaagggctttggttc

SEQ ID NO: 5393622 - DNA, 14 bp, Homo sapiens
cccggacagggtgg

SEQ ID NO: 5393623 - DNA, 19 bp, Homo sapiens
cccggacaggtggggcctc

SEQ ID NO: 5393624 - DNA, 20 bp, Homo sapiens
cccggacaggtggggcctca

SEQ ID NO: 5393625 - DNA, 20 bp, Homo sapiens
cccggacatactctctgcct

SEQ ID NO: 5393626 - DNA, 15 bp, Homo sapiens
cccggacctacctcc

SEQ ID NO: 5393627 - DNA, 19 bp, Homo sapiens
cccggacgcatgcagggcc

SEQ ID NO: 5393628 - DNA, 20 bp, Homo sapiens
cccggacgcccaggacccca

SEQ ID NO: 5393629 - DNA, 17 bp, Homo sapiens
cccggacgggggagctt

SEQ ID NO: 5393630 - DNA, 21 bp, Homo sapiens
cccggactcaccaacttgcca

SEQ ID NO: 5393631 - DNA, 14 bp, Homo sapiens
cccggactgaccaa

SEQ ID NO: 5393632 - DNA, 23 bp, Homo sapiens
cccggactgaccgaagggacggg

SEQ ID NO: 5393633 - DNA, 19 bp, Homo sapiens
cccggagaaggccgctgcc

SEQ ID NO: 5393634 - DNA, 20 bp, Homo sapiens
cccggagaaggccgctgccc

SEQ ID NO: 5393635 - DNA, 18 bp, Homo sapiens
cccggagagggagtcagt

SEQ ID NO: 5393636 - DNA, 17 bp, Homo sapiens
cccggagcacagccctg

SEQ ID NO: 5393637 - DNA, 21 bp, Homo sapiens
cccggagcacagccctgggag

SEQ ID NO: 5393638 - DNA, 13 bp, Homo sapiens
cccggagcagcag

SEQ ID NO: 5393639 - DNA, 19 bp, Homo sapiens
cccggagccatcaccctca

SEQ ID NO: 5393640 - DNA, 17 bp, Homo sapiens
cccggagcgcacctgct

SEQ ID NO: 5393641 - DNA, 22 bp, Homo sapiens
cccggagctaagtcacccagag

SEQ ID NO: 5393642 - DNA, 11 bp, Homo sapiens
cccggagctcc

SEQ ID NO: 5393643 - DNA, 22 bp, Homo sapiens
cccggagctgcccctctctggg

SEQ ID NO: 5393644 - DNA, 11 bp, Homo sapiens
cccggagctgg

SEQ ID NO: 5393645 - DNA, 14 bp, Homo sapiens
cccggaggaaatct

SEQ ID NO: 5393646 - DNA, 15 bp, Homo sapiens
cccggaggcgcccac

SEQ ID NO: 5393647 - DNA, 17 bp, Homo sapiens
cccggaggcgcccacct

SEQ ID NO: 5393648 - DNA, 20 bp, Homo sapiens
cccggaggcgcccacctgcc

SEQ ID NO: 5393649 - DNA, 21 bp, Homo sapiens
cccggaggcgcccacctgccc

SEQ ID NO: 5393650 - DNA, 18 bp, Homo sapiens
cccggaggcgtggaggag

SEQ ID NO: 5393651 - DNA, 20 bp, Homo sapiens
cccggagggaaactgtgaat

SEQ ID NO: 5393652 - DNA, 17 bp, Homo sapiens
cccggaggggcctggca

SEQ ID NO: 5393653 - DNA, 19 bp, Homo sapiens
cccggagtaatcaggcagc

SEQ ID NO: 5393654 - DNA, 21 bp, Homo sapiens
cccggagtaatcaggcagcct

SEQ ID NO: 5393655 - DNA, 22 bp, Homo sapiens
cccggatagaggacacggaccc

SEQ ID NO: 5393656 - DNA, 16 bp, Homo sapiens
cccggatcagagcagg

SEQ ID NO: 5393657 - DNA, 14 bp, Homo sapiens
cccggatctccagg

SEQ ID NO: 5393658 - DNA, 20 bp, Homo sapiens
cccggatctccaggcccagc

SEQ ID NO: 5393659 - DNA, 16 bp, Homo sapiens
cccggatgcccacccc

SEQ ID NO: 5393660 - DNA, 13 bp, Homo sapiens
cccggatgctgct

SEQ ID NO: 5393661 - DNA, 15 bp, Homo sapiens
cccggatgctgcttc

SEQ ID NO: 5393662 - DNA, 15 bp, Homo sapiens
cccggattggccctg

SEQ ID NO: 5393663 - DNA, 21 bp, Homo sapiens
cccggattggccctgcccctc

SEQ ID NO: 5393664 - DNA, 19 bp, Homo sapiens
cccggcaagcgcttctgct

SEQ ID NO: 5393665 - DNA, 21 bp, Homo sapiens
cccggcaagcgcttctgctga

SEQ ID NO: 5393666 - DNA, 22 bp, Homo sapiens
cccggcacagatgctccaggga

SEQ ID NO: 5393667 - DNA, 18 bp, Homo sapiens
cccggcaccccctgcagc

SEQ ID NO: 5393668 - DNA, 19 bp, Homo sapiens
cccggcacctcccttgggc

SEQ ID NO: 5393669 - DNA, 12 bp, Homo sapiens
cccggcagcccc

SEQ ID NO: 5393670 - DNA, 18 bp, Homo sapiens
cccggcagccccttctgg

SEQ ID NO: 5393671 - DNA, 21 bp, Homo sapiens
cccggcaggcctgagaatgag

SEQ ID NO: 5393672 - DNA, 14 bp, Homo sapiens
cccggcagggcggg

SEQ ID NO: 5393673 - DNA, 19 bp, Homo sapiens
cccggcatcatttcccctc

SEQ ID NO: 5393674 - DNA, 17 bp, Homo sapiens
cccggcatcctgaaagc

SEQ ID NO: 5393675 - DNA, 21 bp, Homo sapiens
cccggcatcctgaaagccagc

SEQ ID NO: 5393676 - DNA, 20 bp, Homo sapiens
cccggcatgagactcagtgc

SEQ ID NO: 5393677 - DNA, 21 bp, Homo sapiens
cccggcatgccgagtgcccca

SEQ ID NO: 5393678 - DNA, 17 bp, Homo sapiens
cccggcatgggaaagcc

SEQ ID NO: 5393679 - DNA, 16 bp, Homo sapiens
cccggccaaggacact

SEQ ID NO: 5393680 - DNA, 20 bp, Homo sapiens
cccggccaaggacccaggcg

SEQ ID NO: 5393681 - DNA, 21 bp, Homo sapiens
cccggccaagtaaaatgtttt

SEQ ID NO: 5393682 - DNA, 15 bp, Homo sapiens
cccggccacacccag

SEQ ID NO: 5393683 - DNA, 14 bp, Homo sapiens
cccggccacagctg

SEQ ID NO: 5393684 - DNA, 14 bp, Homo sapiens
cccggccacatgcc

SEQ ID NO: 5393685 - DNA, 15 bp, Homo sapiens
cccggccacatgccg

SEQ ID NO: 5393686 - DNA, 13 bp, Homo sapiens
cccggccacctct

SEQ ID NO: 5393687 - DNA, 21 bp, Homo sapiens
cccggccacctctgcggaccc

SEQ ID NO: 5393688 - DNA, 13 bp, Homo sapiens
cccggccactctg

SEQ ID NO: 5393689 - DNA, 14 bp, Homo sapiens
cccggccactctgt

SEQ ID NO: 5393690 - DNA, 15 bp, Homo sapiens
cccggccactctgtt

SEQ ID NO: 5393691 - DNA, 14 bp, Homo sapiens
cccggccagcgggc

SEQ ID NO: 5393692 - DNA, 21 bp, Homo sapiens
cccggccagcgggcacagggc

SEQ ID NO: 5393693 - DNA, 15 bp, Homo sapiens
cccggccagggcctg

SEQ ID NO: 5393694 - DNA, 18 bp, Homo sapiens
cccggccagggcctggtg

SEQ ID NO: 5393695 - DNA, 14 bp, Homo sapiens
cccggcccagagac

SEQ ID NO: 5393696 - DNA, 12 bp, Homo sapiens
cccggcccagga

SEQ ID NO: 5393697 - DNA, 14 bp, Homo sapiens
cccggcccaggagc

SEQ ID NO: 5393698 - DNA, 15 bp, Homo sapiens
cccggcccaggagcg

SEQ ID NO: 5393699 - DNA, 13 bp, Homo sapiens
cccggcccagtgc

SEQ ID NO: 5393700 - DNA, 16 bp, Homo sapiens
cccggccccagccaga

SEQ ID NO: 5393701 - DNA, 19 bp, Homo sapiens
cccggccccatcagaggct

SEQ ID NO: 5393702 - DNA, 21 bp, Homo sapiens
cccggccccccgcgctcgccc

SEQ ID NO: 5393703 - DNA, 19 bp, Homo sapiens
cccggcccccctctcgggc

SEQ ID NO: 5393704 - DNA, 19 bp, Homo sapiens
cccggcccccgcccagccc

SEQ ID NO: 5393705 - DNA, 20 bp, Homo sapiens
cccggcccccgccctctgcc

SEQ ID NO: 5393706 - DNA, 15 bp, Homo sapiens
cccggcccccggcca

SEQ ID NO: 5393707 - DNA, 12 bp, Homo sapiens
cccggcccctca

SEQ ID NO: 5393708 - DNA, 15 bp, Homo sapiens
cccggcccctcaccc

SEQ ID NO: 5393709 - DNA, 12 bp, Homo sapiens
cccggccctcac

SEQ ID NO: 5393710 - DNA, 13 bp, Homo sapiens
cccggccctcact

SEQ ID NO: 5393711 - DNA, 17 bp, Homo sapiens
cccggccctcccccagc

SEQ ID NO: 5393712 - DNA, 22 bp, Homo sapiens
cccggccctgggctcggaggct

SEQ ID NO: 5393713 - DNA, 22 bp, Homo sapiens
cccggccggagaacatctgcct

SEQ ID NO: 5393714 - DNA, 19 bp, Homo sapiens
cccggcctaggcacctccc

SEQ ID NO: 5393715 - DNA, 22 bp, Homo sapiens
cccggcctattgcttgggtctc

SEQ ID NO: 5393716 - DNA, 23 bp, Homo sapiens
cccggcctattgcttgggtctct

SEQ ID NO: 5393717 - DNA, 17 bp, Homo sapiens
cccggcctccaggctgg

SEQ ID NO: 5393718 - DNA, 18 bp, Homo sapiens
cccggcctccaggctggg

SEQ ID NO: 5393719 - DNA, 20 bp, Homo sapiens
cccggcctccaggctggggc

SEQ ID NO: 5393720 - DNA, 12 bp, Homo sapiens
cccggcctccta

SEQ ID NO: 5393721 - DNA, 22 bp, Homo sapiens
cccggcctcctagcctctccgc

SEQ ID NO: 5393722 - DNA, 22 bp, Homo sapiens
cccggcctcctcggagagcagc

SEQ ID NO: 5393723 - DNA, 19 bp, Homo sapiens
cccggcctctctgccccac

SEQ ID NO: 5393724 - DNA, 14 bp, Homo sapiens
cccggcctcttcca

SEQ ID NO: 5393725 - DNA, 17 bp, Homo sapiens
cccggcctgctcccagc

SEQ ID NO: 5393726 - DNA, 18 bp, Homo sapiens
cccggcctgctcccagca

SEQ ID NO: 5393727 - DNA, 15 bp, Homo sapiens
cccggcctggatgcc

SEQ ID NO: 5393728 - DNA, 14 bp, Homo sapiens
cccggcctggcccc

SEQ ID NO: 5393729 - DNA, 14 bp, Homo sapiens
cccggcgcctgccc

SEQ ID NO: 5393730 - DNA, 21 bp, Homo sapiens
cccggcgcctgccctgcccaa

SEQ ID NO: 5393731 - DNA, 14 bp, Homo sapiens
cccggcgcggtggc

SEQ ID NO: 5393732 - DNA, 15 bp, Homo sapiens
cccggcgctgagtgg

SEQ ID NO: 5393733 - DNA, 22 bp, Homo sapiens
cccggcggaaagcctctgtccg

SEQ ID NO: 5393734 - DNA, 16 bp, Homo sapiens
cccggctaatgtttgt

SEQ ID NO: 5393735 - DNA, 18 bp, Homo sapiens
cccggctaatttttggat

SEQ ID NO: 5393736 - DNA, 13 bp, Homo sapiens
cccggctccaggc

SEQ ID NO: 5393737 - DNA, 20 bp, Homo sapiens
cccggctccccctgccagca

SEQ ID NO: 5393738 - DNA, 15 bp, Homo sapiens
cccggctcctggtca

SEQ ID NO: 5393739 - DNA, 22 bp, Homo sapiens
cccggctcgagcagtcctgcct

SEQ ID NO: 5393740 - DNA, 17 bp, Homo sapiens
cccggctcggcccagca

SEQ ID NO: 5393741 - DNA, 20 bp, Homo sapiens
cccggctcggcctcttgaga

SEQ ID NO: 5393742 - DNA, 18 bp, Homo sapiens
cccggctcgttcccccag

SEQ ID NO: 5393743 - DNA, 20 bp, Homo sapiens
cccggctctacgggggccgc

SEQ ID NO: 5393744 - DNA, 22 bp, Homo sapiens
cccggctctgtgggtgatgggg

SEQ ID NO: 5393745 - DNA, 16 bp, Homo sapiens
cccggctgagccctgc

SEQ ID NO: 5393746 - DNA, 17 bp, Homo sapiens
cccggctgagccctgcc

SEQ ID NO: 5393747 - DNA, 22 bp, Homo sapiens
cccggctgagggtgggaggcaa

SEQ ID NO: 5393748 - DNA, 21 bp, Homo sapiens
cccggctgcagaggccagagg

SEQ ID NO: 5393749 - DNA, 12 bp, Homo sapiens
cccggctgccct

SEQ ID NO: 5393750 - DNA, 23 bp, Homo sapiens
cccggctgcttggcagttgcagt

SEQ ID NO: 5393751 - DNA, 15 bp, Homo sapiens
cccggctgggcctcc

SEQ ID NO: 5393752 - DNA, 21 bp, Homo sapiens
cccggctgggtcggccctgcc

SEQ ID NO: 5393753 - DNA, 17 bp, Homo sapiens
cccggctggttttgtaa

SEQ ID NO: 5393754 - DNA, 23 bp, Homo sapiens
cccggctgtgattgctgccaggc

SEQ ID NO: 5393755 - DNA, 13 bp, Homo sapiens
cccggcttgcctg

SEQ ID NO: 5393756 - DNA, 16 bp, Homo sapiens
cccggctttcctccgg

SEQ ID NO: 5393757 - DNA, 18 bp, Homo sapiens
cccggctttcctccggag

SEQ ID NO: 5393758 - DNA, 22 bp, Homo sapiens
cccgggaacctccccagcctgc

SEQ ID NO: 5393759 - DNA, 23 bp, Homo sapiens
cccgggaacctccccagcctgcg

SEQ ID NO: 5393760 - DNA, 13 bp, Homo sapiens
cccgggaaggaag

SEQ ID NO: 5393761 - DNA, 19 bp, Homo sapiens
cccgggaaggaaggctctc

SEQ ID NO: 5393762 - DNA, 12 bp, Homo sapiens
cccgggaagggg

SEQ ID NO: 5393763 - DNA, 19 bp, Homo sapiens
cccgggacccacggagccc

SEQ ID NO: 5393764 - DNA, 22 bp, Homo sapiens
cccgggacccccggcctccagg

SEQ ID NO: 5393765 - DNA, 24 bp, Homo sapiens
cccgggactcactggcagccccag

SEQ ID NO: 5393766 - DNA, 14 bp, Homo sapiens
cccgggagctgggc

SEQ ID NO: 5393767 - DNA, 19 bp, Homo sapiens
cccgggagctgggccctgc

SEQ ID NO: 5393768 - DNA, 20 bp, Homo sapiens
cccgggaggaacgtggttca

SEQ ID NO: 5393769 - DNA, 23 bp, Homo sapiens
cccgggagggcggcacaggtcgg

SEQ ID NO: 5393770 - DNA, 15 bp, Homo sapiens
cccgggaggggcccg

SEQ ID NO: 5393771 - DNA, 19 bp, Homo sapiens
cccgggaggtggagcttgc

SEQ ID NO: 5393772 - DNA, 18 bp, Homo sapiens
cccgggataaactgagcc

SEQ ID NO: 5393773 - DNA, 14 bp, Homo sapiens
cccgggatattata

SEQ ID NO: 5393774 - DNA, 21 bp, Homo sapiens
cccgggcaagacttttctttg

SEQ ID NO: 5393775 - DNA, 14 bp, Homo sapiens
cccgggcagcagag

SEQ ID NO: 5393776 - DNA, 12 bp, Homo sapiens
cccgggcagggc

SEQ ID NO: 5393777 - DNA, 12 bp, Homo sapiens
cccgggcccaga

SEQ ID NO: 5393778 - DNA, 16 bp, Homo sapiens
cccgttccctggcgtg

SEQ ID NO: 5393779 - DNA, 16 bp, Homo sapiens
cccgttccctgtcaga

SEQ ID NO: 5393780 - DNA, 20 bp, Homo sapiens
cccgttccctgtcagaggct

SEQ ID NO: 5393781 - DNA, 19 bp, Homo sapiens
cccgttctgctggcctgga

SEQ ID NO: 5393782 - DNA, 21 bp, Homo sapiens
cccgttgcttcccgctgcaca

SEQ ID NO: 5393783 - DNA, 15 bp, Homo sapiens
cccgttgtattcacc

SEQ ID NO: 5393784 - DNA, 22 bp, Homo sapiens
cccgttgtctccctggccctca

SEQ ID NO: 5393785 - DNA, 15 bp, Homo sapiens
cccgttgtgcctggt

SEQ ID NO: 5393786 - DNA, 16 bp, Homo sapiens
cccgttgttgtccctg

SEQ ID NO: 5393787 - DNA, 23 bp, Homo sapiens
cccgtttcagaaggaccaattga

SEQ ID NO: 5393788 - DNA, 17 bp, Homo sapiens
cccgtttccaagcctgg

SEQ ID NO: 5393789 - DNA, 22 bp, Homo sapiens
cccgtttcccggttcaggacca

SEQ ID NO: 5393790 - DNA, 14 bp, Homo sapiens
cccgtttccctcca

SEQ ID NO: 5393791 - DNA, 15 bp, Homo sapiens
cccgtttccctccag

SEQ ID NO: 5393792 - DNA, 14 bp, Homo sapiens
cccgtttctggtgg

SEQ ID NO: 5393793 - DNA, 16 bp, Homo sapiens
cccgttttccccatga

SEQ ID NO: 5393794 - DNA, 14 bp, Homo sapiens
ccctaaaagcacac

SEQ ID NO: 5393795 - DNA, 12 bp, Homo sapiens
ccctaaaataaa

SEQ ID NO: 5393796 - DNA, 14 bp, Homo sapiens
ccctaaaataaaaa

SEQ ID NO: 5393797 - DNA, 13 bp, Homo sapiens
ccctaaacatggc

SEQ ID NO: 5393798 - DNA, 19 bp, Homo sapiens
ccctaaagaagataaacac

SEQ ID NO: 5393799 - DNA, 17 bp, Homo sapiens
ccctaaagagcatcctg

SEQ ID NO: 5393800 - DNA, 22 bp, Homo sapiens
ccctaaagcagtaaaataaaaa

SEQ ID NO: 5393801 - DNA, 14 bp, Homo sapiens
ccctaaagccctct

SEQ ID NO: 5393802 - DNA, 22 bp, Homo sapiens
ccctaaagtgtatttttttact

SEQ ID NO: 5393803 - DNA, 21 bp, Homo sapiens
ccctaacccccagtcctcact

SEQ ID NO: 5393804 - DNA, 17 bp, Homo sapiens
ccctaaccccttccaga

SEQ ID NO: 5393805 - DNA, 17 bp, Homo sapiens
ccctaacctcttttctg

SEQ ID NO: 5393806 - DNA, 17 bp, Homo sapiens
ccctaactcttgctcac

SEQ ID NO: 5393807 - DNA, 18 bp, Homo sapiens
ccctaactcttgctcact

SEQ ID NO: 5393808 - DNA, 17 bp, Homo sapiens
ccctaagaaaccccagg

SEQ ID NO: 5393809 - DNA, 18 bp, Homo sapiens
ccctaagaattcccagat

SEQ ID NO: 5393810 - DNA, 14 bp, Homo sapiens
ccctaagagagcac

SEQ ID NO: 5393811 - DNA, 18 bp, Homo sapiens
ccctaagcacaataaaag

SEQ ID NO: 5393812 - DNA, 16 bp, Homo sapiens
ccctaagcagaaagtg

SEQ ID NO: 5393813 - DNA, 20 bp, Homo sapiens
ccctaagcagaaagtgcctt

SEQ ID NO: 5393814 - DNA, 17 bp, Homo sapiens
ccctaagcccccagggc

SEQ ID NO: 5393815 - DNA, 21 bp, Homo sapiens
ccctaagccccgtcccctaac

SEQ ID NO: 5393816 - DNA, 20 bp, Homo sapiens
ccctaagcctgtccccagac

SEQ ID NO: 5393817 - DNA, 18 bp, Homo sapiens
ccctaaggcatgtgtgaa

SEQ ID NO: 5393818 - DNA, 22 bp, Homo sapiens
ccctaagggcagccctccatgg

SEQ ID NO: 5393819 - DNA, 20 bp, Homo sapiens
ccctaagtaagtttcttcct

SEQ ID NO: 5393820 - DNA, 17 bp, Homo sapiens
ccctaagtcacatatca

SEQ ID NO: 5393821 - DNA, 12 bp, Homo sapiens
ccctaagtgccc

SEQ ID NO: 5393822 - DNA, 14 bp, Homo sapiens
ccctaagtgcccaa

SEQ ID NO: 5393823 - DNA, 16 bp, Homo sapiens
ccctaagtgcccaaag

SEQ ID NO: 5393824 - DNA, 20 bp, Homo sapiens
ccctaagtgtggatgttcag

SEQ ID NO: 5393825 - DNA, 12 bp, Homo sapiens
ccctaataaagc

SEQ ID NO: 5393826 - DNA, 12 bp, Homo sapiens
ccctaatcttcc

SEQ ID NO: 5393827 - DNA, 21 bp, Homo sapiens
ccctaatgcgcaggctggccc

SEQ ID NO: 5393828 - DNA, 17 bp, Homo sapiens
ccctaatgttttgctta

SEQ ID NO: 5393829 - DNA, 14 bp, Homo sapiens
ccctaattcatctt

SEQ ID NO: 5393830 - DNA, 17 bp, Homo sapiens
ccctaattcatctttta

SEQ ID NO: 5393831 - DNA, 13 bp, Homo sapiens
ccctaattctctt

SEQ ID NO: 5393832 - DNA, 21 bp, Homo sapiens
ccctaattcttattttataat

SEQ ID NO: 5393833 - DNA, 22 bp, Homo sapiens
ccctaattcttattttataatt

SEQ ID NO: 5393834 - DNA, 14 bp, Homo sapiens
ccctaattttccag

SEQ ID NO: 5393835 - DNA, 14 bp, Homo sapiens
ccctaattttgtac

SEQ ID NO: 5393836 - DNA, 15 bp, Homo sapiens
ccctacaactccagc

SEQ ID NO: 5393837 - DNA, 20 bp, Homo sapiens
ccctacacacacactccctg

SEQ ID NO: 5393838 - DNA, 18 bp, Homo sapiens
ccctacacacacccaggc

SEQ ID NO: 5393839 - DNA, 17 bp, Homo sapiens
ccctacacccagacccc

SEQ ID NO: 5393840 - DNA, 13 bp, Homo sapiens
ccctacagacagc

SEQ ID NO: 5393841 - DNA, 13 bp, Homo sapiens
ccctacagagctg

SEQ ID NO: 5393842 - DNA, 12 bp, Homo sapiens
ccctacagcaga

SEQ ID NO: 5393843 - DNA, 13 bp, Homo sapiens
ccctacagcattg

SEQ ID NO: 5393844 - DNA, 13 bp, Homo sapiens
ccctacagccctg

SEQ ID NO: 5393845 - DNA, 15 bp, Homo sapiens
ccctacagcctaggg

SEQ ID NO: 5393846 - DNA, 13 bp, Homo sapiens
ccctacagcctgc

SEQ ID NO: 5393847 - DNA, 16 bp, Homo sapiens
ccctacagcctgcaca

SEQ ID NO: 5393848 - DNA, 15 bp, Homo sapiens
ccctacagtatataa

SEQ ID NO: 5393849 - DNA, 13 bp, Homo sapiens
ccctacatcttca

SEQ ID NO: 5393850 - DNA, 16 bp, Homo sapiens
ccctacattccccaga

SEQ ID NO: 5393851 - DNA, 19 bp, Homo sapiens
ccctacattccccagagtg

SEQ ID NO: 5393852 - DNA, 20 bp, Homo sapiens
ccctaccacacatctgtgga

SEQ ID NO: 5393853 - DNA, 16 bp, Homo sapiens
ccctaccactgagccc

SEQ ID NO: 5393854 - DNA, 20 bp, Homo sapiens
ccctaccactgagcccttgc

SEQ ID NO: 5393855 - DNA, 13 bp, Homo sapiens
ccctaccactgtg

SEQ ID NO: 5393856 - DNA, 17 bp, Homo sapiens
ccctaccagctcctcca

SEQ ID NO: 5393857 - DNA, 21 bp, Homo sapiens
ccctaccagctcctccagccc

SEQ ID NO: 5393858 - DNA, 16 bp, Homo sapiens
ccctacccaatgtctc

SEQ ID NO: 5393859 - DNA, 15 bp, Homo sapiens
ccctacccacagggc

SEQ ID NO: 5393860 - DNA, 14 bp, Homo sapiens
ccctacccaccgat

SEQ ID NO: 5393861 - DNA, 13 bp, Homo sapiens
ccctacccactct

SEQ ID NO: 5393862 - DNA, 19 bp, Homo sapiens
ccctaccccacaccaggcc

SEQ ID NO: 5393863 - DNA, 23 bp, Homo sapiens
ccctaccccagggccctggccag

SEQ ID NO: 5393864 - DNA, 14 bp, Homo sapiens
ccctaccccatgct

SEQ ID NO: 5393865 - DNA, 18 bp, Homo sapiens
ccctacccccaaccctca

SEQ ID NO: 5393866 - DNA, 22 bp, Homo sapiens
ccctacccccttgtctgctgct

SEQ ID NO: 5393867 - DNA, 13 bp, Homo sapiens
ccctacccccttt

SEQ ID NO: 5393868 - DNA, 15 bp, Homo sapiens
ccctacccctgccct

SEQ ID NO: 5393869 - DNA, 13 bp, Homo sapiens
ccctacccggctc

SEQ ID NO: 5393870 - DNA, 17 bp, Homo sapiens
ccctaccctacccccac

SEQ ID NO: 5393871 - DNA, 18 bp, Homo sapiens
ccctaccctcctgctgag

SEQ ID NO: 5393872 - DNA, 11 bp, Homo sapiens
ccctaccctct

SEQ ID NO: 5393873 - DNA, 14 bp, Homo sapiens
ccctaccctctaga

SEQ ID NO: 5393874 - DNA, 15 bp, Homo sapiens
ccctaccctctagag

SEQ ID NO: 5393875 - DNA, 14 bp, Homo sapiens
ccctaccctcttct

SEQ ID NO: 5393876 - DNA, 14 bp, Homo sapiens
ccctaccctggact

SEQ ID NO: 5393877 - DNA, 14 bp, Homo sapiens
ccctacccttcctg

SEQ ID NO: 5393878 - DNA, 20 bp, Homo sapiens
ccctaccgcatggcagctgg

SEQ ID NO: 5393879 - DNA, 22 bp, Homo sapiens
ccctacctcaacctgtaaatta

SEQ ID NO: 5393880 - DNA, 14 bp, Homo sapiens
ccctacctgcttca

SEQ ID NO: 5393881 - DNA, 12 bp, Homo sapiens
ccctacctgggg

SEQ ID NO: 5393882 - DNA, 21 bp, Homo sapiens
ccctacctggggaaagcctga

SEQ ID NO: 5393883 - DNA, 13 bp, Homo sapiens
ccctaccttcccc

SEQ ID NO: 5393884 - DNA, 22 bp, Homo sapiens
ccctaccttgagaccctcttct

SEQ ID NO: 5393885 - DNA, 16 bp, Homo sapiens
ccctaccttgcctcct

SEQ ID NO: 5393886 - DNA, 19 bp, Homo sapiens
ccctacgctcatctctgga

SEQ ID NO: 5393887 - DNA, 16 bp, Homo sapiens
ccctactaacatccca

SEQ ID NO: 5393888 - DNA, 17 bp, Homo sapiens
ccctactaacatcccaa

SEQ ID NO: 5393889 - DNA, 19 bp, Homo sapiens
ccctactccctgcagatgc

SEQ ID NO: 5393890 - DNA, 13 bp, Homo sapiens
ccctactcctgcg

SEQ ID NO: 5393891 - DNA, 23 bp, Homo sapiens
ccctactcggatggggcacggac

SEQ ID NO: 5393892 - DNA, 19 bp, Homo sapiens
ccctacttcattttcagag

SEQ ID NO: 5393893 - DNA, 19 bp, Homo sapiens
ccctacttcttttgctctt

SEQ ID NO: 5393894 - DNA, 22 bp, Homo sapiens
ccctacttgataatattagtga

SEQ ID NO: 5393895 - DNA, 19 bp, Homo sapiens
ccctagaaacccaagctcc

SEQ ID NO: 5393896 - DNA, 14 bp, Homo sapiens
ccctagaaagccat

SEQ ID NO: 5393897 - DNA, 22 bp, Homo sapiens
ccctagaaagccatattccagc

SEQ ID NO: 5393898 - DNA, 13 bp, Homo sapiens
ccctagaagagca

SEQ ID NO: 5393899 - DNA, 14 bp, Homo sapiens
ccctagaagagcac

SEQ ID NO: 5393900 - DNA, 19 bp, Homo sapiens
ccctagaataatctcatcc

SEQ ID NO: 5393901 - DNA, 22 bp, Homo sapiens
ccctagaataatctcatccccc

SEQ ID NO: 5393902 - DNA, 19 bp, Homo sapiens
ccctagacctccccctcac

SEQ ID NO: 5393903 - DNA, 15 bp, Homo sapiens
ccctagactctgtaa

SEQ ID NO: 5393904 - DNA, 13 bp, Homo sapiens
ccctagagactca

SEQ ID NO: 5393905 - DNA, 14 bp, Homo sapiens
ccctagagagaata

SEQ ID NO: 5393906 - DNA, 15 bp, Homo sapiens
ccctagagagaataa

SEQ ID NO: 5393907 - DNA, 18 bp, Homo sapiens
ccctagagagaataaatt

SEQ ID NO: 5393908 - DNA, 19 bp, Homo sapiens
ccctagaggcgagccaggc

SEQ ID NO: 5393909 - DNA, 18 bp, Homo sapiens
ccctagatagtttattat

SEQ ID NO: 5393910 - DNA, 13 bp, Homo sapiens
ccctagatccagg

SEQ ID NO: 5393911 - DNA, 23 bp, Homo sapiens
ccctagatggttccctttgttgc

SEQ ID NO: 5393912 - DNA, 14 bp, Homo sapiens
ccctagcaaaactc

SEQ ID NO: 5393913 - DNA, 19 bp, Homo sapiens
ccctagcaatacagggagg

SEQ ID NO: 5393914 - DNA, 14 bp, Homo sapiens
ccctagcagagcgt

SEQ ID NO: 5393915 - DNA, 20 bp, Homo sapiens
ccctagcagcccaccctgct

SEQ ID NO: 5393916 - DNA, 14 bp, Homo sapiens
ccctagcaggaact

SEQ ID NO: 5393917 - DNA, 17 bp, Homo sapiens
ccctagcagtttgcctc

SEQ ID NO: 5393918 - DNA, 22 bp, Homo sapiens
ccctagcagtttgcctctgcac

SEQ ID NO: 5393919 - DNA, 20 bp, Homo sapiens
ccctagccaatgtctcctcc

SEQ ID NO: 5393920 - DNA, 13 bp, Homo sapiens
ccctagcccagga

SEQ ID NO: 5393921 - DNA, 13 bp, Homo sapiens
ccctagccctggt

SEQ ID NO: 5393922 - DNA, 12 bp, Homo sapiens
ccctagcccttc

SEQ ID NO: 5393923 - DNA, 14 bp, Homo sapiens
ccctagcccttcca

SEQ ID NO: 5393924 - DNA, 15 bp, Homo sapiens
ccctagcccttccag

SEQ ID NO: 5393925 - DNA, 22 bp, Homo sapiens
ccctagcccttccagcctggga

SEQ ID NO: 5393926 - DNA, 17 bp, Homo sapiens
ccctagccggttcctgt

SEQ ID NO: 5393927 - DNA, 18 bp, Homo sapiens
ccctagccggttcctgtc

SEQ ID NO: 5393928 - DNA, 14 bp, Homo sapiens
ccctagccttgctt

SEQ ID NO: 5393929 - DNA, 19 bp, Homo sapiens
ccctagcgctatctccctg

SEQ ID NO: 5393930 - DNA, 14 bp, Homo sapiens
ccctagctcacact

SEQ ID NO: 5393931 - DNA, 15 bp, Homo sapiens
ccctagctcacactc

SEQ ID NO: 5393932 - DNA, 20 bp, Homo sapiens
ccctagctcacactcatcca

SEQ ID NO: 5393933 - DNA, 17 bp, Homo sapiens
ccctagctcaccaggcc

SEQ ID NO: 5393934 - DNA, 13 bp, Homo sapiens
ccctagctgaccc

SEQ ID NO: 5393935 - DNA, 21 bp, Homo sapiens
ccctagctttacgctcatcac

SEQ ID NO: 5393936 - DNA, 22 bp, Homo sapiens
ccctagctttatatatggacat

SEQ ID NO: 5393937 - DNA, 23 bp, Homo sapiens
ccctagctttatatatggacatg

SEQ ID NO: 5393938 - DNA, 22 bp, Homo sapiens
ccctaggactcaggcctgccaa

SEQ ID NO: 5393939 - DNA, 20 bp, Homo sapiens
ccctaggatgctgcagcaga

SEQ ID NO: 5393940 - DNA, 23 bp, Homo sapiens
ccctaggattccccctgccctgt

SEQ ID NO: 5393941 - DNA, 17 bp, Homo sapiens
ccctaggcacctctgtg

SEQ ID NO: 5393942 - DNA, 21 bp, Homo sapiens
ccctaggcatactctccagga

SEQ ID NO: 5393943 - DNA, 23 bp, Homo sapiens
ccctaggcctgagttagctgttt

SEQ ID NO: 5393944 - DNA, 15 bp, Homo sapiens
ccctagggaattcct

SEQ ID NO: 5393945 - DNA, 12 bp, Homo sapiens
ccctagggactg

SEQ ID NO: 5393946 - DNA, 16 bp, Homo sapiens
ccctagggactgtcct

SEQ ID NO: 5393947 - DNA, 22 bp, Homo sapiens
ccctaggtcagcttgctgccct

SEQ ID NO: 5393948 - DNA, 21 bp, Homo sapiens
ccctaggtctccacccctcaa

SEQ ID NO: 5393949 - DNA, 14 bp, Homo sapiens
ccctaggtgcccag

SEQ ID NO: 5393950 - DNA, 16 bp, Homo sapiens
ccctaggtgcccaggg

SEQ ID NO: 5393951 - DNA, 22 bp, Homo sapiens
ccctaggtgggtcaactccaag

SEQ ID NO: 5393952 - DNA, 12 bp, Homo sapiens
ccctaggtgttt

SEQ ID NO: 5393953 - DNA, 17 bp, Homo sapiens
ccctagtaagtgccttc

SEQ ID NO: 5393954 - DNA, 23 bp, Homo sapiens
ccctagtagctggcgcccatcct

SEQ ID NO: 5393955 - DNA, 16 bp, Homo sapiens
ccctagtatctggctg

SEQ ID NO: 5393956 - DNA, 14 bp, Homo sapiens
ccctagtatgaaag

SEQ ID NO: 5393957 - DNA, 11 bp, Homo sapiens
ccctcctgccc

SEQ ID NO: 5393958 - DNA, 15 bp, Homo sapiens
ccctcctgcccagga

SEQ ID NO: 5393959 - DNA, 18 bp, Homo sapiens
ccctcctgccccacactc

SEQ ID NO: 5393960 - DNA, 23 bp, Homo sapiens
ccctcctgcctgcgcagctcctt

SEQ ID NO: 5393961 - DNA, 13 bp, Homo sapiens
ccctcctgctcct

SEQ ID NO: 5393962 - DNA, 11 bp, Homo sapiens
ccctcctgctg

SEQ ID NO: 5393963 - DNA, 16 bp, Homo sapiens
ccctcctgctgagctg

SEQ ID NO: 5393964 - DNA, 17 bp, Homo sapiens
ccctcctgctgagctgc

SEQ ID NO: 5393965 - DNA, 12 bp, Homo sapiens
ccctcctgctgc

SEQ ID NO: 5393966 - DNA, 14 bp, Homo sapiens
ccctcctgctggct

SEQ ID NO: 5393967 - DNA, 13 bp, Homo sapiens
ccctcctgctgtg

SEQ ID NO: 5393968 - DNA, 17 bp, Homo sapiens
ccctcctggagcagaaa

SEQ ID NO: 5393969 - DNA, 20 bp, Homo sapiens
ccctcctggagctctgtggg

SEQ ID NO: 5393970 - DNA, 16 bp, Homo sapiens
ccctcctggctcacag

SEQ ID NO: 5393971 - DNA, 18 bp, Homo sapiens
ccctcctggctcacagcc

SEQ ID NO: 5393972 - DNA, 10 bp, Homo sapiens
ccctcctggg

SEQ ID NO: 5393973 - DNA, 12 bp, Homo sapiens
ccctcctgggaa

SEQ ID NO: 5393974 - DNA, 21 bp, Homo sapiens
ccctcctgggaaggccacctc

SEQ ID NO: 5393975 - DNA, 16 bp, Homo sapiens
ccctcctgggcacccc

SEQ ID NO: 5393976 - DNA, 17 bp, Homo sapiens
ccctcctgggcacccca

SEQ ID NO: 5393977 - DNA, 10 bp, Homo sapiens
ccctcctggt

SEQ ID NO: 5393978 - DNA, 11 bp, Homo sapiens
ccctcctggtc

SEQ ID NO: 5393979 - DNA, 14 bp, Homo sapiens
ccctcctggtcctg

SEQ ID NO: 5393980 - DNA, 17 bp, Homo sapiens
ccctcctggtgccacct

SEQ ID NO: 5393981 - DNA, 21 bp, Homo sapiens
ccctcctggtgtcaccccaga

SEQ ID NO: 5393982 - DNA, 23 bp, Homo sapiens
ccctcctggtgtcaccccagagc

SEQ ID NO: 5393983 - DNA, 13 bp, Homo sapiens
ccctcctgtaaga

SEQ ID NO: 5393984 - DNA, 12 bp, Homo sapiens
ccctcctgtgcc

SEQ ID NO: 5393985 - DNA, 19 bp, Homo sapiens
ccctcctgtgccccagctg

SEQ ID NO: 5393986 - DNA, 23 bp, Homo sapiens
ccctcctgtgccccagctgccag

SEQ ID NO: 5393987 - DNA, 21 bp, Homo sapiens
ccctcctgtgctcagccctga

SEQ ID NO: 5393988 - DNA, 22 bp, Homo sapiens
ccctcctgttgcacccagccct

SEQ ID NO: 5393989 - DNA, 17 bp, Homo sapiens
ccctcctgttgccacac

SEQ ID NO: 5393990 - DNA, 18 bp, Homo sapiens
ccctcctgttgccacact

SEQ ID NO: 5393991 - DNA, 12 bp, Homo sapiens
ccctccttccag

SEQ ID NO: 5393992 - DNA, 15 bp, Homo sapiens
ccctccttcccagct

SEQ ID NO: 5393993 - DNA, 17 bp, Homo sapiens
ccctccttcccagctgc

SEQ ID NO: 5393994 - DNA, 19 bp, Homo sapiens
ccctccttccccaccccat

SEQ ID NO: 5393995 - DNA, 14 bp, Homo sapiens
ccctccttccccag

SEQ ID NO: 5393996 - DNA, 16 bp, Homo sapiens
ccctccttccctcctg

SEQ ID NO: 5393997 - DNA, 13 bp, Homo sapiens
ccctccttccctg

SEQ ID NO: 5393998 - DNA, 14 bp, Homo sapiens
ccctccttcccttc

SEQ ID NO: 5393999 - DNA, 14 bp, Homo sapiens
ccctccttcctaaa

SEQ ID NO: 5394000 - DNA, 15 bp, Homo sapiens
ccctccttctcccct

SEQ ID NO: 5394001 - DNA, 21 bp, Homo sapiens
ccctccttctcccctgccggt

SEQ ID NO: 5394002 - DNA, 12 bp, Homo sapiens
ccctccttgcaa

SEQ ID NO: 5394003 - DNA, 21 bp, Homo sapiens
ccctccttgcaaccaggcagc

SEQ ID NO: 5394004 - DNA, 16 bp, Homo sapiens
ccctccttgccacccc

SEQ ID NO: 5394005 - DNA, 19 bp, Homo sapiens
ccctccttgccgctgggag

SEQ ID NO: 5394006 - DNA, 22 bp, Homo sapiens
ccctccttgccgctgggagagc

SEQ ID NO: 5394007 - DNA, 16 bp, Homo sapiens
ccctccttgggcactt

SEQ ID NO: 5394008 - DNA, 17 bp, Homo sapiens
ccctccttgggtcattg

SEQ ID NO: 5394009 - DNA, 14 bp, Homo sapiens
ccctcctttcacca

SEQ ID NO: 5394010 - DNA, 15 bp, Homo sapiens
ccctcctttccctta

SEQ ID NO: 5394011 - DNA, 22 bp, Homo sapiens
ccctcctttcccttattgcctc

SEQ ID NO: 5394012 - DNA, 13 bp, Homo sapiens
ccctcctttgtct

SEQ ID NO: 5394013 - DNA, 22 bp, Homo sapiens
ccctcgaaccaaggcagcctcc

SEQ ID NO: 5394014 - DNA, 15 bp, Homo sapiens
ccctcgaagcgcgcc

SEQ ID NO: 5394015 - DNA, 21 bp, Homo sapiens
ccctcgaagcgcgccactcgc

SEQ ID NO: 5394016 - DNA, 22 bp, Homo sapiens
ccctcgaagcgcgccactcgct

SEQ ID NO: 5394017 - DNA, 24 bp, Homo sapiens
ccctcgacagcgcccctgctgtct

SEQ ID NO: 5394018 - DNA, 16 bp, Homo sapiens
ccctcgactcagcacc

SEQ ID NO: 5394019 - DNA, 15 bp, Homo sapiens
ccctcgagagcctta

SEQ ID NO: 5394020 - DNA, 18 bp, Homo sapiens
ccctcgagagccttactt

SEQ ID NO: 5394021 - DNA, 14 bp, Homo sapiens
ccctcgagctctgt

SEQ ID NO: 5394022 - DNA, 21 bp, Homo sapiens
ccctcgagctctgtagcctgg

SEQ ID NO: 5394023 - DNA, 13 bp, Homo sapiens
ccctcgaggccta

SEQ ID NO: 5394024 - DNA, 20 bp, Homo sapiens
ccctcgaggcctacagagga

SEQ ID NO: 5394025 - DNA, 22 bp, Homo sapiens
ccctcgcacacagggctcacag

SEQ ID NO: 5394026 - DNA, 21 bp, Homo sapiens
ccctcgcagacctaagccctg

SEQ ID NO: 5394027 - DNA, 22 bp, Homo sapiens
ccctcgcagagcccttctcgtt

SEQ ID NO: 5394028 - DNA, 14 bp, Homo sapiens
ccctcgcagcaggt

SEQ ID NO: 5394029 - DNA, 15 bp, Homo sapiens
ccctcgcagcaggtg

SEQ ID NO: 5394030 - DNA, 16 bp, Homo sapiens
ccctcgcccagtccca

SEQ ID NO: 5394031 - DNA, 15 bp, Homo sapiens
ccctcgcccatcagt

SEQ ID NO: 5394032 - DNA, 14 bp, Homo sapiens
ccctcgccccagcc

SEQ ID NO: 5394033 - DNA, 15 bp, Homo sapiens
ccctcgccccagcct

SEQ ID NO: 5394034 - DNA, 13 bp, Homo sapiens
ccctcgccctgtc

SEQ ID NO: 5394035 - DNA, 14 bp, Homo sapiens
ccctcgccctgtcc

SEQ ID NO: 5394036 - DNA, 17 bp, Homo sapiens
ccctcgccctgtccctc

SEQ ID NO: 5394037 - DNA, 19 bp, Homo sapiens
ccctcgccgtccctcccag

SEQ ID NO: 5394038 - DNA, 16 bp, Homo sapiens
ccctcgcctcctcctc

SEQ ID NO: 5394039 - DNA, 23 bp, Homo sapiens
ccctcgcctgtggagctcagccc

SEQ ID NO: 5394040 - DNA, 17 bp, Homo sapiens
ccctcgcgcccctgtcc

SEQ ID NO: 5394041 - DNA, 22 bp, Homo sapiens
ccctcgctctctgtctccaggc

SEQ ID NO: 5394042 - DNA, 17 bp, Homo sapiens
ccctcgctgccacccac

SEQ ID NO: 5394043 - DNA, 17 bp, Homo sapiens
ccctcgctgctgctact

SEQ ID NO: 5394044 - DNA, 21 bp, Homo sapiens
ccctcgctgctgctactaccc

SEQ ID NO: 5394045 - DNA, 14 bp, Homo sapiens
ccctcgctgcttct

SEQ ID NO: 5394046 - DNA, 18 bp, Homo sapiens
ccctcgctggcccccact

SEQ ID NO: 5394047 - DNA, 19 bp, Homo sapiens
ccctcgctggcccccactg

SEQ ID NO: 5394048 - DNA, 15 bp, Homo sapiens
ccctcgctgtatgat

SEQ ID NO: 5394049 - DNA, 17 bp, Homo sapiens
ccctcgctgtcctgctg

SEQ ID NO: 5394050 - DNA, 16 bp, Homo sapiens
ccctcgcttcataggc

SEQ ID NO: 5394051 - DNA, 17 bp, Homo sapiens
ccctcggaagccgtctg

SEQ ID NO: 5394052 - DNA, 16 bp, Homo sapiens
ccctcggagcctgtgt

SEQ ID NO: 5394053 - DNA, 20 bp, Homo sapiens
ccctcggagctggctgtgcc

SEQ ID NO: 5394054 - DNA, 23 bp, Homo sapiens
ccctcggaggtccagctgggcct

SEQ ID NO: 5394055 - DNA, 19 bp, Homo sapiens
ccctcggagttcttcttga

SEQ ID NO: 5394056 - DNA, 20 bp, Homo sapiens
ccctcggcattcacacacag

SEQ ID NO: 5394057 - DNA, 19 bp, Homo sapiens
ccctcggcctccagactgc

SEQ ID NO: 5394058 - DNA, 15 bp, Homo sapiens
ccctcgggcccacct

SEQ ID NO: 5394059 - DNA, 18 bp, Homo sapiens
ccctcgggcccacctggc

SEQ ID NO: 5394060 - DNA, 19 bp, Homo sapiens
ccctcgggcccacctggcc

SEQ ID NO: 5394061 - DNA, 14 bp, Homo sapiens
ccctcgggcccagc

SEQ ID NO: 5394062 - DNA, 15 bp, Homo sapiens
ccctcgggcccagcc

SEQ ID NO: 5394063 - DNA, 19 bp, Homo sapiens
ccctcgggcccagccccca

SEQ ID NO: 5394064 - DNA, 17 bp, Homo sapiens
ccctcgggcgagtcact

SEQ ID NO: 5394065 - DNA, 23 bp, Homo sapiens
ccctcggggcaggaagtccctga

SEQ ID NO: 5394066 - DNA, 22 bp, Homo sapiens
ccctcgggtctccccacctgca

SEQ ID NO: 5394067 - DNA, 23 bp, Homo sapiens
ccctcggtcacctgtgctacctc

SEQ ID NO: 5394068 - DNA, 14 bp, Homo sapiens
ccctcggtggctgc

SEQ ID NO: 5394069 - DNA, 18 bp, Homo sapiens
ccctcgtccaccccccac

SEQ ID NO: 5394070 - DNA, 15 bp, Homo sapiens
ccctcgtcccatcca

SEQ ID NO: 5394071 - DNA, 17 bp, Homo sapiens
ccctcgtcccatccagc

SEQ ID NO: 5394072 - DNA, 21 bp, Homo sapiens
ccctcgtcctgtcccagaggt

SEQ ID NO: 5394073 - DNA, 17 bp, Homo sapiens
ccctcgtctccctggcc

SEQ ID NO: 5394074 - DNA, 18 bp, Homo sapiens
ccctcgtcttcagctgca

SEQ ID NO: 5394075 - DNA, 13 bp, Homo sapiens
ccctcgtctttcc

SEQ ID NO: 5394076 - DNA, 14 bp, Homo sapiens
ccctcgtctttccc

SEQ ID NO: 5394077 - DNA, 13 bp, Homo sapiens
ccctcgtgccagt

SEQ ID NO: 5394078 - DNA, 16 bp, Homo sapiens
ccctcgtggacacctg

SEQ ID NO: 5394079 - DNA, 17 bp, Homo sapiens
ccctcgtggacacctgc

SEQ ID NO: 5394080 - DNA, 22 bp, Homo sapiens
ccctcgtggacacctgccctgc

SEQ ID NO: 5394081 - DNA, 17 bp, Homo sapiens
ccctcgtggccagcccg

SEQ ID NO: 5394082 - DNA, 14 bp, Homo sapiens
ccctcgttagcctt

SEQ ID NO: 5394083 - DNA, 15 bp, Homo sapiens
ccctctaacccagtg

SEQ ID NO: 5394084 - DNA, 15 bp, Homo sapiens
ccctctactcttcct

SEQ ID NO: 5394085 - DNA, 18 bp, Homo sapiens
ccctctagaggctgcctg

SEQ ID NO: 5394086 - DNA, 13 bp, Homo sapiens
ccctctagggcag

SEQ ID NO: 5394087 - DNA, 16 bp, Homo sapiens
ccctctagggcagggt

SEQ ID NO: 5394088 - DNA, 14 bp, Homo sapiens
ccctctagtgcctt

SEQ ID NO: 5394089 - DNA, 23 bp, Homo sapiens
ccctctagttttttcttcctttt

SEQ ID NO: 5394090 - DNA, 15 bp, Homo sapiens
ccctctatgctggct

SEQ ID NO: 5394091 - DNA, 12 bp, Homo sapiens
ccctctatttat

SEQ ID NO: 5394092 - DNA, 18 bp, Homo sapiens
ccctctatttattagcca

SEQ ID NO: 5394093 - DNA, 17 bp, Homo sapiens
ccctctcaaccttgtaa

SEQ ID NO: 5394094 - DNA, 13 bp, Homo sapiens
ccctctcacccag

SEQ ID NO: 5394095 - DNA, 12 bp, Homo sapiens
ccctctcacgcc

SEQ ID NO: 5394096 - DNA, 15 bp, Homo sapiens
ccctctcactccagc

SEQ ID NO: 5394097 - DNA, 16 bp, Homo sapiens
ccctctcactccagcc

SEQ ID NO: 5394098 - DNA, 16 bp, Homo sapiens
ccctctcactccccag

SEQ ID NO: 5394099 - DNA, 21 bp, Homo sapiens
ccctctcactccccagcccca

SEQ ID NO: 5394100 - DNA, 14 bp, Homo sapiens
ccctctcagaacat

SEQ ID NO: 5394101 - DNA, 21 bp, Homo sapiens
ccctctcagagctacttgggc

SEQ ID NO: 5394102 - DNA, 19 bp, Homo sapiens
ccctctcagaggcctgctg

SEQ ID NO: 5394103 - DNA, 20 bp, Homo sapiens
ccctctcagaggcctgctgc

SEQ ID NO: 5394104 - DNA, 13 bp, Homo sapiens
ccctctcagatca

SEQ ID NO: 5394105 - DNA, 12 bp, Homo sapiens
ccctctcagccc

SEQ ID NO: 5394106 - DNA, 15 bp, Homo sapiens
ccctctcagccctca

SEQ ID NO: 5394107 - DNA, 17 bp, Homo sapiens
ccctctcagctccaggt

SEQ ID NO: 5394108 - DNA, 14 bp, Homo sapiens
ccctctcaggagag

SEQ ID NO: 5394109 - DNA, 11 bp, Homo sapiens
ccctctcaggc

SEQ ID NO: 5394110 - DNA, 14 bp, Homo sapiens
ccctctcaggctgt

SEQ ID NO: 5394111 - DNA, 13 bp, Homo sapiens
ccctctcatcccc

SEQ ID NO: 5394112 - DNA, 22 bp, Homo sapiens
ccctctcatgtccctccaggga

SEQ ID NO: 5394113 - DNA, 14 bp, Homo sapiens
ccctctccacaccc

SEQ ID NO: 5394114 - DNA, 19 bp, Homo sapiens
ccctctccacacccagcct

SEQ ID NO: 5394115 - DNA, 20 bp, Homo sapiens
ccctctccacacccagcctg

SEQ ID NO: 5394116 - DNA, 21 bp, Homo sapiens
ccctctccacacccagcctgt

SEQ ID NO: 5394117 - DNA, 12 bp, Homo sapiens
ccctctccaccc

SEQ ID NO: 5394118 - DNA, 12 bp, Homo sapiens
ccctctccactc

SEQ ID NO: 5394119 - DNA, 13 bp, Homo sapiens
ccctctccactct

SEQ ID NO: 5394120 - DNA, 22 bp, Homo sapiens
ccctctccactcttctctcctt

SEQ ID NO: 5394121 - DNA, 13 bp, Homo sapiens
ccctctccaggcc

SEQ ID NO: 5394122 - DNA, 15 bp, Homo sapiens
ccctctccaggcctg

SEQ ID NO: 5394123 - DNA, 18 bp, Homo sapiens
ccctctccaggcctgtca

SEQ ID NO: 5394124 - DNA, 20 bp, Homo sapiens
ccctctccatctcccaaggc

SEQ ID NO: 5394125 - DNA, 12 bp, Homo sapiens
ccctctcccacc

SEQ ID NO: 5394126 - DNA, 15 bp, Homo sapiens
ccctctcccacccaa

SEQ ID NO: 5394127 - DNA, 20 bp, Homo sapiens
ccctctcccacccaaggaga

SEQ ID NO: 5394128 - DNA, 17 bp, Homo sapiens
ccctctcccaccctctt

SEQ ID NO: 5394129 - DNA, 12 bp, Homo sapiens
ccctctcccagg

SEQ ID NO: 5394130 - DNA, 16 bp, Homo sapiens
ccctctcccaggcccg

SEQ ID NO: 5394131 - DNA, 13 bp, Homo sapiens
ccctctcccaggg

SEQ ID NO: 5394132 - DNA, 15 bp, Homo sapiens
ccctctcccagtcca

SEQ ID NO: 5394133 - DNA, 22 bp, Homo sapiens
ccctctccccagggaagcagca

SEQ ID NO: 5394134 - DNA, 19 bp, Homo sapiens
ccctctcccccccccctcc

SEQ ID NO: 5394135 - DNA, 21 bp, Homo sapiens
ccctctcccccccccctccaa

SEQ ID NO: 5394136 - DNA, 16 bp, Homo sapiens
ccctctccctctaggc

SEQ ID NO: 5394137 - DNA, 15 bp, Homo sapiens
ccctgagctctctga

SEQ ID NO: 5394138 - DNA, 11 bp, Homo sapiens
ccctgagctga

SEQ ID NO: 5394139 - DNA, 14 bp, Homo sapiens
ccctgagctgacca

SEQ ID NO: 5394140 - DNA, 14 bp, Homo sapiens
ccctgagctgaggg

SEQ ID NO: 5394141 - DNA, 16 bp, Homo sapiens
ccctgagctggcctca

SEQ ID NO: 5394142 - DNA, 20 bp, Homo sapiens
ccctgagctggcgtcacctg

SEQ ID NO: 5394143 - DNA, 19 bp, Homo sapiens
ccctgagctttccggggag

SEQ ID NO: 5394144 - DNA, 16 bp, Homo sapiens
ccctgagctttctgct

SEQ ID NO: 5394145 - DNA, 13 bp, Homo sapiens
ccctgagctttgg

SEQ ID NO: 5394146 - DNA, 13 bp, Homo sapiens
ccctgaggaataa

SEQ ID NO: 5394147 - DNA, 13 bp, Homo sapiens
ccctgaggaatga

SEQ ID NO: 5394148 - DNA, 15 bp, Homo sapiens
ccctgaggacctctc

SEQ ID NO: 5394149 - DNA, 17 bp, Homo sapiens
ccctgaggacctctcag

SEQ ID NO: 5394150 - DNA, 18 bp, Homo sapiens
ccctgaggacctctcagc

SEQ ID NO: 5394151 - DNA, 14 bp, Homo sapiens
ccctgaggacctgc

SEQ ID NO: 5394152 - DNA, 13 bp, Homo sapiens
ccctgaggactgg

SEQ ID NO: 5394153 - DNA, 19 bp, Homo sapiens
ccctgaggagccaggccgg

SEQ ID NO: 5394154 - DNA, 13 bp, Homo sapiens
ccctgaggagggc

SEQ ID NO: 5394155 - DNA, 22 bp, Homo sapiens
ccctgaggagggccctgaggaa

SEQ ID NO: 5394156 - DNA, 15 bp, Homo sapiens
ccctgaggagtctga

SEQ ID NO: 5394157 - DNA, 22 bp, Homo sapiens
ccctgaggagtctgaggtcctg

SEQ ID NO: 5394158 - DNA, 21 bp, Homo sapiens
ccctgaggatcccctgtcccc

SEQ ID NO: 5394159 - DNA, 13 bp, Homo sapiens
ccctgaggcagcc

SEQ ID NO: 5394160 - DNA, 20 bp, Homo sapiens
ccctgaggcaggtccccaga

SEQ ID NO: 5394161 - DNA, 13 bp, Homo sapiens
ccctgaggcccag

SEQ ID NO: 5394162 - DNA, 14 bp, Homo sapiens
ccctgaggcccaga

SEQ ID NO: 5394163 - DNA, 17 bp, Homo sapiens
ccctgaggcccagaggg

SEQ ID NO: 5394164 - DNA, 19 bp, Homo sapiens
ccctgaggcccagagggcc

SEQ ID NO: 5394165 - DNA, 23 bp, Homo sapiens
ccctgaggcccagagggcctgca

SEQ ID NO: 5394166 - DNA, 13 bp, Homo sapiens
ccctgaggccctg

SEQ ID NO: 5394167 - DNA, 16 bp, Homo sapiens
ccctgaggccctgggc

SEQ ID NO: 5394168 - DNA, 21 bp, Homo sapiens
ccctgaggccctgggctgggt

SEQ ID NO: 5394169 - DNA, 16 bp, Homo sapiens
ccctgaggcctagact

SEQ ID NO: 5394170 - DNA, 22 bp, Homo sapiens
ccctgaggcggaggctgtgctc

SEQ ID NO: 5394171 - DNA, 23 bp, Homo sapiens
ccctgaggctggactccagatct

SEQ ID NO: 5394172 - DNA, 20 bp, Homo sapiens
ccctgaggctggcatcctgg

SEQ ID NO: 5394173 - DNA, 22 bp, Homo sapiens
ccctgaggctggcatcctggct

SEQ ID NO: 5394174 - DNA, 16 bp, Homo sapiens
ccctgaggctgtgagc

SEQ ID NO: 5394175 - DNA, 17 bp, Homo sapiens
ccctgagggacgagcag

SEQ ID NO: 5394176 - DNA, 13 bp, Homo sapiens
ccctgagggccct

SEQ ID NO: 5394177 - DNA, 18 bp, Homo sapiens
ccctgagggcccttccca

SEQ ID NO: 5394178 - DNA, 20 bp, Homo sapiens
ccctgagggcccttcccaac

SEQ ID NO: 5394179 - DNA, 20 bp, Homo sapiens
ccctgagggcggagcgcctc

SEQ ID NO: 5394180 - DNA, 23 bp, Homo sapiens
ccctgagggcggggtgtctgtct

SEQ ID NO: 5394181 - DNA, 18 bp, Homo sapiens
ccctgaggggcctgccac

SEQ ID NO: 5394182 - DNA, 17 bp, Homo sapiens
ccctgaggggctgggct

SEQ ID NO: 5394183 - DNA, 19 bp, Homo sapiens
ccctgaggggctgggctgg

SEQ ID NO: 5394184 - DNA, 20 bp, Homo sapiens
ccctgaggggctggggaggg

SEQ ID NO: 5394185 - DNA, 21 bp, Homo sapiens
ccctgagggtggtcagccaag

SEQ ID NO: 5394186 - DNA, 21 bp, Homo sapiens
ccctgaggtacctttccaccc

SEQ ID NO: 5394187 - DNA, 22 bp, Homo sapiens
ccctgaggtacctttccaccca

SEQ ID NO: 5394188 - DNA, 20 bp, Homo sapiens
ccctgaggtgtgggggctgc

SEQ ID NO: 5394189 - DNA, 21 bp, Homo sapiens
ccctgaggtgtgggggctgca

SEQ ID NO: 5394190 - DNA, 19 bp, Homo sapiens
ccctgagtcaactggagca

SEQ ID NO: 5394191 - DNA, 18 bp, Homo sapiens
ccctgagtccgcctgcgc

SEQ ID NO: 5394192 - DNA, 15 bp, Homo sapiens
ccctgagtctggacc

SEQ ID NO: 5394193 - DNA, 22 bp, Homo sapiens
ccctgagtctggacctccatcc

SEQ ID NO: 5394194 - DNA, 15 bp, Homo sapiens
ccctgagtctgggca

SEQ ID NO: 5394195 - DNA, 23 bp, Homo sapiens
ccctgagtgcgggctgaggccag

SEQ ID NO: 5394196 - DNA, 19 bp, Homo sapiens
ccctgagtggatctccaag

SEQ ID NO: 5394197 - DNA, 20 bp, Homo sapiens
ccctgagtggatctccaagg

SEQ ID NO: 5394198 - DNA, 15 bp, Homo sapiens
ccctgagtgtcccaa

SEQ ID NO: 5394199 - DNA, 17 bp, Homo sapiens
ccctgagtgtcccaagc

SEQ ID NO: 5394200 - DNA, 17 bp, Homo sapiens
ccctgagttctgacact

SEQ ID NO: 5394201 - DNA, 21 bp, Homo sapiens
ccctgagttctgacactgtgt

SEQ ID NO: 5394202 - DNA, 16 bp, Homo sapiens
ccctgagttggagctc

SEQ ID NO: 5394203 - DNA, 22 bp, Homo sapiens
ccctgagttggagctcattctg

SEQ ID NO: 5394204 - DNA, 17 bp, Homo sapiens
ccctgagttgggcagcc

SEQ ID NO: 5394205 - DNA, 18 bp, Homo sapiens
ccctgagttgggcagcca

SEQ ID NO: 5394206 - DNA, 19 bp, Homo sapiens
ccctgagttgggcagccag

SEQ ID NO: 5394207 - DNA, 15 bp, Homo sapiens
ccctgatcactccca

SEQ ID NO: 5394208 - DNA, 19 bp, Homo sapiens
ccctgatcactcccagcac

SEQ ID NO: 5394209 - DNA, 14 bp, Homo sapiens
ccctgatcccagag

SEQ ID NO: 5394210 - DNA, 22 bp, Homo sapiens
ccctgatcccattttcctctga

SEQ ID NO: 5394211 - DNA, 16 bp, Homo sapiens
ccctgatcccttccac

SEQ ID NO: 5394212 - DNA, 12 bp, Homo sapiens
ccctgatctccg

SEQ ID NO: 5394213 - DNA, 16 bp, Homo sapiens
ccctgatctctgacct

SEQ ID NO: 5394214 - DNA, 18 bp, Homo sapiens
ccctgatctctgacctct

SEQ ID NO: 5394215 - DNA, 22 bp, Homo sapiens
ccctgatctgacatccccactc

SEQ ID NO: 5394216 - DNA, 13 bp, Homo sapiens
ccctgatgacacc

SEQ ID NO: 5394217 - DNA, 18 bp, Homo sapiens
ccctgatgccttttggac

SEQ ID NO: 5394218 - DNA, 19 bp, Homo sapiens
ccctgatgcttaataaacg

SEQ ID NO: 5394219 - DNA, 22 bp, Homo sapiens
ccctgatggcagaactcccaca

SEQ ID NO: 5394220 - DNA, 16 bp, Homo sapiens
ccctgatggcctttgg

SEQ ID NO: 5394221 - DNA, 19 bp, Homo sapiens
ccctgattacaccagcctc

SEQ ID NO: 5394222 - DNA, 13 bp, Homo sapiens
ccctgattcttga

SEQ ID NO: 5394223 - DNA, 16 bp, Homo sapiens
ccctgattgacctgct

SEQ ID NO: 5394224 - DNA, 19 bp, Homo sapiens
ccctgattgacctgctccg

SEQ ID NO: 5394225 - DNA, 21 bp, Homo sapiens
ccctgatttaggagaagccag

SEQ ID NO: 5394226 - DNA, 18 bp, Homo sapiens
ccctgcaaaaagaaaaaa

SEQ ID NO: 5394227 - DNA, 20 bp, Homo sapiens
ccctgcaaaaagaaaaaaag

SEQ ID NO: 5394228 - DNA, 15 bp, Homo sapiens
ccctgcaaagacagt

SEQ ID NO: 5394229 - DNA, 15 bp, Homo sapiens
ccctgcaaaggactg

SEQ ID NO: 5394230 - DNA, 10 bp, Homo sapiens
ccctgcaaat

SEQ ID NO: 5394231 - DNA, 23 bp, Homo sapiens
ccctgcaacaaagacttgcttta

SEQ ID NO: 5394232 - DNA, 23 bp, Homo sapiens
ccctgcaaccaattgaaaagtgt

SEQ ID NO: 5394233 - DNA, 21 bp, Homo sapiens
ccctgcaacttctatcctttc

SEQ ID NO: 5394234 - DNA, 17 bp, Homo sapiens
ccctgcaaggcccacag

SEQ ID NO: 5394235 - DNA, 14 bp, Homo sapiens
ccctgcaataaaat

SEQ ID NO: 5394236 - DNA, 22 bp, Homo sapiens
ccctgcaatgcgtcttgtgaaa

SEQ ID NO: 5394237 - DNA, 20 bp, Homo sapiens
ccctgcaatgtatcccttct

SEQ ID NO: 5394238 - DNA, 12 bp, Homo sapiens
ccctgcacacac

SEQ ID NO: 5394239 - DNA, 18 bp, Homo sapiens
ccctgcacacacctgcac

SEQ ID NO: 5394240 - DNA, 19 bp, Homo sapiens
ccctgcacacacctgcaca

SEQ ID NO: 5394241 - DNA, 20 bp, Homo sapiens
ccctgcacagatatttccat

SEQ ID NO: 5394242 - DNA, 21 bp, Homo sapiens
ccctgcacagcaggctgccag

SEQ ID NO: 5394243 - DNA, 22 bp, Homo sapiens
ccctgcacagcaggctgccagt

SEQ ID NO: 5394244 - DNA, 14 bp, Homo sapiens
ccctgcacagcctc

SEQ ID NO: 5394245 - DNA, 20 bp, Homo sapiens
ccctgcaccaggccatcagc

SEQ ID NO: 5394246 - DNA, 23 bp, Homo sapiens
ccctgcaccatgctgctggggaa

SEQ ID NO: 5394247 - DNA, 14 bp, Homo sapiens
ccctgcacccaccc

SEQ ID NO: 5394248 - DNA, 22 bp, Homo sapiens
ccctgcacccacccctgcccag

SEQ ID NO: 5394249 - DNA, 13 bp, Homo sapiens
ccctgcaccctcc

SEQ ID NO: 5394250 - DNA, 15 bp, Homo sapiens
ccctgcaccctccta

SEQ ID NO: 5394251 - DNA, 17 bp, Homo sapiens
ccctgcaccctcctagg

SEQ ID NO: 5394252 - DNA, 12 bp, Homo sapiens
ccctgcaccctt

SEQ ID NO: 5394253 - DNA, 14 bp, Homo sapiens
ccctgcacccttgt

SEQ ID NO: 5394254 - DNA, 19 bp, Homo sapiens
ccctgcaccgccgcagaag

SEQ ID NO: 5394255 - DNA, 22 bp, Homo sapiens
ccctgcaccgccgcagaagcag

SEQ ID NO: 5394256 - DNA, 13 bp, Homo sapiens
ccctgcacctgct

SEQ ID NO: 5394257 - DNA, 15 bp, Homo sapiens
ccctgcacctggcct

SEQ ID NO: 5394258 - DNA, 13 bp, Homo sapiens
ccctgcaccttcc

SEQ ID NO: 5394259 - DNA, 20 bp, Homo sapiens
ccctgcacgtatacacccag

SEQ ID NO: 5394260 - DNA, 20 bp, Homo sapiens
ccctgcactaaagccagcct

SEQ ID NO: 5394261 - DNA, 17 bp, Homo sapiens
ccctgcactccctcctg

SEQ ID NO: 5394262 - DNA, 20 bp, Homo sapiens
ccctgcactgtaaaatgtgg

SEQ ID NO: 5394263 - DNA, 14 bp, Homo sapiens
ccctgcactgtcct

SEQ ID NO: 5394264 - DNA, 20 bp, Homo sapiens
ccctgcactgtcctgctcca

SEQ ID NO: 5394265 - DNA, 23 bp, Homo sapiens
ccctgcactgtcctgctccacag

SEQ ID NO: 5394266 - DNA, 16 bp, Homo sapiens
ccctgcacttcatccc

SEQ ID NO: 5394267 - DNA, 12 bp, Homo sapiens
ccctgcacttgc

SEQ ID NO: 5394268 - DNA, 18 bp, Homo sapiens
ccctgcagaagccagaag

SEQ ID NO: 5394269 - DNA, 16 bp, Homo sapiens
ccctgcagaccctgcc

SEQ ID NO: 5394270 - DNA, 17 bp, Homo sapiens
ccctgcagacctcaagc

SEQ ID NO: 5394271 - DNA, 19 bp, Homo sapiens
ccctgcagacgtctggccc

SEQ ID NO: 5394272 - DNA, 13 bp, Homo sapiens
ccctgcagactcc

SEQ ID NO: 5394273 - DNA, 13 bp, Homo sapiens
ccctgcagagcaa

SEQ ID NO: 5394274 - DNA, 15 bp, Homo sapiens
ccctgcagagcaata

SEQ ID NO: 5394275 - DNA, 13 bp, Homo sapiens
ccctgcagagcta

SEQ ID NO: 5394276 - DNA, 21 bp, Homo sapiens
ccctgcagagctatggtgagg

SEQ ID NO: 5394277 - DNA, 12 bp, Homo sapiens
ccctgcagaggg

SEQ ID NO: 5394278 - DNA, 15 bp, Homo sapiens
ccctgcagatgccac

SEQ ID NO: 5394279 - DNA, 17 bp, Homo sapiens
ccctgcagattctgagc

SEQ ID NO: 5394280 - DNA, 13 bp, Homo sapiens
ccctgcagcacgc

SEQ ID NO: 5394281 - DNA, 16 bp, Homo sapiens
ccctgcagcagaacct

SEQ ID NO: 5394282 - DNA, 14 bp, Homo sapiens
ccctgcagccagct

SEQ ID NO: 5394283 - DNA, 20 bp, Homo sapiens
ccctgcagccatcccaaggc

SEQ ID NO: 5394284 - DNA, 12 bp, Homo sapiens
ccctgcagccca

SEQ ID NO: 5394285 - DNA, 21 bp, Homo sapiens
ccctgcagcccaggccagtca

SEQ ID NO: 5394286 - DNA, 18 bp, Homo sapiens
ccctgcagcccccactca

SEQ ID NO: 5394287 - DNA, 14 bp, Homo sapiens
ccctgcagccgtgc

SEQ ID NO: 5394288 - DNA, 19 bp, Homo sapiens
ccctgcagccgtgcaggac

SEQ ID NO: 5394289 - DNA, 20 bp, Homo sapiens
ccctgcagccgtgcaggact

SEQ ID NO: 5394290 - DNA, 16 bp, Homo sapiens
ccctgcagcctgggtc

SEQ ID NO: 5394291 - DNA, 18 bp, Homo sapiens
ccctgcagcctgggtctg

SEQ ID NO: 5394292 - DNA, 18 bp, Homo sapiens
ccctgcagcggtggttgt

SEQ ID NO: 5394293 - DNA, 17 bp, Homo sapiens
ccctgcagctagtccta

SEQ ID NO: 5394294 - DNA, 13 bp, Homo sapiens
ccctgcagctctc

SEQ ID NO: 5394295 - DNA, 16 bp, Homo sapiens
ccctgcagctgaccgg

SEQ ID NO: 5394296 - DNA, 19 bp, Homo sapiens
ccctgcagcttgtagccag

SEQ ID NO: 5394297 - DNA, 15 bp, Homo sapiens
ccctgcaggaaggag

SEQ ID NO: 5394298 - DNA, 18 bp, Homo sapiens
ccctgcaggaaggagctg

SEQ ID NO: 5394299 - DNA, 22 bp, Homo sapiens
ccctgcaggaaggagctgcctg

SEQ ID NO: 5394300 - DNA, 17 bp, Homo sapiens
ccctgcaggaggcctgg

SEQ ID NO: 5394301 - DNA, 19 bp, Homo sapiens
ccctgcaggaggcctggga

SEQ ID NO: 5394302 - DNA, 19 bp, Homo sapiens
ccctgcaggcacagaggag

SEQ ID NO: 5394303 - DNA, 17 bp, Homo sapiens
ccctgcaggcaggcaga

SEQ ID NO: 5394304 - DNA, 13 bp, Homo sapiens
ccctgcaggccag

SEQ ID NO: 5394305 - DNA, 17 bp, Homo sapiens
ccctgcaggccaggcca

SEQ ID NO: 5394306 - DNA, 19 bp, Homo sapiens
ccctgcaggccaggccagc

SEQ ID NO: 5394307 - DNA, 23 bp, Homo sapiens
ccctgcaggccaggccagcttcc

SEQ ID NO: 5394308 - DNA, 22 bp, Homo sapiens
ccctgcaggcggtatccagagg

SEQ ID NO: 5394309 - DNA, 20 bp, Homo sapiens
ccctgcaggctgcaggaggg

SEQ ID NO: 5394310 - DNA, 21 bp, Homo sapiens
ccctgcaggctgcaggagggc

SEQ ID NO: 5394311 - DNA, 13 bp, Homo sapiens
ccctgcagggcca

SEQ ID NO: 5394312 - DNA, 23 bp, Homo sapiens
ccctgcagggtagggggcctgag

SEQ ID NO: 5394313 - DNA, 18 bp, Homo sapiens
ccctgcaggttgttcata

SEQ ID NO: 5394314 - DNA, 22 bp, Homo sapiens
ccctggcccagcctgtggcctc

SEQ ID NO: 5394315 - DNA, 12 bp, Homo sapiens
ccctggcccagg

SEQ ID NO: 5394316 - DNA, 16 bp, Homo sapiens
ccctggcccaggtgcc

SEQ ID NO: 5394317 - DNA, 17 bp, Homo sapiens
ccctggccccagcccta

SEQ ID NO: 5394318 - DNA, 13 bp, Homo sapiens
ccctggccccagt

SEQ ID NO: 5394319 - DNA, 15 bp, Homo sapiens
ccctggcccccacag

SEQ ID NO: 5394320 - DNA, 19 bp, Homo sapiens
ccctggcccccacagcgct

SEQ ID NO: 5394321 - DNA, 17 bp, Homo sapiens
ccctggcccccatcagc

SEQ ID NO: 5394322 - DNA, 12 bp, Homo sapiens
ccctggccccct

SEQ ID NO: 5394323 - DNA, 16 bp, Homo sapiens
ccctggccccctgagt

SEQ ID NO: 5394324 - DNA, 11 bp, Homo sapiens
ccctggcccct

SEQ ID NO: 5394325 - DNA, 17 bp, Homo sapiens
ccctggcccctctccct

SEQ ID NO: 5394326 - DNA, 15 bp, Homo sapiens
ccctggcccctgtgg

SEQ ID NO: 5394327 - DNA, 16 bp, Homo sapiens
ccctggcccgcccctc

SEQ ID NO: 5394328 - DNA, 17 bp, Homo sapiens
ccctggcccggtcccag

SEQ ID NO: 5394329 - DNA, 22 bp, Homo sapiens
ccctggccctcaaggcctccca

SEQ ID NO: 5394330 - DNA, 23 bp, Homo sapiens
ccctggccctcaaggcctcccac

SEQ ID NO: 5394331 - DNA, 16 bp, Homo sapiens
ccctggccctgcccag

SEQ ID NO: 5394332 - DNA, 17 bp, Homo sapiens
ccctggccctgcccagc

SEQ ID NO: 5394333 - DNA, 18 bp, Homo sapiens
ccctggccctgcctcact

SEQ ID NO: 5394334 - DNA, 11 bp, Homo sapiens
ccctggccctt

SEQ ID NO: 5394335 - DNA, 19 bp, Homo sapiens
ccctggccgcttctcccca

SEQ ID NO: 5394336 - DNA, 22 bp, Homo sapiens
ccctggccggcccaggcctcca

SEQ ID NO: 5394337 - DNA, 13 bp, Homo sapiens
ccctggcctcact

SEQ ID NO: 5394338 - DNA, 22 bp, Homo sapiens
ccctggcctcagttcccagctc

SEQ ID NO: 5394339 - DNA, 20 bp, Homo sapiens
ccctggcctcccctgccacc

SEQ ID NO: 5394340 - DNA, 20 bp, Homo sapiens
ccctggcctccggcgtcagc

SEQ ID NO: 5394341 - DNA, 18 bp, Homo sapiens
ccctggcctctgtgcctt

SEQ ID NO: 5394342 - DNA, 18 bp, Homo sapiens
ccctggcctgaactgagg

SEQ ID NO: 5394343 - DNA, 19 bp, Homo sapiens
ccctggcctgaactgagga

SEQ ID NO: 5394344 - DNA, 18 bp, Homo sapiens
ccctggcctgactcccat

SEQ ID NO: 5394345 - DNA, 19 bp, Homo sapiens
ccctggcctgactcccatg

SEQ ID NO: 5394346 - DNA, 22 bp, Homo sapiens
ccctggcctgctgggctctcca

SEQ ID NO: 5394347 - DNA, 22 bp, Homo sapiens
ccctggcctgtggagagaaagc

SEQ ID NO: 5394348 - DNA, 16 bp, Homo sapiens
ccctggccttgcccgt

SEQ ID NO: 5394349 - DNA, 22 bp, Homo sapiens
ccctggcctttgaggcaaaggc

SEQ ID NO: 5394350 - DNA, 16 bp, Homo sapiens
ccctggcgggtggctg

SEQ ID NO: 5394351 - DNA, 17 bp, Homo sapiens
ccctggcgggtggctgc

SEQ ID NO: 5394352 - DNA, 21 bp, Homo sapiens
ccctggcgtcctctccctcct

SEQ ID NO: 5394353 - DNA, 22 bp, Homo sapiens
ccctggcgtcctctccctcctg

SEQ ID NO: 5394354 - DNA, 17 bp, Homo sapiens
ccctggctacttccctt

SEQ ID NO: 5394355 - DNA, 15 bp, Homo sapiens
ccctggctcactggc

SEQ ID NO: 5394356 - DNA, 19 bp, Homo sapiens
ccctggctcactggcaggt

SEQ ID NO: 5394357 - DNA, 14 bp, Homo sapiens
ccctggctcaggga

SEQ ID NO: 5394358 - DNA, 13 bp, Homo sapiens
ccctggctccagg

SEQ ID NO: 5394359 - DNA, 16 bp, Homo sapiens
ccctggctccaggcca

SEQ ID NO: 5394360 - DNA, 11 bp, Homo sapiens
ccctggctccc

SEQ ID NO: 5394361 - DNA, 14 bp, Homo sapiens
ccctggctcccaag

SEQ ID NO: 5394362 - DNA, 20 bp, Homo sapiens
ccctggctcccacaggccct

SEQ ID NO: 5394363 - DNA, 13 bp, Homo sapiens
ccctggctcctcc

SEQ ID NO: 5394364 - DNA, 17 bp, Homo sapiens
ccctggctcctccgtct

SEQ ID NO: 5394365 - DNA, 15 bp, Homo sapiens
ccctggctccttgca

SEQ ID NO: 5394366 - DNA, 20 bp, Homo sapiens
ccctggctccttgcagcagg

SEQ ID NO: 5394367 - DNA, 22 bp, Homo sapiens
ccctggctccttgtgccagaga

SEQ ID NO: 5394368 - DNA, 13 bp, Homo sapiens
ccctggctctgca

SEQ ID NO: 5394369 - DNA, 15 bp, Homo sapiens
ccctggctctgccag

SEQ ID NO: 5394370 - DNA, 16 bp, Homo sapiens
ccctggctctgcccct

SEQ ID NO: 5394371 - DNA, 13 bp, Homo sapiens
ccctggctctgct

SEQ ID NO: 5394372 - DNA, 14 bp, Homo sapiens
ccctggctctgggc

SEQ ID NO: 5394373 - DNA, 16 bp, Homo sapiens
ccctggctctgggccg

SEQ ID NO: 5394374 - DNA, 22 bp, Homo sapiens
ccctggctgaacagtgctctgc

SEQ ID NO: 5394375 - DNA, 19 bp, Homo sapiens
ccctggctgaaggactgtg

SEQ ID NO: 5394376 - DNA, 18 bp, Homo sapiens
ccctggctgactggccag

SEQ ID NO: 5394377 - DNA, 11 bp, Homo sapiens
ccctggctgca

SEQ ID NO: 5394378 - DNA, 13 bp, Homo sapiens
ccctggctgccct

SEQ ID NO: 5394379 - DNA, 14 bp, Homo sapiens
ccctggctgccctg

SEQ ID NO: 5394380 - DNA, 15 bp, Homo sapiens
ccctggctgccctgg

SEQ ID NO: 5394381 - DNA, 22 bp, Homo sapiens
ccctggctgctgcccccacccc

SEQ ID NO: 5394382 - DNA, 23 bp, Homo sapiens
ccctggctgggacgtggctcagc

SEQ ID NO: 5394383 - DNA, 17 bp, Homo sapiens
ccctggctgtactgctc

SEQ ID NO: 5394384 - DNA, 15 bp, Homo sapiens
ccctggctgtgagca

SEQ ID NO: 5394385 - DNA, 16 bp, Homo sapiens
ccctggcttgcttgcc

SEQ ID NO: 5394386 - DNA, 14 bp, Homo sapiens
ccctggcttggagg

SEQ ID NO: 5394387 - DNA, 15 bp, Homo sapiens
ccctggcttggaggc

SEQ ID NO: 5394388 - DNA, 24 bp, Homo sapiens
ccctggctttcattttctctcagg

SEQ ID NO: 5394389 - DNA, 14 bp, Homo sapiens
ccctggctttgcct

SEQ ID NO: 5394390 - DNA, 15 bp, Homo sapiens
ccctggctttgcctc

SEQ ID NO: 5394391 - DNA, 19 bp, Homo sapiens
ccctggcttttcactgctg

SEQ ID NO: 5394392 - DNA, 16 bp, Homo sapiens
ccctgggaacaggccc

SEQ ID NO: 5394393 - DNA, 17 bp, Homo sapiens
ccctgggaactcatcct

SEQ ID NO: 5394394 - DNA, 16 bp, Homo sapiens
ccctgggaaggctaag

SEQ ID NO: 5394395 - DNA, 21 bp, Homo sapiens
ccctgggacacagacccagga

SEQ ID NO: 5394396 - DNA, 23 bp, Homo sapiens
ccctgggacctatacagaacaga

SEQ ID NO: 5394397 - DNA, 16 bp, Homo sapiens
ccctgggagagtgagg

SEQ ID NO: 5394398 - DNA, 19 bp, Homo sapiens
ccctgggagcaagttgcag

SEQ ID NO: 5394399 - DNA, 17 bp, Homo sapiens
ccctgggagccagtcct

SEQ ID NO: 5394400 - DNA, 18 bp, Homo sapiens
ccctgggaggctctggag

SEQ ID NO: 5394401 - DNA, 15 bp, Homo sapiens
ccctgggagggaggt

SEQ ID NO: 5394402 - DNA, 23 bp, Homo sapiens
ccctgggagtgttcccgtgcctg

SEQ ID NO: 5394403 - DNA, 17 bp, Homo sapiens
ccctgggatgcctcacc

SEQ ID NO: 5394404 - DNA, 21 bp, Homo sapiens
ccctgggatgcctcaccacac

SEQ ID NO: 5394405 - DNA, 22 bp, Homo sapiens
ccctgggatgctgacccaggaa

SEQ ID NO: 5394406 - DNA, 23 bp, Homo sapiens
ccctgggatggaacctcaggatg

SEQ ID NO: 5394407 - DNA, 20 bp, Homo sapiens
ccctgggatgggaccaggga

SEQ ID NO: 5394408 - DNA, 19 bp, Homo sapiens
ccctgggcaccctgcaggc

SEQ ID NO: 5394409 - DNA, 13 bp, Homo sapiens
ccctgggcagatg

SEQ ID NO: 5394410 - DNA, 22 bp, Homo sapiens
ccctgggcaggcggtccccatc

SEQ ID NO: 5394411 - DNA, 22 bp, Homo sapiens
ccctgggccaccgggcagcctg

SEQ ID NO: 5394412 - DNA, 11 bp, Homo sapiens
ccctgggccag

SEQ ID NO: 5394413 - DNA, 19 bp, Homo sapiens
ccctgggccagcccaggat

SEQ ID NO: 5394414 - DNA, 14 bp, Homo sapiens
ccctgggccaggca

SEQ ID NO: 5394415 - DNA, 15 bp, Homo sapiens
ccctgggccaggcag

SEQ ID NO: 5394416 - DNA, 16 bp, Homo sapiens
ccctgggccccaccac

SEQ ID NO: 5394417 - DNA, 16 bp, Homo sapiens
ccctgggccccgcctc

SEQ ID NO: 5394418 - DNA, 18 bp, Homo sapiens
ccctgggccccgcctcaa

SEQ ID NO: 5394419 - DNA, 15 bp, Homo sapiens
ccctgggcccctcca

SEQ ID NO: 5394420 - DNA, 16 bp, Homo sapiens
ccctgggcccctccac

SEQ ID NO: 5394421 - DNA, 18 bp, Homo sapiens
ccctgggcccctccacgc

SEQ ID NO: 5394422 - DNA, 22 bp, Homo sapiens
ccctgggcccctccacgcctcc

SEQ ID NO: 5394423 - DNA, 18 bp, Homo sapiens
ccctgggccctgggctgg

SEQ ID NO: 5394424 - DNA, 19 bp, Homo sapiens
ccctgggccctgggctgga

SEQ ID NO: 5394425 - DNA, 15 bp, Homo sapiens
ccctgggcccttgtg

SEQ ID NO: 5394426 - DNA, 18 bp, Homo sapiens
ccctgggcccttgtgctc

SEQ ID NO: 5394427 - DNA, 10 bp, Homo sapiens
ccctgggcct

SEQ ID NO: 5394428 - DNA, 11 bp, Homo sapiens
ccctgggcctc

SEQ ID NO: 5394429 - DNA, 13 bp, Homo sapiens
ccctgggcctcag

SEQ ID NO: 5394430 - DNA, 22 bp, Homo sapiens
ccctgggcctcagcctccaggc

SEQ ID NO: 5394431 - DNA, 14 bp, Homo sapiens
ccctgggcctcagt

SEQ ID NO: 5394432 - DNA, 16 bp, Homo sapiens
ccctgggcctccacct

SEQ ID NO: 5394433 - DNA, 13 bp, Homo sapiens
ccctgggcctccc

SEQ ID NO: 5394434 - DNA, 14 bp, Homo sapiens
ccctgggcctcccg

SEQ ID NO: 5394435 - DNA, 17 bp, Homo sapiens
ccctgggcctcccgtcc

SEQ ID NO: 5394436 - DNA, 19 bp, Homo sapiens
ccctgggcctgctgctgag

SEQ ID NO: 5394437 - DNA, 20 bp, Homo sapiens
ccctgggcctgctgctgaga

SEQ ID NO: 5394438 - DNA, 18 bp, Homo sapiens
ccctgggcctgtctcaga

SEQ ID NO: 5394439 - DNA, 22 bp, Homo sapiens
ccctgggcgcagctgaagcctg

SEQ ID NO: 5394440 - DNA, 16 bp, Homo sapiens
ccctgggctccctgga

SEQ ID NO: 5394441 - DNA, 12 bp, Homo sapiens
ccctgggctctc

SEQ ID NO: 5394442 - DNA, 13 bp, Homo sapiens
ccctgggctctca

SEQ ID NO: 5394443 - DNA, 15 bp, Homo sapiens
ccctgggctctgccc

SEQ ID NO: 5394444 - DNA, 22 bp, Homo sapiens
ccctgggctctggtctgtaggt

SEQ ID NO: 5394445 - DNA, 17 bp, Homo sapiens
ccctgggctctgtgggc

SEQ ID NO: 5394446 - DNA, 20 bp, Homo sapiens
ccctgggctctgtgggctgc

SEQ ID NO: 5394447 - DNA, 24 bp, Homo sapiens
ccctgggctgatggaagatggtcc

SEQ ID NO: 5394448 - DNA, 22 bp, Homo sapiens
ccctgggctgcctcctcctgag

SEQ ID NO: 5394449 - DNA, 12 bp, Homo sapiens
ccctgggctgga

SEQ ID NO: 5394450 - DNA, 14 bp, Homo sapiens
ccctgggctggact

SEQ ID NO: 5394451 - DNA, 16 bp, Homo sapiens
ccctgggctggactgg

SEQ ID NO: 5394452 - DNA, 20 bp, Homo sapiens
ccctgggctggactggaggt

SEQ ID NO: 5394453 - DNA, 19 bp, Homo sapiens
ccctgggctggcacagccc

SEQ ID NO: 5394454 - DNA, 20 bp, Homo sapiens
ccctgggctggcacagcccc

SEQ ID NO: 5394455 - DNA, 22 bp, Homo sapiens
ccctgggctggcatggggaggg

SEQ ID NO: 5394456 - DNA, 18 bp, Homo sapiens
ccctgggctggggaggag

SEQ ID NO: 5394457 - DNA, 17 bp, Homo sapiens
ccctgggctggggcctc

SEQ ID NO: 5394458 - DNA, 18 bp, Homo sapiens
ccctgggctgggtgctgg

SEQ ID NO: 5394459 - DNA, 13 bp, Homo sapiens
ccctgggctgtcc

SEQ ID NO: 5394460 - DNA, 20 bp, Homo sapiens
ccctgggctgtccagcctta

SEQ ID NO: 5394461 - DNA, 18 bp, Homo sapiens
ccctgggctgtctgtcac

SEQ ID NO: 5394462 - DNA, 15 bp, Homo sapiens
ccctgggctgtgcta

SEQ ID NO: 5394463 - DNA, 18 bp, Homo sapiens
ccctgggcttggctcttg

SEQ ID NO: 5394464 - DNA, 19 bp, Homo sapiens
ccctggggaaggagccagt

SEQ ID NO: 5394465 - DNA, 12 bp, Homo sapiens
ccctggggacag

SEQ ID NO: 5394466 - DNA, 19 bp, Homo sapiens
ccctggggacagagccacc

SEQ ID NO: 5394467 - DNA, 22 bp, Homo sapiens
ccctggggacagagccacccca

SEQ ID NO: 5394468 - DNA, 17 bp, Homo sapiens
ccctggggacagcaagg

SEQ ID NO: 5394469 - DNA, 17 bp, Homo sapiens
ccctggggaccaggagc

SEQ ID NO: 5394470 - DNA, 12 bp, Homo sapiens
ccctggggacgg

SEQ ID NO: 5394471 - DNA, 18 bp, Homo sapiens
ccctggggacggggctcc

SEQ ID NO: 5394472 - DNA, 14 bp, Homo sapiens
ccctggggactctg

SEQ ID NO: 5394473 - DNA, 22 bp, Homo sapiens
ccctggggacttcaactgccca

SEQ ID NO: 5394474 - DNA, 19 bp, Homo sapiens
ccctggggagaacccttcc

SEQ ID NO: 5394475 - DNA, 18 bp, Homo sapiens
ccctggggagccctcagg

SEQ ID NO: 5394476 - DNA, 18 bp, Homo sapiens
ccctggggagtgagcttg

SEQ ID NO: 5394477 - DNA, 13 bp, Homo sapiens
ccctggggcactc

SEQ ID NO: 5394478 - DNA, 16 bp, Homo sapiens
ccctggggcactcccc

SEQ ID NO: 5394479 - DNA, 21 bp, Homo sapiens
ccctggggcactcccccagga

SEQ ID NO: 5394480 - DNA, 12 bp, Homo sapiens
ccctggggcagg

SEQ ID NO: 5394481 - DNA, 16 bp, Homo sapiens
ccctggggcaggggtg

SEQ ID NO: 5394482 - DNA, 19 bp, Homo sapiens
ccctggggcagggtggggg

SEQ ID NO: 5394483 - DNA, 15 bp, Homo sapiens
ccctggggcatccac

SEQ ID NO: 5394484 - DNA, 19 bp, Homo sapiens
ccctggggcatccaccttc

SEQ ID NO: 5394485 - DNA, 17 bp, Homo sapiens
ccctggggccatgggtg

SEQ ID NO: 5394486 - DNA, 13 bp, Homo sapiens
ccctggggcctgg

SEQ ID NO: 5394487 - DNA, 20 bp, Homo sapiens
ccctggggcctgtactgcct

SEQ ID NO: 5394488 - DNA, 21 bp, Homo sapiens
ccctggggcctgtactgcctg

SEQ ID NO: 5394489 - DNA, 16 bp, Homo sapiens
ccctggggctgagtct

SEQ ID NO: 5394490 - DNA, 19 bp, Homo sapiens
ccctggggctgagtctcca

SEQ ID NO: 5394491 - DNA, 21 bp, Homo sapiens
ccctggggctgagtctccagg

SEQ ID NO: 5394492 - DNA, 18 bp, Homo sapiens
ccctgttttctgtttctt

SEQ ID NO: 5394493 - DNA, 16 bp, Homo sapiens
ccctgttttttgtaga

SEQ ID NO: 5394494 - DNA, 21 bp, Homo sapiens
cccttaaaaatgaatgtcttg

SEQ ID NO: 5394495 - DNA, 22 bp, Homo sapiens
cccttaaaaattaaattctctc

SEQ ID NO: 5394496 - DNA, 21 bp, Homo sapiens
cccttaaacacaggctgtcct

SEQ ID NO: 5394497 - DNA, 22 bp, Homo sapiens
cccttaaacacaggctgtcctt

SEQ ID NO: 5394498 - DNA, 15 bp, Homo sapiens
cccttaacccaagga

SEQ ID NO: 5394499 - DNA, 20 bp, Homo sapiens
cccttaacccaaggagcaca

SEQ ID NO: 5394500 - DNA, 22 bp, Homo sapiens
cccttaacccaaggagcacagg

SEQ ID NO: 5394501 - DNA, 13 bp, Homo sapiens
cccttaactccaa

SEQ ID NO: 5394502 - DNA, 15 bp, Homo sapiens
cccttaactccaaga

SEQ ID NO: 5394503 - DNA, 22 bp, Homo sapiens
cccttaactctaaccctgtgga

SEQ ID NO: 5394504 - DNA, 23 bp, Homo sapiens
cccttaagaatgagtttcttaga

SEQ ID NO: 5394505 - DNA, 23 bp, Homo sapiens
cccttaagccaaactcaggccca

SEQ ID NO: 5394506 - DNA, 20 bp, Homo sapiens
cccttaaggaggtagctccc

SEQ ID NO: 5394507 - DNA, 20 bp, Homo sapiens
cccttaagggttgaaggcag

SEQ ID NO: 5394508 - DNA, 17 bp, Homo sapiens
cccttaaggtctccaaa

SEQ ID NO: 5394509 - DNA, 20 bp, Homo sapiens
cccttaataaaaatatatat

SEQ ID NO: 5394510 - DNA, 22 bp, Homo sapiens
cccttaatattgaggctgcagc

SEQ ID NO: 5394511 - DNA, 19 bp, Homo sapiens
cccttaattacttaaaaaa

SEQ ID NO: 5394512 - DNA, 21 bp, Homo sapiens
cccttacagccctaagtggct

SEQ ID NO: 5394513 - DNA, 15 bp, Homo sapiens
cccttacagcctctg

SEQ ID NO: 5394514 - DNA, 19 bp, Homo sapiens
cccttacagtgaagatgtt

SEQ ID NO: 5394515 - DNA, 21 bp, Homo sapiens
cccttaccactgctctgatga

SEQ ID NO: 5394516 - DNA, 20 bp, Homo sapiens
cccttaccctcctctgctgg

SEQ ID NO: 5394517 - DNA, 13 bp, Homo sapiens
cccttacctcgtg

SEQ ID NO: 5394518 - DNA, 17 bp, Homo sapiens
cccttacctgccaggaa

SEQ ID NO: 5394519 - DNA, 18 bp, Homo sapiens
cccttacctgtctctctc

SEQ ID NO: 5394520 - DNA, 23 bp, Homo sapiens
cccttactacttcttggaaaaaa

SEQ ID NO: 5394521 - DNA, 18 bp, Homo sapiens
cccttactttaacccttt

SEQ ID NO: 5394522 - DNA, 16 bp, Homo sapiens
cccttagaaaatgtgt

SEQ ID NO: 5394523 - DNA, 16 bp, Homo sapiens
cccttagacagaggcc

SEQ ID NO: 5394524 - DNA, 22 bp, Homo sapiens
cccttagagattgccccagagc

SEQ ID NO: 5394525 - DNA, 23 bp, Homo sapiens
cccttagagattgccccagagcc

SEQ ID NO: 5394526 - DNA, 19 bp, Homo sapiens
cccttagaggacctgagtt

SEQ ID NO: 5394527 - DNA, 22 bp, Homo sapiens
cccttagagggaatctagccca

SEQ ID NO: 5394528 - DNA, 19 bp, Homo sapiens
cccttagagtgctgtgaga

SEQ ID NO: 5394529 - DNA, 19 bp, Homo sapiens
cccttagcaccttcagggc

SEQ ID NO: 5394530 - DNA, 19 bp, Homo sapiens
cccttagcccccacccact

SEQ ID NO: 5394531 - DNA, 16 bp, Homo sapiens
cccttaggccccgtgg

SEQ ID NO: 5394532 - DNA, 12 bp, Homo sapiens
cccttagtcccc

SEQ ID NO: 5394533 - DNA, 22 bp, Homo sapiens
cccttatagtttgggcttcagc

SEQ ID NO: 5394534 - DNA, 15 bp, Homo sapiens
cccttatcaccagct

SEQ ID NO: 5394535 - DNA, 21 bp, Homo sapiens
cccttatcctccctgtaactt

SEQ ID NO: 5394536 - DNA, 21 bp, Homo sapiens
cccttatgagcgtcactgccc

SEQ ID NO: 5394537 - DNA, 23 bp, Homo sapiens
cccttatgagcgtcactgcccac

SEQ ID NO: 5394538 - DNA, 20 bp, Homo sapiens
cccttattacacggaaaacg

SEQ ID NO: 5394539 - DNA, 17 bp, Homo sapiens
cccttcaactcctggct

SEQ ID NO: 5394540 - DNA, 16 bp, Homo sapiens
cccttcaaggcctccc

SEQ ID NO: 5394541 - DNA, 15 bp, Homo sapiens
cccttcaatgctgca

SEQ ID NO: 5394542 - DNA, 17 bp, Homo sapiens
cccttcaatgctgcagg

SEQ ID NO: 5394543 - DNA, 13 bp, Homo sapiens
cccttcaatgtta

SEQ ID NO: 5394544 - DNA, 19 bp, Homo sapiens
cccttcacaccataactag

SEQ ID NO: 5394545 - DNA, 22 bp, Homo sapiens
cccttcacaccccaggcccttc

SEQ ID NO: 5394546 - DNA, 14 bp, Homo sapiens
cccttcacaggggt

SEQ ID NO: 5394547 - DNA, 16 bp, Homo sapiens
cccttcacagtgtttc

SEQ ID NO: 5394548 - DNA, 17 bp, Homo sapiens
cccttcacgctggcttc

SEQ ID NO: 5394549 - DNA, 18 bp, Homo sapiens
cccttcacgctggcttcc

SEQ ID NO: 5394550 - DNA, 15 bp, Homo sapiens
cccttcagaccccag

SEQ ID NO: 5394551 - DNA, 14 bp, Homo sapiens
cccttcagactggc

SEQ ID NO: 5394552 - DNA, 16 bp, Homo sapiens
cccttcagactggccc

SEQ ID NO: 5394553 - DNA, 13 bp, Homo sapiens
cccttcagcccac

SEQ ID NO: 5394554 - DNA, 22 bp, Homo sapiens
cccttcagcccccagcccctcc

SEQ ID NO: 5394555 - DNA, 15 bp, Homo sapiens
cccttcagcttgctt

SEQ ID NO: 5394556 - DNA, 19 bp, Homo sapiens
cccttcaggacccttctac

SEQ ID NO: 5394557 - DNA, 16 bp, Homo sapiens
cccttcaggagcctgg

SEQ ID NO: 5394558 - DNA, 23 bp, Homo sapiens
cccttcaggagcctggccaggca

SEQ ID NO: 5394559 - DNA, 24 bp, Homo sapiens
cccttcaggagcctggccaggcag

SEQ ID NO: 5394560 - DNA, 17 bp, Homo sapiens
cccttcagtaccctctc

SEQ ID NO: 5394561 - DNA, 19 bp, Homo sapiens
cccttcagtaccctctcag

SEQ ID NO: 5394562 - DNA, 21 bp, Homo sapiens
cccttcagtaccctctcagct

SEQ ID NO: 5394563 - DNA, 19 bp, Homo sapiens
cccttcagtctgctccacc

SEQ ID NO: 5394564 - DNA, 13 bp, Homo sapiens
cccttcagtgccc

SEQ ID NO: 5394565 - DNA, 15 bp, Homo sapiens
cccttcatcttcctg

SEQ ID NO: 5394566 - DNA, 16 bp, Homo sapiens
cccttcatgcatggaa

SEQ ID NO: 5394567 - DNA, 11 bp, Homo sapiens
cccttcatgtc

SEQ ID NO: 5394568 - DNA, 12 bp, Homo sapiens
cccttcatgtcc

SEQ ID NO: 5394569 - DNA, 21 bp, Homo sapiens
cccttcatgtcctaaagaaga

SEQ ID NO: 5394570 - DNA, 14 bp, Homo sapiens
cccttcatgtttta

SEQ ID NO: 5394571 - DNA, 18 bp, Homo sapiens
cccttccaaatgtccctc

SEQ ID NO: 5394572 - DNA, 12 bp, Homo sapiens
cccttccacctc

SEQ ID NO: 5394573 - DNA, 13 bp, Homo sapiens
cccttccacttct

SEQ ID NO: 5394574 - DNA, 21 bp, Homo sapiens
cccttccacttctaactccac

SEQ ID NO: 5394575 - DNA, 13 bp, Homo sapiens
cccttccagacat

SEQ ID NO: 5394576 - DNA, 13 bp, Homo sapiens
cccttccagcctg

SEQ ID NO: 5394577 - DNA, 18 bp, Homo sapiens
cccttccagcctgggaca

SEQ ID NO: 5394578 - DNA, 22 bp, Homo sapiens
cccttccaggaatgctgggccc

SEQ ID NO: 5394579 - DNA, 13 bp, Homo sapiens
cccttccaggagt

SEQ ID NO: 5394580 - DNA, 13 bp, Homo sapiens
cccttccaggggt

SEQ ID NO: 5394581 - DNA, 21 bp, Homo sapiens
cccttccaggtgggtgtggga

SEQ ID NO: 5394582 - DNA, 12 bp, Homo sapiens
cccttccagtgg

SEQ ID NO: 5394583 - DNA, 24 bp, Homo sapiens
cccttccagtggtaccagctcact

SEQ ID NO: 5394584 - DNA, 17 bp, Homo sapiens
cccttccatgccctggg

SEQ ID NO: 5394585 - DNA, 14 bp, Homo sapiens
cccttccatttcta

SEQ ID NO: 5394586 - DNA, 18 bp, Homo sapiens
cccttcccaatcagcact

SEQ ID NO: 5394587 - DNA, 11 bp, Homo sapiens
cccttcccaca

SEQ ID NO: 5394588 - DNA, 14 bp, Homo sapiens
cccttcccacagga

SEQ ID NO: 5394589 - DNA, 23 bp, Homo sapiens
cccttcccacaggacatttctct

SEQ ID NO: 5394590 - DNA, 13 bp, Homo sapiens
cccttcccacccc

SEQ ID NO: 5394591 - DNA, 12 bp, Homo sapiens
cccttcccacct

SEQ ID NO: 5394592 - DNA, 19 bp, Homo sapiens
cccttcccacctactgcac

SEQ ID NO: 5394593 - DNA, 13 bp, Homo sapiens
cccttcccacctc

SEQ ID NO: 5394594 - DNA, 18 bp, Homo sapiens
cccttcccagaccaggaa

SEQ ID NO: 5394595 - DNA, 19 bp, Homo sapiens
cccttcccagccagcccgc

SEQ ID NO: 5394596 - DNA, 15 bp, Homo sapiens
cccttcccagccctc

SEQ ID NO: 5394597 - DNA, 17 bp, Homo sapiens
cccttcccagccctcat

SEQ ID NO: 5394598 - DNA, 16 bp, Homo sapiens
cccttcccagggcacc

SEQ ID NO: 5394599 - DNA, 21 bp, Homo sapiens
cccttcccatgacccaggctg

SEQ ID NO: 5394600 - DNA, 17 bp, Homo sapiens
cccttcccatttcttcc

SEQ ID NO: 5394601 - DNA, 19 bp, Homo sapiens
cccttcccatttcttccca

SEQ ID NO: 5394602 - DNA, 14 bp, Homo sapiens
cccttccccaagaa

SEQ ID NO: 5394603 - DNA, 12 bp, Homo sapiens
cccttccccact

SEQ ID NO: 5394604 - DNA, 14 bp, Homo sapiens
cccttccccactcc

SEQ ID NO: 5394605 - DNA, 18 bp, Homo sapiens
cccttccccactcccgtg

SEQ ID NO: 5394606 - DNA, 19 bp, Homo sapiens
cccttccccagcccttagc

SEQ ID NO: 5394607 - DNA, 17 bp, Homo sapiens
cccttccccatcctggg

SEQ ID NO: 5394608 - DNA, 20 bp, Homo sapiens
cccttccccatgaaccctgc

SEQ ID NO: 5394609 - DNA, 18 bp, Homo sapiens
cccttccccatgcttcct

SEQ ID NO: 5394610 - DNA, 12 bp, Homo sapiens
cccttccccctg

SEQ ID NO: 5394611 - DNA, 23 bp, Homo sapiens
cccttccccgctcttgccctgcc

SEQ ID NO: 5394612 - DNA, 14 bp, Homo sapiens
cccttccccgtccc

SEQ ID NO: 5394613 - DNA, 17 bp, Homo sapiens
cccttccccgtcccctg

SEQ ID NO: 5394614 - DNA, 22 bp, Homo sapiens
cccttcccctcccccactcctc

SEQ ID NO: 5394615 - DNA, 21 bp, Homo sapiens
cccttcccctgcgccctccct

SEQ ID NO: 5394616 - DNA, 16 bp, Homo sapiens
cccttcccctgggaac

SEQ ID NO: 5394617 - DNA, 17 bp, Homo sapiens
cccttcccctgggaact

SEQ ID NO: 5394618 - DNA, 16 bp, Homo sapiens
cccttcccctgtgact

SEQ ID NO: 5394619 - DNA, 23 bp, Homo sapiens
cccttcccctgtgactcctccct

SEQ ID NO: 5394620 - DNA, 14 bp, Homo sapiens
cccttccccttcct

SEQ ID NO: 5394621 - DNA, 22 bp, Homo sapiens
cccttcccctttactcagccca

SEQ ID NO: 5394622 - DNA, 15 bp, Homo sapiens
cccttcccgacccag

SEQ ID NO: 5394623 - DNA, 19 bp, Homo sapiens
cccttcccgacccagccag

SEQ ID NO: 5394624 - DNA, 20 bp, Homo sapiens
cccttcccgacccagccagc

SEQ ID NO: 5394625 - DNA, 18 bp, Homo sapiens
cccttcccgccctcggga

SEQ ID NO: 5394626 - DNA, 15 bp, Homo sapiens
cccttccctatagga

SEQ ID NO: 5394627 - DNA, 17 bp, Homo sapiens
cccttccctcacccctg

SEQ ID NO: 5394628 - DNA, 15 bp, Homo sapiens
cccttccctccctga

SEQ ID NO: 5394629 - DNA, 21 bp, Homo sapiens
cccttccctctgggcacgcct

SEQ ID NO: 5394630 - DNA, 15 bp, Homo sapiens
cccttccctctgttg

SEQ ID NO: 5394631 - DNA, 13 bp, Homo sapiens
cccttccctcttc

SEQ ID NO: 5394632 - DNA, 12 bp, Homo sapiens
cccttccctgca

SEQ ID NO: 5394633 - DNA, 13 bp, Homo sapiens
cccttccctgcac

SEQ ID NO: 5394634 - DNA, 15 bp, Homo sapiens
cccttccctgcctcc

SEQ ID NO: 5394635 - DNA, 16 bp, Homo sapiens
cccttccctggcaggt

SEQ ID NO: 5394636 - DNA, 13 bp, Homo sapiens
cccttccctggcc

SEQ ID NO: 5394637 - DNA, 13 bp, Homo sapiens
cccttccctgggg

SEQ ID NO: 5394638 - DNA, 16 bp, Homo sapiens
cccttccctggggagc

SEQ ID NO: 5394639 - DNA, 20 bp, Homo sapiens
cccttccctggggagccctc

SEQ ID NO: 5394640 - DNA, 14 bp, Homo sapiens
cccttccctgtccc

SEQ ID NO: 5394641 - DNA, 16 bp, Homo sapiens
cccttccctgtccctc

SEQ ID NO: 5394642 - DNA, 16 bp, Homo sapiens
cccttccctgtccttg

SEQ ID NO: 5394643 - DNA, 13 bp, Homo sapiens
cccttcccttccc

SEQ ID NO: 5394644 - DNA, 17 bp, Homo sapiens
cccttcccttgagccct

SEQ ID NO: 5394645 - DNA, 18 bp, Homo sapiens
cccttccgaccctctggg

SEQ ID NO: 5394646 - DNA, 23 bp, Homo sapiens
cccttccgcagtgtggccaggct

SEQ ID NO: 5394647 - DNA, 15 bp, Homo sapiens
cccttccgccactgg

SEQ ID NO: 5394648 - DNA, 16 bp, Homo sapiens
cccttccgccactggg

SEQ ID NO: 5394649 - DNA, 20 bp, Homo sapiens
cccttccgtccatccccctt

SEQ ID NO: 5394650 - DNA, 13 bp, Homo sapiens
cccttcctaattc

SEQ ID NO: 5394651 - DNA, 19 bp, Homo sapiens
cccttcctaattccacagc

SEQ ID NO: 5394652 - DNA, 21 bp, Homo sapiens
cccttcctaattccacagctg

SEQ ID NO: 5394653 - DNA, 22 bp, Homo sapiens
cccttcctactcctcatagcat

SEQ ID NO: 5394654 - DNA, 21 bp, Homo sapiens
cccttcctagtgaaccacagg

SEQ ID NO: 5394655 - DNA, 18 bp, Homo sapiens
cccttcctattctcctgc

SEQ ID NO: 5394656 - DNA, 21 bp, Homo sapiens
cccttcctattctcctgccat

SEQ ID NO: 5394657 - DNA, 11 bp, Homo sapiens
cccttcctcac

SEQ ID NO: 5394658 - DNA, 20 bp, Homo sapiens
cccttcctcagcctggggtt

SEQ ID NO: 5394659 - DNA, 18 bp, Homo sapiens
cccttcctcatctgtgcc

SEQ ID NO: 5394660 - DNA, 19 bp, Homo sapiens
cccttcctcatctgtgcct

SEQ ID NO: 5394661 - DNA, 21 bp, Homo sapiens
cccttcctcatctgtgcctgt

SEQ ID NO: 5394662 - DNA, 20 bp, Homo sapiens
cccttcctccccaacctgca

SEQ ID NO: 5394663 - DNA, 13 bp, Homo sapiens
cccttcctcccgg

SEQ ID NO: 5394664 - DNA, 22 bp, Homo sapiens
cccttcctcccggggccttcct

SEQ ID NO: 5394665 - DNA, 13 bp, Homo sapiens
cccttcctccgct

SEQ ID NO: 5394666 - DNA, 13 bp, Homo sapiens
cccttcctcctcc

SEQ ID NO: 5394667 - DNA, 22 bp, Homo sapiens
cccttcctcctctcctggaaac

SEQ ID NO: 5394668 - DNA, 21 bp, Homo sapiens
cccttcctcctgaagcctctg

SEQ ID NO: 5394669 - DNA, 11 bp, Homo sapiens
ccgactcaggg

SEQ ID NO: 5394670 - DNA, 12 bp, Homo sapiens
ccgactcaggga

SEQ ID NO: 5394671 - DNA, 15 bp, Homo sapiens
ccgactccagccagc

SEQ ID NO: 5394672 - DNA, 13 bp, Homo sapiens
ccgactcccccaa

SEQ ID NO: 5394673 - DNA, 21 bp, Homo sapiens
ccgactcccccaaccaaggaa

SEQ ID NO: 5394674 - DNA, 15 bp, Homo sapiens
ccgactccccctccc

SEQ ID NO: 5394675 - DNA, 19 bp, Homo sapiens
ccgactccccctccccggc

SEQ ID NO: 5394676 - DNA, 16 bp, Homo sapiens
ccgactccctccccag

SEQ ID NO: 5394677 - DNA, 21 bp, Homo sapiens
ccgactccctgagtctggacc

SEQ ID NO: 5394678 - DNA, 15 bp, Homo sapiens
ccgactctaagctgt

SEQ ID NO: 5394679 - DNA, 16 bp, Homo sapiens
ccgactctaagctgtg

SEQ ID NO: 5394680 - DNA, 14 bp, Homo sapiens
ccgactctctccat

SEQ ID NO: 5394681 - DNA, 14 bp, Homo sapiens
ccgactctgcactc

SEQ ID NO: 5394682 - DNA, 21 bp, Homo sapiens
ccgactctttctgagtgcctt

SEQ ID NO: 5394683 - DNA, 12 bp, Homo sapiens
ccgactgaccct

SEQ ID NO: 5394684 - DNA, 15 bp, Homo sapiens
ccgactgaccctgag

SEQ ID NO: 5394685 - DNA, 17 bp, Homo sapiens
ccgactgaccctgagga

SEQ ID NO: 5394686 - DNA, 23 bp, Homo sapiens
ccgactgaccctgaggaggccgc

SEQ ID NO: 5394687 - DNA, 22 bp, Homo sapiens
ccgactgactggaggaggcctg

SEQ ID NO: 5394688 - DNA, 13 bp, Homo sapiens
ccgactgcccaga

SEQ ID NO: 5394689 - DNA, 16 bp, Homo sapiens
ccgactgcccagccac

SEQ ID NO: 5394690 - DNA, 16 bp, Homo sapiens
ccgactgcctgtctcc

SEQ ID NO: 5394691 - DNA, 14 bp, Homo sapiens
ccgactgcgctgct

SEQ ID NO: 5394692 - DNA, 23 bp, Homo sapiens
ccgactgcgctgctttttcaaaa

SEQ ID NO: 5394693 - DNA, 16 bp, Homo sapiens
ccgactggctgtgaga

SEQ ID NO: 5394694 - DNA, 16 bp, Homo sapiens
ccgactgggctgctgg

SEQ ID NO: 5394695 - DNA, 15 bp, Homo sapiens
ccgactggggcaggg

SEQ ID NO: 5394696 - DNA, 21 bp, Homo sapiens
ccgacttgaattttcccactg

SEQ ID NO: 5394697 - DNA, 16 bp, Homo sapiens
ccgacttgctgttttg

SEQ ID NO: 5394698 - DNA, 23 bp, Homo sapiens
ccgacttgctgttttgttctgtg

SEQ ID NO: 5394699 - DNA, 22 bp, Homo sapiens
ccgacttttgtttaccagagaa

SEQ ID NO: 5394700 - DNA, 12 bp, Homo sapiens
ccgagaaaagga

SEQ ID NO: 5394701 - DNA, 21 bp, Homo sapiens
ccgagaagcacttgagcatga

SEQ ID NO: 5394702 - DNA, 17 bp, Homo sapiens
ccgagaaggaagcctcc

SEQ ID NO: 5394703 - DNA, 18 bp, Homo sapiens
ccgagaagggggtgacag

SEQ ID NO: 5394704 - DNA, 14 bp, Homo sapiens
ccgagaatgccgag

SEQ ID NO: 5394705 - DNA, 19 bp, Homo sapiens
ccgagacaccatcctgagc

SEQ ID NO: 5394706 - DNA, 21 bp, Homo sapiens
ccgagacaccatcctgagcca

SEQ ID NO: 5394707 - DNA, 15 bp, Homo sapiens
ccgagacactttata

SEQ ID NO: 5394708 - DNA, 15 bp, Homo sapiens
ccgagacatgaatac

SEQ ID NO: 5394709 - DNA, 15 bp, Homo sapiens
ccgagactcagcctc

SEQ ID NO: 5394710 - DNA, 19 bp, Homo sapiens
ccgagactcagcctctgct

SEQ ID NO: 5394711 - DNA, 21 bp, Homo sapiens
ccgagagagctctggccccgc

SEQ ID NO: 5394712 - DNA, 23 bp, Homo sapiens
ccgagagagctctggccccgcta

SEQ ID NO: 5394713 - DNA, 15 bp, Homo sapiens
ccgagagccaaacag

SEQ ID NO: 5394714 - DNA, 15 bp, Homo sapiens
ccgagagcctgctcc

SEQ ID NO: 5394715 - DNA, 21 bp, Homo sapiens
ccgagagctcttagtttttaa

SEQ ID NO: 5394716 - DNA, 21 bp, Homo sapiens
ccgagagcttggactacacaa

SEQ ID NO: 5394717 - DNA, 17 bp, Homo sapiens
ccgagaggacagaatgg

SEQ ID NO: 5394718 - DNA, 13 bp, Homo sapiens
ccgagagggagag

SEQ ID NO: 5394719 - DNA, 19 bp, Homo sapiens
ccgagaggtgggccagtct

SEQ ID NO: 5394720 - DNA, 21 bp, Homo sapiens
ccgagagtagccgagagcctg

SEQ ID NO: 5394721 - DNA, 19 bp, Homo sapiens
ccgagatagccaaggccaa

SEQ ID NO: 5394722 - DNA, 23 bp, Homo sapiens
ccgagatagggtggcacatctgt

SEQ ID NO: 5394723 - DNA, 18 bp, Homo sapiens
ccgagatcacgccactgc

SEQ ID NO: 5394724 - DNA, 21 bp, Homo sapiens
ccgagatcacgccactgcact

SEQ ID NO: 5394725 - DNA, 18 bp, Homo sapiens
ccgagatccccagggcag

SEQ ID NO: 5394726 - DNA, 20 bp, Homo sapiens
ccgagatgtgacccaccagt

SEQ ID NO: 5394727 - DNA, 21 bp, Homo sapiens
ccgagatgtgacccaccagtg

SEQ ID NO: 5394728 - DNA, 21 bp, Homo sapiens
ccgagattgcaccactgcact

SEQ ID NO: 5394729 - DNA, 15 bp, Homo sapiens
ccgagcaaagatcaa

SEQ ID NO: 5394730 - DNA, 21 bp, Homo sapiens
ccgagcaaagatcaaaataaa

SEQ ID NO: 5394731 - DNA, 14 bp, Homo sapiens
ccgagcaaccgtgg

SEQ ID NO: 5394732 - DNA, 18 bp, Homo sapiens
ccgagcaaccgtggccct

SEQ ID NO: 5394733 - DNA, 22 bp, Homo sapiens
ccgagcaatatttatggatgca

SEQ ID NO: 5394734 - DNA, 22 bp, Homo sapiens
ccgagcacatagagctttttaa

SEQ ID NO: 5394735 - DNA, 16 bp, Homo sapiens
ccgagcagctgagcag

SEQ ID NO: 5394736 - DNA, 14 bp, Homo sapiens
ccgagccaccccag

SEQ ID NO: 5394737 - DNA, 23 bp, Homo sapiens
ccgagccacgcagtgcctggagt

SEQ ID NO: 5394738 - DNA, 23 bp, Homo sapiens
ccgagccatgtgtctttacacct

SEQ ID NO: 5394739 - DNA, 13 bp, Homo sapiens
ccgagcccacacc

SEQ ID NO: 5394740 - DNA, 19 bp, Homo sapiens
ccgagcccacaccatctgg

SEQ ID NO: 5394741 - DNA, 20 bp, Homo sapiens
ccgagcccagctacattcct

SEQ ID NO: 5394742 - DNA, 21 bp, Homo sapiens
ccgagcccagctacattcctc

SEQ ID NO: 5394743 - DNA, 22 bp, Homo sapiens
ccgagcccaggcagctatttca

SEQ ID NO: 5394744 - DNA, 16 bp, Homo sapiens
ccgagcccaggggagg

SEQ ID NO: 5394745 - DNA, 18 bp, Homo sapiens
ccgagccccctgtccttc

SEQ ID NO: 5394746 - DNA, 11 bp, Homo sapiens
ccgagcccctg

SEQ ID NO: 5394747 - DNA, 21 bp, Homo sapiens
ccgagcccctgcccacgccct

SEQ ID NO: 5394748 - DNA, 14 bp, Homo sapiens
ccgagccctggaga

SEQ ID NO: 5394749 - DNA, 17 bp, Homo sapiens
ccgagccgagctctcct

SEQ ID NO: 5394750 - DNA, 16 bp, Homo sapiens
ccgagccgggcctggg

SEQ ID NO: 5394751 - DNA, 21 bp, Homo sapiens
ccgagcctctgtcactgcagg

SEQ ID NO: 5394752 - DNA, 16 bp, Homo sapiens
ccgagcctggctccaa

SEQ ID NO: 5394753 - DNA, 18 bp, Homo sapiens
ccgagcgacggctcctcc

SEQ ID NO: 5394754 - DNA, 19 bp, Homo sapiens
ccgagcgacggctcctccc

SEQ ID NO: 5394755 - DNA, 12 bp, Homo sapiens
ccgagcgctggt

SEQ ID NO: 5394756 - DNA, 18 bp, Homo sapiens
ccgagcgctttctggaaa

SEQ ID NO: 5394757 - DNA, 13 bp, Homo sapiens
ccgagctcctggg

SEQ ID NO: 5394758 - DNA, 13 bp, Homo sapiens
ccgagctctggtg

SEQ ID NO: 5394759 - DNA, 13 bp, Homo sapiens
ccgagctctgtcc

SEQ ID NO: 5394760 - DNA, 19 bp, Homo sapiens
ccgagctctgtcctctgtc

SEQ ID NO: 5394761 - DNA, 13 bp, Homo sapiens
ccgagctctgtgg

SEQ ID NO: 5394762 - DNA, 14 bp, Homo sapiens
ccgagctcttggcc

SEQ ID NO: 5394763 - DNA, 15 bp, Homo sapiens
ccgagctcttggcct

SEQ ID NO: 5394764 - DNA, 18 bp, Homo sapiens
ccgagctcttggcctttg

SEQ ID NO: 5394765 - DNA, 17 bp, Homo sapiens
ccgagctgaggactctg

SEQ ID NO: 5394766 - DNA, 15 bp, Homo sapiens
ccgagctgcctggcg

SEQ ID NO: 5394767 - DNA, 16 bp, Homo sapiens
ccgagctgggggccat

SEQ ID NO: 5394768 - DNA, 16 bp, Homo sapiens
ccgagctgtcggaggg

SEQ ID NO: 5394769 - DNA, 19 bp, Homo sapiens
ccgagctgtcggagggctg

SEQ ID NO: 5394770 - DNA, 14 bp, Homo sapiens
ccgagctgtttatg

SEQ ID NO: 5394771 - DNA, 21 bp, Homo sapiens
ccgagcttgggataaagcaag

SEQ ID NO: 5394772 - DNA, 19 bp, Homo sapiens
ccgagctttgaaaattcag

SEQ ID NO: 5394773 - DNA, 14 bp, Homo sapiens
ccgaggaaactcag

SEQ ID NO: 5394774 - DNA, 18 bp, Homo sapiens
ccgaggaactcgcctcag

SEQ ID NO: 5394775 - DNA, 18 bp, Homo sapiens
ccgaggacagcctgcctc

SEQ ID NO: 5394776 - DNA, 18 bp, Homo sapiens
ccgaggacccagacccag

SEQ ID NO: 5394777 - DNA, 23 bp, Homo sapiens
ccgaggacccatgaaacagcagc

SEQ ID NO: 5394778 - DNA, 10 bp, Homo sapiens
ccgaggactc

SEQ ID NO: 5394779 - DNA, 12 bp, Homo sapiens
ccgaggactgga

SEQ ID NO: 5394780 - DNA, 16 bp, Homo sapiens
ccgaggagccaggcaa

SEQ ID NO: 5394781 - DNA, 19 bp, Homo sapiens
ccgaggagccccagccccg

SEQ ID NO: 5394782 - DNA, 18 bp, Homo sapiens
ccgaggagctgggcccct

SEQ ID NO: 5394783 - DNA, 22 bp, Homo sapiens
ccgaggatttctgggaccccgc

SEQ ID NO: 5394784 - DNA, 19 bp, Homo sapiens
ccgaggcaccagtgtcctc

SEQ ID NO: 5394785 - DNA, 14 bp, Homo sapiens
ccgaggcaggcaga

SEQ ID NO: 5394786 - DNA, 17 bp, Homo sapiens
ccgaggcaggggctggg

SEQ ID NO: 5394787 - DNA, 19 bp, Homo sapiens
ccgaggcccagcgggcaga

SEQ ID NO: 5394788 - DNA, 16 bp, Homo sapiens
ccgaggcccccctctg

SEQ ID NO: 5394789 - DNA, 17 bp, Homo sapiens
ccgaggcccccctctgc

SEQ ID NO: 5394790 - DNA, 21 bp, Homo sapiens
ccgaggcccccctctgccttt

SEQ ID NO: 5394791 - DNA, 13 bp, Homo sapiens
ccgaggccctgca

SEQ ID NO: 5394792 - DNA, 11 bp, Homo sapiens
ccgaggcctgg

SEQ ID NO: 5394793 - DNA, 16 bp, Homo sapiens
ccgaggcctggctctg

SEQ ID NO: 5394794 - DNA, 18 bp, Homo sapiens
ccgaggcctggctctgga

SEQ ID NO: 5394795 - DNA, 22 bp, Homo sapiens
ccgaggcctggctctggagccc

SEQ ID NO: 5394796 - DNA, 18 bp, Homo sapiens
ccgaggctacagctccac

SEQ ID NO: 5394797 - DNA, 13 bp, Homo sapiens
ccgaggctccccg

SEQ ID NO: 5394798 - DNA, 21 bp, Homo sapiens
ccgaggctcgagctcggggct

SEQ ID NO: 5394799 - DNA, 18 bp, Homo sapiens
ccgaggctgccccaggcc

SEQ ID NO: 5394800 - DNA, 12 bp, Homo sapiens
ccgagggaaatg

SEQ ID NO: 5394801 - DNA, 15 bp, Homo sapiens
ccgagggagctgctg

SEQ ID NO: 5394802 - DNA, 17 bp, Homo sapiens
ccgagggagctgctggc

SEQ ID NO: 5394803 - DNA, 18 bp, Homo sapiens
ccgagggagctgctggct

SEQ ID NO: 5394804 - DNA, 22 bp, Homo sapiens
ccgagggaggggaagcttctgt

SEQ ID NO: 5394805 - DNA, 18 bp, Homo sapiens
ccgagggatgatgccaca

SEQ ID NO: 5394806 - DNA, 14 bp, Homo sapiens
ccgagggccaggca

SEQ ID NO: 5394807 - DNA, 12 bp, Homo sapiens
ccgagggcctga

SEQ ID NO: 5394808 - DNA, 16 bp, Homo sapiens
ccgagggcctgacagg

SEQ ID NO: 5394809 - DNA, 14 bp, Homo sapiens
ccgagggcgtcaga

SEQ ID NO: 5394810 - DNA, 17 bp, Homo sapiens
ccgagggctcagaagag

SEQ ID NO: 5394811 - DNA, 16 bp, Homo sapiens
ccgagggctgaggagc

SEQ ID NO: 5394812 - DNA, 18 bp, Homo sapiens
ccgagggctgaggagcag

SEQ ID NO: 5394813 - DNA, 22 bp, Homo sapiens
ccgagggctgaggagcagccag

SEQ ID NO: 5394814 - DNA, 23 bp, Homo sapiens
ccgagggctgaggagcagccagg

SEQ ID NO: 5394815 - DNA, 12 bp, Homo sapiens
ccgagggctggc

SEQ ID NO: 5394816 - DNA, 16 bp, Homo sapiens
ccgaggggagggcagg

SEQ ID NO: 5394817 - DNA, 18 bp, Homo sapiens
ccgaggggagggcaggat

SEQ ID NO: 5394818 - DNA, 13 bp, Homo sapiens
ccgaggggcggga

SEQ ID NO: 5394819 - DNA, 23 bp, Homo sapiens
ccgaggggcgggacccaggcacc

SEQ ID NO: 5394820 - DNA, 14 bp, Homo sapiens
ccgagggtcccaag

SEQ ID NO: 5394821 - DNA, 19 bp, Homo sapiens
ccgagggtcctggctcctg

SEQ ID NO: 5394822 - DNA, 21 bp, Homo sapiens
ccgagggtcctggctcctgag

SEQ ID NO: 5394823 - DNA, 17 bp, Homo sapiens
ccgagggttgattaagg

SEQ ID NO: 5394824 - DNA, 22 bp, Homo sapiens
ccgagggttgattaaggcagta

SEQ ID NO: 5394825 - DNA, 17 bp, Homo sapiens
ccgaggtcactctgggc

SEQ ID NO: 5394826 - DNA, 18 bp, Homo sapiens
ccgaggtcactctgggcc

SEQ ID NO: 5394827 - DNA, 16 bp, Homo sapiens
ccgaggtccctgctgc

SEQ ID NO: 5394828 - DNA, 17 bp, Homo sapiens
ccgaggtggttttaaag

SEQ ID NO: 5394829 - DNA, 17 bp, Homo sapiens
ccgaggttgtggggagg

SEQ ID NO: 5394830 - DNA, 20 bp, Homo sapiens
ccgaggttgtggggaggctg

SEQ ID NO: 5394831 - DNA, 21 bp, Homo sapiens
ccgagtaatgacgtgtgtggc

SEQ ID NO: 5394832 - DNA, 13 bp, Homo sapiens
ccgagtacagtct

SEQ ID NO: 5394833 - DNA, 18 bp, Homo sapiens
ccgagtagaaaatgtgac

SEQ ID NO: 5394834 - DNA, 14 bp, Homo sapiens
ccgagtagctggga

SEQ ID NO: 5394835 - DNA, 16 bp, Homo sapiens
ccgagtagctgggact

SEQ ID NO: 5394836 - DNA, 14 bp, Homo sapiens
ccgagtatctgtaa

SEQ ID NO: 5394837 - DNA, 18 bp, Homo sapiens
ccgagtccgcccatccct

SEQ ID NO: 5394838 - DNA, 16 bp, Homo sapiens
ccgagtccgcgctggg

SEQ ID NO: 5394839 - DNA, 16 bp, Homo sapiens
ccgagtctcttctcca

SEQ ID NO: 5394840 - DNA, 18 bp, Homo sapiens
ccgagtctcttctccact

SEQ ID NO: 5394841 - DNA, 22 bp, Homo sapiens
ccgagtctcttctccactggat

SEQ ID NO: 5394842 - DNA, 17 bp, Homo sapiens
ccgagtctgggacacaa

SEQ ID NO: 5394843 - DNA, 14 bp, Homo sapiens
ccgagtctgtcctg

SEQ ID NO: 5394844 - DNA, 22 bp, Homo sapiens
ccgagtctgtttttcatgcgat

SEQ ID NO: 5394845 - DNA, 19 bp, Homo sapiens
ccgagtctttctcactgcc

SEQ ID NO: 5394846 - DNA, 20 bp, Homo sapiens
ccgagtgaactggtcttcct

SEQ ID NO: 5394847 - DNA, 14 bp, Homo sapiens
ccgccgctgcacat

SEQ ID NO: 5394848 - DNA, 13 bp, Homo sapiens
ccgccgctgccct

SEQ ID NO: 5394849 - DNA, 13 bp, Homo sapiens
ccgccgcttttct

SEQ ID NO: 5394850 - DNA, 16 bp, Homo sapiens
ccgccggaggccagct

SEQ ID NO: 5394851 - DNA, 19 bp, Homo sapiens
ccgccggaggccagctatc

SEQ ID NO: 5394852 - DNA, 15 bp, Homo sapiens
ccgccggggtcctgg

SEQ ID NO: 5394853 - DNA, 16 bp, Homo sapiens
ccgccggggtcctggg

SEQ ID NO: 5394854 - DNA, 17 bp, Homo sapiens
ccgccggggtcctggga

SEQ ID NO: 5394855 - DNA, 18 bp, Homo sapiens
ccgccggggtcctgggag

SEQ ID NO: 5394856 - DNA, 22 bp, Homo sapiens
ccgccggggtcctgggaggctg

SEQ ID NO: 5394857 - DNA, 23 bp, Homo sapiens
ccgccggggtcctgggaggctgc

SEQ ID NO: 5394858 - DNA, 18 bp, Homo sapiens
ccgccgtctgcaggggcc

SEQ ID NO: 5394859 - DNA, 22 bp, Homo sapiens
ccgccgtctgcaggggcctgga

SEQ ID NO: 5394860 - DNA, 20 bp, Homo sapiens
ccgccgtgtctgtggccctc

SEQ ID NO: 5394861 - DNA, 23 bp, Homo sapiens
ccgccgtgtctgtggccctctct

SEQ ID NO: 5394862 - DNA, 18 bp, Homo sapiens
ccgcctagtttactgttt

SEQ ID NO: 5394863 - DNA, 17 bp, Homo sapiens
ccgcctatcccaaacct

SEQ ID NO: 5394864 - DNA, 15 bp, Homo sapiens
ccgcctcaaggaaga

SEQ ID NO: 5394865 - DNA, 23 bp, Homo sapiens
ccgcctcaatgtggttgcaaggc

SEQ ID NO: 5394866 - DNA, 13 bp, Homo sapiens
ccgcctcactggg

SEQ ID NO: 5394867 - DNA, 14 bp, Homo sapiens
ccgcctcactgggt

SEQ ID NO: 5394868 - DNA, 15 bp, Homo sapiens
ccgcctcactgggtg

SEQ ID NO: 5394869 - DNA, 15 bp, Homo sapiens
ccgcctcagggccag

SEQ ID NO: 5394870 - DNA, 21 bp, Homo sapiens
ccgcctcagggccaggcccag

SEQ ID NO: 5394871 - DNA, 23 bp, Homo sapiens
ccgcctccactctagttctagat

SEQ ID NO: 5394872 - DNA, 13 bp, Homo sapiens
ccgcctccagcac

SEQ ID NO: 5394873 - DNA, 14 bp, Homo sapiens
ccgcctccaggagc

SEQ ID NO: 5394874 - DNA, 14 bp, Homo sapiens
ccgcctcccagcct

SEQ ID NO: 5394875 - DNA, 15 bp, Homo sapiens
ccgcctcccagcctg

SEQ ID NO: 5394876 - DNA, 21 bp, Homo sapiens
ccgcctccccatacttcctgg

SEQ ID NO: 5394877 - DNA, 16 bp, Homo sapiens
ccgcctcccgccaccc

SEQ ID NO: 5394878 - DNA, 17 bp, Homo sapiens
ccgcctcccgccaccct

SEQ ID NO: 5394879 - DNA, 19 bp, Homo sapiens
ccgcctcccgccaccctgt

SEQ ID NO: 5394880 - DNA, 18 bp, Homo sapiens
ccgcctcccgggaagcat

SEQ ID NO: 5394881 - DNA, 21 bp, Homo sapiens
ccgcctccctctcagaggcct

SEQ ID NO: 5394882 - DNA, 17 bp, Homo sapiens
ccgcctccgggaccccc

SEQ ID NO: 5394883 - DNA, 22 bp, Homo sapiens
ccgcctccgggacccccaggac

SEQ ID NO: 5394884 - DNA, 23 bp, Homo sapiens
ccgcctccgggacccccaggaca

SEQ ID NO: 5394885 - DNA, 11 bp, Homo sapiens
ccgcctcctcc

SEQ ID NO: 5394886 - DNA, 13 bp, Homo sapiens
ccgcctcctccag

SEQ ID NO: 5394887 - DNA, 21 bp, Homo sapiens
ccgcctcctcggggctccagg

SEQ ID NO: 5394888 - DNA, 22 bp, Homo sapiens
ccgcctcctcggggctccaggc

SEQ ID NO: 5394889 - DNA, 10 bp, Homo sapiens
ccgcctcctg

SEQ ID NO: 5394890 - DNA, 14 bp, Homo sapiens
ccgcctcgcccacc

SEQ ID NO: 5394891 - DNA, 15 bp, Homo sapiens
ccgcctcgcccaccg

SEQ ID NO: 5394892 - DNA, 18 bp, Homo sapiens
ccgcctcgcccaccgcat

SEQ ID NO: 5394893 - DNA, 15 bp, Homo sapiens
ccgcctcgcccccgg

SEQ ID NO: 5394894 - DNA, 15 bp, Homo sapiens
ccgcctcgggccgcc

SEQ ID NO: 5394895 - DNA, 16 bp, Homo sapiens
ccgcctcgggccgcct

SEQ ID NO: 5394896 - DNA, 16 bp, Homo sapiens
ccgcctcgtgccagca

SEQ ID NO: 5394897 - DNA, 20 bp, Homo sapiens
ccgcctcgtgccagcagcct

SEQ ID NO: 5394898 - DNA, 13 bp, Homo sapiens
ccgcctctcccgt

SEQ ID NO: 5394899 - DNA, 20 bp, Homo sapiens
ccgcctctcccgtcagggcc

SEQ ID NO: 5394900 - DNA, 16 bp, Homo sapiens
ccgcctctgagccagg

SEQ ID NO: 5394901 - DNA, 16 bp, Homo sapiens
ccgcctctgcccgcag

SEQ ID NO: 5394902 - DNA, 18 bp, Homo sapiens
ccgcctctgcccgcagag

SEQ ID NO: 5394903 - DNA, 12 bp, Homo sapiens
ccgcctctgcct

SEQ ID NO: 5394904 - DNA, 11 bp, Homo sapiens
ccgcctctggc

SEQ ID NO: 5394905 - DNA, 14 bp, Homo sapiens
ccgcctctgggctc

SEQ ID NO: 5394906 - DNA, 17 bp, Homo sapiens
ccgcctctgtctggagc

SEQ ID NO: 5394907 - DNA, 12 bp, Homo sapiens
ccgcctcttccc

SEQ ID NO: 5394908 - DNA, 17 bp, Homo sapiens
ccgcctgaaggcacagc

SEQ ID NO: 5394909 - DNA, 16 bp, Homo sapiens
ccgcctgaggccagcc

SEQ ID NO: 5394910 - DNA, 19 bp, Homo sapiens
ccgcctgagtcagtgctct

SEQ ID NO: 5394911 - DNA, 22 bp, Homo sapiens
ccgcctgagtcagtgctctcag

SEQ ID NO: 5394912 - DNA, 23 bp, Homo sapiens
ccgcctgcagtcttctgggctgc

SEQ ID NO: 5394913 - DNA, 12 bp, Homo sapiens
ccgcctgccacc

SEQ ID NO: 5394914 - DNA, 14 bp, Homo sapiens
ccgcctgccacctc

SEQ ID NO: 5394915 - DNA, 22 bp, Homo sapiens
ccgcctgccagtcctagctgca

SEQ ID NO: 5394916 - DNA, 20 bp, Homo sapiens
ccgcctgccataccgctggg

SEQ ID NO: 5394917 - DNA, 14 bp, Homo sapiens
ccgcctgcccacct

SEQ ID NO: 5394918 - DNA, 16 bp, Homo sapiens
ccgcctgcccacctgc

SEQ ID NO: 5394919 - DNA, 21 bp, Homo sapiens
ccgcctgcccacctgcctggc

SEQ ID NO: 5394920 - DNA, 14 bp, Homo sapiens
ccgcctgccctcat

SEQ ID NO: 5394921 - DNA, 13 bp, Homo sapiens
ccgcctgccctgc

SEQ ID NO: 5394922 - DNA, 14 bp, Homo sapiens
ccgcctgccctgcc

SEQ ID NO: 5394923 - DNA, 17 bp, Homo sapiens
ccgcctgccctgccttg

SEQ ID NO: 5394924 - DNA, 18 bp, Homo sapiens
ccgcctgccctgccttgc

SEQ ID NO: 5394925 - DNA, 21 bp, Homo sapiens
ccgcctgccgtgcatggctcc

SEQ ID NO: 5394926 - DNA, 12 bp, Homo sapiens
ccgcctgcctcc

SEQ ID NO: 5394927 - DNA, 13 bp, Homo sapiens
ccgcctgcctctg

SEQ ID NO: 5394928 - DNA, 14 bp, Homo sapiens
ccgcctgccttagc

SEQ ID NO: 5394929 - DNA, 13 bp, Homo sapiens
ccgcctgcgcccc

SEQ ID NO: 5394930 - DNA, 14 bp, Homo sapiens
ccgcctgctcccat

SEQ ID NO: 5394931 - DNA, 12 bp, Homo sapiens
ccgcctgctcct

SEQ ID NO: 5394932 - DNA, 14 bp, Homo sapiens
ccgcctgctcctca

SEQ ID NO: 5394933 - DNA, 20 bp, Homo sapiens
ccgcctgctgggaagagctc

SEQ ID NO: 5394934 - DNA, 15 bp, Homo sapiens
ccgcctgcttcacac

SEQ ID NO: 5394935 - DNA, 19 bp, Homo sapiens
ccgcctgcttcacacccct

SEQ ID NO: 5394936 - DNA, 12 bp, Homo sapiens
ccgcctggcagg

SEQ ID NO: 5394937 - DNA, 21 bp, Homo sapiens
ccgcctggccaggagcaggca

SEQ ID NO: 5394938 - DNA, 22 bp, Homo sapiens
ccgcctggccagggcagggcca

SEQ ID NO: 5394939 - DNA, 13 bp, Homo sapiens
ccgcctggccctc

SEQ ID NO: 5394940 - DNA, 18 bp, Homo sapiens
ccgcctggccctccctcc

SEQ ID NO: 5394941 - DNA, 14 bp, Homo sapiens
ccgcctggcctggc

SEQ ID NO: 5394942 - DNA, 17 bp, Homo sapiens
ccgcctgggcgactcca

SEQ ID NO: 5394943 - DNA, 19 bp, Homo sapiens
ccgcctgggtcatgggcct

SEQ ID NO: 5394944 - DNA, 20 bp, Homo sapiens
ccgcctgggtcatgggcctg

SEQ ID NO: 5394945 - DNA, 24 bp, Homo sapiens
ccgcctgggtcatgggcctgtggg

SEQ ID NO: 5394946 - DNA, 17 bp, Homo sapiens
ccgcctgggtctcctaa

SEQ ID NO: 5394947 - DNA, 12 bp, Homo sapiens
ccgcctgtcaat

SEQ ID NO: 5394948 - DNA, 18 bp, Homo sapiens
ccgcctgtcctgcctctc

SEQ ID NO: 5394949 - DNA, 13 bp, Homo sapiens
ccgcctgtccttg

SEQ ID NO: 5394950 - DNA, 14 bp, Homo sapiens
ccgcctgtgggcgc

SEQ ID NO: 5394951 - DNA, 21 bp, Homo sapiens
ccgcctgtgtccatctgaccg

SEQ ID NO: 5394952 - DNA, 14 bp, Homo sapiens
ccgccttcagcctc

SEQ ID NO: 5394953 - DNA, 21 bp, Homo sapiens
ccgccttcaggttcctcctag

SEQ ID NO: 5394954 - DNA, 15 bp, Homo sapiens
ccgccttccctcact

SEQ ID NO: 5394955 - DNA, 22 bp, Homo sapiens
ccgccttccctcactcttcctc

SEQ ID NO: 5394956 - DNA, 14 bp, Homo sapiens
ccgccttcctcctc

SEQ ID NO: 5394957 - DNA, 22 bp, Homo sapiens
ccgccttccttgaccttcctct

SEQ ID NO: 5394958 - DNA, 23 bp, Homo sapiens
ccgccttccttgaccttcctctg

SEQ ID NO: 5394959 - DNA, 19 bp, Homo sapiens
ccgccttctcccacatgag

SEQ ID NO: 5394960 - DNA, 15 bp, Homo sapiens
ccgccttctcccctc

SEQ ID NO: 5394961 - DNA, 23 bp, Homo sapiens
ccgccttctcccctctcccaggg

SEQ ID NO: 5394962 - DNA, 21 bp, Homo sapiens
ccgccttctcccttctctcac

SEQ ID NO: 5394963 - DNA, 17 bp, Homo sapiens
ccgccttgcccagcctg

SEQ ID NO: 5394964 - DNA, 16 bp, Homo sapiens
ccgccttggccttgca

SEQ ID NO: 5394965 - DNA, 17 bp, Homo sapiens
ccgccttggccttgcag

SEQ ID NO: 5394966 - DNA, 22 bp, Homo sapiens
ccgcctttagttctccactggg

SEQ ID NO: 5394967 - DNA, 19 bp, Homo sapiens
ccgccttttagttttggtt

SEQ ID NO: 5394968 - DNA, 12 bp, Homo sapiens
ccgccttttgta

SEQ ID NO: 5394969 - DNA, 16 bp, Homo sapiens
ccgcgaccacccctgt

SEQ ID NO: 5394970 - DNA, 18 bp, Homo sapiens
ccgcgaccatgtggccac

SEQ ID NO: 5394971 - DNA, 23 bp, Homo sapiens
ccgcgatgtggaactgctgccac

SEQ ID NO: 5394972 - DNA, 17 bp, Homo sapiens
ccgcgcaccccacgccc

SEQ ID NO: 5394973 - DNA, 13 bp, Homo sapiens
ccgcgcaccgcca

SEQ ID NO: 5394974 - DNA, 16 bp, Homo sapiens
ccgcgcaccgccatgc

SEQ ID NO: 5394975 - DNA, 17 bp, Homo sapiens
ccgcgcaccgccatgca

SEQ ID NO: 5394976 - DNA, 22 bp, Homo sapiens
ccgcgccaaataatgtctctgt

SEQ ID NO: 5394977 - DNA, 15 bp, Homo sapiens
ccgcgccacaggacc

SEQ ID NO: 5394978 - DNA, 16 bp, Homo sapiens
ccgcgccacaggaccc

SEQ ID NO: 5394979 - DNA, 15 bp, Homo sapiens
ccgcgcccagcagag

SEQ ID NO: 5394980 - DNA, 17 bp, Homo sapiens
ccgcgcccccaccccag

SEQ ID NO: 5394981 - DNA, 16 bp, Homo sapiens
ccgcgcccgccgcctc

SEQ ID NO: 5394982 - DNA, 22 bp, Homo sapiens
ccgcgccctcctgcccacggga

SEQ ID NO: 5394983 - DNA, 23 bp, Homo sapiens
ccgcgcctacccttcccgcctcc

SEQ ID NO: 5394984 - DNA, 22 bp, Homo sapiens
ccgcgcgcgggacagcggcccc

SEQ ID NO: 5394985 - DNA, 23 bp, Homo sapiens
ccgcgcgcgggacagcggccccg

SEQ ID NO: 5394986 - DNA, 22 bp, Homo sapiens
ccgcgcgttccttcgcacactg

SEQ ID NO: 5394987 - DNA, 18 bp, Homo sapiens
ccgcgctcgcccagcagg

SEQ ID NO: 5394988 - DNA, 17 bp, Homo sapiens
ccgcgctcggggctggg

SEQ ID NO: 5394989 - DNA, 14 bp, Homo sapiens
ccgcgctctgcccc

SEQ ID NO: 5394990 - DNA, 23 bp, Homo sapiens
ccgcgctgtgtaaatgctccagc

SEQ ID NO: 5394991 - DNA, 14 bp, Homo sapiens
ccgcggaggcccct

SEQ ID NO: 5394992 - DNA, 15 bp, Homo sapiens
ccgcggaggcccctg

SEQ ID NO: 5394993 - DNA, 18 bp, Homo sapiens
ccgcggatcaaccaggca

SEQ ID NO: 5394994 - DNA, 21 bp, Homo sapiens
ccgcggatcaaccaggcagag

SEQ ID NO: 5394995 - DNA, 18 bp, Homo sapiens
ccgcggccaggcacccat

SEQ ID NO: 5394996 - DNA, 20 bp, Homo sapiens
ccgcggccggccgagctgcc

SEQ ID NO: 5394997 - DNA, 17 bp, Homo sapiens
ccgcggcctgcaccgac

SEQ ID NO: 5394998 - DNA, 21 bp, Homo sapiens
ccgcggcgcgaccctccccgg

SEQ ID NO: 5394999 - DNA, 19 bp, Homo sapiens
ccgcggcgggccctgccca

SEQ ID NO: 5395000 - DNA, 22 bp, Homo sapiens
ccgcggctggatgggggctctg

SEQ ID NO: 5395001 - DNA, 17 bp, Homo sapiens
ccgcgggaagccagccc

SEQ ID NO: 5395002 - DNA, 21 bp, Homo sapiens
ccgcgggagacagcttctctg

SEQ ID NO: 5395003 - DNA, 20 bp, Homo sapiens
ccgcgggcgctcgctcaggt

SEQ ID NO: 5395004 - DNA, 18 bp, Homo sapiens
ccgcggggaagctggctt

SEQ ID NO: 5395005 - DNA, 21 bp, Homo sapiens
ccgcggggagagaggaggaga

SEQ ID NO: 5395006 - DNA, 18 bp, Homo sapiens
ccgcgggtggctggagcc

SEQ ID NO: 5395007 - DNA, 15 bp, Homo sapiens
ccgcggtgctgactg

SEQ ID NO: 5395008 - DNA, 20 bp, Homo sapiens
ccgcggtgctgactgaggcc

SEQ ID NO: 5395009 - DNA, 21 bp, Homo sapiens
ccgcggtgctgactgaggcct

SEQ ID NO: 5395010 - DNA, 13 bp, Homo sapiens
ccgcgtagagagc

SEQ ID NO: 5395011 - DNA, 21 bp, Homo sapiens
ccgcgtagagagccgggcccc

SEQ ID NO: 5395012 - DNA, 20 bp, Homo sapiens
ccgcgtagctgggactacag

SEQ ID NO: 5395013 - DNA, 20 bp, Homo sapiens
ccgcgtccaaccccggggca

SEQ ID NO: 5395014 - DNA, 19 bp, Homo sapiens
ccgcgtccgagaaggcgga

SEQ ID NO: 5395015 - DNA, 15 bp, Homo sapiens
ccgcgtcctttcctc

SEQ ID NO: 5395016 - DNA, 15 bp, Homo sapiens
ccgcgtctaccctgg

SEQ ID NO: 5395017 - DNA, 15 bp, Homo sapiens
ccgcgtgctggagaa

SEQ ID NO: 5395018 - DNA, 14 bp, Homo sapiens
ccgctaaaagaaac

SEQ ID NO: 5395019 - DNA, 13 bp, Homo sapiens
ccgctaaggaaga

SEQ ID NO: 5395020 - DNA, 22 bp, Homo sapiens
ccgctacaagagggcaaagctg

SEQ ID NO: 5395021 - DNA, 19 bp, Homo sapiens
ccgctacaattctgcagaa

SEQ ID NO: 5395022 - DNA, 16 bp, Homo sapiens
ccgctacaccactctg

SEQ ID NO: 5395023 - DNA, 20 bp, Homo sapiens
ccgctacaccactctggcag

SEQ ID NO: 5395024 - DNA, 21 bp, Homo sapiens
ccgctacaccactctggcagc

SEQ ID NO: 5395025 - DNA, 18 bp, Homo sapiens
ccggccagcgggcacagg

SEQ ID NO: 5395026 - DNA, 14 bp, Homo sapiens
ccggccagctggga

SEQ ID NO: 5395027 - DNA, 23 bp, Homo sapiens
ccggccagctgggtgccccaggg

SEQ ID NO: 5395028 - DNA, 19 bp, Homo sapiens
ccggccaggccgcgcccag

SEQ ID NO: 5395029 - DNA, 16 bp, Homo sapiens
ccggccagggcctggt

SEQ ID NO: 5395030 - DNA, 17 bp, Homo sapiens
ccggccagggcctggtg

SEQ ID NO: 5395031 - DNA, 17 bp, Homo sapiens
ccggccaggtgcctcct

SEQ ID NO: 5395032 - DNA, 19 bp, Homo sapiens
ccggccaggtgcctcctga

SEQ ID NO: 5395033 - DNA, 20 bp, Homo sapiens
ccggccagtggcggaagtga

SEQ ID NO: 5395034 - DNA, 22 bp, Homo sapiens
ccggcccaccagggactgcagc

SEQ ID NO: 5395035 - DNA, 17 bp, Homo sapiens
ccggcccacgcagagcc

SEQ ID NO: 5395036 - DNA, 18 bp, Homo sapiens
ccggcccacgcagagccc

SEQ ID NO: 5395037 - DNA, 18 bp, Homo sapiens
ccggcccagatgtgtccc

SEQ ID NO: 5395038 - DNA, 19 bp, Homo sapiens
ccggcccagatgtgtcccc

SEQ ID NO: 5395039 - DNA, 17 bp, Homo sapiens
ccggcccaggcctccac

SEQ ID NO: 5395040 - DNA, 12 bp, Homo sapiens
ccggcccagtgc

SEQ ID NO: 5395041 - DNA, 16 bp, Homo sapiens
ccggcccagtgccagc

SEQ ID NO: 5395042 - DNA, 18 bp, Homo sapiens
ccggcccagtgccccctg

SEQ ID NO: 5395043 - DNA, 13 bp, Homo sapiens
ccggccccacccc

SEQ ID NO: 5395044 - DNA, 21 bp, Homo sapiens
ccggccccaccccctgggcag

SEQ ID NO: 5395045 - DNA, 14 bp, Homo sapiens
ccggccccacctcc

SEQ ID NO: 5395046 - DNA, 13 bp, Homo sapiens
ccggccccagcca

SEQ ID NO: 5395047 - DNA, 14 bp, Homo sapiens
ccggccccagccag

SEQ ID NO: 5395048 - DNA, 15 bp, Homo sapiens
ccggccccagccaga

SEQ ID NO: 5395049 - DNA, 15 bp, Homo sapiens
ccggccccaggctcc

SEQ ID NO: 5395050 - DNA, 19 bp, Homo sapiens
ccggccccaggctcccctg

SEQ ID NO: 5395051 - DNA, 21 bp, Homo sapiens
ccggccccccgcgctcgccca

SEQ ID NO: 5395052 - DNA, 19 bp, Homo sapiens
ccggcccccctctcgggct

SEQ ID NO: 5395053 - DNA, 20 bp, Homo sapiens
ccggcccccctctcgggctc

SEQ ID NO: 5395054 - DNA, 18 bp, Homo sapiens
ccggcccccggccaagga

SEQ ID NO: 5395055 - DNA, 19 bp, Homo sapiens
ccggccccctggtctctgg

SEQ ID NO: 5395056 - DNA, 13 bp, Homo sapiens
ccggcccccttcc

SEQ ID NO: 5395057 - DNA, 15 bp, Homo sapiens
ccggcccccttcctg

SEQ ID NO: 5395058 - DNA, 18 bp, Homo sapiens
ccggccccgagagcaggc

SEQ ID NO: 5395059 - DNA, 22 bp, Homo sapiens
ccggccccgagagcaggctcga

SEQ ID NO: 5395060 - DNA, 15 bp, Homo sapiens
ccggcccctaccagc

SEQ ID NO: 5395061 - DNA, 19 bp, Homo sapiens
ccggcccctaccagccacg

SEQ ID NO: 5395062 - DNA, 12 bp, Homo sapiens
ccggcccctcac

SEQ ID NO: 5395063 - DNA, 16 bp, Homo sapiens
ccggcccctcaccctc

SEQ ID NO: 5395064 - DNA, 17 bp, Homo sapiens
ccggcccctcaccctct

SEQ ID NO: 5395065 - DNA, 16 bp, Homo sapiens
ccggcccctcctgact

SEQ ID NO: 5395066 - DNA, 16 bp, Homo sapiens
ccggcccctggcagca

SEQ ID NO: 5395067 - DNA, 15 bp, Homo sapiens
ccggcccgcctgccc

SEQ ID NO: 5395068 - DNA, 14 bp, Homo sapiens
ccggcccggctgag

SEQ ID NO: 5395069 - DNA, 12 bp, Homo sapiens
ccggccctcact

SEQ ID NO: 5395070 - DNA, 17 bp, Homo sapiens
ccggccctcccccagct

SEQ ID NO: 5395071 - DNA, 18 bp, Homo sapiens
ccggccctcccccagctc

SEQ ID NO: 5395072 - DNA, 19 bp, Homo sapiens
ccggccctcccccagctcc

SEQ ID NO: 5395073 - DNA, 19 bp, Homo sapiens
ccggccctgcccctcccta

SEQ ID NO: 5395074 - DNA, 12 bp, Homo sapiens
ccggccctggct

SEQ ID NO: 5395075 - DNA, 14 bp, Homo sapiens
ccggccctggctgg

SEQ ID NO: 5395076 - DNA, 13 bp, Homo sapiens
ccggccctggctt

SEQ ID NO: 5395077 - DNA, 24 bp, Homo sapiens
ccggccctgggctcggaggctgcc

SEQ ID NO: 5395078 - DNA, 15 bp, Homo sapiens
ccggccgcagccccc

SEQ ID NO: 5395079 - DNA, 16 bp, Homo sapiens
ccggccgcagccccca

SEQ ID NO: 5395080 - DNA, 23 bp, Homo sapiens
ccggccgcagcccccactgacct

SEQ ID NO: 5395081 - DNA, 22 bp, Homo sapiens
ccggccgcccagacaccacaga

SEQ ID NO: 5395082 - DNA, 19 bp, Homo sapiens
ccggccgccccgccccaga

SEQ ID NO: 5395083 - DNA, 22 bp, Homo sapiens
ccggccgccccgccccagagct

SEQ ID NO: 5395084 - DNA, 23 bp, Homo sapiens
ccggccgccccgccccagagctc

SEQ ID NO: 5395085 - DNA, 18 bp, Homo sapiens
ccggccgccttctcccct

SEQ ID NO: 5395086 - DNA, 20 bp, Homo sapiens
ccggccgccttctcccctct

SEQ ID NO: 5395087 - DNA, 15 bp, Homo sapiens
ccggccgcgcaccgc

SEQ ID NO: 5395088 - DNA, 23 bp, Homo sapiens
ccggccgcggctccccctggacg

SEQ ID NO: 5395089 - DNA, 15 bp, Homo sapiens
ccggccggagggcag

SEQ ID NO: 5395090 - DNA, 20 bp, Homo sapiens
ccggccggccctggcttgga

SEQ ID NO: 5395091 - DNA, 16 bp, Homo sapiens
ccggcctaggcacctc

SEQ ID NO: 5395092 - DNA, 18 bp, Homo sapiens
ccggcctcctagcctctc

SEQ ID NO: 5395093 - DNA, 13 bp, Homo sapiens
ccggcctctccag

SEQ ID NO: 5395094 - DNA, 14 bp, Homo sapiens
ccggcctctctgcc

SEQ ID NO: 5395095 - DNA, 15 bp, Homo sapiens
ccggcctctctggcc

SEQ ID NO: 5395096 - DNA, 16 bp, Homo sapiens
ccggcctctctggcct

SEQ ID NO: 5395097 - DNA, 18 bp, Homo sapiens
ccggcctctctggcctcc

SEQ ID NO: 5395098 - DNA, 21 bp, Homo sapiens
ccggcctctctggcctcccac

SEQ ID NO: 5395099 - DNA, 13 bp, Homo sapiens
ccggcctcttcca

SEQ ID NO: 5395100 - DNA, 15 bp, Homo sapiens
ccggcctcttcgcct

SEQ ID NO: 5395101 - DNA, 20 bp, Homo sapiens
ccggcctgatggccaggcct

SEQ ID NO: 5395102 - DNA, 12 bp, Homo sapiens
ccggcctgcagc

SEQ ID NO: 5395103 - DNA, 16 bp, Homo sapiens
ccggcctgcagcccag

SEQ ID NO: 5395104 - DNA, 17 bp, Homo sapiens
ccggcctgcagcccaga

SEQ ID NO: 5395105 - DNA, 23 bp, Homo sapiens
ccggcctggatgccagctgtgtc

SEQ ID NO: 5395106 - DNA, 13 bp, Homo sapiens
ccggcctggcacc

SEQ ID NO: 5395107 - DNA, 16 bp, Homo sapiens
ccggcctggccccctc

SEQ ID NO: 5395108 - DNA, 12 bp, Homo sapiens
ccggcctggcct

SEQ ID NO: 5395109 - DNA, 14 bp, Homo sapiens
ccggcctggccttt

SEQ ID NO: 5395110 - DNA, 21 bp, Homo sapiens
ccggcctgggtgacagagtga

SEQ ID NO: 5395111 - DNA, 23 bp, Homo sapiens
ccggcctgtaatcagctctcctg

SEQ ID NO: 5395112 - DNA, 17 bp, Homo sapiens
ccggcgagccctgtgga

SEQ ID NO: 5395113 - DNA, 16 bp, Homo sapiens
ccggcgagggggccgg

SEQ ID NO: 5395114 - DNA, 14 bp, Homo sapiens
ccggcgccctctgt

SEQ ID NO: 5395115 - DNA, 18 bp, Homo sapiens
ccggcgccctctgtcctg

SEQ ID NO: 5395116 - DNA, 19 bp, Homo sapiens
ccggcgccctctgtcctga

SEQ ID NO: 5395117 - DNA, 13 bp, Homo sapiens
ccggcgccgggca

SEQ ID NO: 5395118 - DNA, 23 bp, Homo sapiens
ccggcgcctgccctgcccaagtg

SEQ ID NO: 5395119 - DNA, 13 bp, Homo sapiens
ccggcgctgcagg

SEQ ID NO: 5395120 - DNA, 14 bp, Homo sapiens
ccggcgctgcaggt

SEQ ID NO: 5395121 - DNA, 23 bp, Homo sapiens
ccggcggaattcaccagtgttcc

SEQ ID NO: 5395122 - DNA, 19 bp, Homo sapiens
ccggcggccccgccgcaga

SEQ ID NO: 5395123 - DNA, 13 bp, Homo sapiens
ccggcggcctctc

SEQ ID NO: 5395124 - DNA, 14 bp, Homo sapiens
ccggcggctctgag

SEQ ID NO: 5395125 - DNA, 17 bp, Homo sapiens
ccggcggctctgagcag

SEQ ID NO: 5395126 - DNA, 13 bp, Homo sapiens
ccggcgggactgt

SEQ ID NO: 5395127 - DNA, 19 bp, Homo sapiens
ccggcggggtgcctgctgt

SEQ ID NO: 5395128 - DNA, 22 bp, Homo sapiens
ccggcgggtgacagctccggga

SEQ ID NO: 5395129 - DNA, 21 bp, Homo sapiens
ccggcgggtgctctgaggcct

SEQ ID NO: 5395130 - DNA, 14 bp, Homo sapiens
ccggcgtcagcctc

SEQ ID NO: 5395131 - DNA, 17 bp, Homo sapiens
ccggcgtcagcctccag

SEQ ID NO: 5395132 - DNA, 15 bp, Homo sapiens
ccggcgtcttgccca

SEQ ID NO: 5395133 - DNA, 21 bp, Homo sapiens
ccggcgtcttgcccagcagct

SEQ ID NO: 5395134 - DNA, 15 bp, Homo sapiens
ccggctaatgtttgt

SEQ ID NO: 5395135 - DNA, 21 bp, Homo sapiens
ccggctaatttttttgtattt

SEQ ID NO: 5395136 - DNA, 20 bp, Homo sapiens
ccggctcaggagagggcctt

SEQ ID NO: 5395137 - DNA, 14 bp, Homo sapiens
ccggctccagagca

SEQ ID NO: 5395138 - DNA, 16 bp, Homo sapiens
ccggctccagagcagg

SEQ ID NO: 5395139 - DNA, 14 bp, Homo sapiens
ccggctccaggctc

SEQ ID NO: 5395140 - DNA, 13 bp, Homo sapiens
ccggctcccaccg

SEQ ID NO: 5395141 - DNA, 14 bp, Homo sapiens
ccggctcccaccgg

SEQ ID NO: 5395142 - DNA, 15 bp, Homo sapiens
ccggctcccagcctc

SEQ ID NO: 5395143 - DNA, 16 bp, Homo sapiens
ccggctccccctgcca

SEQ ID NO: 5395144 - DNA, 15 bp, Homo sapiens
ccggctccccctgct

SEQ ID NO: 5395145 - DNA, 22 bp, Homo sapiens
ccggctcccctcgacagctctc

SEQ ID NO: 5395146 - DNA, 15 bp, Homo sapiens
ccggctcctgtcatc

SEQ ID NO: 5395147 - DNA, 16 bp, Homo sapiens
ccggctcctgtgcttt

SEQ ID NO: 5395148 - DNA, 22 bp, Homo sapiens
ccggctcgtgtatttattaccg

SEQ ID NO: 5395149 - DNA, 16 bp, Homo sapiens
ccggctctggctctcc

SEQ ID NO: 5395150 - DNA, 12 bp, Homo sapiens
ccggctgactca

SEQ ID NO: 5395151 - DNA, 16 bp, Homo sapiens
ccggctgagcccccca

SEQ ID NO: 5395152 - DNA, 15 bp, Homo sapiens
ccggctgagccctgc

SEQ ID NO: 5395153 - DNA, 22 bp, Homo sapiens
ccggctgagctgtgccagctgc

SEQ ID NO: 5395154 - DNA, 19 bp, Homo sapiens
ccggctgagggtgggaggc

SEQ ID NO: 5395155 - DNA, 16 bp, Homo sapiens
ccggctgagtggcagc

SEQ ID NO: 5395156 - DNA, 13 bp, Homo sapiens
ccggctgccccca

SEQ ID NO: 5395157 - DNA, 15 bp, Homo sapiens
ccggctgcccccatc

SEQ ID NO: 5395158 - DNA, 12 bp, Homo sapiens
ccggctgccctt

SEQ ID NO: 5395159 - DNA, 16 bp, Homo sapiens
ccggctgcctagccct

SEQ ID NO: 5395160 - DNA, 21 bp, Homo sapiens
ccggctgctcctccagccctt

SEQ ID NO: 5395161 - DNA, 13 bp, Homo sapiens
ccggctgctgctt

SEQ ID NO: 5395162 - DNA, 13 bp, Homo sapiens
ccggctgcttcct

SEQ ID NO: 5395163 - DNA, 12 bp, Homo sapiens
ccggctggaaat

SEQ ID NO: 5395164 - DNA, 18 bp, Homo sapiens
ccggctggccggtccacc

SEQ ID NO: 5395165 - DNA, 12 bp, Homo sapiens
ccggctggcctg

SEQ ID NO: 5395166 - DNA, 13 bp, Homo sapiens
ccggctggcctgg

SEQ ID NO: 5395167 - DNA, 18 bp, Homo sapiens
ccggctggcctggcccct

SEQ ID NO: 5395168 - DNA, 15 bp, Homo sapiens
ccggctgggcccgag

SEQ ID NO: 5395169 - DNA, 16 bp, Homo sapiens
ccggctgggcccgagg

SEQ ID NO: 5395170 - DNA, 12 bp, Homo sapiens
ccggctgggcct

SEQ ID NO: 5395171 - DNA, 16 bp, Homo sapiens
ccggctgggcctcctt

SEQ ID NO: 5395172 - DNA, 23 bp, Homo sapiens
ccggctggttttgtaagatgctg

SEQ ID NO: 5395173 - DNA, 15 bp, Homo sapiens
ccggctgtggagcaa

SEQ ID NO: 5395174 - DNA, 14 bp, Homo sapiens
ccggctgtttcctg

SEQ ID NO: 5395175 - DNA, 19 bp, Homo sapiens
ccggcttcctttcccaagc

SEQ ID NO: 5395176 - DNA, 12 bp, Homo sapiens
ccggcttgcctg

SEQ ID NO: 5395177 - DNA, 19 bp, Homo sapiens
ccggctttcctccggagcc

SEQ ID NO: 5395178 - DNA, 22 bp, Homo sapiens
ccggctttgcagggagaccagg

SEQ ID NO: 5395179 - DNA, 17 bp, Homo sapiens
ccgggaaccaagcagga

SEQ ID NO: 5395180 - DNA, 18 bp, Homo sapiens
ccgggaacctccccagcc

SEQ ID NO: 5395181 - DNA, 22 bp, Homo sapiens
ccgggaacctccccagcctgcg

SEQ ID NO: 5395182 - DNA, 16 bp, Homo sapiens
ccgggaagcatcctcc

SEQ ID NO: 5395183 - DNA, 18 bp, Homo sapiens
ccgggaagcatcctcccc

SEQ ID NO: 5395184 - DNA, 17 bp, Homo sapiens
ccgggaagccaccctcc

SEQ ID NO: 5395185 - DNA, 21 bp, Homo sapiens
ccgggaagtgagggctcactc

SEQ ID NO: 5395186 - DNA, 21 bp, Homo sapiens
ccgggacaccgtggggaaggg

SEQ ID NO: 5395187 - DNA, 19 bp, Homo sapiens
ccgggacacctaggctagg

SEQ ID NO: 5395188 - DNA, 22 bp, Homo sapiens
ccgggacagacctggacactag

SEQ ID NO: 5395189 - DNA, 22 bp, Homo sapiens
ccgggaccaaactcacggacca

SEQ ID NO: 5395190 - DNA, 15 bp, Homo sapiens
ccgggaccacagctg

SEQ ID NO: 5395191 - DNA, 16 bp, Homo sapiens
ccgggaccacagctgc

SEQ ID NO: 5395192 - DNA, 17 bp, Homo sapiens
ccgggaccacagctgct

SEQ ID NO: 5395193 - DNA, 19 bp, Homo sapiens
ccgggaccacagctgctgg

SEQ ID NO: 5395194 - DNA, 24 bp, Homo sapiens
ccgggaccacagctgctggccagg

SEQ ID NO: 5395195 - DNA, 17 bp, Homo sapiens
ccgggaccattgacctc

SEQ ID NO: 5395196 - DNA, 15 bp, Homo sapiens
ccgggacccccagga

SEQ ID NO: 5395197 - DNA, 19 bp, Homo sapiens
ccgggacccggcggccctg

SEQ ID NO: 5395198 - DNA, 20 bp, Homo sapiens
ccgggacccggcggccctgc

SEQ ID NO: 5395199 - DNA, 22 bp, Homo sapiens
ccgggaccctgctcacaggcag

SEQ ID NO: 5395200 - DNA, 17 bp, Homo sapiens
ccgggacctggtgctgc

SEQ ID NO: 5395201 - DNA, 22 bp, Homo sapiens
ccgggactcactggcagcccca

SEQ ID NO: 5395202 - DNA, 14 bp, Homo sapiens
ccgggactgctgct

SEQ ID NO: 5395203 - DNA, 17 bp, Homo sapiens
ccgggagaagccacctt

SEQ ID NO: 5395204 - DNA, 15 bp, Homo sapiens
ccgtcccgcacagtg

SEQ ID NO: 5395205 - DNA, 17 bp, Homo sapiens
ccgtcccgcgttcaaga

SEQ ID NO: 5395206 - DNA, 14 bp, Homo sapiens
ccgtccctcccagg

SEQ ID NO: 5395207 - DNA, 16 bp, Homo sapiens
ccgtccctcccaggtc

SEQ ID NO: 5395208 - DNA, 11 bp, Homo sapiens
ccgtccctcct

SEQ ID NO: 5395209 - DNA, 13 bp, Homo sapiens
ccgtccctcctgt

SEQ ID NO: 5395210 - DNA, 13 bp, Homo sapiens
ccgtccctttccc

SEQ ID NO: 5395211 - DNA, 16 bp, Homo sapiens
ccgtccctttccctgc

SEQ ID NO: 5395212 - DNA, 14 bp, Homo sapiens
ccgtcctcacccct

SEQ ID NO: 5395213 - DNA, 14 bp, Homo sapiens
ccgtcctcccgggc

SEQ ID NO: 5395214 - DNA, 16 bp, Homo sapiens
ccgtcctcccgggccc

SEQ ID NO: 5395215 - DNA, 19 bp, Homo sapiens
ccgtcctcccgggccctcc

SEQ ID NO: 5395216 - DNA, 18 bp, Homo sapiens
ccgtcctctccccagcct

SEQ ID NO: 5395217 - DNA, 22 bp, Homo sapiens
ccgtcctctccccagcctggca

SEQ ID NO: 5395218 - DNA, 16 bp, Homo sapiens
ccgtcctgagggggaa

SEQ ID NO: 5395219 - DNA, 19 bp, Homo sapiens
ccgtcctgctcgccctgtg

SEQ ID NO: 5395220 - DNA, 18 bp, Homo sapiens
ccgtcctgctgtccctgt

SEQ ID NO: 5395221 - DNA, 18 bp, Homo sapiens
ccgtcctggactctgtgt

SEQ ID NO: 5395222 - DNA, 12 bp, Homo sapiens
ccgtcctggcac

SEQ ID NO: 5395223 - DNA, 14 bp, Homo sapiens
ccgtcctggcacag

SEQ ID NO: 5395224 - DNA, 21 bp, Homo sapiens
ccgtcctggcagggcaggcag

SEQ ID NO: 5395225 - DNA, 19 bp, Homo sapiens
ccgtccttcccctcttctt

SEQ ID NO: 5395226 - DNA, 15 bp, Homo sapiens
ccgtcggagctgcct

SEQ ID NO: 5395227 - DNA, 16 bp, Homo sapiens
ccgtcggagctgcctg

SEQ ID NO: 5395228 - DNA, 19 bp, Homo sapiens
ccgtcggagctgcctgcag

SEQ ID NO: 5395229 - DNA, 14 bp, Homo sapiens
ccgtcggccctgcg

SEQ ID NO: 5395230 - DNA, 17 bp, Homo sapiens
ccgtcggccctgcgtcg

SEQ ID NO: 5395231 - DNA, 15 bp, Homo sapiens
ccgtcgggcccctgc

SEQ ID NO: 5395232 - DNA, 23 bp, Homo sapiens
ccgtcgggcccctgcctgccttc

SEQ ID NO: 5395233 - DNA, 15 bp, Homo sapiens
ccgtctacagatggc

SEQ ID NO: 5395234 - DNA, 18 bp, Homo sapiens
ccgtctaggattgggcct

SEQ ID NO: 5395235 - DNA, 19 bp, Homo sapiens
ccgtctcatatttttacaa

SEQ ID NO: 5395236 - DNA, 15 bp, Homo sapiens
ccgtctccagctgct

SEQ ID NO: 5395237 - DNA, 16 bp, Homo sapiens
ccgtctccctaaaata

SEQ ID NO: 5395238 - DNA, 17 bp, Homo sapiens
ccgtctcctccctcagc

SEQ ID NO: 5395239 - DNA, 13 bp, Homo sapiens
ccgtctcctctcc

SEQ ID NO: 5395240 - DNA, 22 bp, Homo sapiens
ccgtctcctgccgggcaggtcc

SEQ ID NO: 5395241 - DNA, 15 bp, Homo sapiens
ccgtctcggccctga

SEQ ID NO: 5395242 - DNA, 19 bp, Homo sapiens
ccgtctcggccctgaacca

SEQ ID NO: 5395243 - DNA, 11 bp, Homo sapiens
ccgtctctcct

SEQ ID NO: 5395244 - DNA, 17 bp, Homo sapiens
ccgtctctcctgctctc

SEQ ID NO: 5395245 - DNA, 13 bp, Homo sapiens
ccgtctctctccc

SEQ ID NO: 5395246 - DNA, 21 bp, Homo sapiens
ccgtctctcttggacccacct

SEQ ID NO: 5395247 - DNA, 12 bp, Homo sapiens
ccgtctctgccc

SEQ ID NO: 5395248 - DNA, 14 bp, Homo sapiens
ccgtctctgccctg

SEQ ID NO: 5395249 - DNA, 17 bp, Homo sapiens
ccgtctctgccctgggc

SEQ ID NO: 5395250 - DNA, 21 bp, Homo sapiens
ccgtctctgccctgggctcct

SEQ ID NO: 5395251 - DNA, 17 bp, Homo sapiens
ccgtctctgctctgctc

SEQ ID NO: 5395252 - DNA, 14 bp, Homo sapiens
ccgtctctggcccc

SEQ ID NO: 5395253 - DNA, 18 bp, Homo sapiens
ccgtctgaccaagggctg

SEQ ID NO: 5395254 - DNA, 18 bp, Homo sapiens
ccgtctgaccccagccca

SEQ ID NO: 5395255 - DNA, 20 bp, Homo sapiens
ccgtctgaccccagcccaga

SEQ ID NO: 5395256 - DNA, 13 bp, Homo sapiens
ccgtctgattgtt

SEQ ID NO: 5395257 - DNA, 12 bp, Homo sapiens
ccgtctgcaggg

SEQ ID NO: 5395258 - DNA, 20 bp, Homo sapiens
ccgtctgcaggggcctggag

SEQ ID NO: 5395259 - DNA, 12 bp, Homo sapiens
ccgtctgcccac

SEQ ID NO: 5395260 - DNA, 19 bp, Homo sapiens
ccgtctgcccaccattccc

SEQ ID NO: 5395261 - DNA, 18 bp, Homo sapiens
ccgtctggcgagccctta

SEQ ID NO: 5395262 - DNA, 18 bp, Homo sapiens
ccgtctgggaatcctgga

SEQ ID NO: 5395263 - DNA, 20 bp, Homo sapiens
ccgtctggggttcagcccct

SEQ ID NO: 5395264 - DNA, 21 bp, Homo sapiens
ccgtctggggttcagcccctc

SEQ ID NO: 5395265 - DNA, 23 bp, Homo sapiens
ccgtctggggttcagcccctcct

SEQ ID NO: 5395266 - DNA, 13 bp, Homo sapiens
ccgtctgtccatc

SEQ ID NO: 5395267 - DNA, 15 bp, Homo sapiens
ccgtctgtcctgcgc

SEQ ID NO: 5395268 - DNA, 22 bp, Homo sapiens
ccgtctgtctcagagtcccagg

SEQ ID NO: 5395269 - DNA, 23 bp, Homo sapiens
ccgtctgtctgtctagtgtctgg

SEQ ID NO: 5395270 - DNA, 15 bp, Homo sapiens
ccgtctgtgtatgtg

SEQ ID NO: 5395271 - DNA, 23 bp, Homo sapiens
ccgtctgtgtggggttctcagtg

SEQ ID NO: 5395272 - DNA, 22 bp, Homo sapiens
ccgtcttagaagtggaccagga

SEQ ID NO: 5395273 - DNA, 21 bp, Homo sapiens
ccgtcttcaatctctgttctg

SEQ ID NO: 5395274 - DNA, 15 bp, Homo sapiens
ccgtcttcacactgc

SEQ ID NO: 5395275 - DNA, 17 bp, Homo sapiens
ccgtcttcacactgcgc

SEQ ID NO: 5395276 - DNA, 15 bp, Homo sapiens
ccgtcttcagcctag

SEQ ID NO: 5395277 - DNA, 20 bp, Homo sapiens
ccgtcttccctagaccttgg

SEQ ID NO: 5395278 - DNA, 14 bp, Homo sapiens
ccgtcttcctcctc

SEQ ID NO: 5395279 - DNA, 13 bp, Homo sapiens
ccgtcttctctcc

SEQ ID NO: 5395280 - DNA, 15 bp, Homo sapiens
ccgtcttctctccat

SEQ ID NO: 5395281 - DNA, 19 bp, Homo sapiens
ccgtctttcttttatactg

SEQ ID NO: 5395282 - DNA, 18 bp, Homo sapiens
ccgtgaaccagagggtgt

SEQ ID NO: 5395283 - DNA, 14 bp, Homo sapiens
ccgtgaagcagtgc

SEQ ID NO: 5395284 - DNA, 19 bp, Homo sapiens
ccgtgaatgggtgcccaca

SEQ ID NO: 5395285 - DNA, 10 bp, Homo sapiens
ccgtgaccta

SEQ ID NO: 5395286 - DNA, 11 bp, Homo sapiens
ccgtgacctat

SEQ ID NO: 5395287 - DNA, 15 bp, Homo sapiens
ccgtgacgaggctca

SEQ ID NO: 5395288 - DNA, 19 bp, Homo sapiens
ccgtgagcaggaaggcctg

SEQ ID NO: 5395289 - DNA, 21 bp, Homo sapiens
ccgtgagcaggaaggcctggg

SEQ ID NO: 5395290 - DNA, 12 bp, Homo sapiens
ccgtgagcatgc

SEQ ID NO: 5395291 - DNA, 14 bp, Homo sapiens
ccgtgagcatgcac

SEQ ID NO: 5395292 - DNA, 15 bp, Homo sapiens
ccgtgagcatgtttg

SEQ ID NO: 5395293 - DNA, 22 bp, Homo sapiens
ccgtgagccaatccctcacctt

SEQ ID NO: 5395294 - DNA, 19 bp, Homo sapiens
ccgtgagcgccccgccccc

SEQ ID NO: 5395295 - DNA, 21 bp, Homo sapiens
ccgtgagcgccccgcccccac

SEQ ID NO: 5395296 - DNA, 14 bp, Homo sapiens
ccgtgaggaggggt

SEQ ID NO: 5395297 - DNA, 12 bp, Homo sapiens
ccgtgaggccag

SEQ ID NO: 5395298 - DNA, 21 bp, Homo sapiens
ccgtgagggcaagagggggac

SEQ ID NO: 5395299 - DNA, 18 bp, Homo sapiens
ccgtgagtgacatagcct

SEQ ID NO: 5395300 - DNA, 21 bp, Homo sapiens
ccgtgagtgacatagcctcat

SEQ ID NO: 5395301 - DNA, 19 bp, Homo sapiens
ccgtgagttctcagggctc

SEQ ID NO: 5395302 - DNA, 23 bp, Homo sapiens
ccgtgatccatccatctccaggg

SEQ ID NO: 5395303 - DNA, 20 bp, Homo sapiens
ccgtgatggagaggacagag

SEQ ID NO: 5395304 - DNA, 24 bp, Homo sapiens
ccgtgatggagaggacagagcagg

SEQ ID NO: 5395305 - DNA, 15 bp, Homo sapiens
ccgtgcacggggcca

SEQ ID NO: 5395306 - DNA, 18 bp, Homo sapiens
ccgtgcacggggccagca

SEQ ID NO: 5395307 - DNA, 13 bp, Homo sapiens
ccgtgcagactgg

SEQ ID NO: 5395308 - DNA, 14 bp, Homo sapiens
ccgtgcagactgga

SEQ ID NO: 5395309 - DNA, 14 bp, Homo sapiens
ccgtgcatcccccc

SEQ ID NO: 5395310 - DNA, 22 bp, Homo sapiens
ccgtgcatcccccctgctcagc

SEQ ID NO: 5395311 - DNA, 11 bp, Homo sapiens
ccgtgccaaag

SEQ ID NO: 5395312 - DNA, 14 bp, Homo sapiens
ccgtgccaacccca

SEQ ID NO: 5395313 - DNA, 20 bp, Homo sapiens
ccgtgccaaccccacccagc

SEQ ID NO: 5395314 - DNA, 20 bp, Homo sapiens
ccgtgccaagtccaggtcct

SEQ ID NO: 5395315 - DNA, 17 bp, Homo sapiens
ccgtgccacccccagcc

SEQ ID NO: 5395316 - DNA, 20 bp, Homo sapiens
ccgtgccacgcgctctgcat

SEQ ID NO: 5395317 - DNA, 12 bp, Homo sapiens
ccgtgccagcag

SEQ ID NO: 5395318 - DNA, 23 bp, Homo sapiens
ccgtgccaggagcaatgggactg

SEQ ID NO: 5395319 - DNA, 23 bp, Homo sapiens
ccgtgccattgtactccagcctg

SEQ ID NO: 5395320 - DNA, 16 bp, Homo sapiens
ccgtgccccttccctg

SEQ ID NO: 5395321 - DNA, 20 bp, Homo sapiens
ccgtgccccttccctgggtt

SEQ ID NO: 5395322 - DNA, 15 bp, Homo sapiens
ccgtgcccctttcct

SEQ ID NO: 5395323 - DNA, 18 bp, Homo sapiens
ccgtgcccctttccttca

SEQ ID NO: 5395324 - DNA, 17 bp, Homo sapiens
ccgtgcccgcaggaact

SEQ ID NO: 5395325 - DNA, 19 bp, Homo sapiens
ccgtgcccgcccacctctg

SEQ ID NO: 5395326 - DNA, 14 bp, Homo sapiens
ccgtgccctggtga

SEQ ID NO: 5395327 - DNA, 15 bp, Homo sapiens
ccgtgccctgtttcc

SEQ ID NO: 5395328 - DNA, 19 bp, Homo sapiens
ccgtgcccttgcccttgga

SEQ ID NO: 5395329 - DNA, 22 bp, Homo sapiens
ccgtgcctccaccaccactggc

SEQ ID NO: 5395330 - DNA, 14 bp, Homo sapiens
ccgtgcctgtgtcc

SEQ ID NO: 5395331 - DNA, 14 bp, Homo sapiens
ccgtgccttcagct

SEQ ID NO: 5395332 - DNA, 15 bp, Homo sapiens
ccgtgccttcagctc

SEQ ID NO: 5395333 - DNA, 21 bp, Homo sapiens
ccgtgcggcccgtgcgcagcc

SEQ ID NO: 5395334 - DNA, 18 bp, Homo sapiens
ccgtgcgggcgaggccgc

SEQ ID NO: 5395335 - DNA, 15 bp, Homo sapiens
ccgtgctcacagtag

SEQ ID NO: 5395336 - DNA, 21 bp, Homo sapiens
ccgtgctcctctgcccgcggg

SEQ ID NO: 5395337 - DNA, 21 bp, Homo sapiens
ccgtgctgacagctgctccta

SEQ ID NO: 5395338 - DNA, 20 bp, Homo sapiens
ccgtgctgagcacacaacag

SEQ ID NO: 5395339 - DNA, 14 bp, Homo sapiens
ccgtgctgggcagc

SEQ ID NO: 5395340 - DNA, 12 bp, Homo sapiens
ccgtgctgggct

SEQ ID NO: 5395341 - DNA, 20 bp, Homo sapiens
ccgtgctgtcttctggtctg

SEQ ID NO: 5395342 - DNA, 23 bp, Homo sapiens
ccgtgcttgtttgctcacctggg

SEQ ID NO: 5395343 - DNA, 18 bp, Homo sapiens
ccgtggaacattctggat

SEQ ID NO: 5395344 - DNA, 11 bp, Homo sapiens
ccgtggaagga

SEQ ID NO: 5395345 - DNA, 12 bp, Homo sapiens
ccgtggacaccc

SEQ ID NO: 5395346 - DNA, 14 bp, Homo sapiens
ccgtggacacccca

SEQ ID NO: 5395347 - DNA, 21 bp, Homo sapiens
ccgtggacagcccgccgtcag

SEQ ID NO: 5395348 - DNA, 13 bp, Homo sapiens
ccgtggacaggcc

SEQ ID NO: 5395349 - DNA, 14 bp, Homo sapiens
ccgtggacaggccc

SEQ ID NO: 5395350 - DNA, 16 bp, Homo sapiens
ccgtggacaggcccag

SEQ ID NO: 5395351 - DNA, 15 bp, Homo sapiens
ccgtggaccacctag

SEQ ID NO: 5395352 - DNA, 23 bp, Homo sapiens
ccgtggaccaggaggattgcctt

SEQ ID NO: 5395353 - DNA, 14 bp, Homo sapiens
ccgtggaccttcct

SEQ ID NO: 5395354 - DNA, 16 bp, Homo sapiens
ccgtggaccttcctgc

SEQ ID NO: 5395355 - DNA, 19 bp, Homo sapiens
ccgtggactggctcatgcc

SEQ ID NO: 5395356 - DNA, 22 bp, Homo sapiens
ccgtggagcttggagccccctg

SEQ ID NO: 5395357 - DNA, 14 bp, Homo sapiens
ccgtggaggaagct

SEQ ID NO: 5395358 - DNA, 11 bp, Homo sapiens
ccgtggaggct

SEQ ID NO: 5395359 - DNA, 14 bp, Homo sapiens
ccgtggaggctgct

SEQ ID NO: 5395360 - DNA, 15 bp, Homo sapiens
ccgtggaggctgctc

SEQ ID NO: 5395361 - DNA, 12 bp, Homo sapiens
ccgtggatctcc

SEQ ID NO: 5395362 - DNA, 14 bp, Homo sapiens
ccgtggatctcctt

SEQ ID NO: 5395363 - DNA, 23 bp, Homo sapiens
ccgtggatctccttcccttctct

SEQ ID NO: 5395364 - DNA, 21 bp, Homo sapiens
ccgtggatggccgtggatgcg

SEQ ID NO: 5395365 - DNA, 20 bp, Homo sapiens
ccgtggcacagctgggagcc

SEQ ID NO: 5395366 - DNA, 11 bp, Homo sapiens
ccgtggcacat

SEQ ID NO: 5395367 - DNA, 16 bp, Homo sapiens
ccgtggcagcttgctg

SEQ ID NO: 5395368 - DNA, 23 bp, Homo sapiens
ccgtggcatcaccttaggcaggg

SEQ ID NO: 5395369 - DNA, 19 bp, Homo sapiens
ccgtggccccagcctggcc

SEQ ID NO: 5395370 - DNA, 23 bp, Homo sapiens
ccgtggccccagcctggcccagc

SEQ ID NO: 5395371 - DNA, 18 bp, Homo sapiens
ccgtggccccgccctcag

SEQ ID NO: 5395372 - DNA, 15 bp, Homo sapiens
ccgtggccctgccct

SEQ ID NO: 5395373 - DNA, 14 bp, Homo sapiens
ccgtggcccttcct

SEQ ID NO: 5395374 - DNA, 16 bp, Homo sapiens
ccgtggcccttcctgg

SEQ ID NO: 5395375 - DNA, 17 bp, Homo sapiens
ccgtggcccttcctgga

SEQ ID NO: 5395376 - DNA, 19 bp, Homo sapiens
ccgtggcccttcctggaca

SEQ ID NO: 5395377 - DNA, 20 bp, Homo sapiens
ccgtggcccttcctggacag

SEQ ID NO: 5395378 - DNA, 18 bp, Homo sapiens
ccgtggcctggcatctgt

SEQ ID NO: 5395379 - DNA, 21 bp, Homo sapiens
ccgtggcctggcatctgtgcg

SEQ ID NO: 5395380 - DNA, 12 bp, Homo sapiens
ccgtggcctggg

SEQ ID NO: 5395381 - DNA, 17 bp, Homo sapiens
ccgtggcctgggcttgg

SEQ ID NO: 5395382 - DNA, 22 bp, Homo sapiens
ccgtggctccagaatgtgctgc

SEQ ID NO: 5395383 - DNA, 14 bp, Homo sapiens
cctacgaccccaga

SEQ ID NO: 5395384 - DNA, 22 bp, Homo sapiens
cctacgagggaggaacacctga

SEQ ID NO: 5395385 - DNA, 19 bp, Homo sapiens
cctacgctcatctctggaa

SEQ ID NO: 5395386 - DNA, 20 bp, Homo sapiens
cctacggagggtgggctctg

SEQ ID NO: 5395387 - DNA, 18 bp, Homo sapiens
cctacgggcgctgcagcc

SEQ ID NO: 5395388 - DNA, 15 bp, Homo sapiens
cctacggtacaagct

SEQ ID NO: 5395389 - DNA, 23 bp, Homo sapiens
cctacggtacaagctacatatgt

SEQ ID NO: 5395390 - DNA, 20 bp, Homo sapiens
cctacgtcaaacatgaagtg

SEQ ID NO: 5395391 - DNA, 18 bp, Homo sapiens
cctactaacatcccaata

SEQ ID NO: 5395392 - DNA, 12 bp, Homo sapiens
cctactaataaa

SEQ ID NO: 5395393 - DNA, 20 bp, Homo sapiens
cctactacatcgccctccac

SEQ ID NO: 5395394 - DNA, 19 bp, Homo sapiens
cctactaggagaggggggc

SEQ ID NO: 5395395 - DNA, 22 bp, Homo sapiens
cctactaggccattagcccttc

SEQ ID NO: 5395396 - DNA, 20 bp, Homo sapiens
cctactagttttccttgaaa

SEQ ID NO: 5395397 - DNA, 14 bp, Homo sapiens
cctactatacatta

SEQ ID NO: 5395398 - DNA, 16 bp, Homo sapiens
cctactatcactgaac

SEQ ID NO: 5395399 - DNA, 19 bp, Homo sapiens
cctactatgtgctgggtgc

SEQ ID NO: 5395400 - DNA, 21 bp, Homo sapiens
cctactatgtgctgggtgcct

SEQ ID NO: 5395401 - DNA, 13 bp, Homo sapiens
cctactatttaaa

SEQ ID NO: 5395402 - DNA, 16 bp, Homo sapiens
cctactccactgccct

SEQ ID NO: 5395403 - DNA, 16 bp, Homo sapiens
cctactcccctgatcc

SEQ ID NO: 5395404 - DNA, 17 bp, Homo sapiens
cctactccgttcctggc

SEQ ID NO: 5395405 - DNA, 16 bp, Homo sapiens
cctactcctccccctc

SEQ ID NO: 5395406 - DNA, 19 bp, Homo sapiens
cctactcctccccctcctc

SEQ ID NO: 5395407 - DNA, 14 bp, Homo sapiens
cctactcctggagc

SEQ ID NO: 5395408 - DNA, 18 bp, Homo sapiens
cctactcggatggggcac

SEQ ID NO: 5395409 - DNA, 22 bp, Homo sapiens
cctactcggatggggcacggac

SEQ ID NO: 5395410 - DNA, 15 bp, Homo sapiens
cctactcttcagggt

SEQ ID NO: 5395411 - DNA, 17 bp, Homo sapiens
cctactgaacccagagt

SEQ ID NO: 5395412 - DNA, 23 bp, Homo sapiens
cctactgaagggaacagcctgag

SEQ ID NO: 5395413 - DNA, 16 bp, Homo sapiens
cctactgaagtggctg

SEQ ID NO: 5395414 - DNA, 17 bp, Homo sapiens
cctactgaagtggctgg

SEQ ID NO: 5395415 - DNA, 22 bp, Homo sapiens
cctactgcactttcccccttcc

SEQ ID NO: 5395416 - DNA, 16 bp, Homo sapiens
cctactgcccaggcac

SEQ ID NO: 5395417 - DNA, 20 bp, Homo sapiens
cctactgcccctgccctgag

SEQ ID NO: 5395418 - DNA, 21 bp, Homo sapiens
cctactgcccctgccctgagg

SEQ ID NO: 5395419 - DNA, 11 bp, Homo sapiens
cctactgctgt

SEQ ID NO: 5395420 - DNA, 20 bp, Homo sapiens
cctactggagcttgatgtta

SEQ ID NO: 5395421 - DNA, 21 bp, Homo sapiens
cctactggatgcttacagtga

SEQ ID NO: 5395422 - DNA, 12 bp, Homo sapiens
cctactggctgt

SEQ ID NO: 5395423 - DNA, 15 bp, Homo sapiens
cctactgggagactg

SEQ ID NO: 5395424 - DNA, 16 bp, Homo sapiens
cctactggtctctcta

SEQ ID NO: 5395425 - DNA, 16 bp, Homo sapiens
cctactggtgtaatct

SEQ ID NO: 5395426 - DNA, 22 bp, Homo sapiens
cctactgtaatagatcagcatc

SEQ ID NO: 5395427 - DNA, 14 bp, Homo sapiens
cctactgtccctct

SEQ ID NO: 5395428 - DNA, 12 bp, Homo sapiens
cctactgtcctc

SEQ ID NO: 5395429 - DNA, 16 bp, Homo sapiens
cctactgtcctcagag

SEQ ID NO: 5395430 - DNA, 20 bp, Homo sapiens
cctactgtctccttcccact

SEQ ID NO: 5395431 - DNA, 21 bp, Homo sapiens
cctactgtctccttcccactg

SEQ ID NO: 5395432 - DNA, 16 bp, Homo sapiens
cctactgtgggcaaag

SEQ ID NO: 5395433 - DNA, 15 bp, Homo sapiens
cctactgttcctttc

SEQ ID NO: 5395434 - DNA, 22 bp, Homo sapiens
cctactgttctaaagctctgac

SEQ ID NO: 5395435 - DNA, 14 bp, Homo sapiens
cctactgttggatg

SEQ ID NO: 5395436 - DNA, 23 bp, Homo sapiens
cctactgtttaaattcccattcc

SEQ ID NO: 5395437 - DNA, 14 bp, Homo sapiens
cctacttaaacaaa

SEQ ID NO: 5395438 - DNA, 20 bp, Homo sapiens
cctacttaaacaaaaacttt

SEQ ID NO: 5395439 - DNA, 15 bp, Homo sapiens
cctacttaatgtaat

SEQ ID NO: 5395440 - DNA, 15 bp, Homo sapiens
cctacttccaggatg

SEQ ID NO: 5395441 - DNA, 17 bp, Homo sapiens
cctacttccaggttctg

SEQ ID NO: 5395442 - DNA, 12 bp, Homo sapiens
cctacttctcca

SEQ ID NO: 5395443 - DNA, 14 bp, Homo sapiens
cctacttctccagc

SEQ ID NO: 5395444 - DNA, 19 bp, Homo sapiens
cctacttctccagcctaga

SEQ ID NO: 5395445 - DNA, 16 bp, Homo sapiens
cctacttcttttgctc

SEQ ID NO: 5395446 - DNA, 22 bp, Homo sapiens
cctacttcttttgctcttagct

SEQ ID NO: 5395447 - DNA, 14 bp, Homo sapiens
cctacttgtgactg

SEQ ID NO: 5395448 - DNA, 16 bp, Homo sapiens
cctactttagccactg

SEQ ID NO: 5395449 - DNA, 21 bp, Homo sapiens
cctactttgactttttgcatt

SEQ ID NO: 5395450 - DNA, 20 bp, Homo sapiens
cctactttgcttccgccact

SEQ ID NO: 5395451 - DNA, 13 bp, Homo sapiens
cctacttttcaag

SEQ ID NO: 5395452 - DNA, 16 bp, Homo sapiens
cctacttttccttccc

SEQ ID NO: 5395453 - DNA, 17 bp, Homo sapiens
cctagaaacaacactgt

SEQ ID NO: 5395454 - DNA, 18 bp, Homo sapiens
cctagaaaccacctgggt

SEQ ID NO: 5395455 - DNA, 17 bp, Homo sapiens
cctagaaacccaagctc

SEQ ID NO: 5395456 - DNA, 22 bp, Homo sapiens
cctagaaacctttatccctgct

SEQ ID NO: 5395457 - DNA, 22 bp, Homo sapiens
cctagaaacgtttggaacaatc

SEQ ID NO: 5395458 - DNA, 19 bp, Homo sapiens
cctagaaagccatattcca

SEQ ID NO: 5395459 - DNA, 13 bp, Homo sapiens
cctagaaatatct

SEQ ID NO: 5395460 - DNA, 18 bp, Homo sapiens
cctagaaatatctttctc

SEQ ID NO: 5395461 - DNA, 16 bp, Homo sapiens
cctagaaatgtagcag

SEQ ID NO: 5395462 - DNA, 19 bp, Homo sapiens
cctagaaatgtagcagcag

SEQ ID NO: 5395463 - DNA, 21 bp, Homo sapiens
cctagaaattccccaccctga

SEQ ID NO: 5395464 - DNA, 22 bp, Homo sapiens
cctagaaattgaacaaaaatgt

SEQ ID NO: 5395465 - DNA, 16 bp, Homo sapiens
cctagaacatccctgg

SEQ ID NO: 5395466 - DNA, 23 bp, Homo sapiens
cctagaaccaagcttcagagcct

SEQ ID NO: 5395467 - DNA, 14 bp, Homo sapiens
cctagaactccagt

SEQ ID NO: 5395468 - DNA, 22 bp, Homo sapiens
cctagaagaaccaaatacctca

SEQ ID NO: 5395469 - DNA, 21 bp, Homo sapiens
cctagaagagcacagagccct

SEQ ID NO: 5395470 - DNA, 19 bp, Homo sapiens
cctagaagatcacagcagg

SEQ ID NO: 5395471 - DNA, 19 bp, Homo sapiens
cctagaagcacggctgtgg

SEQ ID NO: 5395472 - DNA, 23 bp, Homo sapiens
cctagaaggtggggacctggggg

SEQ ID NO: 5395473 - DNA, 16 bp, Homo sapiens
cctagaagtaagaaga

SEQ ID NO: 5395474 - DNA, 14 bp, Homo sapiens
cctagaagtctccc

SEQ ID NO: 5395475 - DNA, 16 bp, Homo sapiens
cctagaagtctccctg

SEQ ID NO: 5395476 - DNA, 21 bp, Homo sapiens
cctagaagtcttaattgtgtt

SEQ ID NO: 5395477 - DNA, 23 bp, Homo sapiens
cctagaagtcttaattgtgttta

SEQ ID NO: 5395478 - DNA, 14 bp, Homo sapiens
cctagaatctttat

SEQ ID NO: 5395479 - DNA, 15 bp, Homo sapiens
cctagaatctttatt

SEQ ID NO: 5395480 - DNA, 18 bp, Homo sapiens
cctagaatgtcagatttc

SEQ ID NO: 5395481 - DNA, 16 bp, Homo sapiens
cctagaattttctccc

SEQ ID NO: 5395482 - DNA, 23 bp, Homo sapiens
cctagacaacctttctgtagcct

SEQ ID NO: 5395483 - DNA, 23 bp, Homo sapiens
cctagaccagtttgcatgattct

SEQ ID NO: 5395484 - DNA, 15 bp, Homo sapiens
cctagacccaggtgg

SEQ ID NO: 5395485 - DNA, 13 bp, Homo sapiens
cctagaccctccc

SEQ ID NO: 5395486 - DNA, 20 bp, Homo sapiens
cctagacctgggccaaaagg

SEQ ID NO: 5395487 - DNA, 22 bp, Homo sapiens
cctagacctgggccaaaagggc

SEQ ID NO: 5395488 - DNA, 20 bp, Homo sapiens
cctagactctgtctacctgg

SEQ ID NO: 5395489 - DNA, 15 bp, Homo sapiens
cctagactgctcctg

SEQ ID NO: 5395490 - DNA, 17 bp, Homo sapiens
cctagactgctcctggg

SEQ ID NO: 5395491 - DNA, 18 bp, Homo sapiens
cctagactgctcctgggc

SEQ ID NO: 5395492 - DNA, 15 bp, Homo sapiens
cctagactgttactt

SEQ ID NO: 5395493 - DNA, 13 bp, Homo sapiens
cctagacttgaaa

SEQ ID NO: 5395494 - DNA, 19 bp, Homo sapiens
cctagagaacgcagcccta

SEQ ID NO: 5395495 - DNA, 17 bp, Homo sapiens
cctagagaagacaggct

SEQ ID NO: 5395496 - DNA, 19 bp, Homo sapiens
cctagagaagacaggctgg

SEQ ID NO: 5395497 - DNA, 22 bp, Homo sapiens
cctagagaagacaggctggaag

SEQ ID NO: 5395498 - DNA, 12 bp, Homo sapiens
cctagagactca

SEQ ID NO: 5395499 - DNA, 18 bp, Homo sapiens
cctagagagaataaattg

SEQ ID NO: 5395500 - DNA, 14 bp, Homo sapiens
cctagagaggctgg

SEQ ID NO: 5395501 - DNA, 17 bp, Homo sapiens
cctagagcactctcacc

SEQ ID NO: 5395502 - DNA, 19 bp, Homo sapiens
cctagagcactctcacccc

SEQ ID NO: 5395503 - DNA, 15 bp, Homo sapiens
cctagagcatctgtc

SEQ ID NO: 5395504 - DNA, 21 bp, Homo sapiens
cctagagcatctgtcccactg

SEQ ID NO: 5395505 - DNA, 22 bp, Homo sapiens
cctagagcatctgtcccactgg

SEQ ID NO: 5395506 - DNA, 12 bp, Homo sapiens
cctagagccaga

SEQ ID NO: 5395507 - DNA, 14 bp, Homo sapiens
cctagagccagacc

SEQ ID NO: 5395508 - DNA, 15 bp, Homo sapiens
cctagagccagacca

SEQ ID NO: 5395509 - DNA, 14 bp, Homo sapiens
cctagagcgcggct

SEQ ID NO: 5395510 - DNA, 21 bp, Homo sapiens
cctagagcgcggctggctctg

SEQ ID NO: 5395511 - DNA, 21 bp, Homo sapiens
cctagaggaggaaaaaggctg

SEQ ID NO: 5395512 - DNA, 20 bp, Homo sapiens
cctagaggccaaattctttt

SEQ ID NO: 5395513 - DNA, 20 bp, Homo sapiens
cctagaggccctttgctgtc

SEQ ID NO: 5395514 - DNA, 12 bp, Homo sapiens
cctagaggcctg

SEQ ID NO: 5395515 - DNA, 17 bp, Homo sapiens
cctagaggcgagccagg

SEQ ID NO: 5395516 - DNA, 16 bp, Homo sapiens
cctagagggaggggcc

SEQ ID NO: 5395517 - DNA, 19 bp, Homo sapiens
cctagaggggcaccttttc

SEQ ID NO: 5395518 - DNA, 16 bp, Homo sapiens
cctagaggtgggcagc

SEQ ID NO: 5395519 - DNA, 19 bp, Homo sapiens
cctagaggtgggcagctgg

SEQ ID NO: 5395520 - DNA, 20 bp, Homo sapiens
cctagaggtgggcagctggg

SEQ ID NO: 5395521 - DNA, 18 bp, Homo sapiens
cctagagtagagtggagg

SEQ ID NO: 5395522 - DNA, 22 bp, Homo sapiens
cctagagtctagggcacaaaga

SEQ ID NO: 5395523 - DNA, 23 bp, Homo sapiens
cctagagtgagggcctgaggtct

SEQ ID NO: 5395524 - DNA, 11 bp, Homo sapiens
cctagagtgta

SEQ ID NO: 5395525 - DNA, 15 bp, Homo sapiens
cctagatatgaatat

SEQ ID NO: 5395526 - DNA, 19 bp, Homo sapiens
cctagatccacacacagag

SEQ ID NO: 5395527 - DNA, 20 bp, Homo sapiens
cctagatccacgtgtggcct

SEQ ID NO: 5395528 - DNA, 23 bp, Homo sapiens
cctagatccacgtgtggcctccg

SEQ ID NO: 5395529 - DNA, 13 bp, Homo sapiens
cctagatccaggc

SEQ ID NO: 5395530 - DNA, 14 bp, Homo sapiens
cctagatccaggct

SEQ ID NO: 5395531 - DNA, 22 bp, Homo sapiens
cctagatccaggcttctcccgg

SEQ ID NO: 5395532 - DNA, 16 bp, Homo sapiens
cctagatcctaagggt

SEQ ID NO: 5395533 - DNA, 22 bp, Homo sapiens
cctagatgtttaacaaatctaa

SEQ ID NO: 5395534 - DNA, 23 bp, Homo sapiens
cctagattaggtagactttgctt

SEQ ID NO: 5395535 - DNA, 15 bp, Homo sapiens
cctagattatatcaa

SEQ ID NO: 5395536 - DNA, 16 bp, Homo sapiens
cctagattcagggaaa

SEQ ID NO: 5395537 - DNA, 19 bp, Homo sapiens
cctagcaacatatctctgc

SEQ ID NO: 5395538 - DNA, 18 bp, Homo sapiens
cctagcaagacctgttgg

SEQ ID NO: 5395539 - DNA, 17 bp, Homo sapiens
cctagcaagctggcctc

SEQ ID NO: 5395540 - DNA, 22 bp, Homo sapiens
cctagcacacctgaatcagctg

SEQ ID NO: 5395541 - DNA, 15 bp, Homo sapiens
cctagcacagcagct

SEQ ID NO: 5395542 - DNA, 16 bp, Homo sapiens
cctagcacagcagctt

SEQ ID NO: 5395543 - DNA, 15 bp, Homo sapiens
cctagcaccctggag

SEQ ID NO: 5395544 - DNA, 18 bp, Homo sapiens
cctagcactcacatgctg

SEQ ID NO: 5395545 - DNA, 17 bp, Homo sapiens
cctagcactttgggagg

SEQ ID NO: 5395546 - DNA, 17 bp, Homo sapiens
cctagcagacagaaact

SEQ ID NO: 5395547 - DNA, 14 bp, Homo sapiens
cctagcagagtgct

SEQ ID NO: 5395548 - DNA, 18 bp, Homo sapiens
cctagcagagtgctggca

SEQ ID NO: 5395549 - DNA, 21 bp, Homo sapiens
cctagcagagtgctggcactt

SEQ ID NO: 5395550 - DNA, 21 bp, Homo sapiens
cctagcagcaccgttctgtgc

SEQ ID NO: 5395551 - DNA, 22 bp, Homo sapiens
cctagcagcccaccctgctgct

SEQ ID NO: 5395552 - DNA, 13 bp, Homo sapiens
cctagcaggaact

SEQ ID NO: 5395553 - DNA, 19 bp, Homo sapiens
cctagcaggaacttctagc

SEQ ID NO: 5395554 - DNA, 20 bp, Homo sapiens
cctagcaggaacttctagct

SEQ ID NO: 5395555 - DNA, 19 bp, Homo sapiens
cctagcagtttgcctctgc

SEQ ID NO: 5395556 - DNA, 19 bp, Homo sapiens
cctagcatggggtcagccc

SEQ ID NO: 5395557 - DNA, 13 bp, Homo sapiens
cctagccaccagt

SEQ ID NO: 5395558 - DNA, 18 bp, Homo sapiens
cctagccaccagtgtcct

SEQ ID NO: 5395559 - DNA, 16 bp, Homo sapiens
cctatgaccataaaat

SEQ ID NO: 5395560 - DNA, 16 bp, Homo sapiens
cctatgaccctgtgcc

SEQ ID NO: 5395561 - DNA, 16 bp, Homo sapiens
cctatgactcaaagat

SEQ ID NO: 5395562 - DNA, 18 bp, Homo sapiens
cctatgactcaaagatga

SEQ ID NO: 5395563 - DNA, 16 bp, Homo sapiens
cctatgacttgggcac

SEQ ID NO: 5395564 - DNA, 15 bp, Homo sapiens
cctatgagagaagag

SEQ ID NO: 5395565 - DNA, 16 bp, Homo sapiens
cctatgagcatcctga

SEQ ID NO: 5395566 - DNA, 20 bp, Homo sapiens
cctatgagcatcctgagccc

SEQ ID NO: 5395567 - DNA, 21 bp, Homo sapiens
cctatgagcatcctgagcccc

SEQ ID NO: 5395568 - DNA, 22 bp, Homo sapiens
cctatgagcatcctgagccccg

SEQ ID NO: 5395569 - DNA, 18 bp, Homo sapiens
cctatgataattatttac

SEQ ID NO: 5395570 - DNA, 22 bp, Homo sapiens
cctatgataattatttacaaaa

SEQ ID NO: 5395571 - DNA, 16 bp, Homo sapiens
cctatgatactgtctc

SEQ ID NO: 5395572 - DNA, 15 bp, Homo sapiens
cctatgatggatggc

SEQ ID NO: 5395573 - DNA, 18 bp, Homo sapiens
cctatgatgtatactgcc

SEQ ID NO: 5395574 - DNA, 22 bp, Homo sapiens
cctatgatgtatactgccacta

SEQ ID NO: 5395575 - DNA, 14 bp, Homo sapiens
cctatgattgaaaa

SEQ ID NO: 5395576 - DNA, 18 bp, Homo sapiens
cctatgcactgaagagct

SEQ ID NO: 5395577 - DNA, 20 bp, Homo sapiens
cctatgcactgaagagctct

SEQ ID NO: 5395578 - DNA, 22 bp, Homo sapiens
cctatgcactgaagagctcttg

SEQ ID NO: 5395579 - DNA, 19 bp, Homo sapiens
cctatgcagaggtccacaa

SEQ ID NO: 5395580 - DNA, 15 bp, Homo sapiens
cctatgcagggaggc

SEQ ID NO: 5395581 - DNA, 19 bp, Homo sapiens
cctatgcatggtttcagca

SEQ ID NO: 5395582 - DNA, 17 bp, Homo sapiens
cctatgccaagtccctg

SEQ ID NO: 5395583 - DNA, 21 bp, Homo sapiens
cctatgccaagtccctggaaa

SEQ ID NO: 5395584 - DNA, 18 bp, Homo sapiens
cctatgccagtgctcaag

SEQ ID NO: 5395585 - DNA, 17 bp, Homo sapiens
cctatgcccagcctcca

SEQ ID NO: 5395586 - DNA, 20 bp, Homo sapiens
cctatgcccaggtaccaccc

SEQ ID NO: 5395587 - DNA, 12 bp, Homo sapiens
cctatgccctgc

SEQ ID NO: 5395588 - DNA, 19 bp, Homo sapiens
cctatgcctgtggtgaagt

SEQ ID NO: 5395589 - DNA, 20 bp, Homo sapiens
cctatgcctgtggtgaagtg

SEQ ID NO: 5395590 - DNA, 17 bp, Homo sapiens
cctatgccttcaaatag

SEQ ID NO: 5395591 - DNA, 18 bp, Homo sapiens
cctatgcttaataaaaga

SEQ ID NO: 5395592 - DNA, 21 bp, Homo sapiens
cctatgcttaataaaagaaca

SEQ ID NO: 5395593 - DNA, 18 bp, Homo sapiens
cctatgctttcacttccc

SEQ ID NO: 5395594 - DNA, 22 bp, Homo sapiens
cctatgctttcacttcccacct

SEQ ID NO: 5395595 - DNA, 12 bp, Homo sapiens
cctatgctttga

SEQ ID NO: 5395596 - DNA, 21 bp, Homo sapiens
cctatggaaaagggtcttctt

SEQ ID NO: 5395597 - DNA, 11 bp, Homo sapiens
cctatggaaac

SEQ ID NO: 5395598 - DNA, 15 bp, Homo sapiens
cctatggaaacattt

SEQ ID NO: 5395599 - DNA, 21 bp, Homo sapiens
cctatggaaagggtgtggctt

SEQ ID NO: 5395600 - DNA, 14 bp, Homo sapiens
cctatggagaattt

SEQ ID NO: 5395601 - DNA, 19 bp, Homo sapiens
cctatggagagccctggga

SEQ ID NO: 5395602 - DNA, 21 bp, Homo sapiens
cctatggagagccctgggacc

SEQ ID NO: 5395603 - DNA, 16 bp, Homo sapiens
cctatggagaggcttc

SEQ ID NO: 5395604 - DNA, 23 bp, Homo sapiens
cctatggcagaaaaaatgtctgt

SEQ ID NO: 5395605 - DNA, 20 bp, Homo sapiens
cctatggcccagccactgca

SEQ ID NO: 5395606 - DNA, 23 bp, Homo sapiens
cctatggcccagccactgcagca

SEQ ID NO: 5395607 - DNA, 12 bp, Homo sapiens
cctatggcctca

SEQ ID NO: 5395608 - DNA, 19 bp, Homo sapiens
cctatgggcctgccgggct

SEQ ID NO: 5395609 - DNA, 22 bp, Homo sapiens
cctatggtataatggttgactg

SEQ ID NO: 5395610 - DNA, 14 bp, Homo sapiens
cctatgtacagagc

SEQ ID NO: 5395611 - DNA, 16 bp, Homo sapiens
cctatgtacagagctt

SEQ ID NO: 5395612 - DNA, 14 bp, Homo sapiens
cctatgtatttgca

SEQ ID NO: 5395613 - DNA, 14 bp, Homo sapiens
cctatgtcctaagg

SEQ ID NO: 5395614 - DNA, 15 bp, Homo sapiens
cctatgtctcaggag

SEQ ID NO: 5395615 - DNA, 17 bp, Homo sapiens
cctatgtctcaggagtg

SEQ ID NO: 5395616 - DNA, 15 bp, Homo sapiens
cctatgtctcagtgc

SEQ ID NO: 5395617 - DNA, 21 bp, Homo sapiens
cctatgtctggcagatgaggg

SEQ ID NO: 5395618 - DNA, 22 bp, Homo sapiens
cctatgtgattttaactctgtc

SEQ ID NO: 5395619 - DNA, 23 bp, Homo sapiens
cctatgtgattttaactctgtct

SEQ ID NO: 5395620 - DNA, 17 bp, Homo sapiens
cctatgtgcgaagcaag

SEQ ID NO: 5395621 - DNA, 17 bp, Homo sapiens
cctatgtggcagctggg

SEQ ID NO: 5395622 - DNA, 11 bp, Homo sapiens
cctatgtgtaa

SEQ ID NO: 5395623 - DNA, 15 bp, Homo sapiens
cctatgttgcccagg

SEQ ID NO: 5395624 - DNA, 20 bp, Homo sapiens
cctatgttgctataagaaaa

SEQ ID NO: 5395625 - DNA, 23 bp, Homo sapiens
cctatgttgtaattttacttttt

SEQ ID NO: 5395626 - DNA, 23 bp, Homo sapiens
cctatgtttgtctcacttttcat

SEQ ID NO: 5395627 - DNA, 17 bp, Homo sapiens
cctattaaaacacagct

SEQ ID NO: 5395628 - DNA, 19 bp, Homo sapiens
cctattaaaagttgcaaag

SEQ ID NO: 5395629 - DNA, 14 bp, Homo sapiens
cctattaatcttca

SEQ ID NO: 5395630 - DNA, 15 bp, Homo sapiens
cctattacttttcat

SEQ ID NO: 5395631 - DNA, 21 bp, Homo sapiens
cctattaggtggaaattttat

SEQ ID NO: 5395632 - DNA, 11 bp, Homo sapiens
cctattagtgt

SEQ ID NO: 5395633 - DNA, 22 bp, Homo sapiens
cctattcacgccgtaattcttt

SEQ ID NO: 5395634 - DNA, 23 bp, Homo sapiens
cctattcacgccgtaattctttc

SEQ ID NO: 5395635 - DNA, 17 bp, Homo sapiens
cctattccaagcttcca

SEQ ID NO: 5395636 - DNA, 14 bp, Homo sapiens
cctattcccacacc

SEQ ID NO: 5395637 - DNA, 21 bp, Homo sapiens
cctattcccacacctccacag

SEQ ID NO: 5395638 - DNA, 20 bp, Homo sapiens
cctattcgtagccatctccg

SEQ ID NO: 5395639 - DNA, 16 bp, Homo sapiens
cctattctataaaact

SEQ ID NO: 5395640 - DNA, 13 bp, Homo sapiens
cctattctcctgc

SEQ ID NO: 5395641 - DNA, 14 bp, Homo sapiens
cctattctcctgcc

SEQ ID NO: 5395642 - DNA, 11 bp, Homo sapiens
cctattctgaa

SEQ ID NO: 5395643 - DNA, 13 bp, Homo sapiens
cctattctgtgtt

SEQ ID NO: 5395644 - DNA, 22 bp, Homo sapiens
cctattgctagagctcctccct

SEQ ID NO: 5395645 - DNA, 21 bp, Homo sapiens
cctattgctgtaaataaaaat

SEQ ID NO: 5395646 - DNA, 24 bp, Homo sapiens
cctattgctgtaaataaaaatagc

SEQ ID NO: 5395647 - DNA, 23 bp, Homo sapiens
cctattgcttgggtctctctcca

SEQ ID NO: 5395648 - DNA, 12 bp, Homo sapiens
cctattgggaca

SEQ ID NO: 5395649 - DNA, 15 bp, Homo sapiens
cctattgtcattaaa

SEQ ID NO: 5395650 - DNA, 22 bp, Homo sapiens
cctattgtgactcttctaaaaa

SEQ ID NO: 5395651 - DNA, 17 bp, Homo sapiens
cctattgttgaataaat

SEQ ID NO: 5395652 - DNA, 19 bp, Homo sapiens
cctatttactggaaacctg

SEQ ID NO: 5395653 - DNA, 14 bp, Homo sapiens
cctatttatgaaaa

SEQ ID NO: 5395654 - DNA, 22 bp, Homo sapiens
cctatttattaatattttacag

SEQ ID NO: 5395655 - DNA, 15 bp, Homo sapiens
cctatttattcattc

SEQ ID NO: 5395656 - DNA, 17 bp, Homo sapiens
cctatttattgactttg

SEQ ID NO: 5395657 - DNA, 13 bp, Homo sapiens
cctatttattggg

SEQ ID NO: 5395658 - DNA, 16 bp, Homo sapiens
cctatttcaaaaattt

SEQ ID NO: 5395659 - DNA, 12 bp, Homo sapiens
cctatttcagaa

SEQ ID NO: 5395660 - DNA, 13 bp, Homo sapiens
cctatttctcttt

SEQ ID NO: 5395661 - DNA, 15 bp, Homo sapiens
cctatttctctttct

SEQ ID NO: 5395662 - DNA, 13 bp, Homo sapiens
cctatttctgatg

SEQ ID NO: 5395663 - DNA, 15 bp, Homo sapiens
cctatttcttgataa

SEQ ID NO: 5395664 - DNA, 14 bp, Homo sapiens
cctatttgaccaga

SEQ ID NO: 5395665 - DNA, 17 bp, Homo sapiens
cctatttgccatgggct

SEQ ID NO: 5395666 - DNA, 13 bp, Homo sapiens
cctatttgtttca

SEQ ID NO: 5395667 - DNA, 20 bp, Homo sapiens
cctattttaaaaccatgcag

SEQ ID NO: 5395668 - DNA, 20 bp, Homo sapiens
cctattttagggttctaaat

SEQ ID NO: 5395669 - DNA, 15 bp, Homo sapiens
cctattttcatttgt

SEQ ID NO: 5395670 - DNA, 20 bp, Homo sapiens
cctattttcatttgtacaag

SEQ ID NO: 5395671 - DNA, 17 bp, Homo sapiens
cctattttcttttccat

SEQ ID NO: 5395672 - DNA, 20 bp, Homo sapiens
cctattttgaaaaattccta

SEQ ID NO: 5395673 - DNA, 21 bp, Homo sapiens
cctattttgaaaaattcctat

SEQ ID NO: 5395674 - DNA, 22 bp, Homo sapiens
cctattttgaaaaattcctatt

SEQ ID NO: 5395675 - DNA, 16 bp, Homo sapiens
cctattttgtaatttt

SEQ ID NO: 5395676 - DNA, 19 bp, Homo sapiens
cctatttttctctcctgtc

SEQ ID NO: 5395677 - DNA, 20 bp, Homo sapiens
cctatttttgacatggaaat

SEQ ID NO: 5395678 - DNA, 23 bp, Homo sapiens
cctatttttgacatggaaatgaa

SEQ ID NO: 5395679 - DNA, 22 bp, Homo sapiens
cctatttttgtagatctccatg

SEQ ID NO: 5395680 - DNA, 21 bp, Homo sapiens
cctatttttgtagatgctatt

SEQ ID NO: 5395681 - DNA, 23 bp, Homo sapiens
cctattttttgacacttccattg

SEQ ID NO: 5395682 - DNA, 18 bp, Homo sapiens
cctcaaaaagcagaagga

SEQ ID NO: 5395683 - DNA, 13 bp, Homo sapiens
cctcaaaacactt

SEQ ID NO: 5395684 - DNA, 15 bp, Homo sapiens
cctcaaaactggagt

SEQ ID NO: 5395685 - DNA, 17 bp, Homo sapiens
cctcaaaactggagtcc

SEQ ID NO: 5395686 - DNA, 16 bp, Homo sapiens
cctcaaaagaaaatgt

SEQ ID NO: 5395687 - DNA, 14 bp, Homo sapiens
cctcaaaagcactt

SEQ ID NO: 5395688 - DNA, 20 bp, Homo sapiens
cctcaaaataagccatgctg

SEQ ID NO: 5395689 - DNA, 13 bp, Homo sapiens
cctcaaacactgc

SEQ ID NO: 5395690 - DNA, 15 bp, Homo sapiens
cctcaaacactgcag

SEQ ID NO: 5395691 - DNA, 17 bp, Homo sapiens
cctcaaacactgcaggc

SEQ ID NO: 5395692 - DNA, 16 bp, Homo sapiens
cctcaaactaggagga

SEQ ID NO: 5395693 - DNA, 18 bp, Homo sapiens
cctcaaactaggaggaaa

SEQ ID NO: 5395694 - DNA, 20 bp, Homo sapiens
cctcaaactaggaggaaaag

SEQ ID NO: 5395695 - DNA, 15 bp, Homo sapiens
cctcaaactcattgc

SEQ ID NO: 5395696 - DNA, 16 bp, Homo sapiens
cctcaaactcattgca

SEQ ID NO: 5395697 - DNA, 16 bp, Homo sapiens
cctcaaactgcacatc

SEQ ID NO: 5395698 - DNA, 11 bp, Homo sapiens
cctcaaactgg

SEQ ID NO: 5395699 - DNA, 14 bp, Homo sapiens
cctcaaagaaagtg

SEQ ID NO: 5395700 - DNA, 20 bp, Homo sapiens
cctcaaagaagtcggaatgt

SEQ ID NO: 5395701 - DNA, 16 bp, Homo sapiens
cctcaaagattctgca

SEQ ID NO: 5395702 - DNA, 20 bp, Homo sapiens
cctcaaagcaacccgctgga

SEQ ID NO: 5395703 - DNA, 23 bp, Homo sapiens
cctcaaagcaacccgctggagcc

SEQ ID NO: 5395704 - DNA, 19 bp, Homo sapiens
cctcaaagcacctgaacca

SEQ ID NO: 5395705 - DNA, 20 bp, Homo sapiens
cctcaaagtcccttgagact

SEQ ID NO: 5395706 - DNA, 21 bp, Homo sapiens
cctcaaataaaaagtgctttt

SEQ ID NO: 5395707 - DNA, 12 bp, Homo sapiens
cctcaaatacat

SEQ ID NO: 5395708 - DNA, 21 bp, Homo sapiens
cctcaaatacatacctactga

SEQ ID NO: 5395709 - DNA, 15 bp, Homo sapiens
cctcaaatacatgca

SEQ ID NO: 5395710 - DNA, 13 bp, Homo sapiens
cctcaaatatagt

SEQ ID NO: 5395711 - DNA, 14 bp, Homo sapiens
cctcaaatcactgc

SEQ ID NO: 5395712 - DNA, 17 bp, Homo sapiens
cctcaaatccaggaccc

SEQ ID NO: 5395713 - DNA, 19 bp, Homo sapiens
cctcaaatccaggaccctg

SEQ ID NO: 5395714 - DNA, 24 bp, Homo sapiens
cctcaaatccaggaccctgccagg

SEQ ID NO: 5395715 - DNA, 13 bp, Homo sapiens
cctcaaatgaatt

SEQ ID NO: 5395716 - DNA, 19 bp, Homo sapiens
cctcaaatgatgtgcctgc

SEQ ID NO: 5395717 - DNA, 23 bp, Homo sapiens
cctcaaatgatgtgcctgcttca

SEQ ID NO: 5395718 - DNA, 19 bp, Homo sapiens
cctcaaatgggtctggggg

SEQ ID NO: 5395719 - DNA, 18 bp, Homo sapiens
cctcaaatgtcagagcta

SEQ ID NO: 5395720 - DNA, 17 bp, Homo sapiens
cctcaaattactttgtg

SEQ ID NO: 5395721 - DNA, 17 bp, Homo sapiens
cctcaaattttttgact

SEQ ID NO: 5395722 - DNA, 15 bp, Homo sapiens
cctcaacaagggaga

SEQ ID NO: 5395723 - DNA, 16 bp, Homo sapiens
cctcaacaagggagag

SEQ ID NO: 5395724 - DNA, 17 bp, Homo sapiens
cctcaacaagggagaga

SEQ ID NO: 5395725 - DNA, 15 bp, Homo sapiens
cctcaacagcaggag

SEQ ID NO: 5395726 - DNA, 23 bp, Homo sapiens
cctcaacagcaggaggcacagca

SEQ ID NO: 5395727 - DNA, 14 bp, Homo sapiens
cctcaacaggccca

SEQ ID NO: 5395728 - DNA, 22 bp, Homo sapiens
cctcaacaggcccagggaggga

SEQ ID NO: 5395729 - DNA, 17 bp, Homo sapiens
cctcaacagtgttttca

SEQ ID NO: 5395730 - DNA, 21 bp, Homo sapiens
cctcaaccctccctcagcccc

SEQ ID NO: 5395731 - DNA, 16 bp, Homo sapiens
cctcaacctccctggc

SEQ ID NO: 5395732 - DNA, 16 bp, Homo sapiens
cctcaacctcctgggc

SEQ ID NO: 5395733 - DNA, 20 bp, Homo sapiens
cctcaacctcctgtggaacc

SEQ ID NO: 5395734 - DNA, 13 bp, Homo sapiens
cctcaacctgtga

SEQ ID NO: 5395735 - DNA, 14 bp, Homo sapiens
cctcaactccagga

SEQ ID NO: 5395736 - DNA, 22 bp, Homo sapiens
cctcagcaagctgcccagccct

SEQ ID NO: 5395737 - DNA, 15 bp, Homo sapiens
cctcagcaccccact

SEQ ID NO: 5395738 - DNA, 20 bp, Homo sapiens
cctcagcaccccactcctca

SEQ ID NO: 5395739 - DNA, 13 bp, Homo sapiens
cctcagcacccct

SEQ ID NO: 5395740 - DNA, 14 bp, Homo sapiens
cctcagcacccctt

SEQ ID NO: 5395741 - DNA, 17 bp, Homo sapiens
cctcagcagaaggcctt

SEQ ID NO: 5395742 - DNA, 13 bp, Homo sapiens
cctcagcatccca

SEQ ID NO: 5395743 - DNA, 16 bp, Homo sapiens
cctcagcatcctggca

SEQ ID NO: 5395744 - DNA, 18 bp, Homo sapiens
cctcagcatttccttcca

SEQ ID NO: 5395745 - DNA, 14 bp, Homo sapiens
cctcagccaccctt

SEQ ID NO: 5395746 - DNA, 20 bp, Homo sapiens
cctcagccacccttggtctc

SEQ ID NO: 5395747 - DNA, 12 bp, Homo sapiens
cctcagccacgc

SEQ ID NO: 5395748 - DNA, 21 bp, Homo sapiens
cctcagccacgcctctctcag

SEQ ID NO: 5395749 - DNA, 16 bp, Homo sapiens
cctcagccactcccag

SEQ ID NO: 5395750 - DNA, 14 bp, Homo sapiens
cctcagccagcctc

SEQ ID NO: 5395751 - DNA, 16 bp, Homo sapiens
cctcagccagcctcct

SEQ ID NO: 5395752 - DNA, 13 bp, Homo sapiens
cctcagccaggcc

SEQ ID NO: 5395753 - DNA, 14 bp, Homo sapiens
cctcagccaggccc

SEQ ID NO: 5395754 - DNA, 16 bp, Homo sapiens
cctcagccaggccctg

SEQ ID NO: 5395755 - DNA, 19 bp, Homo sapiens
cctcagccagtggcacagg

SEQ ID NO: 5395756 - DNA, 16 bp, Homo sapiens
cctcagccatgaggag

SEQ ID NO: 5395757 - DNA, 20 bp, Homo sapiens
cctcagccatgggaacctca

SEQ ID NO: 5395758 - DNA, 16 bp, Homo sapiens
cctcagccattcactg

SEQ ID NO: 5395759 - DNA, 12 bp, Homo sapiens
cctcagcccaac

SEQ ID NO: 5395760 - DNA, 13 bp, Homo sapiens
cctcagcccaact

SEQ ID NO: 5395761 - DNA, 21 bp, Homo sapiens
cctcagcccaacttcttaccc

SEQ ID NO: 5395762 - DNA, 23 bp, Homo sapiens
cctcagccccactgacacccagt

SEQ ID NO: 5395763 - DNA, 18 bp, Homo sapiens
cctcagccccagcccaga

SEQ ID NO: 5395764 - DNA, 19 bp, Homo sapiens
cctcagccccagcccagac

SEQ ID NO: 5395765 - DNA, 15 bp, Homo sapiens
cctcagccccagggc

SEQ ID NO: 5395766 - DNA, 19 bp, Homo sapiens
cctcagccccagggccctg

SEQ ID NO: 5395767 - DNA, 14 bp, Homo sapiens
cctcagcccccagg

SEQ ID NO: 5395768 - DNA, 19 bp, Homo sapiens
cctcagcccccaggccagg

SEQ ID NO: 5395769 - DNA, 18 bp, Homo sapiens
cctcagccccgcgtggaa

SEQ ID NO: 5395770 - DNA, 17 bp, Homo sapiens
cctcagcccctccagtc

SEQ ID NO: 5395771 - DNA, 19 bp, Homo sapiens
cctcagcccctcttgcccc

SEQ ID NO: 5395772 - DNA, 16 bp, Homo sapiens
cctcagccctcagaac

SEQ ID NO: 5395773 - DNA, 15 bp, Homo sapiens
cctcagccctcagtt

SEQ ID NO: 5395774 - DNA, 12 bp, Homo sapiens
cctcagccctct

SEQ ID NO: 5395775 - DNA, 14 bp, Homo sapiens
cctcagccctctct

SEQ ID NO: 5395776 - DNA, 16 bp, Homo sapiens
cctcagccctctcttg

SEQ ID NO: 5395777 - DNA, 19 bp, Homo sapiens
cctcagccctctcttgcca

SEQ ID NO: 5395778 - DNA, 13 bp, Homo sapiens
cctcagccctggc

SEQ ID NO: 5395779 - DNA, 16 bp, Homo sapiens
cctcagccctggccct

SEQ ID NO: 5395780 - DNA, 21 bp, Homo sapiens
cctcagccctggcctttttct

SEQ ID NO: 5395781 - DNA, 11 bp, Homo sapiens
cctcagccctt

SEQ ID NO: 5395782 - DNA, 17 bp, Homo sapiens
cctcagcccttgccccc

SEQ ID NO: 5395783 - DNA, 22 bp, Homo sapiens
cctcagcccttgcccccatccc

SEQ ID NO: 5395784 - DNA, 16 bp, Homo sapiens
cctcagcctagaccct

SEQ ID NO: 5395785 - DNA, 12 bp, Homo sapiens
cctcagcctcag

SEQ ID NO: 5395786 - DNA, 14 bp, Homo sapiens
cctcagcctcagag

SEQ ID NO: 5395787 - DNA, 11 bp, Homo sapiens
cctcagcctcc

SEQ ID NO: 5395788 - DNA, 13 bp, Homo sapiens
cctcagcctccaa

SEQ ID NO: 5395789 - DNA, 18 bp, Homo sapiens
cctcagcctccaaagtgg

SEQ ID NO: 5395790 - DNA, 22 bp, Homo sapiens
cctcagcctccaaagtggagct

SEQ ID NO: 5395791 - DNA, 14 bp, Homo sapiens
cctcagcctccagg

SEQ ID NO: 5395792 - DNA, 16 bp, Homo sapiens
cctcagcctccaggca

SEQ ID NO: 5395793 - DNA, 22 bp, Homo sapiens
cctcagcctcccaagtagctgg

SEQ ID NO: 5395794 - DNA, 17 bp, Homo sapiens
cctcagcctcccagagt

SEQ ID NO: 5395795 - DNA, 16 bp, Homo sapiens
cctcagcctccccagt

SEQ ID NO: 5395796 - DNA, 22 bp, Homo sapiens
cctcagcctcccgaatagctgg

SEQ ID NO: 5395797 - DNA, 15 bp, Homo sapiens
cctcagcctccctgg

SEQ ID NO: 5395798 - DNA, 12 bp, Homo sapiens
cctcagcctccg

SEQ ID NO: 5395799 - DNA, 22 bp, Homo sapiens
cctcagcctcctaagcagctgg

SEQ ID NO: 5395800 - DNA, 23 bp, Homo sapiens
cctcagcctcctgaacagctggg

SEQ ID NO: 5395801 - DNA, 22 bp, Homo sapiens
cctcagcctcctgagtagctgg

SEQ ID NO: 5395802 - DNA, 16 bp, Homo sapiens
cctcagcctcctgggt

SEQ ID NO: 5395803 - DNA, 16 bp, Homo sapiens
cctcagcctctgcaac

SEQ ID NO: 5395804 - DNA, 16 bp, Homo sapiens
cctcagcctctgccac

SEQ ID NO: 5395805 - DNA, 17 bp, Homo sapiens
cctcagcctctgccact

SEQ ID NO: 5395806 - DNA, 20 bp, Homo sapiens
cctcagcctctgccactgtg

SEQ ID NO: 5395807 - DNA, 13 bp, Homo sapiens
cctcagcctcttc

SEQ ID NO: 5395808 - DNA, 14 bp, Homo sapiens
cctcagcctcttct

SEQ ID NO: 5395809 - DNA, 19 bp, Homo sapiens
cctcagcctgaaccccagg

SEQ ID NO: 5395810 - DNA, 21 bp, Homo sapiens
cctcagcctgaaccccagggc

SEQ ID NO: 5395811 - DNA, 11 bp, Homo sapiens
cctcagcctgc

SEQ ID NO: 5395812 - DNA, 12 bp, Homo sapiens
cctcagcctgca

SEQ ID NO: 5395813 - DNA, 14 bp, Homo sapiens
cctcagcctgcaca

SEQ ID NO: 5395814 - DNA, 17 bp, Homo sapiens
cctcagcctgcaccctc

SEQ ID NO: 5395815 - DNA, 12 bp, Homo sapiens
cctcagcctgcc

SEQ ID NO: 5395816 - DNA, 15 bp, Homo sapiens
cctcagcctgcccac

SEQ ID NO: 5395817 - DNA, 16 bp, Homo sapiens
cctcagcctgcccacc

SEQ ID NO: 5395818 - DNA, 21 bp, Homo sapiens
cctcagcctggagaggcctgg

SEQ ID NO: 5395819 - DNA, 14 bp, Homo sapiens
cctcagcctggcca

SEQ ID NO: 5395820 - DNA, 16 bp, Homo sapiens
cctcagcctggccaga

SEQ ID NO: 5395821 - DNA, 18 bp, Homo sapiens
cctcagcctggccagaca

SEQ ID NO: 5395822 - DNA, 19 bp, Homo sapiens
cctcagcctggccagacac

SEQ ID NO: 5395823 - DNA, 21 bp, Homo sapiens
cctcagcctggccagacacag

SEQ ID NO: 5395824 - DNA, 12 bp, Homo sapiens
cctcagcctggg

SEQ ID NO: 5395825 - DNA, 16 bp, Homo sapiens
cctcagcctgggcgct

SEQ ID NO: 5395826 - DNA, 13 bp, Homo sapiens
cctcagcctgggg

SEQ ID NO: 5395827 - DNA, 19 bp, Homo sapiens
cctcagcctggggctctct

SEQ ID NO: 5395828 - DNA, 20 bp, Homo sapiens
cctcagcctggggctctctg

SEQ ID NO: 5395829 - DNA, 21 bp, Homo sapiens
cctcagcctggggctctctga

SEQ ID NO: 5395830 - DNA, 14 bp, Homo sapiens
cctcagccttctga

SEQ ID NO: 5395831 - DNA, 23 bp, Homo sapiens
cctcagccttgaaaaacaagtct

SEQ ID NO: 5395832 - DNA, 17 bp, Homo sapiens
cctcagccttgccagag

SEQ ID NO: 5395833 - DNA, 21 bp, Homo sapiens
cctcagcgagaggcagcaagg

SEQ ID NO: 5395834 - DNA, 14 bp, Homo sapiens
cctcagcgcaggct

SEQ ID NO: 5395835 - DNA, 18 bp, Homo sapiens
cctcagcgcccccagagc

SEQ ID NO: 5395836 - DNA, 16 bp, Homo sapiens
cctcagcgctccctgt

SEQ ID NO: 5395837 - DNA, 15 bp, Homo sapiens
cctcagcgctgccca

SEQ ID NO: 5395838 - DNA, 16 bp, Homo sapiens
cctcagcgctgcccac

SEQ ID NO: 5395839 - DNA, 19 bp, Homo sapiens
cctcagcgggggccttgaa

SEQ ID NO: 5395840 - DNA, 20 bp, Homo sapiens
cctcagcgggggccttgaag

SEQ ID NO: 5395841 - DNA, 17 bp, Homo sapiens
cctcagcgtcctgggct

SEQ ID NO: 5395842 - DNA, 16 bp, Homo sapiens
cctcagcgtctcccca

SEQ ID NO: 5395843 - DNA, 19 bp, Homo sapiens
cctcagcgtctccccatgc

SEQ ID NO: 5395844 - DNA, 15 bp, Homo sapiens
cctcagctagctctg

SEQ ID NO: 5395845 - DNA, 18 bp, Homo sapiens
cctcagctagctctgcca

SEQ ID NO: 5395846 - DNA, 17 bp, Homo sapiens
cctcagctcagcctccc

SEQ ID NO: 5395847 - DNA, 11 bp, Homo sapiens
cctcagctcca

SEQ ID NO: 5395848 - DNA, 11 bp, Homo sapiens
cctcagctccc

SEQ ID NO: 5395849 - DNA, 22 bp, Homo sapiens
cctcagctccccggcactgcag

SEQ ID NO: 5395850 - DNA, 15 bp, Homo sapiens
cctcagctccctgac

SEQ ID NO: 5395851 - DNA, 16 bp, Homo sapiens
cctcagctccctgacc

SEQ ID NO: 5395852 - DNA, 17 bp, Homo sapiens
cctcagctccctgaccc

SEQ ID NO: 5395853 - DNA, 20 bp, Homo sapiens
cctcagctccctgcctgttt

SEQ ID NO: 5395854 - DNA, 21 bp, Homo sapiens
cctcagctccctgcctgtttc

SEQ ID NO: 5395855 - DNA, 15 bp, Homo sapiens
cctcagctcggctca

SEQ ID NO: 5395856 - DNA, 18 bp, Homo sapiens
cctcagctcggctcagct

SEQ ID NO: 5395857 - DNA, 14 bp, Homo sapiens
cctcagctctaggc

SEQ ID NO: 5395858 - DNA, 19 bp, Homo sapiens
cctcagctctaggctgttc

SEQ ID NO: 5395859 - DNA, 17 bp, Homo sapiens
cctcagctctcagttgc

SEQ ID NO: 5395860 - DNA, 17 bp, Homo sapiens
cctcagctctccctcac

SEQ ID NO: 5395861 - DNA, 12 bp, Homo sapiens
cctcagctctgg

SEQ ID NO: 5395862 - DNA, 14 bp, Homo sapiens
cctcagctctggga

SEQ ID NO: 5395863 - DNA, 20 bp, Homo sapiens
cctcagctctgtcctgttag

SEQ ID NO: 5395864 - DNA, 20 bp, Homo sapiens
cctcagctgacccggcctct

SEQ ID NO: 5395865 - DNA, 21 bp, Homo sapiens
cctcagctgcatggagcctgg

SEQ ID NO: 5395866 - DNA, 22 bp, Homo sapiens
cctcagctgcatggagcctgga

SEQ ID NO: 5395867 - DNA, 13 bp, Homo sapiens
cctcagctgccaa

SEQ ID NO: 5395868 - DNA, 12 bp, Homo sapiens
cctcagctgcct

SEQ ID NO: 5395869 - DNA, 18 bp, Homo sapiens
cctcagctgcctcctgcg

SEQ ID NO: 5395870 - DNA, 19 bp, Homo sapiens
cctcagctgctcccacact

SEQ ID NO: 5395871 - DNA, 13 bp, Homo sapiens
cctcagctgctcg

SEQ ID NO: 5395872 - DNA, 19 bp, Homo sapiens
cctcagctgctcgcacaga

SEQ ID NO: 5395873 - DNA, 22 bp, Homo sapiens
cctcagctggcggaacctggct

SEQ ID NO: 5395874 - DNA, 15 bp, Homo sapiens
cctcagctggctgta

SEQ ID NO: 5395875 - DNA, 19 bp, Homo sapiens
cctcagctggtcctgacca

SEQ ID NO: 5395876 - DNA, 22 bp, Homo sapiens
cctcagctggtcctgaccagga

SEQ ID NO: 5395877 - DNA, 19 bp, Homo sapiens
cctcagctgtcacctgctc

SEQ ID NO: 5395878 - DNA, 20 bp, Homo sapiens
cctcagctgtcacctgctca

SEQ ID NO: 5395879 - DNA, 18 bp, Homo sapiens
cctcagcttccccagtag

SEQ ID NO: 5395880 - DNA, 21 bp, Homo sapiens
cctcagcttccccagtagctg

SEQ ID NO: 5395881 - DNA, 21 bp, Homo sapiens
cctcagcttcttcacaggcac

SEQ ID NO: 5395882 - DNA, 21 bp, Homo sapiens
cctcagcttgggcttcttcct

SEQ ID NO: 5395883 - DNA, 12 bp, Homo sapiens
cctcaggaaaga

SEQ ID NO: 5395884 - DNA, 13 bp, Homo sapiens
cctcaggaaagaa

SEQ ID NO: 5395885 - DNA, 18 bp, Homo sapiens
cctcaggaaagaatagaa

SEQ ID NO: 5395886 - DNA, 16 bp, Homo sapiens
cctcaggaacccaccc

SEQ ID NO: 5395887 - DNA, 23 bp, Homo sapiens
cctcaggaacccaccctctccac

SEQ ID NO: 5395888 - DNA, 15 bp, Homo sapiens
cctcaggaaggacat

SEQ ID NO: 5395889 - DNA, 16 bp, Homo sapiens
cctcaggaatgggctg

SEQ ID NO: 5395890 - DNA, 18 bp, Homo sapiens
cctcaggacccatccctg

SEQ ID NO: 5395891 - DNA, 19 bp, Homo sapiens
cctcaggaccccagaggga

SEQ ID NO: 5395892 - DNA, 17 bp, Homo sapiens
cctcaggaccctcagcc

SEQ ID NO: 5395893 - DNA, 15 bp, Homo sapiens
cctcaggaccctcgc

SEQ ID NO: 5395894 - DNA, 16 bp, Homo sapiens
cctcaggaccctcgct

SEQ ID NO: 5395895 - DNA, 19 bp, Homo sapiens
cctcaggaccctcgctggc

SEQ ID NO: 5395896 - DNA, 16 bp, Homo sapiens
cctcaggactgggagc

SEQ ID NO: 5395897 - DNA, 17 bp, Homo sapiens
cctcaggactgggagcc

SEQ ID NO: 5395898 - DNA, 13 bp, Homo sapiens
cctcaggagagac

SEQ ID NO: 5395899 - DNA, 12 bp, Homo sapiens
cctcaggagccg

SEQ ID NO: 5395900 - DNA, 21 bp, Homo sapiens
cctcaggagccgaagcccagg

SEQ ID NO: 5395901 - DNA, 22 bp, Homo sapiens
cctcaggagccgaagcccaggg

SEQ ID NO: 5395902 - DNA, 19 bp, Homo sapiens
cctcaggaggtcacctgcc

SEQ ID NO: 5395903 - DNA, 19 bp, Homo sapiens
cctcaggagtttctatagg

SEQ ID NO: 5395904 - DNA, 17 bp, Homo sapiens
cctcaggattgtttctc

SEQ ID NO: 5395905 - DNA, 16 bp, Homo sapiens
cctcaggcacacagct

SEQ ID NO: 5395906 - DNA, 15 bp, Homo sapiens
cctcaggcacacctt

SEQ ID NO: 5395907 - DNA, 17 bp, Homo sapiens
cctcaggcacaccttgc

SEQ ID NO: 5395908 - DNA, 18 bp, Homo sapiens
cctcaggcacccgtcccc

SEQ ID NO: 5395909 - DNA, 23 bp, Homo sapiens
cctcaggcagcgtgtgggtcccg

SEQ ID NO: 5395910 - DNA, 14 bp, Homo sapiens
cctcaggcagctca

SEQ ID NO: 5395911 - DNA, 15 bp, Homo sapiens
cctcaggcagctcaa

SEQ ID NO: 5395912 - DNA, 22 bp, Homo sapiens
cctcaggcagtggcccagggaa

SEQ ID NO: 5395913 - DNA, 18 bp, Homo sapiens
cctcaggccaagggacca

SEQ ID NO: 5395914 - DNA, 17 bp, Homo sapiens
cctcaggccaccctcca

SEQ ID NO: 5395915 - DNA, 18 bp, Homo sapiens
cctcaggccattccccaa

SEQ ID NO: 5395916 - DNA, 16 bp, Homo sapiens
cctccaatccccactc

SEQ ID NO: 5395917 - DNA, 19 bp, Homo sapiens
cctccaatccccactcctc

SEQ ID NO: 5395918 - DNA, 21 bp, Homo sapiens
cctccaatcctccccgctctg

SEQ ID NO: 5395919 - DNA, 15 bp, Homo sapiens
cctccaatcctttcc

SEQ ID NO: 5395920 - DNA, 15 bp, Homo sapiens
cctccaatgcattgg

SEQ ID NO: 5395921 - DNA, 21 bp, Homo sapiens
cctccaatgcattggcctctg

SEQ ID NO: 5395922 - DNA, 16 bp, Homo sapiens
cctccaattccacagt

SEQ ID NO: 5395923 - DNA, 17 bp, Homo sapiens
cctccacaaagagacca

SEQ ID NO: 5395924 - DNA, 19 bp, Homo sapiens
cctccacaaagcaaaggca

SEQ ID NO: 5395925 - DNA, 13 bp, Homo sapiens
cctccacaccagt

SEQ ID NO: 5395926 - DNA, 18 bp, Homo sapiens
cctccacacccaccccct

SEQ ID NO: 5395927 - DNA, 23 bp, Homo sapiens
cctccacacccaccccctctgga

SEQ ID NO: 5395928 - DNA, 14 bp, Homo sapiens
cctccacacctcca

SEQ ID NO: 5395929 - DNA, 15 bp, Homo sapiens
cctccacacctccac

SEQ ID NO: 5395930 - DNA, 20 bp, Homo sapiens
cctccacactgaccaagtgc

SEQ ID NO: 5395931 - DNA, 14 bp, Homo sapiens
cctccacagagagg

SEQ ID NO: 5395932 - DNA, 21 bp, Homo sapiens
cctccacagagaggaggggac

SEQ ID NO: 5395933 - DNA, 14 bp, Homo sapiens
cctccacagcgagg

SEQ ID NO: 5395934 - DNA, 20 bp, Homo sapiens
cctccacagcgagggcagct

SEQ ID NO: 5395935 - DNA, 18 bp, Homo sapiens
cctccacagctgcagctg

SEQ ID NO: 5395936 - DNA, 12 bp, Homo sapiens
cctccacagctt

SEQ ID NO: 5395937 - DNA, 13 bp, Homo sapiens
cctccacagtccc

SEQ ID NO: 5395938 - DNA, 18 bp, Homo sapiens
cctccacagtcccccacc

SEQ ID NO: 5395939 - DNA, 16 bp, Homo sapiens
cctccacagtgctgct

SEQ ID NO: 5395940 - DNA, 19 bp, Homo sapiens
cctccacatcccagcagcc

SEQ ID NO: 5395941 - DNA, 21 bp, Homo sapiens
cctccacatcccagcagccca

SEQ ID NO: 5395942 - DNA, 18 bp, Homo sapiens
cctccacatcctgtgtca

SEQ ID NO: 5395943 - DNA, 20 bp, Homo sapiens
cctccacatgctgcctggca

SEQ ID NO: 5395944 - DNA, 21 bp, Homo sapiens
cctccacatgctgcctggcac

SEQ ID NO: 5395945 - DNA, 21 bp, Homo sapiens
cctccacattaagtggctttt

SEQ ID NO: 5395946 - DNA, 18 bp, Homo sapiens
cctccaccaaaccccact

SEQ ID NO: 5395947 - DNA, 21 bp, Homo sapiens
cctccaccaccactggccacc

SEQ ID NO: 5395948 - DNA, 12 bp, Homo sapiens
cctccaccagcc

SEQ ID NO: 5395949 - DNA, 16 bp, Homo sapiens
cctccaccagcctgct

SEQ ID NO: 5395950 - DNA, 18 bp, Homo sapiens
cctccaccagcctgctga

SEQ ID NO: 5395951 - DNA, 12 bp, Homo sapiens
cctccaccatgc

SEQ ID NO: 5395952 - DNA, 13 bp, Homo sapiens
cctccacccaccc

SEQ ID NO: 5395953 - DNA, 17 bp, Homo sapiens
cctccacccaccccctt

SEQ ID NO: 5395954 - DNA, 22 bp, Homo sapiens
cctccacccaccccctttggtt

SEQ ID NO: 5395955 - DNA, 15 bp, Homo sapiens
cctccacccacttgc

SEQ ID NO: 5395956 - DNA, 11 bp, Homo sapiens
cctccacccag

SEQ ID NO: 5395957 - DNA, 14 bp, Homo sapiens
cctccacccagccc

SEQ ID NO: 5395958 - DNA, 15 bp, Homo sapiens
cctccacccatccag

SEQ ID NO: 5395959 - DNA, 15 bp, Homo sapiens
cctccaccccaggac

SEQ ID NO: 5395960 - DNA, 19 bp, Homo sapiens
cctccaccccagtccccgg

SEQ ID NO: 5395961 - DNA, 15 bp, Homo sapiens
cctccaccccccact

SEQ ID NO: 5395962 - DNA, 21 bp, Homo sapiens
cctccacccgtcctccctcag

SEQ ID NO: 5395963 - DNA, 23 bp, Homo sapiens
cctccaccctaaagtctcaggtg

SEQ ID NO: 5395964 - DNA, 12 bp, Homo sapiens
cctccaccctcc

SEQ ID NO: 5395965 - DNA, 21 bp, Homo sapiens
cctccaccctcctcctcttca

SEQ ID NO: 5395966 - DNA, 14 bp, Homo sapiens
cctccaccctctga

SEQ ID NO: 5395967 - DNA, 15 bp, Homo sapiens
cctccaccctctgag

SEQ ID NO: 5395968 - DNA, 20 bp, Homo sapiens
cctccaccctctgagctttg

SEQ ID NO: 5395969 - DNA, 11 bp, Homo sapiens
cctccaccctg

SEQ ID NO: 5395970 - DNA, 13 bp, Homo sapiens
cctccaccctgca

SEQ ID NO: 5395971 - DNA, 13 bp, Homo sapiens
cctccaccctgcc

SEQ ID NO: 5395972 - DNA, 18 bp, Homo sapiens
cctccaccctgccctgct

SEQ ID NO: 5395973 - DNA, 23 bp, Homo sapiens
cctccaccggtgcctcctctggg

SEQ ID NO: 5395974 - DNA, 13 bp, Homo sapiens
cctccacctccct

SEQ ID NO: 5395975 - DNA, 13 bp, Homo sapiens
cctccacctcctg

SEQ ID NO: 5395976 - DNA, 18 bp, Homo sapiens
cctccacctctccttgga

SEQ ID NO: 5395977 - DNA, 23 bp, Homo sapiens
cctccacctcttcaccccccact

SEQ ID NO: 5395978 - DNA, 15 bp, Homo sapiens
cctccacctgccgtg

SEQ ID NO: 5395979 - DNA, 12 bp, Homo sapiens
cctccacctgtg

SEQ ID NO: 5395980 - DNA, 13 bp, Homo sapiens
cctccacctgtga

SEQ ID NO: 5395981 - DNA, 14 bp, Homo sapiens
cctccaccttccag

SEQ ID NO: 5395982 - DNA, 20 bp, Homo sapiens
cctccacgcaaggctgtgct

SEQ ID NO: 5395983 - DNA, 21 bp, Homo sapiens
cctccacgcaaggctgtgctc

SEQ ID NO: 5395984 - DNA, 14 bp, Homo sapiens
cctccacgcctcct

SEQ ID NO: 5395985 - DNA, 22 bp, Homo sapiens
cctccacgggggcggcaggctg

SEQ ID NO: 5395986 - DNA, 18 bp, Homo sapiens
cctccacgttcacccctc

SEQ ID NO: 5395987 - DNA, 22 bp, Homo sapiens
cctccactcaccacaagctgag

SEQ ID NO: 5395988 - DNA, 15 bp, Homo sapiens
cctccactcactcca

SEQ ID NO: 5395989 - DNA, 22 bp, Homo sapiens
cctccactccacatctgcatca

SEQ ID NO: 5395990 - DNA, 14 bp, Homo sapiens
cctccactccacct

SEQ ID NO: 5395991 - DNA, 16 bp, Homo sapiens
cctccactccactgcc

SEQ ID NO: 5395992 - DNA, 18 bp, Homo sapiens
cctccactcccacctcac

SEQ ID NO: 5395993 - DNA, 19 bp, Homo sapiens
cctccactcccacctcacc

SEQ ID NO: 5395994 - DNA, 15 bp, Homo sapiens
cctccactcccactt

SEQ ID NO: 5395995 - DNA, 17 bp, Homo sapiens
cctccactccctgtctg

SEQ ID NO: 5395996 - DNA, 11 bp, Homo sapiens
cctccactcct

SEQ ID NO: 5395997 - DNA, 15 bp, Homo sapiens
cctccactcctccca

SEQ ID NO: 5395998 - DNA, 16 bp, Homo sapiens
cctccactcctcccaa

SEQ ID NO: 5395999 - DNA, 14 bp, Homo sapiens
cctccactccttcc

SEQ ID NO: 5396000 - DNA, 16 bp, Homo sapiens
cctccactccttcctg

SEQ ID NO: 5396001 - DNA, 19 bp, Homo sapiens
cctccactctagttctaga

SEQ ID NO: 5396002 - DNA, 17 bp, Homo sapiens
cctccactctcccccac

SEQ ID NO: 5396003 - DNA, 22 bp, Homo sapiens
cctccactctcccccaccccct

SEQ ID NO: 5396004 - DNA, 14 bp, Homo sapiens
cctccactctgagg

SEQ ID NO: 5396005 - DNA, 16 bp, Homo sapiens
cctccactctgaggtc

SEQ ID NO: 5396006 - DNA, 20 bp, Homo sapiens
cctccactctttctttcaat

SEQ ID NO: 5396007 - DNA, 13 bp, Homo sapiens
cctccactgccct

SEQ ID NO: 5396008 - DNA, 15 bp, Homo sapiens
cctccactgccctct

SEQ ID NO: 5396009 - DNA, 14 bp, Homo sapiens
cctccactgctggg

SEQ ID NO: 5396010 - DNA, 21 bp, Homo sapiens
cctccactggggaatgctccc

SEQ ID NO: 5396011 - DNA, 18 bp, Homo sapiens
cctccactgtgtccagag

SEQ ID NO: 5396012 - DNA, 17 bp, Homo sapiens
cctccacttccccacac

SEQ ID NO: 5396013 - DNA, 13 bp, Homo sapiens
cctccacttcccg

SEQ ID NO: 5396014 - DNA, 15 bp, Homo sapiens
cctccacttcccgtc

SEQ ID NO: 5396015 - DNA, 18 bp, Homo sapiens
cctccacttctggtataa

SEQ ID NO: 5396016 - DNA, 21 bp, Homo sapiens
cctccagaaccttactggcac

SEQ ID NO: 5396017 - DNA, 17 bp, Homo sapiens
cctccagaactcttcct

SEQ ID NO: 5396018 - DNA, 19 bp, Homo sapiens
cctccagaagcactgggat

SEQ ID NO: 5396019 - DNA, 13 bp, Homo sapiens
cctccagaagcct

SEQ ID NO: 5396020 - DNA, 14 bp, Homo sapiens
cctccagaagcctc

SEQ ID NO: 5396021 - DNA, 20 bp, Homo sapiens
cctccagaagcctctggcta

SEQ ID NO: 5396022 - DNA, 21 bp, Homo sapiens
cctccagaagcctctggctag

SEQ ID NO: 5396023 - DNA, 13 bp, Homo sapiens
cctccagaagctg

SEQ ID NO: 5396024 - DNA, 9 bp, Homo sapiens
cctccagac

SEQ ID NO: 5396025 - DNA, 12 bp, Homo sapiens
cctccagacaga

SEQ ID NO: 5396026 - DNA, 15 bp, Homo sapiens
cctccagaccaccag

SEQ ID NO: 5396027 - DNA, 16 bp, Homo sapiens
cctccagaccaccagc

SEQ ID NO: 5396028 - DNA, 13 bp, Homo sapiens
cctccagacccct

SEQ ID NO: 5396029 - DNA, 22 bp, Homo sapiens
cctccagacccctaccctttcc

SEQ ID NO: 5396030 - DNA, 20 bp, Homo sapiens
cctccagacccctgtggcag

SEQ ID NO: 5396031 - DNA, 16 bp, Homo sapiens
cctccagaccctgcct

SEQ ID NO: 5396032 - DNA, 13 bp, Homo sapiens
cctccagactcag

SEQ ID NO: 5396033 - DNA, 16 bp, Homo sapiens
cctccagactcagcag

SEQ ID NO: 5396034 - DNA, 17 bp, Homo sapiens
cctccagactcagcaga

SEQ ID NO: 5396035 - DNA, 15 bp, Homo sapiens
cctccagactgcgga

SEQ ID NO: 5396036 - DNA, 13 bp, Homo sapiens
cctccagagaaag

SEQ ID NO: 5396037 - DNA, 18 bp, Homo sapiens
cctccagagaagccccgc

SEQ ID NO: 5396038 - DNA, 17 bp, Homo sapiens
cctccagagacaacagg

SEQ ID NO: 5396039 - DNA, 14 bp, Homo sapiens
cctccagagccagc

SEQ ID NO: 5396040 - DNA, 15 bp, Homo sapiens
cctccagagccagcc

SEQ ID NO: 5396041 - DNA, 21 bp, Homo sapiens
cctccagagccagcctgggac

SEQ ID NO: 5396042 - DNA, 23 bp, Homo sapiens
cctccagagccagcctgggactc

SEQ ID NO: 5396043 - DNA, 20 bp, Homo sapiens
cctccagagccccacagccc

SEQ ID NO: 5396044 - DNA, 23 bp, Homo sapiens
cctccagaggtggaggtgggctg

SEQ ID NO: 5396045 - DNA, 17 bp, Homo sapiens
cctccagcaatgcctgc

SEQ ID NO: 5396046 - DNA, 22 bp, Homo sapiens
cctccagcaatgcctgcctgaa

SEQ ID NO: 5396047 - DNA, 20 bp, Homo sapiens
cctccagcacaaacacaagg

SEQ ID NO: 5396048 - DNA, 14 bp, Homo sapiens
cctccagcacagac

SEQ ID NO: 5396049 - DNA, 21 bp, Homo sapiens
cctccagcacagactgttccc

SEQ ID NO: 5396050 - DNA, 13 bp, Homo sapiens
cctccagcacgcg

SEQ ID NO: 5396051 - DNA, 22 bp, Homo sapiens
cctccagcacgcgacttctcag

SEQ ID NO: 5396052 - DNA, 22 bp, Homo sapiens
cctccagcatcttttccatcct

SEQ ID NO: 5396053 - DNA, 19 bp, Homo sapiens
cctccagccaaacgggagc

SEQ ID NO: 5396054 - DNA, 20 bp, Homo sapiens
cctccagccccgcgaccatg

SEQ ID NO: 5396055 - DNA, 12 bp, Homo sapiens
cctccagcccct

SEQ ID NO: 5396056 - DNA, 17 bp, Homo sapiens
cctccagcccctgtccc

SEQ ID NO: 5396057 - DNA, 18 bp, Homo sapiens
cctccagcccctgtccca

SEQ ID NO: 5396058 - DNA, 16 bp, Homo sapiens
cctccagcccgggagc

SEQ ID NO: 5396059 - DNA, 17 bp, Homo sapiens
cctccagcccgggagcc

SEQ ID NO: 5396060 - DNA, 20 bp, Homo sapiens
cctccagcccgggagcctag

SEQ ID NO: 5396061 - DNA, 22 bp, Homo sapiens
cctccagcccgggagcctagga

SEQ ID NO: 5396062 - DNA, 14 bp, Homo sapiens
cctccagccctgcc

SEQ ID NO: 5396063 - DNA, 19 bp, Homo sapiens
cctccagccctgcccaccc

SEQ ID NO: 5396064 - DNA, 17 bp, Homo sapiens
cctccagccctgggcac

SEQ ID NO: 5396065 - DNA, 12 bp, Homo sapiens
cctccagccctt

SEQ ID NO: 5396066 - DNA, 13 bp, Homo sapiens
cctccagcctccc

SEQ ID NO: 5396067 - DNA, 14 bp, Homo sapiens
cctccagcctcccc

SEQ ID NO: 5396068 - DNA, 15 bp, Homo sapiens
cctccagcctccctg

SEQ ID NO: 5396069 - DNA, 16 bp, Homo sapiens
cctccagcctccctgt

SEQ ID NO: 5396070 - DNA, 12 bp, Homo sapiens
cctccagcctct

SEQ ID NO: 5396071 - DNA, 17 bp, Homo sapiens
cctccagcctctcccgg

SEQ ID NO: 5396072 - DNA, 14 bp, Homo sapiens
cctccagcctctgg

SEQ ID NO: 5396073 - DNA, 16 bp, Homo sapiens
cctccagcctggtggc

SEQ ID NO: 5396074 - DNA, 19 bp, Homo sapiens
cctccagcctttgctccct

SEQ ID NO: 5396075 - DNA, 20 bp, Homo sapiens
cctccagcctttgctccctc

SEQ ID NO: 5396076 - DNA, 23 bp, Homo sapiens
cctccagctaaacaccaacccct

SEQ ID NO: 5396077 - DNA, 13 bp, Homo sapiens
cctccagctcagc

SEQ ID NO: 5396078 - DNA, 13 bp, Homo sapiens
cctccagctccag

SEQ ID NO: 5396079 - DNA, 12 bp, Homo sapiens
cctccagctccc

SEQ ID NO: 5396080 - DNA, 15 bp, Homo sapiens
cctccagctcccact

SEQ ID NO: 5396081 - DNA, 21 bp, Homo sapiens
cctccagctccctgtgccccc

SEQ ID NO: 5396082 - DNA, 17 bp, Homo sapiens
cctccagctcctgcccc

SEQ ID NO: 5396083 - DNA, 15 bp, Homo sapiens
cctccagctctttcc

SEQ ID NO: 5396084 - DNA, 17 bp, Homo sapiens
cctccagctctttcctc

SEQ ID NO: 5396085 - DNA, 16 bp, Homo sapiens
cctccagctgcaccag

SEQ ID NO: 5396086 - DNA, 16 bp, Homo sapiens
cctccagctgctgctc

SEQ ID NO: 5396087 - DNA, 12 bp, Homo sapiens
cctccagctgga

SEQ ID NO: 5396088 - DNA, 15 bp, Homo sapiens
cctccagctggaatt

SEQ ID NO: 5396089 - DNA, 21 bp, Homo sapiens
cctccagctggaattgctgct

SEQ ID NO: 5396090 - DNA, 13 bp, Homo sapiens
cctccagctggga

SEQ ID NO: 5396091 - DNA, 12 bp, Homo sapiens
cctccagcttct

SEQ ID NO: 5396092 - DNA, 15 bp, Homo sapiens
cctccaggaaccaca

SEQ ID NO: 5396093 - DNA, 16 bp, Homo sapiens
cctccaggaccagggg

SEQ ID NO: 5396094 - DNA, 19 bp, Homo sapiens
cctccaggaccttgcttcc

SEQ ID NO: 5396095 - DNA, 18 bp, Homo sapiens
cctccaggagagagccag

SEQ ID NO: 5396096 - DNA, 18 bp, Homo sapiens
cctcccctcctctgcttg

SEQ ID NO: 5396097 - DNA, 14 bp, Homo sapiens
cctcccctcctctt

SEQ ID NO: 5396098 - DNA, 16 bp, Homo sapiens
cctcccctccttgtct

SEQ ID NO: 5396099 - DNA, 13 bp, Homo sapiens
cctcccctccttt

SEQ ID NO: 5396100 - DNA, 14 bp, Homo sapiens
cctcccctctcaga

SEQ ID NO: 5396101 - DNA, 16 bp, Homo sapiens
cctcccctctcagaac

SEQ ID NO: 5396102 - DNA, 12 bp, Homo sapiens
cctcccctctcc

SEQ ID NO: 5396103 - DNA, 14 bp, Homo sapiens
cctcccctctcctg

SEQ ID NO: 5396104 - DNA, 13 bp, Homo sapiens
cctcccctctctt

SEQ ID NO: 5396105 - DNA, 16 bp, Homo sapiens
cctcccctctcttgca

SEQ ID NO: 5396106 - DNA, 23 bp, Homo sapiens
cctcccctctcttgcacccgcct

SEQ ID NO: 5396107 - DNA, 13 bp, Homo sapiens
cctcccctcttcc

SEQ ID NO: 5396108 - DNA, 19 bp, Homo sapiens
cctcccctcttcctggagc

SEQ ID NO: 5396109 - DNA, 22 bp, Homo sapiens
cctcccctcttcttgcggcacc

SEQ ID NO: 5396110 - DNA, 13 bp, Homo sapiens
cctcccctgagga

SEQ ID NO: 5396111 - DNA, 13 bp, Homo sapiens
cctcccctgccac

SEQ ID NO: 5396112 - DNA, 14 bp, Homo sapiens
cctcccctgccagg

SEQ ID NO: 5396113 - DNA, 15 bp, Homo sapiens
cctcccctgccaggg

SEQ ID NO: 5396114 - DNA, 18 bp, Homo sapiens
cctcccctgccagggcag

SEQ ID NO: 5396115 - DNA, 14 bp, Homo sapiens
cctcccctgccatt

SEQ ID NO: 5396116 - DNA, 20 bp, Homo sapiens
cctcccctgcccccatccca

SEQ ID NO: 5396117 - DNA, 16 bp, Homo sapiens
cctcccctgccctggt

SEQ ID NO: 5396118 - DNA, 21 bp, Homo sapiens
cctcccctgccgcctcccggg

SEQ ID NO: 5396119 - DNA, 13 bp, Homo sapiens
cctcccctgcctc

SEQ ID NO: 5396120 - DNA, 14 bp, Homo sapiens
cctcccctgcctcc

SEQ ID NO: 5396121 - DNA, 14 bp, Homo sapiens
cctcccctgcggag

SEQ ID NO: 5396122 - DNA, 13 bp, Homo sapiens
cctcccctgctca

SEQ ID NO: 5396123 - DNA, 13 bp, Homo sapiens
cctcccctgctgc

SEQ ID NO: 5396124 - DNA, 12 bp, Homo sapiens
cctcccctggag

SEQ ID NO: 5396125 - DNA, 14 bp, Homo sapiens
cctcccctgggact

SEQ ID NO: 5396126 - DNA, 14 bp, Homo sapiens
cctcccctggtcct

SEQ ID NO: 5396127 - DNA, 18 bp, Homo sapiens
cctccccttaaaggggag

SEQ ID NO: 5396128 - DNA, 17 bp, Homo sapiens
cctccccttccctgcaa

SEQ ID NO: 5396129 - DNA, 16 bp, Homo sapiens
cctccccttcctgcac

SEQ ID NO: 5396130 - DNA, 14 bp, Homo sapiens
cctccccttcctgt

SEQ ID NO: 5396131 - DNA, 15 bp, Homo sapiens
cctccccttcttccc

SEQ ID NO: 5396132 - DNA, 13 bp, Homo sapiens
cctccccttgaat

SEQ ID NO: 5396133 - DNA, 14 bp, Homo sapiens
cctccccttgcctg

SEQ ID NO: 5396134 - DNA, 21 bp, Homo sapiens
cctccccttgggcccacacct

SEQ ID NO: 5396135 - DNA, 24 bp, Homo sapiens
cctccccttgggcccacacctcct

SEQ ID NO: 5396136 - DNA, 21 bp, Homo sapiens
cctccccttttaccactccca

SEQ ID NO: 5396137 - DNA, 23 bp, Homo sapiens
cctccccttttatgcacttcaaa

SEQ ID NO: 5396138 - DNA, 17 bp, Homo sapiens
cctcccgaacactgaga

SEQ ID NO: 5396139 - DNA, 20 bp, Homo sapiens
cctcccgaatagctgggact

SEQ ID NO: 5396140 - DNA, 16 bp, Homo sapiens
cctcccgactgaccac

SEQ ID NO: 5396141 - DNA, 19 bp, Homo sapiens
cctcccgactgaccactgg

SEQ ID NO: 5396142 - DNA, 14 bp, Homo sapiens
cctcccgagctcct

SEQ ID NO: 5396143 - DNA, 17 bp, Homo sapiens
cctcccgagtagctggg

SEQ ID NO: 5396144 - DNA, 19 bp, Homo sapiens
cctcccgagtagctgggac

SEQ ID NO: 5396145 - DNA, 14 bp, Homo sapiens
cctcccgcaccttc

SEQ ID NO: 5396146 - DNA, 16 bp, Homo sapiens
cctcccgcatgctgcc

SEQ ID NO: 5396147 - DNA, 18 bp, Homo sapiens
cctcccgcatgctgcctg

SEQ ID NO: 5396148 - DNA, 19 bp, Homo sapiens
cctcccgcatgctgcctgc

SEQ ID NO: 5396149 - DNA, 21 bp, Homo sapiens
cctcccgcatgctgcctgcct

SEQ ID NO: 5396150 - DNA, 22 bp, Homo sapiens
cctcccgccactcgccttctta

SEQ ID NO: 5396151 - DNA, 11 bp, Homo sapiens
cctcccgcccc

SEQ ID NO: 5396152 - DNA, 18 bp, Homo sapiens
cctcccgccccttcccac

SEQ ID NO: 5396153 - DNA, 14 bp, Homo sapiens
cctcccgctgcaag

SEQ ID NO: 5396154 - DNA, 17 bp, Homo sapiens
cctcccgcttcctccgg

SEQ ID NO: 5396155 - DNA, 15 bp, Homo sapiens
cctcccggcatggga

SEQ ID NO: 5396156 - DNA, 17 bp, Homo sapiens
cctcccggccctgcctg

SEQ ID NO: 5396157 - DNA, 16 bp, Homo sapiens
cctcccggctttgcag

SEQ ID NO: 5396158 - DNA, 21 bp, Homo sapiens
cctcccgggaagcatcctccc

SEQ ID NO: 5396159 - DNA, 15 bp, Homo sapiens
cctcccgggagcaca

SEQ ID NO: 5396160 - DNA, 16 bp, Homo sapiens
cctcccgggccctccc

SEQ ID NO: 5396161 - DNA, 19 bp, Homo sapiens
cctcccgggccctcccttg

SEQ ID NO: 5396162 - DNA, 21 bp, Homo sapiens
cctcccggggtgcccgtgtgg

SEQ ID NO: 5396163 - DNA, 17 bp, Homo sapiens
cctcccgtagtctcctg

SEQ ID NO: 5396164 - DNA, 19 bp, Homo sapiens
cctcccgtagtctcctggg

SEQ ID NO: 5396165 - DNA, 23 bp, Homo sapiens
cctcccgtccttcccctcttctt

SEQ ID NO: 5396166 - DNA, 22 bp, Homo sapiens
cctccctaccctaaccaagttc

SEQ ID NO: 5396167 - DNA, 16 bp, Homo sapiens
cctccctaccctcgga

SEQ ID NO: 5396168 - DNA, 13 bp, Homo sapiens
cctccctacctca

SEQ ID NO: 5396169 - DNA, 16 bp, Homo sapiens
cctccctacctcaacc

SEQ ID NO: 5396170 - DNA, 18 bp, Homo sapiens
cctccctacctcaacctg

SEQ ID NO: 5396171 - DNA, 18 bp, Homo sapiens
cctccctactcccctggg

SEQ ID NO: 5396172 - DNA, 14 bp, Homo sapiens
cctccctagatcca

SEQ ID NO: 5396173 - DNA, 17 bp, Homo sapiens
cctccctagatccaggc

SEQ ID NO: 5396174 - DNA, 19 bp, Homo sapiens
cctccctagcccttccagc

SEQ ID NO: 5396175 - DNA, 20 bp, Homo sapiens
cctccctagcccttccagcc

SEQ ID NO: 5396176 - DNA, 21 bp, Homo sapiens
cctccctagcccttccagcct

SEQ ID NO: 5396177 - DNA, 18 bp, Homo sapiens
cctccctagtgacccgga

SEQ ID NO: 5396178 - DNA, 15 bp, Homo sapiens
cctccctatgtctgc

SEQ ID NO: 5396179 - DNA, 18 bp, Homo sapiens
cctccctcaaagaaatcc

SEQ ID NO: 5396180 - DNA, 17 bp, Homo sapiens
cctccctcacccggcaa

SEQ ID NO: 5396181 - DNA, 14 bp, Homo sapiens
cctccctcaccctg

SEQ ID NO: 5396182 - DNA, 19 bp, Homo sapiens
cctccctcaccctgagccc

SEQ ID NO: 5396183 - DNA, 17 bp, Homo sapiens
cctccctcactgaagga

SEQ ID NO: 5396184 - DNA, 21 bp, Homo sapiens
cctccctcagacccaggagtc

SEQ ID NO: 5396185 - DNA, 13 bp, Homo sapiens
cctccctcagact

SEQ ID NO: 5396186 - DNA, 23 bp, Homo sapiens
cctccctcagactcagaggtcca

SEQ ID NO: 5396187 - DNA, 20 bp, Homo sapiens
cctccctcaggcccaggagt

SEQ ID NO: 5396188 - DNA, 21 bp, Homo sapiens
cctccctcaggcccaggagtc

SEQ ID NO: 5396189 - DNA, 17 bp, Homo sapiens
cctccctcaggctctgt

SEQ ID NO: 5396190 - DNA, 12 bp, Homo sapiens
cctccctccacc

SEQ ID NO: 5396191 - DNA, 17 bp, Homo sapiens
cctccctccacctccct

SEQ ID NO: 5396192 - DNA, 14 bp, Homo sapiens
cctccctccagctg

SEQ ID NO: 5396193 - DNA, 13 bp, Homo sapiens
cctccctccaggg

SEQ ID NO: 5396194 - DNA, 13 bp, Homo sapiens
cctccctcccaag

SEQ ID NO: 5396195 - DNA, 15 bp, Homo sapiens
cctccctcccacact

SEQ ID NO: 5396196 - DNA, 12 bp, Homo sapiens
cctccctcccag

SEQ ID NO: 5396197 - DNA, 14 bp, Homo sapiens
cctccctcccagcg

SEQ ID NO: 5396198 - DNA, 16 bp, Homo sapiens
cctccctccccagctc

SEQ ID NO: 5396199 - DNA, 17 bp, Homo sapiens
cctccctccccagctcc

SEQ ID NO: 5396200 - DNA, 16 bp, Homo sapiens
cctccctcccgtcctt

SEQ ID NO: 5396201 - DNA, 14 bp, Homo sapiens
cctccctccctcca

SEQ ID NO: 5396202 - DNA, 13 bp, Homo sapiens
cctccctccctct

SEQ ID NO: 5396203 - DNA, 16 bp, Homo sapiens
cctccctccctctttc

SEQ ID NO: 5396204 - DNA, 14 bp, Homo sapiens
cctccctccctgct

SEQ ID NO: 5396205 - DNA, 15 bp, Homo sapiens
cctccctccctgctc

SEQ ID NO: 5396206 - DNA, 15 bp, Homo sapiens
cctccctccgagtga

SEQ ID NO: 5396207 - DNA, 13 bp, Homo sapiens
cctccctccgcta

SEQ ID NO: 5396208 - DNA, 14 bp, Homo sapiens
cctccctccgtccc

SEQ ID NO: 5396209 - DNA, 11 bp, Homo sapiens
cctccctcctc

SEQ ID NO: 5396210 - DNA, 15 bp, Homo sapiens
cctccctcctcactc

SEQ ID NO: 5396211 - DNA, 14 bp, Homo sapiens
cctccctcctcagg

SEQ ID NO: 5396212 - DNA, 13 bp, Homo sapiens
cctccctcctctg

SEQ ID NO: 5396213 - DNA, 17 bp, Homo sapiens
cctccctcctgcaggct

SEQ ID NO: 5396214 - DNA, 21 bp, Homo sapiens
cctccctcctgccgactcctg

SEQ ID NO: 5396215 - DNA, 22 bp, Homo sapiens
cctccctcctggctcacagcca

SEQ ID NO: 5396216 - DNA, 13 bp, Homo sapiens
cctccctccttgg

SEQ ID NO: 5396217 - DNA, 15 bp, Homo sapiens
cctccctccttgggt

SEQ ID NO: 5396218 - DNA, 13 bp, Homo sapiens
cctccctcctttc

SEQ ID NO: 5396219 - DNA, 22 bp, Homo sapiens
cctccctcgccccaaggttcca

SEQ ID NO: 5396220 - DNA, 18 bp, Homo sapiens
cctccctcgggctggtgt

SEQ ID NO: 5396221 - DNA, 13 bp, Homo sapiens
cctccctctccca

SEQ ID NO: 5396222 - DNA, 19 bp, Homo sapiens
cctccctctcccaggcccg

SEQ ID NO: 5396223 - DNA, 15 bp, Homo sapiens
cctccctctcctctg

SEQ ID NO: 5396224 - DNA, 13 bp, Homo sapiens
cctccctctctct

SEQ ID NO: 5396225 - DNA, 22 bp, Homo sapiens
cctccctctctcttctgctcca

SEQ ID NO: 5396226 - DNA, 19 bp, Homo sapiens
cctccctctgacctgcagg

SEQ ID NO: 5396227 - DNA, 14 bp, Homo sapiens
cctccctctgaggc

SEQ ID NO: 5396228 - DNA, 18 bp, Homo sapiens
cctccctctgatttttca

SEQ ID NO: 5396229 - DNA, 14 bp, Homo sapiens
cctccctctgcctc

SEQ ID NO: 5396230 - DNA, 16 bp, Homo sapiens
cctccctctgcctcat

SEQ ID NO: 5396231 - DNA, 18 bp, Homo sapiens
cctccctctgcctcatcc

SEQ ID NO: 5396232 - DNA, 19 bp, Homo sapiens
cctccctctgcctcatcct

SEQ ID NO: 5396233 - DNA, 14 bp, Homo sapiens
cctccctctgctct

SEQ ID NO: 5396234 - DNA, 16 bp, Homo sapiens
cctccctctgctctca

SEQ ID NO: 5396235 - DNA, 21 bp, Homo sapiens
cctccctctgctgtcaccttg

SEQ ID NO: 5396236 - DNA, 14 bp, Homo sapiens
cctccctctgtccc

SEQ ID NO: 5396237 - DNA, 23 bp, Homo sapiens
cctccctctgtccctctccttgc

SEQ ID NO: 5396238 - DNA, 14 bp, Homo sapiens
cctccctcttccca

SEQ ID NO: 5396239 - DNA, 19 bp, Homo sapiens
cctccctcttcccagcaca

SEQ ID NO: 5396240 - DNA, 18 bp, Homo sapiens
cctccctcttccttcccc

SEQ ID NO: 5396241 - DNA, 20 bp, Homo sapiens
cctccctcttccttccccca

SEQ ID NO: 5396242 - DNA, 13 bp, Homo sapiens
cctccctctttcc

SEQ ID NO: 5396243 - DNA, 20 bp, Homo sapiens
cctccctgaaccatccctga

SEQ ID NO: 5396244 - DNA, 17 bp, Homo sapiens
cctccctgaccctgcag

SEQ ID NO: 5396245 - DNA, 17 bp, Homo sapiens
cctccctgacgtctgcc

SEQ ID NO: 5396246 - DNA, 18 bp, Homo sapiens
cctccctgacgtctgcca

SEQ ID NO: 5396247 - DNA, 19 bp, Homo sapiens
cctccctgactccctgtgg

SEQ ID NO: 5396248 - DNA, 12 bp, Homo sapiens
cctccctgagcc

SEQ ID NO: 5396249 - DNA, 17 bp, Homo sapiens
cctccctgagcctgcat

SEQ ID NO: 5396250 - DNA, 22 bp, Homo sapiens
cctccctgagcctgcattctgc

SEQ ID NO: 5396251 - DNA, 23 bp, Homo sapiens
cctccctgagctagaaccctctg

SEQ ID NO: 5396252 - DNA, 12 bp, Homo sapiens
cctccctgcaat

SEQ ID NO: 5396253 - DNA, 22 bp, Homo sapiens
cctccctgcacttcatcccgga

SEQ ID NO: 5396254 - DNA, 14 bp, Homo sapiens
cctccctgcagact

SEQ ID NO: 5396255 - DNA, 20 bp, Homo sapiens
cctccctgcatctgaccagc

SEQ ID NO: 5396256 - DNA, 12 bp, Homo sapiens
cctccctgccca

SEQ ID NO: 5396257 - DNA, 13 bp, Homo sapiens
cctccctgccccc

SEQ ID NO: 5396258 - DNA, 22 bp, Homo sapiens
cctccctgcccctcccttcaac

SEQ ID NO: 5396259 - DNA, 24 bp, Homo sapiens
cctccctgcccctcccttcaacca

SEQ ID NO: 5396260 - DNA, 15 bp, Homo sapiens
cctccctgcctccag

SEQ ID NO: 5396261 - DNA, 13 bp, Homo sapiens
cctccctgcctga

SEQ ID NO: 5396262 - DNA, 16 bp, Homo sapiens
cctccctgcctgctcc

SEQ ID NO: 5396263 - DNA, 14 bp, Homo sapiens
cctccctgctacca

SEQ ID NO: 5396264 - DNA, 21 bp, Homo sapiens
cctccctgctaccaaggccca

SEQ ID NO: 5396265 - DNA, 12 bp, Homo sapiens
cctccctgctag

SEQ ID NO: 5396266 - DNA, 21 bp, Homo sapiens
cctccctgctagcacagaggc

SEQ ID NO: 5396267 - DNA, 12 bp, Homo sapiens
cctccctgctca

SEQ ID NO: 5396268 - DNA, 14 bp, Homo sapiens
cctccctgctcagc

SEQ ID NO: 5396269 - DNA, 16 bp, Homo sapiens
cctccctgctcagctg

SEQ ID NO: 5396270 - DNA, 17 bp, Homo sapiens
cctccctgctcagctgg

SEQ ID NO: 5396271 - DNA, 17 bp, Homo sapiens
cctccctgctcagtgct

SEQ ID NO: 5396272 - DNA, 13 bp, Homo sapiens
cctccctgctccc

SEQ ID NO: 5396273 - DNA, 15 bp, Homo sapiens
cctccctgctcctca

SEQ ID NO: 5396274 - DNA, 21 bp, Homo sapiens
cctccctgctgtcccctcttg

SEQ ID NO: 5396275 - DNA, 11 bp, Homo sapiens
cctccctgctt

SEQ ID NO: 5396276 - DNA, 18 bp, Homo sapiens
cctccctgcttaaaaatg

SEQ ID NO: 5396277 - DNA, 16 bp, Homo sapiens
cctccttttggcctgg

SEQ ID NO: 5396278 - DNA, 18 bp, Homo sapiens
cctccttttggcctgggg

SEQ ID NO: 5396279 - DNA, 18 bp, Homo sapiens
cctcctttttatgttgcc

SEQ ID NO: 5396280 - DNA, 15 bp, Homo sapiens
cctccttttttctta

SEQ ID NO: 5396281 - DNA, 19 bp, Homo sapiens
cctcgaaccaaggcagcct

SEQ ID NO: 5396282 - DNA, 20 bp, Homo sapiens
cctcgaaccaaggcagcctc

SEQ ID NO: 5396283 - DNA, 22 bp, Homo sapiens
cctcgaaccaaggcagcctcca

SEQ ID NO: 5396284 - DNA, 16 bp, Homo sapiens
cctcgaacccacactg

SEQ ID NO: 5396285 - DNA, 16 bp, Homo sapiens
cctcgaactcctggca

SEQ ID NO: 5396286 - DNA, 15 bp, Homo sapiens
cctcgaactcctggg

SEQ ID NO: 5396287 - DNA, 15 bp, Homo sapiens
cctcgaactggctgc

SEQ ID NO: 5396288 - DNA, 19 bp, Homo sapiens
cctcgaagcgcgccactcg

SEQ ID NO: 5396289 - DNA, 17 bp, Homo sapiens
cctcgaagctgttctct

SEQ ID NO: 5396290 - DNA, 19 bp, Homo sapiens
cctcgaagctgttctctgc

SEQ ID NO: 5396291 - DNA, 15 bp, Homo sapiens
cctcgaattctcaga

SEQ ID NO: 5396292 - DNA, 17 bp, Homo sapiens
cctcgaattttatctgt

SEQ ID NO: 5396293 - DNA, 23 bp, Homo sapiens
cctcgacacgtgggctcccctct

SEQ ID NO: 5396294 - DNA, 19 bp, Homo sapiens
cctcgacagcgcccctgct

SEQ ID NO: 5396295 - DNA, 21 bp, Homo sapiens
cctcgacagcgcccctgctgt

SEQ ID NO: 5396296 - DNA, 23 bp, Homo sapiens
cctcgacagcgcccctgctgtct

SEQ ID NO: 5396297 - DNA, 20 bp, Homo sapiens
cctcgacagggcctggagcc

SEQ ID NO: 5396298 - DNA, 22 bp, Homo sapiens
cctcgacagggcctggagcccc

SEQ ID NO: 5396299 - DNA, 14 bp, Homo sapiens
cctcgactcagcac

SEQ ID NO: 5396300 - DNA, 16 bp, Homo sapiens
cctcgactcagcacca

SEQ ID NO: 5396301 - DNA, 20 bp, Homo sapiens
cctcgagaccatacagccag

SEQ ID NO: 5396302 - DNA, 21 bp, Homo sapiens
cctcgagatgggtgctggtcc

SEQ ID NO: 5396303 - DNA, 22 bp, Homo sapiens
cctcgagatgggtgctggtcct

SEQ ID NO: 5396304 - DNA, 16 bp, Homo sapiens
cctcgagcagatgatg

SEQ ID NO: 5396305 - DNA, 16 bp, Homo sapiens
cctcgagccatagagc

SEQ ID NO: 5396306 - DNA, 16 bp, Homo sapiens
cctcgagccctccccc

SEQ ID NO: 5396307 - DNA, 19 bp, Homo sapiens
cctcgaggaactccaggac

SEQ ID NO: 5396308 - DNA, 22 bp, Homo sapiens
cctcgaggcaccggcgctgcag

SEQ ID NO: 5396309 - DNA, 16 bp, Homo sapiens
cctcgaggctggtggt

SEQ ID NO: 5396310 - DNA, 13 bp, Homo sapiens
cctcgagggccgc

SEQ ID NO: 5396311 - DNA, 21 bp, Homo sapiens
cctcgagggccgcctgcctta

SEQ ID NO: 5396312 - DNA, 13 bp, Homo sapiens
cctcgaggggcct

SEQ ID NO: 5396313 - DNA, 16 bp, Homo sapiens
cctcgaggtgccttct

SEQ ID NO: 5396314 - DNA, 16 bp, Homo sapiens
cctcgaggtttctcaa

SEQ ID NO: 5396315 - DNA, 21 bp, Homo sapiens
cctcgaggtttctcaaagaaa

SEQ ID NO: 5396316 - DNA, 17 bp, Homo sapiens
cctcgagtactgtgggc

SEQ ID NO: 5396317 - DNA, 16 bp, Homo sapiens
cctcgagtgcccctgt

SEQ ID NO: 5396318 - DNA, 18 bp, Homo sapiens
cctcgagtttctggtaag

SEQ ID NO: 5396319 - DNA, 17 bp, Homo sapiens
cctcgatgtcctcctct

SEQ ID NO: 5396320 - DNA, 18 bp, Homo sapiens
cctcgatgtcctcctctg

SEQ ID NO: 5396321 - DNA, 14 bp, Homo sapiens
cctcgcaagctggg

SEQ ID NO: 5396322 - DNA, 13 bp, Homo sapiens
cctcgcacacact

SEQ ID NO: 5396323 - DNA, 18 bp, Homo sapiens
cctcgcacacagggctca

SEQ ID NO: 5396324 - DNA, 17 bp, Homo sapiens
cctcgcacaggccctag

SEQ ID NO: 5396325 - DNA, 15 bp, Homo sapiens
cctcgcacagggcat

SEQ ID NO: 5396326 - DNA, 17 bp, Homo sapiens
cctcgcacagggcatgc

SEQ ID NO: 5396327 - DNA, 20 bp, Homo sapiens
cctcgcacagggcatgcctg

SEQ ID NO: 5396328 - DNA, 16 bp, Homo sapiens
cctcgcactgcccagg

SEQ ID NO: 5396329 - DNA, 14 bp, Homo sapiens
cctcgcacttgcag

SEQ ID NO: 5396330 - DNA, 17 bp, Homo sapiens
cctcgcagccacaccta

SEQ ID NO: 5396331 - DNA, 19 bp, Homo sapiens
cctcgcaggcctccctgcc

SEQ ID NO: 5396332 - DNA, 21 bp, Homo sapiens
cctcgcaggcctccctgccag

SEQ ID NO: 5396333 - DNA, 23 bp, Homo sapiens
cctcgcaggcctccctgccagta

SEQ ID NO: 5396334 - DNA, 21 bp, Homo sapiens
cctcgcatccgcctctgagcc

SEQ ID NO: 5396335 - DNA, 22 bp, Homo sapiens
cctcgcatgccagagcctgggg

SEQ ID NO: 5396336 - DNA, 16 bp, Homo sapiens
cctcgccagcttctcc

SEQ ID NO: 5396337 - DNA, 19 bp, Homo sapiens
cctcgccagcttctcctgc

SEQ ID NO: 5396338 - DNA, 21 bp, Homo sapiens
cctcgcccaccgcatgccccc

SEQ ID NO: 5396339 - DNA, 20 bp, Homo sapiens
cctcgcccagcggcatcagg

SEQ ID NO: 5396340 - DNA, 21 bp, Homo sapiens
cctcgcccagcggcatcaggc

SEQ ID NO: 5396341 - DNA, 20 bp, Homo sapiens
cctcgcccaggccggggctg

SEQ ID NO: 5396342 - DNA, 15 bp, Homo sapiens
cctcgcccagtccca

SEQ ID NO: 5396343 - DNA, 17 bp, Homo sapiens
cctcgcccagtcccagc

SEQ ID NO: 5396344 - DNA, 23 bp, Homo sapiens
cctcgcccagtcccagcagccag

SEQ ID NO: 5396345 - DNA, 20 bp, Homo sapiens
cctcgcccatcagtgccagc

SEQ ID NO: 5396346 - DNA, 23 bp, Homo sapiens
cctcgccccagccaagcctgact

SEQ ID NO: 5396347 - DNA, 12 bp, Homo sapiens
cctcgccccccg

SEQ ID NO: 5396348 - DNA, 14 bp, Homo sapiens
cctcgccccccgcc

SEQ ID NO: 5396349 - DNA, 13 bp, Homo sapiens
cctcgcccccggg

SEQ ID NO: 5396350 - DNA, 17 bp, Homo sapiens
cctcgcccccgggccct

SEQ ID NO: 5396351 - DNA, 15 bp, Homo sapiens
cctcgcccctggcag

SEQ ID NO: 5396352 - DNA, 14 bp, Homo sapiens
cctcgccctgtccc

SEQ ID NO: 5396353 - DNA, 22 bp, Homo sapiens
cctcgccctgtccctcccactc

SEQ ID NO: 5396354 - DNA, 23 bp, Homo sapiens
cctcgccctgtccctcccactcc

SEQ ID NO: 5396355 - DNA, 17 bp, Homo sapiens
cctcgccggccttgttt

SEQ ID NO: 5396356 - DNA, 15 bp, Homo sapiens
cctcgccgtccctcc

SEQ ID NO: 5396357 - DNA, 21 bp, Homo sapiens
cctcgcctgccctcctctccc

SEQ ID NO: 5396358 - DNA, 14 bp, Homo sapiens
cctcgcctggcctg

SEQ ID NO: 5396359 - DNA, 21 bp, Homo sapiens
cctcgcctgggcccaggctct

SEQ ID NO: 5396360 - DNA, 13 bp, Homo sapiens
cctcgccttgtgt

SEQ ID NO: 5396361 - DNA, 21 bp, Homo sapiens
cctcgccttttaggctcagga

SEQ ID NO: 5396362 - DNA, 18 bp, Homo sapiens
cctcgcgcccctgtccat

SEQ ID NO: 5396363 - DNA, 18 bp, Homo sapiens
cctcgcggcgcagcccct

SEQ ID NO: 5396364 - DNA, 19 bp, Homo sapiens
cctcgcggcgcagcccctg

SEQ ID NO: 5396365 - DNA, 21 bp, Homo sapiens
cctcgcgggtgtcacattcct

SEQ ID NO: 5396366 - DNA, 20 bp, Homo sapiens
cctcgctcaccgctggccct

SEQ ID NO: 5396367 - DNA, 21 bp, Homo sapiens
cctcgctcaccgctggccctt

SEQ ID NO: 5396368 - DNA, 15 bp, Homo sapiens
cctcgctcccttcaa

SEQ ID NO: 5396369 - DNA, 18 bp, Homo sapiens
cctcgctcctccttccca

SEQ ID NO: 5396370 - DNA, 19 bp, Homo sapiens
cctcgctcctccttcccag

SEQ ID NO: 5396371 - DNA, 23 bp, Homo sapiens
cctcgctcctccttcccagggac

SEQ ID NO: 5396372 - DNA, 15 bp, Homo sapiens
cctcgctctgggatg

SEQ ID NO: 5396373 - DNA, 15 bp, Homo sapiens
cctcgctgctgctac

SEQ ID NO: 5396374 - DNA, 17 bp, Homo sapiens
cctcgctgctgctacta

SEQ ID NO: 5396375 - DNA, 21 bp, Homo sapiens
cctcgctgctgctactacccg

SEQ ID NO: 5396376 - DNA, 13 bp, Homo sapiens
cctcgctgctggg

SEQ ID NO: 5396377 - DNA, 12 bp, Homo sapiens
cctcgctgcttc

SEQ ID NO: 5396378 - DNA, 15 bp, Homo sapiens
cctcgctggccccca

SEQ ID NO: 5396379 - DNA, 15 bp, Homo sapiens
cctcgctgggctcta

SEQ ID NO: 5396380 - DNA, 21 bp, Homo sapiens
cctcgctggggcagtgccctc

SEQ ID NO: 5396381 - DNA, 13 bp, Homo sapiens
cctcgctgtcctg

SEQ ID NO: 5396382 - DNA, 19 bp, Homo sapiens
cctcgctgtcctgctgtgt

SEQ ID NO: 5396383 - DNA, 12 bp, Homo sapiens
cctcgctgtgcc

SEQ ID NO: 5396384 - DNA, 17 bp, Homo sapiens
cctcgctgtgccaccac

SEQ ID NO: 5396385 - DNA, 19 bp, Homo sapiens
cctcgctgtgccaccaccc

SEQ ID NO: 5396386 - DNA, 17 bp, Homo sapiens
cctcgcttcataggcag

SEQ ID NO: 5396387 - DNA, 18 bp, Homo sapiens
cctcgctttttcatcctt

SEQ ID NO: 5396388 - DNA, 19 bp, Homo sapiens
cctcgctttttcatccttc

SEQ ID NO: 5396389 - DNA, 18 bp, Homo sapiens
cctcggaaatcagtgcga

SEQ ID NO: 5396390 - DNA, 14 bp, Homo sapiens
cctcggaagagccc

SEQ ID NO: 5396391 - DNA, 15 bp, Homo sapiens
cctcggaagagcccg

SEQ ID NO: 5396392 - DNA, 16 bp, Homo sapiens
cctcggaagagcccgt

SEQ ID NO: 5396393 - DNA, 17 bp, Homo sapiens
cctcggacacccagggt

SEQ ID NO: 5396394 - DNA, 19 bp, Homo sapiens
cctcggacacccagggtct

SEQ ID NO: 5396395 - DNA, 13 bp, Homo sapiens
cctcggacagagc

SEQ ID NO: 5396396 - DNA, 16 bp, Homo sapiens
cctcggacagagcccc

SEQ ID NO: 5396397 - DNA, 19 bp, Homo sapiens
cctcggacagagcccccct

SEQ ID NO: 5396398 - DNA, 16 bp, Homo sapiens
cctcggactccatggc

SEQ ID NO: 5396399 - DNA, 20 bp, Homo sapiens
cctcggacttagctgggaga

SEQ ID NO: 5396400 - DNA, 14 bp, Homo sapiens
cctcggagaagagc

SEQ ID NO: 5396401 - DNA, 14 bp, Homo sapiens
cctcggagcatggt

SEQ ID NO: 5396402 - DNA, 21 bp, Homo sapiens
cctcggagcatggtgttttca

SEQ ID NO: 5396403 - DNA, 18 bp, Homo sapiens
cctcggagccccccactc

SEQ ID NO: 5396404 - DNA, 13 bp, Homo sapiens
cctcggagcctgt

SEQ ID NO: 5396405 - DNA, 14 bp, Homo sapiens
cctcggagctggct

SEQ ID NO: 5396406 - DNA, 16 bp, Homo sapiens
cctcggagctggctgt

SEQ ID NO: 5396407 - DNA, 16 bp, Homo sapiens
cctcggaggctcctcc

SEQ ID NO: 5396408 - DNA, 20 bp, Homo sapiens
cctcggaggctcctccctct

SEQ ID NO: 5396409 - DNA, 23 bp, Homo sapiens
cctcggaggctcctccctctgcc

SEQ ID NO: 5396410 - DNA, 21 bp, Homo sapiens
cctcggaggtccagctgggcc

SEQ ID NO: 5396411 - DNA, 22 bp, Homo sapiens
cctcggaggtccagctgggcct

SEQ ID NO: 5396412 - DNA, 18 bp, Homo sapiens
cctcggagtgtggcctgg

SEQ ID NO: 5396413 - DNA, 19 bp, Homo sapiens
cctcggagtgtggcctgga

SEQ ID NO: 5396414 - DNA, 17 bp, Homo sapiens
cctcggcaaccgtgggg

SEQ ID NO: 5396415 - DNA, 14 bp, Homo sapiens
cctcggcacacact

SEQ ID NO: 5396416 - DNA, 23 bp, Homo sapiens
cctcggcagaactctctgtcttc

SEQ ID NO: 5396417 - DNA, 13 bp, Homo sapiens
cctcggcagctcc

SEQ ID NO: 5396418 - DNA, 18 bp, Homo sapiens
cctcggcagctccggaag

SEQ ID NO: 5396419 - DNA, 20 bp, Homo sapiens
cctcggcattcacacacagc

SEQ ID NO: 5396420 - DNA, 19 bp, Homo sapiens
cctcggccagagctcccag

SEQ ID NO: 5396421 - DNA, 23 bp, Homo sapiens
cctcggccattgaacactgcacc

SEQ ID NO: 5396422 - DNA, 15 bp, Homo sapiens
cctcggcccatctgt

SEQ ID NO: 5396423 - DNA, 22 bp, Homo sapiens
cctcggccctccctgcgcttcc

SEQ ID NO: 5396424 - DNA, 12 bp, Homo sapiens
cctcggccctgt

SEQ ID NO: 5396425 - DNA, 14 bp, Homo sapiens
cctcggccctgtag

SEQ ID NO: 5396426 - DNA, 15 bp, Homo sapiens
cctcggccctgtagc

SEQ ID NO: 5396427 - DNA, 12 bp, Homo sapiens
cctcggcctccc

SEQ ID NO: 5396428 - DNA, 22 bp, Homo sapiens
cctcggcctcccaaagtgctgg

SEQ ID NO: 5396429 - DNA, 22 bp, Homo sapiens
cctcggcctccgaggctccccg

SEQ ID NO: 5396430 - DNA, 13 bp, Homo sapiens
cctcggcctggct

SEQ ID NO: 5396431 - DNA, 16 bp, Homo sapiens
cctcggcctggctggc

SEQ ID NO: 5396432 - DNA, 18 bp, Homo sapiens
cctcggcctggcttcacc

SEQ ID NO: 5396433 - DNA, 13 bp, Homo sapiens
cctcggctacccc

SEQ ID NO: 5396434 - DNA, 13 bp, Homo sapiens
cctcggctcctgc

SEQ ID NO: 5396435 - DNA, 15 bp, Homo sapiens
cctcggctcctggac

SEQ ID NO: 5396436 - DNA, 19 bp, Homo sapiens
cctcggctcctggactcat

SEQ ID NO: 5396437 - DNA, 15 bp, Homo sapiens
cctcggctggctccc

SEQ ID NO: 5396438 - DNA, 14 bp, Homo sapiens
cctcggctgtctcc

SEQ ID NO: 5396439 - DNA, 18 bp, Homo sapiens
cctcggctgtctcctgtc

SEQ ID NO: 5396440 - DNA, 20 bp, Homo sapiens
cctcggcttgtgggctggtg

SEQ ID NO: 5396441 - DNA, 13 bp, Homo sapiens
cctcgggaagcag

SEQ ID NO: 5396442 - DNA, 19 bp, Homo sapiens
cctcgggatgaaaagccat

SEQ ID NO: 5396443 - DNA, 24 bp, Homo sapiens
cctcgggatgaaaagccatatcta

SEQ ID NO: 5396444 - DNA, 15 bp, Homo sapiens
cctcgggcaagggcc

SEQ ID NO: 5396445 - DNA, 17 bp, Homo sapiens
cctcgggcccacctggc

SEQ ID NO: 5396446 - DNA, 20 bp, Homo sapiens
cctcgggcccacctggccac

SEQ ID NO: 5396447 - DNA, 16 bp, Homo sapiens
cctcgggcccagcccc

SEQ ID NO: 5396448 - DNA, 16 bp, Homo sapiens
cctcgggccctgtggt

SEQ ID NO: 5396449 - DNA, 20 bp, Homo sapiens
cctcgggccgaggcccagcg

SEQ ID NO: 5396450 - DNA, 18 bp, Homo sapiens
cctcgggccgcctcctcc

SEQ ID NO: 5396451 - DNA, 21 bp, Homo sapiens
cctcgggccgcctcctccaga

SEQ ID NO: 5396452 - DNA, 23 bp, Homo sapiens
cctcgggccgggcaccaccccca

SEQ ID NO: 5396453 - DNA, 14 bp, Homo sapiens
cctcgggctggtgt

SEQ ID NO: 5396454 - DNA, 18 bp, Homo sapiens
cctctccgcgggagaccc

SEQ ID NO: 5396455 - DNA, 17 bp, Homo sapiens
cctctccggcctggcct

SEQ ID NO: 5396456 - DNA, 23 bp, Homo sapiens
cctctccgtttattataaactgt

SEQ ID NO: 5396457 - DNA, 22 bp, Homo sapiens
cctctcctagccctcctgaggg

SEQ ID NO: 5396458 - DNA, 13 bp, Homo sapiens
cctctcctcccag

SEQ ID NO: 5396459 - DNA, 17 bp, Homo sapiens
cctctcctcccagctgc

SEQ ID NO: 5396460 - DNA, 21 bp, Homo sapiens
cctctcctcccagctgcttta

SEQ ID NO: 5396461 - DNA, 14 bp, Homo sapiens
cctctcctccctct

SEQ ID NO: 5396462 - DNA, 14 bp, Homo sapiens
cctctcctccgcca

SEQ ID NO: 5396463 - DNA, 14 bp, Homo sapiens
cctctcctcctcag

SEQ ID NO: 5396464 - DNA, 15 bp, Homo sapiens
cctctcctcctctgt

SEQ ID NO: 5396465 - DNA, 18 bp, Homo sapiens
cctctcctcggttcaagg

SEQ ID NO: 5396466 - DNA, 19 bp, Homo sapiens
cctctcctcgtccggcctg

SEQ ID NO: 5396467 - DNA, 16 bp, Homo sapiens
cctctcctctccccca

SEQ ID NO: 5396468 - DNA, 18 bp, Homo sapiens
cctctcctctcccccagg

SEQ ID NO: 5396469 - DNA, 15 bp, Homo sapiens
cctctcctctctgga

SEQ ID NO: 5396470 - DNA, 22 bp, Homo sapiens
cctctcctctgccctctgctct

SEQ ID NO: 5396471 - DNA, 13 bp, Homo sapiens
cctctcctgccca

SEQ ID NO: 5396472 - DNA, 22 bp, Homo sapiens
cctctcctgcccagctctgacc

SEQ ID NO: 5396473 - DNA, 15 bp, Homo sapiens
cctctcctgccctgt

SEQ ID NO: 5396474 - DNA, 14 bp, Homo sapiens
cctctcctgcctac

SEQ ID NO: 5396475 - DNA, 13 bp, Homo sapiens
cctctcctggaaa

SEQ ID NO: 5396476 - DNA, 14 bp, Homo sapiens
cctctcctggaaac

SEQ ID NO: 5396477 - DNA, 13 bp, Homo sapiens
cctctcctggagg

SEQ ID NO: 5396478 - DNA, 18 bp, Homo sapiens
cctctcctgggcagctgc

SEQ ID NO: 5396479 - DNA, 19 bp, Homo sapiens
cctctcctgggcagctgcc

SEQ ID NO: 5396480 - DNA, 22 bp, Homo sapiens
cctctcctgggggtggcaggca

SEQ ID NO: 5396481 - DNA, 14 bp, Homo sapiens
cctctcctgtctgc

SEQ ID NO: 5396482 - DNA, 13 bp, Homo sapiens
cctctccttccca

SEQ ID NO: 5396483 - DNA, 16 bp, Homo sapiens
cctctccttcctcaga

SEQ ID NO: 5396484 - DNA, 14 bp, Homo sapiens
cctctccttccttg

SEQ ID NO: 5396485 - DNA, 21 bp, Homo sapiens
cctctccttcgtatcccgagt

SEQ ID NO: 5396486 - DNA, 12 bp, Homo sapiens
cctctccttgga

SEQ ID NO: 5396487 - DNA, 15 bp, Homo sapiens
cctctccttgtcaca

SEQ ID NO: 5396488 - DNA, 16 bp, Homo sapiens
cctctcctttcactcc

SEQ ID NO: 5396489 - DNA, 14 bp, Homo sapiens
cctctcctttgtag

SEQ ID NO: 5396490 - DNA, 18 bp, Homo sapiens
cctctcctttgtatatta

SEQ ID NO: 5396491 - DNA, 16 bp, Homo sapiens
cctctccttttctcca

SEQ ID NO: 5396492 - DNA, 19 bp, Homo sapiens
cctctccttttctccactg

SEQ ID NO: 5396493 - DNA, 24 bp, Homo sapiens
cctctcgcaagagggtctctttgt

SEQ ID NO: 5396494 - DNA, 21 bp, Homo sapiens
cctctcgcacaatgcatgtgc

SEQ ID NO: 5396495 - DNA, 19 bp, Homo sapiens
cctctcgccccatccctgc

SEQ ID NO: 5396496 - DNA, 20 bp, Homo sapiens
cctctcgccccatccctgct

SEQ ID NO: 5396497 - DNA, 17 bp, Homo sapiens
cctctcgctcccctctg

SEQ ID NO: 5396498 - DNA, 19 bp, Homo sapiens
cctctcgctcccctctgcc

SEQ ID NO: 5396499 - DNA, 22 bp, Homo sapiens
cctctcgcttcctcagcctcca

SEQ ID NO: 5396500 - DNA, 19 bp, Homo sapiens
cctctcggccccatcgccc

SEQ ID NO: 5396501 - DNA, 21 bp, Homo sapiens
cctctcggctggaagaacatc

SEQ ID NO: 5396502 - DNA, 15 bp, Homo sapiens
cctctcggtgacctc

SEQ ID NO: 5396503 - DNA, 22 bp, Homo sapiens
cctctcggtgctccatctccgc

SEQ ID NO: 5396504 - DNA, 19 bp, Homo sapiens
cctctcggtggccagcagg

SEQ ID NO: 5396505 - DNA, 17 bp, Homo sapiens
cctctcggttgaaacct

SEQ ID NO: 5396506 - DNA, 19 bp, Homo sapiens
cctctcgtaagatttcctt

SEQ ID NO: 5396507 - DNA, 23 bp, Homo sapiens
cctctcgtaagatttccttcttt

SEQ ID NO: 5396508 - DNA, 21 bp, Homo sapiens
cctctcgtagaacctgcgcac

SEQ ID NO: 5396509 - DNA, 19 bp, Homo sapiens
cctctcgtcccgtccctcc

SEQ ID NO: 5396510 - DNA, 20 bp, Homo sapiens
cctctcgttggtagttgaga

SEQ ID NO: 5396511 - DNA, 16 bp, Homo sapiens
cctctcgtttctgccc

SEQ ID NO: 5396512 - DNA, 19 bp, Homo sapiens
cctctcgtttctgcccagc

SEQ ID NO: 5396513 - DNA, 17 bp, Homo sapiens
cctctctaacctccttt

SEQ ID NO: 5396514 - DNA, 16 bp, Homo sapiens
cctctctaagccacag

SEQ ID NO: 5396515 - DNA, 20 bp, Homo sapiens
cctctctacagtctcgtctc

SEQ ID NO: 5396516 - DNA, 14 bp, Homo sapiens
cctctctagggacc

SEQ ID NO: 5396517 - DNA, 19 bp, Homo sapiens
cctctctatatttcgggtc

SEQ ID NO: 5396518 - DNA, 19 bp, Homo sapiens
cctctctatcctctcttcc

SEQ ID NO: 5396519 - DNA, 12 bp, Homo sapiens
cctctctcactc

SEQ ID NO: 5396520 - DNA, 14 bp, Homo sapiens
cctctctcactcct

SEQ ID NO: 5396521 - DNA, 17 bp, Homo sapiens
cctctctcactccttga

SEQ ID NO: 5396522 - DNA, 15 bp, Homo sapiens
cctctctcagagcat

SEQ ID NO: 5396523 - DNA, 21 bp, Homo sapiens
cctctctcagagcatctggct

SEQ ID NO: 5396524 - DNA, 14 bp, Homo sapiens
cctctctcagcaca

SEQ ID NO: 5396525 - DNA, 16 bp, Homo sapiens
cctctctcagcacagc

SEQ ID NO: 5396526 - DNA, 17 bp, Homo sapiens
cctctctcagcacagcc

SEQ ID NO: 5396527 - DNA, 19 bp, Homo sapiens
cctctctcagcacagcctg

SEQ ID NO: 5396528 - DNA, 14 bp, Homo sapiens
cctctctcagccca

SEQ ID NO: 5396529 - DNA, 19 bp, Homo sapiens
cctctctcaggagtatctt

SEQ ID NO: 5396530 - DNA, 12 bp, Homo sapiens
cctctctcaggc

SEQ ID NO: 5396531 - DNA, 13 bp, Homo sapiens
cctctctccacta

SEQ ID NO: 5396532 - DNA, 21 bp, Homo sapiens
cctctctcccaccctaagggc

SEQ ID NO: 5396533 - DNA, 22 bp, Homo sapiens
cctctctcccccaccagggggc

SEQ ID NO: 5396534 - DNA, 15 bp, Homo sapiens
cctctctcccctctg

SEQ ID NO: 5396535 - DNA, 13 bp, Homo sapiens
cctctctccctgc

SEQ ID NO: 5396536 - DNA, 21 bp, Homo sapiens
cctctctccctgcctcacatc

SEQ ID NO: 5396537 - DNA, 22 bp, Homo sapiens
cctctctccctgcctcacatct

SEQ ID NO: 5396538 - DNA, 23 bp, Homo sapiens
cctctctccctgcctcacatctc

SEQ ID NO: 5396539 - DNA, 13 bp, Homo sapiens
cctctctcctctc

SEQ ID NO: 5396540 - DNA, 16 bp, Homo sapiens
cctctctccttctggc

SEQ ID NO: 5396541 - DNA, 15 bp, Homo sapiens
cctctctccttggcc

SEQ ID NO: 5396542 - DNA, 20 bp, Homo sapiens
cctctctctaccagtctatt

SEQ ID NO: 5396543 - DNA, 10 bp, Homo sapiens
cctctctctc

SEQ ID NO: 5396544 - DNA, 20 bp, Homo sapiens
cctctctctcacctacttcc

SEQ ID NO: 5396545 - DNA, 20 bp, Homo sapiens
cctctctctccctccactcc

SEQ ID NO: 5396546 - DNA, 20 bp, Homo sapiens
cctctctctccctctttcta

SEQ ID NO: 5396547 - DNA, 12 bp, Homo sapiens
cctctctctccg

SEQ ID NO: 5396548 - DNA, 20 bp, Homo sapiens
cctctctctctctctctgga

SEQ ID NO: 5396549 - DNA, 12 bp, Homo sapiens
cctctctctctg

SEQ ID NO: 5396550 - DNA, 13 bp, Homo sapiens
cctctctctcttc

SEQ ID NO: 5396551 - DNA, 18 bp, Homo sapiens
cctctctctcttctaggc

SEQ ID NO: 5396552 - DNA, 11 bp, Homo sapiens
cctctctctga

SEQ ID NO: 5396553 - DNA, 12 bp, Homo sapiens
cctctctctgac

SEQ ID NO: 5396554 - DNA, 13 bp, Homo sapiens
cctctctctgact

SEQ ID NO: 5396555 - DNA, 14 bp, Homo sapiens
cctctctctgactc

SEQ ID NO: 5396556 - DNA, 21 bp, Homo sapiens
cctctctctgctcctcacccc

SEQ ID NO: 5396557 - DNA, 22 bp, Homo sapiens
cctctctctgctcctcaccccc

SEQ ID NO: 5396558 - DNA, 12 bp, Homo sapiens
cctctctctggg

SEQ ID NO: 5396559 - DNA, 13 bp, Homo sapiens
cctctctctgggc

SEQ ID NO: 5396560 - DNA, 21 bp, Homo sapiens
cctctctcttctgctccaccc

SEQ ID NO: 5396561 - DNA, 22 bp, Homo sapiens
cctctctcttctgctccaccct

SEQ ID NO: 5396562 - DNA, 22 bp, Homo sapiens
cctctctctttcctccacccat

SEQ ID NO: 5396563 - DNA, 23 bp, Homo sapiens
cctctctctttcctccacccata

SEQ ID NO: 5396564 - DNA, 22 bp, Homo sapiens
cctctctcttttctacacactc

SEQ ID NO: 5396565 - DNA, 22 bp, Homo sapiens
cctctctgaagcgactctcctg

SEQ ID NO: 5396566 - DNA, 12 bp, Homo sapiens
cctctctgagtc

SEQ ID NO: 5396567 - DNA, 22 bp, Homo sapiens
cctctctgagtcaaatccagtg

SEQ ID NO: 5396568 - DNA, 22 bp, Homo sapiens
cctctctgatcttgtgctcagc

SEQ ID NO: 5396569 - DNA, 23 bp, Homo sapiens
cctctctgatcttgtgctcagca

SEQ ID NO: 5396570 - DNA, 20 bp, Homo sapiens
cctctctgatgtcccagtgc

SEQ ID NO: 5396571 - DNA, 23 bp, Homo sapiens
cctctctgcagacttcccagcta

SEQ ID NO: 5396572 - DNA, 22 bp, Homo sapiens
cctctctgcaggtccctaataa

SEQ ID NO: 5396573 - DNA, 23 bp, Homo sapiens
cctctctgcaggtccctaataaa

SEQ ID NO: 5396574 - DNA, 16 bp, Homo sapiens
cctctctgcatctgac

SEQ ID NO: 5396575 - DNA, 15 bp, Homo sapiens
cctctctgccagccg

SEQ ID NO: 5396576 - DNA, 19 bp, Homo sapiens
cctctctgccagccgctgg

SEQ ID NO: 5396577 - DNA, 11 bp, Homo sapiens
cctctctgccc

SEQ ID NO: 5396578 - DNA, 18 bp, Homo sapiens
cctctctgccccacccaa

SEQ ID NO: 5396579 - DNA, 13 bp, Homo sapiens
cctctctgcccct

SEQ ID NO: 5396580 - DNA, 14 bp, Homo sapiens
cctctctgcccctg

SEQ ID NO: 5396581 - DNA, 17 bp, Homo sapiens
cctctctgcccctgatc

SEQ ID NO: 5396582 - DNA, 12 bp, Homo sapiens
cctctctgcctc

SEQ ID NO: 5396583 - DNA, 16 bp, Homo sapiens
cctctctgcctctctt

SEQ ID NO: 5396584 - DNA, 14 bp, Homo sapiens
cctctctgctccag

SEQ ID NO: 5396585 - DNA, 13 bp, Homo sapiens
cctctctgctcct

SEQ ID NO: 5396586 - DNA, 19 bp, Homo sapiens
cctctctgctgggtttcca

SEQ ID NO: 5396587 - DNA, 11 bp, Homo sapiens
cctctctggaa

SEQ ID NO: 5396588 - DNA, 22 bp, Homo sapiens
cctctctggaagagggaggggc

SEQ ID NO: 5396589 - DNA, 12 bp, Homo sapiens
cctctctggaga

SEQ ID NO: 5396590 - DNA, 23 bp, Homo sapiens
cctctctggatactgcaaaggct

SEQ ID NO: 5396591 - DNA, 18 bp, Homo sapiens
cctctctggcctcccacc

SEQ ID NO: 5396592 - DNA, 14 bp, Homo sapiens
cctctctggccttg

SEQ ID NO: 5396593 - DNA, 21 bp, Homo sapiens
cctctctggtggctgggctgc

SEQ ID NO: 5396594 - DNA, 22 bp, Homo sapiens
cctctctggtttcctatttgca

SEQ ID NO: 5396595 - DNA, 19 bp, Homo sapiens
cctctctgtagtttatggc

SEQ ID NO: 5396596 - DNA, 20 bp, Homo sapiens
cctctctgtctttttccttc

SEQ ID NO: 5396597 - DNA, 23 bp, Homo sapiens
cctctctgtctttttccttcctg

SEQ ID NO: 5396598 - DNA, 16 bp, Homo sapiens
cctctctgtggctcca

SEQ ID NO: 5396599 - DNA, 17 bp, Homo sapiens
cctctctgtggctccaa

SEQ ID NO: 5396600 - DNA, 16 bp, Homo sapiens
cctctcttaccccgtc

SEQ ID NO: 5396601 - DNA, 19 bp, Homo sapiens
cctctcttcactgctacat

SEQ ID NO: 5396602 - DNA, 15 bp, Homo sapiens
cctctcttccccttc

SEQ ID NO: 5396603 - DNA, 17 bp, Homo sapiens
cctctcttcctatccca

SEQ ID NO: 5396604 - DNA, 19 bp, Homo sapiens
cctctcttcctatcccatc

SEQ ID NO: 5396605 - DNA, 17 bp, Homo sapiens
cctctcttctcaccttt

SEQ ID NO: 5396606 - DNA, 15 bp, Homo sapiens
cctctcttctgactg

SEQ ID NO: 5396607 - DNA, 22 bp, Homo sapiens
cctctcttgaaccccaaatgct

SEQ ID NO: 5396608 - DNA, 11 bp, Homo sapiens
cctctcttgca

SEQ ID NO: 5396609 - DNA, 11 bp, Homo sapiens
cctctcttgcc

SEQ ID NO: 5396610 - DNA, 18 bp, Homo sapiens
cctctcttgccccttgtc

SEQ ID NO: 5396611 - DNA, 21 bp, Homo sapiens
cctctcttgccccttgtcctg

SEQ ID NO: 5396612 - DNA, 12 bp, Homo sapiens
cctctcttgcct

SEQ ID NO: 5396613 - DNA, 18 bp, Homo sapiens
cctctcttggaactgcac

SEQ ID NO: 5396614 - DNA, 17 bp, Homo sapiens
cctctcttggaccctgg

SEQ ID NO: 5396615 - DNA, 18 bp, Homo sapiens
cctctcttggactccctc

SEQ ID NO: 5396616 - DNA, 22 bp, Homo sapiens
cctctcttgtgagccatagaga

SEQ ID NO: 5396617 - DNA, 15 bp, Homo sapiens
cctctctttgttctc

SEQ ID NO: 5396618 - DNA, 18 bp, Homo sapiens
cctctctttgttctcagc

SEQ ID NO: 5396619 - DNA, 20 bp, Homo sapiens
cctctctttgttctcagctc

SEQ ID NO: 5396620 - DNA, 17 bp, Homo sapiens
cctctcttttccccgcc

SEQ ID NO: 5396621 - DNA, 18 bp, Homo sapiens
cctctcttttcctctctg

SEQ ID NO: 5396622 - DNA, 19 bp, Homo sapiens
cctctcttttcctctctgt

SEQ ID NO: 5396623 - DNA, 22 bp, Homo sapiens
cctctcttttcctctctgtctg

SEQ ID NO: 5396624 - DNA, 18 bp, Homo sapiens
cctctgaaaagtgtgtat

SEQ ID NO: 5396625 - DNA, 22 bp, Homo sapiens
cctctgaaaatatttttttcta

SEQ ID NO: 5396626 - DNA, 12 bp, Homo sapiens
cctctgaaacag

SEQ ID NO: 5396627 - DNA, 20 bp, Homo sapiens
cctctgaaacagctgcctta

SEQ ID NO: 5396628 - DNA, 22 bp, Homo sapiens
cctctgaaacagctgccttagc

SEQ ID NO: 5396629 - DNA, 21 bp, Homo sapiens
cctctgaaaccctcctccaca

SEQ ID NO: 5396630 - DNA, 16 bp, Homo sapiens
cctctgaaaccctgga

SEQ ID NO: 5396631 - DNA, 14 bp, Homo sapiens
cctctgtcctccca

SEQ ID NO: 5396632 - DNA, 22 bp, Homo sapiens
cctctgtcctcccatcccctca

SEQ ID NO: 5396633 - DNA, 22 bp, Homo sapiens
cctctgtcctgacttcaggggc

SEQ ID NO: 5396634 - DNA, 18 bp, Homo sapiens
cctctgtcctgcttctga

SEQ ID NO: 5396635 - DNA, 13 bp, Homo sapiens
cctctgtcctggc

SEQ ID NO: 5396636 - DNA, 19 bp, Homo sapiens
cctctgtccttcccccagc

SEQ ID NO: 5396637 - DNA, 21 bp, Homo sapiens
cctctgtccttcccccagcac

SEQ ID NO: 5396638 - DNA, 15 bp, Homo sapiens
cctctgtctagcatg

SEQ ID NO: 5396639 - DNA, 14 bp, Homo sapiens
cctctgtctcatcc

SEQ ID NO: 5396640 - DNA, 17 bp, Homo sapiens
cctctgtctcctccgtg

SEQ ID NO: 5396641 - DNA, 19 bp, Homo sapiens
cctctgtctcgagcgccct

SEQ ID NO: 5396642 - DNA, 20 bp, Homo sapiens
cctctgtctcgagcgccctg

SEQ ID NO: 5396643 - DNA, 13 bp, Homo sapiens
cctctgtctctgc

SEQ ID NO: 5396644 - DNA, 17 bp, Homo sapiens
cctctgtctctgctctt

SEQ ID NO: 5396645 - DNA, 13 bp, Homo sapiens
cctctgtctgccc

SEQ ID NO: 5396646 - DNA, 16 bp, Homo sapiens
cctctgtctgcccttc

SEQ ID NO: 5396647 - DNA, 14 bp, Homo sapiens
cctctgtctggcaa

SEQ ID NO: 5396648 - DNA, 23 bp, Homo sapiens
cctctgtcttctctatcctctct

SEQ ID NO: 5396649 - DNA, 20 bp, Homo sapiens
cctctgtcttggctttcatg

SEQ ID NO: 5396650 - DNA, 18 bp, Homo sapiens
cctctgtgaaatttgtaa

SEQ ID NO: 5396651 - DNA, 17 bp, Homo sapiens
cctctgtgaactgtgtg

SEQ ID NO: 5396652 - DNA, 18 bp, Homo sapiens
cctctgtgaactgtgtgt

SEQ ID NO: 5396653 - DNA, 21 bp, Homo sapiens
cctctgtgacccctccttgtc

SEQ ID NO: 5396654 - DNA, 23 bp, Homo sapiens
cctctgtgaggaaagcacacagt

SEQ ID NO: 5396655 - DNA, 18 bp, Homo sapiens
cctctgtgattacataga

SEQ ID NO: 5396656 - DNA, 18 bp, Homo sapiens
cctctgtgcacagtggct

SEQ ID NO: 5396657 - DNA, 19 bp, Homo sapiens
cctctgtgcacagtggctt

SEQ ID NO: 5396658 - DNA, 15 bp, Homo sapiens
cctctgtgcagggca

SEQ ID NO: 5396659 - DNA, 18 bp, Homo sapiens
cctctgtgcctaataaag

SEQ ID NO: 5396660 - DNA, 21 bp, Homo sapiens
cctctgtgccttcttttgatt

SEQ ID NO: 5396661 - DNA, 15 bp, Homo sapiens
cctctgtgctctcct

SEQ ID NO: 5396662 - DNA, 19 bp, Homo sapiens
cctctgtgctgcatcccac

SEQ ID NO: 5396663 - DNA, 20 bp, Homo sapiens
cctctgtgctgcatcccacc

SEQ ID NO: 5396664 - DNA, 23 bp, Homo sapiens
cctctgtgctgtgtatgtgaacc

SEQ ID NO: 5396665 - DNA, 16 bp, Homo sapiens
cctctgtgctgtgtgt

SEQ ID NO: 5396666 - DNA, 20 bp, Homo sapiens
cctctgtgcttcgactactg

SEQ ID NO: 5396667 - DNA, 12 bp, Homo sapiens
cctctgtggaag

SEQ ID NO: 5396668 - DNA, 15 bp, Homo sapiens
cctctgtggagcgcc

SEQ ID NO: 5396669 - DNA, 16 bp, Homo sapiens
cctctgtggccaggag

SEQ ID NO: 5396670 - DNA, 18 bp, Homo sapiens
cctctgtggccaggagcc

SEQ ID NO: 5396671 - DNA, 22 bp, Homo sapiens
cctctgtgtacatgtgtgcaga

SEQ ID NO: 5396672 - DNA, 18 bp, Homo sapiens
cctctgtgtcactggctg

SEQ ID NO: 5396673 - DNA, 21 bp, Homo sapiens
cctctgtgtcactggctgcct

SEQ ID NO: 5396674 - DNA, 19 bp, Homo sapiens
cctctgtgtccttccctgc

SEQ ID NO: 5396675 - DNA, 23 bp, Homo sapiens
cctctgttacatcctgctacact

SEQ ID NO: 5396676 - DNA, 20 bp, Homo sapiens
cctctgttaggtccattttc

SEQ ID NO: 5396677 - DNA, 20 bp, Homo sapiens
cctctgttcacaaactacct

SEQ ID NO: 5396678 - DNA, 16 bp, Homo sapiens
cctctgttcagtcgca

SEQ ID NO: 5396679 - DNA, 17 bp, Homo sapiens
cctctgttctcatgaag

SEQ ID NO: 5396680 - DNA, 11 bp, Homo sapiens
cctctgttctt

SEQ ID NO: 5396681 - DNA, 21 bp, Homo sapiens
cctctgtttctctttccttgg

SEQ ID NO: 5396682 - DNA, 19 bp, Homo sapiens
cctcttaaagctgcctgta

SEQ ID NO: 5396683 - DNA, 18 bp, Homo sapiens
cctcttaaataaaccttt

SEQ ID NO: 5396684 - DNA, 15 bp, Homo sapiens
cctcttaaattatat

SEQ ID NO: 5396685 - DNA, 15 bp, Homo sapiens
cctcttaagtcccag

SEQ ID NO: 5396686 - DNA, 15 bp, Homo sapiens
cctcttaccttcccg

SEQ ID NO: 5396687 - DNA, 14 bp, Homo sapiens
cctcttactggggc

SEQ ID NO: 5396688 - DNA, 12 bp, Homo sapiens
cctcttagcctc

SEQ ID NO: 5396689 - DNA, 14 bp, Homo sapiens
cctcttagctgagt

SEQ ID NO: 5396690 - DNA, 19 bp, Homo sapiens
cctcttataacttctgaag

SEQ ID NO: 5396691 - DNA, 15 bp, Homo sapiens
cctcttatgggctgg

SEQ ID NO: 5396692 - DNA, 17 bp, Homo sapiens
cctcttatgggctgggt

SEQ ID NO: 5396693 - DNA, 20 bp, Homo sapiens
cctcttatgtacctctttta

SEQ ID NO: 5396694 - DNA, 19 bp, Homo sapiens
cctcttattccaggagaag

SEQ ID NO: 5396695 - DNA, 13 bp, Homo sapiens
cctcttattccta

SEQ ID NO: 5396696 - DNA, 16 bp, Homo sapiens
cctcttattcctaagg

SEQ ID NO: 5396697 - DNA, 18 bp, Homo sapiens
cctcttattcctctaggc

SEQ ID NO: 5396698 - DNA, 17 bp, Homo sapiens
cctcttcaaagcagagt

SEQ ID NO: 5396699 - DNA, 21 bp, Homo sapiens
cctcttcaaagcagagtggga

SEQ ID NO: 5396700 - DNA, 13 bp, Homo sapiens
cctcttcaaatta

SEQ ID NO: 5396701 - DNA, 14 bp, Homo sapiens
cctcttcaccaggt

SEQ ID NO: 5396702 - DNA, 16 bp, Homo sapiens
cctcttcaccaggtgc

SEQ ID NO: 5396703 - DNA, 17 bp, Homo sapiens
cctcttcaccccggcag

SEQ ID NO: 5396704 - DNA, 20 bp, Homo sapiens
cctcttcaccccggcaggcc

SEQ ID NO: 5396705 - DNA, 22 bp, Homo sapiens
cctcttcaccccggcaggccct

SEQ ID NO: 5396706 - DNA, 23 bp, Homo sapiens
cctcttcaccccggcaggccctg

SEQ ID NO: 5396707 - DNA, 16 bp, Homo sapiens
cctcttcactgtggcc

SEQ ID NO: 5396708 - DNA, 14 bp, Homo sapiens
cctcttcagatcct

SEQ ID NO: 5396709 - DNA, 19 bp, Homo sapiens
cctcttcagctgctgacaa

SEQ ID NO: 5396710 - DNA, 16 bp, Homo sapiens
cctcttcaggcctgct

SEQ ID NO: 5396711 - DNA, 19 bp, Homo sapiens
cctcttcaggcctgctagt

SEQ ID NO: 5396712 - DNA, 22 bp, Homo sapiens
cctcttcaggcctgctagtcac

SEQ ID NO: 5396713 - DNA, 17 bp, Homo sapiens
cctcttccaaaggcagc

SEQ ID NO: 5396714 - DNA, 19 bp, Homo sapiens
cctcttccaggaagcacag

SEQ ID NO: 5396715 - DNA, 15 bp, Homo sapiens
cctcttccagtgaac

SEQ ID NO: 5396716 - DNA, 18 bp, Homo sapiens
cctcttccagtgaacatt

SEQ ID NO: 5396717 - DNA, 18 bp, Homo sapiens
cctcttccatcatgtccc

SEQ ID NO: 5396718 - DNA, 16 bp, Homo sapiens
cctcttccatgctgtg

SEQ ID NO: 5396719 - DNA, 13 bp, Homo sapiens
cctcttccccaga

SEQ ID NO: 5396720 - DNA, 22 bp, Homo sapiens
cctcttccccagacgcctggct

SEQ ID NO: 5396721 - DNA, 15 bp, Homo sapiens
cctcttccccctgct

SEQ ID NO: 5396722 - DNA, 17 bp, Homo sapiens
cctcttccccttgccct

SEQ ID NO: 5396723 - DNA, 19 bp, Homo sapiens
cctcttccctctccctctc

SEQ ID NO: 5396724 - DNA, 22 bp, Homo sapiens
cctcttccctctgatttttcct

SEQ ID NO: 5396725 - DNA, 14 bp, Homo sapiens
cctcttccctctgg

SEQ ID NO: 5396726 - DNA, 23 bp, Homo sapiens
cctcttcccttagcctctcccac

SEQ ID NO: 5396727 - DNA, 19 bp, Homo sapiens
cctcttccgactctttctg

SEQ ID NO: 5396728 - DNA, 19 bp, Homo sapiens
cctcttccggagatgtagc

SEQ ID NO: 5396729 - DNA, 16 bp, Homo sapiens
cctcttcctaggccac

SEQ ID NO: 5396730 - DNA, 11 bp, Homo sapiens
cctcttcctca

SEQ ID NO: 5396731 - DNA, 16 bp, Homo sapiens
cctcttcctccctcat

SEQ ID NO: 5396732 - DNA, 19 bp, Homo sapiens
cctcttcctccctcattcc

SEQ ID NO: 5396733 - DNA, 22 bp, Homo sapiens
cctcttcctccctccctgcagg

SEQ ID NO: 5396734 - DNA, 15 bp, Homo sapiens
cctcttcctccctgg

SEQ ID NO: 5396735 - DNA, 17 bp, Homo sapiens
cctcttcctccctgggg

SEQ ID NO: 5396736 - DNA, 14 bp, Homo sapiens
cctcttcctcctgg

SEQ ID NO: 5396737 - DNA, 12 bp, Homo sapiens
cctcttcctctg

SEQ ID NO: 5396738 - DNA, 16 bp, Homo sapiens
cctcttcctctggttc

SEQ ID NO: 5396739 - DNA, 15 bp, Homo sapiens
cctcttcctcttgac

SEQ ID NO: 5396740 - DNA, 11 bp, Homo sapiens
cctcttcctga

SEQ ID NO: 5396741 - DNA, 20 bp, Homo sapiens
cctcttcctgacgaaactgg

SEQ ID NO: 5396742 - DNA, 13 bp, Homo sapiens
cctcttcctgcca

SEQ ID NO: 5396743 - DNA, 19 bp, Homo sapiens
cctcttcctgcccttgaac

SEQ ID NO: 5396744 - DNA, 14 bp, Homo sapiens
cctcttccttcccc

SEQ ID NO: 5396745 - DNA, 17 bp, Homo sapiens
cctcttccttctctact

SEQ ID NO: 5396746 - DNA, 22 bp, Homo sapiens
cctcttctaaaatagcaataac

SEQ ID NO: 5396747 - DNA, 23 bp, Homo sapiens
cctcttctaacccaactgacttg

SEQ ID NO: 5396748 - DNA, 14 bp, Homo sapiens
cctcttctacttgt

SEQ ID NO: 5396749 - DNA, 18 bp, Homo sapiens
cctcttctattttgtaaa

SEQ ID NO: 5396750 - DNA, 17 bp, Homo sapiens
cctcttctcaagtgcct

SEQ ID NO: 5396751 - DNA, 13 bp, Homo sapiens
cctcttctctcag

SEQ ID NO: 5396752 - DNA, 14 bp, Homo sapiens
cctcttctctcaga

SEQ ID NO: 5396753 - DNA, 15 bp, Homo sapiens
cctcttctctcctca

SEQ ID NO: 5396754 - DNA, 16 bp, Homo sapiens
cctcttctctcctcag

SEQ ID NO: 5396755 - DNA, 18 bp, Homo sapiens
cctcttctcttgacagtc

SEQ ID NO: 5396756 - DNA, 17 bp, Homo sapiens
cctcttctgacgtgcct

SEQ ID NO: 5396757 - DNA, 14 bp, Homo sapiens
cctcttctgagcta

SEQ ID NO: 5396758 - DNA, 15 bp, Homo sapiens
cctcttctgctcctt

SEQ ID NO: 5396759 - DNA, 20 bp, Homo sapiens
cctcttctgctcttttcctg

SEQ ID NO: 5396760 - DNA, 23 bp, Homo sapiens
cctcttctggagatggaagcttg

SEQ ID NO: 5396761 - DNA, 15 bp, Homo sapiens
cctcttctggctcaa

SEQ ID NO: 5396762 - DNA, 19 bp, Homo sapiens
cctcttctgggctactgcc

SEQ ID NO: 5396763 - DNA, 22 bp, Homo sapiens
cctcttctggtttccctttatt

SEQ ID NO: 5396764 - DNA, 17 bp, Homo sapiens
cctcttctgtcccaagt

SEQ ID NO: 5396765 - DNA, 20 bp, Homo sapiens
cctcttctgtccctgttaga

SEQ ID NO: 5396766 - DNA, 12 bp, Homo sapiens
cctcttcttact

SEQ ID NO: 5396767 - DNA, 14 bp, Homo sapiens
cctcttcttacttg

SEQ ID NO: 5396768 - DNA, 13 bp, Homo sapiens
cctcttcttctga

SEQ ID NO: 5396769 - DNA, 14 bp, Homo sapiens
cctcttcttctttc

SEQ ID NO: 5396770 - DNA, 18 bp, Homo sapiens
cctcttcttcttttctat

SEQ ID NO: 5396771 - DNA, 21 bp, Homo sapiens
cctcttcttgcggcaccgccc

SEQ ID NO: 5396772 - DNA, 21 bp, Homo sapiens
cctcttctttgtgcctttggc

SEQ ID NO: 5396773 - DNA, 23 bp, Homo sapiens
cctcttctttgtgcctttggcct

SEQ ID NO: 5396774 - DNA, 18 bp, Homo sapiens
cctcttcttttcacctct

SEQ ID NO: 5396775 - DNA, 21 bp, Homo sapiens
cctcttgaagagaaaaaagtc

SEQ ID NO: 5396776 - DNA, 21 bp, Homo sapiens
cctcttgaatgcttaaatgat

SEQ ID NO: 5396777 - DNA, 15 bp, Homo sapiens
cctcttgaccctgca

SEQ ID NO: 5396778 - DNA, 19 bp, Homo sapiens
cctcttgagaggggtgaga

SEQ ID NO: 5396779 - DNA, 24 bp, Homo sapiens
cctcttgagcagtggctggtccag

SEQ ID NO: 5396780 - DNA, 19 bp, Homo sapiens
cctcttgagccttgaactt

SEQ ID NO: 5396781 - DNA, 15 bp, Homo sapiens
cctcttgagttcctc

SEQ ID NO: 5396782 - DNA, 18 bp, Homo sapiens
cctcttgagttcctctgc

SEQ ID NO: 5396783 - DNA, 17 bp, Homo sapiens
cctcttgatctcaaagc

SEQ ID NO: 5396784 - DNA, 14 bp, Homo sapiens
cctcttgccactgc

SEQ ID NO: 5396785 - DNA, 22 bp, Homo sapiens
cctcttgccactgcctcttcct

SEQ ID NO: 5396786 - DNA, 23 bp, Homo sapiens
cctcttgccactgcctcttcctc

SEQ ID NO: 5396787 - DNA, 12 bp, Homo sapiens
cctcttgccagc

SEQ ID NO: 5396788 - DNA, 17 bp, Homo sapiens
cctcttgccagcctcct

SEQ ID NO: 5396789 - DNA, 19 bp, Homo sapiens
cctcttgccagcctccttg

SEQ ID NO: 5396790 - DNA, 15 bp, Homo sapiens
cctcttgccagctca

SEQ ID NO: 5396791 - DNA, 18 bp, Homo sapiens
cctcttgccatcctgatg

SEQ ID NO: 5396792 - DNA, 15 bp, Homo sapiens
cctcttgccccaacc

SEQ ID NO: 5396793 - DNA, 21 bp, Homo sapiens
cctcttgccccaacccccagc

SEQ ID NO: 5396794 - DNA, 22 bp, Homo sapiens
cctcttgccccaacccccagca

SEQ ID NO: 5396795 - DNA, 12 bp, Homo sapiens
cctcttgccccc

SEQ ID NO: 5396796 - DNA, 23 bp, Homo sapiens
cctcttgccccccaccccagcct

SEQ ID NO: 5396797 - DNA, 22 bp, Homo sapiens
cctcttgcccgtcggccctgcg

SEQ ID NO: 5396798 - DNA, 15 bp, Homo sapiens
cctcttgcctctctc

SEQ ID NO: 5396799 - DNA, 18 bp, Homo sapiens
cctcttgcgggcctggac

SEQ ID NO: 5396800 - DNA, 12 bp, Homo sapiens
cctcttgctcaa

SEQ ID NO: 5396801 - DNA, 22 bp, Homo sapiens
cctcttgctcagagctaggccc

SEQ ID NO: 5396802 - DNA, 16 bp, Homo sapiens
cctcttgctgtctctg

SEQ ID NO: 5396803 - DNA, 20 bp, Homo sapiens
cctcttgctgtctctgctcg

SEQ ID NO: 5396804 - DNA, 18 bp, Homo sapiens
cctcttggacctctgctc

SEQ ID NO: 5396805 - DNA, 18 bp, Homo sapiens
cctcttggagaagtctca

SEQ ID NO: 5396806 - DNA, 22 bp, Homo sapiens
cctcttggagaagtctcagcta

SEQ ID NO: 5396807 - DNA, 21 bp, Homo sapiens
cctcttggcacctgcctagct

SEQ ID NO: 5396808 - DNA, 12 bp, Homo sapiens
cctgagcattca

SEQ ID NO: 5396809 - DNA, 23 bp, Homo sapiens
cctgagcattcaggcagcactga

SEQ ID NO: 5396810 - DNA, 17 bp, Homo sapiens
cctgagccaaatttctt

SEQ ID NO: 5396811 - DNA, 13 bp, Homo sapiens
cctgagccaagga

SEQ ID NO: 5396812 - DNA, 16 bp, Homo sapiens
cctgagccacagtggg

SEQ ID NO: 5396813 - DNA, 20 bp, Homo sapiens
cctgagccacctttactctg

SEQ ID NO: 5396814 - DNA, 15 bp, Homo sapiens
cctgagccagatttc

SEQ ID NO: 5396815 - DNA, 19 bp, Homo sapiens
cctgagccagggtctccag

SEQ ID NO: 5396816 - DNA, 21 bp, Homo sapiens
cctgagccagggtctccagaa

SEQ ID NO: 5396817 - DNA, 23 bp, Homo sapiens
cctgagccagggtctccagaaag

SEQ ID NO: 5396818 - DNA, 21 bp, Homo sapiens
cctgagcccaaccaggccctg

SEQ ID NO: 5396819 - DNA, 12 bp, Homo sapiens
cctgagcccacc

SEQ ID NO: 5396820 - DNA, 13 bp, Homo sapiens
cctgagcccactg

SEQ ID NO: 5396821 - DNA, 16 bp, Homo sapiens
cctgagcccactgtgc

SEQ ID NO: 5396822 - DNA, 15 bp, Homo sapiens
cctgagcccagagaa

SEQ ID NO: 5396823 - DNA, 15 bp, Homo sapiens
cctgagcccagggag

SEQ ID NO: 5396824 - DNA, 21 bp, Homo sapiens
cctgagccccagggagagggg

SEQ ID NO: 5396825 - DNA, 13 bp, Homo sapiens
cctgagcccccag

SEQ ID NO: 5396826 - DNA, 14 bp, Homo sapiens
cctgagcccccagc

SEQ ID NO: 5396827 - DNA, 15 bp, Homo sapiens
cctgagcccccagct

SEQ ID NO: 5396828 - DNA, 14 bp, Homo sapiens
cctgagccccctgc

SEQ ID NO: 5396829 - DNA, 16 bp, Homo sapiens
cctgagccccctgcac

SEQ ID NO: 5396830 - DNA, 18 bp, Homo sapiens
cctgagccccctgcaccc

SEQ ID NO: 5396831 - DNA, 23 bp, Homo sapiens
cctgagccccgccctcttcctga

SEQ ID NO: 5396832 - DNA, 17 bp, Homo sapiens
cctgagcccctcagaca

SEQ ID NO: 5396833 - DNA, 20 bp, Homo sapiens
cctgagccccttccttgctc

SEQ ID NO: 5396834 - DNA, 23 bp, Homo sapiens
cctgagccccttccttgctctgc

SEQ ID NO: 5396835 - DNA, 19 bp, Homo sapiens
cctgagcccgcagcccaga

SEQ ID NO: 5396836 - DNA, 21 bp, Homo sapiens
cctgagcccgcagcccagacc

SEQ ID NO: 5396837 - DNA, 23 bp, Homo sapiens
cctgagcccggccctcccccagc

SEQ ID NO: 5396838 - DNA, 17 bp, Homo sapiens
cctgagccctactccct

SEQ ID NO: 5396839 - DNA, 18 bp, Homo sapiens
cctgagcctaactccctc

SEQ ID NO: 5396840 - DNA, 12 bp, Homo sapiens
cctgagcctcac

SEQ ID NO: 5396841 - DNA, 14 bp, Homo sapiens
cctgagcctgacct

SEQ ID NO: 5396842 - DNA, 18 bp, Homo sapiens
cctgagcctgacctttct

SEQ ID NO: 5396843 - DNA, 15 bp, Homo sapiens
cctgagcctgcccca

SEQ ID NO: 5396844 - DNA, 16 bp, Homo sapiens
cctgagcctgccgagc

SEQ ID NO: 5396845 - DNA, 20 bp, Homo sapiens
cctgagcctgccgagcaacc

SEQ ID NO: 5396846 - DNA, 12 bp, Homo sapiens
cctgagcctggc

SEQ ID NO: 5396847 - DNA, 14 bp, Homo sapiens
cctgagcctggcag

SEQ ID NO: 5396848 - DNA, 15 bp, Homo sapiens
cctgagcctggccag

SEQ ID NO: 5396849 - DNA, 16 bp, Homo sapiens
cctgagcctggccagc

SEQ ID NO: 5396850 - DNA, 15 bp, Homo sapiens
cctgagcctgtctct

SEQ ID NO: 5396851 - DNA, 22 bp, Homo sapiens
cctgagccttagctcccagcta

SEQ ID NO: 5396852 - DNA, 23 bp, Homo sapiens
cctgagccttagctcccagctag

SEQ ID NO: 5396853 - DNA, 17 bp, Homo sapiens
cctgagcggcaccctgg

SEQ ID NO: 5396854 - DNA, 21 bp, Homo sapiens
cctgagcggcaccctggtctg

SEQ ID NO: 5396855 - DNA, 21 bp, Homo sapiens
cctgagctagcaaatacagga

SEQ ID NO: 5396856 - DNA, 20 bp, Homo sapiens
cctgagctagtgtcacctgc

SEQ ID NO: 5396857 - DNA, 17 bp, Homo sapiens
cctgagctattttcctc

SEQ ID NO: 5396858 - DNA, 15 bp, Homo sapiens
cctgagctcaggctg

SEQ ID NO: 5396859 - DNA, 16 bp, Homo sapiens
cctgagctcaggctga

SEQ ID NO: 5396860 - DNA, 19 bp, Homo sapiens
cctgagctcaggctgagcc

SEQ ID NO: 5396861 - DNA, 21 bp, Homo sapiens
cctgagctcaggctgagccca

SEQ ID NO: 5396862 - DNA, 23 bp, Homo sapiens
cctgagctcaggctgagcccagc

SEQ ID NO: 5396863 - DNA, 14 bp, Homo sapiens
cctgagctccaccc

SEQ ID NO: 5396864 - DNA, 15 bp, Homo sapiens
cctgagctccaccct

SEQ ID NO: 5396865 - DNA, 16 bp, Homo sapiens
cctgagctccaccctc

SEQ ID NO: 5396866 - DNA, 16 bp, Homo sapiens
cctgagctcggtggac

SEQ ID NO: 5396867 - DNA, 19 bp, Homo sapiens
cctgagctcggtggaccca

SEQ ID NO: 5396868 - DNA, 20 bp, Homo sapiens
cctgagctcggtggacccag

SEQ ID NO: 5396869 - DNA, 23 bp, Homo sapiens
cctgagctctggagcaagccctg

SEQ ID NO: 5396870 - DNA, 16 bp, Homo sapiens
cctgagctgaggcagc

SEQ ID NO: 5396871 - DNA, 18 bp, Homo sapiens
cctgagctgaggcagcag

SEQ ID NO: 5396872 - DNA, 13 bp, Homo sapiens
cctgagctgcttc

SEQ ID NO: 5396873 - DNA, 16 bp, Homo sapiens
cctgagctgcttcact

SEQ ID NO: 5396874 - DNA, 12 bp, Homo sapiens
cctgagctggcc

SEQ ID NO: 5396875 - DNA, 15 bp, Homo sapiens
cctgagctggccagg

SEQ ID NO: 5396876 - DNA, 17 bp, Homo sapiens
cctgagctggccaggcc

SEQ ID NO: 5396877 - DNA, 15 bp, Homo sapiens
cctgagctggcctgt

SEQ ID NO: 5396878 - DNA, 23 bp, Homo sapiens
cctgagctggcctgtctgcgtgg

SEQ ID NO: 5396879 - DNA, 14 bp, Homo sapiens
cctgagctggggaa

SEQ ID NO: 5396880 - DNA, 15 bp, Homo sapiens
cctgagctggggaag

SEQ ID NO: 5396881 - DNA, 16 bp, Homo sapiens
cctgagctggggaagc

SEQ ID NO: 5396882 - DNA, 18 bp, Homo sapiens
cctgagctggggcctgga

SEQ ID NO: 5396883 - DNA, 22 bp, Homo sapiens
cctgagctggggcctggagagg

SEQ ID NO: 5396884 - DNA, 16 bp, Homo sapiens
cctgagctgtcgctgc

SEQ ID NO: 5396885 - DNA, 23 bp, Homo sapiens
cctgagctgtcgctgcctccatg

SEQ ID NO: 5396886 - DNA, 17 bp, Homo sapiens
cctgagcttggccagaa

SEQ ID NO: 5396887 - DNA, 18 bp, Homo sapiens
cctgagcttggccagaag

SEQ ID NO: 5396888 - DNA, 22 bp, Homo sapiens
cctgagctttccggggaggagc

SEQ ID NO: 5396889 - DNA, 16 bp, Homo sapiens
cctgagctttctgcta

SEQ ID NO: 5396890 - DNA, 23 bp, Homo sapiens
cctgagctttggacacacacagc

SEQ ID NO: 5396891 - DNA, 22 bp, Homo sapiens
cctgagctttggacgcacacag

SEQ ID NO: 5396892 - DNA, 18 bp, Homo sapiens
cctgagctttggggacag

SEQ ID NO: 5396893 - DNA, 18 bp, Homo sapiens
cctgaggaacccttacag

SEQ ID NO: 5396894 - DNA, 12 bp, Homo sapiens
cctgaggaataa

SEQ ID NO: 5396895 - DNA, 14 bp, Homo sapiens
cctgaggaataaag

SEQ ID NO: 5396896 - DNA, 16 bp, Homo sapiens
cctgaggaataaagct

SEQ ID NO: 5396897 - DNA, 21 bp, Homo sapiens
cctgaggaataaagcttctct

SEQ ID NO: 5396898 - DNA, 12 bp, Homo sapiens
cctgaggaatga

SEQ ID NO: 5396899 - DNA, 15 bp, Homo sapiens
cctgaggacagctgt

SEQ ID NO: 5396900 - DNA, 16 bp, Homo sapiens
cctgaggacagctgtc

SEQ ID NO: 5396901 - DNA, 20 bp, Homo sapiens
cctgaggacctttctgagga

SEQ ID NO: 5396902 - DNA, 14 bp, Homo sapiens
cctgaggagacatc

SEQ ID NO: 5396903 - DNA, 13 bp, Homo sapiens
cctgaggagagga

SEQ ID NO: 5396904 - DNA, 16 bp, Homo sapiens
cctgaggagcagccca

SEQ ID NO: 5396905 - DNA, 19 bp, Homo sapiens
cctgaggagcagcccacct

SEQ ID NO: 5396906 - DNA, 15 bp, Homo sapiens
cctgaggagccctga

SEQ ID NO: 5396907 - DNA, 12 bp, Homo sapiens
cctgaggaggag

SEQ ID NO: 5396908 - DNA, 17 bp, Homo sapiens
cctgaggaggaggacac

SEQ ID NO: 5396909 - DNA, 14 bp, Homo sapiens
cctgaggaggccgc

SEQ ID NO: 5396910 - DNA, 16 bp, Homo sapiens
cctgaggaggccgctt

SEQ ID NO: 5396911 - DNA, 14 bp, Homo sapiens
cctgaggagggccc

SEQ ID NO: 5396912 - DNA, 17 bp, Homo sapiens
cctgaggagggccctga

SEQ ID NO: 5396913 - DNA, 22 bp, Homo sapiens
cctgaggagggccctgaggaat

SEQ ID NO: 5396914 - DNA, 16 bp, Homo sapiens
cctgaggagtctgagg

SEQ ID NO: 5396915 - DNA, 17 bp, Homo sapiens
cctgaggagtctgaggt

SEQ ID NO: 5396916 - DNA, 19 bp, Homo sapiens
cctgaggagtctgaggtcc

SEQ ID NO: 5396917 - DNA, 22 bp, Homo sapiens
cctgaggagtctgaggtcctga

SEQ ID NO: 5396918 - DNA, 17 bp, Homo sapiens
cctgaggagtgtcctgt

SEQ ID NO: 5396919 - DNA, 18 bp, Homo sapiens
cctgaggagtgtcctgtc

SEQ ID NO: 5396920 - DNA, 15 bp, Homo sapiens
cctgaggatcagaaa

SEQ ID NO: 5396921 - DNA, 16 bp, Homo sapiens
cctgaggatcagaaag

SEQ ID NO: 5396922 - DNA, 18 bp, Homo sapiens
cctgaggatcagaaagta

SEQ ID NO: 5396923 - DNA, 17 bp, Homo sapiens
cctgaggatgagctgga

SEQ ID NO: 5396924 - DNA, 21 bp, Homo sapiens
cctgaggcagaacctggtggc

SEQ ID NO: 5396925 - DNA, 18 bp, Homo sapiens
cctgaggcaggagggcat

SEQ ID NO: 5396926 - DNA, 18 bp, Homo sapiens
cctgaggccaaatattga

SEQ ID NO: 5396927 - DNA, 12 bp, Homo sapiens
cctgaggccagt

SEQ ID NO: 5396928 - DNA, 18 bp, Homo sapiens
cctgaggccagtggcccc

SEQ ID NO: 5396929 - DNA, 22 bp, Homo sapiens
cctgaggccagtggcccccggg

SEQ ID NO: 5396930 - DNA, 17 bp, Homo sapiens
cctgaggcccagagggc

SEQ ID NO: 5396931 - DNA, 21 bp, Homo sapiens
cctgaggcccagagggcctgc

SEQ ID NO: 5396932 - DNA, 11 bp, Homo sapiens
cctgaggccct

SEQ ID NO: 5396933 - DNA, 15 bp, Homo sapiens
cctgaggccctgggc

SEQ ID NO: 5396934 - DNA, 16 bp, Homo sapiens
cctgaggccctgggct

SEQ ID NO: 5396935 - DNA, 20 bp, Homo sapiens
cctgaggccctgggctgggt

SEQ ID NO: 5396936 - DNA, 22 bp, Homo sapiens
cctgaggccctgggctgggtgc

SEQ ID NO: 5396937 - DNA, 21 bp, Homo sapiens
cctgaggcccttctctccagc

SEQ ID NO: 5396938 - DNA, 18 bp, Homo sapiens
cctgaggcctagactctg

SEQ ID NO: 5396939 - DNA, 19 bp, Homo sapiens
cctgaggcctagactctgt

SEQ ID NO: 5396940 - DNA, 20 bp, Homo sapiens
cctgaggcctgtgcctgtca

SEQ ID NO: 5396941 - DNA, 15 bp, Homo sapiens
cctgaggcggaggct

SEQ ID NO: 5396942 - DNA, 17 bp, Homo sapiens
cctgaggcggaggctgt

SEQ ID NO: 5396943 - DNA, 16 bp, Homo sapiens
cctgaggctcaagagg

SEQ ID NO: 5396944 - DNA, 19 bp, Homo sapiens
cctgaggctcaagaggccc

SEQ ID NO: 5396945 - DNA, 12 bp, Homo sapiens
cctgaggctcct

SEQ ID NO: 5396946 - DNA, 19 bp, Homo sapiens
cctgaggctctctaagaaa

SEQ ID NO: 5396947 - DNA, 21 bp, Homo sapiens
cctgaggctctctaagaaaag

SEQ ID NO: 5396948 - DNA, 18 bp, Homo sapiens
cctgaggctggactccag

SEQ ID NO: 5396949 - DNA, 23 bp, Homo sapiens
cctgaggctggcatcctggctgg

SEQ ID NO: 5396950 - DNA, 18 bp, Homo sapiens
cctgaggctggctggggg

SEQ ID NO: 5396951 - DNA, 19 bp, Homo sapiens
cctgaggctggctgggggc

SEQ ID NO: 5396952 - DNA, 14 bp, Homo sapiens
cctgaggctggggc

SEQ ID NO: 5396953 - DNA, 14 bp, Homo sapiens
cctgaggctgtggt

SEQ ID NO: 5396954 - DNA, 21 bp, Homo sapiens
cctgaggctgtttttggctgt

SEQ ID NO: 5396955 - DNA, 20 bp, Homo sapiens
cctgaggctttggatttgac

SEQ ID NO: 5396956 - DNA, 15 bp, Homo sapiens
cctgagggaagccca

SEQ ID NO: 5396957 - DNA, 16 bp, Homo sapiens
cctgagggaagcccac

SEQ ID NO: 5396958 - DNA, 18 bp, Homo sapiens
cctgagggaggacctggg

SEQ ID NO: 5396959 - DNA, 22 bp, Homo sapiens
cctgagggatctatacttgctt

SEQ ID NO: 5396960 - DNA, 13 bp, Homo sapiens
cctgagggcccct

SEQ ID NO: 5396961 - DNA, 16 bp, Homo sapiens
cctgagggcccctctg

SEQ ID NO: 5396962 - DNA, 21 bp, Homo sapiens
cctgagggcccctctgcccag

SEQ ID NO: 5396963 - DNA, 22 bp, Homo sapiens
cctgagggcccctctgcccagc

SEQ ID NO: 5396964 - DNA, 17 bp, Homo sapiens
cctgagggcccttccca

SEQ ID NO: 5396965 - DNA, 18 bp, Homo sapiens
cctgagggcggggtgtct

SEQ ID NO: 5396966 - DNA, 20 bp, Homo sapiens
cctgagggctaattctggga

SEQ ID NO: 5396967 - DNA, 13 bp, Homo sapiens
cctgagggctcct

SEQ ID NO: 5396968 - DNA, 18 bp, Homo sapiens
cctgagggctcctccatg

SEQ ID NO: 5396969 - DNA, 21 bp, Homo sapiens
cctgagggctcctccatggtg

SEQ ID NO: 5396970 - DNA, 23 bp, Homo sapiens
cctgagggctcctccatggtgct

SEQ ID NO: 5396971 - DNA, 17 bp, Homo sapiens
cctgaggggatatccct

SEQ ID NO: 5396972 - DNA, 12 bp, Homo sapiens
cctgaggggcag

SEQ ID NO: 5396973 - DNA, 17 bp, Homo sapiens
cctgaggggcagcctgc

SEQ ID NO: 5396974 - DNA, 21 bp, Homo sapiens
cctgaggggcagcctgccttg

SEQ ID NO: 5396975 - DNA, 18 bp, Homo sapiens
cctgaggggcctgccact

SEQ ID NO: 5396976 - DNA, 17 bp, Homo sapiens
cctgaggggctgggctg

SEQ ID NO: 5396977 - DNA, 18 bp, Homo sapiens
cctgaggggctggggagg

SEQ ID NO: 5396978 - DNA, 19 bp, Homo sapiens
cctgagggtccccacctgg

SEQ ID NO: 5396979 - DNA, 12 bp, Homo sapiens
cctgagggtctg

SEQ ID NO: 5396980 - DNA, 13 bp, Homo sapiens
cctgagggtggag

SEQ ID NO: 5396981 - DNA, 15 bp, Homo sapiens
cctgagggtggagac

SEQ ID NO: 5396982 - DNA, 13 bp, Homo sapiens
cctgagggtgggc

SEQ ID NO: 5396983 - DNA, 16 bp, Homo sapiens
cctgagggtggtcagc

SEQ ID NO: 5396984 - DNA, 17 bp, Homo sapiens
cctgagggtttccacct

SEQ ID NO: 5396985 - DNA, 20 bp, Homo sapiens
cctgaggtacctttccaccc

SEQ ID NO: 5396986 - DNA, 21 bp, Homo sapiens
cctgcactccctggccttgcc

SEQ ID NO: 5396987 - DNA, 12 bp, Homo sapiens
cctgcactcctc

SEQ ID NO: 5396988 - DNA, 19 bp, Homo sapiens
cctgcactctttaagggag

SEQ ID NO: 5396989 - DNA, 19 bp, Homo sapiens
cctgcactgaaacctgaga

SEQ ID NO: 5396990 - DNA, 16 bp, Homo sapiens
cctgcactgactctgg

SEQ ID NO: 5396991 - DNA, 16 bp, Homo sapiens
cctgcactgggaagga

SEQ ID NO: 5396992 - DNA, 14 bp, Homo sapiens
cctgcactgtaaaa

SEQ ID NO: 5396993 - DNA, 16 bp, Homo sapiens
cctgcactgtaaaatg

SEQ ID NO: 5396994 - DNA, 13 bp, Homo sapiens
cctgcactgtcct

SEQ ID NO: 5396995 - DNA, 20 bp, Homo sapiens
cctgcactgtcctgctccac

SEQ ID NO: 5396996 - DNA, 21 bp, Homo sapiens
cctgcactgtcctgctccaca

SEQ ID NO: 5396997 - DNA, 14 bp, Homo sapiens
cctgcactgtgccc

SEQ ID NO: 5396998 - DNA, 16 bp, Homo sapiens
cctgcactgtgccccg

SEQ ID NO: 5396999 - DNA, 18 bp, Homo sapiens
cctgcactgtgccccgcg

SEQ ID NO: 5397000 - DNA, 20 bp, Homo sapiens
cctgcactgtgccccgcggg

SEQ ID NO: 5397001 - DNA, 17 bp, Homo sapiens
cctgcacttcagacacc

SEQ ID NO: 5397002 - DNA, 17 bp, Homo sapiens
cctgcacttgcagactc

SEQ ID NO: 5397003 - DNA, 18 bp, Homo sapiens
cctgcacttgcagactct

SEQ ID NO: 5397004 - DNA, 15 bp, Homo sapiens
cctgcacttgggggc

SEQ ID NO: 5397005 - DNA, 22 bp, Homo sapiens
cctgcacttgggggctcagcaa

SEQ ID NO: 5397006 - DNA, 16 bp, Homo sapiens
cctgcactttcctagt

SEQ ID NO: 5397007 - DNA, 18 bp, Homo sapiens
cctgcactttcctccacc

SEQ ID NO: 5397008 - DNA, 19 bp, Homo sapiens
cctgcactttgatgtcatg

SEQ ID NO: 5397009 - DNA, 21 bp, Homo sapiens
cctgcagaaccggagagccag

SEQ ID NO: 5397010 - DNA, 17 bp, Homo sapiens
cctgcagaagccagaag

SEQ ID NO: 5397011 - DNA, 18 bp, Homo sapiens
cctgcagaaggaaagaag

SEQ ID NO: 5397012 - DNA, 17 bp, Homo sapiens
cctgcagacacctggac

SEQ ID NO: 5397013 - DNA, 13 bp, Homo sapiens
cctgcagaccctg

SEQ ID NO: 5397014 - DNA, 19 bp, Homo sapiens
cctgcagaccctgccaggg

SEQ ID NO: 5397015 - DNA, 16 bp, Homo sapiens
cctgcagaccctgccc

SEQ ID NO: 5397016 - DNA, 18 bp, Homo sapiens
cctgcagaccctgccctt

SEQ ID NO: 5397017 - DNA, 15 bp, Homo sapiens
cctgcagacctcaag

SEQ ID NO: 5397018 - DNA, 21 bp, Homo sapiens
cctgcagacctcaagccatca

SEQ ID NO: 5397019 - DNA, 19 bp, Homo sapiens
cctgcagacctggctgggc

SEQ ID NO: 5397020 - DNA, 15 bp, Homo sapiens
cctgcagactcactg

SEQ ID NO: 5397021 - DNA, 12 bp, Homo sapiens
cctgcagactcc

SEQ ID NO: 5397022 - DNA, 22 bp, Homo sapiens
cctgcagactccaatggggcca

SEQ ID NO: 5397023 - DNA, 13 bp, Homo sapiens
cctgcagagaaac

SEQ ID NO: 5397024 - DNA, 22 bp, Homo sapiens
cctgcagagagggaactagggc

SEQ ID NO: 5397025 - DNA, 12 bp, Homo sapiens
cctgcagagcaa

SEQ ID NO: 5397026 - DNA, 15 bp, Homo sapiens
cctgcagagctatgg

SEQ ID NO: 5397027 - DNA, 17 bp, Homo sapiens
cctgcagagctgcgggc

SEQ ID NO: 5397028 - DNA, 18 bp, Homo sapiens
cctgcagaggaaagacag

SEQ ID NO: 5397029 - DNA, 16 bp, Homo sapiens
cctgcagaggaccaca

SEQ ID NO: 5397030 - DNA, 22 bp, Homo sapiens
cctgcagaggaccacagtgggt

SEQ ID NO: 5397031 - DNA, 20 bp, Homo sapiens
cctgcagatgccaccctagc

SEQ ID NO: 5397032 - DNA, 15 bp, Homo sapiens
cctgcagcagaacct

SEQ ID NO: 5397033 - DNA, 22 bp, Homo sapiens
cctgcagcagtcgcccaagcag

SEQ ID NO: 5397034 - DNA, 16 bp, Homo sapiens
cctgcagcatggtccc

SEQ ID NO: 5397035 - DNA, 19 bp, Homo sapiens
cctgcagcatggtccctgc

SEQ ID NO: 5397036 - DNA, 23 bp, Homo sapiens
cctgcagcatggtccctgcctta

SEQ ID NO: 5397037 - DNA, 18 bp, Homo sapiens
cctgcagccaaacagagc

SEQ ID NO: 5397038 - DNA, 15 bp, Homo sapiens
cctgcagccacatgg

SEQ ID NO: 5397039 - DNA, 14 bp, Homo sapiens
cctgcagccaggac

SEQ ID NO: 5397040 - DNA, 14 bp, Homo sapiens
cctgcagccagggc

SEQ ID NO: 5397041 - DNA, 17 bp, Homo sapiens
cctgcagccagggctgg

SEQ ID NO: 5397042 - DNA, 22 bp, Homo sapiens
cctgcagccagggctggggttg

SEQ ID NO: 5397043 - DNA, 13 bp, Homo sapiens
cctgcagcccacc

SEQ ID NO: 5397044 - DNA, 13 bp, Homo sapiens
cctgcagcccaga

SEQ ID NO: 5397045 - DNA, 19 bp, Homo sapiens
cctgcagccccagaagaaa

SEQ ID NO: 5397046 - DNA, 15 bp, Homo sapiens
cctgcagccccaggc

SEQ ID NO: 5397047 - DNA, 15 bp, Homo sapiens
cctgcagcccgtgtc

SEQ ID NO: 5397048 - DNA, 12 bp, Homo sapiens
cctgcagccgtg

SEQ ID NO: 5397049 - DNA, 23 bp, Homo sapiens
cctgcagcctccctccgcggcgg

SEQ ID NO: 5397050 - DNA, 22 bp, Homo sapiens
cctgcagcctcctccacctcac

SEQ ID NO: 5397051 - DNA, 13 bp, Homo sapiens
cctgcagcctgga

SEQ ID NO: 5397052 - DNA, 15 bp, Homo sapiens
cctgcagcctggagg

SEQ ID NO: 5397053 - DNA, 16 bp, Homo sapiens
cctgcagcctggaggc

SEQ ID NO: 5397054 - DNA, 15 bp, Homo sapiens
cctgcagcctgggtc

SEQ ID NO: 5397055 - DNA, 22 bp, Homo sapiens
cctgcagcctgggtctggatgg

SEQ ID NO: 5397056 - DNA, 15 bp, Homo sapiens
cctgcagcctggtag

SEQ ID NO: 5397057 - DNA, 20 bp, Homo sapiens
cctgcagccttttctggtcc

SEQ ID NO: 5397058 - DNA, 17 bp, Homo sapiens
cctgcagcgagctgaga

SEQ ID NO: 5397059 - DNA, 20 bp, Homo sapiens
cctgcagcgagctgagatca

SEQ ID NO: 5397060 - DNA, 22 bp, Homo sapiens
cctgcagcgcctcccttgtctc

SEQ ID NO: 5397061 - DNA, 22 bp, Homo sapiens
cctgcagcggctgccctctggg

SEQ ID NO: 5397062 - DNA, 10 bp, Homo sapiens
cctgcagctc

SEQ ID NO: 5397063 - DNA, 14 bp, Homo sapiens
cctgcagctcctct

SEQ ID NO: 5397064 - DNA, 12 bp, Homo sapiens
cctgcagctggg

SEQ ID NO: 5397065 - DNA, 13 bp, Homo sapiens
cctgcagcttatt

SEQ ID NO: 5397066 - DNA, 16 bp, Homo sapiens
cctgcagcttgtagcc

SEQ ID NO: 5397067 - DNA, 20 bp, Homo sapiens
cctgcagcttgtagccagcc

SEQ ID NO: 5397068 - DNA, 19 bp, Homo sapiens
cctgcaggaaagaaatcag

SEQ ID NO: 5397069 - DNA, 18 bp, Homo sapiens
cctgcaggaacgagcact

SEQ ID NO: 5397070 - DNA, 20 bp, Homo sapiens
cctgcaggaacgagcactgg

SEQ ID NO: 5397071 - DNA, 21 bp, Homo sapiens
cctgcaggaaggagctgcctg

SEQ ID NO: 5397072 - DNA, 19 bp, Homo sapiens
cctgcaggacctgcctgta

SEQ ID NO: 5397073 - DNA, 20 bp, Homo sapiens
cctgcaggacctgcctgtag

SEQ ID NO: 5397074 - DNA, 18 bp, Homo sapiens
cctgcaggagagagcagc

SEQ ID NO: 5397075 - DNA, 16 bp, Homo sapiens
cctgcaggagcagggc

SEQ ID NO: 5397076 - DNA, 22 bp, Homo sapiens
cctgcaggagcagggcggctgc

SEQ ID NO: 5397077 - DNA, 18 bp, Homo sapiens
cctgcaggaggcctggga

SEQ ID NO: 5397078 - DNA, 22 bp, Homo sapiens
cctgcaggatctcaccaggcag

SEQ ID NO: 5397079 - DNA, 14 bp, Homo sapiens
cctgcaggcacaga

SEQ ID NO: 5397080 - DNA, 12 bp, Homo sapiens
cctgcaggcaga

SEQ ID NO: 5397081 - DNA, 15 bp, Homo sapiens
cctgcaggcagagct

SEQ ID NO: 5397082 - DNA, 20 bp, Homo sapiens
cctgcaggcagagctggagc

SEQ ID NO: 5397083 - DNA, 21 bp, Homo sapiens
cctgcaggcagagctggagcc

SEQ ID NO: 5397084 - DNA, 15 bp, Homo sapiens
cctgcaggcagccag

SEQ ID NO: 5397085 - DNA, 17 bp, Homo sapiens
cctgcaggcagccaggc

SEQ ID NO: 5397086 - DNA, 22 bp, Homo sapiens
cctgcaggcaggaacaaacagg

SEQ ID NO: 5397087 - DNA, 23 bp, Homo sapiens
cctgcaggcaggaacaaacaggg

SEQ ID NO: 5397088 - DNA, 13 bp, Homo sapiens
cctgcaggcaggc

SEQ ID NO: 5397089 - DNA, 22 bp, Homo sapiens
cctgcaggccaagagcagaggc

SEQ ID NO: 5397090 - DNA, 13 bp, Homo sapiens
cctgcaggccagg

SEQ ID NO: 5397091 - DNA, 15 bp, Homo sapiens
cctgcaggccaggcc

SEQ ID NO: 5397092 - DNA, 17 bp, Homo sapiens
cctgcaggccccagcca

SEQ ID NO: 5397093 - DNA, 20 bp, Homo sapiens
cctgcaggccccagccaagt

SEQ ID NO: 5397094 - DNA, 23 bp, Homo sapiens
cctgcaggccccagccaagtgcc

SEQ ID NO: 5397095 - DNA, 22 bp, Homo sapiens
cctgcaggcggtatccagaggt

SEQ ID NO: 5397096 - DNA, 18 bp, Homo sapiens
cctgcaggctccatgcac

SEQ ID NO: 5397097 - DNA, 15 bp, Homo sapiens
cctgcaggctcccga

SEQ ID NO: 5397098 - DNA, 16 bp, Homo sapiens
cctgcaggctgagcca

SEQ ID NO: 5397099 - DNA, 20 bp, Homo sapiens
cctgcaggctgcaggagggc

SEQ ID NO: 5397100 - DNA, 12 bp, Homo sapiens
cctgcaggctgg

SEQ ID NO: 5397101 - DNA, 14 bp, Homo sapiens
cctgcaggctggag

SEQ ID NO: 5397102 - DNA, 17 bp, Homo sapiens
cctgcaggctggagact

SEQ ID NO: 5397103 - DNA, 17 bp, Homo sapiens
cctgcaggctggctgtt

SEQ ID NO: 5397104 - DNA, 19 bp, Homo sapiens
cctgcaggctggctgttgg

SEQ ID NO: 5397105 - DNA, 20 bp, Homo sapiens
cctgcaggctggctgttggc

SEQ ID NO: 5397106 - DNA, 15 bp, Homo sapiens
cctgcagggagcagc

SEQ ID NO: 5397107 - DNA, 19 bp, Homo sapiens
cctgcagggagcagcacgc

SEQ ID NO: 5397108 - DNA, 20 bp, Homo sapiens
cctgcaggggttgagagctt

SEQ ID NO: 5397109 - DNA, 19 bp, Homo sapiens
cctgcagggtggtgctggg

SEQ ID NO: 5397110 - DNA, 21 bp, Homo sapiens
cctgcagggtggtgctgggac

SEQ ID NO: 5397111 - DNA, 17 bp, Homo sapiens
cctgcaggtcagttgta

SEQ ID NO: 5397112 - DNA, 22 bp, Homo sapiens
cctgcaggtccggggaggaggt

SEQ ID NO: 5397113 - DNA, 16 bp, Homo sapiens
cctgcaggtcctggtg

SEQ ID NO: 5397114 - DNA, 17 bp, Homo sapiens
cctgcaggtgctgctgc

SEQ ID NO: 5397115 - DNA, 16 bp, Homo sapiens
cctgcaggttgggcca

SEQ ID NO: 5397116 - DNA, 21 bp, Homo sapiens
cctgcaggttgggccatactg

SEQ ID NO: 5397117 - DNA, 19 bp, Homo sapiens
cctgcaggtttgacacgca

SEQ ID NO: 5397118 - DNA, 18 bp, Homo sapiens
cctgcagtaatctccagg

SEQ ID NO: 5397119 - DNA, 20 bp, Homo sapiens
cctgcagtactttacctcct

SEQ ID NO: 5397120 - DNA, 17 bp, Homo sapiens
cctgcagtcacccctgc

SEQ ID NO: 5397121 - DNA, 19 bp, Homo sapiens
cctgcagtcacgtgaggcc

SEQ ID NO: 5397122 - DNA, 15 bp, Homo sapiens
cctgcagtcagggcc

SEQ ID NO: 5397123 - DNA, 15 bp, Homo sapiens
cctgcagtcatcttg

SEQ ID NO: 5397124 - DNA, 19 bp, Homo sapiens
cctgcagtcccacactgtg

SEQ ID NO: 5397125 - DNA, 21 bp, Homo sapiens
cctgcagtcccacactgtgca

SEQ ID NO: 5397126 - DNA, 22 bp, Homo sapiens
cctgcagtctggctgagccctg

SEQ ID NO: 5397127 - DNA, 18 bp, Homo sapiens
cctgcagtctgtggagcg

SEQ ID NO: 5397128 - DNA, 15 bp, Homo sapiens
cctgcagtcttctgg

SEQ ID NO: 5397129 - DNA, 22 bp, Homo sapiens
cctgcagtgaggggccctccat

SEQ ID NO: 5397130 - DNA, 15 bp, Homo sapiens
cctgcagtgccagct

SEQ ID NO: 5397131 - DNA, 14 bp, Homo sapiens
cctgcagtgtgaga

SEQ ID NO: 5397132 - DNA, 14 bp, Homo sapiens
cctgcagttcctga

SEQ ID NO: 5397133 - DNA, 18 bp, Homo sapiens
cctgcagttggcctcagc

SEQ ID NO: 5397134 - DNA, 20 bp, Homo sapiens
cctgcagttggcctcagcag

SEQ ID NO: 5397135 - DNA, 18 bp, Homo sapiens
cctgcagtttggccctgg

SEQ ID NO: 5397136 - DNA, 22 bp, Homo sapiens
cctgcagtttggccctggagcc

SEQ ID NO: 5397137 - DNA, 24 bp, Homo sapiens
cctgcagtttggccctggagccag

SEQ ID NO: 5397138 - DNA, 18 bp, Homo sapiens
cctgcagtttgggagaca

SEQ ID NO: 5397139 - DNA, 23 bp, Homo sapiens
cctgcatagccggtgggtgagga

SEQ ID NO: 5397140 - DNA, 19 bp, Homo sapiens
cctgcatcagcctctggcc

SEQ ID NO: 5397141 - DNA, 19 bp, Homo sapiens
cctgcatcatgacaaagtt

SEQ ID NO: 5397142 - DNA, 23 bp, Homo sapiens
cctgcatccccttggctgtgagg

SEQ ID NO: 5397143 - DNA, 24 bp, Homo sapiens
cctgcatccccttggctgtgaggc

SEQ ID NO: 5397144 - DNA, 15 bp, Homo sapiens
cctgcatccctccac

SEQ ID NO: 5397145 - DNA, 16 bp, Homo sapiens
cctgcatcccttggcc

SEQ ID NO: 5397146 - DNA, 18 bp, Homo sapiens
cctgcatcccttggcccc

SEQ ID NO: 5397147 - DNA, 16 bp, Homo sapiens
cctgcatccggagaat

SEQ ID NO: 5397148 - DNA, 22 bp, Homo sapiens
cctgcatccgtagttccctgaa

SEQ ID NO: 5397149 - DNA, 15 bp, Homo sapiens
cctgcatcctctccc

SEQ ID NO: 5397150 - DNA, 23 bp, Homo sapiens
cctgcatcctctcccccacaaga

SEQ ID NO: 5397151 - DNA, 16 bp, Homo sapiens
cctgcatcctgaggcc

SEQ ID NO: 5397152 - DNA, 23 bp, Homo sapiens
cctgcatcctgaggccagtggcc

SEQ ID NO: 5397153 - DNA, 20 bp, Homo sapiens
cctgcatctaagcatctggg

SEQ ID NO: 5397154 - DNA, 19 bp, Homo sapiens
cctgcatctagctggagcc

SEQ ID NO: 5397155 - DNA, 14 bp, Homo sapiens
cctgcatctggggc

SEQ ID NO: 5397156 - DNA, 16 bp, Homo sapiens
cctgcatctgtctgct

SEQ ID NO: 5397157 - DNA, 17 bp, Homo sapiens
cctgcatctgtctgctc

SEQ ID NO: 5397158 - DNA, 18 bp, Homo sapiens
cctgcatctgtctgctct

SEQ ID NO: 5397159 - DNA, 15 bp, Homo sapiens
cctgcatgcagcaac

SEQ ID NO: 5397160 - DNA, 14 bp, Homo sapiens
cctgcatgcctggc

SEQ ID NO: 5397161 - DNA, 21 bp, Homo sapiens
cctgcatgcctggcccctcct

SEQ ID NO: 5397162 - DNA, 18 bp, Homo sapiens
cctgcccgcagacctctg

SEQ ID NO: 5397163 - DNA, 18 bp, Homo sapiens
cctgcccgccccaagccc

SEQ ID NO: 5397164 - DNA, 23 bp, Homo sapiens
cctgcccgccctccctcctgcct

SEQ ID NO: 5397165 - DNA, 20 bp, Homo sapiens
cctgcccgcctaagaccctg

SEQ ID NO: 5397166 - DNA, 15 bp, Homo sapiens
cctgcccgctcccaa

SEQ ID NO: 5397167 - DNA, 18 bp, Homo sapiens
cctgcccggcccaggagc

SEQ ID NO: 5397168 - DNA, 10 bp, Homo sapiens
cctgcccggg

SEQ ID NO: 5397169 - DNA, 22 bp, Homo sapiens
cctgcccgggcgcggccagccc

SEQ ID NO: 5397170 - DNA, 15 bp, Homo sapiens
cctgcccgggctccc

SEQ ID NO: 5397171 - DNA, 18 bp, Homo sapiens
cctgcccgggctcccaca

SEQ ID NO: 5397172 - DNA, 19 bp, Homo sapiens
cctgcccggggagctgcag

SEQ ID NO: 5397173 - DNA, 20 bp, Homo sapiens
cctgcccggggagctgcaga

SEQ ID NO: 5397174 - DNA, 21 bp, Homo sapiens
cctgcccggggagctgcagag

SEQ ID NO: 5397175 - DNA, 21 bp, Homo sapiens
cctgcccgtaaacacgcctgc

SEQ ID NO: 5397176 - DNA, 20 bp, Homo sapiens
cctgcccgtctctctcccat

SEQ ID NO: 5397177 - DNA, 22 bp, Homo sapiens
cctgcccgtctctctcccatgg

SEQ ID NO: 5397178 - DNA, 16 bp, Homo sapiens
cctgcccgtgccctgg

SEQ ID NO: 5397179 - DNA, 17 bp, Homo sapiens
cctgcccgtgccctggt

SEQ ID NO: 5397180 - DNA, 14 bp, Homo sapiens
cctgcccgttcttg

SEQ ID NO: 5397181 - DNA, 21 bp, Homo sapiens
cctgcccgttgccgggcctgg

SEQ ID NO: 5397182 - DNA, 18 bp, Homo sapiens
cctgccctagagcacact

SEQ ID NO: 5397183 - DNA, 19 bp, Homo sapiens
cctgccctagagcacactg

SEQ ID NO: 5397184 - DNA, 22 bp, Homo sapiens
cctgccctagcagtttgcctct

SEQ ID NO: 5397185 - DNA, 12 bp, Homo sapiens
cctgccctcact

SEQ ID NO: 5397186 - DNA, 14 bp, Homo sapiens
cctgccctcaggga

SEQ ID NO: 5397187 - DNA, 19 bp, Homo sapiens
cctgccctcatctctctcc

SEQ ID NO: 5397188 - DNA, 21 bp, Homo sapiens
cctgccctcatggcccctctg

SEQ ID NO: 5397189 - DNA, 24 bp, Homo sapiens
cctgccctccacccacacctgccc

SEQ ID NO: 5397190 - DNA, 14 bp, Homo sapiens
cctgccctccagct

SEQ ID NO: 5397191 - DNA, 14 bp, Homo sapiens
cctgccctcccatg

SEQ ID NO: 5397192 - DNA, 15 bp, Homo sapiens
cctgccctccccaga

SEQ ID NO: 5397193 - DNA, 21 bp, Homo sapiens
cctgccctccccagagcactg

SEQ ID NO: 5397194 - DNA, 14 bp, Homo sapiens
cctgccctccccca

SEQ ID NO: 5397195 - DNA, 17 bp, Homo sapiens
cctgccctcccccacgg

SEQ ID NO: 5397196 - DNA, 18 bp, Homo sapiens
cctgccctcccctgctcc

SEQ ID NO: 5397197 - DNA, 16 bp, Homo sapiens
cctgccctcccctgtc

SEQ ID NO: 5397198 - DNA, 18 bp, Homo sapiens
cctgccctcccgcacctt

SEQ ID NO: 5397199 - DNA, 19 bp, Homo sapiens
cctgccctccctcagccgt

SEQ ID NO: 5397200 - DNA, 18 bp, Homo sapiens
cctgccctccgccccgtc

SEQ ID NO: 5397201 - DNA, 16 bp, Homo sapiens
cctgccctccggagga

SEQ ID NO: 5397202 - DNA, 22 bp, Homo sapiens
cctgccctccggaggagcagcc

SEQ ID NO: 5397203 - DNA, 23 bp, Homo sapiens
cctgccctccggaggagcagcct

SEQ ID NO: 5397204 - DNA, 12 bp, Homo sapiens
cctgccctcctg

SEQ ID NO: 5397205 - DNA, 14 bp, Homo sapiens
cctgccctcgtggc

SEQ ID NO: 5397206 - DNA, 20 bp, Homo sapiens
cctgccctcgtggccagccc

SEQ ID NO: 5397207 - DNA, 22 bp, Homo sapiens
cctgccctcgtggccagcccgg

SEQ ID NO: 5397208 - DNA, 15 bp, Homo sapiens
cctgccctctctcag

SEQ ID NO: 5397209 - DNA, 12 bp, Homo sapiens
cctgccctctgc

SEQ ID NO: 5397210 - DNA, 22 bp, Homo sapiens
cctgccctctgctctgcctgga

SEQ ID NO: 5397211 - DNA, 13 bp, Homo sapiens
cctgccctgcacc

SEQ ID NO: 5397212 - DNA, 14 bp, Homo sapiens
cctgccctgcacct

SEQ ID NO: 5397213 - DNA, 12 bp, Homo sapiens
cctgccctgcca

SEQ ID NO: 5397214 - DNA, 16 bp, Homo sapiens
cctgccctgcccaagt

SEQ ID NO: 5397215 - DNA, 16 bp, Homo sapiens
cctgccctgccctgcc

SEQ ID NO: 5397216 - DNA, 15 bp, Homo sapiens
cctgccctgcctggg

SEQ ID NO: 5397217 - DNA, 21 bp, Homo sapiens
cctgccctgccttgccgctcc

SEQ ID NO: 5397218 - DNA, 12 bp, Homo sapiens
cctgccctgcta

SEQ ID NO: 5397219 - DNA, 13 bp, Homo sapiens
cctgccctgctcc

SEQ ID NO: 5397220 - DNA, 15 bp, Homo sapiens
cctgccctgctccta

SEQ ID NO: 5397221 - DNA, 22 bp, Homo sapiens
cctgccctgctctgcccaggca

SEQ ID NO: 5397222 - DNA, 19 bp, Homo sapiens
cctgccctgctgagcacag

SEQ ID NO: 5397223 - DNA, 11 bp, Homo sapiens
cctgccctggc

SEQ ID NO: 5397224 - DNA, 20 bp, Homo sapiens
cctgccctggcctaccacag

SEQ ID NO: 5397225 - DNA, 20 bp, Homo sapiens
cctgccctgggaggcagtga

SEQ ID NO: 5397226 - DNA, 16 bp, Homo sapiens
cctgccctgggcgagc

SEQ ID NO: 5397227 - DNA, 22 bp, Homo sapiens
cctgccctgggcgagcccctcc

SEQ ID NO: 5397228 - DNA, 12 bp, Homo sapiens
cctgccctggtc

SEQ ID NO: 5397229 - DNA, 14 bp, Homo sapiens
cctgccctggtttc

SEQ ID NO: 5397230 - DNA, 21 bp, Homo sapiens
cctgccctggtttcctgccct

SEQ ID NO: 5397231 - DNA, 22 bp, Homo sapiens
cctgccctggtttcctgccctg

SEQ ID NO: 5397232 - DNA, 21 bp, Homo sapiens
cctgccctgtaggaaggcaga

SEQ ID NO: 5397233 - DNA, 15 bp, Homo sapiens
cctgccctgtccctg

SEQ ID NO: 5397234 - DNA, 17 bp, Homo sapiens
cctgccctgtccctgtc

SEQ ID NO: 5397235 - DNA, 13 bp, Homo sapiens
cctgccctgtgcc

SEQ ID NO: 5397236 - DNA, 22 bp, Homo sapiens
cctgccctgtggcccacgggcc

SEQ ID NO: 5397237 - DNA, 18 bp, Homo sapiens
cctgccctgttagctttc

SEQ ID NO: 5397238 - DNA, 21 bp, Homo sapiens
cctgccctgttgtgtatagat

SEQ ID NO: 5397239 - DNA, 21 bp, Homo sapiens
cctgcccttacctgccaggaa

SEQ ID NO: 5397240 - DNA, 22 bp, Homo sapiens
cctgcccttacctgccaggaag

SEQ ID NO: 5397241 - DNA, 13 bp, Homo sapiens
cctgcccttccct

SEQ ID NO: 5397242 - DNA, 15 bp, Homo sapiens
cctgcccttccctct

SEQ ID NO: 5397243 - DNA, 18 bp, Homo sapiens
cctgcccttccctctggg

SEQ ID NO: 5397244 - DNA, 16 bp, Homo sapiens
cctgcccttcctcagg

SEQ ID NO: 5397245 - DNA, 17 bp, Homo sapiens
cctgcccttcctcaggg

SEQ ID NO: 5397246 - DNA, 23 bp, Homo sapiens
cctgcccttctgacccaaagcaa

SEQ ID NO: 5397247 - DNA, 15 bp, Homo sapiens
cctgcccttgaaccc

SEQ ID NO: 5397248 - DNA, 21 bp, Homo sapiens
cctgcccttgctccagcctga

SEQ ID NO: 5397249 - DNA, 13 bp, Homo sapiens
cctgcccttggca

SEQ ID NO: 5397250 - DNA, 21 bp, Homo sapiens
cctgcccttgtttggggcagg

SEQ ID NO: 5397251 - DNA, 16 bp, Homo sapiens
cctgccgacggagcca

SEQ ID NO: 5397252 - DNA, 17 bp, Homo sapiens
cctgccgacggagccac

SEQ ID NO: 5397253 - DNA, 14 bp, Homo sapiens
cctgccgactcctg

SEQ ID NO: 5397254 - DNA, 16 bp, Homo sapiens
cctgccgactcctggg

SEQ ID NO: 5397255 - DNA, 14 bp, Homo sapiens
cctgccgagagtcc

SEQ ID NO: 5397256 - DNA, 23 bp, Homo sapiens
cctgccgagagtccatcagcctc

SEQ ID NO: 5397257 - DNA, 14 bp, Homo sapiens
cctgccgcagacgg

SEQ ID NO: 5397258 - DNA, 19 bp, Homo sapiens
cctgccgcagacgggcaca

SEQ ID NO: 5397259 - DNA, 20 bp, Homo sapiens
cctgccgcagacgggcacag

SEQ ID NO: 5397260 - DNA, 22 bp, Homo sapiens
cctgccgcagacgggcacagac

SEQ ID NO: 5397261 - DNA, 14 bp, Homo sapiens
cctgccgcagagct

SEQ ID NO: 5397262 - DNA, 15 bp, Homo sapiens
cctgccgcagagctg

SEQ ID NO: 5397263 - DNA, 14 bp, Homo sapiens
cctgccgcccaaag

SEQ ID NO: 5397264 - DNA, 20 bp, Homo sapiens
cctgccgcccccgcctgggc

SEQ ID NO: 5397265 - DNA, 14 bp, Homo sapiens
cctgccgccctgtg

SEQ ID NO: 5397266 - DNA, 17 bp, Homo sapiens
cctgccgcctcccggga

SEQ ID NO: 5397267 - DNA, 14 bp, Homo sapiens
cctgccgcctgtgc

SEQ ID NO: 5397268 - DNA, 22 bp, Homo sapiens
cctgccgcctgtgcccttgctg

SEQ ID NO: 5397269 - DNA, 18 bp, Homo sapiens
cctgccgctgcaggaaac

SEQ ID NO: 5397270 - DNA, 19 bp, Homo sapiens
cctgccgctgcaggaaaca

SEQ ID NO: 5397271 - DNA, 14 bp, Homo sapiens
cctgccggccttgg

SEQ ID NO: 5397272 - DNA, 13 bp, Homo sapiens
cctgccggctctg

SEQ ID NO: 5397273 - DNA, 14 bp, Homo sapiens
cctgccggctctgg

SEQ ID NO: 5397274 - DNA, 15 bp, Homo sapiens
cctgccggctctggg

SEQ ID NO: 5397275 - DNA, 20 bp, Homo sapiens
cctgccggctctgggctggc

SEQ ID NO: 5397276 - DNA, 19 bp, Homo sapiens
cctgccgggctgagggcct

SEQ ID NO: 5397277 - DNA, 20 bp, Homo sapiens
cctgccgggctgagggcctg

SEQ ID NO: 5397278 - DNA, 23 bp, Homo sapiens
cctgccgggctgagggcctgctg

SEQ ID NO: 5397279 - DNA, 15 bp, Homo sapiens
cctgccggtaaacac

SEQ ID NO: 5397280 - DNA, 20 bp, Homo sapiens
cctgccggtaaacacgcctg

SEQ ID NO: 5397281 - DNA, 23 bp, Homo sapiens
cctgccggtaaacacgcctgcaa

SEQ ID NO: 5397282 - DNA, 19 bp, Homo sapiens
cctgccggtgcacaggcct

SEQ ID NO: 5397283 - DNA, 21 bp, Homo sapiens
cctgccggttccgcccgccct

SEQ ID NO: 5397284 - DNA, 18 bp, Homo sapiens
cctgccgtcaccaccacc

SEQ ID NO: 5397285 - DNA, 15 bp, Homo sapiens
cctgccgtccctcct

SEQ ID NO: 5397286 - DNA, 14 bp, Homo sapiens
cctgccgtgcatgg

SEQ ID NO: 5397287 - DNA, 23 bp, Homo sapiens
cctgccgtggacttggggtcaga

SEQ ID NO: 5397288 - DNA, 17 bp, Homo sapiens
cctgcctaaccaggccc

SEQ ID NO: 5397289 - DNA, 19 bp, Homo sapiens
cctgcctaaccaggcccag

SEQ ID NO: 5397290 - DNA, 20 bp, Homo sapiens
cctgcctaagggagagtggt

SEQ ID NO: 5397291 - DNA, 18 bp, Homo sapiens
cctgcctaaggttgtcta

SEQ ID NO: 5397292 - DNA, 15 bp, Homo sapiens
cctgcctacatccca

SEQ ID NO: 5397293 - DNA, 23 bp, Homo sapiens
cctgcctactgcccctgccctga

SEQ ID NO: 5397294 - DNA, 20 bp, Homo sapiens
cctgcctagcactcacatgc

SEQ ID NO: 5397295 - DNA, 21 bp, Homo sapiens
cctgcctagcactcacatgct

SEQ ID NO: 5397296 - DNA, 19 bp, Homo sapiens
cctgcctagctcttgggcc

SEQ ID NO: 5397297 - DNA, 17 bp, Homo sapiens
cctgcctaggagctggg

SEQ ID NO: 5397298 - DNA, 20 bp, Homo sapiens
cctgcctaggagctggggag

SEQ ID NO: 5397299 - DNA, 18 bp, Homo sapiens
cctgcctatgtctcctct

SEQ ID NO: 5397300 - DNA, 19 bp, Homo sapiens
cctgcctatgtctcctcta

SEQ ID NO: 5397301 - DNA, 13 bp, Homo sapiens
cctgcctcacatc

SEQ ID NO: 5397302 - DNA, 15 bp, Homo sapiens
cctgcctcactcctc

SEQ ID NO: 5397303 - DNA, 15 bp, Homo sapiens
cctgcctcagccagg

SEQ ID NO: 5397304 - DNA, 15 bp, Homo sapiens
cctgcctcagcctcc

SEQ ID NO: 5397305 - DNA, 16 bp, Homo sapiens
cctgcctcagcctccc

SEQ ID NO: 5397306 - DNA, 20 bp, Homo sapiens
cctgcctcagcctcctgaac

SEQ ID NO: 5397307 - DNA, 14 bp, Homo sapiens
cctgcctcagctgc

SEQ ID NO: 5397308 - DNA, 12 bp, Homo sapiens
cctgcctcagga

SEQ ID NO: 5397309 - DNA, 13 bp, Homo sapiens
cctgcctcagtgg

SEQ ID NO: 5397310 - DNA, 14 bp, Homo sapiens
cctgcctcagtggc

SEQ ID NO: 5397311 - DNA, 16 bp, Homo sapiens
cctgcctcatccacca

SEQ ID NO: 5397312 - DNA, 14 bp, Homo sapiens
cctgcctcatgctc

SEQ ID NO: 5397313 - DNA, 15 bp, Homo sapiens
cctgcctccaccagc

SEQ ID NO: 5397314 - DNA, 17 bp, Homo sapiens
cctgcctccaccagcaa

SEQ ID NO: 5397315 - DNA, 18 bp, Homo sapiens
cctgcctccaccagcaag

SEQ ID NO: 5397316 - DNA, 14 bp, Homo sapiens
cctgcctccacccg

SEQ ID NO: 5397317 - DNA, 18 bp, Homo sapiens
cctgcctccacccgtcct

SEQ ID NO: 5397318 - DNA, 16 bp, Homo sapiens
cctgcctccaccctct

SEQ ID NO: 5397319 - DNA, 17 bp, Homo sapiens
cctgcctccagctgtca

SEQ ID NO: 5397320 - DNA, 20 bp, Homo sapiens
cctgcctccaggaaccacac

SEQ ID NO: 5397321 - DNA, 17 bp, Homo sapiens
cctgcctccagggctgg

SEQ ID NO: 5397322 - DNA, 23 bp, Homo sapiens
cctgcctccagggctggactgag

SEQ ID NO: 5397323 - DNA, 19 bp, Homo sapiens
cctgcctcccaagcagctg

SEQ ID NO: 5397324 - DNA, 17 bp, Homo sapiens
cctgcctcccctgtgca

SEQ ID NO: 5397325 - DNA, 21 bp, Homo sapiens
cctgcctccctttctgggagg

SEQ ID NO: 5397326 - DNA, 15 bp, Homo sapiens
cctgcctccgctggc

SEQ ID NO: 5397327 - DNA, 12 bp, Homo sapiens
cctgcctccggc

SEQ ID NO: 5397328 - DNA, 16 bp, Homo sapiens
cctgcctccggccctg

SEQ ID NO: 5397329 - DNA, 21 bp, Homo sapiens
cctgcctccggccctgcccca

SEQ ID NO: 5397330 - DNA, 13 bp, Homo sapiens
cctgcctccgggc

SEQ ID NO: 5397331 - DNA, 14 bp, Homo sapiens
cctgcctcctaggc

SEQ ID NO: 5397332 - DNA, 16 bp, Homo sapiens
cctgcctcctcagctt

SEQ ID NO: 5397333 - DNA, 16 bp, Homo sapiens
cctgcctcctccctcc

SEQ ID NO: 5397334 - DNA, 15 bp, Homo sapiens
cctgcctcctgccac

SEQ ID NO: 5397335 - DNA, 19 bp, Homo sapiens
cctgcctcctgccacccct

SEQ ID NO: 5397336 - DNA, 23 bp, Homo sapiens
cctgcctcctgccggctccttgg

SEQ ID NO: 5397337 - DNA, 15 bp, Homo sapiens
cctgcctcctgccta

SEQ ID NO: 5397338 - DNA, 16 bp, Homo sapiens
cctgcctcctgcctat

SEQ ID NO: 5397339 - DNA, 21 bp, Homo sapiens
cctgcctcctgcctcccgcct

SEQ ID NO: 5397340 - DNA, 13 bp, Homo sapiens
cctgctctgcacg

SEQ ID NO: 5397341 - DNA, 15 bp, Homo sapiens
cctgctctgcacggt

SEQ ID NO: 5397342 - DNA, 12 bp, Homo sapiens
cctgctctgcag

SEQ ID NO: 5397343 - DNA, 13 bp, Homo sapiens
cctgctctgcagc

SEQ ID NO: 5397344 - DNA, 15 bp, Homo sapiens
cctgctctgcagccc

SEQ ID NO: 5397345 - DNA, 20 bp, Homo sapiens
cctgctctgcagcccacaga

SEQ ID NO: 5397346 - DNA, 12 bp, Homo sapiens
cctgctctgccc

SEQ ID NO: 5397347 - DNA, 13 bp, Homo sapiens
cctgctctgccca

SEQ ID NO: 5397348 - DNA, 21 bp, Homo sapiens
cctgctctgcccaggcaagga

SEQ ID NO: 5397349 - DNA, 22 bp, Homo sapiens
cctgctctgcccaggcaaggaa

SEQ ID NO: 5397350 - DNA, 12 bp, Homo sapiens
cctgctctgctg

SEQ ID NO: 5397351 - DNA, 15 bp, Homo sapiens
cctgctctgcttcct

SEQ ID NO: 5397352 - DNA, 21 bp, Homo sapiens
cctgctctgcttcctcagggc

SEQ ID NO: 5397353 - DNA, 18 bp, Homo sapiens
cctgctctgggacgtgga

SEQ ID NO: 5397354 - DNA, 20 bp, Homo sapiens
cctgctctgggacgtggaca

SEQ ID NO: 5397355 - DNA, 18 bp, Homo sapiens
cctgctctgtagccacct

SEQ ID NO: 5397356 - DNA, 19 bp, Homo sapiens
cctgctctgtagccacctc

SEQ ID NO: 5397357 - DNA, 21 bp, Homo sapiens
cctgctctgtagccacctcct

SEQ ID NO: 5397358 - DNA, 23 bp, Homo sapiens
cctgctcttctctccccagcccc

SEQ ID NO: 5397359 - DNA, 13 bp, Homo sapiens
cctgctctttctc

SEQ ID NO: 5397360 - DNA, 15 bp, Homo sapiens
cctgctctttctctg

SEQ ID NO: 5397361 - DNA, 19 bp, Homo sapiens
cctgctctttctctgagaa

SEQ ID NO: 5397362 - DNA, 19 bp, Homo sapiens
cctgctgaaacacctccca

SEQ ID NO: 5397363 - DNA, 20 bp, Homo sapiens
cctgctgaaacacctcccag

SEQ ID NO: 5397364 - DNA, 19 bp, Homo sapiens
cctgctgaaactgcccact

SEQ ID NO: 5397365 - DNA, 21 bp, Homo sapiens
cctgctgaacacagtgtctgt

SEQ ID NO: 5397366 - DNA, 18 bp, Homo sapiens
cctgctgaagctgctgca

SEQ ID NO: 5397367 - DNA, 21 bp, Homo sapiens
cctgctgaaggtggggattgc

SEQ ID NO: 5397368 - DNA, 12 bp, Homo sapiens
cctgctgaatgc

SEQ ID NO: 5397369 - DNA, 21 bp, Homo sapiens
cctgctgaatgcctcgctccc

SEQ ID NO: 5397370 - DNA, 14 bp, Homo sapiens
cctgctgacagaca

SEQ ID NO: 5397371 - DNA, 15 bp, Homo sapiens
cctgctgacctgtgc

SEQ ID NO: 5397372 - DNA, 16 bp, Homo sapiens
cctgctgacctgtgca

SEQ ID NO: 5397373 - DNA, 22 bp, Homo sapiens
cctgctgaccttggaggaatga

SEQ ID NO: 5397374 - DNA, 18 bp, Homo sapiens
cctgctgagagcccccac

SEQ ID NO: 5397375 - DNA, 16 bp, Homo sapiens
cctgctgagcacagac

SEQ ID NO: 5397376 - DNA, 20 bp, Homo sapiens
cctgctgagcctcacagcag

SEQ ID NO: 5397377 - DNA, 11 bp, Homo sapiens
cctgctgagct

SEQ ID NO: 5397378 - DNA, 15 bp, Homo sapiens
cctgctgagctctga

SEQ ID NO: 5397379 - DNA, 18 bp, Homo sapiens
cctgctgagctctgagag

SEQ ID NO: 5397380 - DNA, 21 bp, Homo sapiens
cctgctgagctctgagaggcc

SEQ ID NO: 5397381 - DNA, 14 bp, Homo sapiens
cctgctgagctgcc

SEQ ID NO: 5397382 - DNA, 19 bp, Homo sapiens
cctgctgagctgcccctgc

SEQ ID NO: 5397383 - DNA, 13 bp, Homo sapiens
cctgctgaggagg

SEQ ID NO: 5397384 - DNA, 15 bp, Homo sapiens
cctgctgagtcccag

SEQ ID NO: 5397385 - DNA, 20 bp, Homo sapiens
cctgctgagtcccaggctga

SEQ ID NO: 5397386 - DNA, 21 bp, Homo sapiens
cctgctgagtggtccacattc

SEQ ID NO: 5397387 - DNA, 16 bp, Homo sapiens
cctgctgatcaatctg

SEQ ID NO: 5397388 - DNA, 22 bp, Homo sapiens
cctgctgcaaaggacagtgggc

SEQ ID NO: 5397389 - DNA, 20 bp, Homo sapiens
cctgctgcaccaacccagcc

SEQ ID NO: 5397390 - DNA, 23 bp, Homo sapiens
cctgctgcaccctgcgcctccag

SEQ ID NO: 5397391 - DNA, 20 bp, Homo sapiens
cctgctgcactaggacttgg

SEQ ID NO: 5397392 - DNA, 14 bp, Homo sapiens
cctgctgcagaggg

SEQ ID NO: 5397393 - DNA, 12 bp, Homo sapiens
cctgctgcagtt

SEQ ID NO: 5397394 - DNA, 17 bp, Homo sapiens
cctgctgcagttgccag

SEQ ID NO: 5397395 - DNA, 21 bp, Homo sapiens
cctgctgcagttgccagtcac

SEQ ID NO: 5397396 - DNA, 13 bp, Homo sapiens
cctgctgcatgcc

SEQ ID NO: 5397397 - DNA, 21 bp, Homo sapiens
cctgctgcatgccctctcagg

SEQ ID NO: 5397398 - DNA, 16 bp, Homo sapiens
cctgctgccacagcaa

SEQ ID NO: 5397399 - DNA, 19 bp, Homo sapiens
cctgctgccacagcaagga

SEQ ID NO: 5397400 - DNA, 12 bp, Homo sapiens
cctgctgccagc

SEQ ID NO: 5397401 - DNA, 21 bp, Homo sapiens
cctgctgccagtaccagcccc

SEQ ID NO: 5397402 - DNA, 17 bp, Homo sapiens
cctgctgccagtgcagc

SEQ ID NO: 5397403 - DNA, 22 bp, Homo sapiens
cctgctgcccaatctccatctg

SEQ ID NO: 5397404 - DNA, 17 bp, Homo sapiens
cctgctgcccaggctgt

SEQ ID NO: 5397405 - DNA, 22 bp, Homo sapiens
cctgctgcccaggctgtgcagc

SEQ ID NO: 5397406 - DNA, 17 bp, Homo sapiens
cctgctgccccagctga

SEQ ID NO: 5397407 - DNA, 22 bp, Homo sapiens
cctgctgccccagctgactgtg

SEQ ID NO: 5397408 - DNA, 14 bp, Homo sapiens
cctgctgcccctcc

SEQ ID NO: 5397409 - DNA, 23 bp, Homo sapiens
cctgctgcccctccctgcctcca

SEQ ID NO: 5397410 - DNA, 11 bp, Homo sapiens
cctgctgccct

SEQ ID NO: 5397411 - DNA, 12 bp, Homo sapiens
cctgctgccctc

SEQ ID NO: 5397412 - DNA, 13 bp, Homo sapiens
cctgctgccctcc

SEQ ID NO: 5397413 - DNA, 23 bp, Homo sapiens
cctgctgccctcccacagcctcc

SEQ ID NO: 5397414 - DNA, 15 bp, Homo sapiens
cctgctgccgccact

SEQ ID NO: 5397415 - DNA, 22 bp, Homo sapiens
cctgctgccgcctcccagcctg

SEQ ID NO: 5397416 - DNA, 15 bp, Homo sapiens
cctgctgcctaataa

SEQ ID NO: 5397417 - DNA, 15 bp, Homo sapiens
cctgctgcctcccca

SEQ ID NO: 5397418 - DNA, 23 bp, Homo sapiens
cctgctgcctccccaaccctgcc

SEQ ID NO: 5397419 - DNA, 22 bp, Homo sapiens
cctgctgcctccctttcataca

SEQ ID NO: 5397420 - DNA, 14 bp, Homo sapiens
cctgctgcctgcag

SEQ ID NO: 5397421 - DNA, 13 bp, Homo sapiens
cctgctgcctgcc

SEQ ID NO: 5397422 - DNA, 16 bp, Homo sapiens
cctgctgcctgctgag

SEQ ID NO: 5397423 - DNA, 18 bp, Homo sapiens
cctgctgcctggagtcag

SEQ ID NO: 5397424 - DNA, 23 bp, Homo sapiens
cctgctgcctggagtcagtagcc

SEQ ID NO: 5397425 - DNA, 14 bp, Homo sapiens
cctgctgccttttc

SEQ ID NO: 5397426 - DNA, 18 bp, Homo sapiens
cctgctgccttttctgga

SEQ ID NO: 5397427 - DNA, 12 bp, Homo sapiens
cctgctgcgctg

SEQ ID NO: 5397428 - DNA, 22 bp, Homo sapiens
cctgctgcgggggagccagttc

SEQ ID NO: 5397429 - DNA, 17 bp, Homo sapiens
cctgctgcgtcagacca

SEQ ID NO: 5397430 - DNA, 15 bp, Homo sapiens
cctgctgcgtcccca

SEQ ID NO: 5397431 - DNA, 17 bp, Homo sapiens
cctgctgcgtccccact

SEQ ID NO: 5397432 - DNA, 19 bp, Homo sapiens
cctgctgcgtccccactcc

SEQ ID NO: 5397433 - DNA, 22 bp, Homo sapiens
cctgctgcgtccccactccctt

SEQ ID NO: 5397434 - DNA, 12 bp, Homo sapiens
cctgctgctcac

SEQ ID NO: 5397435 - DNA, 12 bp, Homo sapiens
cctgctgctcag

SEQ ID NO: 5397436 - DNA, 12 bp, Homo sapiens
cctgctgctccc

SEQ ID NO: 5397437 - DNA, 13 bp, Homo sapiens
cctgctgctccct

SEQ ID NO: 5397438 - DNA, 17 bp, Homo sapiens
cctgctgctcctaggac

SEQ ID NO: 5397439 - DNA, 19 bp, Homo sapiens
cctgctgctcctcggccag

SEQ ID NO: 5397440 - DNA, 21 bp, Homo sapiens
cctgctgctcctcggccagag

SEQ ID NO: 5397441 - DNA, 18 bp, Homo sapiens
cctgctgctcgggaaggc

SEQ ID NO: 5397442 - DNA, 10 bp, Homo sapiens
cctgctgctg

SEQ ID NO: 5397443 - DNA, 15 bp, Homo sapiens
cctgctgctgacctg

SEQ ID NO: 5397444 - DNA, 22 bp, Homo sapiens
cctgctgctgagaacctggcct

SEQ ID NO: 5397445 - DNA, 14 bp, Homo sapiens
cctgctgctgccaa

SEQ ID NO: 5397446 - DNA, 18 bp, Homo sapiens
cctgctgctgcctgcctg

SEQ ID NO: 5397447 - DNA, 15 bp, Homo sapiens
cctgctgctgctact

SEQ ID NO: 5397448 - DNA, 14 bp, Homo sapiens
cctgctgctggggc

SEQ ID NO: 5397449 - DNA, 19 bp, Homo sapiens
cctgctgctggtgcacagc

SEQ ID NO: 5397450 - DNA, 23 bp, Homo sapiens
cctgctgctgtaactgctgagcc

SEQ ID NO: 5397451 - DNA, 19 bp, Homo sapiens
cctgctgctgtcacctctc

SEQ ID NO: 5397452 - DNA, 23 bp, Homo sapiens
cctgctgctgtcacctctcccac

SEQ ID NO: 5397453 - DNA, 20 bp, Homo sapiens
cctgctgctgtctgggtgct

SEQ ID NO: 5397454 - DNA, 17 bp, Homo sapiens
cctgctgcttcctaact

SEQ ID NO: 5397455 - DNA, 20 bp, Homo sapiens
cctgctgcttggagtgcccc

SEQ ID NO: 5397456 - DNA, 21 bp, Homo sapiens
cctgctgcttggagtgcccca

SEQ ID NO: 5397457 - DNA, 22 bp, Homo sapiens
cctgctggaaaccacacttctt

SEQ ID NO: 5397458 - DNA, 12 bp, Homo sapiens
cctgctggaagc

SEQ ID NO: 5397459 - DNA, 17 bp, Homo sapiens
cctgctggacagagact

SEQ ID NO: 5397460 - DNA, 23 bp, Homo sapiens
cctgctggacagcctccgccaag

SEQ ID NO: 5397461 - DNA, 12 bp, Homo sapiens
cctgctggaggc

SEQ ID NO: 5397462 - DNA, 15 bp, Homo sapiens
cctgctggaggcctc

SEQ ID NO: 5397463 - DNA, 22 bp, Homo sapiens
cctgctggaggcctcaggtgct

SEQ ID NO: 5397464 - DNA, 15 bp, Homo sapiens
cctgctggatctccc

SEQ ID NO: 5397465 - DNA, 16 bp, Homo sapiens
cctgctggatctccca

SEQ ID NO: 5397466 - DNA, 17 bp, Homo sapiens
cctgctggatctcccag

SEQ ID NO: 5397467 - DNA, 17 bp, Homo sapiens
cctgctggatgggactc

SEQ ID NO: 5397468 - DNA, 13 bp, Homo sapiens
cctgctggcacct

SEQ ID NO: 5397469 - DNA, 17 bp, Homo sapiens
cctgctggcacctcaga

SEQ ID NO: 5397470 - DNA, 21 bp, Homo sapiens
cctgctggcacctcagacaat

SEQ ID NO: 5397471 - DNA, 15 bp, Homo sapiens
cctgctggcagggcc

SEQ ID NO: 5397472 - DNA, 16 bp, Homo sapiens
cctgctggcagggcca

SEQ ID NO: 5397473 - DNA, 21 bp, Homo sapiens
cctgctggcagggccagggca

SEQ ID NO: 5397474 - DNA, 16 bp, Homo sapiens
cctgctggcccctcac

SEQ ID NO: 5397475 - DNA, 16 bp, Homo sapiens
cctgctggccgcctca

SEQ ID NO: 5397476 - DNA, 19 bp, Homo sapiens
cctgctggccgcctcaccc

SEQ ID NO: 5397477 - DNA, 14 bp, Homo sapiens
cctgctggcctgct

SEQ ID NO: 5397478 - DNA, 16 bp, Homo sapiens
cctgctggcctgctct

SEQ ID NO: 5397479 - DNA, 19 bp, Homo sapiens
cctgctggcctgctcttac

SEQ ID NO: 5397480 - DNA, 13 bp, Homo sapiens
cctgctggctctt

SEQ ID NO: 5397481 - DNA, 14 bp, Homo sapiens
cctgctggctgagg

SEQ ID NO: 5397482 - DNA, 19 bp, Homo sapiens
cctgctggctgaggcttgg

SEQ ID NO: 5397483 - DNA, 12 bp, Homo sapiens
cctgctggctgc

SEQ ID NO: 5397484 - DNA, 16 bp, Homo sapiens
cctgctggctggtgcc

SEQ ID NO: 5397485 - DNA, 19 bp, Homo sapiens
cctgctggctggtgcctga

SEQ ID NO: 5397486 - DNA, 23 bp, Homo sapiens
cctgctggctggtgcctgagccc

SEQ ID NO: 5397487 - DNA, 13 bp, Homo sapiens
cctgctggcttcc

SEQ ID NO: 5397488 - DNA, 15 bp, Homo sapiens
cctgctggcttccag

SEQ ID NO: 5397489 - DNA, 21 bp, Homo sapiens
cctgctggcttccagcttcag

SEQ ID NO: 5397490 - DNA, 15 bp, Homo sapiens
cctgctgggaatggc

SEQ ID NO: 5397491 - DNA, 15 bp, Homo sapiens
cctgctgggcactgg

SEQ ID NO: 5397492 - DNA, 22 bp, Homo sapiens
cctgctgggcactgggcactag

SEQ ID NO: 5397493 - DNA, 21 bp, Homo sapiens
cctgctgggcgtgtgtgacac

SEQ ID NO: 5397494 - DNA, 19 bp, Homo sapiens
cctgctgggctccccccag

SEQ ID NO: 5397495 - DNA, 20 bp, Homo sapiens
cctgctgggctccccccagt

SEQ ID NO: 5397496 - DNA, 17 bp, Homo sapiens
cctgctgggctctccac

SEQ ID NO: 5397497 - DNA, 18 bp, Homo sapiens
cctgctgggctctccacc

SEQ ID NO: 5397498 - DNA, 20 bp, Homo sapiens
cctgctgggctctccacctc

SEQ ID NO: 5397499 - DNA, 22 bp, Homo sapiens
cctgctgggctctccacctcag

SEQ ID NO: 5397500 - DNA, 24 bp, Homo sapiens
cctgctgggctctccacctcagcc

SEQ ID NO: 5397501 - DNA, 23 bp, Homo sapiens
cctgctgggctcttaactgttgc

SEQ ID NO: 5397502 - DNA, 17 bp, Homo sapiens
cctgctggggctgaaca

SEQ ID NO: 5397503 - DNA, 19 bp, Homo sapiens
cctgctggggggcagggcc

SEQ ID NO: 5397504 - DNA, 19 bp, Homo sapiens
cctgctgggtgccaggtgc

SEQ ID NO: 5397505 - DNA, 22 bp, Homo sapiens
cctgctgggtgggaatgcgctc

SEQ ID NO: 5397506 - DNA, 21 bp, Homo sapiens
cctgctgggtgtggcgcagca

SEQ ID NO: 5397507 - DNA, 17 bp, Homo sapiens
cctgctggtacctgccc

SEQ ID NO: 5397508 - DNA, 12 bp, Homo sapiens
cctgctggtcaa

SEQ ID NO: 5397509 - DNA, 20 bp, Homo sapiens
cctgctggtcacagcctcct

SEQ ID NO: 5397510 - DNA, 18 bp, Homo sapiens
cctgctggtgcccaccct

SEQ ID NO: 5397511 - DNA, 13 bp, Homo sapiens
cctgctggttcag

SEQ ID NO: 5397512 - DNA, 22 bp, Homo sapiens
cctgctgtagtcctttctgcct

SEQ ID NO: 5397513 - DNA, 14 bp, Homo sapiens
cctgctgtatttcc

SEQ ID NO: 5397514 - DNA, 20 bp, Homo sapiens
cctgctgtcaagtcccccag

SEQ ID NO: 5397515 - DNA, 16 bp, Homo sapiens
cctgctgtcagcctgg

SEQ ID NO: 5397516 - DNA, 22 bp, Homo sapiens
cctgctgtcattgcttcttctg

SEQ ID NO: 5397517 - DNA, 22 bp, Homo sapiens
cctggagcgtttctagcaagtg

SEQ ID NO: 5397518 - DNA, 21 bp, Homo sapiens
cctggagcgtttgctgtgcca

SEQ ID NO: 5397519 - DNA, 22 bp, Homo sapiens
cctggagcgtttgctgtgccag

SEQ ID NO: 5397520 - DNA, 20 bp, Homo sapiens
cctggagctagtgtctcctc

SEQ ID NO: 5397521 - DNA, 18 bp, Homo sapiens
cctggagctcctgctggg

SEQ ID NO: 5397522 - DNA, 16 bp, Homo sapiens
cctggaggaaccgaaa

SEQ ID NO: 5397523 - DNA, 19 bp, Homo sapiens
cctggaggaattcagctca

SEQ ID NO: 5397524 - DNA, 22 bp, Homo sapiens
cctggaggaattcagctcagct

SEQ ID NO: 5397525 - DNA, 13 bp, Homo sapiens
cctggaggacctg

SEQ ID NO: 5397526 - DNA, 20 bp, Homo sapiens
cctggaggacctgagcctgc

SEQ ID NO: 5397527 - DNA, 18 bp, Homo sapiens
cctggaggacggccggct

SEQ ID NO: 5397528 - DNA, 13 bp, Homo sapiens
cctggaggagaag

SEQ ID NO: 5397529 - DNA, 20 bp, Homo sapiens
cctggaggatccctccatcc

SEQ ID NO: 5397530 - DNA, 12 bp, Homo sapiens
cctggaggatga

SEQ ID NO: 5397531 - DNA, 18 bp, Homo sapiens
cctggaggattgcaggtg

SEQ ID NO: 5397532 - DNA, 16 bp, Homo sapiens
cctggaggcaaaggcc

SEQ ID NO: 5397533 - DNA, 22 bp, Homo sapiens
cctggaggcaagagggagggga

SEQ ID NO: 5397534 - DNA, 14 bp, Homo sapiens
cctggaggcacgca

SEQ ID NO: 5397535 - DNA, 18 bp, Homo sapiens
cctggaggcacgcaccac

SEQ ID NO: 5397536 - DNA, 23 bp, Homo sapiens
cctggaggcacgcaccactgctt

SEQ ID NO: 5397537 - DNA, 13 bp, Homo sapiens
cctggaggcaggg

SEQ ID NO: 5397538 - DNA, 12 bp, Homo sapiens
cctggaggccca

SEQ ID NO: 5397539 - DNA, 20 bp, Homo sapiens
cctggaggctcaaattttga

SEQ ID NO: 5397540 - DNA, 13 bp, Homo sapiens
cctggaggctcct

SEQ ID NO: 5397541 - DNA, 18 bp, Homo sapiens
cctggaggctcctctagg

SEQ ID NO: 5397542 - DNA, 12 bp, Homo sapiens
cctggaggctct

SEQ ID NO: 5397543 - DNA, 13 bp, Homo sapiens
cctggaggctctc

SEQ ID NO: 5397544 - DNA, 14 bp, Homo sapiens
cctggaggctgcct

SEQ ID NO: 5397545 - DNA, 16 bp, Homo sapiens
cctggaggctgcctcc

SEQ ID NO: 5397546 - DNA, 17 bp, Homo sapiens
cctggaggctgcctccc

SEQ ID NO: 5397547 - DNA, 18 bp, Homo sapiens
cctggaggctgcctccca

SEQ ID NO: 5397548 - DNA, 15 bp, Homo sapiens
cctggaggctggacc

SEQ ID NO: 5397549 - DNA, 20 bp, Homo sapiens
cctggaggctggaccaactg

SEQ ID NO: 5397550 - DNA, 22 bp, Homo sapiens
cctggaggctggaccaactgct

SEQ ID NO: 5397551 - DNA, 16 bp, Homo sapiens
cctggaggctggggat

SEQ ID NO: 5397552 - DNA, 17 bp, Homo sapiens
cctggaggctggggatg

SEQ ID NO: 5397553 - DNA, 14 bp, Homo sapiens
cctggagggaagag

SEQ ID NO: 5397554 - DNA, 22 bp, Homo sapiens
cctggagggaaggacagtccct

SEQ ID NO: 5397555 - DNA, 18 bp, Homo sapiens
cctggagggaagttgggg

SEQ ID NO: 5397556 - DNA, 21 bp, Homo sapiens
cctggagggaatgaacctgga

SEQ ID NO: 5397557 - DNA, 23 bp, Homo sapiens
cctggagggcaagccctgcccac

SEQ ID NO: 5397558 - DNA, 12 bp, Homo sapiens
cctggagggcac

SEQ ID NO: 5397559 - DNA, 13 bp, Homo sapiens
cctggagggcact

SEQ ID NO: 5397560 - DNA, 17 bp, Homo sapiens
cctggagggcacttcct

SEQ ID NO: 5397561 - DNA, 13 bp, Homo sapiens
cctggagggcaga

SEQ ID NO: 5397562 - DNA, 14 bp, Homo sapiens
cctggagggcagag

SEQ ID NO: 5397563 - DNA, 16 bp, Homo sapiens
cctggagggcagagac

SEQ ID NO: 5397564 - DNA, 17 bp, Homo sapiens
cctggagggcagagaca

SEQ ID NO: 5397565 - DNA, 17 bp, Homo sapiens
cctggagggcgcccagc

SEQ ID NO: 5397566 - DNA, 19 bp, Homo sapiens
cctggagggcgcccagcag

SEQ ID NO: 5397567 - DNA, 19 bp, Homo sapiens
cctggagggctagaaccta

SEQ ID NO: 5397568 - DNA, 23 bp, Homo sapiens
cctggagggctagaacctggaga

SEQ ID NO: 5397569 - DNA, 19 bp, Homo sapiens
cctggaggggagaggtcag

SEQ ID NO: 5397570 - DNA, 21 bp, Homo sapiens
cctggaggggagaggtcagcc

SEQ ID NO: 5397571 - DNA, 22 bp, Homo sapiens
cctggagggggaatggcagcag

SEQ ID NO: 5397572 - DNA, 13 bp, Homo sapiens
cctggaggtgcca

SEQ ID NO: 5397573 - DNA, 22 bp, Homo sapiens
cctggaggtgccagcaaagccc

SEQ ID NO: 5397574 - DNA, 21 bp, Homo sapiens
cctggaggtggctgagcccct

SEQ ID NO: 5397575 - DNA, 22 bp, Homo sapiens
cctggaggtggctgagcccctg

SEQ ID NO: 5397576 - DNA, 15 bp, Homo sapiens
cctggaggtgggaga

SEQ ID NO: 5397577 - DNA, 14 bp, Homo sapiens
cctggaggtgggca

SEQ ID NO: 5397578 - DNA, 17 bp, Homo sapiens
cctggaggttccccagc

SEQ ID NO: 5397579 - DNA, 18 bp, Homo sapiens
cctggagtaggcctgggg

SEQ ID NO: 5397580 - DNA, 21 bp, Homo sapiens
cctggagtcactgcagaggga

SEQ ID NO: 5397581 - DNA, 18 bp, Homo sapiens
cctggagtcagtagccag

SEQ ID NO: 5397582 - DNA, 19 bp, Homo sapiens
cctggagtcagtagccaga

SEQ ID NO: 5397583 - DNA, 18 bp, Homo sapiens
cctggagtcccctgggcc

SEQ ID NO: 5397584 - DNA, 15 bp, Homo sapiens
cctggagtctcactg

SEQ ID NO: 5397585 - DNA, 21 bp, Homo sapiens
cctggagtctcactgtctgct

SEQ ID NO: 5397586 - DNA, 22 bp, Homo sapiens
cctggagtctgaagcctgcagg

SEQ ID NO: 5397587 - DNA, 12 bp, Homo sapiens
cctggagtgccc

SEQ ID NO: 5397588 - DNA, 16 bp, Homo sapiens
cctggagtgccctgca

SEQ ID NO: 5397589 - DNA, 17 bp, Homo sapiens
cctggagtgccctgcag

SEQ ID NO: 5397590 - DNA, 16 bp, Homo sapiens
cctggagtgctgtgct

SEQ ID NO: 5397591 - DNA, 17 bp, Homo sapiens
cctggagtgctgtgctg

SEQ ID NO: 5397592 - DNA, 18 bp, Homo sapiens
cctggagtgctgtgctgt

SEQ ID NO: 5397593 - DNA, 19 bp, Homo sapiens
cctggagtggcatggtcct

SEQ ID NO: 5397594 - DNA, 21 bp, Homo sapiens
cctggagtgtggctgaggagg

SEQ ID NO: 5397595 - DNA, 16 bp, Homo sapiens
cctggagtgtgtcaga

SEQ ID NO: 5397596 - DNA, 17 bp, Homo sapiens
cctggagtgtgtcagag

SEQ ID NO: 5397597 - DNA, 19 bp, Homo sapiens
cctggagtgtgtcagagcc

SEQ ID NO: 5397598 - DNA, 22 bp, Homo sapiens
cctggagtgtgtcagagcccag

SEQ ID NO: 5397599 - DNA, 16 bp, Homo sapiens
cctggagttctggttc

SEQ ID NO: 5397600 - DNA, 13 bp, Homo sapiens
cctggagttcttg

SEQ ID NO: 5397601 - DNA, 15 bp, Homo sapiens
cctggagtttgggat

SEQ ID NO: 5397602 - DNA, 17 bp, Homo sapiens
cctggagttttgatttg

SEQ ID NO: 5397603 - DNA, 15 bp, Homo sapiens
cctggataaaaaaga

SEQ ID NO: 5397604 - DNA, 17 bp, Homo sapiens
cctggatagttaagggc

SEQ ID NO: 5397605 - DNA, 18 bp, Homo sapiens
cctggatattattcttgt

SEQ ID NO: 5397606 - DNA, 17 bp, Homo sapiens
cctggatcagcgtggcc

SEQ ID NO: 5397607 - DNA, 18 bp, Homo sapiens
cctggatccagcactggt

SEQ ID NO: 5397608 - DNA, 18 bp, Homo sapiens
cctggatccagctctggg

SEQ ID NO: 5397609 - DNA, 16 bp, Homo sapiens
cctggatccatcctgc

SEQ ID NO: 5397610 - DNA, 13 bp, Homo sapiens
cctggatcccttt

SEQ ID NO: 5397611 - DNA, 14 bp, Homo sapiens
cctggatccctttc

SEQ ID NO: 5397612 - DNA, 14 bp, Homo sapiens
cctggatctccctg

SEQ ID NO: 5397613 - DNA, 20 bp, Homo sapiens
cctggatctcctcccttacc

SEQ ID NO: 5397614 - DNA, 21 bp, Homo sapiens
cctggatgagaaacagctcag

SEQ ID NO: 5397615 - DNA, 21 bp, Homo sapiens
cctggatgatttcatcttctg

SEQ ID NO: 5397616 - DNA, 22 bp, Homo sapiens
cctggatgatttcatcttctgg

SEQ ID NO: 5397617 - DNA, 16 bp, Homo sapiens
cctggatgcacagtgc

SEQ ID NO: 5397618 - DNA, 18 bp, Homo sapiens
cctggatgcacagtgcct

SEQ ID NO: 5397619 - DNA, 16 bp, Homo sapiens
cctggatgccagctgt

SEQ ID NO: 5397620 - DNA, 21 bp, Homo sapiens
cctggatgccagctgtgtcct

SEQ ID NO: 5397621 - DNA, 22 bp, Homo sapiens
cctggatgccagctgtgtcctt

SEQ ID NO: 5397622 - DNA, 13 bp, Homo sapiens
cctggatgccatc

SEQ ID NO: 5397623 - DNA, 18 bp, Homo sapiens
cctggatgccatccaagt

SEQ ID NO: 5397624 - DNA, 14 bp, Homo sapiens
cctggatgccccct

SEQ ID NO: 5397625 - DNA, 14 bp, Homo sapiens
cctggatggcctct

SEQ ID NO: 5397626 - DNA, 19 bp, Homo sapiens
cctggatggcctctggggc

SEQ ID NO: 5397627 - DNA, 20 bp, Homo sapiens
cctggatggcctctggggca

SEQ ID NO: 5397628 - DNA, 23 bp, Homo sapiens
cctggatggcctctggggcagga

SEQ ID NO: 5397629 - DNA, 21 bp, Homo sapiens
cctggatggggcagagcttct

SEQ ID NO: 5397630 - DNA, 22 bp, Homo sapiens
cctggatggggcagagcttctc

SEQ ID NO: 5397631 - DNA, 23 bp, Homo sapiens
cctggatggggcagagcttctcc

SEQ ID NO: 5397632 - DNA, 18 bp, Homo sapiens
cctggatggggcaggcca

SEQ ID NO: 5397633 - DNA, 17 bp, Homo sapiens
cctggatggggctgcac

SEQ ID NO: 5397634 - DNA, 23 bp, Homo sapiens
cctggatgggggtgcaggcagcc

SEQ ID NO: 5397635 - DNA, 21 bp, Homo sapiens
cctggatgtcccctgtcccac

SEQ ID NO: 5397636 - DNA, 23 bp, Homo sapiens
cctggatgtcccctgtcccacca

SEQ ID NO: 5397637 - DNA, 12 bp, Homo sapiens
cctggatgtctg

SEQ ID NO: 5397638 - DNA, 18 bp, Homo sapiens
cctggatgtgaagctcac

SEQ ID NO: 5397639 - DNA, 21 bp, Homo sapiens
cctggatgtgaagctcacact

SEQ ID NO: 5397640 - DNA, 17 bp, Homo sapiens
cctggatgtgtggggca

SEQ ID NO: 5397641 - DNA, 15 bp, Homo sapiens
cctggattcatttcc

SEQ ID NO: 5397642 - DNA, 21 bp, Homo sapiens
cctggattcatttcctgccct

SEQ ID NO: 5397643 - DNA, 22 bp, Homo sapiens
cctggattccagcagtgaatgc

SEQ ID NO: 5397644 - DNA, 20 bp, Homo sapiens
cctggattttctttctatgt

SEQ ID NO: 5397645 - DNA, 20 bp, Homo sapiens
cctggattttttatgtacaa

SEQ ID NO: 5397646 - DNA, 23 bp, Homo sapiens
cctggattttttatgtacaaccc

SEQ ID NO: 5397647 - DNA, 23 bp, Homo sapiens
cctggcaaaaatgcaacaaatga

SEQ ID NO: 5397648 - DNA, 22 bp, Homo sapiens
cctggcaaatgcacacacctca

SEQ ID NO: 5397649 - DNA, 17 bp, Homo sapiens
cctggcaacagagcgag

SEQ ID NO: 5397650 - DNA, 22 bp, Homo sapiens
cctggcaacatcttacttgtcc

SEQ ID NO: 5397651 - DNA, 23 bp, Homo sapiens
cctggcaagctagaacctggagg

SEQ ID NO: 5397652 - DNA, 21 bp, Homo sapiens
cctggcaaggcattcctcatc

SEQ ID NO: 5397653 - DNA, 22 bp, Homo sapiens
cctggcaaggcattcctcatca

SEQ ID NO: 5397654 - DNA, 19 bp, Homo sapiens
cctggcaatagtgtgttct

SEQ ID NO: 5397655 - DNA, 17 bp, Homo sapiens
cctggcaatcaatacag

SEQ ID NO: 5397656 - DNA, 21 bp, Homo sapiens
cctggcaatcaatacagcttc

SEQ ID NO: 5397657 - DNA, 14 bp, Homo sapiens
cctggcaatcccac

SEQ ID NO: 5397658 - DNA, 21 bp, Homo sapiens
cctggcacaatgttggagcag

SEQ ID NO: 5397659 - DNA, 22 bp, Homo sapiens
cctggcacaatgttggagcagc

SEQ ID NO: 5397660 - DNA, 14 bp, Homo sapiens
cctggcacaccaga

SEQ ID NO: 5397661 - DNA, 22 bp, Homo sapiens
cctggcacagaaagggcagctt

SEQ ID NO: 5397662 - DNA, 17 bp, Homo sapiens
cctggcacagaagagga

SEQ ID NO: 5397663 - DNA, 17 bp, Homo sapiens
cctggcacagaccaggc

SEQ ID NO: 5397664 - DNA, 17 bp, Homo sapiens
cctggcacaggccgagg

SEQ ID NO: 5397665 - DNA, 18 bp, Homo sapiens
cctggcacagggcagtgg

SEQ ID NO: 5397666 - DNA, 12 bp, Homo sapiens
cctggcacagtg

SEQ ID NO: 5397667 - DNA, 15 bp, Homo sapiens
cctggcacagtgtct

SEQ ID NO: 5397668 - DNA, 19 bp, Homo sapiens
cctggcacagtgtctgggc

SEQ ID NO: 5397669 - DNA, 23 bp, Homo sapiens
cctggcacagtgtctgggctgac

SEQ ID NO: 5397670 - DNA, 21 bp, Homo sapiens
cctggcacagtttttgtaaag

SEQ ID NO: 5397671 - DNA, 22 bp, Homo sapiens
cctggcacatttcagggagaaa

SEQ ID NO: 5397672 - DNA, 13 bp, Homo sapiens
cctggcacccacc

SEQ ID NO: 5397673 - DNA, 18 bp, Homo sapiens
cctggcacctgagtgtcc

SEQ ID NO: 5397674 - DNA, 13 bp, Homo sapiens
cctggcacctgtg

SEQ ID NO: 5397675 - DNA, 17 bp, Homo sapiens
cctggcacgccctactc

SEQ ID NO: 5397676 - DNA, 13 bp, Homo sapiens
cctggcactgcag

SEQ ID NO: 5397677 - DNA, 15 bp, Homo sapiens
cctggcactgctgtg

SEQ ID NO: 5397678 - DNA, 12 bp, Homo sapiens
cctggcactgga

SEQ ID NO: 5397679 - DNA, 22 bp, Homo sapiens
cctggcactgggaggcagggct

SEQ ID NO: 5397680 - DNA, 13 bp, Homo sapiens
cctggcagaactg

SEQ ID NO: 5397681 - DNA, 17 bp, Homo sapiens
cctggcagaactgagct

SEQ ID NO: 5397682 - DNA, 18 bp, Homo sapiens
cctggcagaactgagctc

SEQ ID NO: 5397683 - DNA, 14 bp, Homo sapiens
cctggcagacacaa

SEQ ID NO: 5397684 - DNA, 22 bp, Homo sapiens
cctggcagacttgcccaggtca

SEQ ID NO: 5397685 - DNA, 15 bp, Homo sapiens
cctggcagagaagag

SEQ ID NO: 5397686 - DNA, 19 bp, Homo sapiens
cctggcagagatgcctccc

SEQ ID NO: 5397687 - DNA, 15 bp, Homo sapiens
cctggcagatggggg

SEQ ID NO: 5397688 - DNA, 16 bp, Homo sapiens
cctggcagatgggggc

SEQ ID NO: 5397689 - DNA, 21 bp, Homo sapiens
cctggcagatgggggcctctc

SEQ ID NO: 5397690 - DNA, 14 bp, Homo sapiens
cctggcagcacagc

SEQ ID NO: 5397691 - DNA, 19 bp, Homo sapiens
cctggcagcacagcccagg

SEQ ID NO: 5397692 - DNA, 20 bp, Homo sapiens
cctggcagcacagcccaggg

SEQ ID NO: 5397693 - DNA, 14 bp, Homo sapiens
cctggcccttcagt

SEQ ID NO: 5397694 - DNA, 14 bp, Homo sapiens
cctggcccttcctt

SEQ ID NO: 5397695 - DNA, 17 bp, Homo sapiens
cctggcccttccttcac

SEQ ID NO: 5397696 - DNA, 14 bp, Homo sapiens
cctggcccttggct

SEQ ID NO: 5397697 - DNA, 19 bp, Homo sapiens
cctggccgcaagtccccag

SEQ ID NO: 5397698 - DNA, 19 bp, Homo sapiens
cctggccgcctccaggagc

SEQ ID NO: 5397699 - DNA, 17 bp, Homo sapiens
cctggccgcgctccggg

SEQ ID NO: 5397700 - DNA, 19 bp, Homo sapiens
cctggccgcttctccccag

SEQ ID NO: 5397701 - DNA, 21 bp, Homo sapiens
cctggccggcaaccccagttc

SEQ ID NO: 5397702 - DNA, 22 bp, Homo sapiens
cctggccggcaaccccagttct

SEQ ID NO: 5397703 - DNA, 23 bp, Homo sapiens
cctggccggcaaccccagttctg

SEQ ID NO: 5397704 - DNA, 15 bp, Homo sapiens
cctggccggccagcc

SEQ ID NO: 5397705 - DNA, 16 bp, Homo sapiens
cctggccggtaggctg

SEQ ID NO: 5397706 - DNA, 18 bp, Homo sapiens
cctggccggtaggctgct

SEQ ID NO: 5397707 - DNA, 18 bp, Homo sapiens
cctggccggtgtgggggc

SEQ ID NO: 5397708 - DNA, 21 bp, Homo sapiens
cctggccggtgtgggggcccc

SEQ ID NO: 5397709 - DNA, 17 bp, Homo sapiens
cctggccgttcagcctg

SEQ ID NO: 5397710 - DNA, 21 bp, Homo sapiens
cctggccgttcagcctgtctc

SEQ ID NO: 5397711 - DNA, 22 bp, Homo sapiens
cctggcctaatcctttagatta

SEQ ID NO: 5397712 - DNA, 13 bp, Homo sapiens
cctggcctattta

SEQ ID NO: 5397713 - DNA, 16 bp, Homo sapiens
cctggcctatttaagc

SEQ ID NO: 5397714 - DNA, 19 bp, Homo sapiens
cctggcctatttaagcccc

SEQ ID NO: 5397715 - DNA, 19 bp, Homo sapiens
cctggcctcacgcccagcc

SEQ ID NO: 5397716 - DNA, 15 bp, Homo sapiens
cctggcctcactggc

SEQ ID NO: 5397717 - DNA, 19 bp, Homo sapiens
cctggcctcactggctggg

SEQ ID NO: 5397718 - DNA, 21 bp, Homo sapiens
cctggcctcactggctggggc

SEQ ID NO: 5397719 - DNA, 22 bp, Homo sapiens
cctggcctcactggctggggca

SEQ ID NO: 5397720 - DNA, 12 bp, Homo sapiens
cctggcctcaga

SEQ ID NO: 5397721 - DNA, 13 bp, Homo sapiens
cctggcctcagag

SEQ ID NO: 5397722 - DNA, 17 bp, Homo sapiens
cctggcctcagagcttc

SEQ ID NO: 5397723 - DNA, 19 bp, Homo sapiens
cctggcctcagagcttcct

SEQ ID NO: 5397724 - DNA, 20 bp, Homo sapiens
cctggcctcagagcttcctg

SEQ ID NO: 5397725 - DNA, 16 bp, Homo sapiens
cctggcctcagttccc

SEQ ID NO: 5397726 - DNA, 21 bp, Homo sapiens
cctggcctcagttcccagctc

SEQ ID NO: 5397727 - DNA, 13 bp, Homo sapiens
cctggcctccagc

SEQ ID NO: 5397728 - DNA, 14 bp, Homo sapiens
cctggcctccagct

SEQ ID NO: 5397729 - DNA, 15 bp, Homo sapiens
cctggcctccagctc

SEQ ID NO: 5397730 - DNA, 17 bp, Homo sapiens
cctggcctcccccactt

SEQ ID NO: 5397731 - DNA, 18 bp, Homo sapiens
cctggcctcccctgccac

SEQ ID NO: 5397732 - DNA, 20 bp, Homo sapiens
cctggcctcccctgccacca

SEQ ID NO: 5397733 - DNA, 17 bp, Homo sapiens
cctggcctcccctgcgg

SEQ ID NO: 5397734 - DNA, 18 bp, Homo sapiens
cctggcctcccttctcct

SEQ ID NO: 5397735 - DNA, 21 bp, Homo sapiens
cctggcctccgatgcctggcc

SEQ ID NO: 5397736 - DNA, 21 bp, Homo sapiens
cctggcctccggcgtcagcct

SEQ ID NO: 5397737 - DNA, 11 bp, Homo sapiens
cctggcctcct

SEQ ID NO: 5397738 - DNA, 13 bp, Homo sapiens
cctggcctcctgc

SEQ ID NO: 5397739 - DNA, 17 bp, Homo sapiens
cctggcctcctgcctct

SEQ ID NO: 5397740 - DNA, 13 bp, Homo sapiens
cctggcctccttt

SEQ ID NO: 5397741 - DNA, 13 bp, Homo sapiens
cctggcctcgggg

SEQ ID NO: 5397742 - DNA, 19 bp, Homo sapiens
cctggcctcggggcagggc

SEQ ID NO: 5397743 - DNA, 15 bp, Homo sapiens
cctggcctctgcact

SEQ ID NO: 5397744 - DNA, 17 bp, Homo sapiens
cctggcctctgccatcc

SEQ ID NO: 5397745 - DNA, 13 bp, Homo sapiens
cctggcctctgct

SEQ ID NO: 5397746 - DNA, 12 bp, Homo sapiens
cctggcctctgg

SEQ ID NO: 5397747 - DNA, 14 bp, Homo sapiens
cctggcctctgtgc

SEQ ID NO: 5397748 - DNA, 16 bp, Homo sapiens
cctggcctcttctggg

SEQ ID NO: 5397749 - DNA, 17 bp, Homo sapiens
cctggcctgaactgagg

SEQ ID NO: 5397750 - DNA, 16 bp, Homo sapiens
cctggcctgactccca

SEQ ID NO: 5397751 - DNA, 12 bp, Homo sapiens
cctggcctgagc

SEQ ID NO: 5397752 - DNA, 16 bp, Homo sapiens
cctggcctgagcgcag

SEQ ID NO: 5397753 - DNA, 14 bp, Homo sapiens
cctggcctgagctg

SEQ ID NO: 5397754 - DNA, 20 bp, Homo sapiens
cctggcctgagctgggatga

SEQ ID NO: 5397755 - DNA, 18 bp, Homo sapiens
cctggcctgagctggggc

SEQ ID NO: 5397756 - DNA, 19 bp, Homo sapiens
cctggcctgagctggggcc

SEQ ID NO: 5397757 - DNA, 16 bp, Homo sapiens
cctggcctgaggtctc

SEQ ID NO: 5397758 - DNA, 21 bp, Homo sapiens
cctggcctgccaccctcctgc

SEQ ID NO: 5397759 - DNA, 13 bp, Homo sapiens
cctggcctgccag

SEQ ID NO: 5397760 - DNA, 15 bp, Homo sapiens
cctggcctgccagac

SEQ ID NO: 5397761 - DNA, 14 bp, Homo sapiens
cctggcctgcccgt

SEQ ID NO: 5397762 - DNA, 19 bp, Homo sapiens
cctggcctggcacacatca

SEQ ID NO: 5397763 - DNA, 19 bp, Homo sapiens
cctggcctggccatctccc

SEQ ID NO: 5397764 - DNA, 14 bp, Homo sapiens
cctggcctggctgg

SEQ ID NO: 5397765 - DNA, 21 bp, Homo sapiens
cctggcctggtccctggtcct

SEQ ID NO: 5397766 - DNA, 13 bp, Homo sapiens
cctggcctgtctg

SEQ ID NO: 5397767 - DNA, 11 bp, Homo sapiens
cctggcctgtt

SEQ ID NO: 5397768 - DNA, 13 bp, Homo sapiens
cctggcctgttct

SEQ ID NO: 5397769 - DNA, 18 bp, Homo sapiens
cctggccttaaagaggga

SEQ ID NO: 5397770 - DNA, 12 bp, Homo sapiens
cctggccttgag

SEQ ID NO: 5397771 - DNA, 20 bp, Homo sapiens
cctggccttgggatccaggc

SEQ ID NO: 5397772 - DNA, 20 bp, Homo sapiens
cctggccttgtcaggaccca

SEQ ID NO: 5397773 - DNA, 23 bp, Homo sapiens
cctggccttgtcaggacccaggc

SEQ ID NO: 5397774 - DNA, 18 bp, Homo sapiens
cctggcgacaagagtgag

SEQ ID NO: 5397775 - DNA, 15 bp, Homo sapiens
cctggcgcaggtggg

SEQ ID NO: 5397776 - DNA, 23 bp, Homo sapiens
cctggcgctgtgctagctttcct

SEQ ID NO: 5397777 - DNA, 17 bp, Homo sapiens
cctggcggagctctcct

SEQ ID NO: 5397778 - DNA, 21 bp, Homo sapiens
cctggcggaggtggagtggcc

SEQ ID NO: 5397779 - DNA, 22 bp, Homo sapiens
cctggcggaggtggagtggcca

SEQ ID NO: 5397780 - DNA, 15 bp, Homo sapiens
cctggcggcaggggt

SEQ ID NO: 5397781 - DNA, 15 bp, Homo sapiens
cctggcggccccaac

SEQ ID NO: 5397782 - DNA, 14 bp, Homo sapiens
cctggcggcctgtg

SEQ ID NO: 5397783 - DNA, 20 bp, Homo sapiens
cctggcgggatgggccaccg

SEQ ID NO: 5397784 - DNA, 19 bp, Homo sapiens
cctggcgggcagcccctgc

SEQ ID NO: 5397785 - DNA, 22 bp, Homo sapiens
cctggcgggcagcccctgctgg

SEQ ID NO: 5397786 - DNA, 17 bp, Homo sapiens
cctggcgggctggtgac

SEQ ID NO: 5397787 - DNA, 15 bp, Homo sapiens
cctggcggggcagga

SEQ ID NO: 5397788 - DNA, 19 bp, Homo sapiens
cctggcggggcaggaggcc

SEQ ID NO: 5397789 - DNA, 21 bp, Homo sapiens
cctggcggggttggcccttgt

SEQ ID NO: 5397790 - DNA, 15 bp, Homo sapiens
cctggcgggtggctg

SEQ ID NO: 5397791 - DNA, 20 bp, Homo sapiens
cctggcgtcctctccctcct

SEQ ID NO: 5397792 - DNA, 21 bp, Homo sapiens
cctggcgtcctctccctcctg

SEQ ID NO: 5397793 - DNA, 23 bp, Homo sapiens
cctggcgtcctctccctcctggc

SEQ ID NO: 5397794 - DNA, 16 bp, Homo sapiens
cctggcgtcggccaga

SEQ ID NO: 5397795 - DNA, 16 bp, Homo sapiens
cctggcgtgctcagac

SEQ ID NO: 5397796 - DNA, 21 bp, Homo sapiens
cctggcgtggggggagctctg

SEQ ID NO: 5397797 - DNA, 23 bp, Homo sapiens
cctggcgtggggggagctctggt

SEQ ID NO: 5397798 - DNA, 16 bp, Homo sapiens
cctggctaagcctctg

SEQ ID NO: 5397799 - DNA, 18 bp, Homo sapiens
cctggctaagcctctgct

SEQ ID NO: 5397800 - DNA, 22 bp, Homo sapiens
cctggctaagcctctgcttccg

SEQ ID NO: 5397801 - DNA, 22 bp, Homo sapiens
cctggctaataaggctttagtg

SEQ ID NO: 5397802 - DNA, 14 bp, Homo sapiens
cctggctacatccc

SEQ ID NO: 5397803 - DNA, 16 bp, Homo sapiens
cctggctaccttgtgg

SEQ ID NO: 5397804 - DNA, 18 bp, Homo sapiens
cctggctaccttgtggga

SEQ ID NO: 5397805 - DNA, 20 bp, Homo sapiens
cctggctaccttgtgggaat

SEQ ID NO: 5397806 - DNA, 15 bp, Homo sapiens
cctggctcacagcca

SEQ ID NO: 5397807 - DNA, 18 bp, Homo sapiens
cctggctcacagccacca

SEQ ID NO: 5397808 - DNA, 22 bp, Homo sapiens
cctggctcacagccaccacctg

SEQ ID NO: 5397809 - DNA, 17 bp, Homo sapiens
cctggctcagagccagt

SEQ ID NO: 5397810 - DNA, 12 bp, Homo sapiens
cctggctcagcc

SEQ ID NO: 5397811 - DNA, 13 bp, Homo sapiens
cctggctcaggga

SEQ ID NO: 5397812 - DNA, 20 bp, Homo sapiens
cctggctccaaaccctcgag

SEQ ID NO: 5397813 - DNA, 22 bp, Homo sapiens
cctggctccactcttgatctct

SEQ ID NO: 5397814 - DNA, 13 bp, Homo sapiens
cctggctccaggc

SEQ ID NO: 5397815 - DNA, 15 bp, Homo sapiens
cctggctccaggcca

SEQ ID NO: 5397816 - DNA, 17 bp, Homo sapiens
cctggctccaggccagg

SEQ ID NO: 5397817 - DNA, 15 bp, Homo sapiens
cctggctccaggctc

SEQ ID NO: 5397818 - DNA, 16 bp, Homo sapiens
cctggctccaggctcc

SEQ ID NO: 5397819 - DNA, 20 bp, Homo sapiens
cctggctccaggctccaggc

SEQ ID NO: 5397820 - DNA, 23 bp, Homo sapiens
cctggctccaggctccaggctga

SEQ ID NO: 5397821 - DNA, 16 bp, Homo sapiens
cctggctccagtctca

SEQ ID NO: 5397822 - DNA, 16 bp, Homo sapiens
cctggctcccacaggc

SEQ ID NO: 5397823 - DNA, 18 bp, Homo sapiens
cctggctcccacaggcag

SEQ ID NO: 5397824 - DNA, 19 bp, Homo sapiens
cctggctcccacaggcagc

SEQ ID NO: 5397825 - DNA, 14 bp, Homo sapiens
cctggctcccacct

SEQ ID NO: 5397826 - DNA, 14 bp, Homo sapiens
cctggctcccagga

SEQ ID NO: 5397827 - DNA, 15 bp, Homo sapiens
cctggctcccatgac

SEQ ID NO: 5397828 - DNA, 16 bp, Homo sapiens
cctggctccccacgag

SEQ ID NO: 5397829 - DNA, 21 bp, Homo sapiens
cctggctccccacgagtcacc

SEQ ID NO: 5397830 - DNA, 13 bp, Homo sapiens
cctggctccccga

SEQ ID NO: 5397831 - DNA, 16 bp, Homo sapiens
cctggctccccgaggg

SEQ ID NO: 5397832 - DNA, 14 bp, Homo sapiens
cctggctccctcct

SEQ ID NO: 5397833 - DNA, 22 bp, Homo sapiens
cctggctccctcctccaggcct

SEQ ID NO: 5397834 - DNA, 12 bp, Homo sapiens
cctggctccctg

SEQ ID NO: 5397835 - DNA, 19 bp, Homo sapiens
cctggctccgctgtgtgga

SEQ ID NO: 5397836 - DNA, 21 bp, Homo sapiens
cctggctccgtccaggagcct

SEQ ID NO: 5397837 - DNA, 20 bp, Homo sapiens
cctggctccttgcagcaggg

SEQ ID NO: 5397838 - DNA, 19 bp, Homo sapiens
cctggctctaccctgtctg

SEQ ID NO: 5397839 - DNA, 14 bp, Homo sapiens
cctggctctcacct

SEQ ID NO: 5397840 - DNA, 15 bp, Homo sapiens
cctggctctcacctc

SEQ ID NO: 5397841 - DNA, 19 bp, Homo sapiens
cctggctctcacctctagg

SEQ ID NO: 5397842 - DNA, 16 bp, Homo sapiens
cctggctctcagaagg

SEQ ID NO: 5397843 - DNA, 15 bp, Homo sapiens
cctggctctcctgta

SEQ ID NO: 5397844 - DNA, 20 bp, Homo sapiens
cctggctctgaccgaaacag

SEQ ID NO: 5397845 - DNA, 11 bp, Homo sapiens
cctggctctgc

SEQ ID NO: 5397846 - DNA, 13 bp, Homo sapiens
cctggctctgcca

SEQ ID NO: 5397847 - DNA, 15 bp, Homo sapiens
cctggctctgcccct

SEQ ID NO: 5397848 - DNA, 16 bp, Homo sapiens
cctggctctgcccctc

SEQ ID NO: 5397849 - DNA, 19 bp, Homo sapiens
cctggctctgcccctcagg

SEQ ID NO: 5397850 - DNA, 20 bp, Homo sapiens
cctggctctgcccctcaggg

SEQ ID NO: 5397851 - DNA, 17 bp, Homo sapiens
cctggctctgctgtccc

SEQ ID NO: 5397852 - DNA, 13 bp, Homo sapiens
cctggctctggag

SEQ ID NO: 5397853 - DNA, 13 bp, Homo sapiens
cctggctctgggc

SEQ ID NO: 5397854 - DNA, 14 bp, Homo sapiens
cctggctctgtcac

SEQ ID NO: 5397855 - DNA, 22 bp, Homo sapiens
cctggctctgtcaccgccatgc

SEQ ID NO: 5397856 - DNA, 20 bp, Homo sapiens
cctggctctgtggcttgcta

SEQ ID NO: 5397857 - DNA, 20 bp, Homo sapiens
cctggctgaaggactgtgac

SEQ ID NO: 5397858 - DNA, 23 bp, Homo sapiens
cctggctgaccccaaagagcctg

SEQ ID NO: 5397859 - DNA, 17 bp, Homo sapiens
cctggctgacctgctgt

SEQ ID NO: 5397860 - DNA, 19 bp, Homo sapiens
cctggctgacctgctgtgg

SEQ ID NO: 5397861 - DNA, 12 bp, Homo sapiens
cctggctgagca

SEQ ID NO: 5397862 - DNA, 13 bp, Homo sapiens
cctggctgagcag

SEQ ID NO: 5397863 - DNA, 22 bp, Homo sapiens
cctggctgagcagttcccctgg

SEQ ID NO: 5397864 - DNA, 19 bp, Homo sapiens
cctggctgagcctggctgg

SEQ ID NO: 5397865 - DNA, 22 bp, Homo sapiens
cctggctgatgatccagaacag

SEQ ID NO: 5397866 - DNA, 17 bp, Homo sapiens
cctggctgattcagcat

SEQ ID NO: 5397867 - DNA, 18 bp, Homo sapiens
cctggctgattcagcatt

SEQ ID NO: 5397868 - DNA, 11 bp, Homo sapiens
cctggctgcag

SEQ ID NO: 5397869 - DNA, 12 bp, Homo sapiens
cctggctgccca

SEQ ID NO: 5397870 - DNA, 23 bp, Homo sapiens
cctggctgcccatcatgtggccc

SEQ ID NO: 5397871 - DNA, 19 bp, Homo sapiens
cctgggtccaatgctcagg

SEQ ID NO: 5397872 - DNA, 23 bp, Homo sapiens
cctgggtccaggggaggccttcc

SEQ ID NO: 5397873 - DNA, 13 bp, Homo sapiens
cctgggtcccagg

SEQ ID NO: 5397874 - DNA, 22 bp, Homo sapiens
cctgggtcccaggaccctggac

SEQ ID NO: 5397875 - DNA, 18 bp, Homo sapiens
cctgggtcccagggctgg

SEQ ID NO: 5397876 - DNA, 22 bp, Homo sapiens
cctgggtcccagggctggccct

SEQ ID NO: 5397877 - DNA, 19 bp, Homo sapiens
cctgggtccccctcctgca

SEQ ID NO: 5397878 - DNA, 20 bp, Homo sapiens
cctgggtccccctcctgcac

SEQ ID NO: 5397879 - DNA, 11 bp, Homo sapiens
cctgggtcctc

SEQ ID NO: 5397880 - DNA, 17 bp, Homo sapiens
cctgggtcctcggccct

SEQ ID NO: 5397881 - DNA, 18 bp, Homo sapiens
cctgggtcctcggccctg

SEQ ID NO: 5397882 - DNA, 21 bp, Homo sapiens
cctgggtcctcgggcccctga

SEQ ID NO: 5397883 - DNA, 18 bp, Homo sapiens
cctgggtcctgcctgcag

SEQ ID NO: 5397884 - DNA, 21 bp, Homo sapiens
cctgggtcctgcctggtcctc

SEQ ID NO: 5397885 - DNA, 20 bp, Homo sapiens
cctgggtctggatgggagga

SEQ ID NO: 5397886 - DNA, 22 bp, Homo sapiens
cctgggtctggggacaggcccg

SEQ ID NO: 5397887 - DNA, 14 bp, Homo sapiens
cctgggtctgtgtc

SEQ ID NO: 5397888 - DNA, 16 bp, Homo sapiens
cctgggtctgtgtctc

SEQ ID NO: 5397889 - DNA, 17 bp, Homo sapiens
cctgggtctgtgtctct

SEQ ID NO: 5397890 - DNA, 15 bp, Homo sapiens
cctgggtgacagagt

SEQ ID NO: 5397891 - DNA, 16 bp, Homo sapiens
cctgggtgacagagtg

SEQ ID NO: 5397892 - DNA, 18 bp, Homo sapiens
cctgggtgacagagtgag

SEQ ID NO: 5397893 - DNA, 14 bp, Homo sapiens
cctgggtgacattt

SEQ ID NO: 5397894 - DNA, 20 bp, Homo sapiens
cctgggtgagaatcctgcct

SEQ ID NO: 5397895 - DNA, 21 bp, Homo sapiens
cctgggtgagaatcctgcctc

SEQ ID NO: 5397896 - DNA, 18 bp, Homo sapiens
cctgggtgatctgctgct

SEQ ID NO: 5397897 - DNA, 18 bp, Homo sapiens
cctgggtgccattcccag

SEQ ID NO: 5397898 - DNA, 17 bp, Homo sapiens
cctgggtggagcaggac

SEQ ID NO: 5397899 - DNA, 19 bp, Homo sapiens
cctgggtggagcaggactc

SEQ ID NO: 5397900 - DNA, 14 bp, Homo sapiens
cctgggtggctact

SEQ ID NO: 5397901 - DNA, 22 bp, Homo sapiens
cctgggtggctactctgtgcca

SEQ ID NO: 5397902 - DNA, 23 bp, Homo sapiens
cctgggtggctactctgtgccag

SEQ ID NO: 5397903 - DNA, 18 bp, Homo sapiens
cctgggtggctcagcatc

SEQ ID NO: 5397904 - DNA, 17 bp, Homo sapiens
cctgggtgggacagcct

SEQ ID NO: 5397905 - DNA, 15 bp, Homo sapiens
cctgggtgggcagga

SEQ ID NO: 5397906 - DNA, 16 bp, Homo sapiens
cctgggtgggccctgc

SEQ ID NO: 5397907 - DNA, 16 bp, Homo sapiens
cctgggtgggctctgt

SEQ ID NO: 5397908 - DNA, 17 bp, Homo sapiens
cctgggtggggctgctc

SEQ ID NO: 5397909 - DNA, 20 bp, Homo sapiens
cctgggtgggtggtggggag

SEQ ID NO: 5397910 - DNA, 19 bp, Homo sapiens
cctgggtgtcaagtgcctg

SEQ ID NO: 5397911 - DNA, 21 bp, Homo sapiens
cctgggtgtcaagtgcctgca

SEQ ID NO: 5397912 - DNA, 14 bp, Homo sapiens
cctgggtgtccccg

SEQ ID NO: 5397913 - DNA, 20 bp, Homo sapiens
cctgggtgtccccgctgctg

SEQ ID NO: 5397914 - DNA, 15 bp, Homo sapiens
cctgggtgtgacctg

SEQ ID NO: 5397915 - DNA, 14 bp, Homo sapiens
cctgggtgtgctcc

SEQ ID NO: 5397916 - DNA, 20 bp, Homo sapiens
cctgggttagactgccagct

SEQ ID NO: 5397917 - DNA, 20 bp, Homo sapiens
cctgggttagggtgtgtgtt

SEQ ID NO: 5397918 - DNA, 14 bp, Homo sapiens
cctgggttatttat

SEQ ID NO: 5397919 - DNA, 14 bp, Homo sapiens
cctgggttgctgct

SEQ ID NO: 5397920 - DNA, 17 bp, Homo sapiens
cctgggttggagggaac

SEQ ID NO: 5397921 - DNA, 18 bp, Homo sapiens
cctgggttgtttccagga

SEQ ID NO: 5397922 - DNA, 20 bp, Homo sapiens
cctgggttgtttccaggaga

SEQ ID NO: 5397923 - DNA, 22 bp, Homo sapiens
cctgggttgtttccaggagaaa

SEQ ID NO: 5397924 - DNA, 16 bp, Homo sapiens
cctgggtttcctgcag

SEQ ID NO: 5397925 - DNA, 13 bp, Homo sapiens
cctgggtttcttt

SEQ ID NO: 5397926 - DNA, 22 bp, Homo sapiens
cctgggtttgcaagaatctaaa

SEQ ID NO: 5397927 - DNA, 14 bp, Homo sapiens
cctgggtttggccc

SEQ ID NO: 5397928 - DNA, 18 bp, Homo sapiens
cctgggtttgggagccag

SEQ ID NO: 5397929 - DNA, 20 bp, Homo sapiens
cctgggtttgggagccagga

SEQ ID NO: 5397930 - DNA, 22 bp, Homo sapiens
cctgggttttctaactgtaaat

SEQ ID NO: 5397931 - DNA, 21 bp, Homo sapiens
cctgggttttgtattctctga

SEQ ID NO: 5397932 - DNA, 20 bp, Homo sapiens
cctggtaaccaaatattaaa

SEQ ID NO: 5397933 - DNA, 14 bp, Homo sapiens
cctggtaagaaaaa

SEQ ID NO: 5397934 - DNA, 18 bp, Homo sapiens
cctggtaaggctggtgag

SEQ ID NO: 5397935 - DNA, 18 bp, Homo sapiens
cctggtaattcctctcca

SEQ ID NO: 5397936 - DNA, 23 bp, Homo sapiens
cctggtaattcctctccaggcca

SEQ ID NO: 5397937 - DNA, 15 bp, Homo sapiens
cctggtacctggacg

SEQ ID NO: 5397938 - DNA, 16 bp, Homo sapiens
cctggtactcaagccc

SEQ ID NO: 5397939 - DNA, 20 bp, Homo sapiens
cctggtactccctctcagga

SEQ ID NO: 5397940 - DNA, 22 bp, Homo sapiens
cctggtactctggcaaatgatg

SEQ ID NO: 5397941 - DNA, 18 bp, Homo sapiens
cctggtagaccactgcca

SEQ ID NO: 5397942 - DNA, 14 bp, Homo sapiens
cctggtagagacta

SEQ ID NO: 5397943 - DNA, 15 bp, Homo sapiens
cctggtagagactag

SEQ ID NO: 5397944 - DNA, 19 bp, Homo sapiens
cctggtagaggggccggct

SEQ ID NO: 5397945 - DNA, 15 bp, Homo sapiens
cctggtaggaaagca

SEQ ID NO: 5397946 - DNA, 13 bp, Homo sapiens
cctggtaggtctg

SEQ ID NO: 5397947 - DNA, 15 bp, Homo sapiens
cctggtaggtctgga

SEQ ID NO: 5397948 - DNA, 18 bp, Homo sapiens
cctggtatatccaaaagc

SEQ ID NO: 5397949 - DNA, 15 bp, Homo sapiens
cctggtatggctgca

SEQ ID NO: 5397950 - DNA, 16 bp, Homo sapiens
cctggtatggctgcag

SEQ ID NO: 5397951 - DNA, 20 bp, Homo sapiens
cctggtatgtctcaccagga

SEQ ID NO: 5397952 - DNA, 18 bp, Homo sapiens
cctggtattgtaatatta

SEQ ID NO: 5397953 - DNA, 20 bp, Homo sapiens
cctggtcaacccgctgcttc

SEQ ID NO: 5397954 - DNA, 21 bp, Homo sapiens
cctggtcaccaaggcagtgca

SEQ ID NO: 5397955 - DNA, 24 bp, Homo sapiens
cctggtcaccacaattagagcttg

SEQ ID NO: 5397956 - DNA, 18 bp, Homo sapiens
cctggtcaccctggggct

SEQ ID NO: 5397957 - DNA, 16 bp, Homo sapiens
cctggtcaccgagact

SEQ ID NO: 5397958 - DNA, 21 bp, Homo sapiens
cctggtcaccgagactcagcc

SEQ ID NO: 5397959 - DNA, 15 bp, Homo sapiens
cctggtcacctagga

SEQ ID NO: 5397960 - DNA, 17 bp, Homo sapiens
cctggtcacctaggaag

SEQ ID NO: 5397961 - DNA, 21 bp, Homo sapiens
cctggtcacctaggaagcctc

SEQ ID NO: 5397962 - DNA, 19 bp, Homo sapiens
cctggtcagaaggccagcc

SEQ ID NO: 5397963 - DNA, 15 bp, Homo sapiens
cctggtcagcagagc

SEQ ID NO: 5397964 - DNA, 12 bp, Homo sapiens
cctggtcagccc

SEQ ID NO: 5397965 - DNA, 20 bp, Homo sapiens
cctggtcagggtgagcccat

SEQ ID NO: 5397966 - DNA, 19 bp, Homo sapiens
cctggtcagttttcacaga

SEQ ID NO: 5397967 - DNA, 17 bp, Homo sapiens
cctggtccacagggcac

SEQ ID NO: 5397968 - DNA, 14 bp, Homo sapiens
cctggtccaggctt

SEQ ID NO: 5397969 - DNA, 21 bp, Homo sapiens
cctggtccagggaagctggcc

SEQ ID NO: 5397970 - DNA, 22 bp, Homo sapiens
cctggtccagggaagctggccg

SEQ ID NO: 5397971 - DNA, 16 bp, Homo sapiens
cctggtccatgcaggg

SEQ ID NO: 5397972 - DNA, 20 bp, Homo sapiens
cctggtcccacgagggtgcc

SEQ ID NO: 5397973 - DNA, 19 bp, Homo sapiens
cctggtccccactgctgag

SEQ ID NO: 5397974 - DNA, 13 bp, Homo sapiens
cctggtcccctcc

SEQ ID NO: 5397975 - DNA, 15 bp, Homo sapiens
cctggtccctcgtcc

SEQ ID NO: 5397976 - DNA, 15 bp, Homo sapiens
cctggtccctctgag

SEQ ID NO: 5397977 - DNA, 12 bp, Homo sapiens
cctggtccctgg

SEQ ID NO: 5397978 - DNA, 16 bp, Homo sapiens
cctggtccctgggagg

SEQ ID NO: 5397979 - DNA, 17 bp, Homo sapiens
cctggtccctggtcctt

SEQ ID NO: 5397980 - DNA, 21 bp, Homo sapiens
cctggtccctggtccttcact

SEQ ID NO: 5397981 - DNA, 20 bp, Homo sapiens
cctggtcctcacactcaccc

SEQ ID NO: 5397982 - DNA, 18 bp, Homo sapiens
cctggtcctccctcccaa

SEQ ID NO: 5397983 - DNA, 19 bp, Homo sapiens
cctggtcctccgcctactg

SEQ ID NO: 5397984 - DNA, 21 bp, Homo sapiens
cctggtcctccgcctactgtc

SEQ ID NO: 5397985 - DNA, 15 bp, Homo sapiens
cctggtcctgacttc

SEQ ID NO: 5397986 - DNA, 15 bp, Homo sapiens
cctggtcctgatgcc

SEQ ID NO: 5397987 - DNA, 17 bp, Homo sapiens
cctggtcctgatgcccg

SEQ ID NO: 5397988 - DNA, 14 bp, Homo sapiens
cctggtcctggaca

SEQ ID NO: 5397989 - DNA, 23 bp, Homo sapiens
cctggtcctggacacctcccagg

SEQ ID NO: 5397990 - DNA, 16 bp, Homo sapiens
cctggtcctggctgca

SEQ ID NO: 5397991 - DNA, 23 bp, Homo sapiens
cctggtccttcactggcgccttc

SEQ ID NO: 5397992 - DNA, 18 bp, Homo sapiens
cctggtccttccaggccc

SEQ ID NO: 5397993 - DNA, 16 bp, Homo sapiens
cctggtcgccttccac

SEQ ID NO: 5397994 - DNA, 21 bp, Homo sapiens
cctggtcgccttccacctctg

SEQ ID NO: 5397995 - DNA, 19 bp, Homo sapiens
cctggtcgtctatcccagt

SEQ ID NO: 5397996 - DNA, 12 bp, Homo sapiens
cctggtctcctc

SEQ ID NO: 5397997 - DNA, 18 bp, Homo sapiens
cctggtctcctgccccca

SEQ ID NO: 5397998 - DNA, 22 bp, Homo sapiens
cctggtctcctgcccccacacc

SEQ ID NO: 5397999 - DNA, 13 bp, Homo sapiens
cctggtctctggt

SEQ ID NO: 5398000 - DNA, 13 bp, Homo sapiens
cctggtctcttca

SEQ ID NO: 5398001 - DNA, 16 bp, Homo sapiens
cctggtctgaggatgt

SEQ ID NO: 5398002 - DNA, 21 bp, Homo sapiens
cctggtctgaggatgtagaga

SEQ ID NO: 5398003 - DNA, 16 bp, Homo sapiens
cctggtctgccctggg

SEQ ID NO: 5398004 - DNA, 16 bp, Homo sapiens
cctggtctgctcagga

SEQ ID NO: 5398005 - DNA, 14 bp, Homo sapiens
cctggtctggagcc

SEQ ID NO: 5398006 - DNA, 12 bp, Homo sapiens
cctggtctggct

SEQ ID NO: 5398007 - DNA, 22 bp, Homo sapiens
cctggtctggttgggcagccag

SEQ ID NO: 5398008 - DNA, 18 bp, Homo sapiens
cctggtctgtctggatcc

SEQ ID NO: 5398009 - DNA, 15 bp, Homo sapiens
cctggtctgtgcatt

SEQ ID NO: 5398010 - DNA, 23 bp, Homo sapiens
cctggtctgtgcattgtggctgt

SEQ ID NO: 5398011 - DNA, 22 bp, Homo sapiens
cctggtctgtgctgccctgctc

SEQ ID NO: 5398012 - DNA, 23 bp, Homo sapiens
cctggtctgtggagatggactca

SEQ ID NO: 5398013 - DNA, 16 bp, Homo sapiens
cctggtcttgagatgt

SEQ ID NO: 5398014 - DNA, 22 bp, Homo sapiens
cctggtgaaagagtaaaaccaa

SEQ ID NO: 5398015 - DNA, 20 bp, Homo sapiens
cctggtgaatcacctggctg

SEQ ID NO: 5398016 - DNA, 20 bp, Homo sapiens
cctggtgaatggccttcctt

SEQ ID NO: 5398017 - DNA, 16 bp, Homo sapiens
cctggtgacaggcaga

SEQ ID NO: 5398018 - DNA, 23 bp, Homo sapiens
cctggtgacatcaggtttttccc

SEQ ID NO: 5398019 - DNA, 22 bp, Homo sapiens
cctggtgaccagaccaaggcag

SEQ ID NO: 5398020 - DNA, 13 bp, Homo sapiens
cctggtgactcct

SEQ ID NO: 5398021 - DNA, 14 bp, Homo sapiens
cctggtgactcctg

SEQ ID NO: 5398022 - DNA, 15 bp, Homo sapiens
cctggtgagaactga

SEQ ID NO: 5398023 - DNA, 21 bp, Homo sapiens
cctggtgagagggccgggcag

SEQ ID NO: 5398024 - DNA, 18 bp, Homo sapiens
cctggtgaggcccagcct

SEQ ID NO: 5398025 - DNA, 19 bp, Homo sapiens
cctggtgaggcccagcctg

SEQ ID NO: 5398026 - DNA, 20 bp, Homo sapiens
cctggtgagtaacttagaaa

SEQ ID NO: 5398027 - DNA, 22 bp, Homo sapiens
cctggtgattctgatgcagcct

SEQ ID NO: 5398028 - DNA, 20 bp, Homo sapiens
cctggtgcactggccccacc

SEQ ID NO: 5398029 - DNA, 15 bp, Homo sapiens
cctggtgcagaggtg

SEQ ID NO: 5398030 - DNA, 18 bp, Homo sapiens
cctggtgcaggtctccac

SEQ ID NO: 5398031 - DNA, 23 bp, Homo sapiens
cctggtgcaggtctccacctgca

SEQ ID NO: 5398032 - DNA, 18 bp, Homo sapiens
cctggtgcattgctgtgt

SEQ ID NO: 5398033 - DNA, 20 bp, Homo sapiens
cctggtgcattgctgtgtga

SEQ ID NO: 5398034 - DNA, 21 bp, Homo sapiens
cctggtgcccccgcccctggt

SEQ ID NO: 5398035 - DNA, 17 bp, Homo sapiens
cctggtgcccctcgcca

SEQ ID NO: 5398036 - DNA, 20 bp, Homo sapiens
cctggtgcccctcgccagct

SEQ ID NO: 5398037 - DNA, 21 bp, Homo sapiens
cctggtgcccctcgccagctt

SEQ ID NO: 5398038 - DNA, 23 bp, Homo sapiens
cctggtgcccctcgccagcttct

SEQ ID NO: 5398039 - DNA, 14 bp, Homo sapiens
cctggtgcccctgc

SEQ ID NO: 5398040 - DNA, 14 bp, Homo sapiens
cctggtgccctggc

SEQ ID NO: 5398041 - DNA, 18 bp, Homo sapiens
cctggtgccctggcccag

SEQ ID NO: 5398042 - DNA, 19 bp, Homo sapiens
cctggtgcccttccctgga

SEQ ID NO: 5398043 - DNA, 21 bp, Homo sapiens
cctggtgcccttccctggagg

SEQ ID NO: 5398044 - DNA, 16 bp, Homo sapiens
cctggtgcgctgtgct

SEQ ID NO: 5398045 - DNA, 20 bp, Homo sapiens
cctggtgcgctgtgctccag

SEQ ID NO: 5398046 - DNA, 17 bp, Homo sapiens
cctgtgaacccaggaca

SEQ ID NO: 5398047 - DNA, 17 bp, Homo sapiens
cctgtgaactgaactct

SEQ ID NO: 5398048 - DNA, 15 bp, Homo sapiens
cctgtgaactgccag

SEQ ID NO: 5398049 - DNA, 21 bp, Homo sapiens
cctgtgaagtaacccctcctg

SEQ ID NO: 5398050 - DNA, 23 bp, Homo sapiens
cctgtgaagtaacccctcctggc

SEQ ID NO: 5398051 - DNA, 22 bp, Homo sapiens
cctgtgaagtttaattgtctca

SEQ ID NO: 5398052 - DNA, 19 bp, Homo sapiens
cctgtgaatgccactgcct

SEQ ID NO: 5398053 - DNA, 20 bp, Homo sapiens
cctgtgacacttataaatat

SEQ ID NO: 5398054 - DNA, 23 bp, Homo sapiens
cctgtgacagcagctctgtcccc

SEQ ID NO: 5398055 - DNA, 19 bp, Homo sapiens
cctgtgacatggtgcctga

SEQ ID NO: 5398056 - DNA, 21 bp, Homo sapiens
cctgtgacatggtgcctgaga

SEQ ID NO: 5398057 - DNA, 16 bp, Homo sapiens
cctgtgaccagcactg

SEQ ID NO: 5398058 - DNA, 19 bp, Homo sapiens
cctgtgaccagtctgaccc

SEQ ID NO: 5398059 - DNA, 22 bp, Homo sapiens
cctgtgaccctctcactttggt

SEQ ID NO: 5398060 - DNA, 16 bp, Homo sapiens
cctgtgaccctctttg

SEQ ID NO: 5398061 - DNA, 17 bp, Homo sapiens
cctgtgacctggtctgg

SEQ ID NO: 5398062 - DNA, 14 bp, Homo sapiens
cctgtgaccttggg

SEQ ID NO: 5398063 - DNA, 13 bp, Homo sapiens
cctgtgactcctc

SEQ ID NO: 5398064 - DNA, 18 bp, Homo sapiens
cctgtgagagccacgctg

SEQ ID NO: 5398065 - DNA, 16 bp, Homo sapiens
cctgtgagcaagagcc

SEQ ID NO: 5398066 - DNA, 17 bp, Homo sapiens
cctgtgagcaagagcca

SEQ ID NO: 5398067 - DNA, 19 bp, Homo sapiens
cctgtgagcaagagccagg

SEQ ID NO: 5398068 - DNA, 16 bp, Homo sapiens
cctgtgagcacaaaga

SEQ ID NO: 5398069 - DNA, 20 bp, Homo sapiens
cctgtgagcacaaagaagaa

SEQ ID NO: 5398070 - DNA, 14 bp, Homo sapiens
cctgtgagcatcct

SEQ ID NO: 5398071 - DNA, 19 bp, Homo sapiens
cctgtgagcatggggccag

SEQ ID NO: 5398072 - DNA, 20 bp, Homo sapiens
cctgtgagcatggggccagg

SEQ ID NO: 5398073 - DNA, 21 bp, Homo sapiens
cctgtgagcatggggccagga

SEQ ID NO: 5398074 - DNA, 14 bp, Homo sapiens
cctgtgagccagtc

SEQ ID NO: 5398075 - DNA, 16 bp, Homo sapiens
cctgtgagccagtcta

SEQ ID NO: 5398076 - DNA, 23 bp, Homo sapiens
cctgtgagccagtctagttcctg

SEQ ID NO: 5398077 - DNA, 17 bp, Homo sapiens
cctgtgagcccagctgg

SEQ ID NO: 5398078 - DNA, 22 bp, Homo sapiens
cctgtgagctaggaattgtgtt

SEQ ID NO: 5398079 - DNA, 15 bp, Homo sapiens
cctgtgagctcccca

SEQ ID NO: 5398080 - DNA, 12 bp, Homo sapiens
cctgtgaggaag

SEQ ID NO: 5398081 - DNA, 21 bp, Homo sapiens
cctgtgaggatagagacttgc

SEQ ID NO: 5398082 - DNA, 14 bp, Homo sapiens
cctgtgaggcaggg

SEQ ID NO: 5398083 - DNA, 13 bp, Homo sapiens
cctgtgaggcttt

SEQ ID NO: 5398084 - DNA, 18 bp, Homo sapiens
cctgtgagggagtgcaga

SEQ ID NO: 5398085 - DNA, 17 bp, Homo sapiens
cctgtgaggggcccctg

SEQ ID NO: 5398086 - DNA, 19 bp, Homo sapiens
cctgtgaggtaactgggat

SEQ ID NO: 5398087 - DNA, 20 bp, Homo sapiens
cctgtgaggtaactgggatc

SEQ ID NO: 5398088 - DNA, 23 bp, Homo sapiens
cctgtgaggtgcagagtgcccag

SEQ ID NO: 5398089 - DNA, 17 bp, Homo sapiens
cctgtgagtaaatattg

SEQ ID NO: 5398090 - DNA, 20 bp, Homo sapiens
cctgtgagtactacagtcct

SEQ ID NO: 5398091 - DNA, 13 bp, Homo sapiens
cctgtgagtaggc

SEQ ID NO: 5398092 - DNA, 23 bp, Homo sapiens
cctgtgagtaggctgggcctccc

SEQ ID NO: 5398093 - DNA, 17 bp, Homo sapiens
cctgtgatccaggaaag

SEQ ID NO: 5398094 - DNA, 18 bp, Homo sapiens
cctgtgatccaggaaaga

SEQ ID NO: 5398095 - DNA, 19 bp, Homo sapiens
cctgtgatctagtccttgt

SEQ ID NO: 5398096 - DNA, 19 bp, Homo sapiens
cctgtgatcttatttttct

SEQ ID NO: 5398097 - DNA, 19 bp, Homo sapiens
cctgtgatgcctgacacag

SEQ ID NO: 5398098 - DNA, 15 bp, Homo sapiens
cctgtgatggccagg

SEQ ID NO: 5398099 - DNA, 16 bp, Homo sapiens
cctgtgatggccaggc

SEQ ID NO: 5398100 - DNA, 18 bp, Homo sapiens
cctgtgatggggccctgc

SEQ ID NO: 5398101 - DNA, 19 bp, Homo sapiens
cctgtgatggggccctgcc

SEQ ID NO: 5398102 - DNA, 15 bp, Homo sapiens
cctgtgatgtcccag

SEQ ID NO: 5398103 - DNA, 15 bp, Homo sapiens
cctgtgatttctgtg

SEQ ID NO: 5398104 - DNA, 16 bp, Homo sapiens
cctgtgcaaaataaaa

SEQ ID NO: 5398105 - DNA, 20 bp, Homo sapiens
cctgtgcaattcagtctgct

SEQ ID NO: 5398106 - DNA, 17 bp, Homo sapiens
cctgtgcacacacacac

SEQ ID NO: 5398107 - DNA, 23 bp, Homo sapiens
cctgtgcacaccccactcccaca

SEQ ID NO: 5398108 - DNA, 12 bp, Homo sapiens
cctgtgcacagc

SEQ ID NO: 5398109 - DNA, 13 bp, Homo sapiens
cctgtgcagcagc

SEQ ID NO: 5398110 - DNA, 20 bp, Homo sapiens
cctgtgcagcagcccagctt

SEQ ID NO: 5398111 - DNA, 14 bp, Homo sapiens
cctgtgcagtcccg

SEQ ID NO: 5398112 - DNA, 21 bp, Homo sapiens
cctgtgcagtcccgtggaggg

SEQ ID NO: 5398113 - DNA, 20 bp, Homo sapiens
cctgtgcatgtatgtcttgg

SEQ ID NO: 5398114 - DNA, 12 bp, Homo sapiens
cctgtgccaata

SEQ ID NO: 5398115 - DNA, 24 bp, Homo sapiens
cctgtgccactttgactcagaggc

SEQ ID NO: 5398116 - DNA, 11 bp, Homo sapiens
cctgtgccagc

SEQ ID NO: 5398117 - DNA, 17 bp, Homo sapiens
cctgtgccagcccagag

SEQ ID NO: 5398118 - DNA, 19 bp, Homo sapiens
cctgtgccagcccagaggc

SEQ ID NO: 5398119 - DNA, 12 bp, Homo sapiens
cctgtgccagct

SEQ ID NO: 5398120 - DNA, 17 bp, Homo sapiens
cctgtgccaggactctc

SEQ ID NO: 5398121 - DNA, 21 bp, Homo sapiens
cctgtgccaggactctctttc

SEQ ID NO: 5398122 - DNA, 17 bp, Homo sapiens
cctgtgccaggctgaat

SEQ ID NO: 5398123 - DNA, 12 bp, Homo sapiens
cctgtgccaggt

SEQ ID NO: 5398124 - DNA, 21 bp, Homo sapiens
cctgtgccaggtgaaggaggc

SEQ ID NO: 5398125 - DNA, 15 bp, Homo sapiens
cctgtgccatgccca

SEQ ID NO: 5398126 - DNA, 12 bp, Homo sapiens
cctgtgcccacc

SEQ ID NO: 5398127 - DNA, 16 bp, Homo sapiens
cctgtgcccacccgtc

SEQ ID NO: 5398128 - DNA, 14 bp, Homo sapiens
cctgtgcccactcc

SEQ ID NO: 5398129 - DNA, 15 bp, Homo sapiens
cctgtgcccactccc

SEQ ID NO: 5398130 - DNA, 22 bp, Homo sapiens
cctgtgcccatcatctctgcct

SEQ ID NO: 5398131 - DNA, 20 bp, Homo sapiens
cctgtgcccatggcttctgg

SEQ ID NO: 5398132 - DNA, 17 bp, Homo sapiens
cctgtgccccagctgcc

SEQ ID NO: 5398133 - DNA, 19 bp, Homo sapiens
cctgtgccccagctgccag

SEQ ID NO: 5398134 - DNA, 13 bp, Homo sapiens
cctgtgcccccag

SEQ ID NO: 5398135 - DNA, 15 bp, Homo sapiens
cctgtgcccccagcc

SEQ ID NO: 5398136 - DNA, 17 bp, Homo sapiens
cctgtgcccccagcctc

SEQ ID NO: 5398137 - DNA, 18 bp, Homo sapiens
cctgtgcccccagcctca

SEQ ID NO: 5398138 - DNA, 19 bp, Homo sapiens
cctgtgcccccagcctcag

SEQ ID NO: 5398139 - DNA, 21 bp, Homo sapiens
cctgtgcccccagcctcagcc

SEQ ID NO: 5398140 - DNA, 14 bp, Homo sapiens
cctgtgccccgcct

SEQ ID NO: 5398141 - DNA, 17 bp, Homo sapiens
cctgtgccccgcctccc

SEQ ID NO: 5398142 - DNA, 16 bp, Homo sapiens
cctgtgcccctcagag

SEQ ID NO: 5398143 - DNA, 18 bp, Homo sapiens
cctgtgcccgactgactg

SEQ ID NO: 5398144 - DNA, 17 bp, Homo sapiens
cctgtgcccgctgcgct

SEQ ID NO: 5398145 - DNA, 18 bp, Homo sapiens
cctgtgcccgctgcgctg

SEQ ID NO: 5398146 - DNA, 23 bp, Homo sapiens
cctgtgcccgctgcgctgccctg

SEQ ID NO: 5398147 - DNA, 16 bp, Homo sapiens
cctgtgccctcaccac

SEQ ID NO: 5398148 - DNA, 17 bp, Homo sapiens
cctgtgccctcacccca

SEQ ID NO: 5398149 - DNA, 16 bp, Homo sapiens
cctgtgccctccttcc

SEQ ID NO: 5398150 - DNA, 21 bp, Homo sapiens
cctgtgccctccttcccaatc

SEQ ID NO: 5398151 - DNA, 15 bp, Homo sapiens
cctgtgccctgcacg

SEQ ID NO: 5398152 - DNA, 12 bp, Homo sapiens
cctgtgcctccc

SEQ ID NO: 5398153 - DNA, 13 bp, Homo sapiens
cctgtgcctccca

SEQ ID NO: 5398154 - DNA, 22 bp, Homo sapiens
cctgtgcctccctctcctcgga

SEQ ID NO: 5398155 - DNA, 21 bp, Homo sapiens
cctgtgcctcctcacccccag

SEQ ID NO: 5398156 - DNA, 15 bp, Homo sapiens
cctgtgcctcctccc

SEQ ID NO: 5398157 - DNA, 16 bp, Homo sapiens
cctgtgcctcctccct

SEQ ID NO: 5398158 - DNA, 17 bp, Homo sapiens
cctgtgcctctgggact

SEQ ID NO: 5398159 - DNA, 19 bp, Homo sapiens
cctgtgcctctgggactgg

SEQ ID NO: 5398160 - DNA, 17 bp, Homo sapiens
cctgtgcctgattattt

SEQ ID NO: 5398161 - DNA, 11 bp, Homo sapiens
cctgtgcctgc

SEQ ID NO: 5398162 - DNA, 20 bp, Homo sapiens
cctgtgcctgccatgggcca

SEQ ID NO: 5398163 - DNA, 12 bp, Homo sapiens
cctgtgcctggc

SEQ ID NO: 5398164 - DNA, 17 bp, Homo sapiens
cctgtgcctgggccctg

SEQ ID NO: 5398165 - DNA, 13 bp, Homo sapiens
cctgtgccttcct

SEQ ID NO: 5398166 - DNA, 16 bp, Homo sapiens
cctgtgcctttcctat

SEQ ID NO: 5398167 - DNA, 17 bp, Homo sapiens
cctgtgccttttgccat

SEQ ID NO: 5398168 - DNA, 16 bp, Homo sapiens
cctgtgcgtcccagct

SEQ ID NO: 5398169 - DNA, 18 bp, Homo sapiens
cctgtgcgtcccagctga

SEQ ID NO: 5398170 - DNA, 12 bp, Homo sapiens
cctgtgctacag

SEQ ID NO: 5398171 - DNA, 17 bp, Homo sapiens
cctgtgctactttgcct

SEQ ID NO: 5398172 - DNA, 20 bp, Homo sapiens
cctgtgctatttgtacaaat

SEQ ID NO: 5398173 - DNA, 15 bp, Homo sapiens
cctgtgctcagccct

SEQ ID NO: 5398174 - DNA, 19 bp, Homo sapiens
cctgtgctccgtgcctcca

SEQ ID NO: 5398175 - DNA, 12 bp, Homo sapiens
cctgtgctcctg

SEQ ID NO: 5398176 - DNA, 13 bp, Homo sapiens
cctgtgctctgga

SEQ ID NO: 5398177 - DNA, 18 bp, Homo sapiens
cctgtgctctggaggctg

SEQ ID NO: 5398178 - DNA, 14 bp, Homo sapiens
cctgtgctgaggac

SEQ ID NO: 5398179 - DNA, 17 bp, Homo sapiens
cctgtgctgaggactcc

SEQ ID NO: 5398180 - DNA, 21 bp, Homo sapiens
cctgtgctgaggactccctcc

SEQ ID NO: 5398181 - DNA, 20 bp, Homo sapiens
cctgtgctgatcctgctgac

SEQ ID NO: 5398182 - DNA, 14 bp, Homo sapiens
cctgtgctgcatgc

SEQ ID NO: 5398183 - DNA, 15 bp, Homo sapiens
cctgtgctgcatgcg

SEQ ID NO: 5398184 - DNA, 20 bp, Homo sapiens
cctgtgctgggccagtggct

SEQ ID NO: 5398185 - DNA, 14 bp, Homo sapiens
cctgtgctggtgtc

SEQ ID NO: 5398186 - DNA, 18 bp, Homo sapiens
cctgtgctggtgtcctga

SEQ ID NO: 5398187 - DNA, 12 bp, Homo sapiens
cctgtgctgtgg

SEQ ID NO: 5398188 - DNA, 20 bp, Homo sapiens
cctgtgctgtggcatagaca

SEQ ID NO: 5398189 - DNA, 22 bp, Homo sapiens
cctgtgcttcgggcccttccca

SEQ ID NO: 5398190 - DNA, 17 bp, Homo sapiens
cctgtgcttggaggcct

SEQ ID NO: 5398191 - DNA, 21 bp, Homo sapiens
cctgtgcttggaggcctcaga

SEQ ID NO: 5398192 - DNA, 12 bp, Homo sapiens
cctgtgctttgg

SEQ ID NO: 5398193 - DNA, 16 bp, Homo sapiens
cctgtggaaatatgca

SEQ ID NO: 5398194 - DNA, 19 bp, Homo sapiens
cctgtggaacataaaaagg

SEQ ID NO: 5398195 - DNA, 17 bp, Homo sapiens
cctgtggaagcatggct

SEQ ID NO: 5398196 - DNA, 19 bp, Homo sapiens
cctgtggaaggcagagaaa

SEQ ID NO: 5398197 - DNA, 16 bp, Homo sapiens
cctgtggaagggacta

SEQ ID NO: 5398198 - DNA, 24 bp, Homo sapiens
cctgtggaagggactaggagcact

SEQ ID NO: 5398199 - DNA, 21 bp, Homo sapiens
cctgtggaatgagtgtgcatg

SEQ ID NO: 5398200 - DNA, 17 bp, Homo sapiens
cctgtggaatgggctca

SEQ ID NO: 5398201 - DNA, 17 bp, Homo sapiens
cctgtggagacagccct

SEQ ID NO: 5398202 - DNA, 19 bp, Homo sapiens
cctgtggagacagccctgc

SEQ ID NO: 5398203 - DNA, 12 bp, Homo sapiens
cctgtggatatt

SEQ ID NO: 5398204 - DNA, 20 bp, Homo sapiens
cctgtggatgataaaacaca

SEQ ID NO: 5398205 - DNA, 17 bp, Homo sapiens
cctgtggatgggatcct

SEQ ID NO: 5398206 - DNA, 15 bp, Homo sapiens
cctgtggcacagccc

SEQ ID NO: 5398207 - DNA, 17 bp, Homo sapiens
cctgtggcacagccctg

SEQ ID NO: 5398208 - DNA, 18 bp, Homo sapiens
cctgtggcacagccctga

SEQ ID NO: 5398209 - DNA, 19 bp, Homo sapiens
cctgtggcactcagggagc

SEQ ID NO: 5398210 - DNA, 15 bp, Homo sapiens
cctgtggcagaccgg

SEQ ID NO: 5398211 - DNA, 16 bp, Homo sapiens
cctgtggcagaccggg

SEQ ID NO: 5398212 - DNA, 22 bp, Homo sapiens
cctgtggcagaccgggggccag

SEQ ID NO: 5398213 - DNA, 14 bp, Homo sapiens
cctgtggcagctgc

SEQ ID NO: 5398214 - DNA, 18 bp, Homo sapiens
cctgtggcagctgcccct

SEQ ID NO: 5398215 - DNA, 23 bp, Homo sapiens
cctgtggcagctgcccctggcac

SEQ ID NO: 5398216 - DNA, 18 bp, Homo sapiens
cctgtggcaggcagcgcc

SEQ ID NO: 5398217 - DNA, 19 bp, Homo sapiens
cctgtggcaggcagcgcca

SEQ ID NO: 5398218 - DNA, 14 bp, Homo sapiens
cctgtggcaggcct

SEQ ID NO: 5398219 - DNA, 15 bp, Homo sapiens
cctgtggcaggccta

SEQ ID NO: 5398220 - DNA, 18 bp, Homo sapiens
cctgtggcagtaaagaga

SEQ ID NO: 5398221 - DNA, 16 bp, Homo sapiens
cctgtggccaactgca

SEQ ID NO: 5398222 - DNA, 21 bp, Homo sapiens
cctgtggccagagcacctcag

SEQ ID NO: 5398223 - DNA, 15 bp, Homo sapiens
cctgtggccagcagc

SEQ ID NO: 5398224 - DNA, 12 bp, Homo sapiens
ccttaaacttcc

SEQ ID NO: 5398225 - DNA, 22 bp, Homo sapiens
ccttaaagagggacaggctgaa

SEQ ID NO: 5398226 - DNA, 22 bp, Homo sapiens
ccttaaagtcagtaacttaccc

SEQ ID NO: 5398227 - DNA, 12 bp, Homo sapiens
ccttaaatacac

SEQ ID NO: 5398228 - DNA, 21 bp, Homo sapiens
ccttaaatacactgaattgaa

SEQ ID NO: 5398229 - DNA, 14 bp, Homo sapiens
ccttaaatgaacta

SEQ ID NO: 5398230 - DNA, 20 bp, Homo sapiens
ccttaaatttttagccattt

SEQ ID NO: 5398231 - DNA, 22 bp, Homo sapiens
ccttaaatttttagccatttct

SEQ ID NO: 5398232 - DNA, 16 bp, Homo sapiens
ccttaacagttgtatt

SEQ ID NO: 5398233 - DNA, 15 bp, Homo sapiens
ccttaaccaataatg

SEQ ID NO: 5398234 - DNA, 14 bp, Homo sapiens
ccttaaccagtctc

SEQ ID NO: 5398235 - DNA, 18 bp, Homo sapiens
ccttaacccaaggagcac

SEQ ID NO: 5398236 - DNA, 15 bp, Homo sapiens
ccttaacccacctct

SEQ ID NO: 5398237 - DNA, 18 bp, Homo sapiens
ccttaacccacctctcct

SEQ ID NO: 5398238 - DNA, 14 bp, Homo sapiens
ccttaaccccaagg

SEQ ID NO: 5398239 - DNA, 16 bp, Homo sapiens
ccttaaccccaaggac

SEQ ID NO: 5398240 - DNA, 19 bp, Homo sapiens
ccttaactaagactcccgc

SEQ ID NO: 5398241 - DNA, 22 bp, Homo sapiens
ccttaactaagactcccgcccc

SEQ ID NO: 5398242 - DNA, 19 bp, Homo sapiens
ccttaactatcaccagtgc

SEQ ID NO: 5398243 - DNA, 18 bp, Homo sapiens
ccttaactctaaccctgt

SEQ ID NO: 5398244 - DNA, 16 bp, Homo sapiens
ccttaactgcatccag

SEQ ID NO: 5398245 - DNA, 14 bp, Homo sapiens
ccttaactggagcc

SEQ ID NO: 5398246 - DNA, 23 bp, Homo sapiens
ccttaactggagccccatcagct

SEQ ID NO: 5398247 - DNA, 14 bp, Homo sapiens
ccttaactggccct

SEQ ID NO: 5398248 - DNA, 15 bp, Homo sapiens
ccttaactggccctc

SEQ ID NO: 5398249 - DNA, 20 bp, Homo sapiens
ccttaactggccctcgggcc

SEQ ID NO: 5398250 - DNA, 21 bp, Homo sapiens
ccttaactggccctcgggccc

SEQ ID NO: 5398251 - DNA, 22 bp, Homo sapiens
ccttaactggccctcgggccct

SEQ ID NO: 5398252 - DNA, 21 bp, Homo sapiens
ccttaactttcccatggtcaa

SEQ ID NO: 5398253 - DNA, 12 bp, Homo sapiens
ccttaagaatga

SEQ ID NO: 5398254 - DNA, 20 bp, Homo sapiens
ccttaagaatgagtttctta

SEQ ID NO: 5398255 - DNA, 16 bp, Homo sapiens
ccttaagacactgtga

SEQ ID NO: 5398256 - DNA, 22 bp, Homo sapiens
ccttaagacctactgttctaaa

SEQ ID NO: 5398257 - DNA, 17 bp, Homo sapiens
ccttaagagtcatccag

SEQ ID NO: 5398258 - DNA, 18 bp, Homo sapiens
ccttaagatttttctttt

SEQ ID NO: 5398259 - DNA, 21 bp, Homo sapiens
ccttaagatttttcttttccg

SEQ ID NO: 5398260 - DNA, 18 bp, Homo sapiens
ccttaagcacaattaatt

SEQ ID NO: 5398261 - DNA, 17 bp, Homo sapiens
ccttaagcagaggaatt

SEQ ID NO: 5398262 - DNA, 20 bp, Homo sapiens
ccttaagccaatcatgtaat

SEQ ID NO: 5398263 - DNA, 13 bp, Homo sapiens
ccttaaggctctt

SEQ ID NO: 5398264 - DNA, 16 bp, Homo sapiens
ccttaaggctcttttg

SEQ ID NO: 5398265 - DNA, 22 bp, Homo sapiens
ccttaagggttgaaggcagtct

SEQ ID NO: 5398266 - DNA, 21 bp, Homo sapiens
ccttaagtccttaatgaagag

SEQ ID NO: 5398267 - DNA, 20 bp, Homo sapiens
ccttaataaaaatatatatt

SEQ ID NO: 5398268 - DNA, 18 bp, Homo sapiens
ccttaataaacgtccaca

SEQ ID NO: 5398269 - DNA, 12 bp, Homo sapiens
ccttaataaata

SEQ ID NO: 5398270 - DNA, 15 bp, Homo sapiens
ccttaatattattgg

SEQ ID NO: 5398271 - DNA, 19 bp, Homo sapiens
ccttaatattgaggctgca

SEQ ID NO: 5398272 - DNA, 12 bp, Homo sapiens
ccttaatatttc

SEQ ID NO: 5398273 - DNA, 19 bp, Homo sapiens
ccttaatatttcttcaaat

SEQ ID NO: 5398274 - DNA, 19 bp, Homo sapiens
ccttaatctaatctaaaag

SEQ ID NO: 5398275 - DNA, 14 bp, Homo sapiens
ccttaatctatgtg

SEQ ID NO: 5398276 - DNA, 13 bp, Homo sapiens
ccttaatcttgct

SEQ ID NO: 5398277 - DNA, 22 bp, Homo sapiens
ccttaatgaagagccagcccaa

SEQ ID NO: 5398278 - DNA, 17 bp, Homo sapiens
ccttaatgacaacactt

SEQ ID NO: 5398279 - DNA, 12 bp, Homo sapiens
ccttaatgagaa

SEQ ID NO: 5398280 - DNA, 12 bp, Homo sapiens
ccttaatggatg

SEQ ID NO: 5398281 - DNA, 18 bp, Homo sapiens
ccttaatggatgctcatt

SEQ ID NO: 5398282 - DNA, 19 bp, Homo sapiens
ccttaatggccttaattaa

SEQ ID NO: 5398283 - DNA, 21 bp, Homo sapiens
ccttaatgtcaccatgcttgt

SEQ ID NO: 5398284 - DNA, 13 bp, Homo sapiens
ccttaattattgc

SEQ ID NO: 5398285 - DNA, 20 bp, Homo sapiens
ccttaatttaactttccagt

SEQ ID NO: 5398286 - DNA, 22 bp, Homo sapiens
ccttaatttagaaactgaaaaa

SEQ ID NO: 5398287 - DNA, 12 bp, Homo sapiens
ccttaatttata

SEQ ID NO: 5398288 - DNA, 13 bp, Homo sapiens
ccttaatttcctt

SEQ ID NO: 5398289 - DNA, 14 bp, Homo sapiens
ccttacacaatggt

SEQ ID NO: 5398290 - DNA, 15 bp, Homo sapiens
ccttacacactcagg

SEQ ID NO: 5398291 - DNA, 19 bp, Homo sapiens
ccttacacccatgactgag

SEQ ID NO: 5398292 - DNA, 18 bp, Homo sapiens
ccttacacctcgttaggg

SEQ ID NO: 5398293 - DNA, 14 bp, Homo sapiens
ccttacagaaaatt

SEQ ID NO: 5398294 - DNA, 19 bp, Homo sapiens
ccttacagatatttttctc

SEQ ID NO: 5398295 - DNA, 18 bp, Homo sapiens
ccttacagcctctgactt

SEQ ID NO: 5398296 - DNA, 21 bp, Homo sapiens
ccttacagtaggagcccagct

SEQ ID NO: 5398297 - DNA, 20 bp, Homo sapiens
ccttacagttatcctgcaag

SEQ ID NO: 5398298 - DNA, 18 bp, Homo sapiens
ccttacatcttttctaat

SEQ ID NO: 5398299 - DNA, 14 bp, Homo sapiens
ccttacattaaaaa

SEQ ID NO: 5398300 - DNA, 12 bp, Homo sapiens
ccttaccaaaaa

SEQ ID NO: 5398301 - DNA, 17 bp, Homo sapiens
ccttaccaactttctgt

SEQ ID NO: 5398302 - DNA, 17 bp, Homo sapiens
ccttaccaagactcctg

SEQ ID NO: 5398303 - DNA, 16 bp, Homo sapiens
ccttaccaataataag

SEQ ID NO: 5398304 - DNA, 22 bp, Homo sapiens
ccttaccagagacgcccagccc

SEQ ID NO: 5398305 - DNA, 23 bp, Homo sapiens
ccttaccagagacgcccagcccc

SEQ ID NO: 5398306 - DNA, 16 bp, Homo sapiens
ccttaccagcagagca

SEQ ID NO: 5398307 - DNA, 17 bp, Homo sapiens
ccttacccatcttgctt

SEQ ID NO: 5398308 - DNA, 19 bp, Homo sapiens
ccttaccccaaagagaaag

SEQ ID NO: 5398309 - DNA, 16 bp, Homo sapiens
ccttaccccttagcct

SEQ ID NO: 5398310 - DNA, 16 bp, Homo sapiens
ccttaccctactggct

SEQ ID NO: 5398311 - DNA, 17 bp, Homo sapiens
ccttaccctactggctg

SEQ ID NO: 5398312 - DNA, 15 bp, Homo sapiens
ccttacccttagaat

SEQ ID NO: 5398313 - DNA, 15 bp, Homo sapiens
ccttacctatttcct

SEQ ID NO: 5398314 - DNA, 20 bp, Homo sapiens
ccttacctcctgcccaggag

SEQ ID NO: 5398315 - DNA, 16 bp, Homo sapiens
ccttacctctggaacc

SEQ ID NO: 5398316 - DNA, 14 bp, Homo sapiens
ccttacctgccagg

SEQ ID NO: 5398317 - DNA, 12 bp, Homo sapiens
ccttacctggaa

SEQ ID NO: 5398318 - DNA, 17 bp, Homo sapiens
ccttacctgtctctctc

SEQ ID NO: 5398319 - DNA, 14 bp, Homo sapiens
ccttacctttacat

SEQ ID NO: 5398320 - DNA, 14 bp, Homo sapiens
ccttacctttttat

SEQ ID NO: 5398321 - DNA, 19 bp, Homo sapiens
ccttacgacactttggttt

SEQ ID NO: 5398322 - DNA, 23 bp, Homo sapiens
ccttacgatcaggcacaggtcag

SEQ ID NO: 5398323 - DNA, 17 bp, Homo sapiens
ccttacgtgagaaatag

SEQ ID NO: 5398324 - DNA, 14 bp, Homo sapiens
ccttactaaatatg

SEQ ID NO: 5398325 - DNA, 22 bp, Homo sapiens
ccttactacttcttggaaaaaa

SEQ ID NO: 5398326 - DNA, 13 bp, Homo sapiens
ccttactagaaat

SEQ ID NO: 5398327 - DNA, 14 bp, Homo sapiens
ccttactagaaata

SEQ ID NO: 5398328 - DNA, 12 bp, Homo sapiens
ccttactcacct

SEQ ID NO: 5398329 - DNA, 15 bp, Homo sapiens
ccttactcagagctg

SEQ ID NO: 5398330 - DNA, 20 bp, Homo sapiens
ccttactcagagctgcgggc

SEQ ID NO: 5398331 - DNA, 16 bp, Homo sapiens
ccttactcccaggcac

SEQ ID NO: 5398332 - DNA, 14 bp, Homo sapiens
ccttactccctatc

SEQ ID NO: 5398333 - DNA, 14 bp, Homo sapiens
ccttactcctgtgg

SEQ ID NO: 5398334 - DNA, 19 bp, Homo sapiens
ccttactcctgtgggagcc

SEQ ID NO: 5398335 - DNA, 23 bp, Homo sapiens
ccttactgacctcacctaggaag

SEQ ID NO: 5398336 - DNA, 13 bp, Homo sapiens
ccttactggctta

SEQ ID NO: 5398337 - DNA, 18 bp, Homo sapiens
ccttactggcttacctcc

SEQ ID NO: 5398338 - DNA, 19 bp, Homo sapiens
ccttactggtttccccagg

SEQ ID NO: 5398339 - DNA, 16 bp, Homo sapiens
ccttactgtctcactc

SEQ ID NO: 5398340 - DNA, 14 bp, Homo sapiens
ccttacttccagca

SEQ ID NO: 5398341 - DNA, 21 bp, Homo sapiens
ccttacttccagcaagcaaag

SEQ ID NO: 5398342 - DNA, 12 bp, Homo sapiens
ccttacttcctg

SEQ ID NO: 5398343 - DNA, 19 bp, Homo sapiens
ccttacttcctggcctctt

SEQ ID NO: 5398344 - DNA, 21 bp, Homo sapiens
ccttacttcggttcctctgat

SEQ ID NO: 5398345 - DNA, 14 bp, Homo sapiens
ccttacttgcactg

SEQ ID NO: 5398346 - DNA, 19 bp, Homo sapiens
ccttactttaaccctttct

SEQ ID NO: 5398347 - DNA, 15 bp, Homo sapiens
ccttactttttatat

SEQ ID NO: 5398348 - DNA, 17 bp, Homo sapiens
ccttagaaaaaaaaaga

SEQ ID NO: 5398349 - DNA, 20 bp, Homo sapiens
ccttagaaaagactgacctt

SEQ ID NO: 5398350 - DNA, 21 bp, Homo sapiens
ccttagaaatcattgtagaaa

SEQ ID NO: 5398351 - DNA, 14 bp, Homo sapiens
ccttagaacctttc

SEQ ID NO: 5398352 - DNA, 19 bp, Homo sapiens
ccttagaagatctgcttcc

SEQ ID NO: 5398353 - DNA, 12 bp, Homo sapiens
ccttagaatgtg

SEQ ID NO: 5398354 - DNA, 15 bp, Homo sapiens
ccttagacagaggcc

SEQ ID NO: 5398355 - DNA, 17 bp, Homo sapiens
ccttagacagaggccct

SEQ ID NO: 5398356 - DNA, 22 bp, Homo sapiens
ccttagacagaggccctcaagt

SEQ ID NO: 5398357 - DNA, 21 bp, Homo sapiens
ccttagacagtccctgccaat

SEQ ID NO: 5398358 - DNA, 15 bp, Homo sapiens
ccttagaccaccaag

SEQ ID NO: 5398359 - DNA, 16 bp, Homo sapiens
ccttagaccaccaagc

SEQ ID NO: 5398360 - DNA, 18 bp, Homo sapiens
ccttagaccaggcaggca

SEQ ID NO: 5398361 - DNA, 19 bp, Homo sapiens
ccttagacccgccaggtca

SEQ ID NO: 5398362 - DNA, 18 bp, Homo sapiens
ccttagacggaggtgcct

SEQ ID NO: 5398363 - DNA, 17 bp, Homo sapiens
ccttagagattgcccca

SEQ ID NO: 5398364 - DNA, 22 bp, Homo sapiens
ccttagagcatctctgcctcca

SEQ ID NO: 5398365 - DNA, 14 bp, Homo sapiens
ccttagagctcttg

SEQ ID NO: 5398366 - DNA, 15 bp, Homo sapiens
ccttagagtgctgtg

SEQ ID NO: 5398367 - DNA, 19 bp, Homo sapiens
ccttagatgtgtctcctgt

SEQ ID NO: 5398368 - DNA, 19 bp, Homo sapiens
ccttagatttagtagtgta

SEQ ID NO: 5398369 - DNA, 20 bp, Homo sapiens
ccttagatttagtagtgtaa

SEQ ID NO: 5398370 - DNA, 16 bp, Homo sapiens
ccttagcacagagagg

SEQ ID NO: 5398371 - DNA, 18 bp, Homo sapiens
ccttagcacagagaggga

SEQ ID NO: 5398372 - DNA, 18 bp, Homo sapiens
ccttagcagccctggatg

SEQ ID NO: 5398373 - DNA, 16 bp, Homo sapiens
ccttagcagctcaggc

SEQ ID NO: 5398374 - DNA, 14 bp, Homo sapiens
ccttagcagcttct

SEQ ID NO: 5398375 - DNA, 23 bp, Homo sapiens
ccttagcatgtgttgcagctgtc

SEQ ID NO: 5398376 - DNA, 16 bp, Homo sapiens
ccttagcatgtttgct

SEQ ID NO: 5398377 - DNA, 18 bp, Homo sapiens
ccttagcctccagcaccc

SEQ ID NO: 5398378 - DNA, 13 bp, Homo sapiens
ccttagcctctcc

SEQ ID NO: 5398379 - DNA, 14 bp, Homo sapiens
ccttagcctggacc

SEQ ID NO: 5398380 - DNA, 17 bp, Homo sapiens
ccttagcctggacctct

SEQ ID NO: 5398381 - DNA, 16 bp, Homo sapiens
ccttagccttgctgta

SEQ ID NO: 5398382 - DNA, 17 bp, Homo sapiens
ccttagcgttctggact

SEQ ID NO: 5398383 - DNA, 21 bp, Homo sapiens
ccttagctacaatcctacctt

SEQ ID NO: 5398384 - DNA, 21 bp, Homo sapiens
ccttagctatttatccctttc

SEQ ID NO: 5398385 - DNA, 19 bp, Homo sapiens
ccttagctccctcccgcac

SEQ ID NO: 5398386 - DNA, 18 bp, Homo sapiens
ccttagctcccttgagct

SEQ ID NO: 5398387 - DNA, 13 bp, Homo sapiens
ccttagctgccaa

SEQ ID NO: 5398388 - DNA, 20 bp, Homo sapiens
ccttagctgccaagccccat

SEQ ID NO: 5398389 - DNA, 19 bp, Homo sapiens
ccttagctggcattacagc

SEQ ID NO: 5398390 - DNA, 22 bp, Homo sapiens
ccttagctggcattacagctgg

SEQ ID NO: 5398391 - DNA, 18 bp, Homo sapiens
ccttagcttagacctcag

SEQ ID NO: 5398392 - DNA, 22 bp, Homo sapiens
ccttagcttagacctcagcctg

SEQ ID NO: 5398393 - DNA, 18 bp, Homo sapiens
ccttagcttcactcagct

SEQ ID NO: 5398394 - DNA, 16 bp, Homo sapiens
ccttagcttcaggaac

SEQ ID NO: 5398395 - DNA, 21 bp, Homo sapiens
ccttagcttttagcctggctg

SEQ ID NO: 5398396 - DNA, 19 bp, Homo sapiens
ccttaggaaaatgcttctg

SEQ ID NO: 5398397 - DNA, 23 bp, Homo sapiens
ccttaggaagagccttccaccca

SEQ ID NO: 5398398 - DNA, 20 bp, Homo sapiens
ccttaggaagtgacttgaat

SEQ ID NO: 5398399 - DNA, 18 bp, Homo sapiens
ccttaggaatactgtttt

SEQ ID NO: 5398400 - DNA, 17 bp, Homo sapiens
ccttaggaggccgaggc

SEQ ID NO: 5398401 - DNA, 22 bp, Homo sapiens
ccttaggatggggctcccagct

SEQ ID NO: 5398402 - DNA, 20 bp, Homo sapiens
ccttcccccagcccaataaa

SEQ ID NO: 5398403 - DNA, 17 bp, Homo sapiens
ccttcccccagcccatc

SEQ ID NO: 5398404 - DNA, 15 bp, Homo sapiens
ccttcccccagcttt

SEQ ID NO: 5398405 - DNA, 20 bp, Homo sapiens
ccttcccccatcccctttcc

SEQ ID NO: 5398406 - DNA, 18 bp, Homo sapiens
ccttcccccatccctacc

SEQ ID NO: 5398407 - DNA, 19 bp, Homo sapiens
ccttccccccatctctgag

SEQ ID NO: 5398408 - DNA, 17 bp, Homo sapiens
ccttccccctcccaggg

SEQ ID NO: 5398409 - DNA, 15 bp, Homo sapiens
ccttccccgtcccct

SEQ ID NO: 5398410 - DNA, 23 bp, Homo sapiens
ccttccccgtcccctgcagcctg

SEQ ID NO: 5398411 - DNA, 23 bp, Homo sapiens
ccttcccctcagccacacccagg

SEQ ID NO: 5398412 - DNA, 12 bp, Homo sapiens
ccttcccctccc

SEQ ID NO: 5398413 - DNA, 16 bp, Homo sapiens
ccttcccctcccctcc

SEQ ID NO: 5398414 - DNA, 22 bp, Homo sapiens
ccttcccctcccgacagcccat

SEQ ID NO: 5398415 - DNA, 22 bp, Homo sapiens
ccttcccctccctggctcccat

SEQ ID NO: 5398416 - DNA, 15 bp, Homo sapiens
ccttcccctccctgt

SEQ ID NO: 5398417 - DNA, 16 bp, Homo sapiens
ccttcccctccttctc

SEQ ID NO: 5398418 - DNA, 13 bp, Homo sapiens
ccttcccctgcac

SEQ ID NO: 5398419 - DNA, 22 bp, Homo sapiens
ccttcccctgcgccctccctcc

SEQ ID NO: 5398420 - DNA, 23 bp, Homo sapiens
ccttcccctgcgccctccctccc

SEQ ID NO: 5398421 - DNA, 12 bp, Homo sapiens
ccttcccctgct

SEQ ID NO: 5398422 - DNA, 14 bp, Homo sapiens
ccttcccctgctga

SEQ ID NO: 5398423 - DNA, 18 bp, Homo sapiens
ccttcccctgctgacctt

SEQ ID NO: 5398424 - DNA, 15 bp, Homo sapiens
ccttcccctgggaac

SEQ ID NO: 5398425 - DNA, 23 bp, Homo sapiens
ccttcccctgtcttcacctgcca

SEQ ID NO: 5398426 - DNA, 15 bp, Homo sapiens
ccttcccctgtgact

SEQ ID NO: 5398427 - DNA, 20 bp, Homo sapiens
ccttccccttatcctccctg

SEQ ID NO: 5398428 - DNA, 16 bp, Homo sapiens
ccttccccttccttct

SEQ ID NO: 5398429 - DNA, 17 bp, Homo sapiens
ccttccccttccttctt

SEQ ID NO: 5398430 - DNA, 17 bp, Homo sapiens
ccttccccttctgtgtc

SEQ ID NO: 5398431 - DNA, 18 bp, Homo sapiens
ccttccccttctgtgtca

SEQ ID NO: 5398432 - DNA, 20 bp, Homo sapiens
ccttccccttgtccctgggg

SEQ ID NO: 5398433 - DNA, 21 bp, Homo sapiens
ccttccccttgtccctggggc

SEQ ID NO: 5398434 - DNA, 21 bp, Homo sapiens
ccttcccctttactcagccca

SEQ ID NO: 5398435 - DNA, 19 bp, Homo sapiens
ccttccccttttgcctggc

SEQ ID NO: 5398436 - DNA, 16 bp, Homo sapiens
ccttcccgacccagcc

SEQ ID NO: 5398437 - DNA, 20 bp, Homo sapiens
ccttcccgccgcccgacccc

SEQ ID NO: 5398438 - DNA, 20 bp, Homo sapiens
ccttcccgccggaggccagc

SEQ ID NO: 5398439 - DNA, 13 bp, Homo sapiens
ccttcccgcctcg

SEQ ID NO: 5398440 - DNA, 14 bp, Homo sapiens
ccttcccgggcggg

SEQ ID NO: 5398441 - DNA, 19 bp, Homo sapiens
ccttcccggtccgcccgct

SEQ ID NO: 5398442 - DNA, 12 bp, Homo sapiens
ccttccctagct

SEQ ID NO: 5398443 - DNA, 15 bp, Homo sapiens
ccttccctagcttta

SEQ ID NO: 5398444 - DNA, 19 bp, Homo sapiens
ccttccctaggcacctctg

SEQ ID NO: 5398445 - DNA, 20 bp, Homo sapiens
ccttccctagttctttgcat

SEQ ID NO: 5398446 - DNA, 16 bp, Homo sapiens
ccttccctcaccccca

SEQ ID NO: 5398447 - DNA, 21 bp, Homo sapiens
ccttccctcacccccagcaca

SEQ ID NO: 5398448 - DNA, 21 bp, Homo sapiens
ccttccctcatgcccgccagt

SEQ ID NO: 5398449 - DNA, 18 bp, Homo sapiens
ccttccctccatagccac

SEQ ID NO: 5398450 - DNA, 14 bp, Homo sapiens
ccttccctcctgtg

SEQ ID NO: 5398451 - DNA, 16 bp, Homo sapiens
ccttccctcctgtgcc

SEQ ID NO: 5398452 - DNA, 12 bp, Homo sapiens
ccttccctcctt

SEQ ID NO: 5398453 - DNA, 14 bp, Homo sapiens
ccttccctcctttt

SEQ ID NO: 5398454 - DNA, 17 bp, Homo sapiens
ccttccctccttttaaa

SEQ ID NO: 5398455 - DNA, 14 bp, Homo sapiens
ccttccctctcctg

SEQ ID NO: 5398456 - DNA, 14 bp, Homo sapiens
ccttccctctctcc

SEQ ID NO: 5398457 - DNA, 15 bp, Homo sapiens
ccttccctctctgat

SEQ ID NO: 5398458 - DNA, 21 bp, Homo sapiens
ccttccctctctgatgtccca

SEQ ID NO: 5398459 - DNA, 14 bp, Homo sapiens
ccttccctctctgg

SEQ ID NO: 5398460 - DNA, 15 bp, Homo sapiens
ccttccctctctgga

SEQ ID NO: 5398461 - DNA, 11 bp, Homo sapiens
ccttccctctg

SEQ ID NO: 5398462 - DNA, 13 bp, Homo sapiens
ccttccctctggg

SEQ ID NO: 5398463 - DNA, 14 bp, Homo sapiens
ccttccctcttccc

SEQ ID NO: 5398464 - DNA, 10 bp, Homo sapiens
ccttccctgc

SEQ ID NO: 5398465 - DNA, 12 bp, Homo sapiens
ccttccctgcac

SEQ ID NO: 5398466 - DNA, 13 bp, Homo sapiens
ccttccctgcaga

SEQ ID NO: 5398467 - DNA, 17 bp, Homo sapiens
ccttccctgcctccagc

SEQ ID NO: 5398468 - DNA, 20 bp, Homo sapiens
ccttccctgctttgaggaca

SEQ ID NO: 5398469 - DNA, 14 bp, Homo sapiens
ccttccctggcagg

SEQ ID NO: 5398470 - DNA, 12 bp, Homo sapiens
ccttccctggcc

SEQ ID NO: 5398471 - DNA, 15 bp, Homo sapiens
ccttccctggccccg

SEQ ID NO: 5398472 - DNA, 14 bp, Homo sapiens
ccttccctggcctt

SEQ ID NO: 5398473 - DNA, 19 bp, Homo sapiens
ccttccctggctacttccc

SEQ ID NO: 5398474 - DNA, 24 bp, Homo sapiens
ccttccctggctacttcccttcct

SEQ ID NO: 5398475 - DNA, 15 bp, Homo sapiens
ccttccctgggctgt

SEQ ID NO: 5398476 - DNA, 15 bp, Homo sapiens
ccttccctggggagc

SEQ ID NO: 5398477 - DNA, 16 bp, Homo sapiens
ccttccctggggagcc

SEQ ID NO: 5398478 - DNA, 22 bp, Homo sapiens
ccttccctggggagccctcagg

SEQ ID NO: 5398479 - DNA, 23 bp, Homo sapiens
ccttccctggggagccctcaggc

SEQ ID NO: 5398480 - DNA, 24 bp, Homo sapiens
ccttccctggggagccctcaggct

SEQ ID NO: 5398481 - DNA, 20 bp, Homo sapiens
ccttccctgggtttgggagc

SEQ ID NO: 5398482 - DNA, 15 bp, Homo sapiens
ccttccctgtccctc

SEQ ID NO: 5398483 - DNA, 17 bp, Homo sapiens
ccttccctgtgcctcct

SEQ ID NO: 5398484 - DNA, 17 bp, Homo sapiens
ccttccctgtgtctttt

SEQ ID NO: 5398485 - DNA, 23 bp, Homo sapiens
ccttcccttccactgcctctgcc

SEQ ID NO: 5398486 - DNA, 15 bp, Homo sapiens
ccttcccttctcttg

SEQ ID NO: 5398487 - DNA, 22 bp, Homo sapiens
ccttcccttcttttcctgggtg

SEQ ID NO: 5398488 - DNA, 22 bp, Homo sapiens
ccttcccttgagatgagtttct

SEQ ID NO: 5398489 - DNA, 16 bp, Homo sapiens
ccttcccttggaggga

SEQ ID NO: 5398490 - DNA, 21 bp, Homo sapiens
ccttcccttggagggagaggt

SEQ ID NO: 5398491 - DNA, 19 bp, Homo sapiens
ccttccctttccttccccc

SEQ ID NO: 5398492 - DNA, 18 bp, Homo sapiens
ccttcccttttctgttct

SEQ ID NO: 5398493 - DNA, 16 bp, Homo sapiens
ccttccgacaccactg

SEQ ID NO: 5398494 - DNA, 17 bp, Homo sapiens
ccttccgacaccactgg

SEQ ID NO: 5398495 - DNA, 18 bp, Homo sapiens
ccttccgacaccactggg

SEQ ID NO: 5398496 - DNA, 19 bp, Homo sapiens
ccttccgaccctctgggaa

SEQ ID NO: 5398497 - DNA, 21 bp, Homo sapiens
ccttccgatgacagtgctcta

SEQ ID NO: 5398498 - DNA, 15 bp, Homo sapiens
ccttccgccaatctg

SEQ ID NO: 5398499 - DNA, 14 bp, Homo sapiens
ccttccgccactgg

SEQ ID NO: 5398500 - DNA, 16 bp, Homo sapiens
ccttccgccactgggg

SEQ ID NO: 5398501 - DNA, 22 bp, Homo sapiens
ccttccgccactggggctcaga

SEQ ID NO: 5398502 - DNA, 19 bp, Homo sapiens
ccttccgccccttcccttc

SEQ ID NO: 5398503 - DNA, 17 bp, Homo sapiens
ccttccgctcccaccag

SEQ ID NO: 5398504 - DNA, 18 bp, Homo sapiens
ccttccgctcctttacct

SEQ ID NO: 5398505 - DNA, 12 bp, Homo sapiens
ccttccgctctg

SEQ ID NO: 5398506 - DNA, 15 bp, Homo sapiens
ccttccgctctgagg

SEQ ID NO: 5398507 - DNA, 15 bp, Homo sapiens
ccttccgtccatccc

SEQ ID NO: 5398508 - DNA, 20 bp, Homo sapiens
ccttccgtgggtcatcccag

SEQ ID NO: 5398509 - DNA, 23 bp, Homo sapiens
ccttcctaagcctgtggctgtgg

SEQ ID NO: 5398510 - DNA, 19 bp, Homo sapiens
ccttcctaattccacagct

SEQ ID NO: 5398511 - DNA, 20 bp, Homo sapiens
ccttcctaattccacagctg

SEQ ID NO: 5398512 - DNA, 16 bp, Homo sapiens
ccttcctacagatagt

SEQ ID NO: 5398513 - DNA, 20 bp, Homo sapiens
ccttcctactttgcttctct

SEQ ID NO: 5398514 - DNA, 20 bp, Homo sapiens
ccttcctagtgaaccacagg

SEQ ID NO: 5398515 - DNA, 23 bp, Homo sapiens
ccttcctataacttgatgcatgt

SEQ ID NO: 5398516 - DNA, 15 bp, Homo sapiens
ccttcctatgcccag

SEQ ID NO: 5398517 - DNA, 16 bp, Homo sapiens
ccttcctatgcccagg

SEQ ID NO: 5398518 - DNA, 21 bp, Homo sapiens
ccttcctattccaagcttcca

SEQ ID NO: 5398519 - DNA, 18 bp, Homo sapiens
ccttcctattctcctgcc

SEQ ID NO: 5398520 - DNA, 20 bp, Homo sapiens
ccttcctattctcctgccat

SEQ ID NO: 5398521 - DNA, 18 bp, Homo sapiens
ccttcctcagaatagtga

SEQ ID NO: 5398522 - DNA, 16 bp, Homo sapiens
ccttcctcagcaggcc

SEQ ID NO: 5398523 - DNA, 15 bp, Homo sapiens
ccttcctcagcctcc

SEQ ID NO: 5398524 - DNA, 15 bp, Homo sapiens
ccttcctcagcctgg

SEQ ID NO: 5398525 - DNA, 18 bp, Homo sapiens
ccttcctcagcctggggt

SEQ ID NO: 5398526 - DNA, 16 bp, Homo sapiens
ccttcctcagctgcct

SEQ ID NO: 5398527 - DNA, 17 bp, Homo sapiens
ccttcctcagtcctgga

SEQ ID NO: 5398528 - DNA, 18 bp, Homo sapiens
ccttcctcagtcctggaa

SEQ ID NO: 5398529 - DNA, 19 bp, Homo sapiens
ccttcctcatccaccccat

SEQ ID NO: 5398530 - DNA, 16 bp, Homo sapiens
ccttcctcatctgtgc

SEQ ID NO: 5398531 - DNA, 20 bp, Homo sapiens
ccttcctcatctgtgcctgt

SEQ ID NO: 5398532 - DNA, 23 bp, Homo sapiens
ccttcctcatctgtgcctgtctg

SEQ ID NO: 5398533 - DNA, 14 bp, Homo sapiens
ccttcctccaggag

SEQ ID NO: 5398534 - DNA, 14 bp, Homo sapiens
ccttcctccatcct

SEQ ID NO: 5398535 - DNA, 23 bp, Homo sapiens
ccttcctccatcctcctccttcc

SEQ ID NO: 5398536 - DNA, 12 bp, Homo sapiens
ccttcctcccca

SEQ ID NO: 5398537 - DNA, 20 bp, Homo sapiens
ccttcctccccacactccac

SEQ ID NO: 5398538 - DNA, 21 bp, Homo sapiens
ccttcctccccacactccact

SEQ ID NO: 5398539 - DNA, 18 bp, Homo sapiens
ccttcctccccgcctcct

SEQ ID NO: 5398540 - DNA, 15 bp, Homo sapiens
ccttcctcccggggc

SEQ ID NO: 5398541 - DNA, 14 bp, Homo sapiens
ccttcctcctccac

SEQ ID NO: 5398542 - DNA, 15 bp, Homo sapiens
ccttcctcctccaca

SEQ ID NO: 5398543 - DNA, 16 bp, Homo sapiens
ccttcctcctccacag

SEQ ID NO: 5398544 - DNA, 15 bp, Homo sapiens
ccttcctcctctcaa

SEQ ID NO: 5398545 - DNA, 20 bp, Homo sapiens
ccttcctcctgaagcctctg

SEQ ID NO: 5398546 - DNA, 13 bp, Homo sapiens
ccttcctcctgca

SEQ ID NO: 5398547 - DNA, 13 bp, Homo sapiens
ccttcctcctgcc

SEQ ID NO: 5398548 - DNA, 15 bp, Homo sapiens
ccttcctcctgcctt

SEQ ID NO: 5398549 - DNA, 12 bp, Homo sapiens
ccttcctcctgg

SEQ ID NO: 5398550 - DNA, 13 bp, Homo sapiens
ccttcctcctggg

SEQ ID NO: 5398551 - DNA, 17 bp, Homo sapiens
ccttcctcggtggctct

SEQ ID NO: 5398552 - DNA, 18 bp, Homo sapiens
ccttcctcgtgcagagct

SEQ ID NO: 5398553 - DNA, 21 bp, Homo sapiens
ccttcctcgtgcagagctggg

SEQ ID NO: 5398554 - DNA, 13 bp, Homo sapiens
ccttcctctcact

SEQ ID NO: 5398555 - DNA, 22 bp, Homo sapiens
ccttcctctcatccttttctcc

SEQ ID NO: 5398556 - DNA, 14 bp, Homo sapiens
ccttcctctccact

SEQ ID NO: 5398557 - DNA, 21 bp, Homo sapiens
ccttcctctccactgccttcg

SEQ ID NO: 5398558 - DNA, 17 bp, Homo sapiens
ccttcctctctccagat

SEQ ID NO: 5398559 - DNA, 17 bp, Homo sapiens
ccttcctctctctacca

SEQ ID NO: 5398560 - DNA, 12 bp, Homo sapiens
ccttcctctgag

SEQ ID NO: 5398561 - DNA, 15 bp, Homo sapiens
ccttcctctgagcct

SEQ ID NO: 5398562 - DNA, 13 bp, Homo sapiens
ccttcctctgagg

SEQ ID NO: 5398563 - DNA, 14 bp, Homo sapiens
ccttcctctggggc

SEQ ID NO: 5398564 - DNA, 15 bp, Homo sapiens
ccttcctctggggct

SEQ ID NO: 5398565 - DNA, 14 bp, Homo sapiens
ccttcctctgtcct

SEQ ID NO: 5398566 - DNA, 18 bp, Homo sapiens
ccttcctcttcctgccct

SEQ ID NO: 5398567 - DNA, 14 bp, Homo sapiens
ccttcctcttcggc

SEQ ID NO: 5398568 - DNA, 14 bp, Homo sapiens
ccttcctctttcca

SEQ ID NO: 5398569 - DNA, 20 bp, Homo sapiens
ccttcctcttttccttccca

SEQ ID NO: 5398570 - DNA, 23 bp, Homo sapiens
ccttcctgagaaacgtccatctc

SEQ ID NO: 5398571 - DNA, 17 bp, Homo sapiens
ccttcctgagacctcgc

SEQ ID NO: 5398572 - DNA, 21 bp, Homo sapiens
ccttcctgagtcccttccagt

SEQ ID NO: 5398573 - DNA, 14 bp, Homo sapiens
ccttcctgcagacc

SEQ ID NO: 5398574 - DNA, 19 bp, Homo sapiens
ccttcctgcagacctggct

SEQ ID NO: 5398575 - DNA, 16 bp, Homo sapiens
ccttcctgcagtctcc

SEQ ID NO: 5398576 - DNA, 14 bp, Homo sapiens
ccttcctgccaagc

SEQ ID NO: 5398577 - DNA, 14 bp, Homo sapiens
ccttcctgccctgt

SEQ ID NO: 5398578 - DNA, 19 bp, Homo sapiens
ccttcctgccctgtacctc

SEQ ID NO: 5398579 - DNA, 14 bp, Homo sapiens
ccttcctgctgctg

SEQ ID NO: 5398580 - DNA, 16 bp, Homo sapiens
ccttcctgctgctgct

SEQ ID NO: 5398581 - DNA, 15 bp, Homo sapiens
ccttctttttctgga

SEQ ID NO: 5398582 - DNA, 14 bp, Homo sapiens
ccttctttttcttc

SEQ ID NO: 5398583 - DNA, 16 bp, Homo sapiens
ccttctttttcttctt

SEQ ID NO: 5398584 - DNA, 17 bp, Homo sapiens
ccttcttttttgtctca

SEQ ID NO: 5398585 - DNA, 19 bp, Homo sapiens
ccttgaaaaacaagtcttt

SEQ ID NO: 5398586 - DNA, 20 bp, Homo sapiens
ccttgaaaaatgacaattgt

SEQ ID NO: 5398587 - DNA, 11 bp, Homo sapiens
ccttgaaaaca

SEQ ID NO: 5398588 - DNA, 22 bp, Homo sapiens
ccttgaaaacactgttctctgc

SEQ ID NO: 5398589 - DNA, 20 bp, Homo sapiens
ccttgaaaactttatgctaa

SEQ ID NO: 5398590 - DNA, 21 bp, Homo sapiens
ccttgaaaataagaatagaaa

SEQ ID NO: 5398591 - DNA, 19 bp, Homo sapiens
ccttgaaactttgggaaaa

SEQ ID NO: 5398592 - DNA, 13 bp, Homo sapiens
ccttgaaaggaag

SEQ ID NO: 5398593 - DNA, 22 bp, Homo sapiens
ccttgaaaggcaggaagggaag

SEQ ID NO: 5398594 - DNA, 18 bp, Homo sapiens
ccttgaacaatcaaggca

SEQ ID NO: 5398595 - DNA, 13 bp, Homo sapiens
ccttgaacactgg

SEQ ID NO: 5398596 - DNA, 16 bp, Homo sapiens
ccttgaaccacttccc

SEQ ID NO: 5398597 - DNA, 14 bp, Homo sapiens
ccttgaacccaaca

SEQ ID NO: 5398598 - DNA, 17 bp, Homo sapiens
ccttgaacctcattaaa

SEQ ID NO: 5398599 - DNA, 15 bp, Homo sapiens
ccttgaacctgtgag

SEQ ID NO: 5398600 - DNA, 18 bp, Homo sapiens
ccttgaacctgtgagtaa

SEQ ID NO: 5398601 - DNA, 19 bp, Homo sapiens
ccttgaactgtggccacct

SEQ ID NO: 5398602 - DNA, 17 bp, Homo sapiens
ccttgaactttgacctc

SEQ ID NO: 5398603 - DNA, 19 bp, Homo sapiens
ccttgaactttgacctctg

SEQ ID NO: 5398604 - DNA, 17 bp, Homo sapiens
ccttgaagaacctctca

SEQ ID NO: 5398605 - DNA, 18 bp, Homo sapiens
ccttgaagaacctctcac

SEQ ID NO: 5398606 - DNA, 21 bp, Homo sapiens
ccttgaagaactgcaggccct

SEQ ID NO: 5398607 - DNA, 23 bp, Homo sapiens
ccttgaagaaggggctgttcttc

SEQ ID NO: 5398608 - DNA, 17 bp, Homo sapiens
ccttgaagacagagcaa

SEQ ID NO: 5398609 - DNA, 19 bp, Homo sapiens
ccttgaagaggggaggggc

SEQ ID NO: 5398610 - DNA, 17 bp, Homo sapiens
ccttgaagatgtagctt

SEQ ID NO: 5398611 - DNA, 18 bp, Homo sapiens
ccttgaagatgtagcttc

SEQ ID NO: 5398612 - DNA, 15 bp, Homo sapiens
ccttgaagcaaatgt

SEQ ID NO: 5398613 - DNA, 13 bp, Homo sapiens
ccttgaagcaata

SEQ ID NO: 5398614 - DNA, 22 bp, Homo sapiens
ccttgaagcaataactccaagc

SEQ ID NO: 5398615 - DNA, 18 bp, Homo sapiens
ccttgaatgctgccagtg

SEQ ID NO: 5398616 - DNA, 14 bp, Homo sapiens
ccttgaattgtcta

SEQ ID NO: 5398617 - DNA, 14 bp, Homo sapiens
ccttgacacctgct

SEQ ID NO: 5398618 - DNA, 17 bp, Homo sapiens
ccttgacagagcagcta

SEQ ID NO: 5398619 - DNA, 17 bp, Homo sapiens
ccttgacagggcacacc

SEQ ID NO: 5398620 - DNA, 16 bp, Homo sapiens
ccttgaccactggccc

SEQ ID NO: 5398621 - DNA, 23 bp, Homo sapiens
ccttgaccagcagatcccagctc

SEQ ID NO: 5398622 - DNA, 19 bp, Homo sapiens
ccttgaccattctccacct

SEQ ID NO: 5398623 - DNA, 20 bp, Homo sapiens
ccttgaccattctccacctg

SEQ ID NO: 5398624 - DNA, 17 bp, Homo sapiens
ccttgaccccacacgcc

SEQ ID NO: 5398625 - DNA, 22 bp, Homo sapiens
ccttgaccttcctctggggctc

SEQ ID NO: 5398626 - DNA, 14 bp, Homo sapiens
ccttgacctttgta

SEQ ID NO: 5398627 - DNA, 20 bp, Homo sapiens
ccttgactatgtctagagcc

SEQ ID NO: 5398628 - DNA, 13 bp, Homo sapiens
ccttgactctttc

SEQ ID NO: 5398629 - DNA, 21 bp, Homo sapiens
ccttgactggacctggtggct

SEQ ID NO: 5398630 - DNA, 20 bp, Homo sapiens
ccttgactgtacagagactc

SEQ ID NO: 5398631 - DNA, 24 bp, Homo sapiens
ccttgactgtctagccactccctc

SEQ ID NO: 5398632 - DNA, 12 bp, Homo sapiens
ccttgactgtta

SEQ ID NO: 5398633 - DNA, 16 bp, Homo sapiens
ccttgacttagattct

SEQ ID NO: 5398634 - DNA, 14 bp, Homo sapiens
ccttgacttatggc

SEQ ID NO: 5398635 - DNA, 17 bp, Homo sapiens
ccttgacttatggctcg

SEQ ID NO: 5398636 - DNA, 14 bp, Homo sapiens
ccttgacttgccat

SEQ ID NO: 5398637 - DNA, 21 bp, Homo sapiens
ccttgagaatgagggcgtgaa

SEQ ID NO: 5398638 - DNA, 18 bp, Homo sapiens
ccttgagaattccctgtg

SEQ ID NO: 5398639 - DNA, 11 bp, Homo sapiens
ccttgagacca

SEQ ID NO: 5398640 - DNA, 21 bp, Homo sapiens
ccttgagaccaagccggtgcc

SEQ ID NO: 5398641 - DNA, 17 bp, Homo sapiens
ccttgagaccctcttct

SEQ ID NO: 5398642 - DNA, 19 bp, Homo sapiens
ccttgagaccctcttctct

SEQ ID NO: 5398643 - DNA, 21 bp, Homo sapiens
ccttgagaccctcttctctgg

SEQ ID NO: 5398644 - DNA, 18 bp, Homo sapiens
ccttgagacctcagccat

SEQ ID NO: 5398645 - DNA, 18 bp, Homo sapiens
ccttgagactggagctgg

SEQ ID NO: 5398646 - DNA, 18 bp, Homo sapiens
ccttgagagaccaggcaa

SEQ ID NO: 5398647 - DNA, 16 bp, Homo sapiens
ccttgagaggcatgac

SEQ ID NO: 5398648 - DNA, 20 bp, Homo sapiens
ccttgagaggcatgacagct

SEQ ID NO: 5398649 - DNA, 21 bp, Homo sapiens
ccttgagaggcatgacagctg

SEQ ID NO: 5398650 - DNA, 12 bp, Homo sapiens
ccttgagatgag

SEQ ID NO: 5398651 - DNA, 20 bp, Homo sapiens
ccttgagattctgaagtatg

SEQ ID NO: 5398652 - DNA, 14 bp, Homo sapiens
ccttgagcaccagc

SEQ ID NO: 5398653 - DNA, 17 bp, Homo sapiens
ccttgagcagaatacaa

SEQ ID NO: 5398654 - DNA, 12 bp, Homo sapiens
ccttgagcatct

SEQ ID NO: 5398655 - DNA, 13 bp, Homo sapiens
ccttgagcatctg

SEQ ID NO: 5398656 - DNA, 23 bp, Homo sapiens
ccttgagccaggtggatgtttac

SEQ ID NO: 5398657 - DNA, 11 bp, Homo sapiens
ccttgagccct

SEQ ID NO: 5398658 - DNA, 20 bp, Homo sapiens
ccttgagccctccccaggaa

SEQ ID NO: 5398659 - DNA, 13 bp, Homo sapiens
ccttgagccctgg

SEQ ID NO: 5398660 - DNA, 16 bp, Homo sapiens
ccttgagccctggctg

SEQ ID NO: 5398661 - DNA, 17 bp, Homo sapiens
ccttgagccctggctgt

SEQ ID NO: 5398662 - DNA, 18 bp, Homo sapiens
ccttgagccgtgacctcc

SEQ ID NO: 5398663 - DNA, 18 bp, Homo sapiens
ccttgaggaaacaacagc

SEQ ID NO: 5398664 - DNA, 22 bp, Homo sapiens
ccttgaggacctccacctggga

SEQ ID NO: 5398665 - DNA, 23 bp, Homo sapiens
ccttgaggattgtggaaaaccag

SEQ ID NO: 5398666 - DNA, 11 bp, Homo sapiens
ccttgagggag

SEQ ID NO: 5398667 - DNA, 16 bp, Homo sapiens
ccttgagggctgcagt

SEQ ID NO: 5398668 - DNA, 22 bp, Homo sapiens
ccttgaggggagccaggagggg

SEQ ID NO: 5398669 - DNA, 20 bp, Homo sapiens
ccttgaggggcagtttggga

SEQ ID NO: 5398670 - DNA, 16 bp, Homo sapiens
ccttgaggggccccag

SEQ ID NO: 5398671 - DNA, 21 bp, Homo sapiens
ccttgagggtgcttgttccct

SEQ ID NO: 5398672 - DNA, 18 bp, Homo sapiens
ccttgagtaggccctgct

SEQ ID NO: 5398673 - DNA, 15 bp, Homo sapiens
ccttgagtggggcag

SEQ ID NO: 5398674 - DNA, 17 bp, Homo sapiens
ccttgagttaacaggac

SEQ ID NO: 5398675 - DNA, 18 bp, Homo sapiens
ccttgagttaacaggaca

SEQ ID NO: 5398676 - DNA, 22 bp, Homo sapiens
ccttgagttgattcagctctgc

SEQ ID NO: 5398677 - DNA, 23 bp, Homo sapiens
ccttgagttgattcagctctgca

SEQ ID NO: 5398678 - DNA, 18 bp, Homo sapiens
ccttgataaatatatatg

SEQ ID NO: 5398679 - DNA, 16 bp, Homo sapiens
ccttgataatacttga

SEQ ID NO: 5398680 - DNA, 17 bp, Homo sapiens
ccttgataatacttgac

SEQ ID NO: 5398681 - DNA, 22 bp, Homo sapiens
ccttgatataaaaaatctttag

SEQ ID NO: 5398682 - DNA, 15 bp, Homo sapiens
ccttgatattctcca

SEQ ID NO: 5398683 - DNA, 15 bp, Homo sapiens
ccttgatatttttct

SEQ ID NO: 5398684 - DNA, 18 bp, Homo sapiens
ccttgatcagccccaccc

SEQ ID NO: 5398685 - DNA, 14 bp, Homo sapiens
ccttgatcagtgac

SEQ ID NO: 5398686 - DNA, 14 bp, Homo sapiens
ccttgatgaagaag

SEQ ID NO: 5398687 - DNA, 16 bp, Homo sapiens
ccttgatgaagcccgt

SEQ ID NO: 5398688 - DNA, 19 bp, Homo sapiens
ccttgatgaagcctgtgcc

SEQ ID NO: 5398689 - DNA, 22 bp, Homo sapiens
ccttgatgaagcctgtgccacc

SEQ ID NO: 5398690 - DNA, 16 bp, Homo sapiens
ccttgatgactgcctt

SEQ ID NO: 5398691 - DNA, 17 bp, Homo sapiens
ccttgatgactgccttg

SEQ ID NO: 5398692 - DNA, 16 bp, Homo sapiens
ccttgatggagaagga

SEQ ID NO: 5398693 - DNA, 18 bp, Homo sapiens
ccttgatgggtgctgccc

SEQ ID NO: 5398694 - DNA, 22 bp, Homo sapiens
ccttgatgggtgctgccctcag

SEQ ID NO: 5398695 - DNA, 21 bp, Homo sapiens
ccttgattcaaataaccctga

SEQ ID NO: 5398696 - DNA, 19 bp, Homo sapiens
ccttgattcccttgttatt

SEQ ID NO: 5398697 - DNA, 13 bp, Homo sapiens
ccttgattggaag

SEQ ID NO: 5398698 - DNA, 22 bp, Homo sapiens
ccttgattggaagggcttttca

SEQ ID NO: 5398699 - DNA, 18 bp, Homo sapiens
ccttgatttgttcttaca

SEQ ID NO: 5398700 - DNA, 21 bp, Homo sapiens
ccttgattttagccttctctg

SEQ ID NO: 5398701 - DNA, 14 bp, Homo sapiens
ccttgcaaagcaac

SEQ ID NO: 5398702 - DNA, 16 bp, Homo sapiens
ccttgcaacacacaga

SEQ ID NO: 5398703 - DNA, 21 bp, Homo sapiens
ccttgcaaccaggcagctgag

SEQ ID NO: 5398704 - DNA, 12 bp, Homo sapiens
ccttgcaagcca

SEQ ID NO: 5398705 - DNA, 21 bp, Homo sapiens
ccttgcaagccataacgtgcc

SEQ ID NO: 5398706 - DNA, 22 bp, Homo sapiens
ccttgcaagccataacgtgccc

SEQ ID NO: 5398707 - DNA, 19 bp, Homo sapiens
ccttgcacaaaaagcacaa

SEQ ID NO: 5398708 - DNA, 17 bp, Homo sapiens
ccttgcacacatcatct

SEQ ID NO: 5398709 - DNA, 15 bp, Homo sapiens
ccttgcacacccact

SEQ ID NO: 5398710 - DNA, 20 bp, Homo sapiens
ccttgcacacccactgcccc

SEQ ID NO: 5398711 - DNA, 22 bp, Homo sapiens
ccttgcacactcccctgcactg

SEQ ID NO: 5398712 - DNA, 21 bp, Homo sapiens
ccttgcacagcccacacatga

SEQ ID NO: 5398713 - DNA, 17 bp, Homo sapiens
ccttgcacagctggaga

SEQ ID NO: 5398714 - DNA, 19 bp, Homo sapiens
ccttgcacagctggagaaa

SEQ ID NO: 5398715 - DNA, 14 bp, Homo sapiens
ccttgcacaggcca

SEQ ID NO: 5398716 - DNA, 17 bp, Homo sapiens
ccttgcacccctcactc

SEQ ID NO: 5398717 - DNA, 18 bp, Homo sapiens
ccttgcacccctcactct

SEQ ID NO: 5398718 - DNA, 12 bp, Homo sapiens
ccttgcactgta

SEQ ID NO: 5398719 - DNA, 21 bp, Homo sapiens
ccttgcagcactcacacagga

SEQ ID NO: 5398720 - DNA, 21 bp, Homo sapiens
ccttgcagcagggctgggcct

SEQ ID NO: 5398721 - DNA, 15 bp, Homo sapiens
ccttgcagccacatg

SEQ ID NO: 5398722 - DNA, 16 bp, Homo sapiens
ccttgcagcctggtca

SEQ ID NO: 5398723 - DNA, 12 bp, Homo sapiens
ccttgcagctgg

SEQ ID NO: 5398724 - DNA, 18 bp, Homo sapiens
ccttgcaggggtcccccc

SEQ ID NO: 5398725 - DNA, 19 bp, Homo sapiens
ccttgcaggggtcccccct

SEQ ID NO: 5398726 - DNA, 13 bp, Homo sapiens
ccttgcagggtgg

SEQ ID NO: 5398727 - DNA, 21 bp, Homo sapiens
ccttgcagggtgggtgagctc

SEQ ID NO: 5398728 - DNA, 11 bp, Homo sapiens
ccttgcatcaa

SEQ ID NO: 5398729 - DNA, 23 bp, Homo sapiens
ccttgcatgtacttgaaggatgg

SEQ ID NO: 5398730 - DNA, 14 bp, Homo sapiens
ccttgcattagaaa

SEQ ID NO: 5398731 - DNA, 12 bp, Homo sapiens
ccttgcatttgt

SEQ ID NO: 5398732 - DNA, 21 bp, Homo sapiens
ccttgcattttagctaattta

SEQ ID NO: 5398733 - DNA, 23 bp, Homo sapiens
ccttgccaaattccatgtccctg

SEQ ID NO: 5398734 - DNA, 14 bp, Homo sapiens
ccttgccaaggccg

SEQ ID NO: 5398735 - DNA, 19 bp, Homo sapiens
ccttgccaaggccgcccac

SEQ ID NO: 5398736 - DNA, 22 bp, Homo sapiens
ccttgccaaggccgcccacctg

SEQ ID NO: 5398737 - DNA, 22 bp, Homo sapiens
ccttgccacaatcactaaatat

SEQ ID NO: 5398738 - DNA, 13 bp, Homo sapiens
ccttgccacactc

SEQ ID NO: 5398739 - DNA, 22 bp, Homo sapiens
ccttgccacatcgcagcccctg

SEQ ID NO: 5398740 - DNA, 17 bp, Homo sapiens
ccttgccaccccaccct

SEQ ID NO: 5398741 - DNA, 15 bp, Homo sapiens
ccttgccactttgca

SEQ ID NO: 5398742 - DNA, 19 bp, Homo sapiens
ccttgccagctgctgagcc

SEQ ID NO: 5398743 - DNA, 20 bp, Homo sapiens
ccttgccagctgctgagccg

SEQ ID NO: 5398744 - DNA, 22 bp, Homo sapiens
ccttgccagggaggtggaagga

SEQ ID NO: 5398745 - DNA, 18 bp, Homo sapiens
ccttgccagggcagggtc

SEQ ID NO: 5398746 - DNA, 19 bp, Homo sapiens
ccttgccaggtccctttca

SEQ ID NO: 5398747 - DNA, 12 bp, Homo sapiens
ccttgccagttt

SEQ ID NO: 5398748 - DNA, 14 bp, Homo sapiens
ccttgccagttttc

SEQ ID NO: 5398749 - DNA, 16 bp, Homo sapiens
ccttgcccaactccca

SEQ ID NO: 5398750 - DNA, 18 bp, Homo sapiens
ccttgcccaactcccagc

SEQ ID NO: 5398751 - DNA, 20 bp, Homo sapiens
ccttgcccaactcccagcca

SEQ ID NO: 5398752 - DNA, 15 bp, Homo sapiens
ccttgcccacaggtg

SEQ ID NO: 5398753 - DNA, 18 bp, Homo sapiens
ccttgcccactcctgctc

SEQ ID NO: 5398754 - DNA, 20 bp, Homo sapiens
ccttgcccactcctgctctg

SEQ ID NO: 5398755 - DNA, 21 bp, Homo sapiens
ccttgcccactcctgctctgc

SEQ ID NO: 5398756 - DNA, 20 bp, Homo sapiens
ccttgcccagactacagggc

SEQ ID NO: 5398757 - DNA, 19 bp, Homo sapiens
ccttgcccagagatgcctc

SEQ ID NO: 5398758 - DNA, 19 bp, Homo sapiens
ccttggattaggagaacag

SEQ ID NO: 5398759 - DNA, 15 bp, Homo sapiens
ccttggattttcctg

SEQ ID NO: 5398760 - DNA, 14 bp, Homo sapiens
ccttggatttttga

SEQ ID NO: 5398761 - DNA, 15 bp, Homo sapiens
ccttggcaactttct

SEQ ID NO: 5398762 - DNA, 14 bp, Homo sapiens
ccttggcaccaaag

SEQ ID NO: 5398763 - DNA, 15 bp, Homo sapiens
ccttggcaccagaca

SEQ ID NO: 5398764 - DNA, 18 bp, Homo sapiens
ccttggcacccccatgct

SEQ ID NO: 5398765 - DNA, 21 bp, Homo sapiens
ccttggcacccccatgctgcc

SEQ ID NO: 5398766 - DNA, 21 bp, Homo sapiens
ccttggcacgaggggggccag

SEQ ID NO: 5398767 - DNA, 22 bp, Homo sapiens
ccttggcactgtggaactgcca

SEQ ID NO: 5398768 - DNA, 19 bp, Homo sapiens
ccttggcaggtcctggcca

SEQ ID NO: 5398769 - DNA, 16 bp, Homo sapiens
ccttggcagtgtccca

SEQ ID NO: 5398770 - DNA, 17 bp, Homo sapiens
ccttggcatgccttcca

SEQ ID NO: 5398771 - DNA, 16 bp, Homo sapiens
ccttggcatgggcgca

SEQ ID NO: 5398772 - DNA, 23 bp, Homo sapiens
ccttggcatgggcgcaggcccag

SEQ ID NO: 5398773 - DNA, 15 bp, Homo sapiens
ccttggccacagact

SEQ ID NO: 5398774 - DNA, 15 bp, Homo sapiens
ccttggccacggcct

SEQ ID NO: 5398775 - DNA, 20 bp, Homo sapiens
ccttggccacggcctgggag

SEQ ID NO: 5398776 - DNA, 22 bp, Homo sapiens
ccttggcccacctgaggcccca

SEQ ID NO: 5398777 - DNA, 15 bp, Homo sapiens
ccttggcccagcagc

SEQ ID NO: 5398778 - DNA, 22 bp, Homo sapiens
ccttggcccagcagcggcccag

SEQ ID NO: 5398779 - DNA, 14 bp, Homo sapiens
ccttggcccaggag

SEQ ID NO: 5398780 - DNA, 17 bp, Homo sapiens
ccttggcccaggagctc

SEQ ID NO: 5398781 - DNA, 13 bp, Homo sapiens
ccttggccccaga

SEQ ID NO: 5398782 - DNA, 23 bp, Homo sapiens
ccttggccccccaaagtgctggg

SEQ ID NO: 5398783 - DNA, 21 bp, Homo sapiens
ccttggccccctttcccgggc

SEQ ID NO: 5398784 - DNA, 13 bp, Homo sapiens
ccttggcccctct

SEQ ID NO: 5398785 - DNA, 19 bp, Homo sapiens
ccttggccctacagccctg

SEQ ID NO: 5398786 - DNA, 19 bp, Homo sapiens
ccttggccggctgtgctca

SEQ ID NO: 5398787 - DNA, 23 bp, Homo sapiens
ccttggccggctgtgctcagaga

SEQ ID NO: 5398788 - DNA, 15 bp, Homo sapiens
ccttggcctagccca

SEQ ID NO: 5398789 - DNA, 20 bp, Homo sapiens
ccttggcctagcccaccctg

SEQ ID NO: 5398790 - DNA, 23 bp, Homo sapiens
ccttggcctagcccaccctgctg

SEQ ID NO: 5398791 - DNA, 14 bp, Homo sapiens
ccttggcctcagaa

SEQ ID NO: 5398792 - DNA, 24 bp, Homo sapiens
ccttggcctccatttctgtctcta

SEQ ID NO: 5398793 - DNA, 20 bp, Homo sapiens
ccttggcctcccaaagtgct

SEQ ID NO: 5398794 - DNA, 24 bp, Homo sapiens
ccttggcctcccaaagtgctggga

SEQ ID NO: 5398795 - DNA, 16 bp, Homo sapiens
ccttggcctctttcct

SEQ ID NO: 5398796 - DNA, 15 bp, Homo sapiens
ccttggcctgacctg

SEQ ID NO: 5398797 - DNA, 18 bp, Homo sapiens
ccttggcctgacctggca

SEQ ID NO: 5398798 - DNA, 14 bp, Homo sapiens
ccttggcctggagc

SEQ ID NO: 5398799 - DNA, 12 bp, Homo sapiens
ccttggccttct

SEQ ID NO: 5398800 - DNA, 21 bp, Homo sapiens
ccttggccttgcagctggccc

SEQ ID NO: 5398801 - DNA, 22 bp, Homo sapiens
ccttggccttgcagctggccca

SEQ ID NO: 5398802 - DNA, 20 bp, Homo sapiens
ccttggcctttcctggaagc

SEQ ID NO: 5398803 - DNA, 21 bp, Homo sapiens
ccttggcgagggcagcagggt

SEQ ID NO: 5398804 - DNA, 15 bp, Homo sapiens
ccttggcgggcagcc

SEQ ID NO: 5398805 - DNA, 19 bp, Homo sapiens
ccttggcgtgtgtccctgt

SEQ ID NO: 5398806 - DNA, 18 bp, Homo sapiens
ccttggctcaatcctcta

SEQ ID NO: 5398807 - DNA, 16 bp, Homo sapiens
ccttggctcccggggg

SEQ ID NO: 5398808 - DNA, 16 bp, Homo sapiens
ccttggctgaattaaa

SEQ ID NO: 5398809 - DNA, 22 bp, Homo sapiens
ccttggctgcagccatcccgct

SEQ ID NO: 5398810 - DNA, 14 bp, Homo sapiens
ccttggctggtgca

SEQ ID NO: 5398811 - DNA, 15 bp, Homo sapiens
ccttggcttctgctt

SEQ ID NO: 5398812 - DNA, 16 bp, Homo sapiens
ccttggcttctgcttc

SEQ ID NO: 5398813 - DNA, 17 bp, Homo sapiens
ccttggcttctgtgatg

SEQ ID NO: 5398814 - DNA, 13 bp, Homo sapiens
ccttggcttgccc

SEQ ID NO: 5398815 - DNA, 15 bp, Homo sapiens
ccttggcttgcccac

SEQ ID NO: 5398816 - DNA, 18 bp, Homo sapiens
ccttggcttgcctggtgg

SEQ ID NO: 5398817 - DNA, 18 bp, Homo sapiens
ccttggcttggccctggc

SEQ ID NO: 5398818 - DNA, 19 bp, Homo sapiens
ccttggcttggccctggca

SEQ ID NO: 5398819 - DNA, 22 bp, Homo sapiens
ccttggctttatgcaaatacaa

SEQ ID NO: 5398820 - DNA, 17 bp, Homo sapiens
ccttggctttgaggccg

SEQ ID NO: 5398821 - DNA, 14 bp, Homo sapiens
ccttgggaaggaca

SEQ ID NO: 5398822 - DNA, 12 bp, Homo sapiens
ccttgggacccc

SEQ ID NO: 5398823 - DNA, 11 bp, Homo sapiens
ccttgggacct

SEQ ID NO: 5398824 - DNA, 15 bp, Homo sapiens
ccttgggagccactg

SEQ ID NO: 5398825 - DNA, 20 bp, Homo sapiens
ccttgggagccactgccact

SEQ ID NO: 5398826 - DNA, 21 bp, Homo sapiens
ccttgggagccactgccactc

SEQ ID NO: 5398827 - DNA, 22 bp, Homo sapiens
ccttgggaggaagcagaataaa

SEQ ID NO: 5398828 - DNA, 23 bp, Homo sapiens
ccttgggaggttttattctgact

SEQ ID NO: 5398829 - DNA, 22 bp, Homo sapiens
ccttgggagtcattaccacgcc

SEQ ID NO: 5398830 - DNA, 17 bp, Homo sapiens
ccttgggatgggcacag

SEQ ID NO: 5398831 - DNA, 22 bp, Homo sapiens
ccttgggatggggagtcccaaa

SEQ ID NO: 5398832 - DNA, 14 bp, Homo sapiens
ccttgggcacggga

SEQ ID NO: 5398833 - DNA, 21 bp, Homo sapiens
ccttgggcagagtcctgcctt

SEQ ID NO: 5398834 - DNA, 18 bp, Homo sapiens
ccttgggcatccacccag

SEQ ID NO: 5398835 - DNA, 22 bp, Homo sapiens
ccttgggcatccacccagtgct

SEQ ID NO: 5398836 - DNA, 17 bp, Homo sapiens
ccttgggccctttgagt

SEQ ID NO: 5398837 - DNA, 14 bp, Homo sapiens
ccttgggcctccca

SEQ ID NO: 5398838 - DNA, 16 bp, Homo sapiens
ccttgggcctcccact

SEQ ID NO: 5398839 - DNA, 17 bp, Homo sapiens
ccttgggcctcccactc

SEQ ID NO: 5398840 - DNA, 23 bp, Homo sapiens
ccttgggcctcccactcccatgg

SEQ ID NO: 5398841 - DNA, 15 bp, Homo sapiens
ccttgggcctggcca

SEQ ID NO: 5398842 - DNA, 16 bp, Homo sapiens
ccttgggcctggccag

SEQ ID NO: 5398843 - DNA, 21 bp, Homo sapiens
ccttgggcctggccagtcttc

SEQ ID NO: 5398844 - DNA, 20 bp, Homo sapiens
ccttgggcctgggcctctgc

SEQ ID NO: 5398845 - DNA, 22 bp, Homo sapiens
ccttgggcctgggcctctgccc

SEQ ID NO: 5398846 - DNA, 11 bp, Homo sapiens
ccttgggcctt

SEQ ID NO: 5398847 - DNA, 16 bp, Homo sapiens
ccttgggcctttcagt

SEQ ID NO: 5398848 - DNA, 18 bp, Homo sapiens
ccttgggcggctgagagc

SEQ ID NO: 5398849 - DNA, 20 bp, Homo sapiens
ccttgggcgtctcccccaga

SEQ ID NO: 5398850 - DNA, 12 bp, Homo sapiens
ccttgggctccc

SEQ ID NO: 5398851 - DNA, 13 bp, Homo sapiens
ccttgggctccct

SEQ ID NO: 5398852 - DNA, 13 bp, Homo sapiens
ccttgggctcctg

SEQ ID NO: 5398853 - DNA, 14 bp, Homo sapiens
ccttgggctcctgg

SEQ ID NO: 5398854 - DNA, 16 bp, Homo sapiens
ccttgggctcctggct

SEQ ID NO: 5398855 - DNA, 19 bp, Homo sapiens
ccttgggctcctggctgcc

SEQ ID NO: 5398856 - DNA, 20 bp, Homo sapiens
ccttgggctctgatgaaaaa

SEQ ID NO: 5398857 - DNA, 16 bp, Homo sapiens
ccttgggctctgctga

SEQ ID NO: 5398858 - DNA, 17 bp, Homo sapiens
ccttgggctgctcctca

SEQ ID NO: 5398859 - DNA, 22 bp, Homo sapiens
ccttggggaaccccgagctggg

SEQ ID NO: 5398860 - DNA, 14 bp, Homo sapiens
ccttggggagcagg

SEQ ID NO: 5398861 - DNA, 23 bp, Homo sapiens
ccttggggaggacaaaacttctt

SEQ ID NO: 5398862 - DNA, 22 bp, Homo sapiens
ccttggggattcttccatctga

SEQ ID NO: 5398863 - DNA, 17 bp, Homo sapiens
ccttggggccagactgg

SEQ ID NO: 5398864 - DNA, 21 bp, Homo sapiens
ccttggggccagactggctgc

SEQ ID NO: 5398865 - DNA, 13 bp, Homo sapiens
ccttggggcctgg

SEQ ID NO: 5398866 - DNA, 14 bp, Homo sapiens
ccttggggcctggc

SEQ ID NO: 5398867 - DNA, 22 bp, Homo sapiens
ccttggggcctggcttgctcca

SEQ ID NO: 5398868 - DNA, 18 bp, Homo sapiens
ccttgggggggctgcctt

SEQ ID NO: 5398869 - DNA, 16 bp, Homo sapiens
ccttgggggtctgctc

SEQ ID NO: 5398870 - DNA, 23 bp, Homo sapiens
ccttggggtaagccagagcctgg

SEQ ID NO: 5398871 - DNA, 19 bp, Homo sapiens
ccttggggtggcgcgcctg

SEQ ID NO: 5398872 - DNA, 23 bp, Homo sapiens
ccttggggtggcgcgcctgcctt

SEQ ID NO: 5398873 - DNA, 21 bp, Homo sapiens
ccttggggtgggggccaggcc

SEQ ID NO: 5398874 - DNA, 19 bp, Homo sapiens
ccttgggtagtgagcagtg

SEQ ID NO: 5398875 - DNA, 18 bp, Homo sapiens
ccttgggtcattgacctc

SEQ ID NO: 5398876 - DNA, 19 bp, Homo sapiens
ccttgggtcattgacctct

SEQ ID NO: 5398877 - DNA, 22 bp, Homo sapiens
ccttgggtcattgacctctcag

SEQ ID NO: 5398878 - DNA, 16 bp, Homo sapiens
ccttgggtctgtgtca

SEQ ID NO: 5398879 - DNA, 18 bp, Homo sapiens
ccttgggtgttccacctg

SEQ ID NO: 5398880 - DNA, 18 bp, Homo sapiens
ccttgggttgctggttgg

SEQ ID NO: 5398881 - DNA, 21 bp, Homo sapiens
ccttgggttgctggttggatt

SEQ ID NO: 5398882 - DNA, 21 bp, Homo sapiens
ccttggtaattatatctgttt

SEQ ID NO: 5398883 - DNA, 18 bp, Homo sapiens
ccttggtatgtgccaggc

SEQ ID NO: 5398884 - DNA, 18 bp, Homo sapiens
ccttggtccctctcagat

SEQ ID NO: 5398885 - DNA, 14 bp, Homo sapiens
ccttggtctaactt

SEQ ID NO: 5398886 - DNA, 19 bp, Homo sapiens
ccttggtctcatgccccgc

SEQ ID NO: 5398887 - DNA, 22 bp, Homo sapiens
ccttggtctctccttcctcttg

SEQ ID NO: 5398888 - DNA, 21 bp, Homo sapiens
ccttggtctttgtatcttcca

SEQ ID NO: 5398889 - DNA, 19 bp, Homo sapiens
ccttggtgaacacacacgc

SEQ ID NO: 5398890 - DNA, 20 bp, Homo sapiens
ccttggtgattaaggtcctg

SEQ ID NO: 5398891 - DNA, 20 bp, Homo sapiens
ccttggtgattccgcagtga

SEQ ID NO: 5398892 - DNA, 22 bp, Homo sapiens
ccttggtgccctcgcctcctcc

SEQ ID NO: 5398893 - DNA, 12 bp, Homo sapiens
ccttggtgcctc

SEQ ID NO: 5398894 - DNA, 15 bp, Homo sapiens
ccttggtgcctctgg

SEQ ID NO: 5398895 - DNA, 20 bp, Homo sapiens
ccttggtgctgtgtgcccca

SEQ ID NO: 5398896 - DNA, 23 bp, Homo sapiens
ccttggtgctgtgtgccccactc

SEQ ID NO: 5398897 - DNA, 21 bp, Homo sapiens
ccttggtggagcagccagagc

SEQ ID NO: 5398898 - DNA, 15 bp, Homo sapiens
ccttggtggcaagag

SEQ ID NO: 5398899 - DNA, 17 bp, Homo sapiens
ccttggtgtccacctgg

SEQ ID NO: 5398900 - DNA, 19 bp, Homo sapiens
ccttggtgtccacctggcc

SEQ ID NO: 5398901 - DNA, 15 bp, Homo sapiens
ccttggtgtttccct

SEQ ID NO: 5398902 - DNA, 22 bp, Homo sapiens
ccttggttaggcattgtgggaa

SEQ ID NO: 5398903 - DNA, 14 bp, Homo sapiens
ccttggttatcaaa

SEQ ID NO: 5398904 - DNA, 19 bp, Homo sapiens
ccttggttcatgcttctac

SEQ ID NO: 5398905 - DNA, 15 bp, Homo sapiens
ccttggttcctccag

SEQ ID NO: 5398906 - DNA, 17 bp, Homo sapiens
ccttggtttctgggggc

SEQ ID NO: 5398907 - DNA, 23 bp, Homo sapiens
ccttggtttgatttctagtatct

SEQ ID NO: 5398908 - DNA, 16 bp, Homo sapiens
ccttggttttgcctct

SEQ ID NO: 5398909 - DNA, 21 bp, Homo sapiens
ccttggttttgcctctttaaa

SEQ ID NO: 5398910 - DNA, 21 bp, Homo sapiens
ccttggtttttactgctctga

SEQ ID NO: 5398911 - DNA, 11 bp, Homo sapiens
ccttgtaaaaa

SEQ ID NO: 5398912 - DNA, 14 bp, Homo sapiens
ccttgtaagttatt

SEQ ID NO: 5398913 - DNA, 21 bp, Homo sapiens
ccttgtaatgtaactgctctt

SEQ ID NO: 5398914 - DNA, 22 bp, Homo sapiens
ccttgtacagaaccagcactcc

SEQ ID NO: 5398915 - DNA, 15 bp, Homo sapiens
ccttgtacagtctgc

SEQ ID NO: 5398916 - DNA, 16 bp, Homo sapiens
ccttgtacagtgtctg

SEQ ID NO: 5398917 - DNA, 14 bp, Homo sapiens
ccttgtaccccatc

SEQ ID NO: 5398918 - DNA, 21 bp, Homo sapiens
ccttgtaccccatcccttcct

SEQ ID NO: 5398919 - DNA, 21 bp, Homo sapiens
ccttgtagacgcacctgctga

SEQ ID NO: 5398920 - DNA, 19 bp, Homo sapiens
ccttgtagaggagcagggt

SEQ ID NO: 5398921 - DNA, 14 bp, Homo sapiens
ccttgtagctcctc

SEQ ID NO: 5398922 - DNA, 22 bp, Homo sapiens
ccttgtataaggagctttgctc

SEQ ID NO: 5398923 - DNA, 18 bp, Homo sapiens
ccttgtataatattgaaa

SEQ ID NO: 5398924 - DNA, 17 bp, Homo sapiens
ccttgtatcccctgcag

SEQ ID NO: 5398925 - DNA, 19 bp, Homo sapiens
ccttgtatgaataaaaggc

SEQ ID NO: 5398926 - DNA, 20 bp, Homo sapiens
ccttgtattctgaggatgtt

SEQ ID NO: 5398927 - DNA, 19 bp, Homo sapiens
ccttgtattgaagttaact

SEQ ID NO: 5398928 - DNA, 16 bp, Homo sapiens
ccttgtattttgttaa

SEQ ID NO: 5398929 - DNA, 20 bp, Homo sapiens
ccttgtattttgttaaagct

SEQ ID NO: 5398930 - DNA, 22 bp, Homo sapiens
ccttgtcaacaaagtgcttttt

SEQ ID NO: 5398931 - DNA, 21 bp, Homo sapiens
ccttgtcaggacccaggccgc

SEQ ID NO: 5398932 - DNA, 18 bp, Homo sapiens
ccttgtcagggtctcctt

SEQ ID NO: 5398933 - DNA, 13 bp, Homo sapiens
cctttgtttcttg

SEQ ID NO: 5398934 - DNA, 14 bp, Homo sapiens
cctttgtttcttgt

SEQ ID NO: 5398935 - DNA, 23 bp, Homo sapiens
cctttgttttgatgtttgtggcc

SEQ ID NO: 5398936 - DNA, 19 bp, Homo sapiens
cctttgtttttatgaagaa

SEQ ID NO: 5398937 - DNA, 18 bp, Homo sapiens
ccttttaaagaagcttta

SEQ ID NO: 5398938 - DNA, 17 bp, Homo sapiens
ccttttaaatggcatga

SEQ ID NO: 5398939 - DNA, 15 bp, Homo sapiens
ccttttaacattttg

SEQ ID NO: 5398940 - DNA, 20 bp, Homo sapiens
ccttttaacattttgttctt

SEQ ID NO: 5398941 - DNA, 13 bp, Homo sapiens
ccttttaatcaga

SEQ ID NO: 5398942 - DNA, 13 bp, Homo sapiens
ccttttacagctc

SEQ ID NO: 5398943 - DNA, 19 bp, Homo sapiens
ccttttacattgtgactgt

SEQ ID NO: 5398944 - DNA, 18 bp, Homo sapiens
ccttttaccattttatct

SEQ ID NO: 5398945 - DNA, 11 bp, Homo sapiens
ccttttactgg

SEQ ID NO: 5398946 - DNA, 13 bp, Homo sapiens
ccttttagaaacc

SEQ ID NO: 5398947 - DNA, 20 bp, Homo sapiens
ccttttagaaacctcattgg

SEQ ID NO: 5398948 - DNA, 21 bp, Homo sapiens
ccttttagcctagttcatcca

SEQ ID NO: 5398949 - DNA, 22 bp, Homo sapiens
ccttttagtttgatcagacagc

SEQ ID NO: 5398950 - DNA, 22 bp, Homo sapiens
ccttttataggtgagaaaaaaa

SEQ ID NO: 5398951 - DNA, 11 bp, Homo sapiens
ccttttatata

SEQ ID NO: 5398952 - DNA, 20 bp, Homo sapiens
ccttttatcaataaagcact

SEQ ID NO: 5398953 - DNA, 15 bp, Homo sapiens
ccttttatctgcaga

SEQ ID NO: 5398954 - DNA, 14 bp, Homo sapiens
ccttttatcttcta

SEQ ID NO: 5398955 - DNA, 22 bp, Homo sapiens
ccttttatgtagtaattgacat

SEQ ID NO: 5398956 - DNA, 14 bp, Homo sapiens
ccttttatttataa

SEQ ID NO: 5398957 - DNA, 13 bp, Homo sapiens
ccttttatttctt

SEQ ID NO: 5398958 - DNA, 18 bp, Homo sapiens
ccttttatttcttcacca

SEQ ID NO: 5398959 - DNA, 18 bp, Homo sapiens
ccttttcaaatgcagcaa

SEQ ID NO: 5398960 - DNA, 15 bp, Homo sapiens
ccttttcactacacc

SEQ ID NO: 5398961 - DNA, 16 bp, Homo sapiens
ccttttcagataatga

SEQ ID NO: 5398962 - DNA, 15 bp, Homo sapiens
ccttttcagcccttt

SEQ ID NO: 5398963 - DNA, 18 bp, Homo sapiens
ccttttcagccctttgct

SEQ ID NO: 5398964 - DNA, 20 bp, Homo sapiens
ccttttcagctgagccctgg

SEQ ID NO: 5398965 - DNA, 20 bp, Homo sapiens
ccttttcagcttctgctggg

SEQ ID NO: 5398966 - DNA, 14 bp, Homo sapiens
ccttttcaggaaaa

SEQ ID NO: 5398967 - DNA, 18 bp, Homo sapiens
ccttttcagggctggctc

SEQ ID NO: 5398968 - DNA, 16 bp, Homo sapiens
ccttttcatctgttgt

SEQ ID NO: 5398969 - DNA, 16 bp, Homo sapiens
ccttttcattctcctc

SEQ ID NO: 5398970 - DNA, 12 bp, Homo sapiens
ccttttcattta

SEQ ID NO: 5398971 - DNA, 20 bp, Homo sapiens
ccttttccagaaatacctgt

SEQ ID NO: 5398972 - DNA, 12 bp, Homo sapiens
ccttttccatgc

SEQ ID NO: 5398973 - DNA, 19 bp, Homo sapiens
ccttttcccctacagaatt

SEQ ID NO: 5398974 - DNA, 16 bp, Homo sapiens
ccttttcccggggagg

SEQ ID NO: 5398975 - DNA, 15 bp, Homo sapiens
ccttttccctgcttc

SEQ ID NO: 5398976 - DNA, 15 bp, Homo sapiens
ccttttccgttctgt

SEQ ID NO: 5398977 - DNA, 10 bp, Homo sapiens
ccttttccta

SEQ ID NO: 5398978 - DNA, 13 bp, Homo sapiens
ccttttcctatcc

SEQ ID NO: 5398979 - DNA, 11 bp, Homo sapiens
ccttttcctgt

SEQ ID NO: 5398980 - DNA, 10 bp, Homo sapiens
ccttttcctt

SEQ ID NO: 5398981 - DNA, 21 bp, Homo sapiens
ccttttccttagctgtaaaat

SEQ ID NO: 5398982 - DNA, 12 bp, Homo sapiens
ccttttcctttt

SEQ ID NO: 5398983 - DNA, 19 bp, Homo sapiens
ccttttcgccccctgcctg

SEQ ID NO: 5398984 - DNA, 17 bp, Homo sapiens
ccttttcgcctttcctc

SEQ ID NO: 5398985 - DNA, 15 bp, Homo sapiens
ccttttcgtttagaa

SEQ ID NO: 5398986 - DNA, 18 bp, Homo sapiens
ccttttctaaaaagtcaa

SEQ ID NO: 5398987 - DNA, 22 bp, Homo sapiens
ccttttctataagttgtaccaa

SEQ ID NO: 5398988 - DNA, 13 bp, Homo sapiens
ccttttctatgtt

SEQ ID NO: 5398989 - DNA, 14 bp, Homo sapiens
ccttttctatgttg

SEQ ID NO: 5398990 - DNA, 15 bp, Homo sapiens
ccttttctattcctt

SEQ ID NO: 5398991 - DNA, 18 bp, Homo sapiens
ccttttctcctatcttca

SEQ ID NO: 5398992 - DNA, 18 bp, Homo sapiens
ccttttctcctctttgaa

SEQ ID NO: 5398993 - DNA, 17 bp, Homo sapiens
ccttttctctcacccat

SEQ ID NO: 5398994 - DNA, 14 bp, Homo sapiens
ccttttctctccca

SEQ ID NO: 5398995 - DNA, 15 bp, Homo sapiens
ccttttctctcccat

SEQ ID NO: 5398996 - DNA, 19 bp, Homo sapiens
ccttttctctcctgtgtgc

SEQ ID NO: 5398997 - DNA, 12 bp, Homo sapiens
ccttttctgacc

SEQ ID NO: 5398998 - DNA, 15 bp, Homo sapiens
ccttttctggcaccg

SEQ ID NO: 5398999 - DNA, 14 bp, Homo sapiens
ccttttctggtccc

SEQ ID NO: 5399000 - DNA, 20 bp, Homo sapiens
ccttttctggtgttacacat

SEQ ID NO: 5399001 - DNA, 12 bp, Homo sapiens
ccttttctgtga

SEQ ID NO: 5399002 - DNA, 13 bp, Homo sapiens
ccttttctgtgtt

SEQ ID NO: 5399003 - DNA, 14 bp, Homo sapiens
ccttttctgtgttt

SEQ ID NO: 5399004 - DNA, 14 bp, Homo sapiens
ccttttctgttcta

SEQ ID NO: 5399005 - DNA, 12 bp, Homo sapiens
ccttttctgttt

SEQ ID NO: 5399006 - DNA, 12 bp, Homo sapiens
ccttttcttata

SEQ ID NO: 5399007 - DNA, 15 bp, Homo sapiens
ccttttcttccttct

SEQ ID NO: 5399008 - DNA, 18 bp, Homo sapiens
ccttttcttctagctttg

SEQ ID NO: 5399009 - DNA, 21 bp, Homo sapiens
ccttttcttctagctttgttg

SEQ ID NO: 5399010 - DNA, 17 bp, Homo sapiens
ccttttcttgtttatca

SEQ ID NO: 5399011 - DNA, 20 bp, Homo sapiens
ccttttctttaagttttatt

SEQ ID NO: 5399012 - DNA, 14 bp, Homo sapiens
ccttttctttttcc

SEQ ID NO: 5399013 - DNA, 22 bp, Homo sapiens
ccttttctttttcccttgaact

SEQ ID NO: 5399014 - DNA, 16 bp, Homo sapiens
ccttttgacacagttg

SEQ ID NO: 5399015 - DNA, 21 bp, Homo sapiens
ccttttgacggccttcttggt

SEQ ID NO: 5399016 - DNA, 23 bp, Homo sapiens
ccttttgataaaatgttcctttt

SEQ ID NO: 5399017 - DNA, 18 bp, Homo sapiens
ccttttgatggggagaaa

SEQ ID NO: 5399018 - DNA, 22 bp, Homo sapiens
ccttttgatggggagaaagggc

SEQ ID NO: 5399019 - DNA, 12 bp, Homo sapiens
ccttttgcaccc

SEQ ID NO: 5399020 - DNA, 14 bp, Homo sapiens
ccttttgcacccct

SEQ ID NO: 5399021 - DNA, 16 bp, Homo sapiens
ccttttgcacccctcc

SEQ ID NO: 5399022 - DNA, 15 bp, Homo sapiens
ccttttgcagaagag

SEQ ID NO: 5399023 - DNA, 15 bp, Homo sapiens
ccttttgcaggctcc

SEQ ID NO: 5399024 - DNA, 23 bp, Homo sapiens
ccttttgcccccgtggggctccc

SEQ ID NO: 5399025 - DNA, 16 bp, Homo sapiens
ccttttgcctggctgt

SEQ ID NO: 5399026 - DNA, 19 bp, Homo sapiens
ccttttgcgcttatttgga

SEQ ID NO: 5399027 - DNA, 22 bp, Homo sapiens
ccttttgcgcttatttggaaat

SEQ ID NO: 5399028 - DNA, 14 bp, Homo sapiens
ccttttgctctctg

SEQ ID NO: 5399029 - DNA, 16 bp, Homo sapiens
ccttttgctgtgtgaa

SEQ ID NO: 5399030 - DNA, 21 bp, Homo sapiens
ccttttgctgtgtgaaatctt

SEQ ID NO: 5399031 - DNA, 22 bp, Homo sapiens
ccttttggaacatttctttctt

SEQ ID NO: 5399032 - DNA, 22 bp, Homo sapiens
ccttttggataagtttctattc

SEQ ID NO: 5399033 - DNA, 12 bp, Homo sapiens
ccttttggcccc

SEQ ID NO: 5399034 - DNA, 19 bp, Homo sapiens
ccttttggccgggcatggt

SEQ ID NO: 5399035 - DNA, 15 bp, Homo sapiens
ccttttggcctgggg

SEQ ID NO: 5399036 - DNA, 15 bp, Homo sapiens
ccttttggcctttgt

SEQ ID NO: 5399037 - DNA, 16 bp, Homo sapiens
ccttttggcctttgta

SEQ ID NO: 5399038 - DNA, 17 bp, Homo sapiens
ccttttggcctttgtaa

SEQ ID NO: 5399039 - DNA, 12 bp, Homo sapiens
ccttttgggaag

SEQ ID NO: 5399040 - DNA, 12 bp, Homo sapiens
ccttttggggga

SEQ ID NO: 5399041 - DNA, 12 bp, Homo sapiens
ccttttgggggt

SEQ ID NO: 5399042 - DNA, 21 bp, Homo sapiens
ccttttgggtttctgccctgc

SEQ ID NO: 5399043 - DNA, 23 bp, Homo sapiens
ccttttggtagtcggagcccccg

SEQ ID NO: 5399044 - DNA, 20 bp, Homo sapiens
ccttttggtcattatttcag

SEQ ID NO: 5399045 - DNA, 18 bp, Homo sapiens
ccttttggtcttcagcct

SEQ ID NO: 5399046 - DNA, 19 bp, Homo sapiens
ccttttgtaccatggtgtg

SEQ ID NO: 5399047 - DNA, 15 bp, Homo sapiens
ccttttgtaggctgt

SEQ ID NO: 5399048 - DNA, 20 bp, Homo sapiens
ccttttgtatacatcctggg

SEQ ID NO: 5399049 - DNA, 23 bp, Homo sapiens
ccttttgtatacatcctgggtaa

SEQ ID NO: 5399050 - DNA, 17 bp, Homo sapiens
ccttttgtatcttcctt

SEQ ID NO: 5399051 - DNA, 19 bp, Homo sapiens
ccttttgtatcttcctttc

SEQ ID NO: 5399052 - DNA, 22 bp, Homo sapiens
ccttttgtcaacggcaaaggca

SEQ ID NO: 5399053 - DNA, 18 bp, Homo sapiens
ccttttgtccccagggcc

SEQ ID NO: 5399054 - DNA, 15 bp, Homo sapiens
ccttttgtctgcctc

SEQ ID NO: 5399055 - DNA, 11 bp, Homo sapiens
ccttttgtgta

SEQ ID NO: 5399056 - DNA, 12 bp, Homo sapiens
ccttttgttaat

SEQ ID NO: 5399057 - DNA, 18 bp, Homo sapiens
ccttttgttaatgcattg

SEQ ID NO: 5399058 - DNA, 19 bp, Homo sapiens
ccttttgttcatttcatcc

SEQ ID NO: 5399059 - DNA, 17 bp, Homo sapiens
ccttttgtttacaacac

SEQ ID NO: 5399060 - DNA, 19 bp, Homo sapiens
cctttttaaaaaataccat

SEQ ID NO: 5399061 - DNA, 15 bp, Homo sapiens
cctttttaaaacaca

SEQ ID NO: 5399062 - DNA, 21 bp, Homo sapiens
cctttttaaatgtgaattttt

SEQ ID NO: 5399063 - DNA, 15 bp, Homo sapiens
cctttttacacttta

SEQ ID NO: 5399064 - DNA, 18 bp, Homo sapiens
cctttttacagccaactt

SEQ ID NO: 5399065 - DNA, 19 bp, Homo sapiens
cctttttacctggcctaga

SEQ ID NO: 5399066 - DNA, 21 bp, Homo sapiens
cctttttataactttttatat

SEQ ID NO: 5399067 - DNA, 19 bp, Homo sapiens
cctttttatatttaaaaaa

SEQ ID NO: 5399068 - DNA, 17 bp, Homo sapiens
cctttttattcctttta

SEQ ID NO: 5399069 - DNA, 19 bp, Homo sapiens
cctttttattccttttaaa

SEQ ID NO: 5399070 - DNA, 12 bp, Homo sapiens
cctttttattta

SEQ ID NO: 5399071 - DNA, 20 bp, Homo sapiens
cctttttatttatatgtatg

SEQ ID NO: 5399072 - DNA, 16 bp, Homo sapiens
cctttttcaataactg

SEQ ID NO: 5399073 - DNA, 12 bp, Homo sapiens
cctttttcaatg

SEQ ID NO: 5399074 - DNA, 21 bp, Homo sapiens
cctttttcaatgaattttata

SEQ ID NO: 5399075 - DNA, 15 bp, Homo sapiens
cctttttcacgttta

SEQ ID NO: 5399076 - DNA, 12 bp, Homo sapiens
cctttttcatgt

SEQ ID NO: 5399077 - DNA, 16 bp, Homo sapiens
cctttttccaatgttt

SEQ ID NO: 5399078 - DNA, 21 bp, Homo sapiens
cctttttccaatgttttattg

SEQ ID NO: 5399079 - DNA, 17 bp, Homo sapiens
cctttttccatcatttt

SEQ ID NO: 5399080 - DNA, 10 bp, Homo sapiens
cctttttcct

SEQ ID NO: 5399081 - DNA, 15 bp, Homo sapiens
cctttttcctctcca

SEQ ID NO: 5399082 - DNA, 13 bp, Homo sapiens
cctttttccttgt

SEQ ID NO: 5399083 - DNA, 16 bp, Homo sapiens
cctttttctacctttt

SEQ ID NO: 5399084 - DNA, 15 bp, Homo sapiens
cctttttctatttta

SEQ ID NO: 5399085 - DNA, 14 bp, Homo sapiens
cctttttctccagc

SEQ ID NO: 5399086 - DNA, 14 bp, Homo sapiens
cctttttctgcact

SEQ ID NO: 5399087 - DNA, 17 bp, Homo sapiens
cctttttctgcactata

SEQ ID NO: 5399088 - DNA, 21 bp, Homo sapiens
cctttttctgcactatatgca

SEQ ID NO: 5399089 - DNA, 13 bp, Homo sapiens
cctttttctggcc

SEQ ID NO: 5399090 - DNA, 19 bp, Homo sapiens
cctttttcttcgctggact

SEQ ID NO: 5399091 - DNA, 13 bp, Homo sapiens
cctttttgaagtg

SEQ ID NO: 5399092 - DNA, 22 bp, Homo sapiens
cctttttgaagtgtaggcagac

SEQ ID NO: 5399093 - DNA, 14 bp, Homo sapiens
cctttttgaattgt

SEQ ID NO: 5399094 - DNA, 23 bp, Homo sapiens
cctttttgcaggggactgggcca

SEQ ID NO: 5399095 - DNA, 14 bp, Homo sapiens
cctttttgcagtat

SEQ ID NO: 5399096 - DNA, 14 bp, Homo sapiens
cctttttggcctgt

SEQ ID NO: 5399097 - DNA, 23 bp, Homo sapiens
cctttttggcctgtgatgtttta

SEQ ID NO: 5399098 - DNA, 14 bp, Homo sapiens
cctttttggggagt

SEQ ID NO: 5399099 - DNA, 11 bp, Homo sapiens
cctttttgtaa

SEQ ID NO: 5399100 - DNA, 14 bp, Homo sapiens
cctttttgtaaata

SEQ ID NO: 5399101 - DNA, 17 bp, Homo sapiens
cctttttgtaaatactg

SEQ ID NO: 5399102 - DNA, 22 bp, Homo sapiens
cctttttgtaaatactgcttga

SEQ ID NO: 5399103 - DNA, 16 bp, Homo sapiens
ccttttttaaataaat

SEQ ID NO: 5399104 - DNA, 18 bp, Homo sapiens
ccttttttaagatttttc

SEQ ID NO: 5399105 - DNA, 22 bp, Homo sapiens
ccttttttaggaagcaagctta

SEQ ID NO: 5399106 - DNA, 16 bp, Homo sapiens
ccttttttataactaa

SEQ ID NO: 5399107 - DNA, 18 bp, Homo sapiens
ccttttttatacataaac

SEQ ID NO: 5399108 - DNA, 19 bp, Homo sapiens
ccttttttatacataaaca

SEQ ID NO: 5399109 - DNA, 22 bp, Homo sapiens
ccttttttatatcttggcaggt

SEQ ID NO: 5399110 - DNA, 20 bp, Homo sapiens
ccttttttatcatttctact

SEQ ID NO: 5399111 - DNA, 19 bp, Homo sapiens
ccttttttatgatgctatt

SEQ ID NO: 5399112 - DNA, 14 bp, Homo sapiens
ccttttttcaatat

SEQ ID NO: 5399113 - DNA, 15 bp, Homo sapiens
ccttttttccccaga

SEQ ID NO: 5399114 - DNA, 16 bp, Homo sapiens
cgacttgttttgctgc

SEQ ID NO: 5399115 - DNA, 17 bp, Homo sapiens
cgactttatacagaact

SEQ ID NO: 5399116 - DNA, 13 bp, Homo sapiens
cgactttattttc

SEQ ID NO: 5399117 - DNA, 15 bp, Homo sapiens
cgactttctgcctgg

SEQ ID NO: 5399118 - DNA, 21 bp, Homo sapiens
cgacttttaactatgtaataa

SEQ ID NO: 5399119 - DNA, 24 bp, Homo sapiens
cgagaaaacttcgtaagaacatgt

SEQ ID NO: 5399120 - DNA, 21 bp, Homo sapiens
cgagaaagaggcaccaggaag

SEQ ID NO: 5399121 - DNA, 21 bp, Homo sapiens
cgagaaattcgtgtgtttttt

SEQ ID NO: 5399122 - DNA, 13 bp, Homo sapiens
cgagaacaacagt

SEQ ID NO: 5399123 - DNA, 19 bp, Homo sapiens
cgagaacacaagccacgcc

SEQ ID NO: 5399124 - DNA, 17 bp, Homo sapiens
cgagaactacgcacagc

SEQ ID NO: 5399125 - DNA, 16 bp, Homo sapiens
cgagaactttcatttt

SEQ ID NO: 5399126 - DNA, 20 bp, Homo sapiens
cgagaagctgctctggaatt

SEQ ID NO: 5399127 - DNA, 18 bp, Homo sapiens
cgagaaggggaaaaatgg

SEQ ID NO: 5399128 - DNA, 12 bp, Homo sapiens
cgagaagtgctc

SEQ ID NO: 5399129 - DNA, 23 bp, Homo sapiens
cgagaagtgctcttggctgaccc

SEQ ID NO: 5399130 - DNA, 15 bp, Homo sapiens
cgagacaacagcaca

SEQ ID NO: 5399131 - DNA, 17 bp, Homo sapiens
cgagacaccatcctgag

SEQ ID NO: 5399132 - DNA, 16 bp, Homo sapiens
cgagacaccctaactc

SEQ ID NO: 5399133 - DNA, 13 bp, Homo sapiens
cgagacactttat

SEQ ID NO: 5399134 - DNA, 14 bp, Homo sapiens
cgagacaggagcag

SEQ ID NO: 5399135 - DNA, 18 bp, Homo sapiens
cgagacaggagcagccca

SEQ ID NO: 5399136 - DNA, 12 bp, Homo sapiens
cgagacaggcag

SEQ ID NO: 5399137 - DNA, 22 bp, Homo sapiens
cgagacagtccagtgtcacctc

SEQ ID NO: 5399138 - DNA, 17 bp, Homo sapiens
cgagaccatcctggcta

SEQ ID NO: 5399139 - DNA, 14 bp, Homo sapiens
cgagacccccatcc

SEQ ID NO: 5399140 - DNA, 23 bp, Homo sapiens
cgagacccccatccagcctccag

SEQ ID NO: 5399141 - DNA, 15 bp, Homo sapiens
cgagacctcaagccc

SEQ ID NO: 5399142 - DNA, 16 bp, Homo sapiens
cgagacggctggacct

SEQ ID NO: 5399143 - DNA, 11 bp, Homo sapiens
cgagactccat

SEQ ID NO: 5399144 - DNA, 15 bp, Homo sapiens
cgagactccatctct

SEQ ID NO: 5399145 - DNA, 17 bp, Homo sapiens
cgagactgagaggcaga

SEQ ID NO: 5399146 - DNA, 16 bp, Homo sapiens
cgagacttctctgtga

SEQ ID NO: 5399147 - DNA, 18 bp, Homo sapiens
cgagacttggtttcaaaa

SEQ ID NO: 5399148 - DNA, 15 bp, Homo sapiens
cgagactttgtccca

SEQ ID NO: 5399149 - DNA, 18 bp, Homo sapiens
cgagagagctctggcccc

SEQ ID NO: 5399150 - DNA, 15 bp, Homo sapiens
cgagagaggagccag

SEQ ID NO: 5399151 - DNA, 16 bp, Homo sapiens
cgagagaggagccaga

SEQ ID NO: 5399152 - DNA, 21 bp, Homo sapiens
cgagagaggagccagacagac

SEQ ID NO: 5399153 - DNA, 19 bp, Homo sapiens
cgagagaggtgggcagcag

SEQ ID NO: 5399154 - DNA, 12 bp, Homo sapiens
cgagagcagcct

SEQ ID NO: 5399155 - DNA, 21 bp, Homo sapiens
cgagagcctcgctttttcatc

SEQ ID NO: 5399156 - DNA, 14 bp, Homo sapiens
cgagagcctgctcc

SEQ ID NO: 5399157 - DNA, 19 bp, Homo sapiens
cgagagcctgctcccccac

SEQ ID NO: 5399158 - DNA, 19 bp, Homo sapiens
cgagagctcttagttttta

SEQ ID NO: 5399159 - DNA, 20 bp, Homo sapiens
cgagagctcttagtttttaa

SEQ ID NO: 5399160 - DNA, 21 bp, Homo sapiens
cgagagctcttagtttttaaa

SEQ ID NO: 5399161 - DNA, 14 bp, Homo sapiens
cgagaggaggggcc

SEQ ID NO: 5399162 - DNA, 15 bp, Homo sapiens
cgagaggcagagaaa

SEQ ID NO: 5399163 - DNA, 16 bp, Homo sapiens
cgagagggagagagag

SEQ ID NO: 5399164 - DNA, 15 bp, Homo sapiens
cgagagggaggcagg

SEQ ID NO: 5399165 - DNA, 16 bp, Homo sapiens
cgagagggctgagccc

SEQ ID NO: 5399166 - DNA, 17 bp, Homo sapiens
cgagagggctgagcccc

SEQ ID NO: 5399167 - DNA, 19 bp, Homo sapiens
cgagagggctgagcccctc

SEQ ID NO: 5399168 - DNA, 21 bp, Homo sapiens
cgagagggctgagcccctcct

SEQ ID NO: 5399169 - DNA, 22 bp, Homo sapiens
cgagagggctgagcccctcctc

SEQ ID NO: 5399170 - DNA, 21 bp, Homo sapiens
cgagaggggccgatgcccaga

SEQ ID NO: 5399171 - DNA, 22 bp, Homo sapiens
cgagaggggccgatgcccagag

SEQ ID NO: 5399172 - DNA, 14 bp, Homo sapiens
cgagaggtccctgc

SEQ ID NO: 5399173 - DNA, 19 bp, Homo sapiens
cgagaggtgggccagtctg

SEQ ID NO: 5399174 - DNA, 20 bp, Homo sapiens
cgagaggtgggccagtctgt

SEQ ID NO: 5399175 - DNA, 23 bp, Homo sapiens
cgagaggtgggccagtctgtgga

SEQ ID NO: 5399176 - DNA, 20 bp, Homo sapiens
cgagagtagccgagagcctg

SEQ ID NO: 5399177 - DNA, 14 bp, Homo sapiens
cgagagtctgtctc

SEQ ID NO: 5399178 - DNA, 15 bp, Homo sapiens
cgagataatgtatat

SEQ ID NO: 5399179 - DNA, 18 bp, Homo sapiens
cgagatcacgccactgca

SEQ ID NO: 5399180 - DNA, 17 bp, Homo sapiens
cgagatcagtatttaac

SEQ ID NO: 5399181 - DNA, 21 bp, Homo sapiens
cgagatcccaacactgccagc

SEQ ID NO: 5399182 - DNA, 18 bp, Homo sapiens
cgagatccccagggcagc

SEQ ID NO: 5399183 - DNA, 16 bp, Homo sapiens
cgagatcgctggcaga

SEQ ID NO: 5399184 - DNA, 17 bp, Homo sapiens
cgagatcgctggcagag

SEQ ID NO: 5399185 - DNA, 19 bp, Homo sapiens
cgagatcgctggcagagaa

SEQ ID NO: 5399186 - DNA, 16 bp, Homo sapiens
cgagatcgggaagcag

SEQ ID NO: 5399187 - DNA, 18 bp, Homo sapiens
cgagatcggggtggcaga

SEQ ID NO: 5399188 - DNA, 15 bp, Homo sapiens
cgagatcttccttcc

SEQ ID NO: 5399189 - DNA, 23 bp, Homo sapiens
cgagatggcagattcccactgcc

SEQ ID NO: 5399190 - DNA, 20 bp, Homo sapiens
cgagatgtgacccaccagtg

SEQ ID NO: 5399191 - DNA, 23 bp, Homo sapiens
cgagattgctggaaaccaagtca

SEQ ID NO: 5399192 - DNA, 12 bp, Homo sapiens
cgagatttcttt

SEQ ID NO: 5399193 - DNA, 23 bp, Homo sapiens
cgagcaaacccagaggtggatgt

SEQ ID NO: 5399194 - DNA, 14 bp, Homo sapiens
cgagcaaagatcaa

SEQ ID NO: 5399195 - DNA, 19 bp, Homo sapiens
cgagcaaagtctaaagttt

SEQ ID NO: 5399196 - DNA, 20 bp, Homo sapiens
cgagcaaagtctaaagttta

SEQ ID NO: 5399197 - DNA, 15 bp, Homo sapiens
cgagcaacagtgccc

SEQ ID NO: 5399198 - DNA, 16 bp, Homo sapiens
cgagcaaccctctgaa

SEQ ID NO: 5399199 - DNA, 23 bp, Homo sapiens
cgagcaaccgtggcccttcctgg

SEQ ID NO: 5399200 - DNA, 20 bp, Homo sapiens
cgagcacggttgcctgaggt

SEQ ID NO: 5399201 - DNA, 17 bp, Homo sapiens
cgagcactggccagaga

SEQ ID NO: 5399202 - DNA, 21 bp, Homo sapiens
cgagcactggccagagagggc

SEQ ID NO: 5399203 - DNA, 19 bp, Homo sapiens
cgagcagagcgcagccccc

SEQ ID NO: 5399204 - DNA, 11 bp, Homo sapiens
cgagcagccca

SEQ ID NO: 5399205 - DNA, 12 bp, Homo sapiens
cgagcagcccag

SEQ ID NO: 5399206 - DNA, 13 bp, Homo sapiens
cgagcagcccagg

SEQ ID NO: 5399207 - DNA, 12 bp, Homo sapiens
cgagcagctgag

SEQ ID NO: 5399208 - DNA, 15 bp, Homo sapiens
cgagcagctgagcag

SEQ ID NO: 5399209 - DNA, 16 bp, Homo sapiens
cgagcagctgagcagg

SEQ ID NO: 5399210 - DNA, 19 bp, Homo sapiens
cgagcagctgagcagggcc

SEQ ID NO: 5399211 - DNA, 14 bp, Homo sapiens
cgagcaggaggcct

SEQ ID NO: 5399212 - DNA, 12 bp, Homo sapiens
cgagcagggcag

SEQ ID NO: 5399213 - DNA, 13 bp, Homo sapiens
cgagcagggcagg

SEQ ID NO: 5399214 - DNA, 15 bp, Homo sapiens
cgagcagggctgtgt

SEQ ID NO: 5399215 - DNA, 15 bp, Homo sapiens
cgagcagtcctgcct

SEQ ID NO: 5399216 - DNA, 21 bp, Homo sapiens
cgagcagtcctgcctcagcct

SEQ ID NO: 5399217 - DNA, 20 bp, Homo sapiens
cgagcataaaataggtgcat

SEQ ID NO: 5399218 - DNA, 23 bp, Homo sapiens
cgagcataaaataggtgcattgt

SEQ ID NO: 5399219 - DNA, 21 bp, Homo sapiens
cgagcatccccctcctctccc

SEQ ID NO: 5399220 - DNA, 22 bp, Homo sapiens
cgagcatgccctgagctctctg

SEQ ID NO: 5399221 - DNA, 14 bp, Homo sapiens
cgagcatgcctgga

SEQ ID NO: 5399222 - DNA, 17 bp, Homo sapiens
cgagcatgcctggatgg

SEQ ID NO: 5399223 - DNA, 20 bp, Homo sapiens
cgagcatgggggctgccagc

SEQ ID NO: 5399224 - DNA, 19 bp, Homo sapiens
cgagcatgttgttttttca

SEQ ID NO: 5399225 - DNA, 18 bp, Homo sapiens
cgagcattccagtaactt

SEQ ID NO: 5399226 - DNA, 18 bp, Homo sapiens
cgagccacaagctgcact

SEQ ID NO: 5399227 - DNA, 20 bp, Homo sapiens
cgagccaccatgcttgcctg

SEQ ID NO: 5399228 - DNA, 16 bp, Homo sapiens
cgagccacgcagtgcc

SEQ ID NO: 5399229 - DNA, 19 bp, Homo sapiens
cgagccatgatgtggagtg

SEQ ID NO: 5399230 - DNA, 16 bp, Homo sapiens
cgagccatttgtccca

SEQ ID NO: 5399231 - DNA, 19 bp, Homo sapiens
cgagccatttgtcccaagt

SEQ ID NO: 5399232 - DNA, 20 bp, Homo sapiens
cgagccatttgtcccaagtg

SEQ ID NO: 5399233 - DNA, 21 bp, Homo sapiens
cgagccatttgtcccaagtgc

SEQ ID NO: 5399234 - DNA, 19 bp, Homo sapiens
cgagcccacaccatctggc

SEQ ID NO: 5399235 - DNA, 20 bp, Homo sapiens
cgagcccacaccatctggcc

SEQ ID NO: 5399236 - DNA, 13 bp, Homo sapiens
cgagcccagctac

SEQ ID NO: 5399237 - DNA, 14 bp, Homo sapiens
cgagcccagctaca

SEQ ID NO: 5399238 - DNA, 16 bp, Homo sapiens
cgagcccaggcagcta

SEQ ID NO: 5399239 - DNA, 13 bp, Homo sapiens
cgagcccattctc

SEQ ID NO: 5399240 - DNA, 15 bp, Homo sapiens
cgagccccaggagcc

SEQ ID NO: 5399241 - DNA, 15 bp, Homo sapiens
cgagccccctgtcct

SEQ ID NO: 5399242 - DNA, 21 bp, Homo sapiens
cgagcccctccttctcccctg

SEQ ID NO: 5399243 - DNA, 18 bp, Homo sapiens
cgagcccctcggctctgg

SEQ ID NO: 5399244 - DNA, 18 bp, Homo sapiens
cgagcccctgcccacgcc

SEQ ID NO: 5399245 - DNA, 19 bp, Homo sapiens
cgagcccctgtttctcctc

SEQ ID NO: 5399246 - DNA, 21 bp, Homo sapiens
cgagcccctgtttctcctcca

SEQ ID NO: 5399247 - DNA, 16 bp, Homo sapiens
cgagccctacttccag

SEQ ID NO: 5399248 - DNA, 14 bp, Homo sapiens
cgagccctccccca

SEQ ID NO: 5399249 - DNA, 16 bp, Homo sapiens
cgagccctgactcctg

SEQ ID NO: 5399250 - DNA, 11 bp, Homo sapiens
cgagccctgga

SEQ ID NO: 5399251 - DNA, 13 bp, Homo sapiens
cgagccctggaga

SEQ ID NO: 5399252 - DNA, 15 bp, Homo sapiens
cgagccctggtggca

SEQ ID NO: 5399253 - DNA, 18 bp, Homo sapiens
cgagccctggtggcagtg

SEQ ID NO: 5399254 - DNA, 15 bp, Homo sapiens
cgagccgggcctggg

SEQ ID NO: 5399255 - DNA, 23 bp, Homo sapiens
cgagcctctgtcactgcaggcac

SEQ ID NO: 5399256 - DNA, 18 bp, Homo sapiens
cgagcctgaactgagccc

SEQ ID NO: 5399257 - DNA, 13 bp, Homo sapiens
cgagcctggctcc

SEQ ID NO: 5399258 - DNA, 17 bp, Homo sapiens
cgagcctgtgccttcct

SEQ ID NO: 5399259 - DNA, 21 bp, Homo sapiens
cgagcctgtgccttcctcccc

SEQ ID NO: 5399260 - DNA, 21 bp, Homo sapiens
cgagccttctcaccccaggat

SEQ ID NO: 5399261 - DNA, 16 bp, Homo sapiens
cgagcgacggctcctc

SEQ ID NO: 5399262 - DNA, 17 bp, Homo sapiens
cgagcgacggctcctcc

SEQ ID NO: 5399263 - DNA, 22 bp, Homo sapiens
cgagcgacggctcctccccgat

SEQ ID NO: 5399264 - DNA, 23 bp, Homo sapiens
cgagcgacggctcctccccgatc

SEQ ID NO: 5399265 - DNA, 17 bp, Homo sapiens
cgagcgagaaccaggct

SEQ ID NO: 5399266 - DNA, 22 bp, Homo sapiens
cgagcgagaaccaggctgctgc

SEQ ID NO: 5399267 - DNA, 15 bp, Homo sapiens
cgagcgcccagctcc

SEQ ID NO: 5399268 - DNA, 19 bp, Homo sapiens
cgagcgcccagctcctgac

SEQ ID NO: 5399269 - DNA, 20 bp, Homo sapiens
cgagcgccctgcagaccctg

SEQ ID NO: 5399270 - DNA, 18 bp, Homo sapiens
cgagcgctttctggaaaa

SEQ ID NO: 5399271 - DNA, 18 bp, Homo sapiens
cgagcgttcccagcaggg

SEQ ID NO: 5399272 - DNA, 19 bp, Homo sapiens
cgagcgttcccagcagggg

SEQ ID NO: 5399273 - DNA, 12 bp, Homo sapiens
cgagctcctcca

SEQ ID NO: 5399274 - DNA, 14 bp, Homo sapiens
cgagctcctgggga

SEQ ID NO: 5399275 - DNA, 21 bp, Homo sapiens
cgagctcgtgtatcctggggc

SEQ ID NO: 5399276 - DNA, 22 bp, Homo sapiens
cgagctcgtgtatcctggggct

SEQ ID NO: 5399277 - DNA, 22 bp, Homo sapiens
cgagctctcaaatccctctcca

SEQ ID NO: 5399278 - DNA, 14 bp, Homo sapiens
cgagctctgtagcc

SEQ ID NO: 5399279 - DNA, 15 bp, Homo sapiens
cgagctctgtagcct

SEQ ID NO: 5399280 - DNA, 17 bp, Homo sapiens
cgagctctgtcctctgt

SEQ ID NO: 5399281 - DNA, 19 bp, Homo sapiens
cgagctcttggcctttgca

SEQ ID NO: 5399282 - DNA, 17 bp, Homo sapiens
cgagctgaagaactggg

SEQ ID NO: 5399283 - DNA, 15 bp, Homo sapiens
cgagctggatgtccc

SEQ ID NO: 5399284 - DNA, 17 bp, Homo sapiens
cgagctgggaaggttcc

SEQ ID NO: 5399285 - DNA, 24 bp, Homo sapiens
cgagctgggaccagtacctgggtc

SEQ ID NO: 5399286 - DNA, 15 bp, Homo sapiens
cgagctgggggccat

SEQ ID NO: 5399287 - DNA, 23 bp, Homo sapiens
cgagctgggggccatgagctcca

SEQ ID NO: 5399288 - DNA, 15 bp, Homo sapiens
cgagctggtgcatta

SEQ ID NO: 5399289 - DNA, 19 bp, Homo sapiens
cgagcttagattctgtatg

SEQ ID NO: 5399290 - DNA, 14 bp, Homo sapiens
cgagcttgcctcag

SEQ ID NO: 5399291 - DNA, 22 bp, Homo sapiens
cgcagccctaccttaaggaaag

SEQ ID NO: 5399292 - DNA, 20 bp, Homo sapiens
cgcagccctagagcctgcct

SEQ ID NO: 5399293 - DNA, 23 bp, Homo sapiens
cgcagccctagtgggagcccagc

SEQ ID NO: 5399294 - DNA, 12 bp, Homo sapiens
cgcagccctctc

SEQ ID NO: 5399295 - DNA, 19 bp, Homo sapiens
cgcagccctctccacccag

SEQ ID NO: 5399296 - DNA, 10 bp, Homo sapiens
cgcagccctg

SEQ ID NO: 5399297 - DNA, 15 bp, Homo sapiens
cgcagccctgcagag

SEQ ID NO: 5399298 - DNA, 13 bp, Homo sapiens
cgcagccctgctt

SEQ ID NO: 5399299 - DNA, 15 bp, Homo sapiens
cgcagccctgctttg

SEQ ID NO: 5399300 - DNA, 19 bp, Homo sapiens
cgcagccctgggggccagc

SEQ ID NO: 5399301 - DNA, 20 bp, Homo sapiens
cgcagccctgggggccagct

SEQ ID NO: 5399302 - DNA, 22 bp, Homo sapiens
cgcagccctgggggccagctgg

SEQ ID NO: 5399303 - DNA, 19 bp, Homo sapiens
cgcagccgagccccaggag

SEQ ID NO: 5399304 - DNA, 18 bp, Homo sapiens
cgcagccgcgctctgccc

SEQ ID NO: 5399305 - DNA, 20 bp, Homo sapiens
cgcagccgcgctctgcccct

SEQ ID NO: 5399306 - DNA, 22 bp, Homo sapiens
cgcagccgcgctctgcccctcc

SEQ ID NO: 5399307 - DNA, 12 bp, Homo sapiens
cgcagcctccag

SEQ ID NO: 5399308 - DNA, 15 bp, Homo sapiens
cgcagcctccagggc

SEQ ID NO: 5399309 - DNA, 14 bp, Homo sapiens
cgcagcctccagtt

SEQ ID NO: 5399310 - DNA, 14 bp, Homo sapiens
cgcagcctgaagcc

SEQ ID NO: 5399311 - DNA, 11 bp, Homo sapiens
cgcagcctgag

SEQ ID NO: 5399312 - DNA, 14 bp, Homo sapiens
cgcagcctgagaat

SEQ ID NO: 5399313 - DNA, 12 bp, Homo sapiens
cgcagcctgagt

SEQ ID NO: 5399314 - DNA, 19 bp, Homo sapiens
cgcagcctggcatctgtgc

SEQ ID NO: 5399315 - DNA, 21 bp, Homo sapiens
cgcagcctggcggggcaggag

SEQ ID NO: 5399316 - DNA, 23 bp, Homo sapiens
cgcagcctggcggggcaggaggc

SEQ ID NO: 5399317 - DNA, 24 bp, Homo sapiens
cgcagcctggcggggcaggaggcc

SEQ ID NO: 5399318 - DNA, 18 bp, Homo sapiens
cgcagcgccagggctcag

SEQ ID NO: 5399319 - DNA, 14 bp, Homo sapiens
cgcagcggggtagg

SEQ ID NO: 5399320 - DNA, 21 bp, Homo sapiens
cgcagcggtgggaaggaaagg

SEQ ID NO: 5399321 - DNA, 16 bp, Homo sapiens
cgcagcgtcccccgcc

SEQ ID NO: 5399322 - DNA, 18 bp, Homo sapiens
cgcagctaccctcagcct

SEQ ID NO: 5399323 - DNA, 13 bp, Homo sapiens
cgcagctccttcc

SEQ ID NO: 5399324 - DNA, 17 bp, Homo sapiens
cgcagctcttgcccttc

SEQ ID NO: 5399325 - DNA, 23 bp, Homo sapiens
cgcagctcttgcccttccctgtc

SEQ ID NO: 5399326 - DNA, 12 bp, Homo sapiens
cgcagctgaagc

SEQ ID NO: 5399327 - DNA, 14 bp, Homo sapiens
cgcagctgaagcct

SEQ ID NO: 5399328 - DNA, 16 bp, Homo sapiens
cgcagctgaagcctgg

SEQ ID NO: 5399329 - DNA, 18 bp, Homo sapiens
cgcagctgaagcctggac

SEQ ID NO: 5399330 - DNA, 12 bp, Homo sapiens
cgcagctgctgc

SEQ ID NO: 5399331 - DNA, 18 bp, Homo sapiens
cgcagctgctgccactct

SEQ ID NO: 5399332 - DNA, 16 bp, Homo sapiens
cgcaggaaccgaggac

SEQ ID NO: 5399333 - DNA, 15 bp, Homo sapiens
cgcaggaactcccag

SEQ ID NO: 5399334 - DNA, 17 bp, Homo sapiens
cgcaggaactcccagca

SEQ ID NO: 5399335 - DNA, 18 bp, Homo sapiens
cgcaggaactcccagcaa

SEQ ID NO: 5399336 - DNA, 15 bp, Homo sapiens
cgcaggaagctgctc

SEQ ID NO: 5399337 - DNA, 11 bp, Homo sapiens
cgcaggaatgg

SEQ ID NO: 5399338 - DNA, 19 bp, Homo sapiens
cgcaggaccaagggggcgg

SEQ ID NO: 5399339 - DNA, 22 bp, Homo sapiens
cgcaggagggaggcggggagga

SEQ ID NO: 5399340 - DNA, 22 bp, Homo sapiens
cgcaggagtctctgccacccac

SEQ ID NO: 5399341 - DNA, 14 bp, Homo sapiens
cgcaggatccctcc

SEQ ID NO: 5399342 - DNA, 19 bp, Homo sapiens
cgcaggatccctcctgagc

SEQ ID NO: 5399343 - DNA, 20 bp, Homo sapiens
cgcaggatccctcctgagct

SEQ ID NO: 5399344 - DNA, 17 bp, Homo sapiens
cgcaggattcagccgga

SEQ ID NO: 5399345 - DNA, 22 bp, Homo sapiens
cgcaggattcttcctccctccc

SEQ ID NO: 5399346 - DNA, 19 bp, Homo sapiens
cgcaggcagcgcagggctg

SEQ ID NO: 5399347 - DNA, 20 bp, Homo sapiens
cgcaggcagcgcagggctgg

SEQ ID NO: 5399348 - DNA, 17 bp, Homo sapiens
cgcaggccacccgggct

SEQ ID NO: 5399349 - DNA, 22 bp, Homo sapiens
cgcaggccacccgggctgcctg

SEQ ID NO: 5399350 - DNA, 13 bp, Homo sapiens
cgcaggcccagtg

SEQ ID NO: 5399351 - DNA, 23 bp, Homo sapiens
cgcaggcccctctcctccgtggc

SEQ ID NO: 5399352 - DNA, 12 bp, Homo sapiens
cgcaggccctgt

SEQ ID NO: 5399353 - DNA, 21 bp, Homo sapiens
cgcaggccctgtccagccccc

SEQ ID NO: 5399354 - DNA, 18 bp, Homo sapiens
cgcaggcctccctgccag

SEQ ID NO: 5399355 - DNA, 18 bp, Homo sapiens
cgcaggcctgccttctca

SEQ ID NO: 5399356 - DNA, 18 bp, Homo sapiens
cgcaggcgaccgggcctc

SEQ ID NO: 5399357 - DNA, 20 bp, Homo sapiens
cgcaggcgaccgggcctccc

SEQ ID NO: 5399358 - DNA, 13 bp, Homo sapiens
cgcaggcggccag

SEQ ID NO: 5399359 - DNA, 14 bp, Homo sapiens
cgcaggcggccagg

SEQ ID NO: 5399360 - DNA, 18 bp, Homo sapiens
cgcaggcgggaaaagcag

SEQ ID NO: 5399361 - DNA, 21 bp, Homo sapiens
cgcaggctatttgttcagaga

SEQ ID NO: 5399362 - DNA, 17 bp, Homo sapiens
cgcaggctgagtccaga

SEQ ID NO: 5399363 - DNA, 22 bp, Homo sapiens
cgcaggctgagtgcactggcag

SEQ ID NO: 5399364 - DNA, 19 bp, Homo sapiens
cgcaggctgcagagcccgg

SEQ ID NO: 5399365 - DNA, 17 bp, Homo sapiens
cgcaggctggccctgcc

SEQ ID NO: 5399366 - DNA, 20 bp, Homo sapiens
cgcaggctggccctgccctg

SEQ ID NO: 5399367 - DNA, 21 bp, Homo sapiens
cgcaggctggccctgccctgg

SEQ ID NO: 5399368 - DNA, 14 bp, Homo sapiens
cgcagggacaagcc

SEQ ID NO: 5399369 - DNA, 18 bp, Homo sapiens
cgcagggacatggggcaa

SEQ ID NO: 5399370 - DNA, 19 bp, Homo sapiens
cgcagggacatggggcaag

SEQ ID NO: 5399371 - DNA, 20 bp, Homo sapiens
cgcagggacatggggcaagc

SEQ ID NO: 5399372 - DNA, 22 bp, Homo sapiens
cgcagggacatggggcaagcca

SEQ ID NO: 5399373 - DNA, 18 bp, Homo sapiens
cgcagggaggatgccaca

SEQ ID NO: 5399374 - DNA, 20 bp, Homo sapiens
cgcagggaggatgccacagc

SEQ ID NO: 5399375 - DNA, 16 bp, Homo sapiens
cgcagggccatccact

SEQ ID NO: 5399376 - DNA, 17 bp, Homo sapiens
cgcagggccatccactg

SEQ ID NO: 5399377 - DNA, 18 bp, Homo sapiens
cgcagggccatccactgt

SEQ ID NO: 5399378 - DNA, 22 bp, Homo sapiens
cgcagggccatccactgtgacg

SEQ ID NO: 5399379 - DNA, 14 bp, Homo sapiens
cgcagggccatgca

SEQ ID NO: 5399380 - DNA, 16 bp, Homo sapiens
cgcagggccatgcaga

SEQ ID NO: 5399381 - DNA, 18 bp, Homo sapiens
cgcagggccatgcagacc

SEQ ID NO: 5399382 - DNA, 12 bp, Homo sapiens
cgcagggcgccc

SEQ ID NO: 5399383 - DNA, 22 bp, Homo sapiens
cgcagggctggcacgtgacagg

SEQ ID NO: 5399384 - DNA, 21 bp, Homo sapiens
cgcaggggcccctcctccaga

SEQ ID NO: 5399385 - DNA, 17 bp, Homo sapiens
cgcaggggccctgagcc

SEQ ID NO: 5399386 - DNA, 21 bp, Homo sapiens
cgcagggtccaaaggccagcg

SEQ ID NO: 5399387 - DNA, 23 bp, Homo sapiens
cgcagggtggtggtattctgtca

SEQ ID NO: 5399388 - DNA, 20 bp, Homo sapiens
cgcaggtatttagaagcaga

SEQ ID NO: 5399389 - DNA, 22 bp, Homo sapiens
cgcaggtatttagaagcagagg

SEQ ID NO: 5399390 - DNA, 17 bp, Homo sapiens
cgcaggtgccatgcctg

SEQ ID NO: 5399391 - DNA, 19 bp, Homo sapiens
cgcaggtgccatgcctgct

SEQ ID NO: 5399392 - DNA, 22 bp, Homo sapiens
cgcaggtgccatgcctgctccc

SEQ ID NO: 5399393 - DNA, 23 bp, Homo sapiens
cgcaggtgccatgcctgctccct

SEQ ID NO: 5399394 - DNA, 13 bp, Homo sapiens
cgcaggtgggctg

SEQ ID NO: 5399395 - DNA, 14 bp, Homo sapiens
cgcaggtgggctgg

SEQ ID NO: 5399396 - DNA, 18 bp, Homo sapiens
cgcaggtgggctggactt

SEQ ID NO: 5399397 - DNA, 20 bp, Homo sapiens
cgcaggtgggtgctgccctg

SEQ ID NO: 5399398 - DNA, 23 bp, Homo sapiens
cgcaggtgggtgctgccctgtgt

SEQ ID NO: 5399399 - DNA, 14 bp, Homo sapiens
cgcaggttaccttg

SEQ ID NO: 5399400 - DNA, 20 bp, Homo sapiens
cgcagtccacttctgacagc

SEQ ID NO: 5399401 - DNA, 22 bp, Homo sapiens
cgcagtccacttctgacagcct

SEQ ID NO: 5399402 - DNA, 13 bp, Homo sapiens
cgcagtccccagc

SEQ ID NO: 5399403 - DNA, 15 bp, Homo sapiens
cgcagtccccagccc

SEQ ID NO: 5399404 - DNA, 17 bp, Homo sapiens
cgcagtccccagccctt

SEQ ID NO: 5399405 - DNA, 18 bp, Homo sapiens
cgcagtcgtcagcctccc

SEQ ID NO: 5399406 - DNA, 19 bp, Homo sapiens
cgcagtcgtcagcctccct

SEQ ID NO: 5399407 - DNA, 20 bp, Homo sapiens
cgcagtcgtcagcctccctg

SEQ ID NO: 5399408 - DNA, 22 bp, Homo sapiens
cgcagtcgtcagcctccctgac

SEQ ID NO: 5399409 - DNA, 18 bp, Homo sapiens
cgcagtcgtcccaggctg

SEQ ID NO: 5399410 - DNA, 21 bp, Homo sapiens
cgcagtcgtcgcacagtctct

SEQ ID NO: 5399411 - DNA, 14 bp, Homo sapiens
cgcagtctggcctg

SEQ ID NO: 5399412 - DNA, 15 bp, Homo sapiens
cgcagtgcccagtga

SEQ ID NO: 5399413 - DNA, 20 bp, Homo sapiens
cgcagtgcccagtgatggca

SEQ ID NO: 5399414 - DNA, 15 bp, Homo sapiens
cgcagtgctgggacc

SEQ ID NO: 5399415 - DNA, 16 bp, Homo sapiens
cgcagtggactgtgtc

SEQ ID NO: 5399416 - DNA, 22 bp, Homo sapiens
cgcagtggggtcaagctgagct

SEQ ID NO: 5399417 - DNA, 11 bp, Homo sapiens
cgcagtgtctc

SEQ ID NO: 5399418 - DNA, 16 bp, Homo sapiens
cgcagtgtctccacct

SEQ ID NO: 5399419 - DNA, 17 bp, Homo sapiens
cgcagtgtgcactaagg

SEQ ID NO: 5399420 - DNA, 18 bp, Homo sapiens
cgcagttgtgtggcccag

SEQ ID NO: 5399421 - DNA, 22 bp, Homo sapiens
cgcatacacacatgccctcctg

SEQ ID NO: 5399422 - DNA, 22 bp, Homo sapiens
cgcatagactgaggtataaaga

SEQ ID NO: 5399423 - DNA, 13 bp, Homo sapiens
cgcataggcccag

SEQ ID NO: 5399424 - DNA, 22 bp, Homo sapiens
cgcatagtgtgctcggacacag

SEQ ID NO: 5399425 - DNA, 23 bp, Homo sapiens
cgcatagtgtgctcggacacagt

SEQ ID NO: 5399426 - DNA, 17 bp, Homo sapiens
cgcatatgcatgccagg

SEQ ID NO: 5399427 - DNA, 15 bp, Homo sapiens
cgcatcaaaagacaa

SEQ ID NO: 5399428 - DNA, 19 bp, Homo sapiens
cgcatcaaaagacaattct

SEQ ID NO: 5399429 - DNA, 15 bp, Homo sapiens
cgcatccaccgccac

SEQ ID NO: 5399430 - DNA, 15 bp, Homo sapiens
cgcatccagacagtc

SEQ ID NO: 5399431 - DNA, 12 bp, Homo sapiens
cgcatccagcaa

SEQ ID NO: 5399432 - DNA, 14 bp, Homo sapiens
cgcatcccatctct

SEQ ID NO: 5399433 - DNA, 19 bp, Homo sapiens
cgcatcccatctctcccac

SEQ ID NO: 5399434 - DNA, 16 bp, Homo sapiens
cgcatccctgcttctg

SEQ ID NO: 5399435 - DNA, 21 bp, Homo sapiens
cgcatccctgcttctggcgcc

SEQ ID NO: 5399436 - DNA, 22 bp, Homo sapiens
cgcatctagttcccctgtttat

SEQ ID NO: 5399437 - DNA, 17 bp, Homo sapiens
cgcatctgcctggagcc

SEQ ID NO: 5399438 - DNA, 13 bp, Homo sapiens
cgcatctgctcat

SEQ ID NO: 5399439 - DNA, 15 bp, Homo sapiens
cgcatcttctccatc

SEQ ID NO: 5399440 - DNA, 16 bp, Homo sapiens
cgcatgatggagctga

SEQ ID NO: 5399441 - DNA, 13 bp, Homo sapiens
cgcatgcagcagc

SEQ ID NO: 5399442 - DNA, 11 bp, Homo sapiens
cgcatgcaggg

SEQ ID NO: 5399443 - DNA, 21 bp, Homo sapiens
cgcatgcagggcccccacagg

SEQ ID NO: 5399444 - DNA, 14 bp, Homo sapiens
cgcatgccccctcg

SEQ ID NO: 5399445 - DNA, 20 bp, Homo sapiens
cgcatgccccctcgtgccag

SEQ ID NO: 5399446 - DNA, 21 bp, Homo sapiens
cgcatgccccctcgtgccagt

SEQ ID NO: 5399447 - DNA, 14 bp, Homo sapiens
cgcatgcctcagcc

SEQ ID NO: 5399448 - DNA, 21 bp, Homo sapiens
cgcatgcctcagccagccctg

SEQ ID NO: 5399449 - DNA, 16 bp, Homo sapiens
cgcatgcctcccaggc

SEQ ID NO: 5399450 - DNA, 14 bp, Homo sapiens
cgcatgctcagtgc

SEQ ID NO: 5399451 - DNA, 17 bp, Homo sapiens
cgcatgctgcctgcctc

SEQ ID NO: 5399452 - DNA, 13 bp, Homo sapiens
cgcatggcagctg

SEQ ID NO: 5399453 - DNA, 17 bp, Homo sapiens
cgcatggcagctgggcc

SEQ ID NO: 5399454 - DNA, 24 bp, Homo sapiens
cgcatggcagctgggcccacagcc

SEQ ID NO: 5399455 - DNA, 16 bp, Homo sapiens
cgcatggcccctccag

SEQ ID NO: 5399456 - DNA, 17 bp, Homo sapiens
cgcatgggcattgcagc

SEQ ID NO: 5399457 - DNA, 18 bp, Homo sapiens
cgcatgtacaaaaacaca

SEQ ID NO: 5399458 - DNA, 19 bp, Homo sapiens
cgcatgtacaaaaacacaa

SEQ ID NO: 5399459 - DNA, 20 bp, Homo sapiens
cgcatgtacaaaaacacaaa

SEQ ID NO: 5399460 - DNA, 19 bp, Homo sapiens
cgcatgtccctccaaggct

SEQ ID NO: 5399461 - DNA, 21 bp, Homo sapiens
cgcatgtctgcacctccgctt

SEQ ID NO: 5399462 - DNA, 21 bp, Homo sapiens
cgcatgtctgcatggcagaag

SEQ ID NO: 5399463 - DNA, 21 bp, Homo sapiens
cgcatgtgccagttggggccc

SEQ ID NO: 5399464 - DNA, 20 bp, Homo sapiens
cgcatgtgtctgtattcata

SEQ ID NO: 5399465 - DNA, 13 bp, Homo sapiens
cgcatgtgtgcct

SEQ ID NO: 5399466 - DNA, 11 bp, Homo sapiens
cgcatgtgtgt

SEQ ID NO: 5399467 - DNA, 14 bp, Homo sapiens
cgcatgtttaatgt

SEQ ID NO: 5399468 - DNA, 16 bp, Homo sapiens
cgccctgcagggccgg

SEQ ID NO: 5399469 - DNA, 14 bp, Homo sapiens
cgccctgcccctgc

SEQ ID NO: 5399470 - DNA, 17 bp, Homo sapiens
cgccctgcctcctggag

SEQ ID NO: 5399471 - DNA, 14 bp, Homo sapiens
cgccctgcgggcca

SEQ ID NO: 5399472 - DNA, 17 bp, Homo sapiens
cgccctgcgggccacag

SEQ ID NO: 5399473 - DNA, 15 bp, Homo sapiens
cgccctgctcctccc

SEQ ID NO: 5399474 - DNA, 23 bp, Homo sapiens
cgccctgcttcactgccccctcc

SEQ ID NO: 5399475 - DNA, 12 bp, Homo sapiens
cgccctggaagc

SEQ ID NO: 5399476 - DNA, 16 bp, Homo sapiens
cgccctggactgtgtg

SEQ ID NO: 5399477 - DNA, 21 bp, Homo sapiens
cgccctgggcctgcacctctc

SEQ ID NO: 5399478 - DNA, 22 bp, Homo sapiens
cgccctgggctcgtctttgcag

SEQ ID NO: 5399479 - DNA, 12 bp, Homo sapiens
cgccctgggctg

SEQ ID NO: 5399480 - DNA, 15 bp, Homo sapiens
cgccctgggctggac

SEQ ID NO: 5399481 - DNA, 14 bp, Homo sapiens
cgccctgggctggg

SEQ ID NO: 5399482 - DNA, 14 bp, Homo sapiens
cgccctgggctgtc

SEQ ID NO: 5399483 - DNA, 15 bp, Homo sapiens
cgccctgggctgtct

SEQ ID NO: 5399484 - DNA, 22 bp, Homo sapiens
cgccctgggctgtctgtcacca

SEQ ID NO: 5399485 - DNA, 21 bp, Homo sapiens
cgccctggggagtgagcttgg

SEQ ID NO: 5399486 - DNA, 16 bp, Homo sapiens
cgccctggtaaggctg

SEQ ID NO: 5399487 - DNA, 16 bp, Homo sapiens
cgccctgtccctccca

SEQ ID NO: 5399488 - DNA, 19 bp, Homo sapiens
cgccctgtgcagggaaagg

SEQ ID NO: 5399489 - DNA, 22 bp, Homo sapiens
cgccctgtgccctctcactgac

SEQ ID NO: 5399490 - DNA, 17 bp, Homo sapiens
cgccctgtgtccacagt

SEQ ID NO: 5399491 - DNA, 19 bp, Homo sapiens
cgccctgtgtgtgtcccct

SEQ ID NO: 5399492 - DNA, 21 bp, Homo sapiens
cgcccttagtcccccaactct

SEQ ID NO: 5399493 - DNA, 16 bp, Homo sapiens
cgcccttcaatgctgc

SEQ ID NO: 5399494 - DNA, 15 bp, Homo sapiens
cgcccttcagcccac

SEQ ID NO: 5399495 - DNA, 14 bp, Homo sapiens
cgcccttccatgtg

SEQ ID NO: 5399496 - DNA, 14 bp, Homo sapiens
cgcccttcccacag

SEQ ID NO: 5399497 - DNA, 12 bp, Homo sapiens
cgcccttcctct

SEQ ID NO: 5399498 - DNA, 17 bp, Homo sapiens
cgcccttcctctccacc

SEQ ID NO: 5399499 - DNA, 14 bp, Homo sapiens
cgcccttcctgtgc

SEQ ID NO: 5399500 - DNA, 20 bp, Homo sapiens
cgcccttctcccggccctca

SEQ ID NO: 5399501 - DNA, 18 bp, Homo sapiens
cgcccttgaggggcccca

SEQ ID NO: 5399502 - DNA, 20 bp, Homo sapiens
cgcccttgaggggccccagc

SEQ ID NO: 5399503 - DNA, 15 bp, Homo sapiens
cgcccttggagcctt

SEQ ID NO: 5399504 - DNA, 20 bp, Homo sapiens
cgcccttggagccttccacc

SEQ ID NO: 5399505 - DNA, 11 bp, Homo sapiens
cgcccttggct

SEQ ID NO: 5399506 - DNA, 17 bp, Homo sapiens
cgccctttccttgcctt

SEQ ID NO: 5399507 - DNA, 18 bp, Homo sapiens
cgccctttccttgccttc

SEQ ID NO: 5399508 - DNA, 14 bp, Homo sapiens
cgcccttttcccct

SEQ ID NO: 5399509 - DNA, 18 bp, Homo sapiens
cgccgactttgtaccccc

SEQ ID NO: 5399510 - DNA, 19 bp, Homo sapiens
cgccgagtctgtctctgtc

SEQ ID NO: 5399511 - DNA, 21 bp, Homo sapiens
cgccgatataagccatagccc

SEQ ID NO: 5399512 - DNA, 16 bp, Homo sapiens
cgccgcagaagcagcc

SEQ ID NO: 5399513 - DNA, 19 bp, Homo sapiens
cgccgcagaagcagcccct

SEQ ID NO: 5399514 - DNA, 13 bp, Homo sapiens
cgccgcagaccag

SEQ ID NO: 5399515 - DNA, 12 bp, Homo sapiens
cgccgcaggtgt

SEQ ID NO: 5399516 - DNA, 13 bp, Homo sapiens
cgccgccaccagc

SEQ ID NO: 5399517 - DNA, 14 bp, Homo sapiens
cgccgccaccctgc

SEQ ID NO: 5399518 - DNA, 13 bp, Homo sapiens
cgccgccctccat

SEQ ID NO: 5399519 - DNA, 13 bp, Homo sapiens
cgccgccgccgct

SEQ ID NO: 5399520 - DNA, 18 bp, Homo sapiens
cgccgcctcccacggcac

SEQ ID NO: 5399521 - DNA, 13 bp, Homo sapiens
cgccgcctcgccc

SEQ ID NO: 5399522 - DNA, 15 bp, Homo sapiens
cgccgcctcgccccc

SEQ ID NO: 5399523 - DNA, 16 bp, Homo sapiens
cgccgcctcgggccgc

SEQ ID NO: 5399524 - DNA, 21 bp, Homo sapiens
cgccgcctgctccctgcaccc

SEQ ID NO: 5399525 - DNA, 14 bp, Homo sapiens
cgccgcctggtact

SEQ ID NO: 5399526 - DNA, 18 bp, Homo sapiens
cgccgcgccagtccccgc

SEQ ID NO: 5399527 - DNA, 23 bp, Homo sapiens
cgccgcgcgcccctgcccgagag

SEQ ID NO: 5399528 - DNA, 22 bp, Homo sapiens
cgccgctgaccctgggcctgga

SEQ ID NO: 5399529 - DNA, 19 bp, Homo sapiens
cgccggaagtggctccgtg

SEQ ID NO: 5399530 - DNA, 15 bp, Homo sapiens
cgccggaggccagct

SEQ ID NO: 5399531 - DNA, 21 bp, Homo sapiens
cgccggaggccagctatctgc

SEQ ID NO: 5399532 - DNA, 23 bp, Homo sapiens
cgccggagtccactcccagtgct

SEQ ID NO: 5399533 - DNA, 15 bp, Homo sapiens
cgccggatctgaggg

SEQ ID NO: 5399534 - DNA, 17 bp, Homo sapiens
cgccggcaggggcccct

SEQ ID NO: 5399535 - DNA, 21 bp, Homo sapiens
cgccggccgcgcaccgccatg

SEQ ID NO: 5399536 - DNA, 14 bp, Homo sapiens
cgccggcctctgct

SEQ ID NO: 5399537 - DNA, 15 bp, Homo sapiens
cgccggcctctgctg

SEQ ID NO: 5399538 - DNA, 20 bp, Homo sapiens
cgccggcctctgctgccccc

SEQ ID NO: 5399539 - DNA, 13 bp, Homo sapiens
cgccggcttcctc

SEQ ID NO: 5399540 - DNA, 19 bp, Homo sapiens
cgccggctttcagggcagc

SEQ ID NO: 5399541 - DNA, 21 bp, Homo sapiens
cgccgggagaagccaccttcc

SEQ ID NO: 5399542 - DNA, 18 bp, Homo sapiens
cgccgggcaccaactcca

SEQ ID NO: 5399543 - DNA, 20 bp, Homo sapiens
cgccggggacagaggcctgc

SEQ ID NO: 5399544 - DNA, 14 bp, Homo sapiens
cgccggggctggcc

SEQ ID NO: 5399545 - DNA, 15 bp, Homo sapiens
cgccggggtcctggg

SEQ ID NO: 5399546 - DNA, 19 bp, Homo sapiens
cgccggtccggcgccccgc

SEQ ID NO: 5399547 - DNA, 13 bp, Homo sapiens
cgccggttccacg

SEQ ID NO: 5399548 - DNA, 19 bp, Homo sapiens
cgccgtctgcaggggcctg

SEQ ID NO: 5399549 - DNA, 21 bp, Homo sapiens
cgccgtctgcaggggcctgga

SEQ ID NO: 5399550 - DNA, 21 bp, Homo sapiens
cgccgtgccggcggcagcccc

SEQ ID NO: 5399551 - DNA, 17 bp, Homo sapiens
cgccgtgctgggcagcc

SEQ ID NO: 5399552 - DNA, 13 bp, Homo sapiens
cgccgtggagcat

SEQ ID NO: 5399553 - DNA, 14 bp, Homo sapiens
cgccgtgggctgcg

SEQ ID NO: 5399554 - DNA, 14 bp, Homo sapiens
cgcctacaggagtg

SEQ ID NO: 5399555 - DNA, 19 bp, Homo sapiens
cgcctaccaatctctgctc

SEQ ID NO: 5399556 - DNA, 19 bp, Homo sapiens
cgcctactggggcagggca

SEQ ID NO: 5399557 - DNA, 23 bp, Homo sapiens
cgcctagagcgcggctggctctg

SEQ ID NO: 5399558 - DNA, 20 bp, Homo sapiens
cgcctagtggggtctccctc

SEQ ID NO: 5399559 - DNA, 13 bp, Homo sapiens
cgcctatcttagg

SEQ ID NO: 5399560 - DNA, 16 bp, Homo sapiens
cgcctatgatcccagc

SEQ ID NO: 5399561 - DNA, 24 bp, Homo sapiens
cgcctcaaggaagagccagccgta

SEQ ID NO: 5399562 - DNA, 13 bp, Homo sapiens
cgcctcacctgca

SEQ ID NO: 5399563 - DNA, 12 bp, Homo sapiens
cgcctcactggg

SEQ ID NO: 5399564 - DNA, 14 bp, Homo sapiens
cgcctcagccctca

SEQ ID NO: 5399565 - DNA, 16 bp, Homo sapiens
cgcctcagccctcagt

SEQ ID NO: 5399566 - DNA, 11 bp, Homo sapiens
cgcctcagcct

SEQ ID NO: 5399567 - DNA, 15 bp, Homo sapiens
cgcctcagcctctca

SEQ ID NO: 5399568 - DNA, 16 bp, Homo sapiens
cgcctcagggccaggc

SEQ ID NO: 5399569 - DNA, 13 bp, Homo sapiens
cgcctccaccctg

SEQ ID NO: 5399570 - DNA, 18 bp, Homo sapiens
cgcctccaccctgccctg

SEQ ID NO: 5399571 - DNA, 20 bp, Homo sapiens
cgcctccaccctgccctgct

SEQ ID NO: 5399572 - DNA, 15 bp, Homo sapiens
cgcctccactctagt

SEQ ID NO: 5399573 - DNA, 15 bp, Homo sapiens
cgcctccaggagcct

SEQ ID NO: 5399574 - DNA, 20 bp, Homo sapiens
cgcctccatccacacacagc

SEQ ID NO: 5399575 - DNA, 14 bp, Homo sapiens
cgcctcccacggca

SEQ ID NO: 5399576 - DNA, 13 bp, Homo sapiens
cgcctcccactgg

SEQ ID NO: 5399577 - DNA, 14 bp, Homo sapiens
cgcctcccactggg

SEQ ID NO: 5399578 - DNA, 15 bp, Homo sapiens
cgcctcccactgggg

SEQ ID NO: 5399579 - DNA, 11 bp, Homo sapiens
cgcctcccagc

SEQ ID NO: 5399580 - DNA, 12 bp, Homo sapiens
cgcctcccagcc

SEQ ID NO: 5399581 - DNA, 18 bp, Homo sapiens
cgcctcccagccccaggg

SEQ ID NO: 5399582 - DNA, 18 bp, Homo sapiens
cgcctccccacctccagg

SEQ ID NO: 5399583 - DNA, 19 bp, Homo sapiens
cgcctccccacctccaggc

SEQ ID NO: 5399584 - DNA, 20 bp, Homo sapiens
cgcctccccatacttcctgg

SEQ ID NO: 5399585 - DNA, 22 bp, Homo sapiens
cgcctccccatacttcctggga

SEQ ID NO: 5399586 - DNA, 10 bp, Homo sapiens
cgcctccccg

SEQ ID NO: 5399587 - DNA, 14 bp, Homo sapiens
cgcctcccgccgcc

SEQ ID NO: 5399588 - DNA, 21 bp, Homo sapiens
cgcctcccggggtgcccgtgt

SEQ ID NO: 5399589 - DNA, 20 bp, Homo sapiens
cgcctccctccaccccagga

SEQ ID NO: 5399590 - DNA, 15 bp, Homo sapiens
cgcctccctctcaga

SEQ ID NO: 5399591 - DNA, 15 bp, Homo sapiens
cgcctccgcccaaat

SEQ ID NO: 5399592 - DNA, 20 bp, Homo sapiens
cgcctccgggacccccagga

SEQ ID NO: 5399593 - DNA, 22 bp, Homo sapiens
cgcctccgggacccccaggaca

SEQ ID NO: 5399594 - DNA, 14 bp, Homo sapiens
cgcctcctccagac

SEQ ID NO: 5399595 - DNA, 17 bp, Homo sapiens
cgcctcctccagactcg

SEQ ID NO: 5399596 - DNA, 15 bp, Homo sapiens
cgcctcctccagctc

SEQ ID NO: 5399597 - DNA, 13 bp, Homo sapiens
cgcctcctggaca

SEQ ID NO: 5399598 - DNA, 18 bp, Homo sapiens
cgcctcgacctccccacc

SEQ ID NO: 5399599 - DNA, 14 bp, Homo sapiens
cgcctcgcccaccg

SEQ ID NO: 5399600 - DNA, 16 bp, Homo sapiens
cgcctcgcccaccgca

SEQ ID NO: 5399601 - DNA, 19 bp, Homo sapiens
cgcctcgcccaccgcatgc

SEQ ID NO: 5399602 - DNA, 21 bp, Homo sapiens
cgcctcggagtgtggcctgga

SEQ ID NO: 5399603 - DNA, 22 bp, Homo sapiens
cgcctcggagtgtggcctggat

SEQ ID NO: 5399604 - DNA, 22 bp, Homo sapiens
cgcctcgggccgcctcctccag

SEQ ID NO: 5399605 - DNA, 15 bp, Homo sapiens
cgcctcgtgccagca

SEQ ID NO: 5399606 - DNA, 16 bp, Homo sapiens
cgcctcgtgccagcag

SEQ ID NO: 5399607 - DNA, 14 bp, Homo sapiens
cgcctctccccacc

SEQ ID NO: 5399608 - DNA, 15 bp, Homo sapiens
cgcctctcccgtcag

SEQ ID NO: 5399609 - DNA, 21 bp, Homo sapiens
cgcctctcccgtcagggccca

SEQ ID NO: 5399610 - DNA, 13 bp, Homo sapiens
cgcctctgagcca

SEQ ID NO: 5399611 - DNA, 14 bp, Homo sapiens
cgcctctgagccag

SEQ ID NO: 5399612 - DNA, 14 bp, Homo sapiens
cgcctctgcccagc

SEQ ID NO: 5399613 - DNA, 19 bp, Homo sapiens
cgcctctggccgccacccc

SEQ ID NO: 5399614 - DNA, 18 bp, Homo sapiens
cgcctctggttccactca

SEQ ID NO: 5399615 - DNA, 21 bp, Homo sapiens
cgcctctggttccactcagct

SEQ ID NO: 5399616 - DNA, 14 bp, Homo sapiens
cgcctctgtcctgg

SEQ ID NO: 5399617 - DNA, 15 bp, Homo sapiens
cgcctctgtcctggc

SEQ ID NO: 5399618 - DNA, 18 bp, Homo sapiens
cgcctctgtgtacatgtg

SEQ ID NO: 5399619 - DNA, 10 bp, Homo sapiens
cgcctcttcc

SEQ ID NO: 5399620 - DNA, 18 bp, Homo sapiens
cgcctcttcctctgggca

SEQ ID NO: 5399621 - DNA, 16 bp, Homo sapiens
cgcctcttttccctct

SEQ ID NO: 5399622 - DNA, 21 bp, Homo sapiens
cgcctgaaactttgaggataa

SEQ ID NO: 5399623 - DNA, 15 bp, Homo sapiens
cgcctgaaggcacag

SEQ ID NO: 5399624 - DNA, 14 bp, Homo sapiens
cgcctgagacagca

SEQ ID NO: 5399625 - DNA, 21 bp, Homo sapiens
cgcctgagcccaggaggtgga

SEQ ID NO: 5399626 - DNA, 14 bp, Homo sapiens
cgcctgagctcctg

SEQ ID NO: 5399627 - DNA, 15 bp, Homo sapiens
cgcctgagctcctgc

SEQ ID NO: 5399628 - DNA, 14 bp, Homo sapiens
cgcctgagtcagtg

SEQ ID NO: 5399629 - DNA, 18 bp, Homo sapiens
cgcctgagtgagtgtgtg

SEQ ID NO: 5399630 - DNA, 19 bp, Homo sapiens
cgcctgagtgagtgtgtgt

SEQ ID NO: 5399631 - DNA, 20 bp, Homo sapiens
cgcctgattggggcctcacc

SEQ ID NO: 5399632 - DNA, 18 bp, Homo sapiens
cgcctgcaaacgctgcct

SEQ ID NO: 5399633 - DNA, 20 bp, Homo sapiens
cgcctgcaaacgctgcctgc

SEQ ID NO: 5399634 - DNA, 14 bp, Homo sapiens
cgcctgcacctgcg

SEQ ID NO: 5399635 - DNA, 24 bp, Homo sapiens
cgcctgcacctgcgcctggctctg

SEQ ID NO: 5399636 - DNA, 18 bp, Homo sapiens
cgcctgcaggagagagca

SEQ ID NO: 5399637 - DNA, 20 bp, Homo sapiens
cgcctgccaccacgctggcc

SEQ ID NO: 5399638 - DNA, 14 bp, Homo sapiens
cgcctgccacctct

SEQ ID NO: 5399639 - DNA, 23 bp, Homo sapiens
cgcctgccataccgctggggaac

SEQ ID NO: 5399640 - DNA, 11 bp, Homo sapiens
cgcctgccatc

SEQ ID NO: 5399641 - DNA, 17 bp, Homo sapiens
cgcctgcccacctgcct

SEQ ID NO: 5399642 - DNA, 18 bp, Homo sapiens
cgcctgcccacctgcctg

SEQ ID NO: 5399643 - DNA, 19 bp, Homo sapiens
cgcctgcccagactgatga

SEQ ID NO: 5399644 - DNA, 18 bp, Homo sapiens
cgcctgcccccagcactc

SEQ ID NO: 5399645 - DNA, 23 bp, Homo sapiens
cgcctgcccccagcactcctctg

SEQ ID NO: 5399646 - DNA, 17 bp, Homo sapiens
cgcctgcccccagcgtg

SEQ ID NO: 5399647 - DNA, 21 bp, Homo sapiens
cgcctgcccccagcgtggggg

SEQ ID NO: 5399648 - DNA, 23 bp, Homo sapiens
cgctggatggggagtctcatgca

SEQ ID NO: 5399649 - DNA, 13 bp, Homo sapiens
cgctggcagagaa

SEQ ID NO: 5399650 - DNA, 14 bp, Homo sapiens
cgctggcagagaag

SEQ ID NO: 5399651 - DNA, 14 bp, Homo sapiens
cgctggcagccacc

SEQ ID NO: 5399652 - DNA, 10 bp, Homo sapiens
cgctggccca

SEQ ID NO: 5399653 - DNA, 23 bp, Homo sapiens
cgctggcccagccggcctctctg

SEQ ID NO: 5399654 - DNA, 18 bp, Homo sapiens
cgctggcccagggtaggg

SEQ ID NO: 5399655 - DNA, 13 bp, Homo sapiens
cgctggcccccac

SEQ ID NO: 5399656 - DNA, 16 bp, Homo sapiens
cgctggcccccactgg

SEQ ID NO: 5399657 - DNA, 20 bp, Homo sapiens
cgctggcccccactggctgt

SEQ ID NO: 5399658 - DNA, 21 bp, Homo sapiens
cgctggccgagctgaagaact

SEQ ID NO: 5399659 - DNA, 18 bp, Homo sapiens
cgctggccgggaccccga

SEQ ID NO: 5399660 - DNA, 22 bp, Homo sapiens
cgctggccttcgtctccatctc

SEQ ID NO: 5399661 - DNA, 22 bp, Homo sapiens
cgctggctcacgcgttctggga

SEQ ID NO: 5399662 - DNA, 16 bp, Homo sapiens
cgctggctcaggaaga

SEQ ID NO: 5399663 - DNA, 17 bp, Homo sapiens
cgctggctcaggaagaa

SEQ ID NO: 5399664 - DNA, 21 bp, Homo sapiens
cgctggctcaggaagaaaccc

SEQ ID NO: 5399665 - DNA, 13 bp, Homo sapiens
cgctggctcctac

SEQ ID NO: 5399666 - DNA, 15 bp, Homo sapiens
cgctggctcctccag

SEQ ID NO: 5399667 - DNA, 14 bp, Homo sapiens
cgctggctgcactc

SEQ ID NO: 5399668 - DNA, 20 bp, Homo sapiens
cgctggctgggggcctcact

SEQ ID NO: 5399669 - DNA, 15 bp, Homo sapiens
cgctggctttctctc

SEQ ID NO: 5399670 - DNA, 15 bp, Homo sapiens
cgctgggacacagac

SEQ ID NO: 5399671 - DNA, 16 bp, Homo sapiens
cgctgggacacagacc

SEQ ID NO: 5399672 - DNA, 17 bp, Homo sapiens
cgctgggagaaaagcca

SEQ ID NO: 5399673 - DNA, 14 bp, Homo sapiens
cgctgggagagcca

SEQ ID NO: 5399674 - DNA, 21 bp, Homo sapiens
cgctgggaggaacctgaacct

SEQ ID NO: 5399675 - DNA, 22 bp, Homo sapiens
cgctgggatttcttcgctgctc

SEQ ID NO: 5399676 - DNA, 14 bp, Homo sapiens
cgctgggcacttcc

SEQ ID NO: 5399677 - DNA, 16 bp, Homo sapiens
cgctgggcacttccct

SEQ ID NO: 5399678 - DNA, 19 bp, Homo sapiens
cgctgggcacttccctgct

SEQ ID NO: 5399679 - DNA, 14 bp, Homo sapiens
cgctgggctgagcc

SEQ ID NO: 5399680 - DNA, 15 bp, Homo sapiens
cgctgggctgagccc

SEQ ID NO: 5399681 - DNA, 13 bp, Homo sapiens
cgctggggaacag

SEQ ID NO: 5399682 - DNA, 20 bp, Homo sapiens
cgctggggaccggttcccac

SEQ ID NO: 5399683 - DNA, 21 bp, Homo sapiens
cgctggggaccggttcccaca

SEQ ID NO: 5399684 - DNA, 17 bp, Homo sapiens
cgctggggccagttggt

SEQ ID NO: 5399685 - DNA, 22 bp, Homo sapiens
cgctggggctctctgagactct

SEQ ID NO: 5399686 - DNA, 17 bp, Homo sapiens
cgctgggggctggacct

SEQ ID NO: 5399687 - DNA, 14 bp, Homo sapiens
cgctgggggtgggg

SEQ ID NO: 5399688 - DNA, 18 bp, Homo sapiens
cgctgggtattaccatgt

SEQ ID NO: 5399689 - DNA, 13 bp, Homo sapiens
cgctgggtcctct

SEQ ID NO: 5399690 - DNA, 22 bp, Homo sapiens
cgctgggtggttttttccccct

SEQ ID NO: 5399691 - DNA, 14 bp, Homo sapiens
cgctggtaactgtt

SEQ ID NO: 5399692 - DNA, 22 bp, Homo sapiens
cgctggtcccctccctctgtct

SEQ ID NO: 5399693 - DNA, 15 bp, Homo sapiens
cgctggtccctgccc

SEQ ID NO: 5399694 - DNA, 18 bp, Homo sapiens
cgctggtccctgccctcc

SEQ ID NO: 5399695 - DNA, 13 bp, Homo sapiens
cgctggtggacca

SEQ ID NO: 5399696 - DNA, 16 bp, Homo sapiens
cgctggtggaccacag

SEQ ID NO: 5399697 - DNA, 15 bp, Homo sapiens
cgctggttccgccag

SEQ ID NO: 5399698 - DNA, 22 bp, Homo sapiens
cgctgtatgaaaggagagagca

SEQ ID NO: 5399699 - DNA, 19 bp, Homo sapiens
cgctgtcaaggccgagggc

SEQ ID NO: 5399700 - DNA, 23 bp, Homo sapiens
cgctgtcacccagcaaggcacag

SEQ ID NO: 5399701 - DNA, 19 bp, Homo sapiens
cgctgtcactggctggctc

SEQ ID NO: 5399702 - DNA, 19 bp, Homo sapiens
cgctgtcctctcgagccca

SEQ ID NO: 5399703 - DNA, 15 bp, Homo sapiens
cgctgtcctgagatg

SEQ ID NO: 5399704 - DNA, 12 bp, Homo sapiens
cgctgtcctgcg

SEQ ID NO: 5399705 - DNA, 22 bp, Homo sapiens
cgctgtcctgcgttcagcccct

SEQ ID NO: 5399706 - DNA, 16 bp, Homo sapiens
cgctgtcctgctgtgt

SEQ ID NO: 5399707 - DNA, 17 bp, Homo sapiens
cgctgtcgccccaggcc

SEQ ID NO: 5399708 - DNA, 14 bp, Homo sapiens
cgctgtctccagac

SEQ ID NO: 5399709 - DNA, 20 bp, Homo sapiens
cgctgtctccagacccccac

SEQ ID NO: 5399710 - DNA, 22 bp, Homo sapiens
cgctgtctccagacccccaccc

SEQ ID NO: 5399711 - DNA, 13 bp, Homo sapiens
cgctgtctccctc

SEQ ID NO: 5399712 - DNA, 15 bp, Homo sapiens
cgctgtctccctcct

SEQ ID NO: 5399713 - DNA, 20 bp, Homo sapiens
cgctgtgaaaatgaggagga

SEQ ID NO: 5399714 - DNA, 15 bp, Homo sapiens
cgctgtgattttaag

SEQ ID NO: 5399715 - DNA, 14 bp, Homo sapiens
cgctgtgccaccac

SEQ ID NO: 5399716 - DNA, 20 bp, Homo sapiens
cgctgtgccaccacccctcc

SEQ ID NO: 5399717 - DNA, 20 bp, Homo sapiens
cgctgtgcccccctcctccc

SEQ ID NO: 5399718 - DNA, 16 bp, Homo sapiens
cgctgtgctgccctgc

SEQ ID NO: 5399719 - DNA, 17 bp, Homo sapiens
cgctgtgctgccctgcc

SEQ ID NO: 5399720 - DNA, 21 bp, Homo sapiens
cgctgtgctggtctctaggcc

SEQ ID NO: 5399721 - DNA, 17 bp, Homo sapiens
cgctgtggactgtcctg

SEQ ID NO: 5399722 - DNA, 19 bp, Homo sapiens
cgctgtggccggtgccagc

SEQ ID NO: 5399723 - DNA, 13 bp, Homo sapiens
cgctgtggctcct

SEQ ID NO: 5399724 - DNA, 17 bp, Homo sapiens
cgctgtggctcctgcct

SEQ ID NO: 5399725 - DNA, 13 bp, Homo sapiens
cgctgttgctgaa

SEQ ID NO: 5399726 - DNA, 17 bp, Homo sapiens
cgctgttgtcacatctc

SEQ ID NO: 5399727 - DNA, 17 bp, Homo sapiens
cgcttaccttcccatgc

SEQ ID NO: 5399728 - DNA, 22 bp, Homo sapiens
cgcttactcctctgaccctcct

SEQ ID NO: 5399729 - DNA, 14 bp, Homo sapiens
cgcttagaaacatg

SEQ ID NO: 5399730 - DNA, 13 bp, Homo sapiens
cgcttagccccgc

SEQ ID NO: 5399731 - DNA, 19 bp, Homo sapiens
cgcttagcgctctggacag

SEQ ID NO: 5399732 - DNA, 17 bp, Homo sapiens
cgcttcacccctgcact

SEQ ID NO: 5399733 - DNA, 20 bp, Homo sapiens
cgcttcagacacgcacttct

SEQ ID NO: 5399734 - DNA, 13 bp, Homo sapiens
cgcttccagacca

SEQ ID NO: 5399735 - DNA, 14 bp, Homo sapiens
cgcttccagaccac

SEQ ID NO: 5399736 - DNA, 23 bp, Homo sapiens
cgcttccagaccacctgccagcc

SEQ ID NO: 5399737 - DNA, 14 bp, Homo sapiens
cgcttcccagaggc

SEQ ID NO: 5399738 - DNA, 21 bp, Homo sapiens
cgcttccccagctcagagccc

SEQ ID NO: 5399739 - DNA, 17 bp, Homo sapiens
cgcttccccttgccacg

SEQ ID NO: 5399740 - DNA, 18 bp, Homo sapiens
cgcttccctcctgcccgc

SEQ ID NO: 5399741 - DNA, 20 bp, Homo sapiens
cgcttccggctcctgtgctt

SEQ ID NO: 5399742 - DNA, 18 bp, Homo sapiens
cgcttcctccggctggac

SEQ ID NO: 5399743 - DNA, 17 bp, Homo sapiens
cgcttcgaactccaggc

SEQ ID NO: 5399744 - DNA, 18 bp, Homo sapiens
cgcttcgccatgtgctgt

SEQ ID NO: 5399745 - DNA, 13 bp, Homo sapiens
cgcttctccccag

SEQ ID NO: 5399746 - DNA, 16 bp, Homo sapiens
cgcttctcctgcagtc

SEQ ID NO: 5399747 - DNA, 19 bp, Homo sapiens
cgcttctctcttttaaagt

SEQ ID NO: 5399748 - DNA, 14 bp, Homo sapiens
cgcttctgcctgca

SEQ ID NO: 5399749 - DNA, 16 bp, Homo sapiens
cgcttctgctggagga

SEQ ID NO: 5399750 - DNA, 17 bp, Homo sapiens
cgcttctgctggaggag

SEQ ID NO: 5399751 - DNA, 10 bp, Homo sapiens
cgcttctgga

SEQ ID NO: 5399752 - DNA, 22 bp, Homo sapiens
cgcttctggaggtggggagggc

SEQ ID NO: 5399753 - DNA, 11 bp, Homo sapiens
cgcttcttttt

SEQ ID NO: 5399754 - DNA, 19 bp, Homo sapiens
cgcttgaaccggggaggtg

SEQ ID NO: 5399755 - DNA, 22 bp, Homo sapiens
cgcttgaaccggggaggtggag

SEQ ID NO: 5399756 - DNA, 20 bp, Homo sapiens
cgcttgaccatgttgcactg

SEQ ID NO: 5399757 - DNA, 21 bp, Homo sapiens
cgcttgaccatgttgcactgt

SEQ ID NO: 5399758 - DNA, 13 bp, Homo sapiens
cgcttgagaaaaa

SEQ ID NO: 5399759 - DNA, 12 bp, Homo sapiens
cgcttgagccca

SEQ ID NO: 5399760 - DNA, 14 bp, Homo sapiens
cgcttgagcccagg

SEQ ID NO: 5399761 - DNA, 16 bp, Homo sapiens
cgcttgagcccaggag

SEQ ID NO: 5399762 - DNA, 17 bp, Homo sapiens
cgcttgagcccaggagt

SEQ ID NO: 5399763 - DNA, 11 bp, Homo sapiens
cgcttgcctcg

SEQ ID NO: 5399764 - DNA, 13 bp, Homo sapiens
cgcttgcctcggc

SEQ ID NO: 5399765 - DNA, 16 bp, Homo sapiens
cgcttgcctcggctcc

SEQ ID NO: 5399766 - DNA, 20 bp, Homo sapiens
cgcttgcctcggctcctgct

SEQ ID NO: 5399767 - DNA, 17 bp, Homo sapiens
cgcttgctctcctggag

SEQ ID NO: 5399768 - DNA, 21 bp, Homo sapiens
cgcttgctctcctggagcaag

SEQ ID NO: 5399769 - DNA, 20 bp, Homo sapiens
cgcttgctggaacacagggg

SEQ ID NO: 5399770 - DNA, 15 bp, Homo sapiens
cgcttgcttctgcag

SEQ ID NO: 5399771 - DNA, 18 bp, Homo sapiens
cgcttgcttttctgtatt

SEQ ID NO: 5399772 - DNA, 22 bp, Homo sapiens
cgcttggagctattttccaggc

SEQ ID NO: 5399773 - DNA, 12 bp, Homo sapiens
cgcttggatctg

SEQ ID NO: 5399774 - DNA, 21 bp, Homo sapiens
cgcttggctccatgctcctca

SEQ ID NO: 5399775 - DNA, 22 bp, Homo sapiens
cgcttggggcatttgtgggact

SEQ ID NO: 5399776 - DNA, 23 bp, Homo sapiens
cgcttgtagaactcactctgggc

SEQ ID NO: 5399777 - DNA, 17 bp, Homo sapiens
cgcttgtccagcgccta

SEQ ID NO: 5399778 - DNA, 15 bp, Homo sapiens
cgcttgtgacagtgc

SEQ ID NO: 5399779 - DNA, 20 bp, Homo sapiens
cgcttgtgcagaaaacattg

SEQ ID NO: 5399780 - DNA, 22 bp, Homo sapiens
cgcttgtgcagaaaacattgtt

SEQ ID NO: 5399781 - DNA, 20 bp, Homo sapiens
cgcttgtggggacccaggct

SEQ ID NO: 5399782 - DNA, 18 bp, Homo sapiens
cgctttatgcccttgcct

SEQ ID NO: 5399783 - DNA, 13 bp, Homo sapiens
cgctttcatgaac

SEQ ID NO: 5399784 - DNA, 22 bp, Homo sapiens
cgctttcatgttactgttgcag

SEQ ID NO: 5399785 - DNA, 13 bp, Homo sapiens
cgctttcctggag

SEQ ID NO: 5399786 - DNA, 17 bp, Homo sapiens
cgctttctaaagttacc

SEQ ID NO: 5399787 - DNA, 16 bp, Homo sapiens
cgctttctacccagcg

SEQ ID NO: 5399788 - DNA, 12 bp, Homo sapiens
cgctttctcagt

SEQ ID NO: 5399789 - DNA, 16 bp, Homo sapiens
cgctttctcctgtgcc

SEQ ID NO: 5399790 - DNA, 20 bp, Homo sapiens
cgctttgaacgtgccagcag

SEQ ID NO: 5399791 - DNA, 16 bp, Homo sapiens
cgctttgatggaggag

SEQ ID NO: 5399792 - DNA, 16 bp, Homo sapiens
cgctttgattcatagt

SEQ ID NO: 5399793 - DNA, 12 bp, Homo sapiens
cgctttgcctgc

SEQ ID NO: 5399794 - DNA, 13 bp, Homo sapiens
cgctttgcctgct

SEQ ID NO: 5399795 - DNA, 12 bp, Homo sapiens
cgctttgtcaca

SEQ ID NO: 5399796 - DNA, 18 bp, Homo sapiens
cgctttgtgattccatgg

SEQ ID NO: 5399797 - DNA, 13 bp, Homo sapiens
cgctttgtttact

SEQ ID NO: 5399798 - DNA, 11 bp, Homo sapiens
cgcttttcctt

SEQ ID NO: 5399799 - DNA, 16 bp, Homo sapiens
cgcttttgcagcagag

SEQ ID NO: 5399800 - DNA, 18 bp, Homo sapiens
cgcttttgcagcagagga

SEQ ID NO: 5399801 - DNA, 21 bp, Homo sapiens
cgcttttgcagcagaggagct

SEQ ID NO: 5399802 - DNA, 20 bp, Homo sapiens
cgctttttcatccttctttc

SEQ ID NO: 5399803 - DNA, 20 bp, Homo sapiens
cggaaaacatgctacacact

SEQ ID NO: 5399804 - DNA, 14 bp, Homo sapiens
cggaaacagaactc

SEQ ID NO: 5399805 - DNA, 22 bp, Homo sapiens
cggaaacaggtgtgtgtgaact

SEQ ID NO: 5399806 - DNA, 22 bp, Homo sapiens
cggaaacatacagaggatgcct

SEQ ID NO: 5399807 - DNA, 12 bp, Homo sapiens
cggaaagaagag

SEQ ID NO: 5399808 - DNA, 13 bp, Homo sapiens
cggaaagcagctc

SEQ ID NO: 5399809 - DNA, 23 bp, Homo sapiens
cggaaagcagtcagcggagagga

SEQ ID NO: 5399810 - DNA, 19 bp, Homo sapiens
cggaaagtttttagaatgt

SEQ ID NO: 5399811 - DNA, 12 bp, Homo sapiens
cggaaatgaagg

SEQ ID NO: 5399812 - DNA, 15 bp, Homo sapiens
cggaacaagcctaaa

SEQ ID NO: 5399813 - DNA, 13 bp, Homo sapiens
cggaacagcagat

SEQ ID NO: 5399814 - DNA, 22 bp, Homo sapiens
cggaacagccaaagaaactcag

SEQ ID NO: 5399815 - DNA, 11 bp, Homo sapiens
cggaacagctc

SEQ ID NO: 5399816 - DNA, 19 bp, Homo sapiens
cggaacagctccttactct

SEQ ID NO: 5399817 - DNA, 13 bp, Homo sapiens
cggaacaggagtg

SEQ ID NO: 5399818 - DNA, 20 bp, Homo sapiens
cggaaccacagggccagagg

SEQ ID NO: 5399819 - DNA, 19 bp, Homo sapiens
cggaacccaagcttagaac

SEQ ID NO: 5399820 - DNA, 20 bp, Homo sapiens
cggaaccgcccaggatcaga

SEQ ID NO: 5399821 - DNA, 20 bp, Homo sapiens
cggaaccgtagactaggaag

SEQ ID NO: 5399822 - DNA, 19 bp, Homo sapiens
cggaacctgtgagctgcac

SEQ ID NO: 5399823 - DNA, 23 bp, Homo sapiens
cggaagaaccagaagtgcagccc

SEQ ID NO: 5399824 - DNA, 12 bp, Homo sapiens
cggaagaactga

SEQ ID NO: 5399825 - DNA, 21 bp, Homo sapiens
cggaagaagagatcaggaaga

SEQ ID NO: 5399826 - DNA, 11 bp, Homo sapiens
cggaagagagg

SEQ ID NO: 5399827 - DNA, 12 bp, Homo sapiens
cggcaccgccca

SEQ ID NO: 5399828 - DNA, 13 bp, Homo sapiens
cggcaccgcccac

SEQ ID NO: 5399829 - DNA, 14 bp, Homo sapiens
cggcaccgcccacc

SEQ ID NO: 5399830 - DNA, 22 bp, Homo sapiens
cggcacctacatccccaggtct

SEQ ID NO: 5399831 - DNA, 22 bp, Homo sapiens
cggcacctgcgagaggtccctg

SEQ ID NO: 5399832 - DNA, 13 bp, Homo sapiens
cggcacctgggcc

SEQ ID NO: 5399833 - DNA, 17 bp, Homo sapiens
cggcacgcacttgcctg

SEQ ID NO: 5399834 - DNA, 16 bp, Homo sapiens
cggcacgtcccatgtg

SEQ ID NO: 5399835 - DNA, 15 bp, Homo sapiens
cggcacgtccttggg

SEQ ID NO: 5399836 - DNA, 20 bp, Homo sapiens
cggcactccaacctaacctg

SEQ ID NO: 5399837 - DNA, 12 bp, Homo sapiens
cggcactgcatg

SEQ ID NO: 5399838 - DNA, 22 bp, Homo sapiens
cggcactggatcccatcaaaga

SEQ ID NO: 5399839 - DNA, 15 bp, Homo sapiens
cggcactgtgcactc

SEQ ID NO: 5399840 - DNA, 14 bp, Homo sapiens
cggcagaactctct

SEQ ID NO: 5399841 - DNA, 15 bp, Homo sapiens
cggcagaactctctg

SEQ ID NO: 5399842 - DNA, 20 bp, Homo sapiens
cggcagagcaattccaggct

SEQ ID NO: 5399843 - DNA, 21 bp, Homo sapiens
cggcagagcaattccaggctg

SEQ ID NO: 5399844 - DNA, 24 bp, Homo sapiens
cggcagagcaattccaggctgagc

SEQ ID NO: 5399845 - DNA, 22 bp, Homo sapiens
cggcagaggcagggccctgggg

SEQ ID NO: 5399846 - DNA, 24 bp, Homo sapiens
cggcagaggcagggccctggggtc

SEQ ID NO: 5399847 - DNA, 12 bp, Homo sapiens
cggcagaggtgg

SEQ ID NO: 5399848 - DNA, 22 bp, Homo sapiens
cggcagatgatgctttggaaga

SEQ ID NO: 5399849 - DNA, 18 bp, Homo sapiens
cggcagatgggcctgtgt

SEQ ID NO: 5399850 - DNA, 14 bp, Homo sapiens
cggcagcagccatc

SEQ ID NO: 5399851 - DNA, 18 bp, Homo sapiens
cggcagcatcccagccag

SEQ ID NO: 5399852 - DNA, 15 bp, Homo sapiens
cggcagccccagcct

SEQ ID NO: 5399853 - DNA, 22 bp, Homo sapiens
cggcagccccagcctgctagct

SEQ ID NO: 5399854 - DNA, 16 bp, Homo sapiens
cggcagcccccccctc

SEQ ID NO: 5399855 - DNA, 21 bp, Homo sapiens
cggcagcccccccctcaaggg

SEQ ID NO: 5399856 - DNA, 23 bp, Homo sapiens
cggcagcccctcccagcctaccc

SEQ ID NO: 5399857 - DNA, 16 bp, Homo sapiens
cggcagccccttctgg

SEQ ID NO: 5399858 - DNA, 17 bp, Homo sapiens
cggcagccccttctggc

SEQ ID NO: 5399859 - DNA, 20 bp, Homo sapiens
cggcagcctcaacctccctg

SEQ ID NO: 5399860 - DNA, 22 bp, Homo sapiens
cggcagcctcaggggcctcagg

SEQ ID NO: 5399861 - DNA, 15 bp, Homo sapiens
cggcagcgggcggag

SEQ ID NO: 5399862 - DNA, 13 bp, Homo sapiens
cggcagctggggc

SEQ ID NO: 5399863 - DNA, 17 bp, Homo sapiens
cggcagcttctgccccc

SEQ ID NO: 5399864 - DNA, 17 bp, Homo sapiens
cggcagcttgagcctgt

SEQ ID NO: 5399865 - DNA, 22 bp, Homo sapiens
cggcaggacaacgaggaagccc

SEQ ID NO: 5399866 - DNA, 17 bp, Homo sapiens
cggcaggagcaggaaca

SEQ ID NO: 5399867 - DNA, 18 bp, Homo sapiens
cggcaggagcaggaacag

SEQ ID NO: 5399868 - DNA, 12 bp, Homo sapiens
cggcaggcagag

SEQ ID NO: 5399869 - DNA, 21 bp, Homo sapiens
cggcaggcatggctggtgcct

SEQ ID NO: 5399870 - DNA, 15 bp, Homo sapiens
cggcaggccctgcag

SEQ ID NO: 5399871 - DNA, 16 bp, Homo sapiens
cggcaggccctgcagt

SEQ ID NO: 5399872 - DNA, 17 bp, Homo sapiens
cggcaggcgtgtggcag

SEQ ID NO: 5399873 - DNA, 20 bp, Homo sapiens
cggcaggctcactgccaggc

SEQ ID NO: 5399874 - DNA, 18 bp, Homo sapiens
cggcagggaacctagtgc

SEQ ID NO: 5399875 - DNA, 17 bp, Homo sapiens
cggcagggccaggctgg

SEQ ID NO: 5399876 - DNA, 20 bp, Homo sapiens
cggcagggcgggcagagggc

SEQ ID NO: 5399877 - DNA, 20 bp, Homo sapiens
cggcaggggcccctcctctg

SEQ ID NO: 5399878 - DNA, 22 bp, Homo sapiens
cggcaggggcccctcctctgtg

SEQ ID NO: 5399879 - DNA, 17 bp, Homo sapiens
cggcaggggcctggaga

SEQ ID NO: 5399880 - DNA, 18 bp, Homo sapiens
cggcaggggcctggagat

SEQ ID NO: 5399881 - DNA, 21 bp, Homo sapiens
cggcaggtggcctaaggctgc

SEQ ID NO: 5399882 - DNA, 19 bp, Homo sapiens
cggcagtgctggttctcca

SEQ ID NO: 5399883 - DNA, 15 bp, Homo sapiens
cggcagtggctgggg

SEQ ID NO: 5399884 - DNA, 16 bp, Homo sapiens
cggcagtggctggggg

SEQ ID NO: 5399885 - DNA, 23 bp, Homo sapiens
cggcagtggctgggggactgctt

SEQ ID NO: 5399886 - DNA, 17 bp, Homo sapiens
cggcagtgggcctgctg

SEQ ID NO: 5399887 - DNA, 19 bp, Homo sapiens
cggcatattattccatatc

SEQ ID NO: 5399888 - DNA, 19 bp, Homo sapiens
cggcatcatttcccctccc

SEQ ID NO: 5399889 - DNA, 19 bp, Homo sapiens
cggcatccgagcccctgtt

SEQ ID NO: 5399890 - DNA, 19 bp, Homo sapiens
cggcatccttgcctgtcta

SEQ ID NO: 5399891 - DNA, 22 bp, Homo sapiens
cggcatcgcatccgtcctgggc

SEQ ID NO: 5399892 - DNA, 21 bp, Homo sapiens
cggcatctcccctagctcacc

SEQ ID NO: 5399893 - DNA, 22 bp, Homo sapiens
cggcatctcccctagctcacca

SEQ ID NO: 5399894 - DNA, 22 bp, Homo sapiens
cggcatgaggccccgaggctcg

SEQ ID NO: 5399895 - DNA, 16 bp, Homo sapiens
cggcatgccaggaccc

SEQ ID NO: 5399896 - DNA, 21 bp, Homo sapiens
cggcatgccgagtgccccaga

SEQ ID NO: 5399897 - DNA, 14 bp, Homo sapiens
cggcatggctggga

SEQ ID NO: 5399898 - DNA, 21 bp, Homo sapiens
cggcatgggaaagccacctct

SEQ ID NO: 5399899 - DNA, 15 bp, Homo sapiens
cggcattaaagccat

SEQ ID NO: 5399900 - DNA, 14 bp, Homo sapiens
cggcattcacacac

SEQ ID NO: 5399901 - DNA, 15 bp, Homo sapiens
cggcattcacacaca

SEQ ID NO: 5399902 - DNA, 20 bp, Homo sapiens
cggcattcacacacagcctg

SEQ ID NO: 5399903 - DNA, 21 bp, Homo sapiens
cggcattcacacacagcctgg

SEQ ID NO: 5399904 - DNA, 22 bp, Homo sapiens
cggcattcacacacagcctggc

SEQ ID NO: 5399905 - DNA, 14 bp, Homo sapiens
cggcattctctgcc

SEQ ID NO: 5399906 - DNA, 16 bp, Homo sapiens
cggcattctctgccca

SEQ ID NO: 5399907 - DNA, 23 bp, Homo sapiens
cggcattggttccctttgctcca

SEQ ID NO: 5399908 - DNA, 13 bp, Homo sapiens
cggcatttaactt

SEQ ID NO: 5399909 - DNA, 13 bp, Homo sapiens
cggcatttgtttc

SEQ ID NO: 5399910 - DNA, 18 bp, Homo sapiens
cggccaagataggacctt

SEQ ID NO: 5399911 - DNA, 18 bp, Homo sapiens
cggccaaggacccaggcg

SEQ ID NO: 5399912 - DNA, 14 bp, Homo sapiens
cggccacacccagc

SEQ ID NO: 5399913 - DNA, 16 bp, Homo sapiens
cggccacacccagcgg

SEQ ID NO: 5399914 - DNA, 18 bp, Homo sapiens
cggccacacccagcggcc

SEQ ID NO: 5399915 - DNA, 20 bp, Homo sapiens
cggccacaccccagactcca

SEQ ID NO: 5399916 - DNA, 22 bp, Homo sapiens
cggccacaccccagactccagg

SEQ ID NO: 5399917 - DNA, 13 bp, Homo sapiens
cggccacacccct

SEQ ID NO: 5399918 - DNA, 17 bp, Homo sapiens
cggccacagcactagag

SEQ ID NO: 5399919 - DNA, 14 bp, Homo sapiens
cggccacatcattc

SEQ ID NO: 5399920 - DNA, 19 bp, Homo sapiens
cggccacatcattctgtgt

SEQ ID NO: 5399921 - DNA, 16 bp, Homo sapiens
cggccacctcaccctc

SEQ ID NO: 5399922 - DNA, 13 bp, Homo sapiens
cggccacctctgc

SEQ ID NO: 5399923 - DNA, 16 bp, Homo sapiens
cggccacctgcggtgc

SEQ ID NO: 5399924 - DNA, 19 bp, Homo sapiens
cggccacgcactgggccac

SEQ ID NO: 5399925 - DNA, 18 bp, Homo sapiens
cggccacggccacagtca

SEQ ID NO: 5399926 - DNA, 20 bp, Homo sapiens
cggccactagtggggtcctg

SEQ ID NO: 5399927 - DNA, 15 bp, Homo sapiens
cggccactccctgcc

SEQ ID NO: 5399928 - DNA, 17 bp, Homo sapiens
cggccactccctgccaa

SEQ ID NO: 5399929 - DNA, 19 bp, Homo sapiens
cggccactccctgccaact

SEQ ID NO: 5399930 - DNA, 13 bp, Homo sapiens
cggccactgcagt

SEQ ID NO: 5399931 - DNA, 19 bp, Homo sapiens
cggccactgtgtctctgtt

SEQ ID NO: 5399932 - DNA, 10 bp, Homo sapiens
cggccagcca

SEQ ID NO: 5399933 - DNA, 18 bp, Homo sapiens
cggccagccctcccagca

SEQ ID NO: 5399934 - DNA, 20 bp, Homo sapiens
cggccagccctcccagcagt

SEQ ID NO: 5399935 - DNA, 14 bp, Homo sapiens
cggccagcgggcac

SEQ ID NO: 5399936 - DNA, 19 bp, Homo sapiens
cggccagcgggcacagggc

SEQ ID NO: 5399937 - DNA, 14 bp, Homo sapiens
cggccagctctgga

SEQ ID NO: 5399938 - DNA, 23 bp, Homo sapiens
cggccagctgggtgccccaggga

SEQ ID NO: 5399939 - DNA, 16 bp, Homo sapiens
cggccaggcacagggc

SEQ ID NO: 5399940 - DNA, 11 bp, Homo sapiens
cggccaggcat

SEQ ID NO: 5399941 - DNA, 20 bp, Homo sapiens
cggccaggccagagggagtg

SEQ ID NO: 5399942 - DNA, 16 bp, Homo sapiens
cggccaggcctgcggg

SEQ ID NO: 5399943 - DNA, 17 bp, Homo sapiens
cggccaggcctgcgggc

SEQ ID NO: 5399944 - DNA, 15 bp, Homo sapiens
cggccaggcgggaga

SEQ ID NO: 5399945 - DNA, 18 bp, Homo sapiens
cggccaggctccctgacc

SEQ ID NO: 5399946 - DNA, 19 bp, Homo sapiens
cggccaggctccctgacca

SEQ ID NO: 5399947 - DNA, 18 bp, Homo sapiens
cggccagggacccaaagc

SEQ ID NO: 5399948 - DNA, 19 bp, Homo sapiens
cggccagggacccaaagca

SEQ ID NO: 5399949 - DNA, 23 bp, Homo sapiens
cggccagggacccaaagcaggat

SEQ ID NO: 5399950 - DNA, 15 bp, Homo sapiens
cggccagggaccccc

SEQ ID NO: 5399951 - DNA, 20 bp, Homo sapiens
cggccagggacccccgaggc

SEQ ID NO: 5399952 - DNA, 23 bp, Homo sapiens
cggccagggacccccgaggcccc

SEQ ID NO: 5399953 - DNA, 17 bp, Homo sapiens
cggccagggagaagctc

SEQ ID NO: 5399954 - DNA, 15 bp, Homo sapiens
cggccagggcctggt

SEQ ID NO: 5399955 - DNA, 21 bp, Homo sapiens
cggccagggcggccagggacc

SEQ ID NO: 5399956 - DNA, 11 bp, Homo sapiens
cggccagggtt

SEQ ID NO: 5399957 - DNA, 19 bp, Homo sapiens
cggccagtgcggctgccag

SEQ ID NO: 5399958 - DNA, 22 bp, Homo sapiens
cggccagtggccttccccagca

SEQ ID NO: 5399959 - DNA, 22 bp, Homo sapiens
cggccatctctttgtacaggaa

SEQ ID NO: 5399960 - DNA, 23 bp, Homo sapiens
cggccatgagggctggagaccag

SEQ ID NO: 5399961 - DNA, 14 bp, Homo sapiens
cggcccaacccaac

SEQ ID NO: 5399962 - DNA, 16 bp, Homo sapiens
cggcccaacctcgccc

SEQ ID NO: 5399963 - DNA, 21 bp, Homo sapiens
cggcccaacctcgccctctct

SEQ ID NO: 5399964 - DNA, 22 bp, Homo sapiens
cggcccacacccgacaccagcc

SEQ ID NO: 5399965 - DNA, 15 bp, Homo sapiens
cggcccacagctccc

SEQ ID NO: 5399966 - DNA, 22 bp, Homo sapiens
cggcccacagctcccaccccac

SEQ ID NO: 5399967 - DNA, 18 bp, Homo sapiens
cggcccacgcagagcccc

SEQ ID NO: 5399968 - DNA, 19 bp, Homo sapiens
cggcccacgcagagccccg

SEQ ID NO: 5399969 - DNA, 23 bp, Homo sapiens
cggcccacgcagagccccggagc

SEQ ID NO: 5399970 - DNA, 17 bp, Homo sapiens
cggcccacgccagctgg

SEQ ID NO: 5399971 - DNA, 19 bp, Homo sapiens
cggcccacgccagctggcc

SEQ ID NO: 5399972 - DNA, 15 bp, Homo sapiens
cggcccagacccagc

SEQ ID NO: 5399973 - DNA, 12 bp, Homo sapiens
cggcccagagac

SEQ ID NO: 5399974 - DNA, 19 bp, Homo sapiens
cggcccagagaccccttcc

SEQ ID NO: 5399975 - DNA, 13 bp, Homo sapiens
cggcccagcctct

SEQ ID NO: 5399976 - DNA, 15 bp, Homo sapiens
cggcccagcctctga

SEQ ID NO: 5399977 - DNA, 23 bp, Homo sapiens
cggcccaggccaggtgcccagga

SEQ ID NO: 5399978 - DNA, 19 bp, Homo sapiens
cggcccagggagggtgagc

SEQ ID NO: 5399979 - DNA, 16 bp, Homo sapiens
cggcccagtgccactg

SEQ ID NO: 5399980 - DNA, 15 bp, Homo sapiens
cggcccagtgccagc

SEQ ID NO: 5399981 - DNA, 20 bp, Homo sapiens
cggcccatccccaggcacct

SEQ ID NO: 5399982 - DNA, 16 bp, Homo sapiens
cggcccatctgtccat

SEQ ID NO: 5399983 - DNA, 22 bp, Homo sapiens
cggcccatctgtccatcctcct

SEQ ID NO: 5399984 - DNA, 18 bp, Homo sapiens
cggccccaccagtgcctc

SEQ ID NO: 5399985 - DNA, 20 bp, Homo sapiens
cggccccacccaccctctgg

SEQ ID NO: 5399986 - DNA, 12 bp, Homo sapiens
cggccccagcca

SEQ ID NO: 5399987 - DNA, 16 bp, Homo sapiens
cggccccagccagagt

SEQ ID NO: 5399988 - DNA, 22 bp, Homo sapiens
cggccccagccagagttcctgc

SEQ ID NO: 5399989 - DNA, 11 bp, Homo sapiens
cggccccagcg

SEQ ID NO: 5399990 - DNA, 15 bp, Homo sapiens
cggccccagcgcgca

SEQ ID NO: 5399991 - DNA, 15 bp, Homo sapiens
cggccccaggctccc

SEQ ID NO: 5399992 - DNA, 17 bp, Homo sapiens
cggccccatcagaggct

SEQ ID NO: 5399993 - DNA, 19 bp, Homo sapiens
cggccccatcagaggctgg

SEQ ID NO: 5399994 - DNA, 23 bp, Homo sapiens
cggccccatcagaggctggggga

SEQ ID NO: 5399995 - DNA, 18 bp, Homo sapiens
cggcccccagagcgcccc

SEQ ID NO: 5399996 - DNA, 12 bp, Homo sapiens
cggcccccagga

SEQ ID NO: 5399997 - DNA, 21 bp, Homo sapiens
cggccccccgcgctcgcccag

SEQ ID NO: 5399998 - DNA, 22 bp, Homo sapiens
cggccccccgcgctcgcccagc

SEQ ID NO: 5399999 - DNA, 15 bp, Homo sapiens
cggcccccgcccagc

SEQ ID NO: 5400000 - DNA, 13 bp, Homo sapiens
cggcccccggcca

SEQ ID NO: 5400001 - DNA, 17 bp, Homo sapiens
cggcccccggccaagga

SEQ ID NO: 5400002 - DNA, 19 bp, Homo sapiens
cggcccccggccaaggacc

SEQ ID NO: 5400003 - DNA, 14 bp, Homo sapiens
cggcttgtgggctg

SEQ ID NO: 5400004 - DNA, 21 bp, Homo sapiens
cggcttgttcttgcagcattc

SEQ ID NO: 5400005 - DNA, 14 bp, Homo sapiens
cggctttcagggca

SEQ ID NO: 5400006 - DNA, 19 bp, Homo sapiens
cggctttcagggcagcccc

SEQ ID NO: 5400007 - DNA, 22 bp, Homo sapiens
cggctttcagggcagcccctgc

SEQ ID NO: 5400008 - DNA, 20 bp, Homo sapiens
cggctttctctgcctctggg

SEQ ID NO: 5400009 - DNA, 20 bp, Homo sapiens
cggctttgcagggagaccag

SEQ ID NO: 5400010 - DNA, 15 bp, Homo sapiens
cgggaaaattcaaag

SEQ ID NO: 5400011 - DNA, 13 bp, Homo sapiens
cgggaaagaagaa

SEQ ID NO: 5400012 - DNA, 14 bp, Homo sapiens
cgggaaagaagagc

SEQ ID NO: 5400013 - DNA, 17 bp, Homo sapiens
cgggaaagaatataaag

SEQ ID NO: 5400014 - DNA, 20 bp, Homo sapiens
cgggaaagccagtgactcca

SEQ ID NO: 5400015 - DNA, 12 bp, Homo sapiens
cgggaaaggaaa

SEQ ID NO: 5400016 - DNA, 14 bp, Homo sapiens
cgggaaaggaaacg

SEQ ID NO: 5400017 - DNA, 18 bp, Homo sapiens
cgggaaaggcatctaaga

SEQ ID NO: 5400018 - DNA, 17 bp, Homo sapiens
cgggaaattctgctgct

SEQ ID NO: 5400019 - DNA, 18 bp, Homo sapiens
cgggaaattctgctgctt

SEQ ID NO: 5400020 - DNA, 13 bp, Homo sapiens
cgggaacagtgtt

SEQ ID NO: 5400021 - DNA, 16 bp, Homo sapiens
cgggaacatgccccct

SEQ ID NO: 5400022 - DNA, 18 bp, Homo sapiens
cgggaacctccccagcct

SEQ ID NO: 5400023 - DNA, 19 bp, Homo sapiens
cgggaacctccccagcctg

SEQ ID NO: 5400024 - DNA, 13 bp, Homo sapiens
cgggaacgccccc

SEQ ID NO: 5400025 - DNA, 21 bp, Homo sapiens
cgggaactttgcagcatacca

SEQ ID NO: 5400026 - DNA, 23 bp, Homo sapiens
cgggaagagaggagttcaatgat

SEQ ID NO: 5400027 - DNA, 24 bp, Homo sapiens
cgggaagagaggagttcaatgatc

SEQ ID NO: 5400028 - DNA, 13 bp, Homo sapiens
cgggaagcagcca

SEQ ID NO: 5400029 - DNA, 21 bp, Homo sapiens
cgggaagcctccgtcaggaga

SEQ ID NO: 5400030 - DNA, 23 bp, Homo sapiens
cgggaaggagggttagggagggg

SEQ ID NO: 5400031 - DNA, 13 bp, Homo sapiens
cgggaaggcctga

SEQ ID NO: 5400032 - DNA, 14 bp, Homo sapiens
cgggaagggagggg

SEQ ID NO: 5400033 - DNA, 21 bp, Homo sapiens
cgggaagggcatgcacgggca

SEQ ID NO: 5400034 - DNA, 19 bp, Homo sapiens
cgggaagggggctgggaca

SEQ ID NO: 5400035 - DNA, 19 bp, Homo sapiens
cgggaagggtgggccctgg

SEQ ID NO: 5400036 - DNA, 19 bp, Homo sapiens
cgggaagtgcagcgggcca

SEQ ID NO: 5400037 - DNA, 18 bp, Homo sapiens
cgggaagtttatttcctg

SEQ ID NO: 5400038 - DNA, 16 bp, Homo sapiens
cgggaatattgtttct

SEQ ID NO: 5400039 - DNA, 20 bp, Homo sapiens
cgggaatgaccgctctccct

SEQ ID NO: 5400040 - DNA, 20 bp, Homo sapiens
cgggaattttcatctaggat

SEQ ID NO: 5400041 - DNA, 17 bp, Homo sapiens
cgggacagaccagcagc

SEQ ID NO: 5400042 - DNA, 18 bp, Homo sapiens
cgggacagaccagcagca

SEQ ID NO: 5400043 - DNA, 13 bp, Homo sapiens
cgggacagacctg

SEQ ID NO: 5400044 - DNA, 21 bp, Homo sapiens
cgggacatcacagggtgggcc

SEQ ID NO: 5400045 - DNA, 22 bp, Homo sapiens
cgggacatcacagggtgggcct

SEQ ID NO: 5400046 - DNA, 22 bp, Homo sapiens
cgggaccacagctgctggccag

SEQ ID NO: 5400047 - DNA, 23 bp, Homo sapiens
cgggaccacagctgctggccagg

SEQ ID NO: 5400048 - DNA, 15 bp, Homo sapiens
cgggaccacatctgt

SEQ ID NO: 5400049 - DNA, 17 bp, Homo sapiens
cgggaccaccctgagcc

SEQ ID NO: 5400050 - DNA, 22 bp, Homo sapiens
cgggaccagaaacctgggagag

SEQ ID NO: 5400051 - DNA, 14 bp, Homo sapiens
cgggaccagctcac

SEQ ID NO: 5400052 - DNA, 19 bp, Homo sapiens
cgggaccattgacctcagc

SEQ ID NO: 5400053 - DNA, 22 bp, Homo sapiens
cgggaccattgacctcagctgc

SEQ ID NO: 5400054 - DNA, 18 bp, Homo sapiens
cgggacccacggagccct

SEQ ID NO: 5400055 - DNA, 22 bp, Homo sapiens
cgggacccacggagccctccct

SEQ ID NO: 5400056 - DNA, 18 bp, Homo sapiens
cgggacccccggcctcca

SEQ ID NO: 5400057 - DNA, 20 bp, Homo sapiens
cgggacccccggcctccagg

SEQ ID NO: 5400058 - DNA, 23 bp, Homo sapiens
cgggacccccggcctccaggctg

SEQ ID NO: 5400059 - DNA, 19 bp, Homo sapiens
cgggaccccctggccctgc

SEQ ID NO: 5400060 - DNA, 17 bp, Homo sapiens
cgggacccggcggccct

SEQ ID NO: 5400061 - DNA, 21 bp, Homo sapiens
cgggaccctgcccagagctga

SEQ ID NO: 5400062 - DNA, 23 bp, Homo sapiens
cgggaccctgctcacaggcaggc

SEQ ID NO: 5400063 - DNA, 16 bp, Homo sapiens
cgggacctcccaggac

SEQ ID NO: 5400064 - DNA, 13 bp, Homo sapiens
cgggacctggtgc

SEQ ID NO: 5400065 - DNA, 16 bp, Homo sapiens
cgggacgcggcaggct

SEQ ID NO: 5400066 - DNA, 12 bp, Homo sapiens
cgggacgcttcc

SEQ ID NO: 5400067 - DNA, 21 bp, Homo sapiens
cgggacgcttccagaccacct

SEQ ID NO: 5400068 - DNA, 15 bp, Homo sapiens
cgggacgtggcacct

SEQ ID NO: 5400069 - DNA, 16 bp, Homo sapiens
cgggactacagaagtg

SEQ ID NO: 5400070 - DNA, 22 bp, Homo sapiens
cgggactcaggcgggacagtgc

SEQ ID NO: 5400071 - DNA, 15 bp, Homo sapiens
cgggactcagtgagc

SEQ ID NO: 5400072 - DNA, 16 bp, Homo sapiens
cgggactgctgctctc

SEQ ID NO: 5400073 - DNA, 17 bp, Homo sapiens
cgggactgctgctctcc

SEQ ID NO: 5400074 - DNA, 14 bp, Homo sapiens
cgggactgggggcg

SEQ ID NO: 5400075 - DNA, 22 bp, Homo sapiens
cgggactgggggcgggactggg

SEQ ID NO: 5400076 - DNA, 23 bp, Homo sapiens
cgggactgtcttcaaccctgccc

SEQ ID NO: 5400077 - DNA, 20 bp, Homo sapiens
cgggagaaaagacggatggc

SEQ ID NO: 5400078 - DNA, 19 bp, Homo sapiens
cgggagaagccaccttccc

SEQ ID NO: 5400079 - DNA, 22 bp, Homo sapiens
cgggagacagaggttgcagtga

SEQ ID NO: 5400080 - DNA, 12 bp, Homo sapiens
cgggagacagca

SEQ ID NO: 5400081 - DNA, 13 bp, Homo sapiens
cgggagactgaac

SEQ ID NO: 5400082 - DNA, 14 bp, Homo sapiens
cgggagactgccag

SEQ ID NO: 5400083 - DNA, 12 bp, Homo sapiens
cgggagagagtg

SEQ ID NO: 5400084 - DNA, 13 bp, Homo sapiens
cgggagagagtga

SEQ ID NO: 5400085 - DNA, 21 bp, Homo sapiens
cgggagagagtgagagagagt

SEQ ID NO: 5400086 - DNA, 13 bp, Homo sapiens
cgggagaggggac

SEQ ID NO: 5400087 - DNA, 21 bp, Homo sapiens
cgggagaggggacgcaggccc

SEQ ID NO: 5400088 - DNA, 22 bp, Homo sapiens
cgggagaggggacgcaggcccc

SEQ ID NO: 5400089 - DNA, 22 bp, Homo sapiens
cgggagatggacccctcccttg

SEQ ID NO: 5400090 - DNA, 17 bp, Homo sapiens
cgggagcacccagagca

SEQ ID NO: 5400091 - DNA, 20 bp, Homo sapiens
cgggagcagtgtcttccata

SEQ ID NO: 5400092 - DNA, 23 bp, Homo sapiens
cgggagcagtgtcttccataatg

SEQ ID NO: 5400093 - DNA, 14 bp, Homo sapiens
cgggagcatctctt

SEQ ID NO: 5400094 - DNA, 18 bp, Homo sapiens
cgggagcattctgcctgc

SEQ ID NO: 5400095 - DNA, 15 bp, Homo sapiens
cgggagccagactgt

SEQ ID NO: 5400096 - DNA, 22 bp, Homo sapiens
cgggagccagactgtccaggga

SEQ ID NO: 5400097 - DNA, 15 bp, Homo sapiens
cgggagccctagccc

SEQ ID NO: 5400098 - DNA, 18 bp, Homo sapiens
cgggagccgctggcagaa

SEQ ID NO: 5400099 - DNA, 18 bp, Homo sapiens
cgggagcctccccctcag

SEQ ID NO: 5400100 - DNA, 19 bp, Homo sapiens
cgggagcctccccctcaga

SEQ ID NO: 5400101 - DNA, 17 bp, Homo sapiens
cgggagcctccctgcct

SEQ ID NO: 5400102 - DNA, 17 bp, Homo sapiens
cgggagcctgaccctca

SEQ ID NO: 5400103 - DNA, 21 bp, Homo sapiens
cgggagcctgatcacctgccc

SEQ ID NO: 5400104 - DNA, 22 bp, Homo sapiens
cgggagcctgatcacctgccct

SEQ ID NO: 5400105 - DNA, 14 bp, Homo sapiens
cgggagcctgcgtg

SEQ ID NO: 5400106 - DNA, 16 bp, Homo sapiens
cgggagcgagtaaagt

SEQ ID NO: 5400107 - DNA, 13 bp, Homo sapiens
cgggagctgcaca

SEQ ID NO: 5400108 - DNA, 13 bp, Homo sapiens
cgggagctgggcc

SEQ ID NO: 5400109 - DNA, 15 bp, Homo sapiens
cgggagctgggccct

SEQ ID NO: 5400110 - DNA, 18 bp, Homo sapiens
cgggagctgggccctgcc

SEQ ID NO: 5400111 - DNA, 20 bp, Homo sapiens
cgggagctgggccctgcctg

SEQ ID NO: 5400112 - DNA, 13 bp, Homo sapiens
cgggaggaggtgt

SEQ ID NO: 5400113 - DNA, 16 bp, Homo sapiens
cgggaggcaccagctc

SEQ ID NO: 5400114 - DNA, 20 bp, Homo sapiens
cgggaggcaccagctctgtg

SEQ ID NO: 5400115 - DNA, 21 bp, Homo sapiens
cgggaggcaccagctctgtgg

SEQ ID NO: 5400116 - DNA, 20 bp, Homo sapiens
cgggaggcagaggttgcagt

SEQ ID NO: 5400117 - DNA, 22 bp, Homo sapiens
cgggaggcagaggttgcagtgt

SEQ ID NO: 5400118 - DNA, 19 bp, Homo sapiens
cgggaggcagcgccccacc

SEQ ID NO: 5400119 - DNA, 14 bp, Homo sapiens
cgggaggcagtgct

SEQ ID NO: 5400120 - DNA, 22 bp, Homo sapiens
cgggaggccacgggggaggccg

SEQ ID NO: 5400121 - DNA, 18 bp, Homo sapiens
cgggaggccccagctctg

SEQ ID NO: 5400122 - DNA, 14 bp, Homo sapiens
cgggaggccctggc

SEQ ID NO: 5400123 - DNA, 18 bp, Homo sapiens
cgggaggccctggccctt

SEQ ID NO: 5400124 - DNA, 13 bp, Homo sapiens
cgggaggcctcag

SEQ ID NO: 5400125 - DNA, 22 bp, Homo sapiens
cgggaggcggagcttgcagtga

SEQ ID NO: 5400126 - DNA, 16 bp, Homo sapiens
cgggaggctgagacag

SEQ ID NO: 5400127 - DNA, 17 bp, Homo sapiens
cgggaggctgagacagg

SEQ ID NO: 5400128 - DNA, 17 bp, Homo sapiens
cgggaggctgaggcagg

SEQ ID NO: 5400129 - DNA, 16 bp, Homo sapiens
cgggaggctgggcaca

SEQ ID NO: 5400130 - DNA, 13 bp, Homo sapiens
cgggaggctgggg

SEQ ID NO: 5400131 - DNA, 14 bp, Homo sapiens
cgggaggctggggc

SEQ ID NO: 5400132 - DNA, 21 bp, Homo sapiens
cgggagggacagtctggaggt

SEQ ID NO: 5400133 - DNA, 16 bp, Homo sapiens
cgggagggcggcacag

SEQ ID NO: 5400134 - DNA, 18 bp, Homo sapiens
cgggaggggaaaggctgc

SEQ ID NO: 5400135 - DNA, 15 bp, Homo sapiens
cgggaggggcccgct

SEQ ID NO: 5400136 - DNA, 19 bp, Homo sapiens
cgggagtcagggacctgct

SEQ ID NO: 5400137 - DNA, 20 bp, Homo sapiens
cgggagtcctctagcaggcc

SEQ ID NO: 5400138 - DNA, 16 bp, Homo sapiens
cgggagtgacccagct

SEQ ID NO: 5400139 - DNA, 13 bp, Homo sapiens
cgggagtggccat

SEQ ID NO: 5400140 - DNA, 19 bp, Homo sapiens
cgggagtgtgggggtgcca

SEQ ID NO: 5400141 - DNA, 16 bp, Homo sapiens
cgggagttggagaccc

SEQ ID NO: 5400142 - DNA, 14 bp, Homo sapiens
cgggagtttgagac

SEQ ID NO: 5400143 - DNA, 17 bp, Homo sapiens
cgggataaactgagcct

SEQ ID NO: 5400144 - DNA, 18 bp, Homo sapiens
cgggataacaaaatcaca

SEQ ID NO: 5400145 - DNA, 15 bp, Homo sapiens
cgggatacagctgag

SEQ ID NO: 5400146 - DNA, 23 bp, Homo sapiens
cgggatattaaacctctttcccc

SEQ ID NO: 5400147 - DNA, 20 bp, Homo sapiens
cgggatcaaacctttctggc

SEQ ID NO: 5400148 - DNA, 18 bp, Homo sapiens
cgggatcctccacagaga

SEQ ID NO: 5400149 - DNA, 16 bp, Homo sapiens
cgggatgaaaagccat

SEQ ID NO: 5400150 - DNA, 17 bp, Homo sapiens
cgggatgaaaagccata

SEQ ID NO: 5400151 - DNA, 16 bp, Homo sapiens
cgggatgacctccaga

SEQ ID NO: 5400152 - DNA, 24 bp, Homo sapiens
cgggatgattgcttgagctcagga

SEQ ID NO: 5400153 - DNA, 20 bp, Homo sapiens
cgggatgccgttctgttcca

SEQ ID NO: 5400154 - DNA, 16 bp, Homo sapiens
cgggatggtcctgggg

SEQ ID NO: 5400155 - DNA, 18 bp, Homo sapiens
cgggatggtcctggggct

SEQ ID NO: 5400156 - DNA, 24 bp, Homo sapiens
cgggatgtcagcagacacacatgg

SEQ ID NO: 5400157 - DNA, 16 bp, Homo sapiens
cgggcaaagagctccc

SEQ ID NO: 5400158 - DNA, 17 bp, Homo sapiens
cgggcaaatgccagggc

SEQ ID NO: 5400159 - DNA, 18 bp, Homo sapiens
cgggcaaatgccagggcc

SEQ ID NO: 5400160 - DNA, 22 bp, Homo sapiens
cgggcaaatgccagggcccgca

SEQ ID NO: 5400161 - DNA, 20 bp, Homo sapiens
cgggcaagatagctccttca

SEQ ID NO: 5400162 - DNA, 18 bp, Homo sapiens
cgggcaagtgagagggga

SEQ ID NO: 5400163 - DNA, 21 bp, Homo sapiens
cgggcaagtgagaggggaggg

SEQ ID NO: 5400164 - DNA, 14 bp, Homo sapiens
cgggcacaataaat

SEQ ID NO: 5400165 - DNA, 12 bp, Homo sapiens
cgggcacagggc

SEQ ID NO: 5400166 - DNA, 20 bp, Homo sapiens
cgggcacagggcaccagagg

SEQ ID NO: 5400167 - DNA, 18 bp, Homo sapiens
cgggcacccacaagcccg

SEQ ID NO: 5400168 - DNA, 19 bp, Homo sapiens
cgggcacctatagtcccag

SEQ ID NO: 5400169 - DNA, 15 bp, Homo sapiens
cgggcactggcactg

SEQ ID NO: 5400170 - DNA, 20 bp, Homo sapiens
cgggcagagaccaccgcgcc

SEQ ID NO: 5400171 - DNA, 18 bp, Homo sapiens
cgggcagagggctggagg

SEQ ID NO: 5400172 - DNA, 23 bp, Homo sapiens
cgggcagagggctggaggcccag

SEQ ID NO: 5400173 - DNA, 13 bp, Homo sapiens
cgggcagcagaga

SEQ ID NO: 5400174 - DNA, 13 bp, Homo sapiens
cgggcagccacag

SEQ ID NO: 5400175 - DNA, 17 bp, Homo sapiens
cgggcagccacaggact

SEQ ID NO: 5400176 - DNA, 22 bp, Homo sapiens
cgggcagccacaggactgagcc

SEQ ID NO: 5400177 - DNA, 19 bp, Homo sapiens
cgggcagccacccaagcct

SEQ ID NO: 5400178 - DNA, 14 bp, Homo sapiens
cgggcagccaggct

SEQ ID NO: 5400179 - DNA, 16 bp, Homo sapiens
cggggtattttaggca

SEQ ID NO: 5400180 - DNA, 16 bp, Homo sapiens
cggggtccccgtagcc

SEQ ID NO: 5400181 - DNA, 19 bp, Homo sapiens
cggggtccccgtagccccg

SEQ ID NO: 5400182 - DNA, 15 bp, Homo sapiens
cggggtcccctctgt

SEQ ID NO: 5400183 - DNA, 12 bp, Homo sapiens
cggggtccctgg

SEQ ID NO: 5400184 - DNA, 17 bp, Homo sapiens
cggggtcctgaggctgg

SEQ ID NO: 5400185 - DNA, 15 bp, Homo sapiens
cggggtcctgggagg

SEQ ID NO: 5400186 - DNA, 18 bp, Homo sapiens
cggggtcctgggaggctg

SEQ ID NO: 5400187 - DNA, 21 bp, Homo sapiens
cggggtcctgggaggctgcag

SEQ ID NO: 5400188 - DNA, 17 bp, Homo sapiens
cggggtcctgtggcagg

SEQ ID NO: 5400189 - DNA, 18 bp, Homo sapiens
cggggtcgggggaggagc

SEQ ID NO: 5400190 - DNA, 13 bp, Homo sapiens
cggggtctgtgct

SEQ ID NO: 5400191 - DNA, 23 bp, Homo sapiens
cggggtctgtgctgtgcctgcta

SEQ ID NO: 5400192 - DNA, 19 bp, Homo sapiens
cggggtcttgctctgtctc

SEQ ID NO: 5400193 - DNA, 15 bp, Homo sapiens
cggggtgcacaggag

SEQ ID NO: 5400194 - DNA, 12 bp, Homo sapiens
cggggtgcagaa

SEQ ID NO: 5400195 - DNA, 22 bp, Homo sapiens
cggggtgcccgtgtggcctggg

SEQ ID NO: 5400196 - DNA, 15 bp, Homo sapiens
cggggtgcctgctgt

SEQ ID NO: 5400197 - DNA, 18 bp, Homo sapiens
cggggtggacgagggagt

SEQ ID NO: 5400198 - DNA, 17 bp, Homo sapiens
cggggtggcggtggacc

SEQ ID NO: 5400199 - DNA, 22 bp, Homo sapiens
cggggtgggtgggtgggcaggg

SEQ ID NO: 5400200 - DNA, 16 bp, Homo sapiens
cggggtggtggacagg

SEQ ID NO: 5400201 - DNA, 17 bp, Homo sapiens
cggggtggtggacaggg

SEQ ID NO: 5400202 - DNA, 22 bp, Homo sapiens
cggggtggtggacagggccccc

SEQ ID NO: 5400203 - DNA, 18 bp, Homo sapiens
cggggtggtgggaaccat

SEQ ID NO: 5400204 - DNA, 19 bp, Homo sapiens
cggggtggtgggaaccatg

SEQ ID NO: 5400205 - DNA, 13 bp, Homo sapiens
cggggtgtggtgg

SEQ ID NO: 5400206 - DNA, 20 bp, Homo sapiens
cggggtgttgccagcgtggc

SEQ ID NO: 5400207 - DNA, 18 bp, Homo sapiens
cggggttagagccaagct

SEQ ID NO: 5400208 - DNA, 17 bp, Homo sapiens
cggggttcagcctcctg

SEQ ID NO: 5400209 - DNA, 23 bp, Homo sapiens
cggggttccccacacagggcact

SEQ ID NO: 5400210 - DNA, 20 bp, Homo sapiens
cggggttcgcgcaccaggtg

SEQ ID NO: 5400211 - DNA, 13 bp, Homo sapiens
cggggttggggtg

SEQ ID NO: 5400212 - DNA, 22 bp, Homo sapiens
cggggtttcaccatgttggcca

SEQ ID NO: 5400213 - DNA, 14 bp, Homo sapiens
cggggtttccccat

SEQ ID NO: 5400214 - DNA, 14 bp, Homo sapiens
cgggtaaagtgcaa

SEQ ID NO: 5400215 - DNA, 18 bp, Homo sapiens
cgggtatgaagtgtgggg

SEQ ID NO: 5400216 - DNA, 22 bp, Homo sapiens
cgggtcacacaaaggcatgctg

SEQ ID NO: 5400217 - DNA, 14 bp, Homo sapiens
cgggtcagtaggga

SEQ ID NO: 5400218 - DNA, 22 bp, Homo sapiens
cgggtcatattcataccttctg

SEQ ID NO: 5400219 - DNA, 22 bp, Homo sapiens
cgggtcatctgtacctctgcct

SEQ ID NO: 5400220 - DNA, 17 bp, Homo sapiens
cgggtccacttgccagg

SEQ ID NO: 5400221 - DNA, 19 bp, Homo sapiens
cgggtccacttgccagggc

SEQ ID NO: 5400222 - DNA, 20 bp, Homo sapiens
cgggtccacttgccagggct

SEQ ID NO: 5400223 - DNA, 17 bp, Homo sapiens
cgggtccagagaccaca

SEQ ID NO: 5400224 - DNA, 21 bp, Homo sapiens
cgggtccatagagatgagccc

SEQ ID NO: 5400225 - DNA, 13 bp, Homo sapiens
cgggtcccagcta

SEQ ID NO: 5400226 - DNA, 17 bp, Homo sapiens
cgggtccccagctcccc

SEQ ID NO: 5400227 - DNA, 19 bp, Homo sapiens
cgggtccccagctccccag

SEQ ID NO: 5400228 - DNA, 17 bp, Homo sapiens
cgggtccgattaattta

SEQ ID NO: 5400229 - DNA, 12 bp, Homo sapiens
cgggtccggcct

SEQ ID NO: 5400230 - DNA, 21 bp, Homo sapiens
cgggtcctagctgttagggac

SEQ ID NO: 5400231 - DNA, 16 bp, Homo sapiens
cgggtcctcagctgct

SEQ ID NO: 5400232 - DNA, 20 bp, Homo sapiens
cgggtcctcagctgctccca

SEQ ID NO: 5400233 - DNA, 16 bp, Homo sapiens
cgggtctccccacctg

SEQ ID NO: 5400234 - DNA, 13 bp, Homo sapiens
cgggtctccctcc

SEQ ID NO: 5400235 - DNA, 14 bp, Homo sapiens
cgggtctcctccca

SEQ ID NO: 5400236 - DNA, 18 bp, Homo sapiens
cgggtctcctcccagcgg

SEQ ID NO: 5400237 - DNA, 16 bp, Homo sapiens
cgggtctcgcagcctg

SEQ ID NO: 5400238 - DNA, 20 bp, Homo sapiens
cgggtctcgcagcctgaagc

SEQ ID NO: 5400239 - DNA, 22 bp, Homo sapiens
cgggtctcgcagcctgaagcct

SEQ ID NO: 5400240 - DNA, 14 bp, Homo sapiens
cgggtctctggatt

SEQ ID NO: 5400241 - DNA, 13 bp, Homo sapiens
cgggtctgagact

SEQ ID NO: 5400242 - DNA, 14 bp, Homo sapiens
cgggtctgctccca

SEQ ID NO: 5400243 - DNA, 17 bp, Homo sapiens
cgggtctgctcccaagg

SEQ ID NO: 5400244 - DNA, 16 bp, Homo sapiens
cgggtctgtgggactg

SEQ ID NO: 5400245 - DNA, 20 bp, Homo sapiens
cgggtgaacaaagcagccac

SEQ ID NO: 5400246 - DNA, 21 bp, Homo sapiens
cgggtgaacaaagcagccacg

SEQ ID NO: 5400247 - DNA, 16 bp, Homo sapiens
cgggtgaatctgtcta

SEQ ID NO: 5400248 - DNA, 18 bp, Homo sapiens
cgggtgatggccagcccc

SEQ ID NO: 5400249 - DNA, 19 bp, Homo sapiens
cgggtgatggccagcccct

SEQ ID NO: 5400250 - DNA, 23 bp, Homo sapiens
cgggtgcatttgagagaagccac

SEQ ID NO: 5400251 - DNA, 18 bp, Homo sapiens
cgggtgccaaataaatgc

SEQ ID NO: 5400252 - DNA, 16 bp, Homo sapiens
cgggtgccagaagcta

SEQ ID NO: 5400253 - DNA, 15 bp, Homo sapiens
cgggtgccaggacaa

SEQ ID NO: 5400254 - DNA, 20 bp, Homo sapiens
cgggtgcccgtaatcccagc

SEQ ID NO: 5400255 - DNA, 21 bp, Homo sapiens
cgggtgcctgctgcggcagac

SEQ ID NO: 5400256 - DNA, 19 bp, Homo sapiens
cgggtgcgtgaccggcccg

SEQ ID NO: 5400257 - DNA, 21 bp, Homo sapiens
cgggtgctcaataaacttgtg

SEQ ID NO: 5400258 - DNA, 15 bp, Homo sapiens
cgggtggatcacctg

SEQ ID NO: 5400259 - DNA, 18 bp, Homo sapiens
cgggtggatcacctgagg

SEQ ID NO: 5400260 - DNA, 20 bp, Homo sapiens
cgggtggcagcgcccagcct

SEQ ID NO: 5400261 - DNA, 15 bp, Homo sapiens
cgggtggctggagcc

SEQ ID NO: 5400262 - DNA, 12 bp, Homo sapiens
cgggtggctggt

SEQ ID NO: 5400263 - DNA, 13 bp, Homo sapiens
cgggtgggcctgg

SEQ ID NO: 5400264 - DNA, 14 bp, Homo sapiens
cgggtgggcctggc

SEQ ID NO: 5400265 - DNA, 17 bp, Homo sapiens
cgggtgggcctggcctg

SEQ ID NO: 5400266 - DNA, 19 bp, Homo sapiens
cgggtgggcctggcctgag

SEQ ID NO: 5400267 - DNA, 19 bp, Homo sapiens
cgggtgggcggcacagcct

SEQ ID NO: 5400268 - DNA, 12 bp, Homo sapiens
cgggtggggctg

SEQ ID NO: 5400269 - DNA, 14 bp, Homo sapiens
cgggtggggctggt

SEQ ID NO: 5400270 - DNA, 17 bp, Homo sapiens
cgggtggggggagggca

SEQ ID NO: 5400271 - DNA, 19 bp, Homo sapiens
cgggtgggtatcccacctc

SEQ ID NO: 5400272 - DNA, 12 bp, Homo sapiens
cgggtggtcccc

SEQ ID NO: 5400273 - DNA, 23 bp, Homo sapiens
cgggtgtagattcccttgcactg

SEQ ID NO: 5400274 - DNA, 19 bp, Homo sapiens
cgggtgtggcacgcacctg

SEQ ID NO: 5400275 - DNA, 15 bp, Homo sapiens
cgggtgtggcctcag

SEQ ID NO: 5400276 - DNA, 16 bp, Homo sapiens
cgggtgtggcctcagc

SEQ ID NO: 5400277 - DNA, 20 bp, Homo sapiens
cgggtgtggcctcagccctc

SEQ ID NO: 5400278 - DNA, 22 bp, Homo sapiens
cgggtgtggctcgggtgcccag

SEQ ID NO: 5400279 - DNA, 15 bp, Homo sapiens
cgggtgtgggaaagc

SEQ ID NO: 5400280 - DNA, 15 bp, Homo sapiens
cgggttaagaaatac

SEQ ID NO: 5400281 - DNA, 16 bp, Homo sapiens
cgggttaagaaatacc

SEQ ID NO: 5400282 - DNA, 19 bp, Homo sapiens
cgggttagcctggtgacag

SEQ ID NO: 5400283 - DNA, 14 bp, Homo sapiens
cgggttcaagcttg

SEQ ID NO: 5400284 - DNA, 17 bp, Homo sapiens
cgggttcaccatgttgc

SEQ ID NO: 5400285 - DNA, 14 bp, Homo sapiens
cgggttcagcctgg

SEQ ID NO: 5400286 - DNA, 16 bp, Homo sapiens
cgggttcagcctggcc

SEQ ID NO: 5400287 - DNA, 22 bp, Homo sapiens
cgggttcgcaccattctcctgc

SEQ ID NO: 5400288 - DNA, 12 bp, Homo sapiens
cgggttctagac

SEQ ID NO: 5400289 - DNA, 22 bp, Homo sapiens
cgggttctagacgcccctccca

SEQ ID NO: 5400290 - DNA, 13 bp, Homo sapiens
cgggttctcccat

SEQ ID NO: 5400291 - DNA, 15 bp, Homo sapiens
cgggttctcctgatt

SEQ ID NO: 5400292 - DNA, 17 bp, Homo sapiens
cgggttggaggcctcac

SEQ ID NO: 5400293 - DNA, 22 bp, Homo sapiens
cgggttgttttgggtgaatctt

SEQ ID NO: 5400294 - DNA, 21 bp, Homo sapiens
cgggttttattgtttaaaatc

SEQ ID NO: 5400295 - DNA, 14 bp, Homo sapiens
cggtaccaatgcag

SEQ ID NO: 5400296 - DNA, 21 bp, Homo sapiens
cggtagaggctccccagggct

SEQ ID NO: 5400297 - DNA, 15 bp, Homo sapiens
cggtagggaggcagc

SEQ ID NO: 5400298 - DNA, 16 bp, Homo sapiens
cggtagggaggcagcc

SEQ ID NO: 5400299 - DNA, 18 bp, Homo sapiens
cggtaggtcatgtctgta

SEQ ID NO: 5400300 - DNA, 16 bp, Homo sapiens
cggtaggtgctggcct

SEQ ID NO: 5400301 - DNA, 18 bp, Homo sapiens
cggtaggttcagccaagg

SEQ ID NO: 5400302 - DNA, 14 bp, Homo sapiens
cggtatccagaggt

SEQ ID NO: 5400303 - DNA, 18 bp, Homo sapiens
cggtatcctccctgccca

SEQ ID NO: 5400304 - DNA, 21 bp, Homo sapiens
cggtatctggcttccctggaa

SEQ ID NO: 5400305 - DNA, 22 bp, Homo sapiens
cggtatctggcttccctggaag

SEQ ID NO: 5400306 - DNA, 22 bp, Homo sapiens
cggtcaataattgtggagagga

SEQ ID NO: 5400307 - DNA, 23 bp, Homo sapiens
cggtcaataattgtggagaggag

SEQ ID NO: 5400308 - DNA, 19 bp, Homo sapiens
cggtcacacctcactgtca

SEQ ID NO: 5400309 - DNA, 20 bp, Homo sapiens
cggtcactgcccacctgcca

SEQ ID NO: 5400310 - DNA, 23 bp, Homo sapiens
cggtcactgcccacctgccaggc

SEQ ID NO: 5400311 - DNA, 15 bp, Homo sapiens
cggtcagaacaactt

SEQ ID NO: 5400312 - DNA, 14 bp, Homo sapiens
cggtcagactggag

SEQ ID NO: 5400313 - DNA, 16 bp, Homo sapiens
cggtcagactggaggt

SEQ ID NO: 5400314 - DNA, 22 bp, Homo sapiens
cggtcagaggagcgcaggcagc

SEQ ID NO: 5400315 - DNA, 14 bp, Homo sapiens
cggtcagcgactgg

SEQ ID NO: 5400316 - DNA, 23 bp, Homo sapiens
cggtcaggagggtgcagtatctc

SEQ ID NO: 5400317 - DNA, 17 bp, Homo sapiens
cggtcatgatgtctgca

SEQ ID NO: 5400318 - DNA, 23 bp, Homo sapiens
cggtcatgcttttgccactttgg

SEQ ID NO: 5400319 - DNA, 17 bp, Homo sapiens
cggtcatgtgtgcatgt

SEQ ID NO: 5400320 - DNA, 18 bp, Homo sapiens
cggtcatgtgtgcatgtg

SEQ ID NO: 5400321 - DNA, 17 bp, Homo sapiens
cggtccacaggtccaag

SEQ ID NO: 5400322 - DNA, 20 bp, Homo sapiens
cggtccacccaggagccccg

SEQ ID NO: 5400323 - DNA, 22 bp, Homo sapiens
cggtccagaaggagcaggccct

SEQ ID NO: 5400324 - DNA, 11 bp, Homo sapiens
cggtccagctg

SEQ ID NO: 5400325 - DNA, 15 bp, Homo sapiens
cggtccagctggcct

SEQ ID NO: 5400326 - DNA, 13 bp, Homo sapiens
cggtcccacccct

SEQ ID NO: 5400327 - DNA, 13 bp, Homo sapiens
cggtcccagctcc

SEQ ID NO: 5400328 - DNA, 13 bp, Homo sapiens
cggtcccaggccg

SEQ ID NO: 5400329 - DNA, 15 bp, Homo sapiens
cggtcccaggccgca

SEQ ID NO: 5400330 - DNA, 14 bp, Homo sapiens
cggtcccagtccgg

SEQ ID NO: 5400331 - DNA, 16 bp, Homo sapiens
cggtcccagtccggtg

SEQ ID NO: 5400332 - DNA, 17 bp, Homo sapiens
cggtccccatccccacc

SEQ ID NO: 5400333 - DNA, 20 bp, Homo sapiens
cggtccccatccccaccagc

SEQ ID NO: 5400334 - DNA, 16 bp, Homo sapiens
cggtcccccagagcat

SEQ ID NO: 5400335 - DNA, 18 bp, Homo sapiens
cggtcccctgcctggaac

SEQ ID NO: 5400336 - DNA, 21 bp, Homo sapiens
cggtcccggctgacacctccc

SEQ ID NO: 5400337 - DNA, 16 bp, Homo sapiens
cggtccctgcagaagc

SEQ ID NO: 5400338 - DNA, 13 bp, Homo sapiens
cggtccctgtccc

SEQ ID NO: 5400339 - DNA, 15 bp, Homo sapiens
cggtcccttccatgc

SEQ ID NO: 5400340 - DNA, 22 bp, Homo sapiens
cggtcccttgagacctcagcca

SEQ ID NO: 5400341 - DNA, 21 bp, Homo sapiens
cggtccgcccgcttccctcct

SEQ ID NO: 5400342 - DNA, 18 bp, Homo sapiens
cggtcctgcacagattcc

SEQ ID NO: 5400343 - DNA, 23 bp, Homo sapiens
cggtcctgcacagattcccaggc

SEQ ID NO: 5400344 - DNA, 12 bp, Homo sapiens
cggtcctggccc

SEQ ID NO: 5400345 - DNA, 11 bp, Homo sapiens
cggtcctgtct

SEQ ID NO: 5400346 - DNA, 15 bp, Homo sapiens
cggtcctgtctcccc

SEQ ID NO: 5400347 - DNA, 17 bp, Homo sapiens
cggtcctttaggcagcc

SEQ ID NO: 5400348 - DNA, 21 bp, Homo sapiens
cggtcctttgagtgtcaggct

SEQ ID NO: 5400349 - DNA, 24 bp, Homo sapiens
cggtcgccctttgctgcatggcag

SEQ ID NO: 5400350 - DNA, 19 bp, Homo sapiens
cggtcgggcagccagcaga

SEQ ID NO: 5400351 - DNA, 19 bp, Homo sapiens
cggtctaggtgggagagag

SEQ ID NO: 5400352 - DNA, 21 bp, Homo sapiens
cggtctcccaaagtgctggga

SEQ ID NO: 5400353 - DNA, 16 bp, Homo sapiens
cggtctcctgactggt

SEQ ID NO: 5400354 - DNA, 20 bp, Homo sapiens
cggtctgagctagctagcgc

SEQ ID NO: 5400355 - DNA, 12 bp, Homo sapiens
cggtctggcagg

SEQ ID NO: 5400356 - DNA, 17 bp, Homo sapiens
cggtctggcagggcagc

SEQ ID NO: 5400357 - DNA, 23 bp, Homo sapiens
cgtctctctcccatggagcccca

SEQ ID NO: 5400358 - DNA, 15 bp, Homo sapiens
cgtctctctgcctgc

SEQ ID NO: 5400359 - DNA, 19 bp, Homo sapiens
cgtctctctgcctgctggg

SEQ ID NO: 5400360 - DNA, 20 bp, Homo sapiens
cgtctctctgcctgctgggc

SEQ ID NO: 5400361 - DNA, 21 bp, Homo sapiens
cgtctctctgcctgctgggct

SEQ ID NO: 5400362 - DNA, 13 bp, Homo sapiens
cgtctctcttgct

SEQ ID NO: 5400363 - DNA, 14 bp, Homo sapiens
cgtctctgccctgg

SEQ ID NO: 5400364 - DNA, 17 bp, Homo sapiens
cgtctctgccctgggct

SEQ ID NO: 5400365 - DNA, 15 bp, Homo sapiens
cgtctctgccgcctg

SEQ ID NO: 5400366 - DNA, 17 bp, Homo sapiens
cgtctctggccctcgtg

SEQ ID NO: 5400367 - DNA, 22 bp, Homo sapiens
cgtctcttgtgactcagcagag

SEQ ID NO: 5400368 - DNA, 22 bp, Homo sapiens
cgtctctttttggtaataacaa

SEQ ID NO: 5400369 - DNA, 14 bp, Homo sapiens
cgtctgacaggcaa

SEQ ID NO: 5400370 - DNA, 22 bp, Homo sapiens
cgtctgacaggcaatgctggct

SEQ ID NO: 5400371 - DNA, 18 bp, Homo sapiens
cgtctgaccccagcccag

SEQ ID NO: 5400372 - DNA, 20 bp, Homo sapiens
cgtctgaccccagcccagac

SEQ ID NO: 5400373 - DNA, 19 bp, Homo sapiens
cgtctgactccagagtctg

SEQ ID NO: 5400374 - DNA, 23 bp, Homo sapiens
cgtctgactccagagtctgagcc

SEQ ID NO: 5400375 - DNA, 16 bp, Homo sapiens
cgtctgactccctccc

SEQ ID NO: 5400376 - DNA, 14 bp, Homo sapiens
cgtctgactctggg

SEQ ID NO: 5400377 - DNA, 23 bp, Homo sapiens
cgtctgagcggccgcctgtcctt

SEQ ID NO: 5400378 - DNA, 15 bp, Homo sapiens
cgtctgaggcctgcc

SEQ ID NO: 5400379 - DNA, 16 bp, Homo sapiens
cgtctgattgttcctc

SEQ ID NO: 5400380 - DNA, 18 bp, Homo sapiens
cgtctgattgttcctccc

SEQ ID NO: 5400381 - DNA, 18 bp, Homo sapiens
cgtctgcacttctgttcc

SEQ ID NO: 5400382 - DNA, 18 bp, Homo sapiens
cgtctgccaccagcgccc

SEQ ID NO: 5400383 - DNA, 15 bp, Homo sapiens
cgtctgccaggccca

SEQ ID NO: 5400384 - DNA, 18 bp, Homo sapiens
cgtctgccccaccctcaa

SEQ ID NO: 5400385 - DNA, 11 bp, Homo sapiens
cgtctgcccct

SEQ ID NO: 5400386 - DNA, 19 bp, Homo sapiens
cgtctgccccttgacccca

SEQ ID NO: 5400387 - DNA, 22 bp, Homo sapiens
cgtctgccccttgaccccacac

SEQ ID NO: 5400388 - DNA, 20 bp, Homo sapiens
cgtctgcgttaggcagggca

SEQ ID NO: 5400389 - DNA, 17 bp, Homo sapiens
cgtctgctcctgcgagg

SEQ ID NO: 5400390 - DNA, 22 bp, Homo sapiens
cgtctgctcttctgtgcccagg

SEQ ID NO: 5400391 - DNA, 22 bp, Homo sapiens
cgtctgctgttgattccactga

SEQ ID NO: 5400392 - DNA, 18 bp, Homo sapiens
cgtctggccctggcgggt

SEQ ID NO: 5400393 - DNA, 23 bp, Homo sapiens
cgtctggccctggcgggtggctg

SEQ ID NO: 5400394 - DNA, 16 bp, Homo sapiens
cgtctggctccctgcc

SEQ ID NO: 5400395 - DNA, 18 bp, Homo sapiens
cgtctgggcaagaggaaa

SEQ ID NO: 5400396 - DNA, 17 bp, Homo sapiens
cgtctggggttcagccc

SEQ ID NO: 5400397 - DNA, 14 bp, Homo sapiens
cgtctggtgttctc

SEQ ID NO: 5400398 - DNA, 11 bp, Homo sapiens
cgtctgtccca

SEQ ID NO: 5400399 - DNA, 15 bp, Homo sapiens
cgtctgtcctgcgcc

SEQ ID NO: 5400400 - DNA, 19 bp, Homo sapiens
cgtctgtctcgatgcctga

SEQ ID NO: 5400401 - DNA, 21 bp, Homo sapiens
cgtctgtctcgatgcctgatt

SEQ ID NO: 5400402 - DNA, 18 bp, Homo sapiens
cgtctgtcttcacagctc

SEQ ID NO: 5400403 - DNA, 9 bp, Homo sapiens
cgtctgtga

SEQ ID NO: 5400404 - DNA, 10 bp, Homo sapiens
cgtctgtgaa

SEQ ID NO: 5400405 - DNA, 21 bp, Homo sapiens
cgtctgtgaatgctaagtcca

SEQ ID NO: 5400406 - DNA, 23 bp, Homo sapiens
cgtctgtgattgccatttcttcc

SEQ ID NO: 5400407 - DNA, 11 bp, Homo sapiens
cgtctgtgtgc

SEQ ID NO: 5400408 - DNA, 22 bp, Homo sapiens
cgtctgtgtgtgacccctcctg

SEQ ID NO: 5400409 - DNA, 23 bp, Homo sapiens
cgtctgtgtgtgacccctcctgg

SEQ ID NO: 5400410 - DNA, 13 bp, Homo sapiens
cgtctgttttgtg

SEQ ID NO: 5400411 - DNA, 21 bp, Homo sapiens
cgtcttaagtcagatttttat

SEQ ID NO: 5400412 - DNA, 23 bp, Homo sapiens
cgtcttagaagtggaccaggaca

SEQ ID NO: 5400413 - DNA, 14 bp, Homo sapiens
cgtcttaggtggca

SEQ ID NO: 5400414 - DNA, 21 bp, Homo sapiens
cgtcttcaaattaaagtgctg

SEQ ID NO: 5400415 - DNA, 19 bp, Homo sapiens
cgtcttcaagaacttctcg

SEQ ID NO: 5400416 - DNA, 17 bp, Homo sapiens
cgtcttcaatctctgtt

SEQ ID NO: 5400417 - DNA, 21 bp, Homo sapiens
cgtcttcatctccctgccatc

SEQ ID NO: 5400418 - DNA, 23 bp, Homo sapiens
cgtcttcattaagccctcttcca

SEQ ID NO: 5400419 - DNA, 16 bp, Homo sapiens
cgtcttccctgcttca

SEQ ID NO: 5400420 - DNA, 19 bp, Homo sapiens
cgtcttccgcccctgcctg

SEQ ID NO: 5400421 - DNA, 12 bp, Homo sapiens
cgtcttctctcc

SEQ ID NO: 5400422 - DNA, 17 bp, Homo sapiens
cgtcttcttgctgcagc

SEQ ID NO: 5400423 - DNA, 22 bp, Homo sapiens
cgtcttgaacgagcagcccagg

SEQ ID NO: 5400424 - DNA, 21 bp, Homo sapiens
cgtcttgacgggagcattggc

SEQ ID NO: 5400425 - DNA, 15 bp, Homo sapiens
cgtcttgcccagcag

SEQ ID NO: 5400426 - DNA, 16 bp, Homo sapiens
cgtcttgcccagcagc

SEQ ID NO: 5400427 - DNA, 14 bp, Homo sapiens
cgtcttgcttggga

SEQ ID NO: 5400428 - DNA, 19 bp, Homo sapiens
cgtcttgcttgggaagggg

SEQ ID NO: 5400429 - DNA, 23 bp, Homo sapiens
cgtcttgggtcgccctaccctca

SEQ ID NO: 5400430 - DNA, 22 bp, Homo sapiens
cgtcttggtgtaatttgaagat

SEQ ID NO: 5400431 - DNA, 13 bp, Homo sapiens
cgtcttgtatttt

SEQ ID NO: 5400432 - DNA, 15 bp, Homo sapiens
cgtcttgtgaaattg

SEQ ID NO: 5400433 - DNA, 14 bp, Homo sapiens
cgtcttgtgtttgc

SEQ ID NO: 5400434 - DNA, 17 bp, Homo sapiens
cgtctttaagagactca

SEQ ID NO: 5400435 - DNA, 17 bp, Homo sapiens
cgtctttagatgctatt

SEQ ID NO: 5400436 - DNA, 18 bp, Homo sapiens
cgtctttcccaaaggcat

SEQ ID NO: 5400437 - DNA, 13 bp, Homo sapiens
cgtctttggagga

SEQ ID NO: 5400438 - DNA, 20 bp, Homo sapiens
cgtctttggttcctcatggc

SEQ ID NO: 5400439 - DNA, 21 bp, Homo sapiens
cgtctttggttcctcatggct

SEQ ID NO: 5400440 - DNA, 13 bp, Homo sapiens
cgtcttttgaaaa

SEQ ID NO: 5400441 - DNA, 19 bp, Homo sapiens
cgtcttttttctcttccct

SEQ ID NO: 5400442 - DNA, 19 bp, Homo sapiens
cgtgaaaacacatttgctt

SEQ ID NO: 5400443 - DNA, 17 bp, Homo sapiens
cgtgaaaacggagctga

SEQ ID NO: 5400444 - DNA, 18 bp, Homo sapiens
cgtgaaaacggagctgaa

SEQ ID NO: 5400445 - DNA, 12 bp, Homo sapiens
cgtgaaacacaa

SEQ ID NO: 5400446 - DNA, 18 bp, Homo sapiens
cgtgaaagaattattttt

SEQ ID NO: 5400447 - DNA, 16 bp, Homo sapiens
cgtgaaagcagatgag

SEQ ID NO: 5400448 - DNA, 19 bp, Homo sapiens
cgtgaaagtgcatttttgt

SEQ ID NO: 5400449 - DNA, 13 bp, Homo sapiens
cgtgaaagttttt

SEQ ID NO: 5400450 - DNA, 10 bp, Homo sapiens
cgtgaaatcc

SEQ ID NO: 5400451 - DNA, 16 bp, Homo sapiens
cgtgaaatttgcctct

SEQ ID NO: 5400452 - DNA, 11 bp, Homo sapiens
cgtgaacaaac

SEQ ID NO: 5400453 - DNA, 17 bp, Homo sapiens
cgtgaacccaggaggcg

SEQ ID NO: 5400454 - DNA, 22 bp, Homo sapiens
cgtgaactctggtgctcctgca

SEQ ID NO: 5400455 - DNA, 12 bp, Homo sapiens
cgtgaactgtgc

SEQ ID NO: 5400456 - DNA, 17 bp, Homo sapiens
cgtgaagaaataaatga

SEQ ID NO: 5400457 - DNA, 16 bp, Homo sapiens
cgtgaagagcagtgag

SEQ ID NO: 5400458 - DNA, 19 bp, Homo sapiens
cgtgaagatactttgtatt

SEQ ID NO: 5400459 - DNA, 22 bp, Homo sapiens
cgtgaagcagtgcctcgaggca

SEQ ID NO: 5400460 - DNA, 13 bp, Homo sapiens
cgtgaagcctccc

SEQ ID NO: 5400461 - DNA, 15 bp, Homo sapiens
cgtgaaggacttagc

SEQ ID NO: 5400462 - DNA, 19 bp, Homo sapiens
cgtgaaggccgagaagcaa

SEQ ID NO: 5400463 - DNA, 18 bp, Homo sapiens
cgtgaagggcaccgagaa

SEQ ID NO: 5400464 - DNA, 22 bp, Homo sapiens
cgtgaatagtcttttgcatgtc

SEQ ID NO: 5400465 - DNA, 22 bp, Homo sapiens
cgtgaatatcgagaactgccat

SEQ ID NO: 5400466 - DNA, 17 bp, Homo sapiens
cgtgaatgcttacctgt

SEQ ID NO: 5400467 - DNA, 18 bp, Homo sapiens
cgtgaatgggtgcccaca

SEQ ID NO: 5400468 - DNA, 14 bp, Homo sapiens
cgtgaattgcttta

SEQ ID NO: 5400469 - DNA, 15 bp, Homo sapiens
cgtgaattgctttat

SEQ ID NO: 5400470 - DNA, 23 bp, Homo sapiens
cgtgacaacacaaatttgggagg

SEQ ID NO: 5400471 - DNA, 15 bp, Homo sapiens
cgtgacaacacttgt

SEQ ID NO: 5400472 - DNA, 19 bp, Homo sapiens
cgtgacaataaaacattaa

SEQ ID NO: 5400473 - DNA, 13 bp, Homo sapiens
cgtgacacaaaca

SEQ ID NO: 5400474 - DNA, 22 bp, Homo sapiens
cgtgacactctccttgcagttc

SEQ ID NO: 5400475 - DNA, 18 bp, Homo sapiens
cgtgacatgtgcagtgct

SEQ ID NO: 5400476 - DNA, 18 bp, Homo sapiens
cgtgaccaattgccctgc

SEQ ID NO: 5400477 - DNA, 21 bp, Homo sapiens
cgtgaccaattgccctgccag

SEQ ID NO: 5400478 - DNA, 22 bp, Homo sapiens
cgtgacccacccgccttggcct

SEQ ID NO: 5400479 - DNA, 12 bp, Homo sapiens
cgtgacccagtg

SEQ ID NO: 5400480 - DNA, 15 bp, Homo sapiens
cgtgacccgacctgg

SEQ ID NO: 5400481 - DNA, 20 bp, Homo sapiens
cgtgaccctctgctgaagac

SEQ ID NO: 5400482 - DNA, 13 bp, Homo sapiens
cgtgaccctgtgc

SEQ ID NO: 5400483 - DNA, 17 bp, Homo sapiens
cgtgacccttcagggcc

SEQ ID NO: 5400484 - DNA, 20 bp, Homo sapiens
cgtgaccggacttttctgca

SEQ ID NO: 5400485 - DNA, 21 bp, Homo sapiens
cgtgacctctgcaagacaaag

SEQ ID NO: 5400486 - DNA, 20 bp, Homo sapiens
cgtgacgctgaataaatgtc

SEQ ID NO: 5400487 - DNA, 20 bp, Homo sapiens
cgtgacgtctgggtggccct

SEQ ID NO: 5400488 - DNA, 13 bp, Homo sapiens
cgtgactcaccca

SEQ ID NO: 5400489 - DNA, 16 bp, Homo sapiens
cgtgactcacccaagc

SEQ ID NO: 5400490 - DNA, 13 bp, Homo sapiens
cgtgactcagagc

SEQ ID NO: 5400491 - DNA, 14 bp, Homo sapiens
cgtgactcagagct

SEQ ID NO: 5400492 - DNA, 14 bp, Homo sapiens
cgtgactcagcagc

SEQ ID NO: 5400493 - DNA, 13 bp, Homo sapiens
cgtgactgcccca

SEQ ID NO: 5400494 - DNA, 16 bp, Homo sapiens
cgtgactgccccaact

SEQ ID NO: 5400495 - DNA, 21 bp, Homo sapiens
cgtgactgccccaactcctgg

SEQ ID NO: 5400496 - DNA, 23 bp, Homo sapiens
cgtgactgccccaactcctggaa

SEQ ID NO: 5400497 - DNA, 17 bp, Homo sapiens
cgtgacttcagactctc

SEQ ID NO: 5400498 - DNA, 14 bp, Homo sapiens
cgtgagacacaaga

SEQ ID NO: 5400499 - DNA, 13 bp, Homo sapiens
cgtgagacctgcc

SEQ ID NO: 5400500 - DNA, 16 bp, Homo sapiens
cgtgagacctgcccct

SEQ ID NO: 5400501 - DNA, 15 bp, Homo sapiens
cgtgagagtcatctc

SEQ ID NO: 5400502 - DNA, 23 bp, Homo sapiens
cgtgagagtgtcttcacggcagg

SEQ ID NO: 5400503 - DNA, 16 bp, Homo sapiens
cgtgagcaccaccagg

SEQ ID NO: 5400504 - DNA, 18 bp, Homo sapiens
cgtgagcaccaccagggc

SEQ ID NO: 5400505 - DNA, 20 bp, Homo sapiens
cgtgagcaggaaggcctggg

SEQ ID NO: 5400506 - DNA, 21 bp, Homo sapiens
cgtgagcaggaaggcctgggt

SEQ ID NO: 5400507 - DNA, 19 bp, Homo sapiens
cgtgagcagtgtgtctcct

SEQ ID NO: 5400508 - DNA, 13 bp, Homo sapiens
cgtgagcatgcac

SEQ ID NO: 5400509 - DNA, 20 bp, Homo sapiens
cgtgagccactgcgcccggc

SEQ ID NO: 5400510 - DNA, 17 bp, Homo sapiens
cgtgagccactgctcgt

SEQ ID NO: 5400511 - DNA, 13 bp, Homo sapiens
cgtgagccaggta

SEQ ID NO: 5400512 - DNA, 21 bp, Homo sapiens
cgtgagccaggtaatgaggga

SEQ ID NO: 5400513 - DNA, 16 bp, Homo sapiens
cgtgagcgccccgccc

SEQ ID NO: 5400514 - DNA, 22 bp, Homo sapiens
cgtgagctatgattatgccact

SEQ ID NO: 5400515 - DNA, 15 bp, Homo sapiens
cgtgagctcttgtga

SEQ ID NO: 5400516 - DNA, 20 bp, Homo sapiens
cgtgagctgagcaggccaca

SEQ ID NO: 5400517 - DNA, 12 bp, Homo sapiens
cgtgagctgccc

SEQ ID NO: 5400518 - DNA, 15 bp, Homo sapiens
cgtgagctgcccggc

SEQ ID NO: 5400519 - DNA, 23 bp, Homo sapiens
cgtgagctgcccggcgcctgccc

SEQ ID NO: 5400520 - DNA, 22 bp, Homo sapiens
cgtgagcttaaaatacaagact

SEQ ID NO: 5400521 - DNA, 15 bp, Homo sapiens
cgtgaggctgctgcc

SEQ ID NO: 5400522 - DNA, 18 bp, Homo sapiens
cgtgaggctgctgccatc

SEQ ID NO: 5400523 - DNA, 22 bp, Homo sapiens
cgtgagggcaagagggggacct

SEQ ID NO: 5400524 - DNA, 12 bp, Homo sapiens
cgtgaggggcaa

SEQ ID NO: 5400525 - DNA, 22 bp, Homo sapiens
cgtgaggggcaagctaggcccc

SEQ ID NO: 5400526 - DNA, 16 bp, Homo sapiens
cgtgaggtcccaggaa

SEQ ID NO: 5400527 - DNA, 19 bp, Homo sapiens
cgtgagtgaaccatcatta

SEQ ID NO: 5400528 - DNA, 19 bp, Homo sapiens
cgtgagtgacatagcctca

SEQ ID NO: 5400529 - DNA, 20 bp, Homo sapiens
cgtgagtgacatagcctcat

SEQ ID NO: 5400530 - DNA, 19 bp, Homo sapiens
cgtgagtgtctcttgtcta

SEQ ID NO: 5400531 - DNA, 16 bp, Homo sapiens
cgtgagttctcagggc

SEQ ID NO: 5400532 - DNA, 17 bp, Homo sapiens
cgtgataaacctgctcc

SEQ ID NO: 5400533 - DNA, 16 bp, Homo sapiens
cgtgataatttttgaa

SEQ ID NO: 5400534 - DNA, 17 bp, Homo sapiens
cgtgtgacctataattt

SEQ ID NO: 5400535 - DNA, 21 bp, Homo sapiens
cgtgtgagaagtgaatgctgg

SEQ ID NO: 5400536 - DNA, 23 bp, Homo sapiens
cgtgtgagaagtgaatgctggga

SEQ ID NO: 5400537 - DNA, 23 bp, Homo sapiens
cgtgtgagtgagggagacaggaa

SEQ ID NO: 5400538 - DNA, 15 bp, Homo sapiens
cgtgtgagtgtgaca

SEQ ID NO: 5400539 - DNA, 18 bp, Homo sapiens
cgtgtgatttttctggag

SEQ ID NO: 5400540 - DNA, 19 bp, Homo sapiens
cgtgtgcaacaggtaaaca

SEQ ID NO: 5400541 - DNA, 13 bp, Homo sapiens
cgtgtgcagactg

SEQ ID NO: 5400542 - DNA, 17 bp, Homo sapiens
cgtgtgcagactgtggc

SEQ ID NO: 5400543 - DNA, 19 bp, Homo sapiens
cgtgtgcagactgtggctg

SEQ ID NO: 5400544 - DNA, 13 bp, Homo sapiens
cgtgtgcaggagc

SEQ ID NO: 5400545 - DNA, 13 bp, Homo sapiens
cgtgtgccaggca

SEQ ID NO: 5400546 - DNA, 13 bp, Homo sapiens
cgtgtgcctcctg

SEQ ID NO: 5400547 - DNA, 15 bp, Homo sapiens
cgtgtgcctgtgtgc

SEQ ID NO: 5400548 - DNA, 21 bp, Homo sapiens
cgtgtgcctttcccgggccct

SEQ ID NO: 5400549 - DNA, 16 bp, Homo sapiens
cgtgtgctgaagacat

SEQ ID NO: 5400550 - DNA, 13 bp, Homo sapiens
cgtgtgctgctgc

SEQ ID NO: 5400551 - DNA, 16 bp, Homo sapiens
cgtgtgctgctgctgc

SEQ ID NO: 5400552 - DNA, 12 bp, Homo sapiens
cgtgtgctgtgt

SEQ ID NO: 5400553 - DNA, 14 bp, Homo sapiens
cgtgtggacacaga

SEQ ID NO: 5400554 - DNA, 22 bp, Homo sapiens
cgtgtggagggctgcagagcct

SEQ ID NO: 5400555 - DNA, 12 bp, Homo sapiens
cgtgtggatctt

SEQ ID NO: 5400556 - DNA, 16 bp, Homo sapiens
cgtgtggcagccacac

SEQ ID NO: 5400557 - DNA, 15 bp, Homo sapiens
cgtgtggccctgtgg

SEQ ID NO: 5400558 - DNA, 17 bp, Homo sapiens
cgtgtggccctgtggga

SEQ ID NO: 5400559 - DNA, 18 bp, Homo sapiens
cgtgtggccctgtgggag

SEQ ID NO: 5400560 - DNA, 13 bp, Homo sapiens
cgtgtggcctccg

SEQ ID NO: 5400561 - DNA, 12 bp, Homo sapiens
cgtgtggcctgg

SEQ ID NO: 5400562 - DNA, 16 bp, Homo sapiens
cgtgtggcgtggcccg

SEQ ID NO: 5400563 - DNA, 20 bp, Homo sapiens
cgtgtggctcacgtgtgtga

SEQ ID NO: 5400564 - DNA, 21 bp, Homo sapiens
cgtgtgggtcccgcactctgc

SEQ ID NO: 5400565 - DNA, 21 bp, Homo sapiens
cgtgtggtaccttcagccctg

SEQ ID NO: 5400566 - DNA, 18 bp, Homo sapiens
cgtgtggtttccctgccc

SEQ ID NO: 5400567 - DNA, 12 bp, Homo sapiens
cgtgtgtagagt

SEQ ID NO: 5400568 - DNA, 15 bp, Homo sapiens
cgtgtgtagagttaa

SEQ ID NO: 5400569 - DNA, 22 bp, Homo sapiens
cgtgtgtagagttaagaagctg

SEQ ID NO: 5400570 - DNA, 19 bp, Homo sapiens
cgtgtgtatccgactctaa

SEQ ID NO: 5400571 - DNA, 14 bp, Homo sapiens
cgtgtgtatttcta

SEQ ID NO: 5400572 - DNA, 16 bp, Homo sapiens
cgtgtgtatttctaag

SEQ ID NO: 5400573 - DNA, 16 bp, Homo sapiens
cgtgtgtcagggatga

SEQ ID NO: 5400574 - DNA, 14 bp, Homo sapiens
cgtgtgtccaggct

SEQ ID NO: 5400575 - DNA, 10 bp, Homo sapiens
cgtgtgtctc

SEQ ID NO: 5400576 - DNA, 16 bp, Homo sapiens
cgtgtgtctcatgcca

SEQ ID NO: 5400577 - DNA, 12 bp, Homo sapiens
cgtgtgtctgtg

SEQ ID NO: 5400578 - DNA, 14 bp, Homo sapiens
cgtgtgtctgtgtt

SEQ ID NO: 5400579 - DNA, 22 bp, Homo sapiens
cgtgtgtgcaagtgtctgtgtg

SEQ ID NO: 5400580 - DNA, 14 bp, Homo sapiens
cgtgtgtgtatgct

SEQ ID NO: 5400581 - DNA, 11 bp, Homo sapiens
cgtgtgtgtgt

SEQ ID NO: 5400582 - DNA, 18 bp, Homo sapiens
cgtgtgtgtgtatgtgtg

SEQ ID NO: 5400583 - DNA, 22 bp, Homo sapiens
cgtgtgtgtgtgtgtgtgtgca

SEQ ID NO: 5400584 - DNA, 16 bp, Homo sapiens
cgtgtgtgttgtctga

SEQ ID NO: 5400585 - DNA, 15 bp, Homo sapiens
cgtgtgttccccagc

SEQ ID NO: 5400586 - DNA, 19 bp, Homo sapiens
cgtgtgttccccagctgat

SEQ ID NO: 5400587 - DNA, 15 bp, Homo sapiens
cgtgtgttctatcca

SEQ ID NO: 5400588 - DNA, 20 bp, Homo sapiens
cgtgtgttcttttgagtcct

SEQ ID NO: 5400589 - DNA, 18 bp, Homo sapiens
cgtgtgtttttctattaa

SEQ ID NO: 5400590 - DNA, 23 bp, Homo sapiens
cgtgtgtttttctattaaaagac

SEQ ID NO: 5400591 - DNA, 15 bp, Homo sapiens
cgtgttacccactgc

SEQ ID NO: 5400592 - DNA, 19 bp, Homo sapiens
cgtgttaggaggctgcatg

SEQ ID NO: 5400593 - DNA, 21 bp, Homo sapiens
cgtgttattttaatctcagaa

SEQ ID NO: 5400594 - DNA, 23 bp, Homo sapiens
cgtgttcacaccattctcctgcc

SEQ ID NO: 5400595 - DNA, 16 bp, Homo sapiens
cgtgttcagcagaacc

SEQ ID NO: 5400596 - DNA, 19 bp, Homo sapiens
cgtgttccagccaaagcat

SEQ ID NO: 5400597 - DNA, 18 bp, Homo sapiens
cgtgttcccctcttgtct

SEQ ID NO: 5400598 - DNA, 20 bp, Homo sapiens
cgtgttcccctcttgtctcc

SEQ ID NO: 5400599 - DNA, 16 bp, Homo sapiens
cgtgttcgctggctga

SEQ ID NO: 5400600 - DNA, 12 bp, Homo sapiens
cgtgttctcagc

SEQ ID NO: 5400601 - DNA, 15 bp, Homo sapiens
cgtgttgccttgaac

SEQ ID NO: 5400602 - DNA, 18 bp, Homo sapiens
cgtgttgtcattgactcg

SEQ ID NO: 5400603 - DNA, 14 bp, Homo sapiens
cgtgtttcacagtg

SEQ ID NO: 5400604 - DNA, 16 bp, Homo sapiens
cgtgtttcgggccagg

SEQ ID NO: 5400605 - DNA, 12 bp, Homo sapiens
cgtgtttctcta

SEQ ID NO: 5400606 - DNA, 12 bp, Homo sapiens
cgtgtttgctta

SEQ ID NO: 5400607 - DNA, 16 bp, Homo sapiens
cgtgtttgcttaaaat

SEQ ID NO: 5400608 - DNA, 21 bp, Homo sapiens
cgtgttttattcctgtatgtt

SEQ ID NO: 5400609 - DNA, 16 bp, Homo sapiens
cgttaaaagtgtacaa

SEQ ID NO: 5400610 - DNA, 21 bp, Homo sapiens
cgttaactgcattttacacat

SEQ ID NO: 5400611 - DNA, 19 bp, Homo sapiens
cgttaactgtgtatgtaca

SEQ ID NO: 5400612 - DNA, 14 bp, Homo sapiens
cgttaagcagtaca

SEQ ID NO: 5400613 - DNA, 20 bp, Homo sapiens
cgttaagggaaggaactctg

SEQ ID NO: 5400614 - DNA, 14 bp, Homo sapiens
cgttaagggcagag

SEQ ID NO: 5400615 - DNA, 20 bp, Homo sapiens
cgttaatagattatttcata

SEQ ID NO: 5400616 - DNA, 14 bp, Homo sapiens
cgttacagctcccc

SEQ ID NO: 5400617 - DNA, 23 bp, Homo sapiens
cgttacatctgtgcagggctggt

SEQ ID NO: 5400618 - DNA, 19 bp, Homo sapiens
cgttactcagggctcctcc

SEQ ID NO: 5400619 - DNA, 21 bp, Homo sapiens
cgttactcagggctcctccca

SEQ ID NO: 5400620 - DNA, 15 bp, Homo sapiens
cgttactctcacctc

SEQ ID NO: 5400621 - DNA, 14 bp, Homo sapiens
cgttagaggaaaaa

SEQ ID NO: 5400622 - DNA, 17 bp, Homo sapiens
cgttagaggagcaacag

SEQ ID NO: 5400623 - DNA, 14 bp, Homo sapiens
cgttagctcctgtg

SEQ ID NO: 5400624 - DNA, 15 bp, Homo sapiens
cgttagctcctgtgg

SEQ ID NO: 5400625 - DNA, 17 bp, Homo sapiens
cgttagctcctgtggcc

SEQ ID NO: 5400626 - DNA, 17 bp, Homo sapiens
cgttagcttcctgcagg

SEQ ID NO: 5400627 - DNA, 13 bp, Homo sapiens
cgttagctttttc

SEQ ID NO: 5400628 - DNA, 21 bp, Homo sapiens
cgttaggaataacactgcagc

SEQ ID NO: 5400629 - DNA, 15 bp, Homo sapiens
cgttaggacaaggct

SEQ ID NO: 5400630 - DNA, 21 bp, Homo sapiens
cgttaggaggacaaaaggaat

SEQ ID NO: 5400631 - DNA, 19 bp, Homo sapiens
cgttaggcccgggcccctg

SEQ ID NO: 5400632 - DNA, 14 bp, Homo sapiens
cgttagggaagaga

SEQ ID NO: 5400633 - DNA, 13 bp, Homo sapiens
cgttagggctgct

SEQ ID NO: 5400634 - DNA, 20 bp, Homo sapiens
cgttagtcgtgagctcttgt

SEQ ID NO: 5400635 - DNA, 20 bp, Homo sapiens
cgttatgtaagtttctaaga

SEQ ID NO: 5400636 - DNA, 22 bp, Homo sapiens
cgttatgtaagtttctaagaat

SEQ ID NO: 5400637 - DNA, 15 bp, Homo sapiens
cgttattataaatgt

SEQ ID NO: 5400638 - DNA, 16 bp, Homo sapiens
cgttattataaatgtt

SEQ ID NO: 5400639 - DNA, 16 bp, Homo sapiens
cgttattataattgta

SEQ ID NO: 5400640 - DNA, 17 bp, Homo sapiens
cgttatttatggaccac

SEQ ID NO: 5400641 - DNA, 18 bp, Homo sapiens
cgttatttatggaccact

SEQ ID NO: 5400642 - DNA, 21 bp, Homo sapiens
cgttattttctttttccttta

SEQ ID NO: 5400643 - DNA, 13 bp, Homo sapiens
cgttcaaaagtgg

SEQ ID NO: 5400644 - DNA, 16 bp, Homo sapiens
cgttcacttccccttc

SEQ ID NO: 5400645 - DNA, 15 bp, Homo sapiens
cgttcagcagactgg

SEQ ID NO: 5400646 - DNA, 13 bp, Homo sapiens
cgttcataaccaa

SEQ ID NO: 5400647 - DNA, 21 bp, Homo sapiens
cgttcatggaacgcgttgaaa

SEQ ID NO: 5400648 - DNA, 14 bp, Homo sapiens
cgttcattcattca

SEQ ID NO: 5400649 - DNA, 11 bp, Homo sapiens
cgttcatttgt

SEQ ID NO: 5400650 - DNA, 12 bp, Homo sapiens
cgttcatttgtg

SEQ ID NO: 5400651 - DNA, 14 bp, Homo sapiens
cgttcattttctgt

SEQ ID NO: 5400652 - DNA, 16 bp, Homo sapiens
cgttccacagttgcca

SEQ ID NO: 5400653 - DNA, 22 bp, Homo sapiens
cgttccacagttgccaccacct

SEQ ID NO: 5400654 - DNA, 21 bp, Homo sapiens
cgttccaccccaagagaactc

SEQ ID NO: 5400655 - DNA, 19 bp, Homo sapiens
cgttccccttggcttcctc

SEQ ID NO: 5400656 - DNA, 18 bp, Homo sapiens
cgttccctgattatttat

SEQ ID NO: 5400657 - DNA, 11 bp, Homo sapiens
cgttccctgcg

SEQ ID NO: 5400658 - DNA, 12 bp, Homo sapiens
cgttccctttgg

SEQ ID NO: 5400659 - DNA, 22 bp, Homo sapiens
cgttccgggcaaatgccagggc

SEQ ID NO: 5400660 - DNA, 14 bp, Homo sapiens
cgttcctcctcagc

SEQ ID NO: 5400661 - DNA, 17 bp, Homo sapiens
cgttcctcctcagcctc

SEQ ID NO: 5400662 - DNA, 21 bp, Homo sapiens
cgttcctgacatcacagcagc

SEQ ID NO: 5400663 - DNA, 17 bp, Homo sapiens
cgttcctgccaggctct

SEQ ID NO: 5400664 - DNA, 11 bp, Homo sapiens
cgttcctggca

SEQ ID NO: 5400665 - DNA, 16 bp, Homo sapiens
cgttcctggccttctg

SEQ ID NO: 5400666 - DNA, 22 bp, Homo sapiens
cgttccttcaaagcaaatgtct

SEQ ID NO: 5400667 - DNA, 13 bp, Homo sapiens
cgttcgatttcta

SEQ ID NO: 5400668 - DNA, 14 bp, Homo sapiens
cgttcgcctctggc

SEQ ID NO: 5400669 - DNA, 16 bp, Homo sapiens
cgttcgcctctggccc

SEQ ID NO: 5400670 - DNA, 16 bp, Homo sapiens
cgttcgcttgttttaa

SEQ ID NO: 5400671 - DNA, 19 bp, Homo sapiens
cgttcgcttgttttaaaag

SEQ ID NO: 5400672 - DNA, 16 bp, Homo sapiens
cgttctcaagaatcta

SEQ ID NO: 5400673 - DNA, 14 bp, Homo sapiens
cgttctcagtcctt

SEQ ID NO: 5400674 - DNA, 15 bp, Homo sapiens
cgttctcccaaagat

SEQ ID NO: 5400675 - DNA, 16 bp, Homo sapiens
cgttctcccaaagatt

SEQ ID NO: 5400676 - DNA, 19 bp, Homo sapiens
cgttctcctgatgttttgc

SEQ ID NO: 5400677 - DNA, 11 bp, Homo sapiens
cgttctcctgc

SEQ ID NO: 5400678 - DNA, 14 bp, Homo sapiens
cgttctccttcccc

SEQ ID NO: 5400679 - DNA, 18 bp, Homo sapiens
cgttctccttccccattt

SEQ ID NO: 5400680 - DNA, 15 bp, Homo sapiens
cgttctcgtgaccca

SEQ ID NO: 5400681 - DNA, 19 bp, Homo sapiens
cgttctcgtgacccagtgg

SEQ ID NO: 5400682 - DNA, 19 bp, Homo sapiens
cgttctctgggtggccggc

SEQ ID NO: 5400683 - DNA, 14 bp, Homo sapiens
cgttctctgtccta

SEQ ID NO: 5400684 - DNA, 18 bp, Homo sapiens
cgttctcttctctcttca

SEQ ID NO: 5400685 - DNA, 19 bp, Homo sapiens
cgttctgccttccttgtta

SEQ ID NO: 5400686 - DNA, 18 bp, Homo sapiens
cgttctgctgaccaaatg

SEQ ID NO: 5400687 - DNA, 15 bp, Homo sapiens
cgttctgctgcccct

SEQ ID NO: 5400688 - DNA, 20 bp, Homo sapiens
cgttctgctgcccctgcagt

SEQ ID NO: 5400689 - DNA, 12 bp, Homo sapiens
cgttctgctggc

SEQ ID NO: 5400690 - DNA, 23 bp, Homo sapiens
cgttctgtactgttactgggccc

SEQ ID NO: 5400691 - DNA, 19 bp, Homo sapiens
cgttctgttacccagggct

SEQ ID NO: 5400692 - DNA, 12 bp, Homo sapiens
cgttctgttcca

SEQ ID NO: 5400693 - DNA, 15 bp, Homo sapiens
cgttctgttctgctg

SEQ ID NO: 5400694 - DNA, 16 bp, Homo sapiens
cgttctgttctgctgg

SEQ ID NO: 5400695 - DNA, 12 bp, Homo sapiens
cgttctgtttac

SEQ ID NO: 5400696 - DNA, 19 bp, Homo sapiens
cgttcttaggctgctggga

SEQ ID NO: 5400697 - DNA, 15 bp, Homo sapiens
cgttcttcaggagat

SEQ ID NO: 5400698 - DNA, 13 bp, Homo sapiens
cgttcttgtaatt

SEQ ID NO: 5400699 - DNA, 13 bp, Homo sapiens
cgttcttgttctg

SEQ ID NO: 5400700 - DNA, 18 bp, Homo sapiens
cgttgaaattgtaattat

SEQ ID NO: 5400701 - DNA, 22 bp, Homo sapiens
cgttgaaccacgtgaaactgct

SEQ ID NO: 5400702 - DNA, 19 bp, Homo sapiens
cgttgaagttgactctgct

SEQ ID NO: 5400703 - DNA, 16 bp, Homo sapiens
cgttgaatctgggagg

SEQ ID NO: 5400704 - DNA, 20 bp, Homo sapiens
cgttgaatgagtgtgttttg

SEQ ID NO: 5400705 - DNA, 16 bp, Homo sapiens
cgttgacatgcacagt

SEQ ID NO: 5400706 - DNA, 15 bp, Homo sapiens
cgttgacccctttcc

SEQ ID NO: 5400707 - DNA, 18 bp, Homo sapiens
cgttgacccctttccccc

SEQ ID NO: 5400708 - DNA, 19 bp, Homo sapiens
cgttgacccctttccccca

SEQ ID NO: 5400709 - DNA, 22 bp, Homo sapiens
cgttgacccctttcccccaccc

SEQ ID NO: 5400710 - DNA, 22 bp, Homo sapiens
cgttgagcgtacgatggaggcc

SEQ ID NO: 5400711 - DNA, 21 bp, Homo sapiens
cgttgaggcggtttcctgaat

SEQ ID NO: 5400712 - DNA, 18 bp, Homo sapiens
cgttgatctcctggtagc

SEQ ID NO: 5400713 - DNA, 16 bp, Homo sapiens
cgttgatgtaatgaaa

SEQ ID NO: 5400714 - DNA, 18 bp, Homo sapiens
ctaaagaggctgaaagag

SEQ ID NO: 5400715 - DNA, 19 bp, Homo sapiens
ctaaagagttattcaaatg

SEQ ID NO: 5400716 - DNA, 23 bp, Homo sapiens
ctaaagagttattcaaatgaagg

SEQ ID NO: 5400717 - DNA, 15 bp, Homo sapiens
ctaaagataatatta

SEQ ID NO: 5400718 - DNA, 17 bp, Homo sapiens
ctaaagatggaaaagaa

SEQ ID NO: 5400719 - DNA, 18 bp, Homo sapiens
ctaaagatggagtttcta

SEQ ID NO: 5400720 - DNA, 21 bp, Homo sapiens
ctaaagatggagtttctaagg

SEQ ID NO: 5400721 - DNA, 14 bp, Homo sapiens
ctaaagattctata

SEQ ID NO: 5400722 - DNA, 20 bp, Homo sapiens
ctaaagattctatagttcta

SEQ ID NO: 5400723 - DNA, 13 bp, Homo sapiens
ctaaagattttga

SEQ ID NO: 5400724 - DNA, 15 bp, Homo sapiens
ctaaagcaatagaaa

SEQ ID NO: 5400725 - DNA, 17 bp, Homo sapiens
ctaaagcaatagaaaca

SEQ ID NO: 5400726 - DNA, 22 bp, Homo sapiens
ctaaagcactggtttcaagaat

SEQ ID NO: 5400727 - DNA, 19 bp, Homo sapiens
ctaaagcagacttttgtgt

SEQ ID NO: 5400728 - DNA, 13 bp, Homo sapiens
ctaaagcagagat

SEQ ID NO: 5400729 - DNA, 14 bp, Homo sapiens
ctaaagcagagatg

SEQ ID NO: 5400730 - DNA, 17 bp, Homo sapiens
ctaaagcagtaaaataa

SEQ ID NO: 5400731 - DNA, 14 bp, Homo sapiens
ctaaagcagtgttt

SEQ ID NO: 5400732 - DNA, 17 bp, Homo sapiens
ctaaagcagtgttttca

SEQ ID NO: 5400733 - DNA, 19 bp, Homo sapiens
ctaaagcatgaaatgtgaa

SEQ ID NO: 5400734 - DNA, 17 bp, Homo sapiens
ctaaagcattttttaaa

SEQ ID NO: 5400735 - DNA, 18 bp, Homo sapiens
ctaaagcattttttaaaa

SEQ ID NO: 5400736 - DNA, 15 bp, Homo sapiens
ctaaagccaaagttt

SEQ ID NO: 5400737 - DNA, 16 bp, Homo sapiens
ctaaagccaaagtttc

SEQ ID NO: 5400738 - DNA, 18 bp, Homo sapiens
ctaaagccaaccagcctt

SEQ ID NO: 5400739 - DNA, 15 bp, Homo sapiens
ctaaagccagcctga

SEQ ID NO: 5400740 - DNA, 17 bp, Homo sapiens
ctaaagccaggaacagg

SEQ ID NO: 5400741 - DNA, 22 bp, Homo sapiens
ctaaagccaggaacagggacca

SEQ ID NO: 5400742 - DNA, 23 bp, Homo sapiens
ctaaagccaggaacagggaccag

SEQ ID NO: 5400743 - DNA, 17 bp, Homo sapiens
ctaaagcccattgctgc

SEQ ID NO: 5400744 - DNA, 16 bp, Homo sapiens
ctaaagctatgttaca

SEQ ID NO: 5400745 - DNA, 12 bp, Homo sapiens
ctaaagctctga

SEQ ID NO: 5400746 - DNA, 14 bp, Homo sapiens
ctaaagctgccagc

SEQ ID NO: 5400747 - DNA, 18 bp, Homo sapiens
ctaaagctggtttaatgt

SEQ ID NO: 5400748 - DNA, 12 bp, Homo sapiens
ctaaagctttat

SEQ ID NO: 5400749 - DNA, 14 bp, Homo sapiens
ctaaagctttggac

SEQ ID NO: 5400750 - DNA, 21 bp, Homo sapiens
ctaaaggactattatgtggaa

SEQ ID NO: 5400751 - DNA, 16 bp, Homo sapiens
ctaaaggagtttatgt

SEQ ID NO: 5400752 - DNA, 17 bp, Homo sapiens
ctaaaggatagatcaaa

SEQ ID NO: 5400753 - DNA, 22 bp, Homo sapiens
ctaaaggatgagatttttcatg

SEQ ID NO: 5400754 - DNA, 23 bp, Homo sapiens
ctaaaggatgagatttttcatgt

SEQ ID NO: 5400755 - DNA, 16 bp, Homo sapiens
ctaaaggcatccttgt

SEQ ID NO: 5400756 - DNA, 17 bp, Homo sapiens
ctaaaggctacctttgt

SEQ ID NO: 5400757 - DNA, 19 bp, Homo sapiens
ctaaaggctacctttgtat

SEQ ID NO: 5400758 - DNA, 20 bp, Homo sapiens
ctaaagggacaataactctg

SEQ ID NO: 5400759 - DNA, 13 bp, Homo sapiens
ctaaagggaccat

SEQ ID NO: 5400760 - DNA, 21 bp, Homo sapiens
ctaaagggaccatctgctgca

SEQ ID NO: 5400761 - DNA, 15 bp, Homo sapiens
ctaaagggagaagga

SEQ ID NO: 5400762 - DNA, 17 bp, Homo sapiens
ctaaagggagaaggaag

SEQ ID NO: 5400763 - DNA, 13 bp, Homo sapiens
ctaaagggcaggg

SEQ ID NO: 5400764 - DNA, 17 bp, Homo sapiens
ctaaagggcagggccca

SEQ ID NO: 5400765 - DNA, 16 bp, Homo sapiens
ctaaagggcttcattt

SEQ ID NO: 5400766 - DNA, 19 bp, Homo sapiens
ctaaaggggactagacagt

SEQ ID NO: 5400767 - DNA, 22 bp, Homo sapiens
ctaaaggggactagacagttag

SEQ ID NO: 5400768 - DNA, 22 bp, Homo sapiens
ctaaagggtatgagctggagct

SEQ ID NO: 5400769 - DNA, 18 bp, Homo sapiens
ctaaagggtgtgggtcag

SEQ ID NO: 5400770 - DNA, 23 bp, Homo sapiens
ctaaagggtgtgggtcagggagg

SEQ ID NO: 5400771 - DNA, 22 bp, Homo sapiens
ctaaaggtaccaaacaaggaag

SEQ ID NO: 5400772 - DNA, 21 bp, Homo sapiens
ctaaaggtagatcatcttgaa

SEQ ID NO: 5400773 - DNA, 20 bp, Homo sapiens
ctaaaggtcccaaggcaagg

SEQ ID NO: 5400774 - DNA, 23 bp, Homo sapiens
ctaaaggtggccacaaattcttt

SEQ ID NO: 5400775 - DNA, 20 bp, Homo sapiens
ctaaaggtgttgtcccttct

SEQ ID NO: 5400776 - DNA, 21 bp, Homo sapiens
ctaaagtacagcctggaccac

SEQ ID NO: 5400777 - DNA, 23 bp, Homo sapiens
ctaaagtactgagcagtgatatt

SEQ ID NO: 5400778 - DNA, 17 bp, Homo sapiens
ctaaagtagacttcatt

SEQ ID NO: 5400779 - DNA, 19 bp, Homo sapiens
ctaaagtagggaagtttta

SEQ ID NO: 5400780 - DNA, 20 bp, Homo sapiens
ctaaagtatagagaaaagtg

SEQ ID NO: 5400781 - DNA, 15 bp, Homo sapiens
ctaaagtatgaagca

SEQ ID NO: 5400782 - DNA, 19 bp, Homo sapiens
ctaaagtatttttataaat

SEQ ID NO: 5400783 - DNA, 14 bp, Homo sapiens
ctaaagtctcaggt

SEQ ID NO: 5400784 - DNA, 18 bp, Homo sapiens
ctaaagtctctgctgcta

SEQ ID NO: 5400785 - DNA, 17 bp, Homo sapiens
ctaaagtcttcctattg

SEQ ID NO: 5400786 - DNA, 18 bp, Homo sapiens
ctaaagtgcctaccccag

SEQ ID NO: 5400787 - DNA, 12 bp, Homo sapiens
ctaaagtgctgc

SEQ ID NO: 5400788 - DNA, 20 bp, Homo sapiens
ctaaagtgctgggattacag

SEQ ID NO: 5400789 - DNA, 15 bp, Homo sapiens
ctaaagtgtcaaggt

SEQ ID NO: 5400790 - DNA, 13 bp, Homo sapiens
ctaaagtgtctat

SEQ ID NO: 5400791 - DNA, 22 bp, Homo sapiens
ctaaagtgtctattagttttct

SEQ ID NO: 5400792 - DNA, 16 bp, Homo sapiens
ctaaagtgtgctttat

SEQ ID NO: 5400793 - DNA, 21 bp, Homo sapiens
ctaaagtgtgctttataaaaa

SEQ ID NO: 5400794 - DNA, 15 bp, Homo sapiens
ctaaagtgttggtct

SEQ ID NO: 5400795 - DNA, 20 bp, Homo sapiens
ctaaagtgttggtctttcta

SEQ ID NO: 5400796 - DNA, 19 bp, Homo sapiens
ctaaagttagggcattttt

SEQ ID NO: 5400797 - DNA, 11 bp, Homo sapiens
ctaaagttcta

SEQ ID NO: 5400798 - DNA, 15 bp, Homo sapiens
ctaaagttctaagat

SEQ ID NO: 5400799 - DNA, 18 bp, Homo sapiens
ctaaagttctaagattct

SEQ ID NO: 5400800 - DNA, 20 bp, Homo sapiens
ctaaagttctaagattctga

SEQ ID NO: 5400801 - DNA, 17 bp, Homo sapiens
ctaaagttgaaaataca

SEQ ID NO: 5400802 - DNA, 15 bp, Homo sapiens
ctaaagttgtacttt

SEQ ID NO: 5400803 - DNA, 14 bp, Homo sapiens
ctaaagtttacagt

SEQ ID NO: 5400804 - DNA, 21 bp, Homo sapiens
ctaaagtttacagtaaataaa

SEQ ID NO: 5400805 - DNA, 23 bp, Homo sapiens
ctaaagttttcttcccagagaga

SEQ ID NO: 5400806 - DNA, 11 bp, Homo sapiens
ctaaagttttg

SEQ ID NO: 5400807 - DNA, 15 bp, Homo sapiens
ctaaagttttgcaac

SEQ ID NO: 5400808 - DNA, 17 bp, Homo sapiens
ctaaataaaaaaagaca

SEQ ID NO: 5400809 - DNA, 17 bp, Homo sapiens
ctaaataaaaaaattaa

SEQ ID NO: 5400810 - DNA, 22 bp, Homo sapiens
ctaaataaaagttttacaaagg

SEQ ID NO: 5400811 - DNA, 19 bp, Homo sapiens
ctaaataaaatataattgt

SEQ ID NO: 5400812 - DNA, 15 bp, Homo sapiens
ctaaataaaatgcta

SEQ ID NO: 5400813 - DNA, 20 bp, Homo sapiens
ctaaataaacacatagattc

SEQ ID NO: 5400814 - DNA, 15 bp, Homo sapiens
ctaaataaacacgat

SEQ ID NO: 5400815 - DNA, 19 bp, Homo sapiens
ctaaataaactactttgaa

SEQ ID NO: 5400816 - DNA, 12 bp, Homo sapiens
ctaaataaagac

SEQ ID NO: 5400817 - DNA, 12 bp, Homo sapiens
ctaaataaagtc

SEQ ID NO: 5400818 - DNA, 12 bp, Homo sapiens
ctaaataaatgg

SEQ ID NO: 5400819 - DNA, 19 bp, Homo sapiens
ctaaataaattatttgtta

SEQ ID NO: 5400820 - DNA, 23 bp, Homo sapiens
ctaaataactatataagacatta

SEQ ID NO: 5400821 - DNA, 18 bp, Homo sapiens
ctaaataacttgccattt

SEQ ID NO: 5400822 - DNA, 22 bp, Homo sapiens
ctaaataacttgccatttcttt

SEQ ID NO: 5400823 - DNA, 23 bp, Homo sapiens
ctaaataacttgccatttcttta

SEQ ID NO: 5400824 - DNA, 18 bp, Homo sapiens
ctaaataaggaatttcct

SEQ ID NO: 5400825 - DNA, 20 bp, Homo sapiens
ctaaataatcttactctaga

SEQ ID NO: 5400826 - DNA, 20 bp, Homo sapiens
ctaaataatgaataaactga

SEQ ID NO: 5400827 - DNA, 21 bp, Homo sapiens
ctaaataatgatcttccaaat

SEQ ID NO: 5400828 - DNA, 17 bp, Homo sapiens
ctaaatacaacactgat

SEQ ID NO: 5400829 - DNA, 22 bp, Homo sapiens
ctaaatactgactgctggacat

SEQ ID NO: 5400830 - DNA, 21 bp, Homo sapiens
ctaaatactgagaaaacctgt

SEQ ID NO: 5400831 - DNA, 15 bp, Homo sapiens
ctaaatagatacttt

SEQ ID NO: 5400832 - DNA, 19 bp, Homo sapiens
ctaaatagatacttttgat

SEQ ID NO: 5400833 - DNA, 18 bp, Homo sapiens
ctaaatagatttttagat

SEQ ID NO: 5400834 - DNA, 22 bp, Homo sapiens
ctaaatagatttttagattcct

SEQ ID NO: 5400835 - DNA, 15 bp, Homo sapiens
ctaaatagcatgtat

SEQ ID NO: 5400836 - DNA, 16 bp, Homo sapiens
ctaaatagtattttgt

SEQ ID NO: 5400837 - DNA, 18 bp, Homo sapiens
ctaaatataaattttcag

SEQ ID NO: 5400838 - DNA, 17 bp, Homo sapiens
ctaaatatatattatgc

SEQ ID NO: 5400839 - DNA, 12 bp, Homo sapiens
ctaaatatatgt

SEQ ID NO: 5400840 - DNA, 14 bp, Homo sapiens
ctaaatatatgtct

SEQ ID NO: 5400841 - DNA, 16 bp, Homo sapiens
ctaaatatatgtctgt

SEQ ID NO: 5400842 - DNA, 18 bp, Homo sapiens
ctaaatatattttaagac

SEQ ID NO: 5400843 - DNA, 20 bp, Homo sapiens
ctaaatatccaaagactgta

SEQ ID NO: 5400844 - DNA, 23 bp, Homo sapiens
ctaaatatccaaagactgtactg

SEQ ID NO: 5400845 - DNA, 21 bp, Homo sapiens
ctaaatatgaaccctttgttt

SEQ ID NO: 5400846 - DNA, 23 bp, Homo sapiens
ctaaatatgaaccctttgtttct

SEQ ID NO: 5400847 - DNA, 16 bp, Homo sapiens
ctaaatatggactgct

SEQ ID NO: 5400848 - DNA, 19 bp, Homo sapiens
ctaaatatgggaatgtcta

SEQ ID NO: 5400849 - DNA, 20 bp, Homo sapiens
ctaaatattatgagatgctg

SEQ ID NO: 5400850 - DNA, 17 bp, Homo sapiens
ctaaatattgacactta

SEQ ID NO: 5400851 - DNA, 20 bp, Homo sapiens
ctaaatatttaagtgcagtc

SEQ ID NO: 5400852 - DNA, 19 bp, Homo sapiens
ctaaatatttaccttgaaa

SEQ ID NO: 5400853 - DNA, 20 bp, Homo sapiens
ctaaatatttaccttgaaaa

SEQ ID NO: 5400854 - DNA, 12 bp, Homo sapiens
ctaaatatttca

SEQ ID NO: 5400855 - DNA, 20 bp, Homo sapiens
ctaaatattttcaagaaaag

SEQ ID NO: 5400856 - DNA, 21 bp, Homo sapiens
ctaaatcactttaatttagaa

SEQ ID NO: 5400857 - DNA, 16 bp, Homo sapiens
ctaaatcagcattttt

SEQ ID NO: 5400858 - DNA, 15 bp, Homo sapiens
ctaaatcataatcat

SEQ ID NO: 5400859 - DNA, 13 bp, Homo sapiens
ctaaatccaaaga

SEQ ID NO: 5400860 - DNA, 16 bp, Homo sapiens
ctaaatccattttcta

SEQ ID NO: 5400861 - DNA, 23 bp, Homo sapiens
ctaaatccattttctaaactgtt

SEQ ID NO: 5400862 - DNA, 16 bp, Homo sapiens
ctaaatcccaagaaat

SEQ ID NO: 5400863 - DNA, 18 bp, Homo sapiens
ctaaatccgacttgaata

SEQ ID NO: 5400864 - DNA, 21 bp, Homo sapiens
ctaaatcctttactgttagtc

SEQ ID NO: 5400865 - DNA, 15 bp, Homo sapiens
ctaaatccttttgtt

SEQ ID NO: 5400866 - DNA, 23 bp, Homo sapiens
ctaaatccttttgttttgaagct

SEQ ID NO: 5400867 - DNA, 14 bp, Homo sapiens
ctaaatctatttat

SEQ ID NO: 5400868 - DNA, 20 bp, Homo sapiens
ctaaatctccaaaataaaac

SEQ ID NO: 5400869 - DNA, 19 bp, Homo sapiens
ctaaatctccaagacctgg

SEQ ID NO: 5400870 - DNA, 15 bp, Homo sapiens
ctaaatctctaatat

SEQ ID NO: 5400871 - DNA, 15 bp, Homo sapiens
ctaaatcttccttgt

SEQ ID NO: 5400872 - DNA, 16 bp, Homo sapiens
ctaaatgaaaagagaa

SEQ ID NO: 5400873 - DNA, 14 bp, Homo sapiens
ctaaatgaatgttt

SEQ ID NO: 5400874 - DNA, 12 bp, Homo sapiens
ctaaatgacctc

SEQ ID NO: 5400875 - DNA, 14 bp, Homo sapiens
ctaaatgacctcag

SEQ ID NO: 5400876 - DNA, 15 bp, Homo sapiens
ctaaatgacctcagc

SEQ ID NO: 5400877 - DNA, 18 bp, Homo sapiens
ctaaatgacctcagcaaa

SEQ ID NO: 5400878 - DNA, 19 bp, Homo sapiens
ctaaatgacctcagcaaat

SEQ ID NO: 5400879 - DNA, 20 bp, Homo sapiens
ctaaatgacttgcagatgaa

SEQ ID NO: 5400880 - DNA, 12 bp, Homo sapiens
ctaaatgcaaag

SEQ ID NO: 5400881 - DNA, 14 bp, Homo sapiens
ctaaatgcaaagca

SEQ ID NO: 5400882 - DNA, 13 bp, Homo sapiens
ctaaatgcaataa

SEQ ID NO: 5400883 - DNA, 17 bp, Homo sapiens
ctaaatgcaatttaaaa

SEQ ID NO: 5400884 - DNA, 21 bp, Homo sapiens
ctaaatgcaatttaaaattat

SEQ ID NO: 5400885 - DNA, 18 bp, Homo sapiens
ctaaatgcagttttaaga

SEQ ID NO: 5400886 - DNA, 18 bp, Homo sapiens
ctaaatgcccagttcact

SEQ ID NO: 5400887 - DNA, 17 bp, Homo sapiens
ctaaatgcctaataaac

SEQ ID NO: 5400888 - DNA, 18 bp, Homo sapiens
ctaaatgcctaataaaca

SEQ ID NO: 5400889 - DNA, 19 bp, Homo sapiens
ctaaatgccttagaaatgt

SEQ ID NO: 5400890 - DNA, 14 bp, Homo sapiens
ctaaatgcctttga

SEQ ID NO: 5400891 - DNA, 15 bp, Homo sapiens
ctaagagagaatgag

SEQ ID NO: 5400892 - DNA, 13 bp, Homo sapiens
ctaagagcaattc

SEQ ID NO: 5400893 - DNA, 16 bp, Homo sapiens
ctaagagccacaataa

SEQ ID NO: 5400894 - DNA, 15 bp, Homo sapiens
ctaagagcctctgga

SEQ ID NO: 5400895 - DNA, 16 bp, Homo sapiens
ctaagagcctctggaa

SEQ ID NO: 5400896 - DNA, 19 bp, Homo sapiens
ctaagagctagcgctgccg

SEQ ID NO: 5400897 - DNA, 18 bp, Homo sapiens
ctaagaggaaagtacatt

SEQ ID NO: 5400898 - DNA, 20 bp, Homo sapiens
ctaagaggctatttaaaagt

SEQ ID NO: 5400899 - DNA, 11 bp, Homo sapiens
ctaagaggctg

SEQ ID NO: 5400900 - DNA, 23 bp, Homo sapiens
ctaagaggctgccctcctgtgct

SEQ ID NO: 5400901 - DNA, 14 bp, Homo sapiens
ctaagaggctgctg

SEQ ID NO: 5400902 - DNA, 22 bp, Homo sapiens
ctaagagggagggagggctcca

SEQ ID NO: 5400903 - DNA, 20 bp, Homo sapiens
ctaagaggttgctaatgcct

SEQ ID NO: 5400904 - DNA, 16 bp, Homo sapiens
ctaagaggtttttcct

SEQ ID NO: 5400905 - DNA, 18 bp, Homo sapiens
ctaagagtcctgggtaaa

SEQ ID NO: 5400906 - DNA, 19 bp, Homo sapiens
ctaagagtcctgggtaaat

SEQ ID NO: 5400907 - DNA, 22 bp, Homo sapiens
ctaagagtgctgggcattttta

SEQ ID NO: 5400908 - DNA, 16 bp, Homo sapiens
ctaagagtggaggagg

SEQ ID NO: 5400909 - DNA, 18 bp, Homo sapiens
ctaagagtggaggaggag

SEQ ID NO: 5400910 - DNA, 18 bp, Homo sapiens
ctaagagtgtcctaggag

SEQ ID NO: 5400911 - DNA, 21 bp, Homo sapiens
ctaagagttgagctctcggaa

SEQ ID NO: 5400912 - DNA, 23 bp, Homo sapiens
ctaagataaaagcttaggctgat

SEQ ID NO: 5400913 - DNA, 19 bp, Homo sapiens
ctaagatacactgcacttt

SEQ ID NO: 5400914 - DNA, 23 bp, Homo sapiens
ctaagatacactgcactttgttt

SEQ ID NO: 5400915 - DNA, 18 bp, Homo sapiens
ctaagatagaaagctgga

SEQ ID NO: 5400916 - DNA, 17 bp, Homo sapiens
ctaagatataatttaaa

SEQ ID NO: 5400917 - DNA, 18 bp, Homo sapiens
ctaagatatacttgtttt

SEQ ID NO: 5400918 - DNA, 14 bp, Homo sapiens
ctaagatcttgcct

SEQ ID NO: 5400919 - DNA, 17 bp, Homo sapiens
ctaagatgaaatgcact

SEQ ID NO: 5400920 - DNA, 13 bp, Homo sapiens
ctaagatgaaatt

SEQ ID NO: 5400921 - DNA, 20 bp, Homo sapiens
ctaagatgaagctgagcttt

SEQ ID NO: 5400922 - DNA, 15 bp, Homo sapiens
ctaagatgaatccaa

SEQ ID NO: 5400923 - DNA, 19 bp, Homo sapiens
ctaagatgaatccaaatgt

SEQ ID NO: 5400924 - DNA, 24 bp, Homo sapiens
ctaagatgaatccaaatgtgaaag

SEQ ID NO: 5400925 - DNA, 12 bp, Homo sapiens
ctaagatgacat

SEQ ID NO: 5400926 - DNA, 20 bp, Homo sapiens
ctaagatgagatttgccagc

SEQ ID NO: 5400927 - DNA, 21 bp, Homo sapiens
ctaagatgagatttgccagca

SEQ ID NO: 5400928 - DNA, 23 bp, Homo sapiens
ctaagatgattttttaaggagct

SEQ ID NO: 5400929 - DNA, 18 bp, Homo sapiens
ctaagatgtgatattcta

SEQ ID NO: 5400930 - DNA, 22 bp, Homo sapiens
ctaagatgtgcagcatttcact

SEQ ID NO: 5400931 - DNA, 20 bp, Homo sapiens
ctaagatgtgttcttatttt

SEQ ID NO: 5400932 - DNA, 14 bp, Homo sapiens
ctaagatgttatat

SEQ ID NO: 5400933 - DNA, 19 bp, Homo sapiens
ctaagattacaaatcagaa

SEQ ID NO: 5400934 - DNA, 11 bp, Homo sapiens
ctaagattcta

SEQ ID NO: 5400935 - DNA, 13 bp, Homo sapiens
ctaagattctaaa

SEQ ID NO: 5400936 - DNA, 13 bp, Homo sapiens
ctaagattctaga

SEQ ID NO: 5400937 - DNA, 12 bp, Homo sapiens
ctaagattctga

SEQ ID NO: 5400938 - DNA, 18 bp, Homo sapiens
ctaagattctgattttag

SEQ ID NO: 5400939 - DNA, 21 bp, Homo sapiens
ctaagattcttttaaattaga

SEQ ID NO: 5400940 - DNA, 14 bp, Homo sapiens
ctaagcaaaatgtg

SEQ ID NO: 5400941 - DNA, 18 bp, Homo sapiens
ctaagcaaaatgtgatat

SEQ ID NO: 5400942 - DNA, 16 bp, Homo sapiens
ctaagcaacagaaata

SEQ ID NO: 5400943 - DNA, 14 bp, Homo sapiens
ctaagcaaccacac

SEQ ID NO: 5400944 - DNA, 14 bp, Homo sapiens
ctaagcaagatgtt

SEQ ID NO: 5400945 - DNA, 15 bp, Homo sapiens
ctaagcaagatgttt

SEQ ID NO: 5400946 - DNA, 21 bp, Homo sapiens
ctaagcaagtgaactcatccc

SEQ ID NO: 5400947 - DNA, 14 bp, Homo sapiens
ctaagcaagtgagt

SEQ ID NO: 5400948 - DNA, 19 bp, Homo sapiens
ctaagcaatcactgggccc

SEQ ID NO: 5400949 - DNA, 12 bp, Homo sapiens
ctaagcaatttc

SEQ ID NO: 5400950 - DNA, 16 bp, Homo sapiens
ctaagcacttctagaa

SEQ ID NO: 5400951 - DNA, 13 bp, Homo sapiens
ctaagcagaaagt

SEQ ID NO: 5400952 - DNA, 18 bp, Homo sapiens
ctaagcagaaagtgcctt

SEQ ID NO: 5400953 - DNA, 12 bp, Homo sapiens
ctaagcagagga

SEQ ID NO: 5400954 - DNA, 13 bp, Homo sapiens
ctaagcagaggag

SEQ ID NO: 5400955 - DNA, 16 bp, Homo sapiens
ctaagcagaggagggg

SEQ ID NO: 5400956 - DNA, 19 bp, Homo sapiens
ctaagcagcatttctgaag

SEQ ID NO: 5400957 - DNA, 22 bp, Homo sapiens
ctaagcagccaggagggacctg

SEQ ID NO: 5400958 - DNA, 14 bp, Homo sapiens
ctaagcagctggga

SEQ ID NO: 5400959 - DNA, 17 bp, Homo sapiens
ctaagcagcttattgtt

SEQ ID NO: 5400960 - DNA, 17 bp, Homo sapiens
ctaagcagttttgtaaa

SEQ ID NO: 5400961 - DNA, 18 bp, Homo sapiens
ctaagcagttttgtaaat

SEQ ID NO: 5400962 - DNA, 19 bp, Homo sapiens
ctaagcagttttgtaaatg

SEQ ID NO: 5400963 - DNA, 20 bp, Homo sapiens
ctaagcagttttgtaaatgt

SEQ ID NO: 5400964 - DNA, 21 bp, Homo sapiens
ctaagcataaaagatgaaaga

SEQ ID NO: 5400965 - DNA, 15 bp, Homo sapiens
ctaagcatggcctgg

SEQ ID NO: 5400966 - DNA, 23 bp, Homo sapiens
ctaagcattagctttaattaagc

SEQ ID NO: 5400967 - DNA, 16 bp, Homo sapiens
ctaagcattgcctggc

SEQ ID NO: 5400968 - DNA, 17 bp, Homo sapiens
ctaagccaagctgtgtt

SEQ ID NO: 5400969 - DNA, 18 bp, Homo sapiens
ctaagccaagggcctctt

SEQ ID NO: 5400970 - DNA, 19 bp, Homo sapiens
ctaagccagcaccggacca

SEQ ID NO: 5400971 - DNA, 14 bp, Homo sapiens
ctaagccagcctgg

SEQ ID NO: 5400972 - DNA, 15 bp, Homo sapiens
ctaagccagctgccc

SEQ ID NO: 5400973 - DNA, 22 bp, Homo sapiens
ctaagccagctgcccccagagc

SEQ ID NO: 5400974 - DNA, 13 bp, Homo sapiens
ctaagccaggcct

SEQ ID NO: 5400975 - DNA, 18 bp, Homo sapiens
ctaagccagttttcattt

SEQ ID NO: 5400976 - DNA, 12 bp, Homo sapiens
ctaagcccagga

SEQ ID NO: 5400977 - DNA, 14 bp, Homo sapiens
ctaagcccaggatc

SEQ ID NO: 5400978 - DNA, 17 bp, Homo sapiens
ctaagccccagcaagca

SEQ ID NO: 5400979 - DNA, 12 bp, Homo sapiens
ctaagcccccag

SEQ ID NO: 5400980 - DNA, 14 bp, Homo sapiens
ctaagcccccaggg

SEQ ID NO: 5400981 - DNA, 17 bp, Homo sapiens
ctaagcccccagggcct

SEQ ID NO: 5400982 - DNA, 18 bp, Homo sapiens
ctaagcccccagggcctc

SEQ ID NO: 5400983 - DNA, 15 bp, Homo sapiens
ctaagccccgtctga

SEQ ID NO: 5400984 - DNA, 20 bp, Homo sapiens
ctaagccccgtctgacccca

SEQ ID NO: 5400985 - DNA, 15 bp, Homo sapiens
ctaagccctgttctc

SEQ ID NO: 5400986 - DNA, 11 bp, Homo sapiens
ctaagcccttt

SEQ ID NO: 5400987 - DNA, 14 bp, Homo sapiens
ctaagcctacctgc

SEQ ID NO: 5400988 - DNA, 16 bp, Homo sapiens
ctaagcctacctgctc

SEQ ID NO: 5400989 - DNA, 20 bp, Homo sapiens
ctaagcctacctgctctcca

SEQ ID NO: 5400990 - DNA, 21 bp, Homo sapiens
ctaagcctatacgtttctgtg

SEQ ID NO: 5400991 - DNA, 12 bp, Homo sapiens
ctaagcctctgc

SEQ ID NO: 5400992 - DNA, 22 bp, Homo sapiens
ctaagcctggacacagtcaggg

SEQ ID NO: 5400993 - DNA, 12 bp, Homo sapiens
ctaagcctggct

SEQ ID NO: 5400994 - DNA, 15 bp, Homo sapiens
ctaagcctgtcccca

SEQ ID NO: 5400995 - DNA, 19 bp, Homo sapiens
ctaagcctgtccccagacc

SEQ ID NO: 5400996 - DNA, 14 bp, Homo sapiens
ctaagcctgtggct

SEQ ID NO: 5400997 - DNA, 22 bp, Homo sapiens
ctaagcgcacattcatgtgggc

SEQ ID NO: 5400998 - DNA, 18 bp, Homo sapiens
ctaagcggctgtttactg

SEQ ID NO: 5400999 - DNA, 18 bp, Homo sapiens
ctaagcgtgctgacatca

SEQ ID NO: 5401000 - DNA, 19 bp, Homo sapiens
ctaagcgtgctgacatcag

SEQ ID NO: 5401001 - DNA, 15 bp, Homo sapiens
ctaagctaaccccct

SEQ ID NO: 5401002 - DNA, 22 bp, Homo sapiens
ctaagctattcagtaataactc

SEQ ID NO: 5401003 - DNA, 19 bp, Homo sapiens
ctaagctcaaatgtatatt

SEQ ID NO: 5401004 - DNA, 15 bp, Homo sapiens
ctaagctcagtgctc

SEQ ID NO: 5401005 - DNA, 13 bp, Homo sapiens
ctaagctccagcc

SEQ ID NO: 5401006 - DNA, 20 bp, Homo sapiens
ctaagctctctgggcctggg

SEQ ID NO: 5401007 - DNA, 15 bp, Homo sapiens
ctaagctctttgaga

SEQ ID NO: 5401008 - DNA, 13 bp, Homo sapiens
ctaagctgcagct

SEQ ID NO: 5401009 - DNA, 16 bp, Homo sapiens
ctaagctgcagcttcc

SEQ ID NO: 5401010 - DNA, 11 bp, Homo sapiens
ctaagctgcca

SEQ ID NO: 5401011 - DNA, 13 bp, Homo sapiens
ctaagctggctct

SEQ ID NO: 5401012 - DNA, 18 bp, Homo sapiens
ctaagctggctctgtttg

SEQ ID NO: 5401013 - DNA, 12 bp, Homo sapiens
ctaagctgggga

SEQ ID NO: 5401014 - DNA, 12 bp, Homo sapiens
ctaagctgtgtg

SEQ ID NO: 5401015 - DNA, 16 bp, Homo sapiens
ctaagctgtgtgcagg

SEQ ID NO: 5401016 - DNA, 18 bp, Homo sapiens
ctaagctgttggaagggg

SEQ ID NO: 5401017 - DNA, 11 bp, Homo sapiens
ctaagctgttt

SEQ ID NO: 5401018 - DNA, 16 bp, Homo sapiens
ctaagctgtttgccaa

SEQ ID NO: 5401019 - DNA, 15 bp, Homo sapiens
ctaagcttaaaaaaa

SEQ ID NO: 5401020 - DNA, 12 bp, Homo sapiens
ctaagcttattt

SEQ ID NO: 5401021 - DNA, 13 bp, Homo sapiens
ctaagcttatttc

SEQ ID NO: 5401022 - DNA, 15 bp, Homo sapiens
ctaagcttatttcta

SEQ ID NO: 5401023 - DNA, 19 bp, Homo sapiens
ctaagcttctagaggctca

SEQ ID NO: 5401024 - DNA, 20 bp, Homo sapiens
ctaagctttgccagctgctg

SEQ ID NO: 5401025 - DNA, 12 bp, Homo sapiens
ctaaggaaaatt

SEQ ID NO: 5401026 - DNA, 15 bp, Homo sapiens
ctaaggaaaattaat

SEQ ID NO: 5401027 - DNA, 18 bp, Homo sapiens
ctaaggaaactgctttat

SEQ ID NO: 5401028 - DNA, 10 bp, Homo sapiens
ctaaggaaat

SEQ ID NO: 5401029 - DNA, 13 bp, Homo sapiens
ctaaggaaatatt

SEQ ID NO: 5401030 - DNA, 16 bp, Homo sapiens
ctaaggaacaatgccg

SEQ ID NO: 5401031 - DNA, 14 bp, Homo sapiens
ctaaggaaccaaca

SEQ ID NO: 5401032 - DNA, 15 bp, Homo sapiens
ctaaggaaccttcct

SEQ ID NO: 5401033 - DNA, 20 bp, Homo sapiens
ctaaggaagtatcagcacta

SEQ ID NO: 5401034 - DNA, 22 bp, Homo sapiens
ctaaggaatatccagtcaaaga

SEQ ID NO: 5401035 - DNA, 13 bp, Homo sapiens
ctaaggacaaatt

SEQ ID NO: 5401036 - DNA, 17 bp, Homo sapiens
ctaaggacaaattagca

SEQ ID NO: 5401037 - DNA, 23 bp, Homo sapiens
ctaaggacaaattagcatgcaag

SEQ ID NO: 5401038 - DNA, 11 bp, Homo sapiens
ctaaggacaca

SEQ ID NO: 5401039 - DNA, 12 bp, Homo sapiens
ctaaggacacac

SEQ ID NO: 5401040 - DNA, 17 bp, Homo sapiens
ctaaggacatttcccag

SEQ ID NO: 5401041 - DNA, 19 bp, Homo sapiens
ctaaggacatttcccaggg

SEQ ID NO: 5401042 - DNA, 19 bp, Homo sapiens
ctaaggacatttggtttta

SEQ ID NO: 5401043 - DNA, 22 bp, Homo sapiens
ctaaggacccaaatttccctgg

SEQ ID NO: 5401044 - DNA, 11 bp, Homo sapiens
ctaaggacctt

SEQ ID NO: 5401045 - DNA, 11 bp, Homo sapiens
ctaaggacttg

SEQ ID NO: 5401046 - DNA, 16 bp, Homo sapiens
ctaaggacttgttaga

SEQ ID NO: 5401047 - DNA, 17 bp, Homo sapiens
ctaaggacttgttagat

SEQ ID NO: 5401048 - DNA, 23 bp, Homo sapiens
ctaaggagcactagaatgagaaa

SEQ ID NO: 5401049 - DNA, 20 bp, Homo sapiens
ctaaggagcgctagtgcctt

SEQ ID NO: 5401050 - DNA, 23 bp, Homo sapiens
ctaaggagcgctagtgccttgcc

SEQ ID NO: 5401051 - DNA, 17 bp, Homo sapiens
ctaaggaggggaaaaaa

SEQ ID NO: 5401052 - DNA, 21 bp, Homo sapiens
ctaaggaggggaaaaaaatgt

SEQ ID NO: 5401053 - DNA, 22 bp, Homo sapiens
ctaaggaggggaaaaaaatgtt

SEQ ID NO: 5401054 - DNA, 23 bp, Homo sapiens
ctaaggaggggaaaaaaatgttg

SEQ ID NO: 5401055 - DNA, 17 bp, Homo sapiens
ctaaggatagggaaagg

SEQ ID NO: 5401056 - DNA, 17 bp, Homo sapiens
ctaaggatctctcagga

SEQ ID NO: 5401057 - DNA, 15 bp, Homo sapiens
ctaaggcagacagga

SEQ ID NO: 5401058 - DNA, 11 bp, Homo sapiens
ctaaggcagct

SEQ ID NO: 5401059 - DNA, 22 bp, Homo sapiens
ctaaggccaaggcctcaggaga

SEQ ID NO: 5401060 - DNA, 15 bp, Homo sapiens
ctaaggccaatgggc

SEQ ID NO: 5401061 - DNA, 17 bp, Homo sapiens
ctaaggccaatgggcta

SEQ ID NO: 5401062 - DNA, 23 bp, Homo sapiens
ctaaggccatggcatcccttttt

SEQ ID NO: 5401063 - DNA, 12 bp, Homo sapiens
ctaaggcccagc

SEQ ID NO: 5401064 - DNA, 13 bp, Homo sapiens
ctaaggcccagct

SEQ ID NO: 5401065 - DNA, 15 bp, Homo sapiens
ctaaggcccagctgc

SEQ ID NO: 5401066 - DNA, 14 bp, Homo sapiens
ctaaggcctaggat

SEQ ID NO: 5401067 - DNA, 22 bp, Homo sapiens
ctaaggcctaggattctaaaat

SEQ ID NO: 5401068 - DNA, 20 bp, Homo sapiens
ctaaggcctcttgctggtgc

SEQ ID NO: 5401069 - DNA, 17 bp, Homo sapiens
ctaaggccttccctgtc

SEQ ID NO: 5401070 - DNA, 18 bp, Homo sapiens
ctaaggcgtggagctgcc

SEQ ID NO: 5401071 - DNA, 15 bp, Homo sapiens
ctaattttaaataat

SEQ ID NO: 5401072 - DNA, 17 bp, Homo sapiens
ctaattttaagttattt

SEQ ID NO: 5401073 - DNA, 20 bp, Homo sapiens
ctaattttacatgtttataa

SEQ ID NO: 5401074 - DNA, 15 bp, Homo sapiens
ctaattttagtattc

SEQ ID NO: 5401075 - DNA, 15 bp, Homo sapiens
ctaattttatttcta

SEQ ID NO: 5401076 - DNA, 21 bp, Homo sapiens
ctaattttccataagctattt

SEQ ID NO: 5401077 - DNA, 12 bp, Homo sapiens
ctaattttctat

SEQ ID NO: 5401078 - DNA, 19 bp, Homo sapiens
ctaattttctcaaaagcat

SEQ ID NO: 5401079 - DNA, 14 bp, Homo sapiens
ctaattttgtacat

SEQ ID NO: 5401080 - DNA, 18 bp, Homo sapiens
ctaattttgtacatactg

SEQ ID NO: 5401081 - DNA, 22 bp, Homo sapiens
ctaattttgtacatactgtatt

SEQ ID NO: 5401082 - DNA, 18 bp, Homo sapiens
ctaattttgtatttttag

SEQ ID NO: 5401083 - DNA, 19 bp, Homo sapiens
ctaattttgtgctctttcc

SEQ ID NO: 5401084 - DNA, 23 bp, Homo sapiens
ctaattttgtgctctttcctgcc

SEQ ID NO: 5401085 - DNA, 16 bp, Homo sapiens
ctaattttgttttaaa

SEQ ID NO: 5401086 - DNA, 20 bp, Homo sapiens
ctaatttttattaatttgta

SEQ ID NO: 5401087 - DNA, 12 bp, Homo sapiens
ctaatttttcca

SEQ ID NO: 5401088 - DNA, 21 bp, Homo sapiens
ctaatttttgcttaacattag

SEQ ID NO: 5401089 - DNA, 22 bp, Homo sapiens
ctaatttttggagaaatgtcat

SEQ ID NO: 5401090 - DNA, 11 bp, Homo sapiens
ctaatttttgt

SEQ ID NO: 5401091 - DNA, 15 bp, Homo sapiens
ctaatttttgtattt

SEQ ID NO: 5401092 - DNA, 16 bp, Homo sapiens
ctaatttttgtatttt

SEQ ID NO: 5401093 - DNA, 14 bp, Homo sapiens
ctaattttttgttg

SEQ ID NO: 5401094 - DNA, 16 bp, Homo sapiens
ctaattttttgttgtt

SEQ ID NO: 5401095 - DNA, 13 bp, Homo sapiens
ctaatttttttgt

SEQ ID NO: 5401096 - DNA, 21 bp, Homo sapiens
ctaatttttttgtattttagc

SEQ ID NO: 5401097 - DNA, 17 bp, Homo sapiens
ctacaaaaaaccaggat

SEQ ID NO: 5401098 - DNA, 16 bp, Homo sapiens
ctacaaaaaataaaat

SEQ ID NO: 5401099 - DNA, 18 bp, Homo sapiens
ctacaaaaaataaaataa

SEQ ID NO: 5401100 - DNA, 15 bp, Homo sapiens
ctacaaaaagaagag

SEQ ID NO: 5401101 - DNA, 16 bp, Homo sapiens
ctacaaaaattaactg

SEQ ID NO: 5401102 - DNA, 13 bp, Homo sapiens
ctacaaaacatta

SEQ ID NO: 5401103 - DNA, 20 bp, Homo sapiens
ctacaaaacctgatgttaaa

SEQ ID NO: 5401104 - DNA, 18 bp, Homo sapiens
ctacaaaacgcgcagatg

SEQ ID NO: 5401105 - DNA, 20 bp, Homo sapiens
ctacaaaacgtatttatctg

SEQ ID NO: 5401106 - DNA, 15 bp, Homo sapiens
ctacaaaagaagtgt

SEQ ID NO: 5401107 - DNA, 13 bp, Homo sapiens
ctacaaaagcaaa

SEQ ID NO: 5401108 - DNA, 20 bp, Homo sapiens
ctacaaaagcaaagtgaagt

SEQ ID NO: 5401109 - DNA, 13 bp, Homo sapiens
ctacaaaagtgaa

SEQ ID NO: 5401110 - DNA, 11 bp, Homo sapiens
ctacaaaatgg

SEQ ID NO: 5401111 - DNA, 13 bp, Homo sapiens
ctacaaaatggag

SEQ ID NO: 5401112 - DNA, 15 bp, Homo sapiens
ctacaaaatgtgtgc

SEQ ID NO: 5401113 - DNA, 21 bp, Homo sapiens
ctacaaacaaaagcagccctc

SEQ ID NO: 5401114 - DNA, 13 bp, Homo sapiens
ctacaaacaaaat

SEQ ID NO: 5401115 - DNA, 17 bp, Homo sapiens
ctacaaacaaaatttct

SEQ ID NO: 5401116 - DNA, 15 bp, Homo sapiens
ctacaaaccaggagc

SEQ ID NO: 5401117 - DNA, 16 bp, Homo sapiens
ctacaaaccaggagca

SEQ ID NO: 5401118 - DNA, 16 bp, Homo sapiens
ctacaaacttttaaga

SEQ ID NO: 5401119 - DNA, 17 bp, Homo sapiens
ctacaaacttttaagat

SEQ ID NO: 5401120 - DNA, 20 bp, Homo sapiens
ctacaaacttttaagatttc

SEQ ID NO: 5401121 - DNA, 20 bp, Homo sapiens
ctacaaacttttataaatgt

SEQ ID NO: 5401122 - DNA, 22 bp, Homo sapiens
ctacaaacttttataaatgttt

SEQ ID NO: 5401123 - DNA, 13 bp, Homo sapiens
ctacaaagaaaaa

SEQ ID NO: 5401124 - DNA, 17 bp, Homo sapiens
ctacaaagaaaaattaa

SEQ ID NO: 5401125 - DNA, 19 bp, Homo sapiens
ctacaaagagatgcttgga

SEQ ID NO: 5401126 - DNA, 12 bp, Homo sapiens
ctacaaagcaga

SEQ ID NO: 5401127 - DNA, 24 bp, Homo sapiens
ctacaaaggaggacaagaccctct

SEQ ID NO: 5401128 - DNA, 16 bp, Homo sapiens
ctacaaagtaaaatga

SEQ ID NO: 5401129 - DNA, 10 bp, Homo sapiens
ctacaaatca

SEQ ID NO: 5401130 - DNA, 14 bp, Homo sapiens
ctacaaatcagtaa

SEQ ID NO: 5401131 - DNA, 15 bp, Homo sapiens
ctacaaatcagtaat

SEQ ID NO: 5401132 - DNA, 16 bp, Homo sapiens
ctacaaatgaaaacaa

SEQ ID NO: 5401133 - DNA, 12 bp, Homo sapiens
ctacaaatggat

SEQ ID NO: 5401134 - DNA, 13 bp, Homo sapiens
ctacaaatttatg

SEQ ID NO: 5401135 - DNA, 15 bp, Homo sapiens
ctacaaatttatgca

SEQ ID NO: 5401136 - DNA, 19 bp, Homo sapiens
ctacaaatttatgcatttc

SEQ ID NO: 5401137 - DNA, 16 bp, Homo sapiens
ctacaacaagagttta

SEQ ID NO: 5401138 - DNA, 14 bp, Homo sapiens
ctacaacattagaa

SEQ ID NO: 5401139 - DNA, 18 bp, Homo sapiens
ctacaaccaagctctctg

SEQ ID NO: 5401140 - DNA, 15 bp, Homo sapiens
ctacaaccaatggaa

SEQ ID NO: 5401141 - DNA, 19 bp, Homo sapiens
ctacaaccagagcccccca

SEQ ID NO: 5401142 - DNA, 15 bp, Homo sapiens
ctacaaccaggtctt

SEQ ID NO: 5401143 - DNA, 20 bp, Homo sapiens
ctacaaccccagcctcctga

SEQ ID NO: 5401144 - DNA, 20 bp, Homo sapiens
ctacaacctccaccttccag

SEQ ID NO: 5401145 - DNA, 16 bp, Homo sapiens
ctacaacctccgcctc

SEQ ID NO: 5401146 - DNA, 14 bp, Homo sapiens
ctacaactgagtcc

SEQ ID NO: 5401147 - DNA, 23 bp, Homo sapiens
ctacaactgatcatttgcagctg

SEQ ID NO: 5401148 - DNA, 16 bp, Homo sapiens
ctacaacttcagcagt

SEQ ID NO: 5401149 - DNA, 18 bp, Homo sapiens
ctacaacttttgttttct

SEQ ID NO: 5401150 - DNA, 15 bp, Homo sapiens
ctacaagagggcaaa

SEQ ID NO: 5401151 - DNA, 16 bp, Homo sapiens
ctacaagagggcaaag

SEQ ID NO: 5401152 - DNA, 18 bp, Homo sapiens
ctacaagagggcaaagct

SEQ ID NO: 5401153 - DNA, 20 bp, Homo sapiens
ctacaagagggcaaagctga

SEQ ID NO: 5401154 - DNA, 13 bp, Homo sapiens
ctacaagatttcc

SEQ ID NO: 5401155 - DNA, 19 bp, Homo sapiens
ctacaagatttccttaaaa

SEQ ID NO: 5401156 - DNA, 19 bp, Homo sapiens
ctacaagctaaaattagat

SEQ ID NO: 5401157 - DNA, 15 bp, Homo sapiens
ctacaaggacaatgc

SEQ ID NO: 5401158 - DNA, 18 bp, Homo sapiens
ctacaagtattctgcctt

SEQ ID NO: 5401159 - DNA, 13 bp, Homo sapiens
ctacaataaatgc

SEQ ID NO: 5401160 - DNA, 14 bp, Homo sapiens
ctacaataaatgct

SEQ ID NO: 5401161 - DNA, 16 bp, Homo sapiens
ctacaataaatgctga

SEQ ID NO: 5401162 - DNA, 17 bp, Homo sapiens
ctacaataaatgctgaa

SEQ ID NO: 5401163 - DNA, 20 bp, Homo sapiens
ctacaataaatgctgaatga

SEQ ID NO: 5401164 - DNA, 19 bp, Homo sapiens
ctacaatacatatatctac

SEQ ID NO: 5401165 - DNA, 15 bp, Homo sapiens
ctacaatacatctga

SEQ ID NO: 5401166 - DNA, 21 bp, Homo sapiens
ctacaatatcattttcctggg

SEQ ID NO: 5401167 - DNA, 18 bp, Homo sapiens
ctacaatattttattcta

SEQ ID NO: 5401168 - DNA, 21 bp, Homo sapiens
ctacaatcagttgactttaag

SEQ ID NO: 5401169 - DNA, 13 bp, Homo sapiens
ctacaatctcttt

SEQ ID NO: 5401170 - DNA, 21 bp, Homo sapiens
ctacaatcttggagctgcttg

SEQ ID NO: 5401171 - DNA, 16 bp, Homo sapiens
ctacaatgatggtaaa

SEQ ID NO: 5401172 - DNA, 20 bp, Homo sapiens
ctacaatgctcatgtccctg

SEQ ID NO: 5401173 - DNA, 21 bp, Homo sapiens
ctacaattaatagtttgtcta

SEQ ID NO: 5401174 - DNA, 16 bp, Homo sapiens
ctacaattcattgtgt

SEQ ID NO: 5401175 - DNA, 13 bp, Homo sapiens
ctacaattcctct

SEQ ID NO: 5401176 - DNA, 18 bp, Homo sapiens
ctacaattcctctgataa

SEQ ID NO: 5401177 - DNA, 15 bp, Homo sapiens
ctacaattctgcaga

SEQ ID NO: 5401178 - DNA, 17 bp, Homo sapiens
ctacaattctgcagaaa

SEQ ID NO: 5401179 - DNA, 18 bp, Homo sapiens
ctacaattgtaaactagt

SEQ ID NO: 5401180 - DNA, 17 bp, Homo sapiens
ctacaatttaaacacca

SEQ ID NO: 5401181 - DNA, 16 bp, Homo sapiens
ctacaatttaaagcaa

SEQ ID NO: 5401182 - DNA, 21 bp, Homo sapiens
ctacaatttgttaattcctat

SEQ ID NO: 5401183 - DNA, 16 bp, Homo sapiens
ctacaatttgtttttg

SEQ ID NO: 5401184 - DNA, 21 bp, Homo sapiens
ctacaatttgtttttgcattt

SEQ ID NO: 5401185 - DNA, 20 bp, Homo sapiens
ctacaattttctcccaggaa

SEQ ID NO: 5401186 - DNA, 23 bp, Homo sapiens
ctacaattttctcccaggaagct

SEQ ID NO: 5401187 - DNA, 21 bp, Homo sapiens
ctacacaaggacagaaccctc

SEQ ID NO: 5401188 - DNA, 15 bp, Homo sapiens
ctacacaatacagta

SEQ ID NO: 5401189 - DNA, 11 bp, Homo sapiens
ctacacacaca

SEQ ID NO: 5401190 - DNA, 13 bp, Homo sapiens
ctacacacacaca

SEQ ID NO: 5401191 - DNA, 14 bp, Homo sapiens
ctacacacacacac

SEQ ID NO: 5401192 - DNA, 14 bp, Homo sapiens
ctacacacacactc

SEQ ID NO: 5401193 - DNA, 15 bp, Homo sapiens
ctacacacacactcc

SEQ ID NO: 5401194 - DNA, 19 bp, Homo sapiens
ctacacacacactccctgc

SEQ ID NO: 5401195 - DNA, 14 bp, Homo sapiens
ctacacacacccag

SEQ ID NO: 5401196 - DNA, 20 bp, Homo sapiens
ctacacacagaccgcgcccc

SEQ ID NO: 5401197 - DNA, 18 bp, Homo sapiens
ctacacacctaacttatg

SEQ ID NO: 5401198 - DNA, 14 bp, Homo sapiens
ctacacactcagcc

SEQ ID NO: 5401199 - DNA, 13 bp, Homo sapiens
ctacacactgcat

SEQ ID NO: 5401200 - DNA, 18 bp, Homo sapiens
ctacacagcacaccagcc

SEQ ID NO: 5401201 - DNA, 19 bp, Homo sapiens
ctacacagcagctgttcaa

SEQ ID NO: 5401202 - DNA, 13 bp, Homo sapiens
ctacacagcctgg

SEQ ID NO: 5401203 - DNA, 15 bp, Homo sapiens
ctacacagctcagca

SEQ ID NO: 5401204 - DNA, 15 bp, Homo sapiens
ctacacaggacaggg

SEQ ID NO: 5401205 - DNA, 23 bp, Homo sapiens
ctacacaggagtcttcagaccca

SEQ ID NO: 5401206 - DNA, 14 bp, Homo sapiens
ctacacaggcagga

SEQ ID NO: 5401207 - DNA, 14 bp, Homo sapiens
ctacacagggatgt

SEQ ID NO: 5401208 - DNA, 21 bp, Homo sapiens
ctacacaggggaaaagaggag

SEQ ID NO: 5401209 - DNA, 15 bp, Homo sapiens
ctacacaggggccct

SEQ ID NO: 5401210 - DNA, 18 bp, Homo sapiens
ctacacatacagaaagaa

SEQ ID NO: 5401211 - DNA, 20 bp, Homo sapiens
ctacacatacagaaagaagc

SEQ ID NO: 5401212 - DNA, 22 bp, Homo sapiens
ctacacatataaacacagtaag

SEQ ID NO: 5401213 - DNA, 12 bp, Homo sapiens
ctacacatatat

SEQ ID NO: 5401214 - DNA, 15 bp, Homo sapiens
ctacacatcagggct

SEQ ID NO: 5401215 - DNA, 19 bp, Homo sapiens
ctacacatttcatctaatt

SEQ ID NO: 5401216 - DNA, 17 bp, Homo sapiens
ctacacatttttaaatt

SEQ ID NO: 5401217 - DNA, 19 bp, Homo sapiens
ctacacatttttaaattgt

SEQ ID NO: 5401218 - DNA, 14 bp, Homo sapiens
ctacaccaatgaaa

SEQ ID NO: 5401219 - DNA, 14 bp, Homo sapiens
ctacaccacacaca

SEQ ID NO: 5401220 - DNA, 19 bp, Homo sapiens
ctacaccacacacaacagc

SEQ ID NO: 5401221 - DNA, 21 bp, Homo sapiens
ctacaccacacacaacagcca

SEQ ID NO: 5401222 - DNA, 14 bp, Homo sapiens
ctacacccaagcct

SEQ ID NO: 5401223 - DNA, 13 bp, Homo sapiens
ctacacccagcaa

SEQ ID NO: 5401224 - DNA, 16 bp, Homo sapiens
ctacacccagcaatag

SEQ ID NO: 5401225 - DNA, 17 bp, Homo sapiens
ctacacccctgtgctcc

SEQ ID NO: 5401226 - DNA, 18 bp, Homo sapiens
ctacaccctctgccccag

SEQ ID NO: 5401227 - DNA, 16 bp, Homo sapiens
ctacacctattatccc

SEQ ID NO: 5401228 - DNA, 18 bp, Homo sapiens
ctacacctattatcccag

SEQ ID NO: 5401229 - DNA, 14 bp, Homo sapiens
ctacacctctgggc

SEQ ID NO: 5401230 - DNA, 19 bp, Homo sapiens
ctacacctctgggccctgc

SEQ ID NO: 5401231 - DNA, 13 bp, Homo sapiens
ctacacctgaggc

SEQ ID NO: 5401232 - DNA, 11 bp, Homo sapiens
ctacacctgga

SEQ ID NO: 5401233 - DNA, 19 bp, Homo sapiens
ctacacctgttgcacctca

SEQ ID NO: 5401234 - DNA, 15 bp, Homo sapiens
ctacacctttctcct

SEQ ID NO: 5401235 - DNA, 21 bp, Homo sapiens
ctacacgatccgcaacccatg

SEQ ID NO: 5401236 - DNA, 15 bp, Homo sapiens
ctacacgcacccaat

SEQ ID NO: 5401237 - DNA, 14 bp, Homo sapiens
ctacactaagagag

SEQ ID NO: 5401238 - DNA, 18 bp, Homo sapiens
ctacactccagcctgagc

SEQ ID NO: 5401239 - DNA, 16 bp, Homo sapiens
ctacactcgtccccct

SEQ ID NO: 5401240 - DNA, 12 bp, Homo sapiens
ctacactctcct

SEQ ID NO: 5401241 - DNA, 15 bp, Homo sapiens
ctacactctcctggg

SEQ ID NO: 5401242 - DNA, 17 bp, Homo sapiens
ctacactctcctgggcc

SEQ ID NO: 5401243 - DNA, 11 bp, Homo sapiens
ctacactgaaa

SEQ ID NO: 5401244 - DNA, 15 bp, Homo sapiens
ctacactgccagccg

SEQ ID NO: 5401245 - DNA, 11 bp, Homo sapiens
ctacactgcct

SEQ ID NO: 5401246 - DNA, 18 bp, Homo sapiens
ctacactgtgctgagtct

SEQ ID NO: 5401247 - DNA, 16 bp, Homo sapiens
ctacacttacaagtaa

SEQ ID NO: 5401248 - DNA, 16 bp, Homo sapiens
ctacactttatacttg

SEQ ID NO: 5401249 - DNA, 17 bp, Homo sapiens
ctacactttgctagtga

SEQ ID NO: 5401250 - DNA, 15 bp, Homo sapiens
ctacagaaaaacctt

SEQ ID NO: 5401251 - DNA, 17 bp, Homo sapiens
ctacagaaaaaccttgg

SEQ ID NO: 5401252 - DNA, 15 bp, Homo sapiens
ctacccgggaagggg

SEQ ID NO: 5401253 - DNA, 20 bp, Homo sapiens
ctacccgggaagggggctgg

SEQ ID NO: 5401254 - DNA, 15 bp, Homo sapiens
ctacccgtgcctggg

SEQ ID NO: 5401255 - DNA, 23 bp, Homo sapiens
ctacccgtgcctgggcccctccc

SEQ ID NO: 5401256 - DNA, 15 bp, Homo sapiens
ctaccctaaccaagt

SEQ ID NO: 5401257 - DNA, 16 bp, Homo sapiens
ctaccctaaccaagtt

SEQ ID NO: 5401258 - DNA, 16 bp, Homo sapiens
ctaccctacacctctg

SEQ ID NO: 5401259 - DNA, 14 bp, Homo sapiens
ctaccctcaaagta

SEQ ID NO: 5401260 - DNA, 11 bp, Homo sapiens
ctaccctcacc

SEQ ID NO: 5401261 - DNA, 12 bp, Homo sapiens
ctaccctcagcc

SEQ ID NO: 5401262 - DNA, 13 bp, Homo sapiens
ctaccctcagcct

SEQ ID NO: 5401263 - DNA, 15 bp, Homo sapiens
ctaccctcagcctcc

SEQ ID NO: 5401264 - DNA, 19 bp, Homo sapiens
ctaccctcagcctccaatg

SEQ ID NO: 5401265 - DNA, 20 bp, Homo sapiens
ctaccctcagcctccaatgc

SEQ ID NO: 5401266 - DNA, 15 bp, Homo sapiens
ctaccctcagtgagc

SEQ ID NO: 5401267 - DNA, 17 bp, Homo sapiens
ctaccctccatgtgaga

SEQ ID NO: 5401268 - DNA, 13 bp, Homo sapiens
ctaccctcccacc

SEQ ID NO: 5401269 - DNA, 15 bp, Homo sapiens
ctaccctcccaccag

SEQ ID NO: 5401270 - DNA, 16 bp, Homo sapiens
ctaccctcccaccccc

SEQ ID NO: 5401271 - DNA, 14 bp, Homo sapiens
ctaccctcccccag

SEQ ID NO: 5401272 - DNA, 14 bp, Homo sapiens
ctaccctccctgct

SEQ ID NO: 5401273 - DNA, 18 bp, Homo sapiens
ctaccctccctgctgtcc

SEQ ID NO: 5401274 - DNA, 15 bp, Homo sapiens
ctaccctcctgctga

SEQ ID NO: 5401275 - DNA, 14 bp, Homo sapiens
ctaccctccttcca

SEQ ID NO: 5401276 - DNA, 17 bp, Homo sapiens
ctaccctcgggcccacc

SEQ ID NO: 5401277 - DNA, 22 bp, Homo sapiens
ctaccctcgggcccacctggcc

SEQ ID NO: 5401278 - DNA, 23 bp, Homo sapiens
ctaccctcgggcccacctggcca

SEQ ID NO: 5401279 - DNA, 14 bp, Homo sapiens
ctaccctctagaga

SEQ ID NO: 5401280 - DNA, 22 bp, Homo sapiens
ctaccctcttctcagctccact

SEQ ID NO: 5401281 - DNA, 21 bp, Homo sapiens
ctaccctgaaacccagtaatt

SEQ ID NO: 5401282 - DNA, 12 bp, Homo sapiens
ctaccctgagct

SEQ ID NO: 5401283 - DNA, 18 bp, Homo sapiens
ctaccctgagctgaggca

SEQ ID NO: 5401284 - DNA, 14 bp, Homo sapiens
ctaccctgatcacc

SEQ ID NO: 5401285 - DNA, 14 bp, Homo sapiens
ctaccctgcacatt

SEQ ID NO: 5401286 - DNA, 23 bp, Homo sapiens
ctaccctgctccctgctttggct

SEQ ID NO: 5401287 - DNA, 21 bp, Homo sapiens
ctaccctggcagggacctgag

SEQ ID NO: 5401288 - DNA, 15 bp, Homo sapiens
ctaccctgggctctg

SEQ ID NO: 5401289 - DNA, 19 bp, Homo sapiens
ctaccctgggctctggtct

SEQ ID NO: 5401290 - DNA, 14 bp, Homo sapiens
ctaccctgggtcct

SEQ ID NO: 5401291 - DNA, 13 bp, Homo sapiens
ctaccctgtcctt

SEQ ID NO: 5401292 - DNA, 16 bp, Homo sapiens
ctaccctgtcctttgc

SEQ ID NO: 5401293 - DNA, 17 bp, Homo sapiens
ctaccctgtgctaagca

SEQ ID NO: 5401294 - DNA, 19 bp, Homo sapiens
ctaccctgtgctaagcacg

SEQ ID NO: 5401295 - DNA, 13 bp, Homo sapiens
ctacccttaatta

SEQ ID NO: 5401296 - DNA, 14 bp, Homo sapiens
ctacccttctcctt

SEQ ID NO: 5401297 - DNA, 15 bp, Homo sapiens
ctacccttgccaagg

SEQ ID NO: 5401298 - DNA, 20 bp, Homo sapiens
ctacccttgccaaggccgcc

SEQ ID NO: 5401299 - DNA, 22 bp, Homo sapiens
ctacccttgtaccccatccctt

SEQ ID NO: 5401300 - DNA, 13 bp, Homo sapiens
ctaccctttccca

SEQ ID NO: 5401301 - DNA, 15 bp, Homo sapiens
ctaccctttcccaaa

SEQ ID NO: 5401302 - DNA, 18 bp, Homo sapiens
ctaccctttttctccagc

SEQ ID NO: 5401303 - DNA, 18 bp, Homo sapiens
ctaccgaaaccttgcctt

SEQ ID NO: 5401304 - DNA, 17 bp, Homo sapiens
ctaccgaatgtgtcttt

SEQ ID NO: 5401305 - DNA, 21 bp, Homo sapiens
ctaccgacccagggttcccgc

SEQ ID NO: 5401306 - DNA, 23 bp, Homo sapiens
ctaccgagtctcttctccactgg

SEQ ID NO: 5401307 - DNA, 17 bp, Homo sapiens
ctaccgatggtcccagg

SEQ ID NO: 5401308 - DNA, 20 bp, Homo sapiens
ctaccgatttcagcacatgc

SEQ ID NO: 5401309 - DNA, 18 bp, Homo sapiens
ctaccgcaggcccggact

SEQ ID NO: 5401310 - DNA, 14 bp, Homo sapiens
ctaccgcatggcag

SEQ ID NO: 5401311 - DNA, 21 bp, Homo sapiens
ctaccgcatggcagctgggcc

SEQ ID NO: 5401312 - DNA, 22 bp, Homo sapiens
ctaccgcatggcagctgggccc

SEQ ID NO: 5401313 - DNA, 12 bp, Homo sapiens
ctaccgccctgg

SEQ ID NO: 5401314 - DNA, 17 bp, Homo sapiens
ctaccgccctgggctgg

SEQ ID NO: 5401315 - DNA, 18 bp, Homo sapiens
ctaccgccctgggctgga

SEQ ID NO: 5401316 - DNA, 15 bp, Homo sapiens
ctaccgctcttggga

SEQ ID NO: 5401317 - DNA, 19 bp, Homo sapiens
ctaccgggttctcctgatt

SEQ ID NO: 5401318 - DNA, 22 bp, Homo sapiens
ctaccgggttctcctgatttga

SEQ ID NO: 5401319 - DNA, 18 bp, Homo sapiens
ctaccgtaattgctttgt

SEQ ID NO: 5401320 - DNA, 22 bp, Homo sapiens
ctaccgtaattgctttgtgcct

SEQ ID NO: 5401321 - DNA, 14 bp, Homo sapiens
ctaccgtatttcag

SEQ ID NO: 5401322 - DNA, 16 bp, Homo sapiens
ctaccgtcttttcctg

SEQ ID NO: 5401323 - DNA, 14 bp, Homo sapiens
ctaccgtgccagca

SEQ ID NO: 5401324 - DNA, 21 bp, Homo sapiens
ctaccgtggatctccttccct

SEQ ID NO: 5401325 - DNA, 21 bp, Homo sapiens
ctacctaactccctaggcctg

SEQ ID NO: 5401326 - DNA, 21 bp, Homo sapiens
ctacctacatgctgaaaaata

SEQ ID NO: 5401327 - DNA, 20 bp, Homo sapiens
ctacctagaagtaagaagag

SEQ ID NO: 5401328 - DNA, 18 bp, Homo sapiens
ctacctataaatggactt

SEQ ID NO: 5401329 - DNA, 22 bp, Homo sapiens
ctacctataaatggacttgctt

SEQ ID NO: 5401330 - DNA, 16 bp, Homo sapiens
ctacctataggaaagt

SEQ ID NO: 5401331 - DNA, 21 bp, Homo sapiens
ctacctatgtacttgaaaata

SEQ ID NO: 5401332 - DNA, 14 bp, Homo sapiens
ctacctcaaaacac

SEQ ID NO: 5401333 - DNA, 15 bp, Homo sapiens
ctacctcaacctgta

SEQ ID NO: 5401334 - DNA, 21 bp, Homo sapiens
ctacctcaacctgtaaattat

SEQ ID NO: 5401335 - DNA, 17 bp, Homo sapiens
ctacctcaagttcttgg

SEQ ID NO: 5401336 - DNA, 18 bp, Homo sapiens
ctacctcaagttcttgga

SEQ ID NO: 5401337 - DNA, 22 bp, Homo sapiens
ctacctcaagttcttggaccag

SEQ ID NO: 5401338 - DNA, 13 bp, Homo sapiens
ctacctcactctc

SEQ ID NO: 5401339 - DNA, 11 bp, Homo sapiens
ctacctcagcc

SEQ ID NO: 5401340 - DNA, 15 bp, Homo sapiens
ctacctcagcctaga

SEQ ID NO: 5401341 - DNA, 19 bp, Homo sapiens
ctacctcagcctcctgggt

SEQ ID NO: 5401342 - DNA, 20 bp, Homo sapiens
ctacctcaggcaggaagggc

SEQ ID NO: 5401343 - DNA, 12 bp, Homo sapiens
ctacctcaggtt

SEQ ID NO: 5401344 - DNA, 13 bp, Homo sapiens
ctacctcaggttg

SEQ ID NO: 5401345 - DNA, 17 bp, Homo sapiens
ctacctcaggttgctgg

SEQ ID NO: 5401346 - DNA, 18 bp, Homo sapiens
ctacctcaggttgctggt

SEQ ID NO: 5401347 - DNA, 20 bp, Homo sapiens
ctacctcaggttgctggttg

SEQ ID NO: 5401348 - DNA, 13 bp, Homo sapiens
ctacctcagtgct

SEQ ID NO: 5401349 - DNA, 22 bp, Homo sapiens
ctacctcagtgctcctggaaac

SEQ ID NO: 5401350 - DNA, 22 bp, Homo sapiens
ctacctccaaagcttcccacgg

SEQ ID NO: 5401351 - DNA, 12 bp, Homo sapiens
ctacctccaccc

SEQ ID NO: 5401352 - DNA, 17 bp, Homo sapiens
ctacctccaccctgcat

SEQ ID NO: 5401353 - DNA, 20 bp, Homo sapiens
ctacctccagagttgttgaa

SEQ ID NO: 5401354 - DNA, 11 bp, Homo sapiens
ctacctccctc

SEQ ID NO: 5401355 - DNA, 15 bp, Homo sapiens
ctacctccctccctc

SEQ ID NO: 5401356 - DNA, 17 bp, Homo sapiens
ctacctccctccctctc

SEQ ID NO: 5401357 - DNA, 13 bp, Homo sapiens
ctacctccctcct

SEQ ID NO: 5401358 - DNA, 15 bp, Homo sapiens
ctacctcccttgcct

SEQ ID NO: 5401359 - DNA, 16 bp, Homo sapiens
ctacctcccttgcctt

SEQ ID NO: 5401360 - DNA, 16 bp, Homo sapiens
ctacctcctctcctga

SEQ ID NO: 5401361 - DNA, 14 bp, Homo sapiens
ctacctccttagct

SEQ ID NO: 5401362 - DNA, 23 bp, Homo sapiens
ctacctccttagctttccctgtg

SEQ ID NO: 5401363 - DNA, 23 bp, Homo sapiens
ctacctcgagtggcgagtccaga

SEQ ID NO: 5401364 - DNA, 18 bp, Homo sapiens
ctacctcgcatcattgca

SEQ ID NO: 5401365 - DNA, 16 bp, Homo sapiens
ctacctcgccgagctg

SEQ ID NO: 5401366 - DNA, 17 bp, Homo sapiens
ctacctctaacaccaca

SEQ ID NO: 5401367 - DNA, 18 bp, Homo sapiens
ctacctctaacaccacac

SEQ ID NO: 5401368 - DNA, 18 bp, Homo sapiens
ctacctctcgtttctgcc

SEQ ID NO: 5401369 - DNA, 16 bp, Homo sapiens
ctacctctctgtccct

SEQ ID NO: 5401370 - DNA, 16 bp, Homo sapiens
ctacctctgagaagac

SEQ ID NO: 5401371 - DNA, 18 bp, Homo sapiens
ctacctctgtctgagaca

SEQ ID NO: 5401372 - DNA, 18 bp, Homo sapiens
ctacctctgtgccagggc

SEQ ID NO: 5401373 - DNA, 13 bp, Homo sapiens
ctacctctttgtc

SEQ ID NO: 5401374 - DNA, 20 bp, Homo sapiens
ctacctgaaggcagggctcc

SEQ ID NO: 5401375 - DNA, 21 bp, Homo sapiens
ctacctgaaggcagggctcct

SEQ ID NO: 5401376 - DNA, 19 bp, Homo sapiens
ctacctgacactcccttgg

SEQ ID NO: 5401377 - DNA, 14 bp, Homo sapiens
ctacctgagctaaa

SEQ ID NO: 5401378 - DNA, 15 bp, Homo sapiens
ctacctgaggccagg

SEQ ID NO: 5401379 - DNA, 14 bp, Homo sapiens
ctacctgaggccta

SEQ ID NO: 5401380 - DNA, 22 bp, Homo sapiens
ctacctgaggcctatctgagac

SEQ ID NO: 5401381 - DNA, 15 bp, Homo sapiens
ctacctgatcccact

SEQ ID NO: 5401382 - DNA, 17 bp, Homo sapiens
ctacctgatcccactcc

SEQ ID NO: 5401383 - DNA, 20 bp, Homo sapiens
ctacctgattggtgcaaccc

SEQ ID NO: 5401384 - DNA, 14 bp, Homo sapiens
ctacctgccactca

SEQ ID NO: 5401385 - DNA, 16 bp, Homo sapiens
ctacctgccactcaca

SEQ ID NO: 5401386 - DNA, 22 bp, Homo sapiens
ctacctgccactcacacagcca

SEQ ID NO: 5401387 - DNA, 14 bp, Homo sapiens
ctacctgccctcag

SEQ ID NO: 5401388 - DNA, 14 bp, Homo sapiens
ctacctgccctctc

SEQ ID NO: 5401389 - DNA, 18 bp, Homo sapiens
ctacctgccctctctcag

SEQ ID NO: 5401390 - DNA, 14 bp, Homo sapiens
ctacctgccctgga

SEQ ID NO: 5401391 - DNA, 18 bp, Homo sapiens
ctacctgccctggaacat

SEQ ID NO: 5401392 - DNA, 13 bp, Homo sapiens
ctacctgctcccc

SEQ ID NO: 5401393 - DNA, 16 bp, Homo sapiens
ctacctgctcccctca

SEQ ID NO: 5401394 - DNA, 11 bp, Homo sapiens
ctacctgctgg

SEQ ID NO: 5401395 - DNA, 18 bp, Homo sapiens
ctacctgctggacagcct

SEQ ID NO: 5401396 - DNA, 14 bp, Homo sapiens
ctacctggctggag

SEQ ID NO: 5401397 - DNA, 21 bp, Homo sapiens
ctacctggggaaagcctgaag

SEQ ID NO: 5401398 - DNA, 23 bp, Homo sapiens
ctacctggggaccccccttgccc

SEQ ID NO: 5401399 - DNA, 20 bp, Homo sapiens
ctacctggggtgggggccaa

SEQ ID NO: 5401400 - DNA, 21 bp, Homo sapiens
ctacctgtctgctgccagcac

SEQ ID NO: 5401401 - DNA, 17 bp, Homo sapiens
ctacctgtgaatcatat

SEQ ID NO: 5401402 - DNA, 11 bp, Homo sapiens
ctacctgtgtg

SEQ ID NO: 5401403 - DNA, 15 bp, Homo sapiens
ctacctgtgtggtac

SEQ ID NO: 5401404 - DNA, 19 bp, Homo sapiens
ctacctgtgttcattctta

SEQ ID NO: 5401405 - DNA, 16 bp, Homo sapiens
ctacctgttcagtgtc

SEQ ID NO: 5401406 - DNA, 13 bp, Homo sapiens
ctacctgttctgt

SEQ ID NO: 5401407 - DNA, 22 bp, Homo sapiens
ctacctgttgagcatcacagaa

SEQ ID NO: 5401408 - DNA, 14 bp, Homo sapiens
ctaccttacatcca

SEQ ID NO: 5401409 - DNA, 15 bp, Homo sapiens
ctaccttatagagca

SEQ ID NO: 5401410 - DNA, 22 bp, Homo sapiens
ctaccttatcactgcattattc

SEQ ID NO: 5401411 - DNA, 21 bp, Homo sapiens
ctaccttcaacatgtgctcgc

SEQ ID NO: 5401412 - DNA, 11 bp, Homo sapiens
ctaccttcccc

SEQ ID NO: 5401413 - DNA, 15 bp, Homo sapiens
ctaccttccccagac

SEQ ID NO: 5401414 - DNA, 16 bp, Homo sapiens
ctaccttccccagact

SEQ ID NO: 5401415 - DNA, 19 bp, Homo sapiens
ctaccttccccagacttgc

SEQ ID NO: 5401416 - DNA, 20 bp, Homo sapiens
ctaccttccccagacttgca

SEQ ID NO: 5401417 - DNA, 22 bp, Homo sapiens
ctaccttccccagacttgcact

SEQ ID NO: 5401418 - DNA, 13 bp, Homo sapiens
ctaccttcctgtc

SEQ ID NO: 5401419 - DNA, 21 bp, Homo sapiens
ctaccttctccccagctccca

SEQ ID NO: 5401420 - DNA, 16 bp, Homo sapiens
ctaccttctgacctcc

SEQ ID NO: 5401421 - DNA, 13 bp, Homo sapiens
ctaccttctgtag

SEQ ID NO: 5401422 - DNA, 13 bp, Homo sapiens
ctaccttctttgg

SEQ ID NO: 5401423 - DNA, 14 bp, Homo sapiens
ctaccttctttggc

SEQ ID NO: 5401424 - DNA, 12 bp, Homo sapiens
ctaccttgcctc

SEQ ID NO: 5401425 - DNA, 13 bp, Homo sapiens
ctaccttgcctcc

SEQ ID NO: 5401426 - DNA, 18 bp, Homo sapiens
ctaccttgctagctagcc

SEQ ID NO: 5401427 - DNA, 19 bp, Homo sapiens
ctaccttgcttttgcttct

SEQ ID NO: 5401428 - DNA, 14 bp, Homo sapiens
ctaccttgtgaccc

SEQ ID NO: 5401429 - DNA, 11 bp, Homo sapiens
ctaccttgtgg

SEQ ID NO: 5401430 - DNA, 19 bp, Homo sapiens
ctacctttatagctcatca

SEQ ID NO: 5401431 - DNA, 18 bp, Homo sapiens
ctacctttatagctctca

SEQ ID NO: 5401432 - DNA, 12 bp, Homo sapiens
ctagaaggggaa

SEQ ID NO: 5401433 - DNA, 15 bp, Homo sapiens
ctagaagtaagaaga

SEQ ID NO: 5401434 - DNA, 16 bp, Homo sapiens
ctagaagtaagaagag

SEQ ID NO: 5401435 - DNA, 23 bp, Homo sapiens
ctagaagtaagaagaggagcctc

SEQ ID NO: 5401436 - DNA, 12 bp, Homo sapiens
ctagaagtattt

SEQ ID NO: 5401437 - DNA, 21 bp, Homo sapiens
ctagaagtatttttgtctctt

SEQ ID NO: 5401438 - DNA, 18 bp, Homo sapiens
ctagaagtctccctgcac

SEQ ID NO: 5401439 - DNA, 19 bp, Homo sapiens
ctagaagtctccctgcaca

SEQ ID NO: 5401440 - DNA, 18 bp, Homo sapiens
ctagaagtgccatctcaa

SEQ ID NO: 5401441 - DNA, 17 bp, Homo sapiens
ctagaagtgggccagga

SEQ ID NO: 5401442 - DNA, 18 bp, Homo sapiens
ctagaagttactgaatgc

SEQ ID NO: 5401443 - DNA, 18 bp, Homo sapiens
ctagaagtttcccttcct

SEQ ID NO: 5401444 - DNA, 19 bp, Homo sapiens
ctagaagtttcccttcctc

SEQ ID NO: 5401445 - DNA, 20 bp, Homo sapiens
ctagaagtttcccttcctcc

SEQ ID NO: 5401446 - DNA, 22 bp, Homo sapiens
ctagaataatctcatcccccca

SEQ ID NO: 5401447 - DNA, 17 bp, Homo sapiens
ctagaatactaataaaa

SEQ ID NO: 5401448 - DNA, 14 bp, Homo sapiens
ctagaatacttttt

SEQ ID NO: 5401449 - DNA, 21 bp, Homo sapiens
ctagaataggagaaaatgaaa

SEQ ID NO: 5401450 - DNA, 22 bp, Homo sapiens
ctagaatcaccgcatttcagtg

SEQ ID NO: 5401451 - DNA, 19 bp, Homo sapiens
ctagaatcatgtattttgt

SEQ ID NO: 5401452 - DNA, 14 bp, Homo sapiens
ctagaatcccagca

SEQ ID NO: 5401453 - DNA, 19 bp, Homo sapiens
ctagaatcccagcagcaga

SEQ ID NO: 5401454 - DNA, 16 bp, Homo sapiens
ctagaatcctgcttta

SEQ ID NO: 5401455 - DNA, 13 bp, Homo sapiens
ctagaatctttat

SEQ ID NO: 5401456 - DNA, 14 bp, Homo sapiens
ctagaatgagaaat

SEQ ID NO: 5401457 - DNA, 16 bp, Homo sapiens
ctagaatggaagcctc

SEQ ID NO: 5401458 - DNA, 22 bp, Homo sapiens
ctagaatggaagcctccacctg

SEQ ID NO: 5401459 - DNA, 18 bp, Homo sapiens
ctagaatggtagcactac

SEQ ID NO: 5401460 - DNA, 14 bp, Homo sapiens
ctagaatgtaaagt

SEQ ID NO: 5401461 - DNA, 19 bp, Homo sapiens
ctagaatgtcagatttctg

SEQ ID NO: 5401462 - DNA, 20 bp, Homo sapiens
ctagaatgtcagatttctgg

SEQ ID NO: 5401463 - DNA, 22 bp, Homo sapiens
ctagaatgtcagatttctggtt

SEQ ID NO: 5401464 - DNA, 21 bp, Homo sapiens
ctagaatgtctgaagtacaaa

SEQ ID NO: 5401465 - DNA, 21 bp, Homo sapiens
ctagaatgtgaatataacttt

SEQ ID NO: 5401466 - DNA, 20 bp, Homo sapiens
ctagaatgtggatttgattc

SEQ ID NO: 5401467 - DNA, 19 bp, Homo sapiens
ctagaattagtatgtctgt

SEQ ID NO: 5401468 - DNA, 20 bp, Homo sapiens
ctagaattagtatgtctgtt

SEQ ID NO: 5401469 - DNA, 16 bp, Homo sapiens
ctagaattccctctct

SEQ ID NO: 5401470 - DNA, 20 bp, Homo sapiens
ctagaattccctctctctga

SEQ ID NO: 5401471 - DNA, 19 bp, Homo sapiens
ctagaattctagtgctgct

SEQ ID NO: 5401472 - DNA, 20 bp, Homo sapiens
ctagaattgattttttttct

SEQ ID NO: 5401473 - DNA, 21 bp, Homo sapiens
ctagaatttatcacacttctg

SEQ ID NO: 5401474 - DNA, 22 bp, Homo sapiens
ctagaatttattcaattcctct

SEQ ID NO: 5401475 - DNA, 18 bp, Homo sapiens
ctagaatttgtattttgc

SEQ ID NO: 5401476 - DNA, 19 bp, Homo sapiens
ctagaattttaagtgcttt

SEQ ID NO: 5401477 - DNA, 16 bp, Homo sapiens
ctagacaaacaaggga

SEQ ID NO: 5401478 - DNA, 18 bp, Homo sapiens
ctagacaaaggcccagaa

SEQ ID NO: 5401479 - DNA, 16 bp, Homo sapiens
ctagacaaccctgcaa

SEQ ID NO: 5401480 - DNA, 16 bp, Homo sapiens
ctagacaacctttctg

SEQ ID NO: 5401481 - DNA, 18 bp, Homo sapiens
ctagacaacctttctgta

SEQ ID NO: 5401482 - DNA, 20 bp, Homo sapiens
ctagacaagatattgtacat

SEQ ID NO: 5401483 - DNA, 14 bp, Homo sapiens
ctagacaagccaga

SEQ ID NO: 5401484 - DNA, 19 bp, Homo sapiens
ctagacaatgatttggcca

SEQ ID NO: 5401485 - DNA, 18 bp, Homo sapiens
ctagacacaatttcattt

SEQ ID NO: 5401486 - DNA, 23 bp, Homo sapiens
ctagacacaatttcatttccagc

SEQ ID NO: 5401487 - DNA, 13 bp, Homo sapiens
ctagacacacaaa

SEQ ID NO: 5401488 - DNA, 17 bp, Homo sapiens
ctagacacacaaagcag

SEQ ID NO: 5401489 - DNA, 22 bp, Homo sapiens
ctagacacatgaaggtaaataa

SEQ ID NO: 5401490 - DNA, 16 bp, Homo sapiens
ctagacaccaaagttc

SEQ ID NO: 5401491 - DNA, 17 bp, Homo sapiens
ctagacaccaaagttct

SEQ ID NO: 5401492 - DNA, 16 bp, Homo sapiens
ctagacactgaaggca

SEQ ID NO: 5401493 - DNA, 18 bp, Homo sapiens
ctagacagatccccgttc

SEQ ID NO: 5401494 - DNA, 20 bp, Homo sapiens
ctagacagtattgccacctc

SEQ ID NO: 5401495 - DNA, 22 bp, Homo sapiens
ctagacagtattgccacctctg

SEQ ID NO: 5401496 - DNA, 23 bp, Homo sapiens
ctagacagttagagactctgtca

SEQ ID NO: 5401497 - DNA, 22 bp, Homo sapiens
ctagacatcattgtcagccttg

SEQ ID NO: 5401498 - DNA, 17 bp, Homo sapiens
ctagacatggaggttct

SEQ ID NO: 5401499 - DNA, 19 bp, Homo sapiens
ctagacatggaggttctaa

SEQ ID NO: 5401500 - DNA, 20 bp, Homo sapiens
ctagacatggaggttctaag

SEQ ID NO: 5401501 - DNA, 23 bp, Homo sapiens
ctagacatggaggttctaaggcc

SEQ ID NO: 5401502 - DNA, 13 bp, Homo sapiens
ctagacattacca

SEQ ID NO: 5401503 - DNA, 23 bp, Homo sapiens
ctagacattgcaattttgcatag

SEQ ID NO: 5401504 - DNA, 13 bp, Homo sapiens
ctagaccaaggtc

SEQ ID NO: 5401505 - DNA, 17 bp, Homo sapiens
ctagaccagcagacaga

SEQ ID NO: 5401506 - DNA, 20 bp, Homo sapiens
ctagaccagcagacagagcc

SEQ ID NO: 5401507 - DNA, 14 bp, Homo sapiens
ctagaccagggctg

SEQ ID NO: 5401508 - DNA, 22 bp, Homo sapiens
ctagaccagggctgctctttcc

SEQ ID NO: 5401509 - DNA, 13 bp, Homo sapiens
ctagaccagtttg

SEQ ID NO: 5401510 - DNA, 15 bp, Homo sapiens
ctagacccaaccctt

SEQ ID NO: 5401511 - DNA, 21 bp, Homo sapiens
ctagacccactggactcacct

SEQ ID NO: 5401512 - DNA, 23 bp, Homo sapiens
ctagacccaggtggagggcacag

SEQ ID NO: 5401513 - DNA, 14 bp, Homo sapiens
ctagacctgggcca

SEQ ID NO: 5401514 - DNA, 23 bp, Homo sapiens
ctagacctgggccaaaagggcag

SEQ ID NO: 5401515 - DNA, 20 bp, Homo sapiens
ctagacgagcaggcttcttc

SEQ ID NO: 5401516 - DNA, 16 bp, Homo sapiens
ctagacgcaccgcctg

SEQ ID NO: 5401517 - DNA, 16 bp, Homo sapiens
ctagacgcccctccca

SEQ ID NO: 5401518 - DNA, 21 bp, Homo sapiens
ctagactaaaagattgagaag

SEQ ID NO: 5401519 - DNA, 22 bp, Homo sapiens
ctagactaccggacactcgtca

SEQ ID NO: 5401520 - DNA, 19 bp, Homo sapiens
ctagactagcaatctcttc

SEQ ID NO: 5401521 - DNA, 20 bp, Homo sapiens
ctagactcaaaacctggaga

SEQ ID NO: 5401522 - DNA, 15 bp, Homo sapiens
ctagactcatactca

SEQ ID NO: 5401523 - DNA, 23 bp, Homo sapiens
ctagactgcaagaactgttttta

SEQ ID NO: 5401524 - DNA, 20 bp, Homo sapiens
ctagactgcatcccgtacct

SEQ ID NO: 5401525 - DNA, 13 bp, Homo sapiens
ctagactgctcct

SEQ ID NO: 5401526 - DNA, 14 bp, Homo sapiens
ctagactggagtga

SEQ ID NO: 5401527 - DNA, 16 bp, Homo sapiens
ctagactggagtgagg

SEQ ID NO: 5401528 - DNA, 24 bp, Homo sapiens
ctagactggagtgaggcttccagg

SEQ ID NO: 5401529 - DNA, 13 bp, Homo sapiens
ctagactgggctg

SEQ ID NO: 5401530 - DNA, 15 bp, Homo sapiens
ctagactgggctggc

SEQ ID NO: 5401531 - DNA, 21 bp, Homo sapiens
ctagactgggctggctgcctt

SEQ ID NO: 5401532 - DNA, 14 bp, Homo sapiens
ctagactggtgact

SEQ ID NO: 5401533 - DNA, 13 bp, Homo sapiens
ctagactgtgtct

SEQ ID NO: 5401534 - DNA, 18 bp, Homo sapiens
ctagactgttactttggc

SEQ ID NO: 5401535 - DNA, 20 bp, Homo sapiens
ctagactgttactttggcaa

SEQ ID NO: 5401536 - DNA, 21 bp, Homo sapiens
ctagacttcccaacagcctta

SEQ ID NO: 5401537 - DNA, 21 bp, Homo sapiens
ctagacttccccatcccgaag

SEQ ID NO: 5401538 - DNA, 16 bp, Homo sapiens
ctagacttgaaagttt

SEQ ID NO: 5401539 - DNA, 22 bp, Homo sapiens
ctagacttgaaagttttccagt

SEQ ID NO: 5401540 - DNA, 16 bp, Homo sapiens
ctagactttaggcttt

SEQ ID NO: 5401541 - DNA, 21 bp, Homo sapiens
ctagactttaggctttcagct

SEQ ID NO: 5401542 - DNA, 14 bp, Homo sapiens
ctagactttccttt

SEQ ID NO: 5401543 - DNA, 13 bp, Homo sapiens
ctagactttctgt

SEQ ID NO: 5401544 - DNA, 18 bp, Homo sapiens
ctagactttgatttcctt

SEQ ID NO: 5401545 - DNA, 20 bp, Homo sapiens
ctagagaaaataaattccaa

SEQ ID NO: 5401546 - DNA, 10 bp, Homo sapiens
ctagagaaac

SEQ ID NO: 5401547 - DNA, 18 bp, Homo sapiens
ctagagaaatcagctgct

SEQ ID NO: 5401548 - DNA, 16 bp, Homo sapiens
ctagagaacaggtggt

SEQ ID NO: 5401549 - DNA, 15 bp, Homo sapiens
ctagagaacgcagcc

SEQ ID NO: 5401550 - DNA, 16 bp, Homo sapiens
ctagagaacgcagccc

SEQ ID NO: 5401551 - DNA, 15 bp, Homo sapiens
ctagagaagataatt

SEQ ID NO: 5401552 - DNA, 18 bp, Homo sapiens
ctagagaagataattgtt

SEQ ID NO: 5401553 - DNA, 21 bp, Homo sapiens
ctagagaagataattgttgaa

SEQ ID NO: 5401554 - DNA, 10 bp, Homo sapiens
ctagagaagg

SEQ ID NO: 5401555 - DNA, 22 bp, Homo sapiens
ctagagaagggagacattgttt

SEQ ID NO: 5401556 - DNA, 21 bp, Homo sapiens
ctagagaagtggactggagga

SEQ ID NO: 5401557 - DNA, 15 bp, Homo sapiens
ctagagaatgcacag

SEQ ID NO: 5401558 - DNA, 20 bp, Homo sapiens
ctagagacagaagcaggctg

SEQ ID NO: 5401559 - DNA, 23 bp, Homo sapiens
ctagagacagaagcaggctggag

SEQ ID NO: 5401560 - DNA, 21 bp, Homo sapiens
ctagagacagatgctggtgga

SEQ ID NO: 5401561 - DNA, 18 bp, Homo sapiens
ctagagacctctcaacag

SEQ ID NO: 5401562 - DNA, 16 bp, Homo sapiens
ctagagacgcaccttg

SEQ ID NO: 5401563 - DNA, 17 bp, Homo sapiens
ctagagacgctgatcca

SEQ ID NO: 5401564 - DNA, 18 bp, Homo sapiens
ctagagagaaaaagaaag

SEQ ID NO: 5401565 - DNA, 14 bp, Homo sapiens
ctagagagaaccaa

SEQ ID NO: 5401566 - DNA, 16 bp, Homo sapiens
ctagagagaataaatt

SEQ ID NO: 5401567 - DNA, 17 bp, Homo sapiens
ctagagagccttaactt

SEQ ID NO: 5401568 - DNA, 23 bp, Homo sapiens
ctagagagccttaacttcttaaa

SEQ ID NO: 5401569 - DNA, 20 bp, Homo sapiens
ctagagaggctggcaaggag

SEQ ID NO: 5401570 - DNA, 23 bp, Homo sapiens
ctagagagggaggcaagccctgt

SEQ ID NO: 5401571 - DNA, 23 bp, Homo sapiens
ctagagaggggcctctggctgcc

SEQ ID NO: 5401572 - DNA, 14 bp, Homo sapiens
ctagagataaaaca

SEQ ID NO: 5401573 - DNA, 17 bp, Homo sapiens
ctagagatatggcagcg

SEQ ID NO: 5401574 - DNA, 22 bp, Homo sapiens
ctagagatgtgcctgtgggagg

SEQ ID NO: 5401575 - DNA, 13 bp, Homo sapiens
ctagagattctta

SEQ ID NO: 5401576 - DNA, 22 bp, Homo sapiens
ctagagattcttagctcttggg

SEQ ID NO: 5401577 - DNA, 14 bp, Homo sapiens
ctagagcaacccct

SEQ ID NO: 5401578 - DNA, 16 bp, Homo sapiens
ctagagcaacccctgt

SEQ ID NO: 5401579 - DNA, 21 bp, Homo sapiens
ctagagcaacccctgtaccca

SEQ ID NO: 5401580 - DNA, 15 bp, Homo sapiens
ctagagcagccctgg

SEQ ID NO: 5401581 - DNA, 15 bp, Homo sapiens
ctagagcagggatta

SEQ ID NO: 5401582 - DNA, 20 bp, Homo sapiens
ctagagcatctgtcccactg

SEQ ID NO: 5401583 - DNA, 17 bp, Homo sapiens
ctagagcatgctgcctg

SEQ ID NO: 5401584 - DNA, 13 bp, Homo sapiens
ctagagcattctg

SEQ ID NO: 5401585 - DNA, 23 bp, Homo sapiens
ctagagcattctggggtggggct

SEQ ID NO: 5401586 - DNA, 16 bp, Homo sapiens
ctagagccgaggggag

SEQ ID NO: 5401587 - DNA, 21 bp, Homo sapiens
ctagagccgaggggagagagg

SEQ ID NO: 5401588 - DNA, 15 bp, Homo sapiens
ctagagcctcgacac

SEQ ID NO: 5401589 - DNA, 22 bp, Homo sapiens
ctagagcctctgcctgacagca

SEQ ID NO: 5401590 - DNA, 11 bp, Homo sapiens
ctagagcctgc

SEQ ID NO: 5401591 - DNA, 15 bp, Homo sapiens
ctagagcctgcctgg

SEQ ID NO: 5401592 - DNA, 16 bp, Homo sapiens
ctagagccttcagcct

SEQ ID NO: 5401593 - DNA, 17 bp, Homo sapiens
ctagagccttcagcctt

SEQ ID NO: 5401594 - DNA, 16 bp, Homo sapiens
ctagagcgcggctggc

SEQ ID NO: 5401595 - DNA, 17 bp, Homo sapiens
ctagagcgcggctggct

SEQ ID NO: 5401596 - DNA, 11 bp, Homo sapiens
ctagagctcct

SEQ ID NO: 5401597 - DNA, 15 bp, Homo sapiens
ctagagctcctccct

SEQ ID NO: 5401598 - DNA, 21 bp, Homo sapiens
ctagagctcctgtccctaccc

SEQ ID NO: 5401599 - DNA, 17 bp, Homo sapiens
ctagagctgagagtctg

SEQ ID NO: 5401600 - DNA, 13 bp, Homo sapiens
ctagagctgggaa

SEQ ID NO: 5401601 - DNA, 21 bp, Homo sapiens
ctagagctgggaaacagggag

SEQ ID NO: 5401602 - DNA, 24 bp, Homo sapiens
ctagagctgggaaacagggagccc

SEQ ID NO: 5401603 - DNA, 14 bp, Homo sapiens
ctagagctttcttt

SEQ ID NO: 5401604 - DNA, 15 bp, Homo sapiens
ctagaggaaaagaaa

SEQ ID NO: 5401605 - DNA, 22 bp, Homo sapiens
ctagaggaataaagctgtgagc

SEQ ID NO: 5401606 - DNA, 15 bp, Homo sapiens
ctagaggacactagg

SEQ ID NO: 5401607 - DNA, 23 bp, Homo sapiens
ctagaggacactaggagactggt

SEQ ID NO: 5401608 - DNA, 14 bp, Homo sapiens
ctagctgctacaaa

SEQ ID NO: 5401609 - DNA, 22 bp, Homo sapiens
ctagctggaattttttattctt

SEQ ID NO: 5401610 - DNA, 24 bp, Homo sapiens
ctagctggaattttttattcttgt

SEQ ID NO: 5401611 - DNA, 22 bp, Homo sapiens
ctagctggagaggagccctgcc

SEQ ID NO: 5401612 - DNA, 13 bp, Homo sapiens
ctagctggagcct

SEQ ID NO: 5401613 - DNA, 21 bp, Homo sapiens
ctagctggagtgccatggctg

SEQ ID NO: 5401614 - DNA, 22 bp, Homo sapiens
ctagctggagtgccatggctgg

SEQ ID NO: 5401615 - DNA, 23 bp, Homo sapiens
ctagctggagtgccatggctggg

SEQ ID NO: 5401616 - DNA, 15 bp, Homo sapiens
ctagctggcaggaca

SEQ ID NO: 5401617 - DNA, 22 bp, Homo sapiens
ctagctggcaggacacatcccg

SEQ ID NO: 5401618 - DNA, 13 bp, Homo sapiens
ctagctggctctg

SEQ ID NO: 5401619 - DNA, 14 bp, Homo sapiens
ctagctggctctgt

SEQ ID NO: 5401620 - DNA, 18 bp, Homo sapiens
ctagctgggcaaaccctt

SEQ ID NO: 5401621 - DNA, 20 bp, Homo sapiens
ctagctgggcaaacccttct

SEQ ID NO: 5401622 - DNA, 18 bp, Homo sapiens
ctagctgggggtgggcca

SEQ ID NO: 5401623 - DNA, 20 bp, Homo sapiens
ctagctgggggtgggccagg

SEQ ID NO: 5401624 - DNA, 21 bp, Homo sapiens
ctagctgggggtgggccaggc

SEQ ID NO: 5401625 - DNA, 22 bp, Homo sapiens
ctagctggtggtttcacggtgc

SEQ ID NO: 5401626 - DNA, 19 bp, Homo sapiens
ctagctggttaatggcagc

SEQ ID NO: 5401627 - DNA, 16 bp, Homo sapiens
ctagctgtatgatttg

SEQ ID NO: 5401628 - DNA, 17 bp, Homo sapiens
ctagctgtatgatttgt

SEQ ID NO: 5401629 - DNA, 17 bp, Homo sapiens
ctagctgtcctttttcc

SEQ ID NO: 5401630 - DNA, 23 bp, Homo sapiens
ctagctgtcctttttcctctcca

SEQ ID NO: 5401631 - DNA, 16 bp, Homo sapiens
ctagctgtctcaggag

SEQ ID NO: 5401632 - DNA, 15 bp, Homo sapiens
ctagctgtctctctt

SEQ ID NO: 5401633 - DNA, 16 bp, Homo sapiens
ctagctgtctctcttg

SEQ ID NO: 5401634 - DNA, 17 bp, Homo sapiens
ctagctgtctctcttgt

SEQ ID NO: 5401635 - DNA, 16 bp, Homo sapiens
ctagctgtgcaacctt

SEQ ID NO: 5401636 - DNA, 12 bp, Homo sapiens
ctagctgtgctg

SEQ ID NO: 5401637 - DNA, 14 bp, Homo sapiens
ctagctgtgggggt

SEQ ID NO: 5401638 - DNA, 23 bp, Homo sapiens
ctagctgtgtgaatacctgctca

SEQ ID NO: 5401639 - DNA, 18 bp, Homo sapiens
ctagctgttgagctgttt

SEQ ID NO: 5401640 - DNA, 15 bp, Homo sapiens
ctagcttcatgcctc

SEQ ID NO: 5401641 - DNA, 13 bp, Homo sapiens
ctagcttctgctt

SEQ ID NO: 5401642 - DNA, 14 bp, Homo sapiens
ctagcttctgcttt

SEQ ID NO: 5401643 - DNA, 16 bp, Homo sapiens
ctagcttctgcttttc

SEQ ID NO: 5401644 - DNA, 18 bp, Homo sapiens
ctagcttctgcttttctg

SEQ ID NO: 5401645 - DNA, 23 bp, Homo sapiens
ctagcttctgcttttctgccctg

SEQ ID NO: 5401646 - DNA, 14 bp, Homo sapiens
ctagcttcttccat

SEQ ID NO: 5401647 - DNA, 20 bp, Homo sapiens
ctagcttgggaggcttcccc

SEQ ID NO: 5401648 - DNA, 19 bp, Homo sapiens
ctagctttagaccctgggt

SEQ ID NO: 5401649 - DNA, 21 bp, Homo sapiens
ctagctttagctggagggaga

SEQ ID NO: 5401650 - DNA, 21 bp, Homo sapiens
ctagctttcctttacagctgt

SEQ ID NO: 5401651 - DNA, 14 bp, Homo sapiens
ctagctttgttgtc

SEQ ID NO: 5401652 - DNA, 17 bp, Homo sapiens
ctagctttgttgtcctc

SEQ ID NO: 5401653 - DNA, 21 bp, Homo sapiens
ctagctttgttgtcctcccag

SEQ ID NO: 5401654 - DNA, 14 bp, Homo sapiens
ctagcttttaggaa

SEQ ID NO: 5401655 - DNA, 13 bp, Homo sapiens
ctagcttttctat

SEQ ID NO: 5401656 - DNA, 19 bp, Homo sapiens
ctagcttttttcctccttt

SEQ ID NO: 5401657 - DNA, 11 bp, Homo sapiens
ctaggaaaaaa

SEQ ID NO: 5401658 - DNA, 21 bp, Homo sapiens
ctaggaaaagagaactttttt

SEQ ID NO: 5401659 - DNA, 15 bp, Homo sapiens
ctaggaaaattattc

SEQ ID NO: 5401660 - DNA, 12 bp, Homo sapiens
ctaggaaagcag

SEQ ID NO: 5401661 - DNA, 23 bp, Homo sapiens
ctaggaaagggaagcctgactgc

SEQ ID NO: 5401662 - DNA, 15 bp, Homo sapiens
ctaggaaatatttat

SEQ ID NO: 5401663 - DNA, 19 bp, Homo sapiens
ctaggaaatatttatttta

SEQ ID NO: 5401664 - DNA, 22 bp, Homo sapiens
ctaggaaatatttattttaata

SEQ ID NO: 5401665 - DNA, 16 bp, Homo sapiens
ctaggaaatccagggt

SEQ ID NO: 5401666 - DNA, 13 bp, Homo sapiens
ctaggaacactcc

SEQ ID NO: 5401667 - DNA, 15 bp, Homo sapiens
ctaggaaccctggag

SEQ ID NO: 5401668 - DNA, 16 bp, Homo sapiens
ctaggaaccctggagg

SEQ ID NO: 5401669 - DNA, 11 bp, Homo sapiens
ctaggaagaat

SEQ ID NO: 5401670 - DNA, 19 bp, Homo sapiens
ctaggaagaattttaaaaa

SEQ ID NO: 5401671 - DNA, 22 bp, Homo sapiens
ctaggaagaattttaaaaatga

SEQ ID NO: 5401672 - DNA, 23 bp, Homo sapiens
ctaggaagagcaggactccaggc

SEQ ID NO: 5401673 - DNA, 16 bp, Homo sapiens
ctaggaagaggagtgg

SEQ ID NO: 5401674 - DNA, 14 bp, Homo sapiens
ctaggaagcaagat

SEQ ID NO: 5401675 - DNA, 22 bp, Homo sapiens
ctaggaaggcacttctgcctga

SEQ ID NO: 5401676 - DNA, 21 bp, Homo sapiens
ctaggaagtaaagtgaagaat

SEQ ID NO: 5401677 - DNA, 17 bp, Homo sapiens
ctaggaatgaaatcctg

SEQ ID NO: 5401678 - DNA, 15 bp, Homo sapiens
ctaggaatggaggag

SEQ ID NO: 5401679 - DNA, 16 bp, Homo sapiens
ctaggaatggaggagc

SEQ ID NO: 5401680 - DNA, 17 bp, Homo sapiens
ctaggaattctttgcat

SEQ ID NO: 5401681 - DNA, 22 bp, Homo sapiens
ctaggacatgttcccttctcct

SEQ ID NO: 5401682 - DNA, 17 bp, Homo sapiens
ctaggaccactcagccc

SEQ ID NO: 5401683 - DNA, 21 bp, Homo sapiens
ctaggaccactcagcccctag

SEQ ID NO: 5401684 - DNA, 15 bp, Homo sapiens
ctaggaccagttttg

SEQ ID NO: 5401685 - DNA, 21 bp, Homo sapiens
ctaggaccatggttaagagtc

SEQ ID NO: 5401686 - DNA, 21 bp, Homo sapiens
ctaggacccccagtgctcaca

SEQ ID NO: 5401687 - DNA, 23 bp, Homo sapiens
ctaggacccccagtgctcacaca

SEQ ID NO: 5401688 - DNA, 22 bp, Homo sapiens
ctaggacccctccatgtgggct

SEQ ID NO: 5401689 - DNA, 14 bp, Homo sapiens
ctaggacctcaggc

SEQ ID NO: 5401690 - DNA, 22 bp, Homo sapiens
ctaggacctcaggcggggagga

SEQ ID NO: 5401691 - DNA, 22 bp, Homo sapiens
ctaggacgcaataaatttatat

SEQ ID NO: 5401692 - DNA, 13 bp, Homo sapiens
ctaggacgccaac

SEQ ID NO: 5401693 - DNA, 17 bp, Homo sapiens
ctaggacgccaacttct

SEQ ID NO: 5401694 - DNA, 21 bp, Homo sapiens
ctaggacgccaacttctccca

SEQ ID NO: 5401695 - DNA, 22 bp, Homo sapiens
ctaggacgccaacttctcccac

SEQ ID NO: 5401696 - DNA, 23 bp, Homo sapiens
ctaggacgccaacttctcccacc

SEQ ID NO: 5401697 - DNA, 18 bp, Homo sapiens
ctaggacgccacccagca

SEQ ID NO: 5401698 - DNA, 16 bp, Homo sapiens
ctaggactcaggcctg

SEQ ID NO: 5401699 - DNA, 19 bp, Homo sapiens
ctaggactcaggcctgcca

SEQ ID NO: 5401700 - DNA, 15 bp, Homo sapiens
ctaggactctgaggc

SEQ ID NO: 5401701 - DNA, 22 bp, Homo sapiens
ctaggactgaattatgaaactt

SEQ ID NO: 5401702 - DNA, 14 bp, Homo sapiens
ctaggactgggccc

SEQ ID NO: 5401703 - DNA, 14 bp, Homo sapiens
ctaggactgtggag

SEQ ID NO: 5401704 - DNA, 21 bp, Homo sapiens
ctaggactgtggaggggagct

SEQ ID NO: 5401705 - DNA, 22 bp, Homo sapiens
ctaggacttaaaattagtcttt

SEQ ID NO: 5401706 - DNA, 13 bp, Homo sapiens
ctaggacttcaaa

SEQ ID NO: 5401707 - DNA, 12 bp, Homo sapiens
ctaggagacaga

SEQ ID NO: 5401708 - DNA, 18 bp, Homo sapiens
ctaggagacagagccaag

SEQ ID NO: 5401709 - DNA, 20 bp, Homo sapiens
ctaggagaccaaggcgggag

SEQ ID NO: 5401710 - DNA, 18 bp, Homo sapiens
ctaggagaccagaagtga

SEQ ID NO: 5401711 - DNA, 12 bp, Homo sapiens
ctaggagactgg

SEQ ID NO: 5401712 - DNA, 13 bp, Homo sapiens
ctaggagactggt

SEQ ID NO: 5401713 - DNA, 21 bp, Homo sapiens
ctaggagagactgaaagcagc

SEQ ID NO: 5401714 - DNA, 19 bp, Homo sapiens
ctaggagaggagaaccaga

SEQ ID NO: 5401715 - DNA, 19 bp, Homo sapiens
ctaggagatatctgaggga

SEQ ID NO: 5401716 - DNA, 21 bp, Homo sapiens
ctaggagatatctgagggagg

SEQ ID NO: 5401717 - DNA, 23 bp, Homo sapiens
ctaggagatatctgagggaggag

SEQ ID NO: 5401718 - DNA, 19 bp, Homo sapiens
ctaggagatgttgggaaca

SEQ ID NO: 5401719 - DNA, 20 bp, Homo sapiens
ctaggagcaaagcctgttca

SEQ ID NO: 5401720 - DNA, 18 bp, Homo sapiens
ctaggagccccagcttcc

SEQ ID NO: 5401721 - DNA, 19 bp, Homo sapiens
ctaggagccccagcttcct

SEQ ID NO: 5401722 - DNA, 12 bp, Homo sapiens
ctaggagctggg

SEQ ID NO: 5401723 - DNA, 15 bp, Homo sapiens
ctaggagctgggagg

SEQ ID NO: 5401724 - DNA, 17 bp, Homo sapiens
ctaggagctgtctccag

SEQ ID NO: 5401725 - DNA, 16 bp, Homo sapiens
ctaggaggaaaaagaa

SEQ ID NO: 5401726 - DNA, 22 bp, Homo sapiens
ctaggaggacctgggaatttca

SEQ ID NO: 5401727 - DNA, 19 bp, Homo sapiens
ctaggaggatgctgtgcct

SEQ ID NO: 5401728 - DNA, 21 bp, Homo sapiens
ctaggaggatgctgtgcctcc

SEQ ID NO: 5401729 - DNA, 18 bp, Homo sapiens
ctaggaggccttctcgca

SEQ ID NO: 5401730 - DNA, 18 bp, Homo sapiens
ctaggaggctggccaagg

SEQ ID NO: 5401731 - DNA, 19 bp, Homo sapiens
ctaggaggctgtgggtttt

SEQ ID NO: 5401732 - DNA, 14 bp, Homo sapiens
ctaggagggctctg

SEQ ID NO: 5401733 - DNA, 16 bp, Homo sapiens
ctaggagggctctgag

SEQ ID NO: 5401734 - DNA, 14 bp, Homo sapiens
ctaggaggtaatga

SEQ ID NO: 5401735 - DNA, 13 bp, Homo sapiens
ctaggaggttccg

SEQ ID NO: 5401736 - DNA, 20 bp, Homo sapiens
ctaggaggttccggtgtctg

SEQ ID NO: 5401737 - DNA, 19 bp, Homo sapiens
ctaggagtcaactggctgg

SEQ ID NO: 5401738 - DNA, 20 bp, Homo sapiens
ctaggagttaactaccctac

SEQ ID NO: 5401739 - DNA, 21 bp, Homo sapiens
ctaggataaaccaatcatctt

SEQ ID NO: 5401740 - DNA, 22 bp, Homo sapiens
ctaggataacttgctttcttct

SEQ ID NO: 5401741 - DNA, 14 bp, Homo sapiens
ctaggatactgctg

SEQ ID NO: 5401742 - DNA, 15 bp, Homo sapiens
ctaggatactgctgc

SEQ ID NO: 5401743 - DNA, 19 bp, Homo sapiens
ctaggatagttgatgcatg

SEQ ID NO: 5401744 - DNA, 17 bp, Homo sapiens
ctaggatatcttctcca

SEQ ID NO: 5401745 - DNA, 17 bp, Homo sapiens
ctaggatatgccctcct

SEQ ID NO: 5401746 - DNA, 22 bp, Homo sapiens
ctaggatatgccctcctggtga

SEQ ID NO: 5401747 - DNA, 14 bp, Homo sapiens
ctaggatatgtata

SEQ ID NO: 5401748 - DNA, 18 bp, Homo sapiens
ctaggatatgtatatttt

SEQ ID NO: 5401749 - DNA, 20 bp, Homo sapiens
ctaggatcttcactgtctta

SEQ ID NO: 5401750 - DNA, 17 bp, Homo sapiens
ctaggatgctgcagcag

SEQ ID NO: 5401751 - DNA, 11 bp, Homo sapiens
ctaggatgggg

SEQ ID NO: 5401752 - DNA, 14 bp, Homo sapiens
ctaggatgtggagc

SEQ ID NO: 5401753 - DNA, 17 bp, Homo sapiens
ctaggatgttctgggct

SEQ ID NO: 5401754 - DNA, 22 bp, Homo sapiens
ctaggattacaggcatgagcca

SEQ ID NO: 5401755 - DNA, 19 bp, Homo sapiens
ctaggattcacaccccacc

SEQ ID NO: 5401756 - DNA, 22 bp, Homo sapiens
ctaggattcacaccccacctgc

SEQ ID NO: 5401757 - DNA, 23 bp, Homo sapiens
ctaggattcacaccccacctgcg

SEQ ID NO: 5401758 - DNA, 23 bp, Homo sapiens
ctaggattcctcccccagagcca

SEQ ID NO: 5401759 - DNA, 13 bp, Homo sapiens
ctaggattctaaa

SEQ ID NO: 5401760 - DNA, 17 bp, Homo sapiens
ctaggcaaaattgtgaa

SEQ ID NO: 5401761 - DNA, 19 bp, Homo sapiens
ctaggcaaaattgtgaagc

SEQ ID NO: 5401762 - DNA, 14 bp, Homo sapiens
ctaggcaagcagga

SEQ ID NO: 5401763 - DNA, 18 bp, Homo sapiens
ctaggcaagcaggacctg

SEQ ID NO: 5401764 - DNA, 20 bp, Homo sapiens
ctaggcactgtagttctaag

SEQ ID NO: 5401765 - DNA, 23 bp, Homo sapiens
ctaggcagaagaagctgggaggg

SEQ ID NO: 5401766 - DNA, 13 bp, Homo sapiens
ctaggcaggacat

SEQ ID NO: 5401767 - DNA, 22 bp, Homo sapiens
ctaggcaggacatgctgaagcc

SEQ ID NO: 5401768 - DNA, 15 bp, Homo sapiens
ctaggcaggacctgt

SEQ ID NO: 5401769 - DNA, 14 bp, Homo sapiens
ctaggcaggcaaga

SEQ ID NO: 5401770 - DNA, 16 bp, Homo sapiens
ctaggcagtgggaggc

SEQ ID NO: 5401771 - DNA, 23 bp, Homo sapiens
ctaggcagttagagatgcctccc

SEQ ID NO: 5401772 - DNA, 15 bp, Homo sapiens
ctaggcatcaccccc

SEQ ID NO: 5401773 - DNA, 22 bp, Homo sapiens
ctaggcatcacccccgctttgg

SEQ ID NO: 5401774 - DNA, 18 bp, Homo sapiens
ctaggcatcccaggggac

SEQ ID NO: 5401775 - DNA, 19 bp, Homo sapiens
ctaggcatcccaggggacc

SEQ ID NO: 5401776 - DNA, 14 bp, Homo sapiens
ctaggcatctcctc

SEQ ID NO: 5401777 - DNA, 17 bp, Homo sapiens
ctaggcatctctgtact

SEQ ID NO: 5401778 - DNA, 20 bp, Homo sapiens
ctaggcatgtcagaggaccc

SEQ ID NO: 5401779 - DNA, 21 bp, Homo sapiens
ctaggcatgtcagaggacccc

SEQ ID NO: 5401780 - DNA, 18 bp, Homo sapiens
ctaggcattgcaggacct

SEQ ID NO: 5401781 - DNA, 12 bp, Homo sapiens
ctaggcatttca

SEQ ID NO: 5401782 - DNA, 22 bp, Homo sapiens
ctaggccaaatgcacaagctca

SEQ ID NO: 5401783 - DNA, 15 bp, Homo sapiens
ctaggccagagccca

SEQ ID NO: 5401784 - DNA, 15 bp, Homo sapiens
ctagtgcctagaaag

SEQ ID NO: 5401785 - DNA, 18 bp, Homo sapiens
ctagtgcctagaaagcaa

SEQ ID NO: 5401786 - DNA, 17 bp, Homo sapiens
ctagtgccttctaaagg

SEQ ID NO: 5401787 - DNA, 15 bp, Homo sapiens
ctagtgctacagatg

SEQ ID NO: 5401788 - DNA, 22 bp, Homo sapiens
ctagtgctccatagtttggcat

SEQ ID NO: 5401789 - DNA, 15 bp, Homo sapiens
ctagtgctgaagctt

SEQ ID NO: 5401790 - DNA, 12 bp, Homo sapiens
ctagtgctgctg

SEQ ID NO: 5401791 - DNA, 13 bp, Homo sapiens
ctagtgctgtgaa

SEQ ID NO: 5401792 - DNA, 17 bp, Homo sapiens
ctagtgctgtgaaaaaa

SEQ ID NO: 5401793 - DNA, 21 bp, Homo sapiens
ctagtgctttccttttttaaa

SEQ ID NO: 5401794 - DNA, 22 bp, Homo sapiens
ctagtgctttccttttttaaaa

SEQ ID NO: 5401795 - DNA, 23 bp, Homo sapiens
ctagtgctttccttttttaaaaa

SEQ ID NO: 5401796 - DNA, 15 bp, Homo sapiens
ctagtggaaagtcag

SEQ ID NO: 5401797 - DNA, 16 bp, Homo sapiens
ctagtggaaatgagcg

SEQ ID NO: 5401798 - DNA, 19 bp, Homo sapiens
ctagtggatgactgttgat

SEQ ID NO: 5401799 - DNA, 16 bp, Homo sapiens
ctagtggctgtccagt

SEQ ID NO: 5401800 - DNA, 19 bp, Homo sapiens
ctagtggctgtccagtgcc

SEQ ID NO: 5401801 - DNA, 23 bp, Homo sapiens
ctagtggctgttcatgctccaag

SEQ ID NO: 5401802 - DNA, 16 bp, Homo sapiens
ctagtggcttcctccg

SEQ ID NO: 5401803 - DNA, 18 bp, Homo sapiens
ctagtggcttcctccgtc

SEQ ID NO: 5401804 - DNA, 14 bp, Homo sapiens
ctagtggcttgtcc

SEQ ID NO: 5401805 - DNA, 17 bp, Homo sapiens
ctagtgggacagcccag

SEQ ID NO: 5401806 - DNA, 22 bp, Homo sapiens
ctagtgggacagcccagagcct

SEQ ID NO: 5401807 - DNA, 18 bp, Homo sapiens
ctagtggggtctccctct

SEQ ID NO: 5401808 - DNA, 19 bp, Homo sapiens
ctagtggggtctccctctc

SEQ ID NO: 5401809 - DNA, 19 bp, Homo sapiens
ctagtggggtgaacagctg

SEQ ID NO: 5401810 - DNA, 15 bp, Homo sapiens
ctagtggggtttcct

SEQ ID NO: 5401811 - DNA, 20 bp, Homo sapiens
ctagtgggttgacctttaaa

SEQ ID NO: 5401812 - DNA, 14 bp, Homo sapiens
ctagtggtctgatt

SEQ ID NO: 5401813 - DNA, 14 bp, Homo sapiens
ctagtggtctttgt

SEQ ID NO: 5401814 - DNA, 18 bp, Homo sapiens
ctagtggtctttgtaaga

SEQ ID NO: 5401815 - DNA, 16 bp, Homo sapiens
ctagtgtaacactgca

SEQ ID NO: 5401816 - DNA, 23 bp, Homo sapiens
ctagtgtacctcctctcagtgtt

SEQ ID NO: 5401817 - DNA, 15 bp, Homo sapiens
ctagtgtatcaaaat

SEQ ID NO: 5401818 - DNA, 17 bp, Homo sapiens
ctagtgtattcaacaga

SEQ ID NO: 5401819 - DNA, 14 bp, Homo sapiens
ctagtgtgactcct

SEQ ID NO: 5401820 - DNA, 19 bp, Homo sapiens
ctagtgtggtctgtaatat

SEQ ID NO: 5401821 - DNA, 17 bp, Homo sapiens
ctagtgtggtgtgtttg

SEQ ID NO: 5401822 - DNA, 21 bp, Homo sapiens
ctagtgtggtgtttcctggca

SEQ ID NO: 5401823 - DNA, 15 bp, Homo sapiens
ctagtgtgtgtgctt

SEQ ID NO: 5401824 - DNA, 13 bp, Homo sapiens
ctagtgtgtgttt

SEQ ID NO: 5401825 - DNA, 16 bp, Homo sapiens
ctagtgttaatccaga

SEQ ID NO: 5401826 - DNA, 14 bp, Homo sapiens
ctagtgttgcttgg

SEQ ID NO: 5401827 - DNA, 16 bp, Homo sapiens
ctagtgttgtatttct

SEQ ID NO: 5401828 - DNA, 19 bp, Homo sapiens
ctagtgttgtatttctata

SEQ ID NO: 5401829 - DNA, 21 bp, Homo sapiens
ctagtgtttaagtcatttttt

SEQ ID NO: 5401830 - DNA, 13 bp, Homo sapiens
ctagtgtttctag

SEQ ID NO: 5401831 - DNA, 15 bp, Homo sapiens
ctagtgtttctgcag

SEQ ID NO: 5401832 - DNA, 23 bp, Homo sapiens
ctagtgtttctgcagaggcagca

SEQ ID NO: 5401833 - DNA, 19 bp, Homo sapiens
ctagtgtttggctcacctt

SEQ ID NO: 5401834 - DNA, 20 bp, Homo sapiens
ctagttaacctagaagtatt

SEQ ID NO: 5401835 - DNA, 21 bp, Homo sapiens
ctagttaacctagaagtattt

SEQ ID NO: 5401836 - DNA, 13 bp, Homo sapiens
ctagttaataatt

SEQ ID NO: 5401837 - DNA, 15 bp, Homo sapiens
ctagttacccaccct

SEQ ID NO: 5401838 - DNA, 16 bp, Homo sapiens
ctagttacccacccta

SEQ ID NO: 5401839 - DNA, 15 bp, Homo sapiens
ctagttagagactcg

SEQ ID NO: 5401840 - DNA, 16 bp, Homo sapiens
ctagttagcaggaaat

SEQ ID NO: 5401841 - DNA, 17 bp, Homo sapiens
ctagttagcatacacat

SEQ ID NO: 5401842 - DNA, 19 bp, Homo sapiens
ctagttagcatccaggctg

SEQ ID NO: 5401843 - DNA, 21 bp, Homo sapiens
ctagttagctcacaagccgtg

SEQ ID NO: 5401844 - DNA, 20 bp, Homo sapiens
ctagttagctgctttaaatc

SEQ ID NO: 5401845 - DNA, 16 bp, Homo sapiens
ctagttatacttattt

SEQ ID NO: 5401846 - DNA, 22 bp, Homo sapiens
ctagttatcaaggggatgattt

SEQ ID NO: 5401847 - DNA, 22 bp, Homo sapiens
ctagttattggatcagtgaaaa

SEQ ID NO: 5401848 - DNA, 20 bp, Homo sapiens
ctagttatttacaggaactt

SEQ ID NO: 5401849 - DNA, 20 bp, Homo sapiens
ctagttatttattctgggaa

SEQ ID NO: 5401850 - DNA, 20 bp, Homo sapiens
ctagttattttataatcaat

SEQ ID NO: 5401851 - DNA, 15 bp, Homo sapiens
ctagttattttctga

SEQ ID NO: 5401852 - DNA, 20 bp, Homo sapiens
ctagttcaaaacaaccactt

SEQ ID NO: 5401853 - DNA, 20 bp, Homo sapiens
ctagttcagacactttggaa

SEQ ID NO: 5401854 - DNA, 17 bp, Homo sapiens
ctagttcagaggaagca

SEQ ID NO: 5401855 - DNA, 22 bp, Homo sapiens
ctagttcatccaatcctcactg

SEQ ID NO: 5401856 - DNA, 18 bp, Homo sapiens
ctagttccaccatcaagc

SEQ ID NO: 5401857 - DNA, 20 bp, Homo sapiens
ctagttccaccatcaagcca

SEQ ID NO: 5401858 - DNA, 22 bp, Homo sapiens
ctagttccaccatcaagccacc

SEQ ID NO: 5401859 - DNA, 17 bp, Homo sapiens
ctagttccattcttggt

SEQ ID NO: 5401860 - DNA, 23 bp, Homo sapiens
ctagttccccgtgaacttccttt

SEQ ID NO: 5401861 - DNA, 21 bp, Homo sapiens
ctagttcccctgtttattcat

SEQ ID NO: 5401862 - DNA, 16 bp, Homo sapiens
ctagttccctcagtgt

SEQ ID NO: 5401863 - DNA, 24 bp, Homo sapiens
ctagttccctcagtgtgaagcctg

SEQ ID NO: 5401864 - DNA, 15 bp, Homo sapiens
ctagttctaatttca

SEQ ID NO: 5401865 - DNA, 12 bp, Homo sapiens
ctagttctagat

SEQ ID NO: 5401866 - DNA, 22 bp, Homo sapiens
ctagttctcagcttgcagctgg

SEQ ID NO: 5401867 - DNA, 18 bp, Homo sapiens
ctagttctcttgtcctgt

SEQ ID NO: 5401868 - DNA, 17 bp, Homo sapiens
ctagttctgctgccctc

SEQ ID NO: 5401869 - DNA, 17 bp, Homo sapiens
ctagttctgtagaaatg

SEQ ID NO: 5401870 - DNA, 23 bp, Homo sapiens
ctagttctgtagaaatggttgta

SEQ ID NO: 5401871 - DNA, 17 bp, Homo sapiens
ctagttcttaagcattt

SEQ ID NO: 5401872 - DNA, 21 bp, Homo sapiens
ctagttctttcctccccctgc

SEQ ID NO: 5401873 - DNA, 12 bp, Homo sapiens
ctagttgaatac

SEQ ID NO: 5401874 - DNA, 18 bp, Homo sapiens
ctagttgaatacttgaac

SEQ ID NO: 5401875 - DNA, 21 bp, Homo sapiens
ctagttgaatacttgaaccat

SEQ ID NO: 5401876 - DNA, 23 bp, Homo sapiens
ctagttgaatacttgaaccataa

SEQ ID NO: 5401877 - DNA, 14 bp, Homo sapiens
ctagttgacttcaa

SEQ ID NO: 5401878 - DNA, 23 bp, Homo sapiens
ctagttgatcagcttattgtcta

SEQ ID NO: 5401879 - DNA, 21 bp, Homo sapiens
ctagttgcccccattcccagc

SEQ ID NO: 5401880 - DNA, 21 bp, Homo sapiens
ctagttgccctctacctgact

SEQ ID NO: 5401881 - DNA, 16 bp, Homo sapiens
ctagttgctcttgctt

SEQ ID NO: 5401882 - DNA, 17 bp, Homo sapiens
ctagttggttgaatttt

SEQ ID NO: 5401883 - DNA, 13 bp, Homo sapiens
ctagttgtgaatt

SEQ ID NO: 5401884 - DNA, 15 bp, Homo sapiens
ctagttgttatcaat

SEQ ID NO: 5401885 - DNA, 23 bp, Homo sapiens
ctagttgtttgattcagacagct

SEQ ID NO: 5401886 - DNA, 22 bp, Homo sapiens
ctagttgtttgggctttaacat

SEQ ID NO: 5401887 - DNA, 21 bp, Homo sapiens
ctagtttacagaaaaatcttg

SEQ ID NO: 5401888 - DNA, 15 bp, Homo sapiens
ctagtttacttgctc

SEQ ID NO: 5401889 - DNA, 16 bp, Homo sapiens
ctagtttacttgctcg

SEQ ID NO: 5401890 - DNA, 21 bp, Homo sapiens
ctagtttatggttctgcagtc

SEQ ID NO: 5401891 - DNA, 12 bp, Homo sapiens
ctagtttattct

SEQ ID NO: 5401892 - DNA, 21 bp, Homo sapiens
ctagtttcagtaaataatgaa

SEQ ID NO: 5401893 - DNA, 22 bp, Homo sapiens
ctagtttcagtaaataatgaaa

SEQ ID NO: 5401894 - DNA, 11 bp, Homo sapiens
ctagtttcctg

SEQ ID NO: 5401895 - DNA, 16 bp, Homo sapiens
ctagtttcctggttcc

SEQ ID NO: 5401896 - DNA, 18 bp, Homo sapiens
ctagtttcttacacactg

SEQ ID NO: 5401897 - DNA, 22 bp, Homo sapiens
ctagtttcttacacactgtctg

SEQ ID NO: 5401898 - DNA, 18 bp, Homo sapiens
ctagtttgtgagaaacat

SEQ ID NO: 5401899 - DNA, 14 bp, Homo sapiens
ctagttttacagat

SEQ ID NO: 5401900 - DNA, 21 bp, Homo sapiens
ctagttttacagattgcctcc

SEQ ID NO: 5401901 - DNA, 16 bp, Homo sapiens
ctagttttactttgaa

SEQ ID NO: 5401902 - DNA, 17 bp, Homo sapiens
ctagttttatgtttctt

SEQ ID NO: 5401903 - DNA, 19 bp, Homo sapiens
ctagttttcagtttgtata

SEQ ID NO: 5401904 - DNA, 20 bp, Homo sapiens
ctagttttctcctcccagga

SEQ ID NO: 5401905 - DNA, 16 bp, Homo sapiens
ctagttttctttcctc

SEQ ID NO: 5401906 - DNA, 12 bp, Homo sapiens
ctagtttttaat

SEQ ID NO: 5401907 - DNA, 22 bp, Homo sapiens
ctagtttttagtaatctgtaca

SEQ ID NO: 5401908 - DNA, 23 bp, Homo sapiens
ctagttttttcttccttttcact

SEQ ID NO: 5401909 - DNA, 15 bp, Homo sapiens
ctagttttttttgta

SEQ ID NO: 5401910 - DNA, 16 bp, Homo sapiens
ctagttttttttgtaa

SEQ ID NO: 5401911 - DNA, 19 bp, Homo sapiens
ctagttttttttgtaaact

SEQ ID NO: 5401912 - DNA, 15 bp, Homo sapiens
ctataaaaaatatgt

SEQ ID NO: 5401913 - DNA, 23 bp, Homo sapiens
ctataaaaatgcccctcccagat

SEQ ID NO: 5401914 - DNA, 12 bp, Homo sapiens
ctataaaacaaa

SEQ ID NO: 5401915 - DNA, 17 bp, Homo sapiens
ctataaaactaggtgct

SEQ ID NO: 5401916 - DNA, 16 bp, Homo sapiens
ctataaaactttctgt

SEQ ID NO: 5401917 - DNA, 19 bp, Homo sapiens
ctataaaagctttctgcca

SEQ ID NO: 5401918 - DNA, 14 bp, Homo sapiens
ctataaaagtgata

SEQ ID NO: 5401919 - DNA, 15 bp, Homo sapiens
ctataaaataaactt

SEQ ID NO: 5401920 - DNA, 17 bp, Homo sapiens
ctataaaataaacttct

SEQ ID NO: 5401921 - DNA, 20 bp, Homo sapiens
ctataaaataaacttcttaa

SEQ ID NO: 5401922 - DNA, 11 bp, Homo sapiens
ctataaaatag

SEQ ID NO: 5401923 - DNA, 13 bp, Homo sapiens
ctataaaatagat

SEQ ID NO: 5401924 - DNA, 13 bp, Homo sapiens
ctataaaatgagg

SEQ ID NO: 5401925 - DNA, 24 bp, Homo sapiens
ctataaaatgcagtaacattctac

SEQ ID NO: 5401926 - DNA, 16 bp, Homo sapiens
ctataaaatgcccatt

SEQ ID NO: 5401927 - DNA, 20 bp, Homo sapiens
ctataaaatgcccatttcga

SEQ ID NO: 5401928 - DNA, 14 bp, Homo sapiens
ctataaaattaaat

SEQ ID NO: 5401929 - DNA, 17 bp, Homo sapiens
ctataaaattaaatgcc

SEQ ID NO: 5401930 - DNA, 17 bp, Homo sapiens
ctataaacaattacatg

SEQ ID NO: 5401931 - DNA, 14 bp, Homo sapiens
ctataaacactgtt

SEQ ID NO: 5401932 - DNA, 15 bp, Homo sapiens
ctataaactactgta

SEQ ID NO: 5401933 - DNA, 16 bp, Homo sapiens
ctataaactactgtaa

SEQ ID NO: 5401934 - DNA, 19 bp, Homo sapiens
ctataaactactgtaatta

SEQ ID NO: 5401935 - DNA, 21 bp, Homo sapiens
ctataaagaaaagagggagag

SEQ ID NO: 5401936 - DNA, 21 bp, Homo sapiens
ctataaagaaacttttgaaaa

SEQ ID NO: 5401937 - DNA, 23 bp, Homo sapiens
ctataaagaagaacttgcatgga

SEQ ID NO: 5401938 - DNA, 19 bp, Homo sapiens
ctataaagagaagacgaaa

SEQ ID NO: 5401939 - DNA, 19 bp, Homo sapiens
ctataaagcagtatttttc

SEQ ID NO: 5401940 - DNA, 11 bp, Homo sapiens
ctataaagcat

SEQ ID NO: 5401941 - DNA, 13 bp, Homo sapiens
ctataaagctgtt

SEQ ID NO: 5401942 - DNA, 14 bp, Homo sapiens
ctataaagctgtta

SEQ ID NO: 5401943 - DNA, 18 bp, Homo sapiens
ctataaagggtcaggccc

SEQ ID NO: 5401944 - DNA, 17 bp, Homo sapiens
ctataaagtaaagctaa

SEQ ID NO: 5401945 - DNA, 15 bp, Homo sapiens
ctataaagtatatat

SEQ ID NO: 5401946 - DNA, 16 bp, Homo sapiens
ctataaagtgtttatg

SEQ ID NO: 5401947 - DNA, 17 bp, Homo sapiens
ctataaatacaaatctg

SEQ ID NO: 5401948 - DNA, 21 bp, Homo sapiens
ctataaatacaaatctgtata

SEQ ID NO: 5401949 - DNA, 18 bp, Homo sapiens
ctataaatagtattccaa

SEQ ID NO: 5401950 - DNA, 18 bp, Homo sapiens
ctataaatatattgtata

SEQ ID NO: 5401951 - DNA, 12 bp, Homo sapiens
ctataaatgaaa

SEQ ID NO: 5401952 - DNA, 13 bp, Homo sapiens
ctataaatgacta

SEQ ID NO: 5401953 - DNA, 16 bp, Homo sapiens
ctataaatgactattg

SEQ ID NO: 5401954 - DNA, 22 bp, Homo sapiens
ctataaatgatatctatattct

SEQ ID NO: 5401955 - DNA, 19 bp, Homo sapiens
ctataaatggacttgcttc

SEQ ID NO: 5401956 - DNA, 16 bp, Homo sapiens
ctataaatggtgtttt

SEQ ID NO: 5401957 - DNA, 23 bp, Homo sapiens
ctataaatggtgtttttttaata

SEQ ID NO: 5401958 - DNA, 14 bp, Homo sapiens
ctataaatgttgct

SEQ ID NO: 5401959 - DNA, 22 bp, Homo sapiens
ctataaattcaacacttatttt

SEQ ID NO: 5401960 - DNA, 15 bp, Homo sapiens
ctataaattcctctt

SEQ ID NO: 5401961 - DNA, 16 bp, Homo sapiens
ctatcatttttacact

SEQ ID NO: 5401962 - DNA, 15 bp, Homo sapiens
ctatcatttttgtac

SEQ ID NO: 5401963 - DNA, 18 bp, Homo sapiens
ctatcatttttgtacagt

SEQ ID NO: 5401964 - DNA, 22 bp, Homo sapiens
ctatcatttttgtacagtttgc

SEQ ID NO: 5401965 - DNA, 18 bp, Homo sapiens
ctatccaaacatgtattt

SEQ ID NO: 5401966 - DNA, 18 bp, Homo sapiens
ctatccaaagaacttgat

SEQ ID NO: 5401967 - DNA, 13 bp, Homo sapiens
ctatccaaataaa

SEQ ID NO: 5401968 - DNA, 14 bp, Homo sapiens
ctatccaaataaaa

SEQ ID NO: 5401969 - DNA, 19 bp, Homo sapiens
ctatccaacttatatttct

SEQ ID NO: 5401970 - DNA, 15 bp, Homo sapiens
ctatccacactgtca

SEQ ID NO: 5401971 - DNA, 13 bp, Homo sapiens
ctatccacagaga

SEQ ID NO: 5401972 - DNA, 19 bp, Homo sapiens
ctatccacagagagtccca

SEQ ID NO: 5401973 - DNA, 12 bp, Homo sapiens
ctatccacccag

SEQ ID NO: 5401974 - DNA, 14 bp, Homo sapiens
ctatccacccagcc

SEQ ID NO: 5401975 - DNA, 15 bp, Homo sapiens
ctatccacccagccc

SEQ ID NO: 5401976 - DNA, 16 bp, Homo sapiens
ctatccacccagccca

SEQ ID NO: 5401977 - DNA, 23 bp, Homo sapiens
ctatccagtgacttgttctgagt

SEQ ID NO: 5401978 - DNA, 22 bp, Homo sapiens
ctatccatcatgaccagcaaat

SEQ ID NO: 5401979 - DNA, 15 bp, Homo sapiens
ctatccatgcaccaa

SEQ ID NO: 5401980 - DNA, 16 bp, Homo sapiens
ctatccatgcaccaaa

SEQ ID NO: 5401981 - DNA, 17 bp, Homo sapiens
ctatccatgcaccaaac

SEQ ID NO: 5401982 - DNA, 18 bp, Homo sapiens
ctatccatgcaccaaact

SEQ ID NO: 5401983 - DNA, 14 bp, Homo sapiens
ctatcccaaaccta

SEQ ID NO: 5401984 - DNA, 16 bp, Homo sapiens
ctatcccaatcaaaga

SEQ ID NO: 5401985 - DNA, 18 bp, Homo sapiens
ctatcccacccaacagct

SEQ ID NO: 5401986 - DNA, 14 bp, Homo sapiens
ctatcccatcccat

SEQ ID NO: 5401987 - DNA, 14 bp, Homo sapiens
ctatccccatccag

SEQ ID NO: 5401988 - DNA, 18 bp, Homo sapiens
ctatccccatctccctgc

SEQ ID NO: 5401989 - DNA, 23 bp, Homo sapiens
ctatccccatctccctgcctggc

SEQ ID NO: 5401990 - DNA, 12 bp, Homo sapiens
ctatccccctta

SEQ ID NO: 5401991 - DNA, 17 bp, Homo sapiens
ctatcccccttaaagaa

SEQ ID NO: 5401992 - DNA, 19 bp, Homo sapiens
ctatcccccttaaagaaaa

SEQ ID NO: 5401993 - DNA, 14 bp, Homo sapiens
ctatccctcacaca

SEQ ID NO: 5401994 - DNA, 20 bp, Homo sapiens
ctatccctggacgcatgcag

SEQ ID NO: 5401995 - DNA, 20 bp, Homo sapiens
ctatccctggcttccccttc

SEQ ID NO: 5401996 - DNA, 15 bp, Homo sapiens
ctatccctgtacaga

SEQ ID NO: 5401997 - DNA, 15 bp, Homo sapiens
ctatcccttctcaga

SEQ ID NO: 5401998 - DNA, 15 bp, Homo sapiens
ctatccgtgttgcag

SEQ ID NO: 5401999 - DNA, 17 bp, Homo sapiens
ctatccgtgttgcaggt

SEQ ID NO: 5402000 - DNA, 17 bp, Homo sapiens
ctatcctaaataaaaaa

SEQ ID NO: 5402001 - DNA, 18 bp, Homo sapiens
ctatcctacaaggcctat

SEQ ID NO: 5402002 - DNA, 16 bp, Homo sapiens
ctatcctagagaggct

SEQ ID NO: 5402003 - DNA, 19 bp, Homo sapiens
ctatcctagagaggctggc

SEQ ID NO: 5402004 - DNA, 12 bp, Homo sapiens
ctatcctctctc

SEQ ID NO: 5402005 - DNA, 12 bp, Homo sapiens
ctatcctctgta

SEQ ID NO: 5402006 - DNA, 13 bp, Homo sapiens
ctatcctctgtaa

SEQ ID NO: 5402007 - DNA, 23 bp, Homo sapiens
ctatcctgacttctaatatcatt

SEQ ID NO: 5402008 - DNA, 17 bp, Homo sapiens
ctatcctgattccaaat

SEQ ID NO: 5402009 - DNA, 18 bp, Homo sapiens
ctatcctgattccaaata

SEQ ID NO: 5402010 - DNA, 14 bp, Homo sapiens
ctatcctgcaccct

SEQ ID NO: 5402011 - DNA, 16 bp, Homo sapiens
ctatcctgcaccctct

SEQ ID NO: 5402012 - DNA, 14 bp, Homo sapiens
ctatcctgctgaaa

SEQ ID NO: 5402013 - DNA, 18 bp, Homo sapiens
ctatcctggctttgccca

SEQ ID NO: 5402014 - DNA, 21 bp, Homo sapiens
ctatcctggctttgcccaacc

SEQ ID NO: 5402015 - DNA, 22 bp, Homo sapiens
ctatcctggctttgcccaacct

SEQ ID NO: 5402016 - DNA, 11 bp, Homo sapiens
ctatcctggga

SEQ ID NO: 5402017 - DNA, 17 bp, Homo sapiens
ctatcctgggcttttgt

SEQ ID NO: 5402018 - DNA, 18 bp, Homo sapiens
ctatcctgtaaatatatc

SEQ ID NO: 5402019 - DNA, 22 bp, Homo sapiens
ctatcctgtgaggcttttaatt

SEQ ID NO: 5402020 - DNA, 17 bp, Homo sapiens
ctatcctgtttaataaa

SEQ ID NO: 5402021 - DNA, 13 bp, Homo sapiens
ctatccttccagg

SEQ ID NO: 5402022 - DNA, 13 bp, Homo sapiens
ctatccttcgtga

SEQ ID NO: 5402023 - DNA, 19 bp, Homo sapiens
ctatccttggagagcagct

SEQ ID NO: 5402024 - DNA, 22 bp, Homo sapiens
ctatccttggctttcagagcca

SEQ ID NO: 5402025 - DNA, 14 bp, Homo sapiens
ctatcctttcaaac

SEQ ID NO: 5402026 - DNA, 16 bp, Homo sapiens
ctatccttttgcctgc

SEQ ID NO: 5402027 - DNA, 21 bp, Homo sapiens
ctatccttttgcctgcaggtc

SEQ ID NO: 5402028 - DNA, 19 bp, Homo sapiens
ctatccttttttcctttcc

SEQ ID NO: 5402029 - DNA, 22 bp, Homo sapiens
ctatccttttttcctttcctga

SEQ ID NO: 5402030 - DNA, 13 bp, Homo sapiens
ctatcgactttat

SEQ ID NO: 5402031 - DNA, 18 bp, Homo sapiens
ctatcgccctcctttccc

SEQ ID NO: 5402032 - DNA, 20 bp, Homo sapiens
ctatcgccctcctttccctt

SEQ ID NO: 5402033 - DNA, 22 bp, Homo sapiens
ctatcgccctcctttcccttat

SEQ ID NO: 5402034 - DNA, 13 bp, Homo sapiens
ctatcggaagaac

SEQ ID NO: 5402035 - DNA, 17 bp, Homo sapiens
ctatcgtaaaattaaga

SEQ ID NO: 5402036 - DNA, 18 bp, Homo sapiens
ctatcgttattataaatg

SEQ ID NO: 5402037 - DNA, 21 bp, Homo sapiens
ctatcgttattataaatgtta

SEQ ID NO: 5402038 - DNA, 13 bp, Homo sapiens
ctatctaaagttt

SEQ ID NO: 5402039 - DNA, 14 bp, Homo sapiens
ctatctaaatgttg

SEQ ID NO: 5402040 - DNA, 21 bp, Homo sapiens
ctatctaagacaatcacgctg

SEQ ID NO: 5402041 - DNA, 16 bp, Homo sapiens
ctatctaccttccttc

SEQ ID NO: 5402042 - DNA, 15 bp, Homo sapiens
ctatctactaagttt

SEQ ID NO: 5402043 - DNA, 16 bp, Homo sapiens
ctatctactctcctca

SEQ ID NO: 5402044 - DNA, 16 bp, Homo sapiens
ctatctagatagctga

SEQ ID NO: 5402045 - DNA, 20 bp, Homo sapiens
ctatctaggtggagttgaaa

SEQ ID NO: 5402046 - DNA, 13 bp, Homo sapiens
ctatctagtgtct

SEQ ID NO: 5402047 - DNA, 17 bp, Homo sapiens
ctatctatacctgcctt

SEQ ID NO: 5402048 - DNA, 16 bp, Homo sapiens
ctatctatataatgta

SEQ ID NO: 5402049 - DNA, 23 bp, Homo sapiens
ctatctatatatacatatacaca

SEQ ID NO: 5402050 - DNA, 16 bp, Homo sapiens
ctatctatgtcctgga

SEQ ID NO: 5402051 - DNA, 21 bp, Homo sapiens
ctatctattaaagtgactttc

SEQ ID NO: 5402052 - DNA, 14 bp, Homo sapiens
ctatctcacactgc

SEQ ID NO: 5402053 - DNA, 16 bp, Homo sapiens
ctatctcacactgcac

SEQ ID NO: 5402054 - DNA, 14 bp, Homo sapiens
ctatctcagagata

SEQ ID NO: 5402055 - DNA, 14 bp, Homo sapiens
ctatctcagccata

SEQ ID NO: 5402056 - DNA, 16 bp, Homo sapiens
ctatctcatctgtctc

SEQ ID NO: 5402057 - DNA, 23 bp, Homo sapiens
ctatctccaaatgagacacatta

SEQ ID NO: 5402058 - DNA, 13 bp, Homo sapiens
ctatctcccacaa

SEQ ID NO: 5402059 - DNA, 22 bp, Homo sapiens
ctatctcccccaacccacctct

SEQ ID NO: 5402060 - DNA, 14 bp, Homo sapiens
ctatctcccccagc

SEQ ID NO: 5402061 - DNA, 18 bp, Homo sapiens
ctatctcccccagcccca

SEQ ID NO: 5402062 - DNA, 15 bp, Homo sapiens
ctatctccctgcctc

SEQ ID NO: 5402063 - DNA, 14 bp, Homo sapiens
ctatctcctgacag

SEQ ID NO: 5402064 - DNA, 15 bp, Homo sapiens
ctatctcctgacaga

SEQ ID NO: 5402065 - DNA, 18 bp, Homo sapiens
ctatctctagagtgagaa

SEQ ID NO: 5402066 - DNA, 19 bp, Homo sapiens
ctatctctattattggaaa

SEQ ID NO: 5402067 - DNA, 21 bp, Homo sapiens
ctatctctgtgtgcacaaata

SEQ ID NO: 5402068 - DNA, 16 bp, Homo sapiens
ctatctcttcctgtct

SEQ ID NO: 5402069 - DNA, 13 bp, Homo sapiens
ctatctctttctt

SEQ ID NO: 5402070 - DNA, 18 bp, Homo sapiens
ctatctgaaagtaaagtt

SEQ ID NO: 5402071 - DNA, 17 bp, Homo sapiens
ctatctgacttcataca

SEQ ID NO: 5402072 - DNA, 18 bp, Homo sapiens
ctatctgattttgtgcaa

SEQ ID NO: 5402073 - DNA, 20 bp, Homo sapiens
ctatctgcaaatagtttcaa

SEQ ID NO: 5402074 - DNA, 18 bp, Homo sapiens
ctatctgcactctaaact

SEQ ID NO: 5402075 - DNA, 15 bp, Homo sapiens
ctatctgcattatct

SEQ ID NO: 5402076 - DNA, 18 bp, Homo sapiens
ctatctgccaaattgaga

SEQ ID NO: 5402077 - DNA, 12 bp, Homo sapiens
ctatctgcctga

SEQ ID NO: 5402078 - DNA, 23 bp, Homo sapiens
ctatctggaggccttccagctgc

SEQ ID NO: 5402079 - DNA, 24 bp, Homo sapiens
ctatctggccatatttactacctt

SEQ ID NO: 5402080 - DNA, 15 bp, Homo sapiens
ctatctgggcctggg

SEQ ID NO: 5402081 - DNA, 21 bp, Homo sapiens
ctatctgggcttcctggagca

SEQ ID NO: 5402082 - DNA, 18 bp, Homo sapiens
ctatctggggagctcctg

SEQ ID NO: 5402083 - DNA, 21 bp, Homo sapiens
ctatctggggagctcctggcc

SEQ ID NO: 5402084 - DNA, 22 bp, Homo sapiens
ctatctgtaagaggtactaaaa

SEQ ID NO: 5402085 - DNA, 12 bp, Homo sapiens
ctatctgtattt

SEQ ID NO: 5402086 - DNA, 21 bp, Homo sapiens
ctatctgtctggtggccccgt

SEQ ID NO: 5402087 - DNA, 19 bp, Homo sapiens
ctatctgtgaagttacact

SEQ ID NO: 5402088 - DNA, 14 bp, Homo sapiens
ctatctgtgttttg

SEQ ID NO: 5402089 - DNA, 16 bp, Homo sapiens
ctatctgttcctatct

SEQ ID NO: 5402090 - DNA, 15 bp, Homo sapiens
ctatctgttgaaaag

SEQ ID NO: 5402091 - DNA, 20 bp, Homo sapiens
ctatctgtttacagtgttcc

SEQ ID NO: 5402092 - DNA, 21 bp, Homo sapiens
ctatctgtttacagtgttccg

SEQ ID NO: 5402093 - DNA, 13 bp, Homo sapiens
ctatcttaaaata

SEQ ID NO: 5402094 - DNA, 19 bp, Homo sapiens
ctatcttaaaatatagaaa

SEQ ID NO: 5402095 - DNA, 22 bp, Homo sapiens
ctatcttaattttggttgtatt

SEQ ID NO: 5402096 - DNA, 18 bp, Homo sapiens
ctatcttactatttcaca

SEQ ID NO: 5402097 - DNA, 21 bp, Homo sapiens
ctatcttagtggttccccacc

SEQ ID NO: 5402098 - DNA, 14 bp, Homo sapiens
ctatcttcatgtaa

SEQ ID NO: 5402099 - DNA, 20 bp, Homo sapiens
ctatcttcatgtaaattgac

SEQ ID NO: 5402100 - DNA, 13 bp, Homo sapiens
ctatcttccaaat

SEQ ID NO: 5402101 - DNA, 14 bp, Homo sapiens
ctatcttccaaatg

SEQ ID NO: 5402102 - DNA, 12 bp, Homo sapiens
ctatcttctcca

SEQ ID NO: 5402103 - DNA, 18 bp, Homo sapiens
ctatcttcttcaaataca

SEQ ID NO: 5402104 - DNA, 22 bp, Homo sapiens
ctatcttctttggacttctgaa

SEQ ID NO: 5402105 - DNA, 17 bp, Homo sapiens
ctatcttgctctgtaat

SEQ ID NO: 5402106 - DNA, 12 bp, Homo sapiens
ctatctttgcca

SEQ ID NO: 5402107 - DNA, 14 bp, Homo sapiens
ctatctttgctgca

SEQ ID NO: 5402108 - DNA, 15 bp, Homo sapiens
ctatcttttatttca

SEQ ID NO: 5402109 - DNA, 14 bp, Homo sapiens
ctatcttttcatct

SEQ ID NO: 5402110 - DNA, 19 bp, Homo sapiens
ctatcttttgtttcctttt

SEQ ID NO: 5402111 - DNA, 18 bp, Homo sapiens
ctatctttttgaaagcaa

SEQ ID NO: 5402112 - DNA, 16 bp, Homo sapiens
ctatgaaaagctagaa

SEQ ID NO: 5402113 - DNA, 21 bp, Homo sapiens
ctatgaaaagctagaattgag

SEQ ID NO: 5402114 - DNA, 13 bp, Homo sapiens
ctatgaaaatgag

SEQ ID NO: 5402115 - DNA, 15 bp, Homo sapiens
ctatgaaaatgagcc

SEQ ID NO: 5402116 - DNA, 19 bp, Homo sapiens
ctatgaaaatgagccctgg

SEQ ID NO: 5402117 - DNA, 17 bp, Homo sapiens
ctatgaaacaatcttcc

SEQ ID NO: 5402118 - DNA, 20 bp, Homo sapiens
ctatgaaacaatcttccaaa

SEQ ID NO: 5402119 - DNA, 17 bp, Homo sapiens
ctatgaaatactttata

SEQ ID NO: 5402120 - DNA, 13 bp, Homo sapiens
ctatgaaatatta

SEQ ID NO: 5402121 - DNA, 18 bp, Homo sapiens
ctatgaaatattatgtta

SEQ ID NO: 5402122 - DNA, 12 bp, Homo sapiens
ctatgaacaact

SEQ ID NO: 5402123 - DNA, 14 bp, Homo sapiens
ctatgaacagacca

SEQ ID NO: 5402124 - DNA, 13 bp, Homo sapiens
ctatgaacttgtc

SEQ ID NO: 5402125 - DNA, 18 bp, Homo sapiens
ctatgaagacttaaaaga

SEQ ID NO: 5402126 - DNA, 15 bp, Homo sapiens
ctatgaagagaagga

SEQ ID NO: 5402127 - DNA, 19 bp, Homo sapiens
ctatgaagggacagctgct

SEQ ID NO: 5402128 - DNA, 19 bp, Homo sapiens
ctatgaagtaaagaactgc

SEQ ID NO: 5402129 - DNA, 23 bp, Homo sapiens
ctatgaagtatataatggtttca

SEQ ID NO: 5402130 - DNA, 22 bp, Homo sapiens
ctatgaagttgctgtttatttt

SEQ ID NO: 5402131 - DNA, 19 bp, Homo sapiens
ctatgaagttggcacattt

SEQ ID NO: 5402132 - DNA, 23 bp, Homo sapiens
ctatgaagtttattttctatttt

SEQ ID NO: 5402133 - DNA, 20 bp, Homo sapiens
ctatgaatctattatactgt

SEQ ID NO: 5402134 - DNA, 23 bp, Homo sapiens
ctatgaatgggcaaaactgaatt

SEQ ID NO: 5402135 - DNA, 16 bp, Homo sapiens
ctatgacaatcttatt

SEQ ID NO: 5402136 - DNA, 16 bp, Homo sapiens
ctatgacaatttttgc

SEQ ID NO: 5402137 - DNA, 23 bp, Homo sapiens
ctatgacagatatatttaagcct

SEQ ID NO: 5402138 - DNA, 15 bp, Homo sapiens
ctatgacagctggct

SEQ ID NO: 5402139 - DNA, 14 bp, Homo sapiens
ctatgacatttcta

SEQ ID NO: 5402140 - DNA, 15 bp, Homo sapiens
ctattccaataaact

SEQ ID NO: 5402141 - DNA, 13 bp, Homo sapiens
ctattccagctca

SEQ ID NO: 5402142 - DNA, 12 bp, Homo sapiens
ctattccaggaa

SEQ ID NO: 5402143 - DNA, 19 bp, Homo sapiens
ctattccaggaattcctct

SEQ ID NO: 5402144 - DNA, 13 bp, Homo sapiens
ctattccatgttt

SEQ ID NO: 5402145 - DNA, 15 bp, Homo sapiens
ctattccattccctt

SEQ ID NO: 5402146 - DNA, 17 bp, Homo sapiens
ctattccattcccttcg

SEQ ID NO: 5402147 - DNA, 16 bp, Homo sapiens
ctattcccatcgctgg

SEQ ID NO: 5402148 - DNA, 17 bp, Homo sapiens
ctattccccagcagggt

SEQ ID NO: 5402149 - DNA, 14 bp, Homo sapiens
ctattcctgaccct

SEQ ID NO: 5402150 - DNA, 16 bp, Homo sapiens
ctattcctgaccctcc

SEQ ID NO: 5402151 - DNA, 13 bp, Homo sapiens
ctattcctgagag

SEQ ID NO: 5402152 - DNA, 18 bp, Homo sapiens
ctattcctgtaaataaga

SEQ ID NO: 5402153 - DNA, 11 bp, Homo sapiens
ctattccttat

SEQ ID NO: 5402154 - DNA, 16 bp, Homo sapiens
ctattccttctggcct

SEQ ID NO: 5402155 - DNA, 23 bp, Homo sapiens
ctattccttctggcctttcctct

SEQ ID NO: 5402156 - DNA, 16 bp, Homo sapiens
ctattcctttcccttc

SEQ ID NO: 5402157 - DNA, 17 bp, Homo sapiens
ctattcctttcccttcc

SEQ ID NO: 5402158 - DNA, 19 bp, Homo sapiens
ctattcctttcccttcctc

SEQ ID NO: 5402159 - DNA, 17 bp, Homo sapiens
ctattccttttctgtat

SEQ ID NO: 5402160 - DNA, 21 bp, Homo sapiens
ctattcgccacacagtatttt

SEQ ID NO: 5402161 - DNA, 15 bp, Homo sapiens
ctattcgtaagttct

SEQ ID NO: 5402162 - DNA, 22 bp, Homo sapiens
ctattcgtagccatctccgtgg

SEQ ID NO: 5402163 - DNA, 14 bp, Homo sapiens
ctattctagagctt

SEQ ID NO: 5402164 - DNA, 14 bp, Homo sapiens
ctattctattgcag

SEQ ID NO: 5402165 - DNA, 19 bp, Homo sapiens
ctattctcaaagtttccta

SEQ ID NO: 5402166 - DNA, 16 bp, Homo sapiens
ctattctcatgcctca

SEQ ID NO: 5402167 - DNA, 12 bp, Homo sapiens
ctattctccaga

SEQ ID NO: 5402168 - DNA, 13 bp, Homo sapiens
ctattctccagaa

SEQ ID NO: 5402169 - DNA, 12 bp, Homo sapiens
ctattctctgcc

SEQ ID NO: 5402170 - DNA, 16 bp, Homo sapiens
ctattctgaaaaagac

SEQ ID NO: 5402171 - DNA, 19 bp, Homo sapiens
ctattctgaaaaagacata

SEQ ID NO: 5402172 - DNA, 16 bp, Homo sapiens
ctattctgagaaaaca

SEQ ID NO: 5402173 - DNA, 17 bp, Homo sapiens
ctattctgagaaaacaa

SEQ ID NO: 5402174 - DNA, 16 bp, Homo sapiens
ctattctgagatgact

SEQ ID NO: 5402175 - DNA, 13 bp, Homo sapiens
ctattctgagcct

SEQ ID NO: 5402176 - DNA, 16 bp, Homo sapiens
ctattctgagccttga

SEQ ID NO: 5402177 - DNA, 18 bp, Homo sapiens
ctattctgccactcctga

SEQ ID NO: 5402178 - DNA, 20 bp, Homo sapiens
ctattctgccatgggagagt

SEQ ID NO: 5402179 - DNA, 22 bp, Homo sapiens
ctattctgtcagtgttaaagat

SEQ ID NO: 5402180 - DNA, 15 bp, Homo sapiens
ctattctgtccctag

SEQ ID NO: 5402181 - DNA, 16 bp, Homo sapiens
ctattctgtccctagg

SEQ ID NO: 5402182 - DNA, 21 bp, Homo sapiens
ctattctgtttctaggctgtt

SEQ ID NO: 5402183 - DNA, 15 bp, Homo sapiens
ctattcttaagcact

SEQ ID NO: 5402184 - DNA, 17 bp, Homo sapiens
ctattcttcatttacaa

SEQ ID NO: 5402185 - DNA, 14 bp, Homo sapiens
ctattcttgatgta

SEQ ID NO: 5402186 - DNA, 19 bp, Homo sapiens
ctattcttgatgtaaaatc

SEQ ID NO: 5402187 - DNA, 20 bp, Homo sapiens
ctattcttgatgtaaaatct

SEQ ID NO: 5402188 - DNA, 22 bp, Homo sapiens
ctattcttgatgtaaaatcttg

SEQ ID NO: 5402189 - DNA, 23 bp, Homo sapiens
ctattcttggaccatgccagatt

SEQ ID NO: 5402190 - DNA, 17 bp, Homo sapiens
ctattcttgggaaacac

SEQ ID NO: 5402191 - DNA, 15 bp, Homo sapiens
ctattgaaaatatat

SEQ ID NO: 5402192 - DNA, 18 bp, Homo sapiens
ctattgaactgagccaaa

SEQ ID NO: 5402193 - DNA, 15 bp, Homo sapiens
ctattgaactgtatt

SEQ ID NO: 5402194 - DNA, 15 bp, Homo sapiens
ctattgaagatacac

SEQ ID NO: 5402195 - DNA, 16 bp, Homo sapiens
ctattgaagatgctgc

SEQ ID NO: 5402196 - DNA, 18 bp, Homo sapiens
ctattgaagatgctgcct

SEQ ID NO: 5402197 - DNA, 20 bp, Homo sapiens
ctattgaattcggaactgtc

SEQ ID NO: 5402198 - DNA, 16 bp, Homo sapiens
ctattgacaataaaat

SEQ ID NO: 5402199 - DNA, 22 bp, Homo sapiens
ctattgacatcagcatcaccta

SEQ ID NO: 5402200 - DNA, 17 bp, Homo sapiens
ctattgaccaccagtta

SEQ ID NO: 5402201 - DNA, 18 bp, Homo sapiens
ctattgacttttcaataa

SEQ ID NO: 5402202 - DNA, 16 bp, Homo sapiens
ctattgataatttaga

SEQ ID NO: 5402203 - DNA, 22 bp, Homo sapiens
ctattgatacaatattgtgcat

SEQ ID NO: 5402204 - DNA, 23 bp, Homo sapiens
ctattgatacaatattgtgcatg

SEQ ID NO: 5402205 - DNA, 14 bp, Homo sapiens
ctattgatactctt

SEQ ID NO: 5402206 - DNA, 18 bp, Homo sapiens
ctattgatgtttccagaa

SEQ ID NO: 5402207 - DNA, 19 bp, Homo sapiens
ctattgatgtttccagaaa

SEQ ID NO: 5402208 - DNA, 21 bp, Homo sapiens
ctattgatgtttccagaaaat

SEQ ID NO: 5402209 - DNA, 14 bp, Homo sapiens
ctattgatttgaaa

SEQ ID NO: 5402210 - DNA, 17 bp, Homo sapiens
ctattgcactccagtct

SEQ ID NO: 5402211 - DNA, 19 bp, Homo sapiens
ctattgcagagactcattt

SEQ ID NO: 5402212 - DNA, 20 bp, Homo sapiens
ctattgcagcaattaaaaat

SEQ ID NO: 5402213 - DNA, 17 bp, Homo sapiens
ctattgcagctgggaga

SEQ ID NO: 5402214 - DNA, 14 bp, Homo sapiens
ctattgcatgtaaa

SEQ ID NO: 5402215 - DNA, 17 bp, Homo sapiens
ctattgcatgtaaaatg

SEQ ID NO: 5402216 - DNA, 21 bp, Homo sapiens
ctattgcatgtaaaatgcagt

SEQ ID NO: 5402217 - DNA, 22 bp, Homo sapiens
ctattgcatgtaaaatgcagtc

SEQ ID NO: 5402218 - DNA, 14 bp, Homo sapiens
ctattgcatttata

SEQ ID NO: 5402219 - DNA, 17 bp, Homo sapiens
ctattgcatttatatgt

SEQ ID NO: 5402220 - DNA, 20 bp, Homo sapiens
ctattgccttctttgaagaa

SEQ ID NO: 5402221 - DNA, 20 bp, Homo sapiens
ctattgctgtaaataaaaat

SEQ ID NO: 5402222 - DNA, 22 bp, Homo sapiens
ctattgctgtaaataaaaatag

SEQ ID NO: 5402223 - DNA, 16 bp, Homo sapiens
ctattggaaaaaccac

SEQ ID NO: 5402224 - DNA, 22 bp, Homo sapiens
ctattggaatttttttttcctg

SEQ ID NO: 5402225 - DNA, 16 bp, Homo sapiens
ctattggacagacaca

SEQ ID NO: 5402226 - DNA, 15 bp, Homo sapiens
ctattggatttgtcc

SEQ ID NO: 5402227 - DNA, 20 bp, Homo sapiens
ctattggcctcccaaaagac

SEQ ID NO: 5402228 - DNA, 18 bp, Homo sapiens
ctattggcttactgaaag

SEQ ID NO: 5402229 - DNA, 16 bp, Homo sapiens
ctattgggacagcatg

SEQ ID NO: 5402230 - DNA, 22 bp, Homo sapiens
ctattgggagcaatctggaaaa

SEQ ID NO: 5402231 - DNA, 24 bp, Homo sapiens
ctattggtaatataataatgtcct

SEQ ID NO: 5402232 - DNA, 18 bp, Homo sapiens
ctattgtaagataaaaaa

SEQ ID NO: 5402233 - DNA, 19 bp, Homo sapiens
ctattgtaaggtctttgta

SEQ ID NO: 5402234 - DNA, 22 bp, Homo sapiens
ctattgtaaggtctttgtaaaa

SEQ ID NO: 5402235 - DNA, 18 bp, Homo sapiens
ctattgtaagttgttggt

SEQ ID NO: 5402236 - DNA, 21 bp, Homo sapiens
ctattgtaatcgtgtgccatg

SEQ ID NO: 5402237 - DNA, 15 bp, Homo sapiens
ctattgtaatgccaa

SEQ ID NO: 5402238 - DNA, 17 bp, Homo sapiens
ctattgtccttgtgtat

SEQ ID NO: 5402239 - DNA, 20 bp, Homo sapiens
ctattgtgacagagccatgg

SEQ ID NO: 5402240 - DNA, 14 bp, Homo sapiens
ctattgtgatttga

SEQ ID NO: 5402241 - DNA, 17 bp, Homo sapiens
ctattgtgatttgactg

SEQ ID NO: 5402242 - DNA, 22 bp, Homo sapiens
ctattgtgcaatgtaaatattt

SEQ ID NO: 5402243 - DNA, 23 bp, Homo sapiens
ctattgtgcacaagtctttccag

SEQ ID NO: 5402244 - DNA, 16 bp, Homo sapiens
ctattgtgccaactgc

SEQ ID NO: 5402245 - DNA, 16 bp, Homo sapiens
ctattgtgctttctat

SEQ ID NO: 5402246 - DNA, 20 bp, Homo sapiens
ctattgtgtggatgaccaca

SEQ ID NO: 5402247 - DNA, 14 bp, Homo sapiens
ctattgtgtggtcg

SEQ ID NO: 5402248 - DNA, 23 bp, Homo sapiens
ctattgtgttggctttacaaata

SEQ ID NO: 5402249 - DNA, 16 bp, Homo sapiens
ctattgttactctggt

SEQ ID NO: 5402250 - DNA, 12 bp, Homo sapiens
ctattgtttact

SEQ ID NO: 5402251 - DNA, 13 bp, Homo sapiens
ctatttaaaaaat

SEQ ID NO: 5402252 - DNA, 16 bp, Homo sapiens
ctatttaaaaaataaa

SEQ ID NO: 5402253 - DNA, 17 bp, Homo sapiens
ctatttaaaaaataaaa

SEQ ID NO: 5402254 - DNA, 18 bp, Homo sapiens
ctatttaaaaagctcttt

SEQ ID NO: 5402255 - DNA, 17 bp, Homo sapiens
ctatttaaaacttgtaa

SEQ ID NO: 5402256 - DNA, 21 bp, Homo sapiens
ctatttaaaagtataaaactg

SEQ ID NO: 5402257 - DNA, 12 bp, Homo sapiens
ctatttaaaata

SEQ ID NO: 5402258 - DNA, 14 bp, Homo sapiens
ctatttaaaataaa

SEQ ID NO: 5402259 - DNA, 23 bp, Homo sapiens
ctatttaaaatgctcaatttcag

SEQ ID NO: 5402260 - DNA, 15 bp, Homo sapiens
ctatttaaaattggc

SEQ ID NO: 5402261 - DNA, 16 bp, Homo sapiens
ctatttaaaattggca

SEQ ID NO: 5402262 - DNA, 20 bp, Homo sapiens
ctatttaaatccttggcttc

SEQ ID NO: 5402263 - DNA, 17 bp, Homo sapiens
ctatttaacaagatgtt

SEQ ID NO: 5402264 - DNA, 14 bp, Homo sapiens
ctatttaagatgtg

SEQ ID NO: 5402265 - DNA, 16 bp, Homo sapiens
ctatttaagattccca

SEQ ID NO: 5402266 - DNA, 16 bp, Homo sapiens
ctatttaagccccctc

SEQ ID NO: 5402267 - DNA, 12 bp, Homo sapiens
ctatttaatatt

SEQ ID NO: 5402268 - DNA, 13 bp, Homo sapiens
ctatttaatgttt

SEQ ID NO: 5402269 - DNA, 20 bp, Homo sapiens
ctatttaattctttctattt

SEQ ID NO: 5402270 - DNA, 20 bp, Homo sapiens
ctatttacatagtcatttag

SEQ ID NO: 5402271 - DNA, 20 bp, Homo sapiens
ctatttactggaaacctgtt

SEQ ID NO: 5402272 - DNA, 16 bp, Homo sapiens
ctatttagataacaag

SEQ ID NO: 5402273 - DNA, 17 bp, Homo sapiens
ctatttagtttttgtaa

SEQ ID NO: 5402274 - DNA, 20 bp, Homo sapiens
ctatttagtttttgtaattt

SEQ ID NO: 5402275 - DNA, 15 bp, Homo sapiens
ctatttataactaat

SEQ ID NO: 5402276 - DNA, 13 bp, Homo sapiens
ctatttataagtg

SEQ ID NO: 5402277 - DNA, 17 bp, Homo sapiens
ctatttataagtgactt

SEQ ID NO: 5402278 - DNA, 13 bp, Homo sapiens
ctatttatccctt

SEQ ID NO: 5402279 - DNA, 16 bp, Homo sapiens
ctatttatccctttcc

SEQ ID NO: 5402280 - DNA, 19 bp, Homo sapiens
ctatttatccctttcctgg

SEQ ID NO: 5402281 - DNA, 21 bp, Homo sapiens
ctatttatccctttcctggtt

SEQ ID NO: 5402282 - DNA, 22 bp, Homo sapiens
ctatttatctgtgtttttgaaa

SEQ ID NO: 5402283 - DNA, 16 bp, Homo sapiens
ctatttatgatttcaa

SEQ ID NO: 5402284 - DNA, 14 bp, Homo sapiens
ctatttatgtaaaa

SEQ ID NO: 5402285 - DNA, 16 bp, Homo sapiens
ctatttattagccaac

SEQ ID NO: 5402286 - DNA, 21 bp, Homo sapiens
ctatttattatcgcatacaga

SEQ ID NO: 5402287 - DNA, 16 bp, Homo sapiens
ctatttattcattcag

SEQ ID NO: 5402288 - DNA, 14 bp, Homo sapiens
ctatttattcctgt

SEQ ID NO: 5402289 - DNA, 18 bp, Homo sapiens
ctatttattgactttgac

SEQ ID NO: 5402290 - DNA, 22 bp, Homo sapiens
ctatttattgactttgacaatt

SEQ ID NO: 5402291 - DNA, 11 bp, Homo sapiens
ctatttattgg

SEQ ID NO: 5402292 - DNA, 14 bp, Homo sapiens
ctatttattggggt

SEQ ID NO: 5402293 - DNA, 15 bp, Homo sapiens
ctatttattgtgctg

SEQ ID NO: 5402294 - DNA, 14 bp, Homo sapiens
ctatttatttacaa

SEQ ID NO: 5402295 - DNA, 14 bp, Homo sapiens
ctatttatttactg

SEQ ID NO: 5402296 - DNA, 23 bp, Homo sapiens
ctatttatttatttattgaagat

SEQ ID NO: 5402297 - DNA, 15 bp, Homo sapiens
ctatttatttgaggt

SEQ ID NO: 5402298 - DNA, 16 bp, Homo sapiens
ctatttattttcctaa

SEQ ID NO: 5402299 - DNA, 17 bp, Homo sapiens
ctatttattttcctaaa

SEQ ID NO: 5402300 - DNA, 11 bp, Homo sapiens
ctatttcaata

SEQ ID NO: 5402301 - DNA, 13 bp, Homo sapiens
ctatttcaataac

SEQ ID NO: 5402302 - DNA, 20 bp, Homo sapiens
ctatttcaatacttacatat

SEQ ID NO: 5402303 - DNA, 14 bp, Homo sapiens
ctatttcagctgct

SEQ ID NO: 5402304 - DNA, 18 bp, Homo sapiens
ctatttcagctgctttga

SEQ ID NO: 5402305 - DNA, 15 bp, Homo sapiens
ctatttcatgttttt

SEQ ID NO: 5402306 - DNA, 13 bp, Homo sapiens
ctatttcattttt

SEQ ID NO: 5402307 - DNA, 17 bp, Homo sapiens
ctatttcccaagctgga

SEQ ID NO: 5402308 - DNA, 21 bp, Homo sapiens
ctatttccccaggggaaaatg

SEQ ID NO: 5402309 - DNA, 17 bp, Homo sapiens
ctatttcccctcttctg

SEQ ID NO: 5402310 - DNA, 15 bp, Homo sapiens
ctatttccttccagc

SEQ ID NO: 5402311 - DNA, 14 bp, Homo sapiens
ctatttcctttgcg

SEQ ID NO: 5402312 - DNA, 18 bp, Homo sapiens
ctatttcctttgcgcaaa

SEQ ID NO: 5402313 - DNA, 22 bp, Homo sapiens
ctatttcctttgcgcaaacttt

SEQ ID NO: 5402314 - DNA, 18 bp, Homo sapiens
ctatttcggaaatacact

SEQ ID NO: 5402315 - DNA, 19 bp, Homo sapiens
ctatttcggaaatacacta

SEQ ID NO: 5402316 - DNA, 12 bp, Homo sapiens
ctatttctacat

SEQ ID NO: 5402317 - DNA, 16 bp, Homo sapiens
ctatttctatgtcatt

SEQ ID NO: 5402318 - DNA, 15 bp, Homo sapiens
ctatttctcctccat

SEQ ID NO: 5402319 - DNA, 21 bp, Homo sapiens
ctcaagactttagcttttcct

SEQ ID NO: 5402320 - DNA, 22 bp, Homo sapiens
ctcaagactttagcttttcctt

SEQ ID NO: 5402321 - DNA, 15 bp, Homo sapiens
ctcaagactttgatc

SEQ ID NO: 5402322 - DNA, 21 bp, Homo sapiens
ctcaagactttgatccttgga

SEQ ID NO: 5402323 - DNA, 19 bp, Homo sapiens
ctcaagagatcccaagtag

SEQ ID NO: 5402324 - DNA, 17 bp, Homo sapiens
ctcaagagcacacagag

SEQ ID NO: 5402325 - DNA, 20 bp, Homo sapiens
ctcaagagcacacagagaag

SEQ ID NO: 5402326 - DNA, 21 bp, Homo sapiens
ctcaagagcacacagagaagg

SEQ ID NO: 5402327 - DNA, 20 bp, Homo sapiens
ctcaagagcataatggtaaa

SEQ ID NO: 5402328 - DNA, 18 bp, Homo sapiens
ctcaagaggaatctgttt

SEQ ID NO: 5402329 - DNA, 15 bp, Homo sapiens
ctcaagaggcccagg

SEQ ID NO: 5402330 - DNA, 18 bp, Homo sapiens
ctcaagaggcccagggag

SEQ ID NO: 5402331 - DNA, 17 bp, Homo sapiens
ctcaagagggcactggt

SEQ ID NO: 5402332 - DNA, 19 bp, Homo sapiens
ctcaagagggcactggtgg

SEQ ID NO: 5402333 - DNA, 15 bp, Homo sapiens
ctcaagagtgctgag

SEQ ID NO: 5402334 - DNA, 16 bp, Homo sapiens
ctcaagatactggact

SEQ ID NO: 5402335 - DNA, 15 bp, Homo sapiens
ctcaagatgacagct

SEQ ID NO: 5402336 - DNA, 17 bp, Homo sapiens
ctcaagatgacagctct

SEQ ID NO: 5402337 - DNA, 20 bp, Homo sapiens
ctcaagatgggggcagggct

SEQ ID NO: 5402338 - DNA, 21 bp, Homo sapiens
ctcaagatgggtccctggcca

SEQ ID NO: 5402339 - DNA, 20 bp, Homo sapiens
ctcaagattatattataata

SEQ ID NO: 5402340 - DNA, 13 bp, Homo sapiens
ctcaagattccca

SEQ ID NO: 5402341 - DNA, 21 bp, Homo sapiens
ctcaagattcccaggagttct

SEQ ID NO: 5402342 - DNA, 21 bp, Homo sapiens
ctcaagcaatccacctgcctt

SEQ ID NO: 5402343 - DNA, 22 bp, Homo sapiens
ctcaagcaatcctcctgagtga

SEQ ID NO: 5402344 - DNA, 24 bp, Homo sapiens
ctcaagcaatccttctgccttggc

SEQ ID NO: 5402345 - DNA, 16 bp, Homo sapiens
ctcaagcactgacact

SEQ ID NO: 5402346 - DNA, 14 bp, Homo sapiens
ctcaagcactgata

SEQ ID NO: 5402347 - DNA, 18 bp, Homo sapiens
ctcaagcacttttcctgt

SEQ ID NO: 5402348 - DNA, 13 bp, Homo sapiens
ctcaagcaggttt

SEQ ID NO: 5402349 - DNA, 16 bp, Homo sapiens
ctcaagccaagcagcc

SEQ ID NO: 5402350 - DNA, 18 bp, Homo sapiens
ctcaagccaatcccctcc

SEQ ID NO: 5402351 - DNA, 21 bp, Homo sapiens
ctcaagccagccccctccagc

SEQ ID NO: 5402352 - DNA, 14 bp, Homo sapiens
ctcaagccagcctg

SEQ ID NO: 5402353 - DNA, 13 bp, Homo sapiens
ctcaagccaggag

SEQ ID NO: 5402354 - DNA, 16 bp, Homo sapiens
ctcaagccaggagacc

SEQ ID NO: 5402355 - DNA, 18 bp, Homo sapiens
ctcaagccatcttcccgc

SEQ ID NO: 5402356 - DNA, 16 bp, Homo sapiens
ctcaagcccaggaggg

SEQ ID NO: 5402357 - DNA, 12 bp, Homo sapiens
ctcaagccccag

SEQ ID NO: 5402358 - DNA, 19 bp, Homo sapiens
ctcaagccccagcagccct

SEQ ID NO: 5402359 - DNA, 15 bp, Homo sapiens
ctcaagccccttctc

SEQ ID NO: 5402360 - DNA, 17 bp, Homo sapiens
ctcaagcccgcggggac

SEQ ID NO: 5402361 - DNA, 21 bp, Homo sapiens
ctcaagccgcaagctctcagc

SEQ ID NO: 5402362 - DNA, 22 bp, Homo sapiens
ctcaagccgcaagctctcagca

SEQ ID NO: 5402363 - DNA, 16 bp, Homo sapiens
ctcaagccgtggccgg

SEQ ID NO: 5402364 - DNA, 17 bp, Homo sapiens
ctcaagccgtggccggg

SEQ ID NO: 5402365 - DNA, 16 bp, Homo sapiens
ctcaagcctgtgggca

SEQ ID NO: 5402366 - DNA, 20 bp, Homo sapiens
ctcaagcgctatccacagaa

SEQ ID NO: 5402367 - DNA, 13 bp, Homo sapiens
ctcaagctagcca

SEQ ID NO: 5402368 - DNA, 17 bp, Homo sapiens
ctcaagctgcatctaga

SEQ ID NO: 5402369 - DNA, 14 bp, Homo sapiens
ctcaagctgcgttt

SEQ ID NO: 5402370 - DNA, 11 bp, Homo sapiens
ctcaagctttc

SEQ ID NO: 5402371 - DNA, 13 bp, Homo sapiens
ctcaagctttccc

SEQ ID NO: 5402372 - DNA, 22 bp, Homo sapiens
ctcaaggaaaagttctttcaac

SEQ ID NO: 5402373 - DNA, 20 bp, Homo sapiens
ctcaaggaaggatgccttat

SEQ ID NO: 5402374 - DNA, 14 bp, Homo sapiens
ctcaaggaatcttt

SEQ ID NO: 5402375 - DNA, 16 bp, Homo sapiens
ctcaaggacaaagtct

SEQ ID NO: 5402376 - DNA, 10 bp, Homo sapiens
ctcaaggact

SEQ ID NO: 5402377 - DNA, 18 bp, Homo sapiens
ctcaaggatacagggagc

SEQ ID NO: 5402378 - DNA, 15 bp, Homo sapiens
ctcaaggcaatgggc

SEQ ID NO: 5402379 - DNA, 23 bp, Homo sapiens
ctcaaggcaccgcagcctgtcag

SEQ ID NO: 5402380 - DNA, 15 bp, Homo sapiens
ctcaaggcccagcca

SEQ ID NO: 5402381 - DNA, 12 bp, Homo sapiens
ctcaaggccctc

SEQ ID NO: 5402382 - DNA, 19 bp, Homo sapiens
ctcaaggccctcggagctg

SEQ ID NO: 5402383 - DNA, 17 bp, Homo sapiens
ctcaaggcctcccacag

SEQ ID NO: 5402384 - DNA, 23 bp, Homo sapiens
ctcaaggcggtgcttgatagaaa

SEQ ID NO: 5402385 - DNA, 15 bp, Homo sapiens
ctcaaggcgtgagga

SEQ ID NO: 5402386 - DNA, 16 bp, Homo sapiens
ctcaaggcgtgaggat

SEQ ID NO: 5402387 - DNA, 12 bp, Homo sapiens
ctcaaggctgca

SEQ ID NO: 5402388 - DNA, 14 bp, Homo sapiens
ctcaagggaaaggc

SEQ ID NO: 5402389 - DNA, 17 bp, Homo sapiens
ctcaagggacaaggaca

SEQ ID NO: 5402390 - DNA, 14 bp, Homo sapiens
ctcaagggcatgag

SEQ ID NO: 5402391 - DNA, 12 bp, Homo sapiens
ctcaagggcttt

SEQ ID NO: 5402392 - DNA, 16 bp, Homo sapiens
ctcaaggggcagggag

SEQ ID NO: 5402393 - DNA, 22 bp, Homo sapiens
ctcaaggggccatcctgtccca

SEQ ID NO: 5402394 - DNA, 13 bp, Homo sapiens
ctcaagggggtga

SEQ ID NO: 5402395 - DNA, 14 bp, Homo sapiens
ctcaagggtggcag

SEQ ID NO: 5402396 - DNA, 16 bp, Homo sapiens
ctcaagggttttccag

SEQ ID NO: 5402397 - DNA, 17 bp, Homo sapiens
ctcaagggttttccagg

SEQ ID NO: 5402398 - DNA, 20 bp, Homo sapiens
ctcaaggtcatcaaacattt

SEQ ID NO: 5402399 - DNA, 13 bp, Homo sapiens
ctcaaggtggctg

SEQ ID NO: 5402400 - DNA, 18 bp, Homo sapiens
ctcaaggtggctggagat

SEQ ID NO: 5402401 - DNA, 22 bp, Homo sapiens
ctcaaggttactgggagtgtgg

SEQ ID NO: 5402402 - DNA, 17 bp, Homo sapiens
ctcaaggttctcatttc

SEQ ID NO: 5402403 - DNA, 20 bp, Homo sapiens
ctcaaggttttaggttctaa

SEQ ID NO: 5402404 - DNA, 22 bp, Homo sapiens
ctcaaggttttaggttctaaag

SEQ ID NO: 5402405 - DNA, 19 bp, Homo sapiens
ctcaagtagaaaagcagtc

SEQ ID NO: 5402406 - DNA, 14 bp, Homo sapiens
ctcaagtcctcttt

SEQ ID NO: 5402407 - DNA, 19 bp, Homo sapiens
ctcaagtcggtgggcctgc

SEQ ID NO: 5402408 - DNA, 18 bp, Homo sapiens
ctcaagtcttccctgatc

SEQ ID NO: 5402409 - DNA, 13 bp, Homo sapiens
ctcaagtgatagt

SEQ ID NO: 5402410 - DNA, 20 bp, Homo sapiens
ctcaagtgattctcctgcct

SEQ ID NO: 5402411 - DNA, 9 bp, Homo sapiens
ctcaagtgc

SEQ ID NO: 5402412 - DNA, 15 bp, Homo sapiens
ctcaagtgccctctc

SEQ ID NO: 5402413 - DNA, 22 bp, Homo sapiens
ctcaagtgccctctccgagctg

SEQ ID NO: 5402414 - DNA, 14 bp, Homo sapiens
ctcaagtgtcacct

SEQ ID NO: 5402415 - DNA, 15 bp, Homo sapiens
ctcaagtgtcacctc

SEQ ID NO: 5402416 - DNA, 17 bp, Homo sapiens
ctcaagtgtcacctcct

SEQ ID NO: 5402417 - DNA, 22 bp, Homo sapiens
ctcaagtgtcacctccttcccc

SEQ ID NO: 5402418 - DNA, 22 bp, Homo sapiens
ctcaagtgtctcagtccacctg

SEQ ID NO: 5402419 - DNA, 20 bp, Homo sapiens
ctcaagtgttaaattatttt

SEQ ID NO: 5402420 - DNA, 20 bp, Homo sapiens
ctcaagtgttcacaacctgg

SEQ ID NO: 5402421 - DNA, 18 bp, Homo sapiens
ctcaagttagcatttcaa

SEQ ID NO: 5402422 - DNA, 20 bp, Homo sapiens
ctcaagttcaccagcatggt

SEQ ID NO: 5402423 - DNA, 14 bp, Homo sapiens
ctcaagttctaaga

SEQ ID NO: 5402424 - DNA, 20 bp, Homo sapiens
ctcaagttctaagattctaa

SEQ ID NO: 5402425 - DNA, 18 bp, Homo sapiens
ctcaagttgtgtgctatt

SEQ ID NO: 5402426 - DNA, 17 bp, Homo sapiens
ctcaagttgtttaactg

SEQ ID NO: 5402427 - DNA, 12 bp, Homo sapiens
ctcaagtttaaa

SEQ ID NO: 5402428 - DNA, 13 bp, Homo sapiens
ctcaagtttaaaa

SEQ ID NO: 5402429 - DNA, 20 bp, Homo sapiens
ctcaagtttcttcaatctga

SEQ ID NO: 5402430 - DNA, 12 bp, Homo sapiens
ctcaagttttta

SEQ ID NO: 5402431 - DNA, 20 bp, Homo sapiens
ctcaagtttttcagaaagca

SEQ ID NO: 5402432 - DNA, 19 bp, Homo sapiens
ctcaataaaagaatctgat

SEQ ID NO: 5402433 - DNA, 14 bp, Homo sapiens
ctcaataaacagtc

SEQ ID NO: 5402434 - DNA, 20 bp, Homo sapiens
ctcaataaacagtcactgga

SEQ ID NO: 5402435 - DNA, 20 bp, Homo sapiens
ctcaataaactgaatttttc

SEQ ID NO: 5402436 - DNA, 14 bp, Homo sapiens
ctcaataaacttgt

SEQ ID NO: 5402437 - DNA, 18 bp, Homo sapiens
ctcaataaacttgtgcct

SEQ ID NO: 5402438 - DNA, 19 bp, Homo sapiens
ctcaataaacttgtgcctc

SEQ ID NO: 5402439 - DNA, 21 bp, Homo sapiens
ctcaataaacttgtgcctcca

SEQ ID NO: 5402440 - DNA, 13 bp, Homo sapiens
ctcaataaagatt

SEQ ID NO: 5402441 - DNA, 15 bp, Homo sapiens
ctcaataagccttgt

SEQ ID NO: 5402442 - DNA, 18 bp, Homo sapiens
ctcaataaggcagtgcag

SEQ ID NO: 5402443 - DNA, 23 bp, Homo sapiens
ctcaatacagcctgaataaacca

SEQ ID NO: 5402444 - DNA, 17 bp, Homo sapiens
ctcaatacctggcctca

SEQ ID NO: 5402445 - DNA, 20 bp, Homo sapiens
ctcaatagctccaagctgtt

SEQ ID NO: 5402446 - DNA, 19 bp, Homo sapiens
ctcaatagttcttaaaatt

SEQ ID NO: 5402447 - DNA, 20 bp, Homo sapiens
ctcaatagttcttaaaatta

SEQ ID NO: 5402448 - DNA, 17 bp, Homo sapiens
ctcaatattcaataaag

SEQ ID NO: 5402449 - DNA, 18 bp, Homo sapiens
ctcaatattcaataaagc

SEQ ID NO: 5402450 - DNA, 19 bp, Homo sapiens
ctcaatattcaataaagct

SEQ ID NO: 5402451 - DNA, 16 bp, Homo sapiens
ctcaatattcctgaat

SEQ ID NO: 5402452 - DNA, 18 bp, Homo sapiens
ctcaatattcctgaatga

SEQ ID NO: 5402453 - DNA, 18 bp, Homo sapiens
ctcaatattttccatgaa

SEQ ID NO: 5402454 - DNA, 22 bp, Homo sapiens
ctcaatattttccatgaaaatg

SEQ ID NO: 5402455 - DNA, 14 bp, Homo sapiens
ctcaatcacactgg

SEQ ID NO: 5402456 - DNA, 14 bp, Homo sapiens
ctcaatcagtgcag

SEQ ID NO: 5402457 - DNA, 20 bp, Homo sapiens
ctcaatcagtgcagtgatac

SEQ ID NO: 5402458 - DNA, 13 bp, Homo sapiens
ctcaatcattgtc

SEQ ID NO: 5402459 - DNA, 23 bp, Homo sapiens
ctcaatcattgtcagagatgttt

SEQ ID NO: 5402460 - DNA, 15 bp, Homo sapiens
ctcaatccatgttct

SEQ ID NO: 5402461 - DNA, 15 bp, Homo sapiens
ctcaatccctttgca

SEQ ID NO: 5402462 - DNA, 16 bp, Homo sapiens
ctcaatccctttgcaa

SEQ ID NO: 5402463 - DNA, 17 bp, Homo sapiens
ctcaatctaaattaaaa

SEQ ID NO: 5402464 - DNA, 13 bp, Homo sapiens
ctcaatctgcagc

SEQ ID NO: 5402465 - DNA, 21 bp, Homo sapiens
ctcaatcttcggggtgtgatg

SEQ ID NO: 5402466 - DNA, 12 bp, Homo sapiens
ctcaatgagcat

SEQ ID NO: 5402467 - DNA, 16 bp, Homo sapiens
ctcaatgagctcttcc

SEQ ID NO: 5402468 - DNA, 22 bp, Homo sapiens
ctcaatgcagttagctgaagaa

SEQ ID NO: 5402469 - DNA, 17 bp, Homo sapiens
ctcaatgcatgatgact

SEQ ID NO: 5402470 - DNA, 21 bp, Homo sapiens
ctcaatgcattgtcttgtgga

SEQ ID NO: 5402471 - DNA, 13 bp, Homo sapiens
ctcaatgcccagt

SEQ ID NO: 5402472 - DNA, 16 bp, Homo sapiens
ctcaatgcccagtaaa

SEQ ID NO: 5402473 - DNA, 21 bp, Homo sapiens
ctcaatgcccagtaaaatttc

SEQ ID NO: 5402474 - DNA, 23 bp, Homo sapiens
ctcaatgcccagtaaaatttcag

SEQ ID NO: 5402475 - DNA, 16 bp, Homo sapiens
ctcaatgccctgccat

SEQ ID NO: 5402476 - DNA, 17 bp, Homo sapiens
ctcaatgccctgccatt

SEQ ID NO: 5402477 - DNA, 18 bp, Homo sapiens
ctcaatgccctgccatta

SEQ ID NO: 5402478 - DNA, 16 bp, Homo sapiens
ctcaatgcctggagac

SEQ ID NO: 5402479 - DNA, 19 bp, Homo sapiens
ctcaatgctgggccctctt

SEQ ID NO: 5402480 - DNA, 17 bp, Homo sapiens
ctcaatgctgtttgggt

SEQ ID NO: 5402481 - DNA, 14 bp, Homo sapiens
ctcaatgcttttct

SEQ ID NO: 5402482 - DNA, 15 bp, Homo sapiens
ctcaatgcttttcta

SEQ ID NO: 5402483 - DNA, 22 bp, Homo sapiens
ctcaatggaaacatcactgggg

SEQ ID NO: 5402484 - DNA, 13 bp, Homo sapiens
ctcaatggactgg

SEQ ID NO: 5402485 - DNA, 14 bp, Homo sapiens
ctcaatggcctttt

SEQ ID NO: 5402486 - DNA, 12 bp, Homo sapiens
ctcaatgggaga

SEQ ID NO: 5402487 - DNA, 14 bp, Homo sapiens
ctcaatgggagaat

SEQ ID NO: 5402488 - DNA, 22 bp, Homo sapiens
ctcaatgtacatagaccctctt

SEQ ID NO: 5402489 - DNA, 21 bp, Homo sapiens
ctcaatgtgaatcagacccta

SEQ ID NO: 5402490 - DNA, 15 bp, Homo sapiens
ctcaatgtgaccagg

SEQ ID NO: 5402491 - DNA, 21 bp, Homo sapiens
ctcaatgtgtgccgagccctt

SEQ ID NO: 5402492 - DNA, 23 bp, Homo sapiens
ctcaatgtttagcagatttaaga

SEQ ID NO: 5402493 - DNA, 19 bp, Homo sapiens
ctcaatgtttctggacatt

SEQ ID NO: 5402494 - DNA, 21 bp, Homo sapiens
ctcaatgtttctggacattct

SEQ ID NO: 5402495 - DNA, 17 bp, Homo sapiens
ctcaattatcttggaaa

SEQ ID NO: 5402496 - DNA, 22 bp, Homo sapiens
ctcaattatcttggaaaaatgc

SEQ ID NO: 5402497 - DNA, 23 bp, Homo sapiens
ctcacctgctcccagtcctgcct

SEQ ID NO: 5402498 - DNA, 16 bp, Homo sapiens
ctcacctgctggcccc

SEQ ID NO: 5402499 - DNA, 19 bp, Homo sapiens
ctcacctggcttcccagga

SEQ ID NO: 5402500 - DNA, 20 bp, Homo sapiens
ctcacctggcttcccaggac

SEQ ID NO: 5402501 - DNA, 21 bp, Homo sapiens
ctcacctgggcacctggggag

SEQ ID NO: 5402502 - DNA, 21 bp, Homo sapiens
ctcacctgggcctttcctgtg

SEQ ID NO: 5402503 - DNA, 22 bp, Homo sapiens
ctcacctgggcctttcctgtgc

SEQ ID NO: 5402504 - DNA, 24 bp, Homo sapiens
ctcacctgggcctttcctgtgcca

SEQ ID NO: 5402505 - DNA, 13 bp, Homo sapiens
ctcacctggtcct

SEQ ID NO: 5402506 - DNA, 19 bp, Homo sapiens
ctcacctggtcgccaatcc

SEQ ID NO: 5402507 - DNA, 16 bp, Homo sapiens
ctcacctggttgaccc

SEQ ID NO: 5402508 - DNA, 16 bp, Homo sapiens
ctcacctgtactattg

SEQ ID NO: 5402509 - DNA, 14 bp, Homo sapiens
ctcacctgtactct

SEQ ID NO: 5402510 - DNA, 18 bp, Homo sapiens
ctcacctgtttgaaacca

SEQ ID NO: 5402511 - DNA, 16 bp, Homo sapiens
ctcaccttccaacact

SEQ ID NO: 5402512 - DNA, 21 bp, Homo sapiens
ctcaccttctgagtacagagt

SEQ ID NO: 5402513 - DNA, 20 bp, Homo sapiens
ctcaccttgaacaccacgct

SEQ ID NO: 5402514 - DNA, 18 bp, Homo sapiens
ctcaccttgcaacacaca

SEQ ID NO: 5402515 - DNA, 20 bp, Homo sapiens
ctcaccttgcaacacacaga

SEQ ID NO: 5402516 - DNA, 22 bp, Homo sapiens
ctcaccttgcaacacacagaca

SEQ ID NO: 5402517 - DNA, 18 bp, Homo sapiens
ctcaccttggggccttga

SEQ ID NO: 5402518 - DNA, 22 bp, Homo sapiens
ctcaccttgtgctggggacagg

SEQ ID NO: 5402519 - DNA, 13 bp, Homo sapiens
ctcacctttcctg

SEQ ID NO: 5402520 - DNA, 20 bp, Homo sapiens
ctcacctttctccactgggt

SEQ ID NO: 5402521 - DNA, 20 bp, Homo sapiens
ctcacctttgcaaagttaca

SEQ ID NO: 5402522 - DNA, 16 bp, Homo sapiens
ctcaccttttcccggg

SEQ ID NO: 5402523 - DNA, 14 bp, Homo sapiens
ctcacctttttaaa

SEQ ID NO: 5402524 - DNA, 15 bp, Homo sapiens
ctcacgaaactggaa

SEQ ID NO: 5402525 - DNA, 17 bp, Homo sapiens
ctcacgaaagtatttac

SEQ ID NO: 5402526 - DNA, 23 bp, Homo sapiens
ctcacgaaagtatttacttttta

SEQ ID NO: 5402527 - DNA, 16 bp, Homo sapiens
ctcacgactcttcctg

SEQ ID NO: 5402528 - DNA, 15 bp, Homo sapiens
ctcacgagccttgcg

SEQ ID NO: 5402529 - DNA, 16 bp, Homo sapiens
ctcacgattccagtgc

SEQ ID NO: 5402530 - DNA, 20 bp, Homo sapiens
ctcacgattccagtgcagta

SEQ ID NO: 5402531 - DNA, 15 bp, Homo sapiens
ctcacgcacctccca

SEQ ID NO: 5402532 - DNA, 14 bp, Homo sapiens
ctcacgccaccccc

SEQ ID NO: 5402533 - DNA, 15 bp, Homo sapiens
ctcacgccacccccg

SEQ ID NO: 5402534 - DNA, 14 bp, Homo sapiens
ctcacgcccagcct

SEQ ID NO: 5402535 - DNA, 18 bp, Homo sapiens
ctcacgcccagcctcctc

SEQ ID NO: 5402536 - DNA, 16 bp, Homo sapiens
ctcacgcccccaggaa

SEQ ID NO: 5402537 - DNA, 16 bp, Homo sapiens
ctcacgccccgctgtg

SEQ ID NO: 5402538 - DNA, 19 bp, Homo sapiens
ctcacgccccgctgtgtcc

SEQ ID NO: 5402539 - DNA, 21 bp, Homo sapiens
ctcacgcccttcaatgctgca

SEQ ID NO: 5402540 - DNA, 22 bp, Homo sapiens
ctcacgcccttcaatgctgcag

SEQ ID NO: 5402541 - DNA, 18 bp, Homo sapiens
ctcacgcctataatccca

SEQ ID NO: 5402542 - DNA, 21 bp, Homo sapiens
ctcacgcctataatcccagca

SEQ ID NO: 5402543 - DNA, 23 bp, Homo sapiens
ctcacgcctgtaatcccagcact

SEQ ID NO: 5402544 - DNA, 22 bp, Homo sapiens
ctcacgcctgtaatcccagcat

SEQ ID NO: 5402545 - DNA, 17 bp, Homo sapiens
ctcacgcgttctgggag

SEQ ID NO: 5402546 - DNA, 20 bp, Homo sapiens
ctcacgctcccaacacaagg

SEQ ID NO: 5402547 - DNA, 18 bp, Homo sapiens
ctcacgctcccccgcagt

SEQ ID NO: 5402548 - DNA, 17 bp, Homo sapiens
ctcacgctcctttctga

SEQ ID NO: 5402549 - DNA, 13 bp, Homo sapiens
ctcacgctctgga

SEQ ID NO: 5402550 - DNA, 18 bp, Homo sapiens
ctcacgctgacagcctcc

SEQ ID NO: 5402551 - DNA, 19 bp, Homo sapiens
ctcacgctgacagcctcct

SEQ ID NO: 5402552 - DNA, 23 bp, Homo sapiens
ctcacgcttacctcaaccatcct

SEQ ID NO: 5402553 - DNA, 15 bp, Homo sapiens
ctcacgcttcacagt

SEQ ID NO: 5402554 - DNA, 14 bp, Homo sapiens
ctcacgctttgttt

SEQ ID NO: 5402555 - DNA, 21 bp, Homo sapiens
ctcacggaccactcgaggcct

SEQ ID NO: 5402556 - DNA, 23 bp, Homo sapiens
ctcacggaccactcgaggcctgc

SEQ ID NO: 5402557 - DNA, 15 bp, Homo sapiens
ctcacggcagcctca

SEQ ID NO: 5402558 - DNA, 16 bp, Homo sapiens
ctcacggcagcctcaa

SEQ ID NO: 5402559 - DNA, 19 bp, Homo sapiens
ctcacggccacacagctgc

SEQ ID NO: 5402560 - DNA, 21 bp, Homo sapiens
ctcacggccacacagctgccg

SEQ ID NO: 5402561 - DNA, 17 bp, Homo sapiens
ctcacggctgcacctgc

SEQ ID NO: 5402562 - DNA, 19 bp, Homo sapiens
ctcacgggcagtagctgtg

SEQ ID NO: 5402563 - DNA, 15 bp, Homo sapiens
ctcacgggccctgcc

SEQ ID NO: 5402564 - DNA, 18 bp, Homo sapiens
ctcacgggccctgcccca

SEQ ID NO: 5402565 - DNA, 21 bp, Homo sapiens
ctcacggggttggctgttcca

SEQ ID NO: 5402566 - DNA, 22 bp, Homo sapiens
ctcacgtaatgcattgcctgta

SEQ ID NO: 5402567 - DNA, 20 bp, Homo sapiens
ctcacgtatttcacagagca

SEQ ID NO: 5402568 - DNA, 21 bp, Homo sapiens
ctcacgtatttcacagagcac

SEQ ID NO: 5402569 - DNA, 14 bp, Homo sapiens
ctcacgtcctgaga

SEQ ID NO: 5402570 - DNA, 13 bp, Homo sapiens
ctcacgtctctgc

SEQ ID NO: 5402571 - DNA, 15 bp, Homo sapiens
ctcacgtctctgccg

SEQ ID NO: 5402572 - DNA, 16 bp, Homo sapiens
ctcacgtctctgccgc

SEQ ID NO: 5402573 - DNA, 20 bp, Homo sapiens
ctcacgtctctgccgcctgc

SEQ ID NO: 5402574 - DNA, 22 bp, Homo sapiens
ctcacgtctgtaatcccagcgc

SEQ ID NO: 5402575 - DNA, 16 bp, Homo sapiens
ctcacgtgcaggacag

SEQ ID NO: 5402576 - DNA, 15 bp, Homo sapiens
ctcacgttacaggga

SEQ ID NO: 5402577 - DNA, 20 bp, Homo sapiens
ctcacgttacagggaaggag

SEQ ID NO: 5402578 - DNA, 16 bp, Homo sapiens
ctcacgtttcttcccc

SEQ ID NO: 5402579 - DNA, 14 bp, Homo sapiens
ctcactaaaaatat

SEQ ID NO: 5402580 - DNA, 15 bp, Homo sapiens
ctcactaattcatta

SEQ ID NO: 5402581 - DNA, 15 bp, Homo sapiens
ctcactaatttttgt

SEQ ID NO: 5402582 - DNA, 19 bp, Homo sapiens
ctcactacaacctccacct

SEQ ID NO: 5402583 - DNA, 19 bp, Homo sapiens
ctcactacatgggccagcc

SEQ ID NO: 5402584 - DNA, 20 bp, Homo sapiens
ctcactaccctattctctct

SEQ ID NO: 5402585 - DNA, 12 bp, Homo sapiens
ctcactacctcc

SEQ ID NO: 5402586 - DNA, 17 bp, Homo sapiens
ctcactacctcctcagg

SEQ ID NO: 5402587 - DNA, 11 bp, Homo sapiens
ctcactactga

SEQ ID NO: 5402588 - DNA, 15 bp, Homo sapiens
ctcactagctcccca

SEQ ID NO: 5402589 - DNA, 18 bp, Homo sapiens
ctcactagctgtctcagg

SEQ ID NO: 5402590 - DNA, 20 bp, Homo sapiens
ctcactagctgtctcaggag

SEQ ID NO: 5402591 - DNA, 21 bp, Homo sapiens
ctcactagctgtctcaggagt

SEQ ID NO: 5402592 - DNA, 18 bp, Homo sapiens
ctcactaggcccccactt

SEQ ID NO: 5402593 - DNA, 23 bp, Homo sapiens
ctcactaggcccccacttgcctc

SEQ ID NO: 5402594 - DNA, 13 bp, Homo sapiens
ctcactaggcttc

SEQ ID NO: 5402595 - DNA, 20 bp, Homo sapiens
ctcactaggcttctggttga

SEQ ID NO: 5402596 - DNA, 16 bp, Homo sapiens
ctcactagtttttcct

SEQ ID NO: 5402597 - DNA, 17 bp, Homo sapiens
ctcactataccagtata

SEQ ID NO: 5402598 - DNA, 15 bp, Homo sapiens
ctcactatgctgcta

SEQ ID NO: 5402599 - DNA, 24 bp, Homo sapiens
ctcactatggtatgctggccagca

SEQ ID NO: 5402600 - DNA, 17 bp, Homo sapiens
ctcactatgttgcccag

SEQ ID NO: 5402601 - DNA, 20 bp, Homo sapiens
ctcactatgttgcccaggca

SEQ ID NO: 5402602 - DNA, 14 bp, Homo sapiens
ctcactatgtttct

SEQ ID NO: 5402603 - DNA, 20 bp, Homo sapiens
ctcactatgtttctcagact

SEQ ID NO: 5402604 - DNA, 17 bp, Homo sapiens
ctcactcaagaccaggc

SEQ ID NO: 5402605 - DNA, 17 bp, Homo sapiens
ctcactcaagttcaagg

SEQ ID NO: 5402606 - DNA, 21 bp, Homo sapiens
ctcactcaccccagcgagctc

SEQ ID NO: 5402607 - DNA, 15 bp, Homo sapiens
ctcactcactcactc

SEQ ID NO: 5402608 - DNA, 13 bp, Homo sapiens
ctcactcactcca

SEQ ID NO: 5402609 - DNA, 15 bp, Homo sapiens
ctcactcactccaag

SEQ ID NO: 5402610 - DNA, 16 bp, Homo sapiens
ctcactcactccaaga

SEQ ID NO: 5402611 - DNA, 17 bp, Homo sapiens
ctcactcactccccact

SEQ ID NO: 5402612 - DNA, 18 bp, Homo sapiens
ctcactcactccccactc

SEQ ID NO: 5402613 - DNA, 20 bp, Homo sapiens
ctcactcagaagtccagagt

SEQ ID NO: 5402614 - DNA, 14 bp, Homo sapiens
ctcactcagcacca

SEQ ID NO: 5402615 - DNA, 15 bp, Homo sapiens
ctcactcagcaccac

SEQ ID NO: 5402616 - DNA, 14 bp, Homo sapiens
ctcactcaggaacc

SEQ ID NO: 5402617 - DNA, 15 bp, Homo sapiens
ctcactcaggaaccc

SEQ ID NO: 5402618 - DNA, 18 bp, Homo sapiens
ctcactcaggaaccctgg

SEQ ID NO: 5402619 - DNA, 20 bp, Homo sapiens
ctcactcaggaaccctggag

SEQ ID NO: 5402620 - DNA, 14 bp, Homo sapiens
ctcactcaggactt

SEQ ID NO: 5402621 - DNA, 14 bp, Homo sapiens
ctcactccaagacc

SEQ ID NO: 5402622 - DNA, 16 bp, Homo sapiens
ctcactccacactggc

SEQ ID NO: 5402623 - DNA, 12 bp, Homo sapiens
ctcactccacca

SEQ ID NO: 5402624 - DNA, 16 bp, Homo sapiens
ctcactccaccaccca

SEQ ID NO: 5402625 - DNA, 17 bp, Homo sapiens
ctcactccaccacccaa

SEQ ID NO: 5402626 - DNA, 20 bp, Homo sapiens
ctcactccaccacccaaaag

SEQ ID NO: 5402627 - DNA, 14 bp, Homo sapiens
ctcactccacccag

SEQ ID NO: 5402628 - DNA, 17 bp, Homo sapiens
ctcactccactcccctc

SEQ ID NO: 5402629 - DNA, 18 bp, Homo sapiens
ctcactccactcccctca

SEQ ID NO: 5402630 - DNA, 12 bp, Homo sapiens
ctcactccagcc

SEQ ID NO: 5402631 - DNA, 13 bp, Homo sapiens
ctcactccagcca

SEQ ID NO: 5402632 - DNA, 21 bp, Homo sapiens
ctcactccaggaaggggctgg

SEQ ID NO: 5402633 - DNA, 17 bp, Homo sapiens
ctcactccatttcccac

SEQ ID NO: 5402634 - DNA, 23 bp, Homo sapiens
ctcactccatttcccacttccac

SEQ ID NO: 5402635 - DNA, 18 bp, Homo sapiens
ctcactcccaagggacag

SEQ ID NO: 5402636 - DNA, 14 bp, Homo sapiens
ctcactcccactgg

SEQ ID NO: 5402637 - DNA, 22 bp, Homo sapiens
ctcactcccagttccctggaca

SEQ ID NO: 5402638 - DNA, 18 bp, Homo sapiens
ctcactccccacatccca

SEQ ID NO: 5402639 - DNA, 13 bp, Homo sapiens
ctcactccccact

SEQ ID NO: 5402640 - DNA, 23 bp, Homo sapiens
ctcactccccagggagctctggg

SEQ ID NO: 5402641 - DNA, 17 bp, Homo sapiens
ctcactcccctctcctc

SEQ ID NO: 5402642 - DNA, 20 bp, Homo sapiens
ctcactcccctctcctcccc

SEQ ID NO: 5402643 - DNA, 19 bp, Homo sapiens
ctcactcccgctgagccca

SEQ ID NO: 5402644 - DNA, 24 bp, Homo sapiens
ctcactccctaaagccctcttcag

SEQ ID NO: 5402645 - DNA, 22 bp, Homo sapiens
ctcactccctaggcccaagtct

SEQ ID NO: 5402646 - DNA, 15 bp, Homo sapiens
ctcactcccttccca

SEQ ID NO: 5402647 - DNA, 21 bp, Homo sapiens
ctcactccctttgtggacttt

SEQ ID NO: 5402648 - DNA, 15 bp, Homo sapiens
ctcactcctacctgg

SEQ ID NO: 5402649 - DNA, 16 bp, Homo sapiens
ctcactcctacctggt

SEQ ID NO: 5402650 - DNA, 15 bp, Homo sapiens
ctcactcctccgtga

SEQ ID NO: 5402651 - DNA, 22 bp, Homo sapiens
ctcactcctgaattcagttgct

SEQ ID NO: 5402652 - DNA, 14 bp, Homo sapiens
ctcactcctgagac

SEQ ID NO: 5402653 - DNA, 13 bp, Homo sapiens
ctcactcctgcct

SEQ ID NO: 5402654 - DNA, 16 bp, Homo sapiens
ctcactcctgcctccg

SEQ ID NO: 5402655 - DNA, 13 bp, Homo sapiens
ctcactcctttta

SEQ ID NO: 5402656 - DNA, 15 bp, Homo sapiens
ctcactccttttaaa

SEQ ID NO: 5402657 - DNA, 18 bp, Homo sapiens
ctcactccttttaaagaa

SEQ ID NO: 5402658 - DNA, 19 bp, Homo sapiens
ctcactccttttaaagaaa

SEQ ID NO: 5402659 - DNA, 12 bp, Homo sapiens
ctcactctcagg

SEQ ID NO: 5402660 - DNA, 13 bp, Homo sapiens
ctcactctcccca

SEQ ID NO: 5402661 - DNA, 13 bp, Homo sapiens
ctcactctctggg

SEQ ID NO: 5402662 - DNA, 17 bp, Homo sapiens
ctcactctcttcctttc

SEQ ID NO: 5402663 - DNA, 19 bp, Homo sapiens
ctcactctcttcctttcat

SEQ ID NO: 5402664 - DNA, 19 bp, Homo sapiens
ctcactctgctaccttgcc

SEQ ID NO: 5402665 - DNA, 20 bp, Homo sapiens
ctcactctggcagcctcaga

SEQ ID NO: 5402666 - DNA, 19 bp, Homo sapiens
ctcactctgggtgcctcct

SEQ ID NO: 5402667 - DNA, 12 bp, Homo sapiens
ctcactctgtca

SEQ ID NO: 5402668 - DNA, 23 bp, Homo sapiens
ctcactctgtccctgtccttccc

SEQ ID NO: 5402669 - DNA, 13 bp, Homo sapiens
ctcactctgtcgc

SEQ ID NO: 5402670 - DNA, 22 bp, Homo sapiens
ctcactctgtcgcccagtctgg

SEQ ID NO: 5402671 - DNA, 21 bp, Homo sapiens
ctcactctgtcgctcaggctg

SEQ ID NO: 5402672 - DNA, 20 bp, Homo sapiens
ctcactctgttgaccaggct

SEQ ID NO: 5402673 - DNA, 22 bp, Homo sapiens
ctcactctgttgaccaggctgg

SEQ ID NO: 5402674 - DNA, 22 bp, Homo sapiens
ctcagccctgagctggcgtcac

SEQ ID NO: 5402675 - DNA, 16 bp, Homo sapiens
ctcagccctgaggaca

SEQ ID NO: 5402676 - DNA, 14 bp, Homo sapiens
ctcagccctgaggt

SEQ ID NO: 5402677 - DNA, 20 bp, Homo sapiens
ctcagccctgcaccatgctg

SEQ ID NO: 5402678 - DNA, 18 bp, Homo sapiens
ctcagccctgctccctgc

SEQ ID NO: 5402679 - DNA, 19 bp, Homo sapiens
ctcagccctgctccctgcc

SEQ ID NO: 5402680 - DNA, 11 bp, Homo sapiens
ctcagccctgg

SEQ ID NO: 5402681 - DNA, 18 bp, Homo sapiens
ctcagccctggaggtgcc

SEQ ID NO: 5402682 - DNA, 22 bp, Homo sapiens
ctcagccctggaggtgccagca

SEQ ID NO: 5402683 - DNA, 21 bp, Homo sapiens
ctcagccctggccctgcccag

SEQ ID NO: 5402684 - DNA, 19 bp, Homo sapiens
ctcagccctggcctggctg

SEQ ID NO: 5402685 - DNA, 12 bp, Homo sapiens
ctcagccctggg

SEQ ID NO: 5402686 - DNA, 18 bp, Homo sapiens
ctcagcccttgcccccat

SEQ ID NO: 5402687 - DNA, 23 bp, Homo sapiens
ctcagcccttgcccccatccctc

SEQ ID NO: 5402688 - DNA, 14 bp, Homo sapiens
ctcagccgagccca

SEQ ID NO: 5402689 - DNA, 21 bp, Homo sapiens
ctcagccgagcccaggggagg

SEQ ID NO: 5402690 - DNA, 19 bp, Homo sapiens
ctcagccgcagacaagtaa

SEQ ID NO: 5402691 - DNA, 16 bp, Homo sapiens
ctcagccgtgggcccg

SEQ ID NO: 5402692 - DNA, 16 bp, Homo sapiens
ctcagcctagcacagg

SEQ ID NO: 5402693 - DNA, 12 bp, Homo sapiens
ctcagcctcaga

SEQ ID NO: 5402694 - DNA, 13 bp, Homo sapiens
ctcagcctcagag

SEQ ID NO: 5402695 - DNA, 16 bp, Homo sapiens
ctcagcctcatcctga

SEQ ID NO: 5402696 - DNA, 19 bp, Homo sapiens
ctcagcctcattcagcatg

SEQ ID NO: 5402697 - DNA, 23 bp, Homo sapiens
ctcagcctccaaagtggagctgg

SEQ ID NO: 5402698 - DNA, 19 bp, Homo sapiens
ctcagcctccactccctgt

SEQ ID NO: 5402699 - DNA, 15 bp, Homo sapiens
ctcagcctcccaaag

SEQ ID NO: 5402700 - DNA, 20 bp, Homo sapiens
ctcagcctcccaaccccagg

SEQ ID NO: 5402701 - DNA, 21 bp, Homo sapiens
ctcagcctcccaagtagctgg

SEQ ID NO: 5402702 - DNA, 23 bp, Homo sapiens
ctcagcctcccaagtagctggga

SEQ ID NO: 5402703 - DNA, 13 bp, Homo sapiens
ctcagcctcccag

SEQ ID NO: 5402704 - DNA, 20 bp, Homo sapiens
ctcagcctcccagagtgctg

SEQ ID NO: 5402705 - DNA, 20 bp, Homo sapiens
ctcagcctcccatagctggg

SEQ ID NO: 5402706 - DNA, 13 bp, Homo sapiens
ctcagcctccccc

SEQ ID NO: 5402707 - DNA, 15 bp, Homo sapiens
ctcagcctccccccg

SEQ ID NO: 5402708 - DNA, 22 bp, Homo sapiens
ctcagcctccccctgctgctca

SEQ ID NO: 5402709 - DNA, 14 bp, Homo sapiens
ctcagcctcccctt

SEQ ID NO: 5402710 - DNA, 16 bp, Homo sapiens
ctcagcctccccttct

SEQ ID NO: 5402711 - DNA, 21 bp, Homo sapiens
ctcagcctccccttcttcccg

SEQ ID NO: 5402712 - DNA, 22 bp, Homo sapiens
ctcagcctccccttcttcccgc

SEQ ID NO: 5402713 - DNA, 19 bp, Homo sapiens
ctcagcctcccgaatagct

SEQ ID NO: 5402714 - DNA, 23 bp, Homo sapiens
ctcagcctcccgaatagctggga

SEQ ID NO: 5402715 - DNA, 14 bp, Homo sapiens
ctcagcctcccgag

SEQ ID NO: 5402716 - DNA, 23 bp, Homo sapiens
ctcagcctcccgagtagctggga

SEQ ID NO: 5402717 - DNA, 22 bp, Homo sapiens
ctcagcctccctttgccagcca

SEQ ID NO: 5402718 - DNA, 23 bp, Homo sapiens
ctcagcctccggatgacacaaat

SEQ ID NO: 5402719 - DNA, 13 bp, Homo sapiens
ctcagcctcctaa

SEQ ID NO: 5402720 - DNA, 13 bp, Homo sapiens
ctcagcctcctca

SEQ ID NO: 5402721 - DNA, 15 bp, Homo sapiens
ctcagcctcctgagc

SEQ ID NO: 5402722 - DNA, 20 bp, Homo sapiens
ctcagcctcctgagcctgtg

SEQ ID NO: 5402723 - DNA, 20 bp, Homo sapiens
ctcagcctcctgagtagctg

SEQ ID NO: 5402724 - DNA, 23 bp, Homo sapiens
ctcagcctcctgagtagctgaga

SEQ ID NO: 5402725 - DNA, 21 bp, Homo sapiens
ctcagcctcctgagtagctgg

SEQ ID NO: 5402726 - DNA, 22 bp, Homo sapiens
ctcagcctcctgagtagctgga

SEQ ID NO: 5402727 - DNA, 15 bp, Homo sapiens
ctcagcctcctgggt

SEQ ID NO: 5402728 - DNA, 22 bp, Homo sapiens
ctcagcctcctgtgtagctggg

SEQ ID NO: 5402729 - DNA, 15 bp, Homo sapiens
ctcagcctctcccct

SEQ ID NO: 5402730 - DNA, 16 bp, Homo sapiens
ctcagcctctcgaagt

SEQ ID NO: 5402731 - DNA, 12 bp, Homo sapiens
ctcagcctctgc

SEQ ID NO: 5402732 - DNA, 15 bp, Homo sapiens
ctcagcctctgccac

SEQ ID NO: 5402733 - DNA, 20 bp, Homo sapiens
ctcagcctctgccagcgcca

SEQ ID NO: 5402734 - DNA, 16 bp, Homo sapiens
ctcagcctctgctgga

SEQ ID NO: 5402735 - DNA, 17 bp, Homo sapiens
ctcagcctctgctggag

SEQ ID NO: 5402736 - DNA, 23 bp, Homo sapiens
ctcagcctctgctggagaaagcc

SEQ ID NO: 5402737 - DNA, 17 bp, Homo sapiens
ctcagcctcttctctgc

SEQ ID NO: 5402738 - DNA, 18 bp, Homo sapiens
ctcagcctcttctctgca

SEQ ID NO: 5402739 - DNA, 22 bp, Homo sapiens
ctcagcctgatcaggcttcctg

SEQ ID NO: 5402740 - DNA, 16 bp, Homo sapiens
ctcagcctgcccacct

SEQ ID NO: 5402741 - DNA, 17 bp, Homo sapiens
ctcagcctgcccacctc

SEQ ID NO: 5402742 - DNA, 16 bp, Homo sapiens
ctcagcctgctgccca

SEQ ID NO: 5402743 - DNA, 17 bp, Homo sapiens
ctcagcctgctgcccag

SEQ ID NO: 5402744 - DNA, 18 bp, Homo sapiens
ctcagcctggagaggcct

SEQ ID NO: 5402745 - DNA, 21 bp, Homo sapiens
ctcagcctggagaggcctggg

SEQ ID NO: 5402746 - DNA, 15 bp, Homo sapiens
ctcagcctggccaga

SEQ ID NO: 5402747 - DNA, 17 bp, Homo sapiens
ctcagcctggccagaca

SEQ ID NO: 5402748 - DNA, 13 bp, Homo sapiens
ctcagcctgggcc

SEQ ID NO: 5402749 - DNA, 21 bp, Homo sapiens
ctcagcctgggcccctcagcc

SEQ ID NO: 5402750 - DNA, 12 bp, Homo sapiens
ctcagcctgggg

SEQ ID NO: 5402751 - DNA, 16 bp, Homo sapiens
ctcagcctggggctct

SEQ ID NO: 5402752 - DNA, 23 bp, Homo sapiens
ctcagcctggggctctctgaccc

SEQ ID NO: 5402753 - DNA, 14 bp, Homo sapiens
ctcagcctggggtt

SEQ ID NO: 5402754 - DNA, 20 bp, Homo sapiens
ctcagcctggtgggcctcct

SEQ ID NO: 5402755 - DNA, 18 bp, Homo sapiens
ctcagcctggtttctggg

SEQ ID NO: 5402756 - DNA, 18 bp, Homo sapiens
ctcagcctgtctcgggct

SEQ ID NO: 5402757 - DNA, 13 bp, Homo sapiens
ctcagcctgtgct

SEQ ID NO: 5402758 - DNA, 18 bp, Homo sapiens
ctcagcctgtgctgcccg

SEQ ID NO: 5402759 - DNA, 14 bp, Homo sapiens
ctcagcctgttcct

SEQ ID NO: 5402760 - DNA, 21 bp, Homo sapiens
ctcagcctgttccttcctgca

SEQ ID NO: 5402761 - DNA, 22 bp, Homo sapiens
ctcagcctgttccttcctgcag

SEQ ID NO: 5402762 - DNA, 19 bp, Homo sapiens
ctcagccttcagacagaga

SEQ ID NO: 5402763 - DNA, 23 bp, Homo sapiens
ctcagccttccccttgcccaggg

SEQ ID NO: 5402764 - DNA, 15 bp, Homo sapiens
ctcagccttcctcct

SEQ ID NO: 5402765 - DNA, 18 bp, Homo sapiens
ctcagccttgaaaaacaa

SEQ ID NO: 5402766 - DNA, 20 bp, Homo sapiens
ctcagccttgactatgtcta

SEQ ID NO: 5402767 - DNA, 15 bp, Homo sapiens
ctcagccttgcacac

SEQ ID NO: 5402768 - DNA, 19 bp, Homo sapiens
ctcagccttgcacacccac

SEQ ID NO: 5402769 - DNA, 23 bp, Homo sapiens
ctcagccttgcacacccactgcc

SEQ ID NO: 5402770 - DNA, 13 bp, Homo sapiens
ctcagccttgctg

SEQ ID NO: 5402771 - DNA, 21 bp, Homo sapiens
ctcagccttgctgctctgcgt

SEQ ID NO: 5402772 - DNA, 15 bp, Homo sapiens
ctcagccttggataa

SEQ ID NO: 5402773 - DNA, 16 bp, Homo sapiens
ctcagccttggttcct

SEQ ID NO: 5402774 - DNA, 17 bp, Homo sapiens
ctcagcgagaggcagca

SEQ ID NO: 5402775 - DNA, 14 bp, Homo sapiens
ctcagcgaggtgta

SEQ ID NO: 5402776 - DNA, 12 bp, Homo sapiens
ctcagcgcaggc

SEQ ID NO: 5402777 - DNA, 18 bp, Homo sapiens
ctcagcgcaggctgcaga

SEQ ID NO: 5402778 - DNA, 15 bp, Homo sapiens
ctcagcgctccctgt

SEQ ID NO: 5402779 - DNA, 13 bp, Homo sapiens
ctcagcgctcctc

SEQ ID NO: 5402780 - DNA, 14 bp, Homo sapiens
ctcagcgctcctcc

SEQ ID NO: 5402781 - DNA, 21 bp, Homo sapiens
ctcagcgctcctcctgtgtga

SEQ ID NO: 5402782 - DNA, 13 bp, Homo sapiens
ctcagcgctgccc

SEQ ID NO: 5402783 - DNA, 14 bp, Homo sapiens
ctcagcgctgccca

SEQ ID NO: 5402784 - DNA, 15 bp, Homo sapiens
ctcagcgctgcccac

SEQ ID NO: 5402785 - DNA, 16 bp, Homo sapiens
ctcagcgctgcccaca

SEQ ID NO: 5402786 - DNA, 14 bp, Homo sapiens
ctcagcggaggggt

SEQ ID NO: 5402787 - DNA, 20 bp, Homo sapiens
ctcagcgggagtctcctcac

SEQ ID NO: 5402788 - DNA, 15 bp, Homo sapiens
ctcagcgtctcccca

SEQ ID NO: 5402789 - DNA, 21 bp, Homo sapiens
ctcagcgtctccccatgctgg

SEQ ID NO: 5402790 - DNA, 22 bp, Homo sapiens
ctcagcgtctccccatgctggg

SEQ ID NO: 5402791 - DNA, 15 bp, Homo sapiens
ctcagctaagctcac

SEQ ID NO: 5402792 - DNA, 16 bp, Homo sapiens
ctcagctagctctgcc

SEQ ID NO: 5402793 - DNA, 17 bp, Homo sapiens
ctcagctataattctgt

SEQ ID NO: 5402794 - DNA, 13 bp, Homo sapiens
ctcagctcactgc

SEQ ID NO: 5402795 - DNA, 14 bp, Homo sapiens
ctcagctcactgca

SEQ ID NO: 5402796 - DNA, 21 bp, Homo sapiens
ctcagctcactgcaacctcca

SEQ ID NO: 5402797 - DNA, 24 bp, Homo sapiens
ctcagctcactggtccatttctca

SEQ ID NO: 5402798 - DNA, 18 bp, Homo sapiens
ctcagctcagctgggcca

SEQ ID NO: 5402799 - DNA, 12 bp, Homo sapiens
ctcagctccact

SEQ ID NO: 5402800 - DNA, 15 bp, Homo sapiens
ctcagctccactctg

SEQ ID NO: 5402801 - DNA, 19 bp, Homo sapiens
ctcagctccactctgaagt

SEQ ID NO: 5402802 - DNA, 19 bp, Homo sapiens
ctcagctccaggtggctct

SEQ ID NO: 5402803 - DNA, 19 bp, Homo sapiens
ctcagctcccaaggctctg

SEQ ID NO: 5402804 - DNA, 22 bp, Homo sapiens
ctcagctcccacaagcctctgc

SEQ ID NO: 5402805 - DNA, 18 bp, Homo sapiens
ctcagctcccatttctac

SEQ ID NO: 5402806 - DNA, 16 bp, Homo sapiens
ctcagctccccctgtc

SEQ ID NO: 5402807 - DNA, 17 bp, Homo sapiens
ctcagctccccctgtcc

SEQ ID NO: 5402808 - DNA, 19 bp, Homo sapiens
ctcagctccccctgtcccc

SEQ ID NO: 5402809 - DNA, 13 bp, Homo sapiens
ctcagctccctgc

SEQ ID NO: 5402810 - DNA, 21 bp, Homo sapiens
ctcagctccctgcctgtttcc

SEQ ID NO: 5402811 - DNA, 17 bp, Homo sapiens
ctcagctcctacctctg

SEQ ID NO: 5402812 - DNA, 13 bp, Homo sapiens
ctcagctcctggg

SEQ ID NO: 5402813 - DNA, 15 bp, Homo sapiens
ctcagctcggctcag

SEQ ID NO: 5402814 - DNA, 18 bp, Homo sapiens
ctcagctcggctcagctc

SEQ ID NO: 5402815 - DNA, 16 bp, Homo sapiens
ctcagctctaggctgt

SEQ ID NO: 5402816 - DNA, 20 bp, Homo sapiens
ctcagctctcagttgcagcc

SEQ ID NO: 5402817 - DNA, 15 bp, Homo sapiens
ctcagctctccctca

SEQ ID NO: 5402818 - DNA, 15 bp, Homo sapiens
ctcagctctggctca

SEQ ID NO: 5402819 - DNA, 18 bp, Homo sapiens
ctcagctctggctcacag

SEQ ID NO: 5402820 - DNA, 22 bp, Homo sapiens
ctcagctctgggagaggatttt

SEQ ID NO: 5402821 - DNA, 14 bp, Homo sapiens
ctcagctctgggcc

SEQ ID NO: 5402822 - DNA, 13 bp, Homo sapiens
ctcagctctggtc

SEQ ID NO: 5402823 - DNA, 22 bp, Homo sapiens
ctcagctctggtccaggccctg

SEQ ID NO: 5402824 - DNA, 12 bp, Homo sapiens
ctcagctctgtc

SEQ ID NO: 5402825 - DNA, 14 bp, Homo sapiens
ctcagctctgtctg

SEQ ID NO: 5402826 - DNA, 15 bp, Homo sapiens
ctcagctctgtctgc

SEQ ID NO: 5402827 - DNA, 13 bp, Homo sapiens
ctcagctcttcca

SEQ ID NO: 5402828 - DNA, 20 bp, Homo sapiens
ctcagctcttggctccactg

SEQ ID NO: 5402829 - DNA, 22 bp, Homo sapiens
ctcagctcttggtgggcccagg

SEQ ID NO: 5402830 - DNA, 23 bp, Homo sapiens
ctcagctcttggtgggcccaggg

SEQ ID NO: 5402831 - DNA, 14 bp, Homo sapiens
ctcagctgacacat

SEQ ID NO: 5402832 - DNA, 22 bp, Homo sapiens
ctcagctgacccggcctctctg

SEQ ID NO: 5402833 - DNA, 20 bp, Homo sapiens
ctcagctgagaaggccagcc

SEQ ID NO: 5402834 - DNA, 21 bp, Homo sapiens
ctcagctgagcatggagacag

SEQ ID NO: 5402835 - DNA, 13 bp, Homo sapiens
ctcagctgcacat

SEQ ID NO: 5402836 - DNA, 15 bp, Homo sapiens
ctcagctgcacattc

SEQ ID NO: 5402837 - DNA, 20 bp, Homo sapiens
ctcagctgcacattcctggc

SEQ ID NO: 5402838 - DNA, 20 bp, Homo sapiens
ctcagctgcatggagcctgg

SEQ ID NO: 5402839 - DNA, 12 bp, Homo sapiens
ctcagctgccaa

SEQ ID NO: 5402840 - DNA, 16 bp, Homo sapiens
ctcagctgccaagcac

SEQ ID NO: 5402841 - DNA, 17 bp, Homo sapiens
ctcagctgccaagcact

SEQ ID NO: 5402842 - DNA, 12 bp, Homo sapiens
ctcagctgccca

SEQ ID NO: 5402843 - DNA, 14 bp, Homo sapiens
ctcagctgcccatc

SEQ ID NO: 5402844 - DNA, 14 bp, Homo sapiens
ctcagctgcctcac

SEQ ID NO: 5402845 - DNA, 18 bp, Homo sapiens
ctcagctgcctcacttcc

SEQ ID NO: 5402846 - DNA, 14 bp, Homo sapiens
ctcagctgcctccc

SEQ ID NO: 5402847 - DNA, 19 bp, Homo sapiens
ctcagctgcctcctgcgcc

SEQ ID NO: 5402848 - DNA, 19 bp, Homo sapiens
ctcagctgcgcccccttct

SEQ ID NO: 5402849 - DNA, 15 bp, Homo sapiens
ctcagctgcttctcc

SEQ ID NO: 5402850 - DNA, 21 bp, Homo sapiens
ctcagctgcttctcccacttg

SEQ ID NO: 5402851 - DNA, 13 bp, Homo sapiens
ctcagctggaagt

SEQ ID NO: 5402852 - DNA, 18 bp, Homo sapiens
ctcagttcccttggcctc

SEQ ID NO: 5402853 - DNA, 16 bp, Homo sapiens
ctcagttcctcaccat

SEQ ID NO: 5402854 - DNA, 15 bp, Homo sapiens
ctcagttctagtctc

SEQ ID NO: 5402855 - DNA, 15 bp, Homo sapiens
ctcagttctctccct

SEQ ID NO: 5402856 - DNA, 20 bp, Homo sapiens
ctcagttctctcccttcctc

SEQ ID NO: 5402857 - DNA, 13 bp, Homo sapiens
ctcagttctgctc

SEQ ID NO: 5402858 - DNA, 23 bp, Homo sapiens
ctcagttctgctctaagaagctg

SEQ ID NO: 5402859 - DNA, 19 bp, Homo sapiens
ctcagttcttggcctgcta

SEQ ID NO: 5402860 - DNA, 16 bp, Homo sapiens
ctcagttgagaaacag

SEQ ID NO: 5402861 - DNA, 15 bp, Homo sapiens
ctcagttgattttct

SEQ ID NO: 5402862 - DNA, 13 bp, Homo sapiens
ctcagttgcagcc

SEQ ID NO: 5402863 - DNA, 17 bp, Homo sapiens
ctcagttgctaaacact

SEQ ID NO: 5402864 - DNA, 21 bp, Homo sapiens
ctcagttggaaataataaaag

SEQ ID NO: 5402865 - DNA, 14 bp, Homo sapiens
ctcagttgtagaat

SEQ ID NO: 5402866 - DNA, 21 bp, Homo sapiens
ctcagttgtagaatgtattgt

SEQ ID NO: 5402867 - DNA, 14 bp, Homo sapiens
ctcagttgtgcagc

SEQ ID NO: 5402868 - DNA, 21 bp, Homo sapiens
ctcagttgtgcagcttttggt

SEQ ID NO: 5402869 - DNA, 14 bp, Homo sapiens
ctcagttgttaact

SEQ ID NO: 5402870 - DNA, 17 bp, Homo sapiens
ctcagtttccccatttg

SEQ ID NO: 5402871 - DNA, 19 bp, Homo sapiens
ctcagtttccctatctgca

SEQ ID NO: 5402872 - DNA, 11 bp, Homo sapiens
ctcagtttcct

SEQ ID NO: 5402873 - DNA, 21 bp, Homo sapiens
ctcagtttcctcatctgcaga

SEQ ID NO: 5402874 - DNA, 18 bp, Homo sapiens
ctcagtttctgcctgggc

SEQ ID NO: 5402875 - DNA, 14 bp, Homo sapiens
ctcagtttctgttg

SEQ ID NO: 5402876 - DNA, 20 bp, Homo sapiens
ctcagtttctgttgtttctt

SEQ ID NO: 5402877 - DNA, 14 bp, Homo sapiens
ctcagtttggctgt

SEQ ID NO: 5402878 - DNA, 16 bp, Homo sapiens
ctcagttttcagctat

SEQ ID NO: 5402879 - DNA, 14 bp, Homo sapiens
ctcagttttcataa

SEQ ID NO: 5402880 - DNA, 12 bp, Homo sapiens
ctcagttttcct

SEQ ID NO: 5402881 - DNA, 15 bp, Homo sapiens
ctcagttttccttct

SEQ ID NO: 5402882 - DNA, 20 bp, Homo sapiens
ctcagtttttcggtgggaca

SEQ ID NO: 5402883 - DNA, 23 bp, Homo sapiens
ctcagtttttcggtgggacagcc

SEQ ID NO: 5402884 - DNA, 15 bp, Homo sapiens
ctcagttttttgtaa

SEQ ID NO: 5402885 - DNA, 15 bp, Homo sapiens
ctcagtttttttcct

SEQ ID NO: 5402886 - DNA, 21 bp, Homo sapiens
ctcataaaaagcctgcaattt

SEQ ID NO: 5402887 - DNA, 15 bp, Homo sapiens
ctcataaaatggaag

SEQ ID NO: 5402888 - DNA, 20 bp, Homo sapiens
ctcataaacagagtccctcc

SEQ ID NO: 5402889 - DNA, 17 bp, Homo sapiens
ctcataaaccaatgtgg

SEQ ID NO: 5402890 - DNA, 20 bp, Homo sapiens
ctcataaactgccaagagct

SEQ ID NO: 5402891 - DNA, 22 bp, Homo sapiens
ctcataaagatgttaaatggaa

SEQ ID NO: 5402892 - DNA, 15 bp, Homo sapiens
ctcataaatcttttt

SEQ ID NO: 5402893 - DNA, 16 bp, Homo sapiens
ctcataaatttacttt

SEQ ID NO: 5402894 - DNA, 22 bp, Homo sapiens
ctcataacatctttgaaaagaa

SEQ ID NO: 5402895 - DNA, 23 bp, Homo sapiens
ctcataacatctttgaaaagaaa

SEQ ID NO: 5402896 - DNA, 19 bp, Homo sapiens
ctcataactagagtatgtg

SEQ ID NO: 5402897 - DNA, 17 bp, Homo sapiens
ctcataacttgagacct

SEQ ID NO: 5402898 - DNA, 20 bp, Homo sapiens
ctcataagctactgatgaga

SEQ ID NO: 5402899 - DNA, 16 bp, Homo sapiens
ctcataaggtgctatc

SEQ ID NO: 5402900 - DNA, 20 bp, Homo sapiens
ctcataaggttctttagctg

SEQ ID NO: 5402901 - DNA, 18 bp, Homo sapiens
ctcataagttggaccaga

SEQ ID NO: 5402902 - DNA, 20 bp, Homo sapiens
ctcataagttggaccagagg

SEQ ID NO: 5402903 - DNA, 23 bp, Homo sapiens
ctcataagttggaccagaggaag

SEQ ID NO: 5402904 - DNA, 14 bp, Homo sapiens
ctcataatgtgaag

SEQ ID NO: 5402905 - DNA, 15 bp, Homo sapiens
ctcataatgtgaagt

SEQ ID NO: 5402906 - DNA, 17 bp, Homo sapiens
ctcataatgtgaagtgt

SEQ ID NO: 5402907 - DNA, 12 bp, Homo sapiens
ctcataattcct

SEQ ID NO: 5402908 - DNA, 15 bp, Homo sapiens
ctcatacaagccatt

SEQ ID NO: 5402909 - DNA, 23 bp, Homo sapiens
ctcatacaagccatttactttgc

SEQ ID NO: 5402910 - DNA, 17 bp, Homo sapiens
ctcatacactcgtatga

SEQ ID NO: 5402911 - DNA, 18 bp, Homo sapiens
ctcatacagtctctattt

SEQ ID NO: 5402912 - DNA, 15 bp, Homo sapiens
ctcataccacactta

SEQ ID NO: 5402913 - DNA, 20 bp, Homo sapiens
ctcataccatctgctgcccc

SEQ ID NO: 5402914 - DNA, 15 bp, Homo sapiens
ctcatacccaccccc

SEQ ID NO: 5402915 - DNA, 21 bp, Homo sapiens
ctcatacctctgaccaacagg

SEQ ID NO: 5402916 - DNA, 16 bp, Homo sapiens
ctcatacctttaaagg

SEQ ID NO: 5402917 - DNA, 18 bp, Homo sapiens
ctcatacctttaaaggaa

SEQ ID NO: 5402918 - DNA, 14 bp, Homo sapiens
ctcatactcacctc

SEQ ID NO: 5402919 - DNA, 22 bp, Homo sapiens
ctcatactcacctcaccccact

SEQ ID NO: 5402920 - DNA, 13 bp, Homo sapiens
ctcatactgtctg

SEQ ID NO: 5402921 - DNA, 13 bp, Homo sapiens
ctcatactgtgct

SEQ ID NO: 5402922 - DNA, 14 bp, Homo sapiens
ctcatagacactga

SEQ ID NO: 5402923 - DNA, 23 bp, Homo sapiens
ctcatagcacatgttttacaaag

SEQ ID NO: 5402924 - DNA, 19 bp, Homo sapiens
ctcatagcatagccagcat

SEQ ID NO: 5402925 - DNA, 21 bp, Homo sapiens
ctcatagcatagccagcattc

SEQ ID NO: 5402926 - DNA, 23 bp, Homo sapiens
ctcatagcatgatattgttctcc

SEQ ID NO: 5402927 - DNA, 16 bp, Homo sapiens
ctcatagcattaacta

SEQ ID NO: 5402928 - DNA, 18 bp, Homo sapiens
ctcatagcattaactaat

SEQ ID NO: 5402929 - DNA, 21 bp, Homo sapiens
ctcataggaaaagtacattta

SEQ ID NO: 5402930 - DNA, 16 bp, Homo sapiens
ctcataggacctgcat

SEQ ID NO: 5402931 - DNA, 15 bp, Homo sapiens
ctcataggagactgc

SEQ ID NO: 5402932 - DNA, 16 bp, Homo sapiens
ctcataggagactgcg

SEQ ID NO: 5402933 - DNA, 19 bp, Homo sapiens
ctcataggagttaggctgt

SEQ ID NO: 5402934 - DNA, 22 bp, Homo sapiens
ctcataggctatgccatgtgcg

SEQ ID NO: 5402935 - DNA, 18 bp, Homo sapiens
ctcatagggatgctgtga

SEQ ID NO: 5402936 - DNA, 13 bp, Homo sapiens
ctcataggtccct

SEQ ID NO: 5402937 - DNA, 19 bp, Homo sapiens
ctcataggttgagcaattt

SEQ ID NO: 5402938 - DNA, 19 bp, Homo sapiens
ctcatagtatggtggctgg

SEQ ID NO: 5402939 - DNA, 19 bp, Homo sapiens
ctcatagtgaacacagcag

SEQ ID NO: 5402940 - DNA, 13 bp, Homo sapiens
ctcatataagaca

SEQ ID NO: 5402941 - DNA, 19 bp, Homo sapiens
ctcatatacttgaatatta

SEQ ID NO: 5402942 - DNA, 15 bp, Homo sapiens
ctcatatagcacttt

SEQ ID NO: 5402943 - DNA, 16 bp, Homo sapiens
ctcatatatattttaa

SEQ ID NO: 5402944 - DNA, 19 bp, Homo sapiens
ctcatatatattttaaaaa

SEQ ID NO: 5402945 - DNA, 13 bp, Homo sapiens
ctcatatatttaa

SEQ ID NO: 5402946 - DNA, 22 bp, Homo sapiens
ctcatatatttggagtttttct

SEQ ID NO: 5402947 - DNA, 16 bp, Homo sapiens
ctcatatcccatcctt

SEQ ID NO: 5402948 - DNA, 17 bp, Homo sapiens
ctcatatcttcctcatc

SEQ ID NO: 5402949 - DNA, 14 bp, Homo sapiens
ctcatatgccaccc

SEQ ID NO: 5402950 - DNA, 21 bp, Homo sapiens
ctcatatgctatgttagaagt

SEQ ID NO: 5402951 - DNA, 13 bp, Homo sapiens
ctcatatggccca

SEQ ID NO: 5402952 - DNA, 18 bp, Homo sapiens
ctcatatgtagccctcat

SEQ ID NO: 5402953 - DNA, 22 bp, Homo sapiens
ctcatattcctgcagcctggag

SEQ ID NO: 5402954 - DNA, 13 bp, Homo sapiens
ctcatatttaaag

SEQ ID NO: 5402955 - DNA, 21 bp, Homo sapiens
ctcatattttgtatatatctg

SEQ ID NO: 5402956 - DNA, 15 bp, Homo sapiens
ctcatcaacaaagaa

SEQ ID NO: 5402957 - DNA, 18 bp, Homo sapiens
ctcatcaacaaagaaata

SEQ ID NO: 5402958 - DNA, 13 bp, Homo sapiens
ctcatcaactgaa

SEQ ID NO: 5402959 - DNA, 21 bp, Homo sapiens
ctcatcaatcaaataagtatt

SEQ ID NO: 5402960 - DNA, 16 bp, Homo sapiens
ctcatcacacacatgg

SEQ ID NO: 5402961 - DNA, 16 bp, Homo sapiens
ctcatcacccagtcct

SEQ ID NO: 5402962 - DNA, 17 bp, Homo sapiens
ctcatcacccagtcctg

SEQ ID NO: 5402963 - DNA, 18 bp, Homo sapiens
ctcatcacccagtcctgg

SEQ ID NO: 5402964 - DNA, 22 bp, Homo sapiens
ctcatcacccagtcctggccat

SEQ ID NO: 5402965 - DNA, 15 bp, Homo sapiens
ctcatcaccccagag

SEQ ID NO: 5402966 - DNA, 20 bp, Homo sapiens
ctcatcacccggatagagga

SEQ ID NO: 5402967 - DNA, 10 bp, Homo sapiens
ctcatcacta

SEQ ID NO: 5402968 - DNA, 13 bp, Homo sapiens
ctcatcactgaaa

SEQ ID NO: 5402969 - DNA, 14 bp, Homo sapiens
ctcatcactgaaat

SEQ ID NO: 5402970 - DNA, 13 bp, Homo sapiens
ctcatcactgtgg

SEQ ID NO: 5402971 - DNA, 20 bp, Homo sapiens
ctcatcagaaacaatttctg

SEQ ID NO: 5402972 - DNA, 15 bp, Homo sapiens
ctcatcagccttggg

SEQ ID NO: 5402973 - DNA, 13 bp, Homo sapiens
ctcatcagccttt

SEQ ID NO: 5402974 - DNA, 22 bp, Homo sapiens
ctcatcaggagttccagtgctg

SEQ ID NO: 5402975 - DNA, 12 bp, Homo sapiens
ctcatcaggatg

SEQ ID NO: 5402976 - DNA, 20 bp, Homo sapiens
ctcatcaggatgaacccagg

SEQ ID NO: 5402977 - DNA, 22 bp, Homo sapiens
ctcatcaggatgaacccaggac

SEQ ID NO: 5402978 - DNA, 21 bp, Homo sapiens
ctcatcagggtagcagcagag

SEQ ID NO: 5402979 - DNA, 20 bp, Homo sapiens
ctcatcagtgtcattttctg

SEQ ID NO: 5402980 - DNA, 18 bp, Homo sapiens
ctcatcagtgtgtaaata

SEQ ID NO: 5402981 - DNA, 16 bp, Homo sapiens
ctcatcatcagtctta

SEQ ID NO: 5402982 - DNA, 13 bp, Homo sapiens
ctcatcatccacc

SEQ ID NO: 5402983 - DNA, 19 bp, Homo sapiens
ctcatcatccacccgctgc

SEQ ID NO: 5402984 - DNA, 20 bp, Homo sapiens
ctcatcatccacccgctgcc

SEQ ID NO: 5402985 - DNA, 21 bp, Homo sapiens
ctcatcatccacccgctgccc

SEQ ID NO: 5402986 - DNA, 14 bp, Homo sapiens
ctcatcattaataa

SEQ ID NO: 5402987 - DNA, 22 bp, Homo sapiens
ctcatcattaataagtgaagaa

SEQ ID NO: 5402988 - DNA, 23 bp, Homo sapiens
ctcatccaaaagtgaccagcata

SEQ ID NO: 5402989 - DNA, 13 bp, Homo sapiens
ctcatccacagag

SEQ ID NO: 5402990 - DNA, 15 bp, Homo sapiens
ctcatccacagaggc

SEQ ID NO: 5402991 - DNA, 17 bp, Homo sapiens
ctcatccacagaggcca

SEQ ID NO: 5402992 - DNA, 16 bp, Homo sapiens
ctcatccaccccatcc

SEQ ID NO: 5402993 - DNA, 24 bp, Homo sapiens
ctcatccaccccatccctccccag

SEQ ID NO: 5402994 - DNA, 19 bp, Homo sapiens
ctcatccactaggtgccca

SEQ ID NO: 5402995 - DNA, 21 bp, Homo sapiens
ctcatccactaggtgcccagt

SEQ ID NO: 5402996 - DNA, 22 bp, Homo sapiens
ctcatccactaggtgcccagtc

SEQ ID NO: 5402997 - DNA, 18 bp, Homo sapiens
ctcatccagcctcagaga

SEQ ID NO: 5402998 - DNA, 16 bp, Homo sapiens
ctcatccagggctctg

SEQ ID NO: 5402999 - DNA, 22 bp, Homo sapiens
ctcatccaggtcctttccttct

SEQ ID NO: 5403000 - DNA, 19 bp, Homo sapiens
ctcatccatcatcatgtgt

SEQ ID NO: 5403001 - DNA, 20 bp, Homo sapiens
ctcatccatgcagataacag

SEQ ID NO: 5403002 - DNA, 19 bp, Homo sapiens
ctcatccattaatgtagat

SEQ ID NO: 5403003 - DNA, 13 bp, Homo sapiens
ctcatccatttct

SEQ ID NO: 5403004 - DNA, 13 bp, Homo sapiens
ctcatcccaacct

SEQ ID NO: 5403005 - DNA, 18 bp, Homo sapiens
ctcatcccacttcctttc

SEQ ID NO: 5403006 - DNA, 15 bp, Homo sapiens
ctcatcccagtcctg

SEQ ID NO: 5403007 - DNA, 10 bp, Homo sapiens
ctcatcccat

SEQ ID NO: 5403008 - DNA, 21 bp, Homo sapiens
ctcatcccatgagaccctggt

SEQ ID NO: 5403009 - DNA, 14 bp, Homo sapiens
ctcatccccagggg

SEQ ID NO: 5403010 - DNA, 22 bp, Homo sapiens
ctcatccccaggggtcccagcc

SEQ ID NO: 5403011 - DNA, 15 bp, Homo sapiens
ctcatccccccaccc

SEQ ID NO: 5403012 - DNA, 17 bp, Homo sapiens
ctcatcccccctgctgc

SEQ ID NO: 5403013 - DNA, 17 bp, Homo sapiens
ctcatcccctcgtcctg

SEQ ID NO: 5403014 - DNA, 20 bp, Homo sapiens
ctcatcccctcgtcctgtcc

SEQ ID NO: 5403015 - DNA, 23 bp, Homo sapiens
ctcatcccgacctcttagaaaat

SEQ ID NO: 5403016 - DNA, 16 bp, Homo sapiens
ctcatcccgtgttctc

SEQ ID NO: 5403017 - DNA, 21 bp, Homo sapiens
ctcatccctaatgctgcagat

SEQ ID NO: 5403018 - DNA, 12 bp, Homo sapiens
ctcatccctcaa

SEQ ID NO: 5403019 - DNA, 12 bp, Homo sapiens
ctcatccctgga

SEQ ID NO: 5403020 - DNA, 18 bp, Homo sapiens
ctcatcccttgtttataa

SEQ ID NO: 5403021 - DNA, 15 bp, Homo sapiens
ctcatcctcataccc

SEQ ID NO: 5403022 - DNA, 23 bp, Homo sapiens
ctcatcctccagtaccttgcttc

SEQ ID NO: 5403023 - DNA, 13 bp, Homo sapiens
ctcatcctcccat

SEQ ID NO: 5403024 - DNA, 16 bp, Homo sapiens
ctcatcctcccattgc

SEQ ID NO: 5403025 - DNA, 23 bp, Homo sapiens
ctcatcctcccattgcccagtga

SEQ ID NO: 5403026 - DNA, 13 bp, Homo sapiens
ctcatcctcctcc

SEQ ID NO: 5403027 - DNA, 15 bp, Homo sapiens
ctcatcctcctggaa

SEQ ID NO: 5403028 - DNA, 13 bp, Homo sapiens
ctcatcctccttc

SEQ ID NO: 5403029 - DNA, 14 bp, Homo sapiens
ctcatcctcctttc

SEQ ID NO: 5403030 - DNA, 18 bp, Homo sapiens
ctccaaaggcggggtggc

SEQ ID NO: 5403031 - DNA, 15 bp, Homo sapiens
ctccaaaggctctgt

SEQ ID NO: 5403032 - DNA, 22 bp, Homo sapiens
ctccaaaggggctgctggggca

SEQ ID NO: 5403033 - DNA, 17 bp, Homo sapiens
ctccaaagtcataattg

SEQ ID NO: 5403034 - DNA, 20 bp, Homo sapiens
ctccaaagtcataattgcat

SEQ ID NO: 5403035 - DNA, 17 bp, Homo sapiens
ctccaaagtggagctgg

SEQ ID NO: 5403036 - DNA, 19 bp, Homo sapiens
ctccaaatccaaggaaaca

SEQ ID NO: 5403037 - DNA, 15 bp, Homo sapiens
ctccaaatctccagt

SEQ ID NO: 5403038 - DNA, 18 bp, Homo sapiens
ctccaaatctgatttcat

SEQ ID NO: 5403039 - DNA, 17 bp, Homo sapiens
ctccaaatcttgccatt

SEQ ID NO: 5403040 - DNA, 20 bp, Homo sapiens
ctccaaatgagacacattaa

SEQ ID NO: 5403041 - DNA, 21 bp, Homo sapiens
ctccaaatggagaagctgcag

SEQ ID NO: 5403042 - DNA, 14 bp, Homo sapiens
ctccaaatttttct

SEQ ID NO: 5403043 - DNA, 23 bp, Homo sapiens
ctccaacacaaggctccaagacc

SEQ ID NO: 5403044 - DNA, 22 bp, Homo sapiens
ctccaacaccaagcacagcagc

SEQ ID NO: 5403045 - DNA, 22 bp, Homo sapiens
ctccaacagaactaaatgttct

SEQ ID NO: 5403046 - DNA, 18 bp, Homo sapiens
ctccaacagacaccctcc

SEQ ID NO: 5403047 - DNA, 19 bp, Homo sapiens
ctccaacagacaccctcca

SEQ ID NO: 5403048 - DNA, 20 bp, Homo sapiens
ctccaacagcttgaccagac

SEQ ID NO: 5403049 - DNA, 23 bp, Homo sapiens
ctccaacagcttgaccagaccta

SEQ ID NO: 5403050 - DNA, 14 bp, Homo sapiens
ctccaacatccact

SEQ ID NO: 5403051 - DNA, 23 bp, Homo sapiens
ctccaaccaagaggatttcttca

SEQ ID NO: 5403052 - DNA, 13 bp, Homo sapiens
ctccaaccactgt

SEQ ID NO: 5403053 - DNA, 20 bp, Homo sapiens
ctccaacccaacctcatcct

SEQ ID NO: 5403054 - DNA, 15 bp, Homo sapiens
ctccaacccagcagt

SEQ ID NO: 5403055 - DNA, 14 bp, Homo sapiens
ctccaaccccccag

SEQ ID NO: 5403056 - DNA, 17 bp, Homo sapiens
ctccaaccccccagcac

SEQ ID NO: 5403057 - DNA, 20 bp, Homo sapiens
ctccaaccccccagcactga

SEQ ID NO: 5403058 - DNA, 23 bp, Homo sapiens
ctccaaccccccagcactgagga

SEQ ID NO: 5403059 - DNA, 15 bp, Homo sapiens
ctccaacccctcgcc

SEQ ID NO: 5403060 - DNA, 19 bp, Homo sapiens
ctccaacccctcgcccagt

SEQ ID NO: 5403061 - DNA, 23 bp, Homo sapiens
ctccaacccctcgcccagtccca

SEQ ID NO: 5403062 - DNA, 22 bp, Homo sapiens
ctccaacctaacctgtgtctgc

SEQ ID NO: 5403063 - DNA, 14 bp, Homo sapiens
ctccaacctctcgg

SEQ ID NO: 5403064 - DNA, 14 bp, Homo sapiens
ctccaacctggagg

SEQ ID NO: 5403065 - DNA, 16 bp, Homo sapiens
ctccaacctggaggct

SEQ ID NO: 5403066 - DNA, 18 bp, Homo sapiens
ctccaacctggaggctgg

SEQ ID NO: 5403067 - DNA, 21 bp, Homo sapiens
ctccaacctggaggctggacc

SEQ ID NO: 5403068 - DNA, 23 bp, Homo sapiens
ctccaacctggaggctggaccaa

SEQ ID NO: 5403069 - DNA, 21 bp, Homo sapiens
ctccaaccttctgccctcctg

SEQ ID NO: 5403070 - DNA, 20 bp, Homo sapiens
ctccaacgcccctgtggcca

SEQ ID NO: 5403071 - DNA, 20 bp, Homo sapiens
ctccaactcagagcacagcc

SEQ ID NO: 5403072 - DNA, 21 bp, Homo sapiens
ctccaactcagagcacagcca

SEQ ID NO: 5403073 - DNA, 12 bp, Homo sapiens
ctccaactccaa

SEQ ID NO: 5403074 - DNA, 18 bp, Homo sapiens
ctccaactccaacatcca

SEQ ID NO: 5403075 - DNA, 22 bp, Homo sapiens
ctccaactcctttcagccacat

SEQ ID NO: 5403076 - DNA, 18 bp, Homo sapiens
ctccaactggattataaa

SEQ ID NO: 5403077 - DNA, 18 bp, Homo sapiens
ctccaagaaactgaatga

SEQ ID NO: 5403078 - DNA, 17 bp, Homo sapiens
ctccaagaatgctgaaa

SEQ ID NO: 5403079 - DNA, 21 bp, Homo sapiens
ctccaagaatggaagcctgaa

SEQ ID NO: 5403080 - DNA, 21 bp, Homo sapiens
ctccaagacagcagcagcctg

SEQ ID NO: 5403081 - DNA, 16 bp, Homo sapiens
ctccaagaccaccagg

SEQ ID NO: 5403082 - DNA, 12 bp, Homo sapiens
ctccaagacctg

SEQ ID NO: 5403083 - DNA, 15 bp, Homo sapiens
ctccaagacctggtg

SEQ ID NO: 5403084 - DNA, 16 bp, Homo sapiens
ctccaagaccttctcc

SEQ ID NO: 5403085 - DNA, 17 bp, Homo sapiens
ctccaagaccttctcct

SEQ ID NO: 5403086 - DNA, 21 bp, Homo sapiens
ctccaagaccttctccttcac

SEQ ID NO: 5403087 - DNA, 14 bp, Homo sapiens
ctccaagagctaca

SEQ ID NO: 5403088 - DNA, 18 bp, Homo sapiens
ctccaagaggctccctcc

SEQ ID NO: 5403089 - DNA, 16 bp, Homo sapiens
ctccaagaggctggaa

SEQ ID NO: 5403090 - DNA, 20 bp, Homo sapiens
ctccaagataagcctgagcc

SEQ ID NO: 5403091 - DNA, 15 bp, Homo sapiens
ctccaagatgccctc

SEQ ID NO: 5403092 - DNA, 16 bp, Homo sapiens
ctccaagatgttctcc

SEQ ID NO: 5403093 - DNA, 12 bp, Homo sapiens
ctccaagattct

SEQ ID NO: 5403094 - DNA, 16 bp, Homo sapiens
ctccaagattctagat

SEQ ID NO: 5403095 - DNA, 17 bp, Homo sapiens
ctccaagattctagatg

SEQ ID NO: 5403096 - DNA, 18 bp, Homo sapiens
ctccaagattctagatga

SEQ ID NO: 5403097 - DNA, 21 bp, Homo sapiens
ctccaagatttaacctgcaag

SEQ ID NO: 5403098 - DNA, 16 bp, Homo sapiens
ctccaagcacagagcc

SEQ ID NO: 5403099 - DNA, 17 bp, Homo sapiens
ctccaagcacagagcct

SEQ ID NO: 5403100 - DNA, 22 bp, Homo sapiens
ctccaagcactagccttcccag

SEQ ID NO: 5403101 - DNA, 24 bp, Homo sapiens
ctccaagcaggacatggacaagga

SEQ ID NO: 5403102 - DNA, 19 bp, Homo sapiens
ctccaagcatttcatgaaa

SEQ ID NO: 5403103 - DNA, 22 bp, Homo sapiens
ctccaagcatttcatgaaaaag

SEQ ID NO: 5403104 - DNA, 16 bp, Homo sapiens
ctccaagccagcaagc

SEQ ID NO: 5403105 - DNA, 17 bp, Homo sapiens
ctccaagccccatcttc

SEQ ID NO: 5403106 - DNA, 18 bp, Homo sapiens
ctccaagccccctggcag

SEQ ID NO: 5403107 - DNA, 19 bp, Homo sapiens
ctccaagccccctggcagc

SEQ ID NO: 5403108 - DNA, 17 bp, Homo sapiens
ctccaagccctggggca

SEQ ID NO: 5403109 - DNA, 12 bp, Homo sapiens
ctccaagccctt

SEQ ID NO: 5403110 - DNA, 12 bp, Homo sapiens
ctccaagcctct

SEQ ID NO: 5403111 - DNA, 17 bp, Homo sapiens
ctccaagcctctgtctt

SEQ ID NO: 5403112 - DNA, 18 bp, Homo sapiens
ctccaagcctgcctccca

SEQ ID NO: 5403113 - DNA, 14 bp, Homo sapiens
ctccaagcctggca

SEQ ID NO: 5403114 - DNA, 15 bp, Homo sapiens
ctccaagcctggcac

SEQ ID NO: 5403115 - DNA, 16 bp, Homo sapiens
ctccaagcctggcacc

SEQ ID NO: 5403116 - DNA, 15 bp, Homo sapiens
ctccaagcgcctggc

SEQ ID NO: 5403117 - DNA, 16 bp, Homo sapiens
ctccaagcgcctggct

SEQ ID NO: 5403118 - DNA, 14 bp, Homo sapiens
ctccaagctcccag

SEQ ID NO: 5403119 - DNA, 20 bp, Homo sapiens
ctccaagctgttaaagatat

SEQ ID NO: 5403120 - DNA, 19 bp, Homo sapiens
ctccaagcttcaagtgata

SEQ ID NO: 5403121 - DNA, 17 bp, Homo sapiens
ctccaaggacagaaggc

SEQ ID NO: 5403122 - DNA, 15 bp, Homo sapiens
ctccaaggaccaggt

SEQ ID NO: 5403123 - DNA, 19 bp, Homo sapiens
ctccaaggactaaggcctc

SEQ ID NO: 5403124 - DNA, 23 bp, Homo sapiens
ctccaaggactaaggcctccagc

SEQ ID NO: 5403125 - DNA, 14 bp, Homo sapiens
ctccaaggactcta

SEQ ID NO: 5403126 - DNA, 21 bp, Homo sapiens
ctccaaggaggggctgtaaaa

SEQ ID NO: 5403127 - DNA, 17 bp, Homo sapiens
ctccaaggatcctctcc

SEQ ID NO: 5403128 - DNA, 16 bp, Homo sapiens
ctccaaggcaaatgtc

SEQ ID NO: 5403129 - DNA, 17 bp, Homo sapiens
ctccaaggcaaatgtcc

SEQ ID NO: 5403130 - DNA, 16 bp, Homo sapiens
ctccaaggcagggacc

SEQ ID NO: 5403131 - DNA, 22 bp, Homo sapiens
ctccaaggctgtcttctcccag

SEQ ID NO: 5403132 - DNA, 23 bp, Homo sapiens
ctccaaggctgtcttctcccaga

SEQ ID NO: 5403133 - DNA, 15 bp, Homo sapiens
ctccaagggacaggt

SEQ ID NO: 5403134 - DNA, 23 bp, Homo sapiens
ctccaagggacaggtgggcctgg

SEQ ID NO: 5403135 - DNA, 19 bp, Homo sapiens
ctccaagggaccctttgcc

SEQ ID NO: 5403136 - DNA, 23 bp, Homo sapiens
ctccaagggagggtgcagccctc

SEQ ID NO: 5403137 - DNA, 13 bp, Homo sapiens
ctccaagggatct

SEQ ID NO: 5403138 - DNA, 20 bp, Homo sapiens
ctccaagggcttctgcaccc

SEQ ID NO: 5403139 - DNA, 20 bp, Homo sapiens
ctccaagggtttcgactggt

SEQ ID NO: 5403140 - DNA, 13 bp, Homo sapiens
ctccaaggtcctc

SEQ ID NO: 5403141 - DNA, 18 bp, Homo sapiens
ctccaaggtgatgttgta

SEQ ID NO: 5403142 - DNA, 16 bp, Homo sapiens
ctccaaggtgctctgt

SEQ ID NO: 5403143 - DNA, 19 bp, Homo sapiens
ctccaaggtttataaagca

SEQ ID NO: 5403144 - DNA, 20 bp, Homo sapiens
ctccaaggtttataaagcag

SEQ ID NO: 5403145 - DNA, 23 bp, Homo sapiens
ctccaaggtttataaagcagatt

SEQ ID NO: 5403146 - DNA, 14 bp, Homo sapiens
ctccaagtactttt

SEQ ID NO: 5403147 - DNA, 22 bp, Homo sapiens
ctccaagtagtccaccttcatt

SEQ ID NO: 5403148 - DNA, 23 bp, Homo sapiens
ctccaagtccacagtggaaccag

SEQ ID NO: 5403149 - DNA, 15 bp, Homo sapiens
ctccaagtctctctg

SEQ ID NO: 5403150 - DNA, 17 bp, Homo sapiens
ctccaagtctctctgtg

SEQ ID NO: 5403151 - DNA, 20 bp, Homo sapiens
ctccaagtctctctgtgaat

SEQ ID NO: 5403152 - DNA, 17 bp, Homo sapiens
ctccaagtctgtacctc

SEQ ID NO: 5403153 - DNA, 19 bp, Homo sapiens
ctccaagtctgtacctcaa

SEQ ID NO: 5403154 - DNA, 23 bp, Homo sapiens
ctccaagtctgtacctcaaatga

SEQ ID NO: 5403155 - DNA, 15 bp, Homo sapiens
ctccaagtgccccct

SEQ ID NO: 5403156 - DNA, 19 bp, Homo sapiens
ctccaagtggcagttttta

SEQ ID NO: 5403157 - DNA, 17 bp, Homo sapiens
ctccaagttgctgcagc

SEQ ID NO: 5403158 - DNA, 16 bp, Homo sapiens
ctccaatatcagtgct

SEQ ID NO: 5403159 - DNA, 15 bp, Homo sapiens
ctccaatcccatcta

SEQ ID NO: 5403160 - DNA, 15 bp, Homo sapiens
ctccaatccccactc

SEQ ID NO: 5403161 - DNA, 12 bp, Homo sapiens
ctccaatcctcc

SEQ ID NO: 5403162 - DNA, 19 bp, Homo sapiens
ctccaatcctccccgctct

SEQ ID NO: 5403163 - DNA, 14 bp, Homo sapiens
ctccaatcctgccc

SEQ ID NO: 5403164 - DNA, 15 bp, Homo sapiens
ctccaatctggtaat

SEQ ID NO: 5403165 - DNA, 16 bp, Homo sapiens
ctccaatgactgagca

SEQ ID NO: 5403166 - DNA, 17 bp, Homo sapiens
ctccaatgcattggcct

SEQ ID NO: 5403167 - DNA, 20 bp, Homo sapiens
ctccaatgcattggcctctg

SEQ ID NO: 5403168 - DNA, 23 bp, Homo sapiens
ctccaatgcattggcctctgtac

SEQ ID NO: 5403169 - DNA, 14 bp, Homo sapiens
ctccaatggaaagc

SEQ ID NO: 5403170 - DNA, 18 bp, Homo sapiens
ctccaatggggccagcac

SEQ ID NO: 5403171 - DNA, 19 bp, Homo sapiens
ctccaatggggccagcact

SEQ ID NO: 5403172 - DNA, 18 bp, Homo sapiens
ctccaatggggcggggct

SEQ ID NO: 5403173 - DNA, 14 bp, Homo sapiens
ctccaatgtcctga

SEQ ID NO: 5403174 - DNA, 15 bp, Homo sapiens
ctccaatgtctaatt

SEQ ID NO: 5403175 - DNA, 17 bp, Homo sapiens
ctccaattaaggatttt

SEQ ID NO: 5403176 - DNA, 20 bp, Homo sapiens
ctccaattaaggattttatg

SEQ ID NO: 5403177 - DNA, 22 bp, Homo sapiens
ctccaattaaggattttatgct

SEQ ID NO: 5403178 - DNA, 15 bp, Homo sapiens
ctccaattccacagt

SEQ ID NO: 5403179 - DNA, 21 bp, Homo sapiens
ctccaattccacagtctctgg

SEQ ID NO: 5403180 - DNA, 23 bp, Homo sapiens
ctccaattttttaagtgaaaata

SEQ ID NO: 5403181 - DNA, 18 bp, Homo sapiens
ctccaatttttttttcct

SEQ ID NO: 5403182 - DNA, 21 bp, Homo sapiens
ctccacaaagcaaaggcagtc

SEQ ID NO: 5403183 - DNA, 19 bp, Homo sapiens
ctccacaacagcctggggt

SEQ ID NO: 5403184 - DNA, 14 bp, Homo sapiens
ctccacaagagaga

SEQ ID NO: 5403185 - DNA, 20 bp, Homo sapiens
ctccacaagagagatgatac

SEQ ID NO: 5403186 - DNA, 13 bp, Homo sapiens
ctccacaaggtcc

SEQ ID NO: 5403187 - DNA, 14 bp, Homo sapiens
ctccacaaggtccc

SEQ ID NO: 5403188 - DNA, 21 bp, Homo sapiens
ctccacacaagggaaggacag

SEQ ID NO: 5403189 - DNA, 21 bp, Homo sapiens
ctccacacacagctgggctgt

SEQ ID NO: 5403190 - DNA, 22 bp, Homo sapiens
ctccacacagcagtgtcccctg

SEQ ID NO: 5403191 - DNA, 15 bp, Homo sapiens
ctccacacattccag

SEQ ID NO: 5403192 - DNA, 17 bp, Homo sapiens
ctccacacattccagcc

SEQ ID NO: 5403193 - DNA, 19 bp, Homo sapiens
ctccacacattccagccag

SEQ ID NO: 5403194 - DNA, 23 bp, Homo sapiens
ctccacacattccagccaggccc

SEQ ID NO: 5403195 - DNA, 11 bp, Homo sapiens
ctccacaccag

SEQ ID NO: 5403196 - DNA, 19 bp, Homo sapiens
ctccacaccagtaataaaa

SEQ ID NO: 5403197 - DNA, 21 bp, Homo sapiens
ctccacacccaccccctctgg

SEQ ID NO: 5403198 - DNA, 14 bp, Homo sapiens
ctccacacccagcc

SEQ ID NO: 5403199 - DNA, 18 bp, Homo sapiens
ctccacacccagcctgtc

SEQ ID NO: 5403200 - DNA, 13 bp, Homo sapiens
ctccacacccgcg

SEQ ID NO: 5403201 - DNA, 20 bp, Homo sapiens
ctccacaccctctcccagga

SEQ ID NO: 5403202 - DNA, 13 bp, Homo sapiens
ctccacacctcca

SEQ ID NO: 5403203 - DNA, 16 bp, Homo sapiens
ctccacacctccaccc

SEQ ID NO: 5403204 - DNA, 17 bp, Homo sapiens
ctccacacctccaccgt

SEQ ID NO: 5403205 - DNA, 13 bp, Homo sapiens
ctccacacctgaa

SEQ ID NO: 5403206 - DNA, 14 bp, Homo sapiens
ctccaggcctgcag

SEQ ID NO: 5403207 - DNA, 17 bp, Homo sapiens
ctccaggcctgcagcag

SEQ ID NO: 5403208 - DNA, 15 bp, Homo sapiens
ctccaggcctgcagg

SEQ ID NO: 5403209 - DNA, 16 bp, Homo sapiens
ctccaggcctgcctcc

SEQ ID NO: 5403210 - DNA, 17 bp, Homo sapiens
ctccaggcctgcctccc

SEQ ID NO: 5403211 - DNA, 22 bp, Homo sapiens
ctccaggcctgcctcccacttc

SEQ ID NO: 5403212 - DNA, 13 bp, Homo sapiens
ctccaggcctgtt

SEQ ID NO: 5403213 - DNA, 20 bp, Homo sapiens
ctccaggcctgttgctatag

SEQ ID NO: 5403214 - DNA, 18 bp, Homo sapiens
ctccaggcgccggcgggc

SEQ ID NO: 5403215 - DNA, 14 bp, Homo sapiens
ctccaggctccagc

SEQ ID NO: 5403216 - DNA, 16 bp, Homo sapiens
ctccaggctccagcac

SEQ ID NO: 5403217 - DNA, 19 bp, Homo sapiens
ctccaggctccagcacatc

SEQ ID NO: 5403218 - DNA, 18 bp, Homo sapiens
ctccaggctccaggctga

SEQ ID NO: 5403219 - DNA, 20 bp, Homo sapiens
ctccaggctccaggctgact

SEQ ID NO: 5403220 - DNA, 13 bp, Homo sapiens
ctccaggctgact

SEQ ID NO: 5403221 - DNA, 18 bp, Homo sapiens
ctccaggctgactggggg

SEQ ID NO: 5403222 - DNA, 23 bp, Homo sapiens
ctccaggctgactgggggcctct

SEQ ID NO: 5403223 - DNA, 19 bp, Homo sapiens
ctccaggctggaagtactt

SEQ ID NO: 5403224 - DNA, 14 bp, Homo sapiens
ctccaggctgggct

SEQ ID NO: 5403225 - DNA, 15 bp, Homo sapiens
ctccaggctgggctg

SEQ ID NO: 5403226 - DNA, 16 bp, Homo sapiens
ctccaggctgggctga

SEQ ID NO: 5403227 - DNA, 13 bp, Homo sapiens
ctccaggctgggg

SEQ ID NO: 5403228 - DNA, 16 bp, Homo sapiens
ctccaggctggggcct

SEQ ID NO: 5403229 - DNA, 18 bp, Homo sapiens
ctccaggctggggcctgg

SEQ ID NO: 5403230 - DNA, 20 bp, Homo sapiens
ctccaggctgtatcccatga

SEQ ID NO: 5403231 - DNA, 20 bp, Homo sapiens
ctccaggcttcacagtctgg

SEQ ID NO: 5403232 - DNA, 23 bp, Homo sapiens
ctccaggcttcacagtctggtgc

SEQ ID NO: 5403233 - DNA, 21 bp, Homo sapiens
ctccaggcttcctgccctagc

SEQ ID NO: 5403234 - DNA, 15 bp, Homo sapiens
ctccaggctttccca

SEQ ID NO: 5403235 - DNA, 17 bp, Homo sapiens
ctccaggctttctggag

SEQ ID NO: 5403236 - DNA, 22 bp, Homo sapiens
ctccagggaaggtggccacagc

SEQ ID NO: 5403237 - DNA, 16 bp, Homo sapiens
ctccagggaatccaag

SEQ ID NO: 5403238 - DNA, 19 bp, Homo sapiens
ctccagggaatccaagcct

SEQ ID NO: 5403239 - DNA, 17 bp, Homo sapiens
ctccagggaattcttac

SEQ ID NO: 5403240 - DNA, 20 bp, Homo sapiens
ctccagggaattcttacagc

SEQ ID NO: 5403241 - DNA, 14 bp, Homo sapiens
ctccagggacagca

SEQ ID NO: 5403242 - DNA, 23 bp, Homo sapiens
ctccagggacagcaactatcaga

SEQ ID NO: 5403243 - DNA, 22 bp, Homo sapiens
ctccagggacccttgcctgcct

SEQ ID NO: 5403244 - DNA, 18 bp, Homo sapiens
ctccagggagcaagacag

SEQ ID NO: 5403245 - DNA, 18 bp, Homo sapiens
ctccagggagtcccctcc

SEQ ID NO: 5403246 - DNA, 20 bp, Homo sapiens
ctccagggagtcccctcccc

SEQ ID NO: 5403247 - DNA, 17 bp, Homo sapiens
ctccagggatggcccct

SEQ ID NO: 5403248 - DNA, 16 bp, Homo sapiens
ctccagggcattgctc

SEQ ID NO: 5403249 - DNA, 20 bp, Homo sapiens
ctccagggcattgctcagcc

SEQ ID NO: 5403250 - DNA, 21 bp, Homo sapiens
ctccagggcattgctcagccc

SEQ ID NO: 5403251 - DNA, 11 bp, Homo sapiens
ctccagggcca

SEQ ID NO: 5403252 - DNA, 20 bp, Homo sapiens
ctccagggccaggattcagg

SEQ ID NO: 5403253 - DNA, 18 bp, Homo sapiens
ctccagggcccccaccga

SEQ ID NO: 5403254 - DNA, 23 bp, Homo sapiens
ctccagggcctctccttggaagg

SEQ ID NO: 5403255 - DNA, 15 bp, Homo sapiens
ctccagggctccaaa

SEQ ID NO: 5403256 - DNA, 21 bp, Homo sapiens
ctccaggggcagggccttgtc

SEQ ID NO: 5403257 - DNA, 23 bp, Homo sapiens
ctccaggggcccttgggacagcc

SEQ ID NO: 5403258 - DNA, 18 bp, Homo sapiens
ctccaggggcctgcagaa

SEQ ID NO: 5403259 - DNA, 19 bp, Homo sapiens
ctccaggggctcctgggtt

SEQ ID NO: 5403260 - DNA, 21 bp, Homo sapiens
ctccaggggctgcttcctcct

SEQ ID NO: 5403261 - DNA, 23 bp, Homo sapiens
ctccaggggctgcttcctcctgg

SEQ ID NO: 5403262 - DNA, 17 bp, Homo sapiens
ctccaggggctggggac

SEQ ID NO: 5403263 - DNA, 20 bp, Homo sapiens
ctccaggggctggggacttc

SEQ ID NO: 5403264 - DNA, 16 bp, Homo sapiens
ctccagggggcctgca

SEQ ID NO: 5403265 - DNA, 23 bp, Homo sapiens
ctccagggggcctgcaggcccca

SEQ ID NO: 5403266 - DNA, 19 bp, Homo sapiens
ctccaggggggacaatatg

SEQ ID NO: 5403267 - DNA, 20 bp, Homo sapiens
ctccagggggtgccctccca

SEQ ID NO: 5403268 - DNA, 20 bp, Homo sapiens
ctccaggggtcctaggcctc

SEQ ID NO: 5403269 - DNA, 14 bp, Homo sapiens
ctccagggtcccct

SEQ ID NO: 5403270 - DNA, 18 bp, Homo sapiens
ctccagggtcccctgcca

SEQ ID NO: 5403271 - DNA, 19 bp, Homo sapiens
ctccagggtcccctgccac

SEQ ID NO: 5403272 - DNA, 14 bp, Homo sapiens
ctccagggtcctct

SEQ ID NO: 5403273 - DNA, 17 bp, Homo sapiens
ctccagggtcctctctt

SEQ ID NO: 5403274 - DNA, 18 bp, Homo sapiens
ctccagggtcctctcttc

SEQ ID NO: 5403275 - DNA, 23 bp, Homo sapiens
ctccagggtcctctcttccacag

SEQ ID NO: 5403276 - DNA, 13 bp, Homo sapiens
ctccagggtcttg

SEQ ID NO: 5403277 - DNA, 20 bp, Homo sapiens
ctccagggtcttgggctact

SEQ ID NO: 5403278 - DNA, 21 bp, Homo sapiens
ctccagggtcttgggctactg

SEQ ID NO: 5403279 - DNA, 22 bp, Homo sapiens
ctccagggtcttgggctactgg

SEQ ID NO: 5403280 - DNA, 12 bp, Homo sapiens
ctccagggtgct

SEQ ID NO: 5403281 - DNA, 19 bp, Homo sapiens
ctccagggtggcagcaaca

SEQ ID NO: 5403282 - DNA, 17 bp, Homo sapiens
ctccaggtaccttgacc

SEQ ID NO: 5403283 - DNA, 20 bp, Homo sapiens
ctccaggtaccttgaccttt

SEQ ID NO: 5403284 - DNA, 19 bp, Homo sapiens
ctccaggtcagcctggaag

SEQ ID NO: 5403285 - DNA, 20 bp, Homo sapiens
ctccaggtcagcctggaagg

SEQ ID NO: 5403286 - DNA, 22 bp, Homo sapiens
ctccaggtcggagtgcctggag

SEQ ID NO: 5403287 - DNA, 23 bp, Homo sapiens
ctccaggtgcacaagctccaagc

SEQ ID NO: 5403288 - DNA, 13 bp, Homo sapiens
ctccaggtgcaga

SEQ ID NO: 5403289 - DNA, 18 bp, Homo sapiens
ctccaggtgccctgtggg

SEQ ID NO: 5403290 - DNA, 14 bp, Homo sapiens
ctccaggtgtgcac

SEQ ID NO: 5403291 - DNA, 13 bp, Homo sapiens
ctccaggttcctc

SEQ ID NO: 5403292 - DNA, 14 bp, Homo sapiens
ctccaggttcctca

SEQ ID NO: 5403293 - DNA, 15 bp, Homo sapiens
ctccaggttgcctca

SEQ ID NO: 5403294 - DNA, 22 bp, Homo sapiens
ctccaggttgcctcaacagcag

SEQ ID NO: 5403295 - DNA, 18 bp, Homo sapiens
ctccaggtttttcaatta

SEQ ID NO: 5403296 - DNA, 19 bp, Homo sapiens
ctccaggtttttcaattaa

SEQ ID NO: 5403297 - DNA, 22 bp, Homo sapiens
ctccagtaaaagttgtgcctca

SEQ ID NO: 5403298 - DNA, 15 bp, Homo sapiens
ctccagtacaataaa

SEQ ID NO: 5403299 - DNA, 16 bp, Homo sapiens
ctccagtaccttgctt

SEQ ID NO: 5403300 - DNA, 14 bp, Homo sapiens
ctccagtacgtccc

SEQ ID NO: 5403301 - DNA, 24 bp, Homo sapiens
ctccagtacgtcccgctgctgtgc

SEQ ID NO: 5403302 - DNA, 21 bp, Homo sapiens
ctccagtactggagcttctct

SEQ ID NO: 5403303 - DNA, 16 bp, Homo sapiens
ctccagtagtggacaa

SEQ ID NO: 5403304 - DNA, 15 bp, Homo sapiens
ctccagtatgaaatt

SEQ ID NO: 5403305 - DNA, 14 bp, Homo sapiens
ctccagtatgacag

SEQ ID NO: 5403306 - DNA, 20 bp, Homo sapiens
ctccagtattcttgtcaaaa

SEQ ID NO: 5403307 - DNA, 14 bp, Homo sapiens
ctccagtcacactc

SEQ ID NO: 5403308 - DNA, 16 bp, Homo sapiens
ctccagtcaggaggca

SEQ ID NO: 5403309 - DNA, 22 bp, Homo sapiens
ctccagtcatctgtaagagctt

SEQ ID NO: 5403310 - DNA, 14 bp, Homo sapiens
ctccagtccccaga

SEQ ID NO: 5403311 - DNA, 17 bp, Homo sapiens
ctccagtccccagaact

SEQ ID NO: 5403312 - DNA, 17 bp, Homo sapiens
ctccagtccctgggagc

SEQ ID NO: 5403313 - DNA, 13 bp, Homo sapiens
ctccagtcctgcc

SEQ ID NO: 5403314 - DNA, 17 bp, Homo sapiens
ctccagtcctgccacca

SEQ ID NO: 5403315 - DNA, 21 bp, Homo sapiens
ctccagtcctgccaccaccct

SEQ ID NO: 5403316 - DNA, 14 bp, Homo sapiens
ctccagtcctgctc

SEQ ID NO: 5403317 - DNA, 17 bp, Homo sapiens
ctccagtcctgctctct

SEQ ID NO: 5403318 - DNA, 20 bp, Homo sapiens
ctccagtcctgctctctacc

SEQ ID NO: 5403319 - DNA, 17 bp, Homo sapiens
ctccagtcctgctggcc

SEQ ID NO: 5403320 - DNA, 18 bp, Homo sapiens
ctccagtcctgctggcct

SEQ ID NO: 5403321 - DNA, 23 bp, Homo sapiens
ctccagtcctgctggcctgctct

SEQ ID NO: 5403322 - DNA, 17 bp, Homo sapiens
ctccagtcgttatttct

SEQ ID NO: 5403323 - DNA, 19 bp, Homo sapiens
ctccagtcgttatttctgt

SEQ ID NO: 5403324 - DNA, 18 bp, Homo sapiens
ctccagtctcatcctccc

SEQ ID NO: 5403325 - DNA, 22 bp, Homo sapiens
ctccagtctcatcctcccattg

SEQ ID NO: 5403326 - DNA, 15 bp, Homo sapiens
ctccagtctgccata

SEQ ID NO: 5403327 - DNA, 17 bp, Homo sapiens
ctccagtctgctctcag

SEQ ID NO: 5403328 - DNA, 21 bp, Homo sapiens
ctccagtctgctctcagcttg

SEQ ID NO: 5403329 - DNA, 20 bp, Homo sapiens
ctccagtctgctgccctcca

SEQ ID NO: 5403330 - DNA, 21 bp, Homo sapiens
ctccagtctgctgccctccat

SEQ ID NO: 5403331 - DNA, 17 bp, Homo sapiens
ctccagtgagtacctgc

SEQ ID NO: 5403332 - DNA, 18 bp, Homo sapiens
ctccagtgccgctcctgc

SEQ ID NO: 5403333 - DNA, 19 bp, Homo sapiens
ctccagtgccgctcctgct

SEQ ID NO: 5403334 - DNA, 20 bp, Homo sapiens
ctccagtgccgctcctgctt

SEQ ID NO: 5403335 - DNA, 22 bp, Homo sapiens
ctccagtgccgctcctgcttcc

SEQ ID NO: 5403336 - DNA, 20 bp, Homo sapiens
ctccagtgctcagctgtggc

SEQ ID NO: 5403337 - DNA, 21 bp, Homo sapiens
ctccagtgctcagctgtggct

SEQ ID NO: 5403338 - DNA, 22 bp, Homo sapiens
ctccagtgctcagctgtggctg

SEQ ID NO: 5403339 - DNA, 16 bp, Homo sapiens
ctccagtgctggattt

SEQ ID NO: 5403340 - DNA, 17 bp, Homo sapiens
ctccagtgggaggacag

SEQ ID NO: 5403341 - DNA, 16 bp, Homo sapiens
ctccagtgggcagggg

SEQ ID NO: 5403342 - DNA, 21 bp, Homo sapiens
ctccagtgggctgatgctggg

SEQ ID NO: 5403343 - DNA, 14 bp, Homo sapiens
ctccagtggtgacc

SEQ ID NO: 5403344 - DNA, 16 bp, Homo sapiens
ctccagtggttgctgt

SEQ ID NO: 5403345 - DNA, 14 bp, Homo sapiens
ctccagtgtcaggg

SEQ ID NO: 5403346 - DNA, 19 bp, Homo sapiens
ctccagtgtcctgagctca

SEQ ID NO: 5403347 - DNA, 22 bp, Homo sapiens
ctccagtgttccccccatagag

SEQ ID NO: 5403348 - DNA, 16 bp, Homo sapiens
ctccagtgttgcctcc

SEQ ID NO: 5403349 - DNA, 15 bp, Homo sapiens
ctccagttctttata

SEQ ID NO: 5403350 - DNA, 17 bp, Homo sapiens
ctccagttgggactcag

SEQ ID NO: 5403351 - DNA, 16 bp, Homo sapiens
ctccagtttcacctct

SEQ ID NO: 5403352 - DNA, 18 bp, Homo sapiens
ctccagtttcagaagcag

SEQ ID NO: 5403353 - DNA, 19 bp, Homo sapiens
ctccagtttcagaagcagg

SEQ ID NO: 5403354 - DNA, 22 bp, Homo sapiens
ctccagtttcagaagcaggcag

SEQ ID NO: 5403355 - DNA, 14 bp, Homo sapiens
ctccagtttcccca

SEQ ID NO: 5403356 - DNA, 23 bp, Homo sapiens
ctccagtttctcttaagctgccc

SEQ ID NO: 5403357 - DNA, 16 bp, Homo sapiens
ctccagtttgcacctg

SEQ ID NO: 5403358 - DNA, 16 bp, Homo sapiens
ctccagtttgcatttg

SEQ ID NO: 5403359 - DNA, 18 bp, Homo sapiens
ctccagttttctcctctg

SEQ ID NO: 5403360 - DNA, 21 bp, Homo sapiens
ctccagttttgcctgagaagg

SEQ ID NO: 5403361 - DNA, 16 bp, Homo sapiens
ctccagtttttgagga

SEQ ID NO: 5403362 - DNA, 14 bp, Homo sapiens
ctccagtttttgtt

SEQ ID NO: 5403363 - DNA, 21 bp, Homo sapiens
ctccataaaaagaaagctaat

SEQ ID NO: 5403364 - DNA, 19 bp, Homo sapiens
ctccataaagtacaaatga

SEQ ID NO: 5403365 - DNA, 14 bp, Homo sapiens
ctccataaccccac

SEQ ID NO: 5403366 - DNA, 15 bp, Homo sapiens
ctccataaccccacc

SEQ ID NO: 5403367 - DNA, 22 bp, Homo sapiens
ctccataagtggagaaatgaaa

SEQ ID NO: 5403368 - DNA, 18 bp, Homo sapiens
ctccataagtttaacttt

SEQ ID NO: 5403369 - DNA, 16 bp, Homo sapiens
ctccataatgccactg

SEQ ID NO: 5403370 - DNA, 17 bp, Homo sapiens
ctccatacacacgctgc

SEQ ID NO: 5403371 - DNA, 13 bp, Homo sapiens
ctccatacagcct

SEQ ID NO: 5403372 - DNA, 15 bp, Homo sapiens
ctccatacagcctct

SEQ ID NO: 5403373 - DNA, 16 bp, Homo sapiens
ctccataccttttctc

SEQ ID NO: 5403374 - DNA, 20 bp, Homo sapiens
ctccataccttttctctttt

SEQ ID NO: 5403375 - DNA, 20 bp, Homo sapiens
ctccatactgtttctttctt

SEQ ID NO: 5403376 - DNA, 19 bp, Homo sapiens
ctccatagaccttttcatt

SEQ ID NO: 5403377 - DNA, 18 bp, Homo sapiens
ctccatagtttggcattt

SEQ ID NO: 5403378 - DNA, 15 bp, Homo sapiens
ctccatatcagctct

SEQ ID NO: 5403379 - DNA, 19 bp, Homo sapiens
ctccatatcagctctctgc

SEQ ID NO: 5403380 - DNA, 17 bp, Homo sapiens
ctccatatcccgggagc

SEQ ID NO: 5403381 - DNA, 19 bp, Homo sapiens
ctcccagaaggctgggtcc

SEQ ID NO: 5403382 - DNA, 15 bp, Homo sapiens
ctcccagaatcccag

SEQ ID NO: 5403383 - DNA, 16 bp, Homo sapiens
ctcccagaatcccagc

SEQ ID NO: 5403384 - DNA, 20 bp, Homo sapiens
ctcccagaatcccagccggc

SEQ ID NO: 5403385 - DNA, 21 bp, Homo sapiens
ctcccagaatcccagccggcc

SEQ ID NO: 5403386 - DNA, 16 bp, Homo sapiens
ctcccagacccagggc

SEQ ID NO: 5403387 - DNA, 19 bp, Homo sapiens
ctcccagacccagggcagt

SEQ ID NO: 5403388 - DNA, 20 bp, Homo sapiens
ctcccagacctgcctcttcc

SEQ ID NO: 5403389 - DNA, 21 bp, Homo sapiens
ctcccagacttgtttcctgtg

SEQ ID NO: 5403390 - DNA, 19 bp, Homo sapiens
ctcccagaggagccaccag

SEQ ID NO: 5403391 - DNA, 21 bp, Homo sapiens
ctcccagaggagccaccagtt

SEQ ID NO: 5403392 - DNA, 16 bp, Homo sapiens
ctcccagaggctcctg

SEQ ID NO: 5403393 - DNA, 16 bp, Homo sapiens
ctcccagagtgctagg

SEQ ID NO: 5403394 - DNA, 12 bp, Homo sapiens
ctcccagatcca

SEQ ID NO: 5403395 - DNA, 16 bp, Homo sapiens
ctcccagatccaggaa

SEQ ID NO: 5403396 - DNA, 22 bp, Homo sapiens
ctcccagatccaggaacacatg

SEQ ID NO: 5403397 - DNA, 13 bp, Homo sapiens
ctcccagatcctg

SEQ ID NO: 5403398 - DNA, 15 bp, Homo sapiens
ctcccagatgctggg

SEQ ID NO: 5403399 - DNA, 16 bp, Homo sapiens
ctcccagatgctgggg

SEQ ID NO: 5403400 - DNA, 22 bp, Homo sapiens
ctcccagatttttactttttcc

SEQ ID NO: 5403401 - DNA, 14 bp, Homo sapiens
ctcccagcacaggc

SEQ ID NO: 5403402 - DNA, 18 bp, Homo sapiens
ctcccagcacaggcacct

SEQ ID NO: 5403403 - DNA, 23 bp, Homo sapiens
ctcccagcacaggcacctatgtg

SEQ ID NO: 5403404 - DNA, 20 bp, Homo sapiens
ctcccagcactccccttgcc

SEQ ID NO: 5403405 - DNA, 17 bp, Homo sapiens
ctcccagcactgcctcc

SEQ ID NO: 5403406 - DNA, 19 bp, Homo sapiens
ctcccagcactgcctcctg

SEQ ID NO: 5403407 - DNA, 13 bp, Homo sapiens
ctcccagcagagc

SEQ ID NO: 5403408 - DNA, 19 bp, Homo sapiens
ctcccagcagagcccacca

SEQ ID NO: 5403409 - DNA, 22 bp, Homo sapiens
ctcccagccaccaccactgtcc

SEQ ID NO: 5403410 - DNA, 15 bp, Homo sapiens
ctcccagccacccgg

SEQ ID NO: 5403411 - DNA, 20 bp, Homo sapiens
ctcccagcccatctgaacac

SEQ ID NO: 5403412 - DNA, 20 bp, Homo sapiens
ctcccagcccattgctgcca

SEQ ID NO: 5403413 - DNA, 22 bp, Homo sapiens
ctcccagcccattgctgccaag

SEQ ID NO: 5403414 - DNA, 18 bp, Homo sapiens
ctcccagcccctgcccct

SEQ ID NO: 5403415 - DNA, 16 bp, Homo sapiens
ctcccagccctcagca

SEQ ID NO: 5403416 - DNA, 18 bp, Homo sapiens
ctcccagccctgaggggt

SEQ ID NO: 5403417 - DNA, 19 bp, Homo sapiens
ctcccagccctgaggggtg

SEQ ID NO: 5403418 - DNA, 11 bp, Homo sapiens
ctcccagcctc

SEQ ID NO: 5403419 - DNA, 14 bp, Homo sapiens
ctcccagcctcagc

SEQ ID NO: 5403420 - DNA, 22 bp, Homo sapiens
ctcccagcctcttgctcagagc

SEQ ID NO: 5403421 - DNA, 23 bp, Homo sapiens
ctcccagcctgccctccagctgc

SEQ ID NO: 5403422 - DNA, 13 bp, Homo sapiens
ctcccagcctgct

SEQ ID NO: 5403423 - DNA, 22 bp, Homo sapiens
ctcccagcgctggctccaggct

SEQ ID NO: 5403424 - DNA, 13 bp, Homo sapiens
ctcccagcggcct

SEQ ID NO: 5403425 - DNA, 16 bp, Homo sapiens
ctcccagcgtgtgtat

SEQ ID NO: 5403426 - DNA, 17 bp, Homo sapiens
ctcccagcgtgtgtatc

SEQ ID NO: 5403427 - DNA, 18 bp, Homo sapiens
ctcccagctctagacaac

SEQ ID NO: 5403428 - DNA, 17 bp, Homo sapiens
ctcccagctctagcctc

SEQ ID NO: 5403429 - DNA, 17 bp, Homo sapiens
ctcccagctctctctcc

SEQ ID NO: 5403430 - DNA, 18 bp, Homo sapiens
ctcccagctctctctcct

SEQ ID NO: 5403431 - DNA, 20 bp, Homo sapiens
ctcccagctctctctcctgg

SEQ ID NO: 5403432 - DNA, 12 bp, Homo sapiens
ctcccagctctg

SEQ ID NO: 5403433 - DNA, 13 bp, Homo sapiens
ctcccagctctgg

SEQ ID NO: 5403434 - DNA, 20 bp, Homo sapiens
ctcccagctgacagtcctct

SEQ ID NO: 5403435 - DNA, 21 bp, Homo sapiens
ctcccagctgacagtcctctc

SEQ ID NO: 5403436 - DNA, 12 bp, Homo sapiens
ctcccagctgct

SEQ ID NO: 5403437 - DNA, 14 bp, Homo sapiens
ctcccagctgcttt

SEQ ID NO: 5403438 - DNA, 21 bp, Homo sapiens
ctcccagctgtaccggccact

SEQ ID NO: 5403439 - DNA, 17 bp, Homo sapiens
ctcccagctgtgctgtg

SEQ ID NO: 5403440 - DNA, 17 bp, Homo sapiens
ctcccagcttcaaatgc

SEQ ID NO: 5403441 - DNA, 16 bp, Homo sapiens
ctcccaggaaccaaaa

SEQ ID NO: 5403442 - DNA, 23 bp, Homo sapiens
ctcccaggaaccgaacatatcat

SEQ ID NO: 5403443 - DNA, 16 bp, Homo sapiens
ctcccaggaagcccag

SEQ ID NO: 5403444 - DNA, 15 bp, Homo sapiens
ctcccaggaccacag

SEQ ID NO: 5403445 - DNA, 22 bp, Homo sapiens
ctcccaggacctcggatgacca

SEQ ID NO: 5403446 - DNA, 20 bp, Homo sapiens
ctcccaggacctggagacag

SEQ ID NO: 5403447 - DNA, 16 bp, Homo sapiens
ctcccaggacgcaggg

SEQ ID NO: 5403448 - DNA, 19 bp, Homo sapiens
ctcccaggacgcagggaga

SEQ ID NO: 5403449 - DNA, 19 bp, Homo sapiens
ctcccaggagacagttcaa

SEQ ID NO: 5403450 - DNA, 21 bp, Homo sapiens
ctcccaggagcctgcccagcc

SEQ ID NO: 5403451 - DNA, 19 bp, Homo sapiens
ctcccaggcattccccagg

SEQ ID NO: 5403452 - DNA, 20 bp, Homo sapiens
ctcccaggcattccccagga

SEQ ID NO: 5403453 - DNA, 21 bp, Homo sapiens
ctcccaggccacctcagtctc

SEQ ID NO: 5403454 - DNA, 17 bp, Homo sapiens
ctcccaggccaggctcc

SEQ ID NO: 5403455 - DNA, 14 bp, Homo sapiens
ctcccaggccccag

SEQ ID NO: 5403456 - DNA, 15 bp, Homo sapiens
ctcccaggccccagg

SEQ ID NO: 5403457 - DNA, 15 bp, Homo sapiens
ctcccaggccccatg

SEQ ID NO: 5403458 - DNA, 18 bp, Homo sapiens
ctcccaggccccctgcat

SEQ ID NO: 5403459 - DNA, 12 bp, Homo sapiens
ctcccaggcccg

SEQ ID NO: 5403460 - DNA, 16 bp, Homo sapiens
ctcccaggcctctgcc

SEQ ID NO: 5403461 - DNA, 17 bp, Homo sapiens
ctcccaggcctctgccc

SEQ ID NO: 5403462 - DNA, 18 bp, Homo sapiens
ctcccaggcctgcctgca

SEQ ID NO: 5403463 - DNA, 17 bp, Homo sapiens
ctcccaggcgccccttc

SEQ ID NO: 5403464 - DNA, 12 bp, Homo sapiens
ctcccaggctgc

SEQ ID NO: 5403465 - DNA, 15 bp, Homo sapiens
ctcccaggctgctgg

SEQ ID NO: 5403466 - DNA, 19 bp, Homo sapiens
ctcccaggctggagtgcag

SEQ ID NO: 5403467 - DNA, 20 bp, Homo sapiens
ctcccaggctggagtgcagt

SEQ ID NO: 5403468 - DNA, 13 bp, Homo sapiens
ctcccagggagtg

SEQ ID NO: 5403469 - DNA, 21 bp, Homo sapiens
ctcccagggagtgagcagcta

SEQ ID NO: 5403470 - DNA, 12 bp, Homo sapiens
ctcccagggcca

SEQ ID NO: 5403471 - DNA, 22 bp, Homo sapiens
ctcccagggccagggccctgca

SEQ ID NO: 5403472 - DNA, 23 bp, Homo sapiens
ctcccagggccagggccctgcag

SEQ ID NO: 5403473 - DNA, 20 bp, Homo sapiens
ctcccagggccatgaacttt

SEQ ID NO: 5403474 - DNA, 21 bp, Homo sapiens
ctcccagggccatgaactttg

SEQ ID NO: 5403475 - DNA, 13 bp, Homo sapiens
ctcccagggcccg

SEQ ID NO: 5403476 - DNA, 15 bp, Homo sapiens
ctcccagggcccgag

SEQ ID NO: 5403477 - DNA, 16 bp, Homo sapiens
ctcccagggcctcctg

SEQ ID NO: 5403478 - DNA, 17 bp, Homo sapiens
ctcccagggctacacag

SEQ ID NO: 5403479 - DNA, 21 bp, Homo sapiens
ctcccagggctctctggacca

SEQ ID NO: 5403480 - DNA, 17 bp, Homo sapiens
ctcccaggggcctttgc

SEQ ID NO: 5403481 - DNA, 19 bp, Homo sapiens
ctcccaggggcctttgcag

SEQ ID NO: 5403482 - DNA, 19 bp, Homo sapiens
ctcccaggggctccacctg

SEQ ID NO: 5403483 - DNA, 19 bp, Homo sapiens
ctcccaggggctccctccg

SEQ ID NO: 5403484 - DNA, 16 bp, Homo sapiens
ctcccagggtcctggg

SEQ ID NO: 5403485 - DNA, 21 bp, Homo sapiens
ctcccagggtggaggaaggtg

SEQ ID NO: 5403486 - DNA, 12 bp, Homo sapiens
ctcccagggttt

SEQ ID NO: 5403487 - DNA, 15 bp, Homo sapiens
ctcccagggttttaa

SEQ ID NO: 5403488 - DNA, 20 bp, Homo sapiens
ctcccagggttttaactttg

SEQ ID NO: 5403489 - DNA, 22 bp, Homo sapiens
ctcccagggttttaactttgtt

SEQ ID NO: 5403490 - DNA, 21 bp, Homo sapiens
ctcccaggtaccagctgcgct

SEQ ID NO: 5403491 - DNA, 23 bp, Homo sapiens
ctcccaggtgaaatccacaccag

SEQ ID NO: 5403492 - DNA, 22 bp, Homo sapiens
ctcccaggtgttaacattccaa

SEQ ID NO: 5403493 - DNA, 19 bp, Homo sapiens
ctcccaggttcccccagca

SEQ ID NO: 5403494 - DNA, 17 bp, Homo sapiens
ctcccaggttgacacca

SEQ ID NO: 5403495 - DNA, 15 bp, Homo sapiens
ctcccaggtttcttc

SEQ ID NO: 5403496 - DNA, 17 bp, Homo sapiens
ctcccaggtttcttctc

SEQ ID NO: 5403497 - DNA, 20 bp, Homo sapiens
ctcccaggtttcttctctgg

SEQ ID NO: 5403498 - DNA, 22 bp, Homo sapiens
ctcccaggtttcttctctggag

SEQ ID NO: 5403499 - DNA, 16 bp, Homo sapiens
ctcccagtaagggcgt

SEQ ID NO: 5403500 - DNA, 16 bp, Homo sapiens
ctcccagtacctcctg

SEQ ID NO: 5403501 - DNA, 16 bp, Homo sapiens
ctcccagtatgtttta

SEQ ID NO: 5403502 - DNA, 17 bp, Homo sapiens
ctcccagtatgttttaa

SEQ ID NO: 5403503 - DNA, 23 bp, Homo sapiens
ctcccagtatgttttaacaaaaa

SEQ ID NO: 5403504 - DNA, 20 bp, Homo sapiens
ctcccagtccaaatgtcctc

SEQ ID NO: 5403505 - DNA, 18 bp, Homo sapiens
ctcccagtcctccagacc

SEQ ID NO: 5403506 - DNA, 17 bp, Homo sapiens
ctcccagtcctgcctga

SEQ ID NO: 5403507 - DNA, 18 bp, Homo sapiens
ctcccagtcgaggctggt

SEQ ID NO: 5403508 - DNA, 16 bp, Homo sapiens
ctcccagtctacccag

SEQ ID NO: 5403509 - DNA, 19 bp, Homo sapiens
ctcccagtctacccagaga

SEQ ID NO: 5403510 - DNA, 21 bp, Homo sapiens
ctcccagtctcatctcctgac

SEQ ID NO: 5403511 - DNA, 13 bp, Homo sapiens
ctcccagtctctg

SEQ ID NO: 5403512 - DNA, 16 bp, Homo sapiens
ctcccagtctctgtcg

SEQ ID NO: 5403513 - DNA, 14 bp, Homo sapiens
ctcccagtgccttc

SEQ ID NO: 5403514 - DNA, 12 bp, Homo sapiens
ctcccagtgtct

SEQ ID NO: 5403515 - DNA, 19 bp, Homo sapiens
ctcccagtgtcttcctgtg

SEQ ID NO: 5403516 - DNA, 23 bp, Homo sapiens
ctcccagttccctggacagagct

SEQ ID NO: 5403517 - DNA, 15 bp, Homo sapiens
ctcccatcacctcta

SEQ ID NO: 5403518 - DNA, 16 bp, Homo sapiens
ctcccatcattccttc

SEQ ID NO: 5403519 - DNA, 22 bp, Homo sapiens
ctcccatccagggcccccatct

SEQ ID NO: 5403520 - DNA, 16 bp, Homo sapiens
ctcccatccccctgcc

SEQ ID NO: 5403521 - DNA, 17 bp, Homo sapiens
ctcccatccccctgccc

SEQ ID NO: 5403522 - DNA, 24 bp, Homo sapiens
ctcccatccccctgccctcgtggc

SEQ ID NO: 5403523 - DNA, 12 bp, Homo sapiens
ctcccatcccct

SEQ ID NO: 5403524 - DNA, 15 bp, Homo sapiens
ctcccatcccctcaa

SEQ ID NO: 5403525 - DNA, 17 bp, Homo sapiens
ctcccatcccctcaaca

SEQ ID NO: 5403526 - DNA, 14 bp, Homo sapiens
ctcccatcccttca

SEQ ID NO: 5403527 - DNA, 16 bp, Homo sapiens
ctcccatcccttcaac

SEQ ID NO: 5403528 - DNA, 16 bp, Homo sapiens
ctcccatcctcaccca

SEQ ID NO: 5403529 - DNA, 17 bp, Homo sapiens
ctcccatcctccagccc

SEQ ID NO: 5403530 - DNA, 15 bp, Homo sapiens
ctcccatcctggggc

SEQ ID NO: 5403531 - DNA, 15 bp, Homo sapiens
ctcccatccttccct

SEQ ID NO: 5403532 - DNA, 14 bp, Homo sapiens
ctcccatctcacac

SEQ ID NO: 5403533 - DNA, 12 bp, Homo sapiens
ctcccatctcct

SEQ ID NO: 5403534 - DNA, 13 bp, Homo sapiens
ctcccatctcctg

SEQ ID NO: 5403535 - DNA, 22 bp, Homo sapiens
ctcccatctccttacctctgga

SEQ ID NO: 5403536 - DNA, 21 bp, Homo sapiens
ctcccatctccttcccccagc

SEQ ID NO: 5403537 - DNA, 23 bp, Homo sapiens
ctcccatctccttcccccagccc

SEQ ID NO: 5403538 - DNA, 17 bp, Homo sapiens
ctcccatctctacccca

SEQ ID NO: 5403539 - DNA, 12 bp, Homo sapiens
ctcccatctggg

SEQ ID NO: 5403540 - DNA, 13 bp, Homo sapiens
ctcccatctggga

SEQ ID NO: 5403541 - DNA, 14 bp, Homo sapiens
ctcccatctgtgaa

SEQ ID NO: 5403542 - DNA, 18 bp, Homo sapiens
ctcccatctgtgaaagga

SEQ ID NO: 5403543 - DNA, 16 bp, Homo sapiens
ctcccatgaagccttt

SEQ ID NO: 5403544 - DNA, 22 bp, Homo sapiens
ctcccatgactgcccagctctg

SEQ ID NO: 5403545 - DNA, 20 bp, Homo sapiens
ctcccatgagggagatgcca

SEQ ID NO: 5403546 - DNA, 22 bp, Homo sapiens
ctcccatgcaagtagctggctg

SEQ ID NO: 5403547 - DNA, 14 bp, Homo sapiens
ctcccatggagccc

SEQ ID NO: 5403548 - DNA, 16 bp, Homo sapiens
ctcccatggagcccca

SEQ ID NO: 5403549 - DNA, 17 bp, Homo sapiens
ctcccatggagccccag

SEQ ID NO: 5403550 - DNA, 14 bp, Homo sapiens
ctcccatggcacct

SEQ ID NO: 5403551 - DNA, 14 bp, Homo sapiens
ctcccatggcccag

SEQ ID NO: 5403552 - DNA, 13 bp, Homo sapiens
ctcccatggcttt

SEQ ID NO: 5403553 - DNA, 22 bp, Homo sapiens
ctcccatggctttgtgctgctg

SEQ ID NO: 5403554 - DNA, 18 bp, Homo sapiens
ctcccatgggggctccag

SEQ ID NO: 5403555 - DNA, 23 bp, Homo sapiens
ctcccatgggggctccagacatt

SEQ ID NO: 5403556 - DNA, 16 bp, Homo sapiens
ctcccatgtcactgca

SEQ ID NO: 5403557 - DNA, 20 bp, Homo sapiens
ctcccatgtgagtccctgtg

SEQ ID NO: 5403558 - DNA, 19 bp, Homo sapiens
ctccctaagaaaccccagg

SEQ ID NO: 5403559 - DNA, 19 bp, Homo sapiens
ctccctaaggaatctgaaa

SEQ ID NO: 5403560 - DNA, 20 bp, Homo sapiens
ctccctaagtaatcccagaa

SEQ ID NO: 5403561 - DNA, 18 bp, Homo sapiens
ctccctaatttatgtgct

SEQ ID NO: 5403562 - DNA, 18 bp, Homo sapiens
ctccctacattccccaga

SEQ ID NO: 5403563 - DNA, 14 bp, Homo sapiens
ctccctaccacctc

SEQ ID NO: 5403564 - DNA, 15 bp, Homo sapiens
ctccctaccacctcc

SEQ ID NO: 5403565 - DNA, 20 bp, Homo sapiens
ctccctacccaatgtctccc

SEQ ID NO: 5403566 - DNA, 23 bp, Homo sapiens
ctccctaccccagggccctggcc

SEQ ID NO: 5403567 - DNA, 15 bp, Homo sapiens
ctccctaccctcgga

SEQ ID NO: 5403568 - DNA, 16 bp, Homo sapiens
ctccctaccctcttct

SEQ ID NO: 5403569 - DNA, 19 bp, Homo sapiens
ctccctaccctcttctcag

SEQ ID NO: 5403570 - DNA, 20 bp, Homo sapiens
ctccctacctcaacctgtaa

SEQ ID NO: 5403571 - DNA, 21 bp, Homo sapiens
ctccctacctcaacctgtaaa

SEQ ID NO: 5403572 - DNA, 17 bp, Homo sapiens
ctccctacctccctcct

SEQ ID NO: 5403573 - DNA, 18 bp, Homo sapiens
ctccctacctgaggccta

SEQ ID NO: 5403574 - DNA, 14 bp, Homo sapiens
ctccctactcccct

SEQ ID NO: 5403575 - DNA, 18 bp, Homo sapiens
ctccctactcccctgggc

SEQ ID NO: 5403576 - DNA, 15 bp, Homo sapiens
ctccctacttccaag

SEQ ID NO: 5403577 - DNA, 13 bp, Homo sapiens
ctccctagatcca

SEQ ID NO: 5403578 - DNA, 23 bp, Homo sapiens
ctccctagatccaggcttctccc

SEQ ID NO: 5403579 - DNA, 21 bp, Homo sapiens
ctccctagccagcacttgtat

SEQ ID NO: 5403580 - DNA, 14 bp, Homo sapiens
ctccctagctcctc

SEQ ID NO: 5403581 - DNA, 12 bp, Homo sapiens
ctccctagctct

SEQ ID NO: 5403582 - DNA, 15 bp, Homo sapiens
ctccctagctctgaa

SEQ ID NO: 5403583 - DNA, 22 bp, Homo sapiens
ctccctagctctgaaatcaact

SEQ ID NO: 5403584 - DNA, 23 bp, Homo sapiens
ctccctaggcccaagtctcctag

SEQ ID NO: 5403585 - DNA, 14 bp, Homo sapiens
ctccctagtctcca

SEQ ID NO: 5403586 - DNA, 21 bp, Homo sapiens
ctccctagtgacccggaggcc

SEQ ID NO: 5403587 - DNA, 17 bp, Homo sapiens
ctccctagtggcttcct

SEQ ID NO: 5403588 - DNA, 22 bp, Homo sapiens
ctccctagtggcttcctccgtc

SEQ ID NO: 5403589 - DNA, 19 bp, Homo sapiens
ctccctagtgtagagcaag

SEQ ID NO: 5403590 - DNA, 16 bp, Homo sapiens
ctccctagttacccac

SEQ ID NO: 5403591 - DNA, 19 bp, Homo sapiens
ctccctagttacccaccct

SEQ ID NO: 5403592 - DNA, 21 bp, Homo sapiens
ctccctagttagcatccaggc

SEQ ID NO: 5403593 - DNA, 24 bp, Homo sapiens
ctccctagttagcatccaggctgg

SEQ ID NO: 5403594 - DNA, 17 bp, Homo sapiens
ctccctagttccttcat

SEQ ID NO: 5403595 - DNA, 18 bp, Homo sapiens
ctccctatactgcttgga

SEQ ID NO: 5403596 - DNA, 21 bp, Homo sapiens
ctccctatactgcttggagct

SEQ ID NO: 5403597 - DNA, 17 bp, Homo sapiens
ctccctatcaagcacta

SEQ ID NO: 5403598 - DNA, 13 bp, Homo sapiens
ctccctatctcct

SEQ ID NO: 5403599 - DNA, 15 bp, Homo sapiens
ctccctatctccttc

SEQ ID NO: 5403600 - DNA, 18 bp, Homo sapiens
ctccctatgtctgcaaag

SEQ ID NO: 5403601 - DNA, 19 bp, Homo sapiens
ctccctatgttgcccaggt

SEQ ID NO: 5403602 - DNA, 19 bp, Homo sapiens
ctccctattaacctagaga

SEQ ID NO: 5403603 - DNA, 21 bp, Homo sapiens
ctccctattttttttctgtta

SEQ ID NO: 5403604 - DNA, 13 bp, Homo sapiens
ctccctcaacctc

SEQ ID NO: 5403605 - DNA, 17 bp, Homo sapiens
ctccctcaacctcatcc

SEQ ID NO: 5403606 - DNA, 22 bp, Homo sapiens
ctccctcaagccagactctgcc

SEQ ID NO: 5403607 - DNA, 17 bp, Homo sapiens
ctccctcacccccaggt

SEQ ID NO: 5403608 - DNA, 10 bp, Homo sapiens
ctccctcaga

SEQ ID NO: 5403609 - DNA, 22 bp, Homo sapiens
ctccctcagacccagcggtcca

SEQ ID NO: 5403610 - DNA, 19 bp, Homo sapiens
ctccctcagacccaggagt

SEQ ID NO: 5403611 - DNA, 12 bp, Homo sapiens
ctccctcagact

SEQ ID NO: 5403612 - DNA, 18 bp, Homo sapiens
ctccctcagccacgcctc

SEQ ID NO: 5403613 - DNA, 15 bp, Homo sapiens
ctccctcagccccca

SEQ ID NO: 5403614 - DNA, 18 bp, Homo sapiens
ctccctcagcccccagga

SEQ ID NO: 5403615 - DNA, 18 bp, Homo sapiens
ctccctcagctctctggg

SEQ ID NO: 5403616 - DNA, 19 bp, Homo sapiens
ctccctcagctctctggga

SEQ ID NO: 5403617 - DNA, 13 bp, Homo sapiens
ctccctcaggccc

SEQ ID NO: 5403618 - DNA, 15 bp, Homo sapiens
ctccctcaggcccag

SEQ ID NO: 5403619 - DNA, 18 bp, Homo sapiens
ctccctcaggcccaggag

SEQ ID NO: 5403620 - DNA, 20 bp, Homo sapiens
ctccctcaggctctgtggag

SEQ ID NO: 5403621 - DNA, 23 bp, Homo sapiens
ctccctcagtgccctcattttat

SEQ ID NO: 5403622 - DNA, 22 bp, Homo sapiens
ctccctcatcaaggacacgggc

SEQ ID NO: 5403623 - DNA, 17 bp, Homo sapiens
ctccctcattcatcttg

SEQ ID NO: 5403624 - DNA, 19 bp, Homo sapiens
ctccctcattcatcttgca

SEQ ID NO: 5403625 - DNA, 12 bp, Homo sapiens
ctccctccaagc

SEQ ID NO: 5403626 - DNA, 17 bp, Homo sapiens
ctccctccaagcctggc

SEQ ID NO: 5403627 - DNA, 18 bp, Homo sapiens
ctccctccaagcctggca

SEQ ID NO: 5403628 - DNA, 19 bp, Homo sapiens
ctccctccaagcctggcac

SEQ ID NO: 5403629 - DNA, 20 bp, Homo sapiens
ctccctccaagcctggcacc

SEQ ID NO: 5403630 - DNA, 14 bp, Homo sapiens
ctccctccacacct

SEQ ID NO: 5403631 - DNA, 18 bp, Homo sapiens
ctccctccacacctccac

SEQ ID NO: 5403632 - DNA, 15 bp, Homo sapiens
ctccctccaccagcc

SEQ ID NO: 5403633 - DNA, 12 bp, Homo sapiens
ctccctccaccc

SEQ ID NO: 5403634 - DNA, 18 bp, Homo sapiens
ctccctccaccccaggac

SEQ ID NO: 5403635 - DNA, 17 bp, Homo sapiens
ctccctccacctccctg

SEQ ID NO: 5403636 - DNA, 19 bp, Homo sapiens
ctccctccacctccctgca

SEQ ID NO: 5403637 - DNA, 20 bp, Homo sapiens
ctccctccacctccctgcaa

SEQ ID NO: 5403638 - DNA, 22 bp, Homo sapiens
ctccctccacctccctgcaata

SEQ ID NO: 5403639 - DNA, 16 bp, Homo sapiens
ctccctccactcctcc

SEQ ID NO: 5403640 - DNA, 14 bp, Homo sapiens
ctccctccagagac

SEQ ID NO: 5403641 - DNA, 17 bp, Homo sapiens
ctccctccatggcagga

SEQ ID NO: 5403642 - DNA, 17 bp, Homo sapiens
ctccctcccaaggagcc

SEQ ID NO: 5403643 - DNA, 12 bp, Homo sapiens
ctccctcccacc

SEQ ID NO: 5403644 - DNA, 20 bp, Homo sapiens
ctccctcccagcgctctggg

SEQ ID NO: 5403645 - DNA, 17 bp, Homo sapiens
ctccctcccaggactct

SEQ ID NO: 5403646 - DNA, 15 bp, Homo sapiens
ctccctcccatcctc

SEQ ID NO: 5403647 - DNA, 14 bp, Homo sapiens
ctccctcccatttg

SEQ ID NO: 5403648 - DNA, 22 bp, Homo sapiens
ctccctccccacacctccctac

SEQ ID NO: 5403649 - DNA, 17 bp, Homo sapiens
ctccctccccacccaag

SEQ ID NO: 5403650 - DNA, 20 bp, Homo sapiens
ctccctccccacccaagaga

SEQ ID NO: 5403651 - DNA, 12 bp, Homo sapiens
ctccctccccag

SEQ ID NO: 5403652 - DNA, 23 bp, Homo sapiens
ctccctccccagatctgtcctgg

SEQ ID NO: 5403653 - DNA, 15 bp, Homo sapiens
ctccctccccagctc

SEQ ID NO: 5403654 - DNA, 14 bp, Homo sapiens
ctccctccccagtg

SEQ ID NO: 5403655 - DNA, 15 bp, Homo sapiens
ctccctccccagtgt

SEQ ID NO: 5403656 - DNA, 19 bp, Homo sapiens
ctccctcccccagccacca

SEQ ID NO: 5403657 - DNA, 18 bp, Homo sapiens
ctccctccccctgcccct

SEQ ID NO: 5403658 - DNA, 19 bp, Homo sapiens
ctccctccccgctgccctt

SEQ ID NO: 5403659 - DNA, 17 bp, Homo sapiens
ctccctcccctcacccg

SEQ ID NO: 5403660 - DNA, 18 bp, Homo sapiens
ctccctcccctctcagaa

SEQ ID NO: 5403661 - DNA, 16 bp, Homo sapiens
ctccctcccctgccct

SEQ ID NO: 5403662 - DNA, 18 bp, Homo sapiens
ctccctcccctgccctcg

SEQ ID NO: 5403663 - DNA, 17 bp, Homo sapiens
ctccctccccttgcctg

SEQ ID NO: 5403664 - DNA, 21 bp, Homo sapiens
ctccctccctagcccttccag

SEQ ID NO: 5403665 - DNA, 23 bp, Homo sapiens
ctccctccctagcccttccagcc

SEQ ID NO: 5403666 - DNA, 16 bp, Homo sapiens
ctccctccctcccaga

SEQ ID NO: 5403667 - DNA, 13 bp, Homo sapiens
ctccctccctctc

SEQ ID NO: 5403668 - DNA, 15 bp, Homo sapiens
ctccctccctctttc

SEQ ID NO: 5403669 - DNA, 13 bp, Homo sapiens
ctccctccctgca

SEQ ID NO: 5403670 - DNA, 16 bp, Homo sapiens
ctccctccctgcaggg

SEQ ID NO: 5403671 - DNA, 21 bp, Homo sapiens
ctccctcccttctttccttcc

SEQ ID NO: 5403672 - DNA, 17 bp, Homo sapiens
ctccctccgactccaga

SEQ ID NO: 5403673 - DNA, 18 bp, Homo sapiens
ctccctccgatccttcct

SEQ ID NO: 5403674 - DNA, 20 bp, Homo sapiens
ctccctccgcccccaggtag

SEQ ID NO: 5403675 - DNA, 19 bp, Homo sapiens
ctccctccgcctcccatcc

SEQ ID NO: 5403676 - DNA, 18 bp, Homo sapiens
ctccctccgggtcttcct

SEQ ID NO: 5403677 - DNA, 11 bp, Homo sapiens
ctccctcctca

SEQ ID NO: 5403678 - DNA, 19 bp, Homo sapiens
ctccctcctcacactccag

SEQ ID NO: 5403679 - DNA, 14 bp, Homo sapiens
ctccctcctcacct

SEQ ID NO: 5403680 - DNA, 18 bp, Homo sapiens
ctccctcctcacctctgg

SEQ ID NO: 5403681 - DNA, 19 bp, Homo sapiens
ctccctcctcactccctag

SEQ ID NO: 5403682 - DNA, 12 bp, Homo sapiens
ctccctcctcag

SEQ ID NO: 5403683 - DNA, 14 bp, Homo sapiens
ctccctcctccagg

SEQ ID NO: 5403684 - DNA, 17 bp, Homo sapiens
ctccctcctccaggtcg

SEQ ID NO: 5403685 - DNA, 13 bp, Homo sapiens
ctccctcctccca

SEQ ID NO: 5403686 - DNA, 14 bp, Homo sapiens
ctccctcctcccat

SEQ ID NO: 5403687 - DNA, 15 bp, Homo sapiens
ctccctcctcccatc

SEQ ID NO: 5403688 - DNA, 12 bp, Homo sapiens
ctccctcctcct

SEQ ID NO: 5403689 - DNA, 14 bp, Homo sapiens
ctccctcctctggc

SEQ ID NO: 5403690 - DNA, 23 bp, Homo sapiens
ctccctcctgcaggctggctgtt

SEQ ID NO: 5403691 - DNA, 12 bp, Homo sapiens
ctccctcctgcc

SEQ ID NO: 5403692 - DNA, 13 bp, Homo sapiens
ctccctcctgcct

SEQ ID NO: 5403693 - DNA, 22 bp, Homo sapiens
ctccctcctggagcatcccagg

SEQ ID NO: 5403694 - DNA, 21 bp, Homo sapiens
ctccctcctggagctctgtgg

SEQ ID NO: 5403695 - DNA, 13 bp, Homo sapiens
ctccctcctggcc

SEQ ID NO: 5403696 - DNA, 15 bp, Homo sapiens
ctccctcctggccag

SEQ ID NO: 5403697 - DNA, 16 bp, Homo sapiens
ctccctcctggccaga

SEQ ID NO: 5403698 - DNA, 13 bp, Homo sapiens
ctccctcctggtg

SEQ ID NO: 5403699 - DNA, 16 bp, Homo sapiens
ctccctccttctcctt

SEQ ID NO: 5403700 - DNA, 14 bp, Homo sapiens
ctccctccttgggt

SEQ ID NO: 5403701 - DNA, 23 bp, Homo sapiens
ctccctcgatccccccattttct

SEQ ID NO: 5403702 - DNA, 14 bp, Homo sapiens
ctccctcgccctgt

SEQ ID NO: 5403703 - DNA, 15 bp, Homo sapiens
ctccctcgctgtatg

SEQ ID NO: 5403704 - DNA, 16 bp, Homo sapiens
ctccctcgctgtatga

SEQ ID NO: 5403705 - DNA, 23 bp, Homo sapiens
ctccctctactaatttcctgctg

SEQ ID NO: 5403706 - DNA, 14 bp, Homo sapiens
ctccctctactctt

SEQ ID NO: 5403707 - DNA, 13 bp, Homo sapiens
ctccctctactgg

SEQ ID NO: 5403708 - DNA, 18 bp, Homo sapiens
ctccctctagaggctgcc

SEQ ID NO: 5403709 - DNA, 19 bp, Homo sapiens
ctccctctagaggctgcct

SEQ ID NO: 5403710 - DNA, 19 bp, Homo sapiens
ctccctctaggctctgcct

SEQ ID NO: 5403711 - DNA, 22 bp, Homo sapiens
ctccctctaggctctgccttcg

SEQ ID NO: 5403712 - DNA, 14 bp, Homo sapiens
ctccctctatttat

SEQ ID NO: 5403713 - DNA, 15 bp, Homo sapiens
ctccctctcactgtc

SEQ ID NO: 5403714 - DNA, 17 bp, Homo sapiens
ctccctctcaggatcca

SEQ ID NO: 5403715 - DNA, 20 bp, Homo sapiens
ctccctctcatgtccctcca

SEQ ID NO: 5403716 - DNA, 13 bp, Homo sapiens
ctccctctccaag

SEQ ID NO: 5403717 - DNA, 14 bp, Homo sapiens
ctccctctccaaga

SEQ ID NO: 5403718 - DNA, 15 bp, Homo sapiens
ctccctctccaagac

SEQ ID NO: 5403719 - DNA, 16 bp, Homo sapiens
ctccctctccaagaca

SEQ ID NO: 5403720 - DNA, 12 bp, Homo sapiens
ctccctctccca

SEQ ID NO: 5403721 - DNA, 17 bp, Homo sapiens
ctccctctcccaggccc

SEQ ID NO: 5403722 - DNA, 13 bp, Homo sapiens
ctccctctccctg

SEQ ID NO: 5403723 - DNA, 17 bp, Homo sapiens
ctccctctcctctgtcc

SEQ ID NO: 5403724 - DNA, 13 bp, Homo sapiens
ctccctctcctgc

SEQ ID NO: 5403725 - DNA, 15 bp, Homo sapiens
ctccctctcctgcct

SEQ ID NO: 5403726 - DNA, 17 bp, Homo sapiens
ctccctctctcatgaga

SEQ ID NO: 5403727 - DNA, 18 bp, Homo sapiens
ctccctctctcctggact

SEQ ID NO: 5403728 - DNA, 12 bp, Homo sapiens
ctccctctctct

SEQ ID NO: 5403729 - DNA, 13 bp, Homo sapiens
ctccctctctctt

SEQ ID NO: 5403730 - DNA, 16 bp, Homo sapiens
ctccctctctcttctg

SEQ ID NO: 5403731 - DNA, 22 bp, Homo sapiens
ctccctctctcttctgctccac

SEQ ID NO: 5403732 - DNA, 18 bp, Homo sapiens
ctccctctctcttttcat

SEQ ID NO: 5403733 - DNA, 18 bp, Homo sapiens
ctccctctcttccgggag

SEQ ID NO: 5403734 - DNA, 20 bp, Homo sapiens
ctccctctgaggctgtagga

SEQ ID NO: 5403735 - DNA, 18 bp, Homo sapiens
ctccctctgatttttcat

SEQ ID NO: 5403736 - DNA, 23 bp, Homo sapiens
ctccctctgccccaagcagccag

SEQ ID NO: 5403737 - DNA, 19 bp, Homo sapiens
ctccgcctgggtcatgggc

SEQ ID NO: 5403738 - DNA, 18 bp, Homo sapiens
ctccgcctgtccacagcc

SEQ ID NO: 5403739 - DNA, 13 bp, Homo sapiens
ctccgccttttag

SEQ ID NO: 5403740 - DNA, 21 bp, Homo sapiens
ctccgcgagggctactcagca

SEQ ID NO: 5403741 - DNA, 19 bp, Homo sapiens
ctccgcgccctccgacctc

SEQ ID NO: 5403742 - DNA, 15 bp, Homo sapiens
ctccgcggaggcccc

SEQ ID NO: 5403743 - DNA, 16 bp, Homo sapiens
ctccgcggaggcccct

SEQ ID NO: 5403744 - DNA, 18 bp, Homo sapiens
ctccgcggaggcccctga

SEQ ID NO: 5403745 - DNA, 14 bp, Homo sapiens
ctccgcgggtggga

SEQ ID NO: 5403746 - DNA, 14 bp, Homo sapiens
ctccgctcccaccg

SEQ ID NO: 5403747 - DNA, 15 bp, Homo sapiens
ctccgctcccaccgc

SEQ ID NO: 5403748 - DNA, 23 bp, Homo sapiens
ctccgctcccctttcccatcacc

SEQ ID NO: 5403749 - DNA, 15 bp, Homo sapiens
ctccgctctgtagtg

SEQ ID NO: 5403750 - DNA, 13 bp, Homo sapiens
ctccgctgctcct

SEQ ID NO: 5403751 - DNA, 12 bp, Homo sapiens
ctccgctggctt

SEQ ID NO: 5403752 - DNA, 12 bp, Homo sapiens
ctccgctgggct

SEQ ID NO: 5403753 - DNA, 13 bp, Homo sapiens
ctccgctgggctt

SEQ ID NO: 5403754 - DNA, 12 bp, Homo sapiens
ctccgctgtgtg

SEQ ID NO: 5403755 - DNA, 18 bp, Homo sapiens
ctccgcttgtccaagaca

SEQ ID NO: 5403756 - DNA, 20 bp, Homo sapiens
ctccgctttctacccagcga

SEQ ID NO: 5403757 - DNA, 23 bp, Homo sapiens
ctccgctttctacccagcgagcc

SEQ ID NO: 5403758 - DNA, 16 bp, Homo sapiens
ctccggaatgaccagc

SEQ ID NO: 5403759 - DNA, 13 bp, Homo sapiens
ctccggagacagg

SEQ ID NO: 5403760 - DNA, 13 bp, Homo sapiens
ctccggagagaga

SEQ ID NO: 5403761 - DNA, 13 bp, Homo sapiens
ctccggagcctca

SEQ ID NO: 5403762 - DNA, 16 bp, Homo sapiens
ctccggagcgccctgc

SEQ ID NO: 5403763 - DNA, 18 bp, Homo sapiens
ctccggagcgccctgcag

SEQ ID NO: 5403764 - DNA, 19 bp, Homo sapiens
ctccggagcgccctgcagg

SEQ ID NO: 5403765 - DNA, 19 bp, Homo sapiens
ctccggaggagcagcctcg

SEQ ID NO: 5403766 - DNA, 23 bp, Homo sapiens
ctccggaggctgaggcaggagaa

SEQ ID NO: 5403767 - DNA, 16 bp, Homo sapiens
ctccggatgacacaaa

SEQ ID NO: 5403768 - DNA, 22 bp, Homo sapiens
ctccggattccggccctggctg

SEQ ID NO: 5403769 - DNA, 23 bp, Homo sapiens
ctccggattccggccctggctgg

SEQ ID NO: 5403770 - DNA, 16 bp, Homo sapiens
ctccggcactgggttt

SEQ ID NO: 5403771 - DNA, 21 bp, Homo sapiens
ctccggccctcctaccctgcg

SEQ ID NO: 5403772 - DNA, 13 bp, Homo sapiens
ctccggccctgcc

SEQ ID NO: 5403773 - DNA, 14 bp, Homo sapiens
ctccggccctgccc

SEQ ID NO: 5403774 - DNA, 14 bp, Homo sapiens
ctccggcctctcca

SEQ ID NO: 5403775 - DNA, 20 bp, Homo sapiens
ctccggcctggccttttcca

SEQ ID NO: 5403776 - DNA, 12 bp, Homo sapiens
ctccggcctgta

SEQ ID NO: 5403777 - DNA, 15 bp, Homo sapiens
ctccggcgcagacag

SEQ ID NO: 5403778 - DNA, 21 bp, Homo sapiens
ctccggcgggtgacagctccg

SEQ ID NO: 5403779 - DNA, 16 bp, Homo sapiens
ctccggcgtcagcctc

SEQ ID NO: 5403780 - DNA, 18 bp, Homo sapiens
ctccggcgtcagcctcca

SEQ ID NO: 5403781 - DNA, 19 bp, Homo sapiens
ctccggcgtcttgcccagc

SEQ ID NO: 5403782 - DNA, 19 bp, Homo sapiens
ctccggctcccagcctcag

SEQ ID NO: 5403783 - DNA, 14 bp, Homo sapiens
ctccggctgcctag

SEQ ID NO: 5403784 - DNA, 19 bp, Homo sapiens
ctccggctggacctggggt

SEQ ID NO: 5403785 - DNA, 21 bp, Homo sapiens
ctccggctgtgctgggagaaa

SEQ ID NO: 5403786 - DNA, 18 bp, Homo sapiens
ctccggcttgacctgttt

SEQ ID NO: 5403787 - DNA, 16 bp, Homo sapiens
ctccgggcaggcaagg

SEQ ID NO: 5403788 - DNA, 14 bp, Homo sapiens
ctccgggcagggga

SEQ ID NO: 5403789 - DNA, 20 bp, Homo sapiens
ctccgggcaggggagccagg

SEQ ID NO: 5403790 - DNA, 18 bp, Homo sapiens
ctccgggcctcggcctgg

SEQ ID NO: 5403791 - DNA, 19 bp, Homo sapiens
ctccgggcctcggcctggc

SEQ ID NO: 5403792 - DNA, 21 bp, Homo sapiens
ctccgggcctcggcctggctt

SEQ ID NO: 5403793 - DNA, 18 bp, Homo sapiens
ctccggggagcgcccgcg

SEQ ID NO: 5403794 - DNA, 16 bp, Homo sapiens
ctccggggtctgtgct

SEQ ID NO: 5403795 - DNA, 21 bp, Homo sapiens
ctccggggtctgtgctgtgcc

SEQ ID NO: 5403796 - DNA, 16 bp, Homo sapiens
ctccgggtcactgctg

SEQ ID NO: 5403797 - DNA, 15 bp, Homo sapiens
ctccgggtcttccta

SEQ ID NO: 5403798 - DNA, 19 bp, Homo sapiens
ctccgggtgtagattccct

SEQ ID NO: 5403799 - DNA, 20 bp, Homo sapiens
ctccgggtgtggcctcagcc

SEQ ID NO: 5403800 - DNA, 19 bp, Homo sapiens
ctccggtgtgcctgcagcc

SEQ ID NO: 5403801 - DNA, 19 bp, Homo sapiens
ctccggtttgggctgtctt

SEQ ID NO: 5403802 - DNA, 17 bp, Homo sapiens
ctccgtaacagtgtaaa

SEQ ID NO: 5403803 - DNA, 15 bp, Homo sapiens
ctccgtagctctgct

SEQ ID NO: 5403804 - DNA, 18 bp, Homo sapiens
ctccgtagctctgctgct

SEQ ID NO: 5403805 - DNA, 15 bp, Homo sapiens
ctccgtagcttctag

SEQ ID NO: 5403806 - DNA, 21 bp, Homo sapiens
ctccgtagggtctttcttggg

SEQ ID NO: 5403807 - DNA, 14 bp, Homo sapiens
ctccgtcaactcat

SEQ ID NO: 5403808 - DNA, 12 bp, Homo sapiens
ctccgtcaggag

SEQ ID NO: 5403809 - DNA, 22 bp, Homo sapiens
ctccgtcaggagagacgcagcc

SEQ ID NO: 5403810 - DNA, 22 bp, Homo sapiens
ctccgtcatctgcggggcttct

SEQ ID NO: 5403811 - DNA, 19 bp, Homo sapiens
ctccgtcatgaatgccttc

SEQ ID NO: 5403812 - DNA, 20 bp, Homo sapiens
ctccgtcatgaatgccttcc

SEQ ID NO: 5403813 - DNA, 22 bp, Homo sapiens
ctccgtccacccaggctgcact

SEQ ID NO: 5403814 - DNA, 22 bp, Homo sapiens
ctccgtccactacgctcctgtc

SEQ ID NO: 5403815 - DNA, 18 bp, Homo sapiens
ctccgtccaggagcctgg

SEQ ID NO: 5403816 - DNA, 19 bp, Homo sapiens
ctccgtccaggagcctggc

SEQ ID NO: 5403817 - DNA, 13 bp, Homo sapiens
ctccgtccatatc

SEQ ID NO: 5403818 - DNA, 21 bp, Homo sapiens
ctccgtccatccgactgcccc

SEQ ID NO: 5403819 - DNA, 14 bp, Homo sapiens
ctccgtccccaggg

SEQ ID NO: 5403820 - DNA, 17 bp, Homo sapiens
ctccgtccctctgtcca

SEQ ID NO: 5403821 - DNA, 21 bp, Homo sapiens
ctccgtcctgtcactgatgga

SEQ ID NO: 5403822 - DNA, 17 bp, Homo sapiens
ctccgtcgggcccctgc

SEQ ID NO: 5403823 - DNA, 22 bp, Homo sapiens
ctccgtcgggcccctgcctgcc

SEQ ID NO: 5403824 - DNA, 12 bp, Homo sapiens
ctccgtctctgt

SEQ ID NO: 5403825 - DNA, 13 bp, Homo sapiens
ctccgtctctgtc

SEQ ID NO: 5403826 - DNA, 17 bp, Homo sapiens
ctccgtctctgtcctcg

SEQ ID NO: 5403827 - DNA, 23 bp, Homo sapiens
ctccgtgaaaatatgtttggaat

SEQ ID NO: 5403828 - DNA, 20 bp, Homo sapiens
ctccgtgagcaccaccaggg

SEQ ID NO: 5403829 - DNA, 15 bp, Homo sapiens
ctccgtgagcccttg

SEQ ID NO: 5403830 - DNA, 20 bp, Homo sapiens
ctccgtgatgctgtttttct

SEQ ID NO: 5403831 - DNA, 21 bp, Homo sapiens
ctccgtgcctccaccaccact

SEQ ID NO: 5403832 - DNA, 16 bp, Homo sapiens
ctccgtggaacattct

SEQ ID NO: 5403833 - DNA, 20 bp, Homo sapiens
ctccgtggaacattctggat

SEQ ID NO: 5403834 - DNA, 17 bp, Homo sapiens
ctccgtggactgcagtc

SEQ ID NO: 5403835 - DNA, 13 bp, Homo sapiens
ctccgtggagcag

SEQ ID NO: 5403836 - DNA, 17 bp, Homo sapiens
ctccgtggaggaggttg

SEQ ID NO: 5403837 - DNA, 22 bp, Homo sapiens
ctccgtggccaaaaagtaccat

SEQ ID NO: 5403838 - DNA, 22 bp, Homo sapiens
ctccgtggtggcggcggcactt

SEQ ID NO: 5403839 - DNA, 15 bp, Homo sapiens
ctccgtgtgcctggg

SEQ ID NO: 5403840 - DNA, 14 bp, Homo sapiens
ctccgtgtggagca

SEQ ID NO: 5403841 - DNA, 20 bp, Homo sapiens
ctccgtgtggagcacgtgga

SEQ ID NO: 5403842 - DNA, 14 bp, Homo sapiens
ctccgtgtgggaga

SEQ ID NO: 5403843 - DNA, 18 bp, Homo sapiens
ctccgtgtgggagaccgg

SEQ ID NO: 5403844 - DNA, 12 bp, Homo sapiens
ctccgtgtgtct

SEQ ID NO: 5403845 - DNA, 14 bp, Homo sapiens
ctccgtgtgtctca

SEQ ID NO: 5403846 - DNA, 19 bp, Homo sapiens
ctccgtgtgtctcatgcca

SEQ ID NO: 5403847 - DNA, 16 bp, Homo sapiens
ctccgtgtttctctaa

SEQ ID NO: 5403848 - DNA, 21 bp, Homo sapiens
ctccgtgtttctctaaggaat

SEQ ID NO: 5403849 - DNA, 16 bp, Homo sapiens
ctccgttagctcctgt

SEQ ID NO: 5403850 - DNA, 21 bp, Homo sapiens
ctccgttcccacctctgagga

SEQ ID NO: 5403851 - DNA, 23 bp, Homo sapiens
ctccgttcctcctcagcctccct

SEQ ID NO: 5403852 - DNA, 12 bp, Homo sapiens
ctccgttcctgg

SEQ ID NO: 5403853 - DNA, 14 bp, Homo sapiens
ctccgttcctggca

SEQ ID NO: 5403854 - DNA, 21 bp, Homo sapiens
ctccgttcctggcatttgctg

SEQ ID NO: 5403855 - DNA, 20 bp, Homo sapiens
ctccgttggccactccgaga

SEQ ID NO: 5403856 - DNA, 17 bp, Homo sapiens
ctccgttggtcagcgtt

SEQ ID NO: 5403857 - DNA, 13 bp, Homo sapiens
ctccgtttctacc

SEQ ID NO: 5403858 - DNA, 17 bp, Homo sapiens
ctcctaaaaggcccaga

SEQ ID NO: 5403859 - DNA, 18 bp, Homo sapiens
ctcctaaaaggcccagag

SEQ ID NO: 5403860 - DNA, 15 bp, Homo sapiens
ctcctaaacaaaaac

SEQ ID NO: 5403861 - DNA, 20 bp, Homo sapiens
ctcctaaacccccgctccag

SEQ ID NO: 5403862 - DNA, 16 bp, Homo sapiens
ctcctaaagacctcca

SEQ ID NO: 5403863 - DNA, 18 bp, Homo sapiens
ctcctaaaggcagcaacc

SEQ ID NO: 5403864 - DNA, 14 bp, Homo sapiens
ctcctaacaaaaga

SEQ ID NO: 5403865 - DNA, 19 bp, Homo sapiens
ctcctaacaaaagaactaa

SEQ ID NO: 5403866 - DNA, 14 bp, Homo sapiens
ctcctaacatatat

SEQ ID NO: 5403867 - DNA, 16 bp, Homo sapiens
ctcctaacccagcagt

SEQ ID NO: 5403868 - DNA, 15 bp, Homo sapiens
ctcctaactccaccg

SEQ ID NO: 5403869 - DNA, 12 bp, Homo sapiens
ctcctaagagag

SEQ ID NO: 5403870 - DNA, 19 bp, Homo sapiens
ctcctaagcagctgggact

SEQ ID NO: 5403871 - DNA, 21 bp, Homo sapiens
ctcctaaggctccccaccccg

SEQ ID NO: 5403872 - DNA, 20 bp, Homo sapiens
ctcctaatcaagagtctctc

SEQ ID NO: 5403873 - DNA, 23 bp, Homo sapiens
ctcctaatcaagagtctctccag

SEQ ID NO: 5403874 - DNA, 20 bp, Homo sapiens
ctcctaatgatgacttgagc

SEQ ID NO: 5403875 - DNA, 17 bp, Homo sapiens
ctcctaatgctctgaaa

SEQ ID NO: 5403876 - DNA, 19 bp, Homo sapiens
ctcctaatggcatggagac

SEQ ID NO: 5403877 - DNA, 22 bp, Homo sapiens
ctcctaatggcatggagactct

SEQ ID NO: 5403878 - DNA, 21 bp, Homo sapiens
ctcctaattaagggacatgta

SEQ ID NO: 5403879 - DNA, 19 bp, Homo sapiens
ctcctacaaccaggtcttg

SEQ ID NO: 5403880 - DNA, 20 bp, Homo sapiens
ctcctacaagatttagaaaa

SEQ ID NO: 5403881 - DNA, 24 bp, Homo sapiens
ctcctacaggcgctccaggccact

SEQ ID NO: 5403882 - DNA, 17 bp, Homo sapiens
ctcctacatccagctcc

SEQ ID NO: 5403883 - DNA, 14 bp, Homo sapiens
ctcctaccagcaaa

SEQ ID NO: 5403884 - DNA, 15 bp, Homo sapiens
ctcctaccagcaaac

SEQ ID NO: 5403885 - DNA, 20 bp, Homo sapiens
ctcctacccactggtctgct

SEQ ID NO: 5403886 - DNA, 16 bp, Homo sapiens
ctcctacccctcccag

SEQ ID NO: 5403887 - DNA, 23 bp, Homo sapiens
ctcctacccctcccagctgacag

SEQ ID NO: 5403888 - DNA, 15 bp, Homo sapiens
ctcctacccctgtcc

SEQ ID NO: 5403889 - DNA, 18 bp, Homo sapiens
ctcctaccctcccaccag

SEQ ID NO: 5403890 - DNA, 22 bp, Homo sapiens
ctcctaccctcccaccagaacg

SEQ ID NO: 5403891 - DNA, 15 bp, Homo sapiens
ctcctaccctgcgcc

SEQ ID NO: 5403892 - DNA, 18 bp, Homo sapiens
ctcctaccctgcgcccag

SEQ ID NO: 5403893 - DNA, 13 bp, Homo sapiens
ctcctacctcagc

SEQ ID NO: 5403894 - DNA, 14 bp, Homo sapiens
ctcctacctcagcc

SEQ ID NO: 5403895 - DNA, 16 bp, Homo sapiens
ctcctacctcagccta

SEQ ID NO: 5403896 - DNA, 18 bp, Homo sapiens
ctcctacctcagcctcct

SEQ ID NO: 5403897 - DNA, 21 bp, Homo sapiens
ctcctacctcagcctcctggg

SEQ ID NO: 5403898 - DNA, 18 bp, Homo sapiens
ctcctacctctgtgccag

SEQ ID NO: 5403899 - DNA, 10 bp, Homo sapiens
ctcctacctg

SEQ ID NO: 5403900 - DNA, 21 bp, Homo sapiens
ctcctacctgaaggcagggct

SEQ ID NO: 5403901 - DNA, 16 bp, Homo sapiens
ctcctacctgctgctg

SEQ ID NO: 5403902 - DNA, 14 bp, Homo sapiens
ctcctacctgggga

SEQ ID NO: 5403903 - DNA, 22 bp, Homo sapiens
ctcctacctggggactcctcaa

SEQ ID NO: 5403904 - DNA, 15 bp, Homo sapiens
ctcctacctgggggc

SEQ ID NO: 5403905 - DNA, 14 bp, Homo sapiens
ctcctacctggtca

SEQ ID NO: 5403906 - DNA, 22 bp, Homo sapiens
ctcctacctgtctgctgccagc

SEQ ID NO: 5403907 - DNA, 18 bp, Homo sapiens
ctcctactccagtatgac

SEQ ID NO: 5403908 - DNA, 14 bp, Homo sapiens
ctcctactctgtgt

SEQ ID NO: 5403909 - DNA, 15 bp, Homo sapiens
ctcctactctgtgta

SEQ ID NO: 5403910 - DNA, 20 bp, Homo sapiens
ctcctactgcttcctctgaa

SEQ ID NO: 5403911 - DNA, 15 bp, Homo sapiens
ctcctactttacact

SEQ ID NO: 5403912 - DNA, 19 bp, Homo sapiens
ctcctagaaaacccttccc

SEQ ID NO: 5403913 - DNA, 13 bp, Homo sapiens
ctcctagaactcc

SEQ ID NO: 5403914 - DNA, 13 bp, Homo sapiens
ctcctagaagtct

SEQ ID NO: 5403915 - DNA, 22 bp, Homo sapiens
ctcctgagttgaagtcatgctc

SEQ ID NO: 5403916 - DNA, 21 bp, Homo sapiens
ctcctgatagtcacctgctgg

SEQ ID NO: 5403917 - DNA, 17 bp, Homo sapiens
ctcctgatcagaggcat

SEQ ID NO: 5403918 - DNA, 23 bp, Homo sapiens
ctcctgatgccctcttctccttg

SEQ ID NO: 5403919 - DNA, 20 bp, Homo sapiens
ctcctgatggagtgtgcaga

SEQ ID NO: 5403920 - DNA, 14 bp, Homo sapiens
ctcctgatggccaa

SEQ ID NO: 5403921 - DNA, 17 bp, Homo sapiens
ctcctgatggccaagag

SEQ ID NO: 5403922 - DNA, 18 bp, Homo sapiens
ctcctgatgtttgtatca

SEQ ID NO: 5403923 - DNA, 17 bp, Homo sapiens
ctcctgatgtttttccc

SEQ ID NO: 5403924 - DNA, 15 bp, Homo sapiens
ctcctgattgctctg

SEQ ID NO: 5403925 - DNA, 16 bp, Homo sapiens
ctcctgattgctctgg

SEQ ID NO: 5403926 - DNA, 19 bp, Homo sapiens
ctcctgattgctctggaag

SEQ ID NO: 5403927 - DNA, 21 bp, Homo sapiens
ctcctgattgctctggaagcc

SEQ ID NO: 5403928 - DNA, 18 bp, Homo sapiens
ctcctgatttctctgaac

SEQ ID NO: 5403929 - DNA, 14 bp, Homo sapiens
ctcctgattttgta

SEQ ID NO: 5403930 - DNA, 20 bp, Homo sapiens
ctcctgcaaatttagtttgt

SEQ ID NO: 5403931 - DNA, 14 bp, Homo sapiens
ctcctgcacacagg

SEQ ID NO: 5403932 - DNA, 15 bp, Homo sapiens
ctcctgcacacaggg

SEQ ID NO: 5403933 - DNA, 22 bp, Homo sapiens
ctcctgcacttacttgcttatt

SEQ ID NO: 5403934 - DNA, 18 bp, Homo sapiens
ctcctgcagacacctgga

SEQ ID NO: 5403935 - DNA, 20 bp, Homo sapiens
ctcctgcagacacctggact

SEQ ID NO: 5403936 - DNA, 21 bp, Homo sapiens
ctcctgcagacacctggactg

SEQ ID NO: 5403937 - DNA, 11 bp, Homo sapiens
ctcctgcaggc

SEQ ID NO: 5403938 - DNA, 17 bp, Homo sapiens
ctcctgcaggcagccag

SEQ ID NO: 5403939 - DNA, 21 bp, Homo sapiens
ctcctgcaggcagccaggcca

SEQ ID NO: 5403940 - DNA, 22 bp, Homo sapiens
ctcctgcaggcagccaggccac

SEQ ID NO: 5403941 - DNA, 21 bp, Homo sapiens
ctcctgcaggctggctgttgg

SEQ ID NO: 5403942 - DNA, 14 bp, Homo sapiens
ctcctgcagtctgt

SEQ ID NO: 5403943 - DNA, 13 bp, Homo sapiens
ctcctgcagtgga

SEQ ID NO: 5403944 - DNA, 19 bp, Homo sapiens
ctcctgcatccctccaccc

SEQ ID NO: 5403945 - DNA, 22 bp, Homo sapiens
ctcctgcatgtcggggcccctg

SEQ ID NO: 5403946 - DNA, 23 bp, Homo sapiens
ctcctgcatgtcggggcccctgc

SEQ ID NO: 5403947 - DNA, 18 bp, Homo sapiens
ctcctgcatgtgtatata

SEQ ID NO: 5403948 - DNA, 14 bp, Homo sapiens
ctcctgccaaaaga

SEQ ID NO: 5403949 - DNA, 22 bp, Homo sapiens
ctcctgccaaaagatctgggga

SEQ ID NO: 5403950 - DNA, 14 bp, Homo sapiens
ctcctgccaaggag

SEQ ID NO: 5403951 - DNA, 18 bp, Homo sapiens
ctcctgccacaacagaat

SEQ ID NO: 5403952 - DNA, 15 bp, Homo sapiens
ctcctgccaccagca

SEQ ID NO: 5403953 - DNA, 19 bp, Homo sapiens
ctcctgccaccagcatcca

SEQ ID NO: 5403954 - DNA, 14 bp, Homo sapiens
ctcctgccactgac

SEQ ID NO: 5403955 - DNA, 19 bp, Homo sapiens
ctcctgccactgacctcac

SEQ ID NO: 5403956 - DNA, 11 bp, Homo sapiens
ctcctgccagc

SEQ ID NO: 5403957 - DNA, 15 bp, Homo sapiens
ctcctgccagcccag

SEQ ID NO: 5403958 - DNA, 16 bp, Homo sapiens
ctcctgccagcccagc

SEQ ID NO: 5403959 - DNA, 12 bp, Homo sapiens
ctcctgccagct

SEQ ID NO: 5403960 - DNA, 16 bp, Homo sapiens
ctcctgccagctctgt

SEQ ID NO: 5403961 - DNA, 15 bp, Homo sapiens
ctcctgccaggcaca

SEQ ID NO: 5403962 - DNA, 23 bp, Homo sapiens
ctcctgccaggcacacacagccc

SEQ ID NO: 5403963 - DNA, 18 bp, Homo sapiens
ctcctgccagggaactgg

SEQ ID NO: 5403964 - DNA, 24 bp, Homo sapiens
ctcctgccagggaactggcctgct

SEQ ID NO: 5403965 - DNA, 18 bp, Homo sapiens
ctcctgccagtgtggaac

SEQ ID NO: 5403966 - DNA, 14 bp, Homo sapiens
ctcctgccatgggt

SEQ ID NO: 5403967 - DNA, 22 bp, Homo sapiens
ctcctgccatgggtgcagaccc

SEQ ID NO: 5403968 - DNA, 11 bp, Homo sapiens
ctcctgcccac

SEQ ID NO: 5403969 - DNA, 13 bp, Homo sapiens
ctcctgcccacgg

SEQ ID NO: 5403970 - DNA, 18 bp, Homo sapiens
ctcctgcccacgggagga

SEQ ID NO: 5403971 - DNA, 22 bp, Homo sapiens
ctcctgcccacgtgcagcacct

SEQ ID NO: 5403972 - DNA, 12 bp, Homo sapiens
ctcctgcccaga

SEQ ID NO: 5403973 - DNA, 13 bp, Homo sapiens
ctcctgcccagcc

SEQ ID NO: 5403974 - DNA, 18 bp, Homo sapiens
ctcctgcccagctcctca

SEQ ID NO: 5403975 - DNA, 16 bp, Homo sapiens
ctcctgcccaggactg

SEQ ID NO: 5403976 - DNA, 15 bp, Homo sapiens
ctcctgcccaggagc

SEQ ID NO: 5403977 - DNA, 19 bp, Homo sapiens
ctcctgcccaggagcagct

SEQ ID NO: 5403978 - DNA, 13 bp, Homo sapiens
ctcctgcccaggc

SEQ ID NO: 5403979 - DNA, 19 bp, Homo sapiens
ctcctgcccaggccacaga

SEQ ID NO: 5403980 - DNA, 13 bp, Homo sapiens
ctcctgcccagtc

SEQ ID NO: 5403981 - DNA, 14 bp, Homo sapiens
ctcctgcccagtcc

SEQ ID NO: 5403982 - DNA, 11 bp, Homo sapiens
ctcctgcccca

SEQ ID NO: 5403983 - DNA, 21 bp, Homo sapiens
ctcctgccccaagggcccaga

SEQ ID NO: 5403984 - DNA, 16 bp, Homo sapiens
ctcctgccccacactc

SEQ ID NO: 5403985 - DNA, 13 bp, Homo sapiens
ctcctgcccccac

SEQ ID NO: 5403986 - DNA, 17 bp, Homo sapiens
ctcctgcccccacacct

SEQ ID NO: 5403987 - DNA, 22 bp, Homo sapiens
ctcctgcccccacacctggccc

SEQ ID NO: 5403988 - DNA, 15 bp, Homo sapiens
ctcctgcccccaccc

SEQ ID NO: 5403989 - DNA, 17 bp, Homo sapiens
ctcctgcccccacccca

SEQ ID NO: 5403990 - DNA, 18 bp, Homo sapiens
ctcctgcccccaccccag

SEQ ID NO: 5403991 - DNA, 12 bp, Homo sapiens
ctcctgcccctt

SEQ ID NO: 5403992 - DNA, 23 bp, Homo sapiens
ctcctgcccctttcaggcctaca

SEQ ID NO: 5403993 - DNA, 19 bp, Homo sapiens
ctcctgcccgccacacaga

SEQ ID NO: 5403994 - DNA, 15 bp, Homo sapiens
ctcctgcccgcccag

SEQ ID NO: 5403995 - DNA, 11 bp, Homo sapiens
ctcctgccctc

SEQ ID NO: 5403996 - DNA, 13 bp, Homo sapiens
ctcctgccctccg

SEQ ID NO: 5403997 - DNA, 14 bp, Homo sapiens
ctcctgccctcgtc

SEQ ID NO: 5403998 - DNA, 22 bp, Homo sapiens
ctcctgccctcgtctccctggc

SEQ ID NO: 5403999 - DNA, 12 bp, Homo sapiens
ctcctgccctct

SEQ ID NO: 5404000 - DNA, 13 bp, Homo sapiens
ctcctgccctctg

SEQ ID NO: 5404001 - DNA, 20 bp, Homo sapiens
ctcctgccctctgctctgcc

SEQ ID NO: 5404002 - DNA, 13 bp, Homo sapiens
ctcctgccctgcc

SEQ ID NO: 5404003 - DNA, 19 bp, Homo sapiens
ctcctgccctgccctcctg

SEQ ID NO: 5404004 - DNA, 16 bp, Homo sapiens
ctcctgccctgtccct

SEQ ID NO: 5404005 - DNA, 18 bp, Homo sapiens
ctcctgccctgtccctgt

SEQ ID NO: 5404006 - DNA, 16 bp, Homo sapiens
ctcctgccgcagacgg

SEQ ID NO: 5404007 - DNA, 18 bp, Homo sapiens
ctcctgccgcagacgggc

SEQ ID NO: 5404008 - DNA, 21 bp, Homo sapiens
ctcctgccgcagacgggcaca

SEQ ID NO: 5404009 - DNA, 14 bp, Homo sapiens
ctcctgccgcagag

SEQ ID NO: 5404010 - DNA, 16 bp, Homo sapiens
ctcctgccgcagagct

SEQ ID NO: 5404011 - DNA, 18 bp, Homo sapiens
ctcctgccgcagagctgg

SEQ ID NO: 5404012 - DNA, 15 bp, Homo sapiens
ctcctgccggctcct

SEQ ID NO: 5404013 - DNA, 13 bp, Homo sapiens
ctcctgcctacat

SEQ ID NO: 5404014 - DNA, 23 bp, Homo sapiens
ctcctgcctacattccctggcct

SEQ ID NO: 5404015 - DNA, 21 bp, Homo sapiens
ctcctgcctatgacacagaag

SEQ ID NO: 5404016 - DNA, 19 bp, Homo sapiens
ctcctgcctatgtctcctc

SEQ ID NO: 5404017 - DNA, 11 bp, Homo sapiens
ctcctgcctca

SEQ ID NO: 5404018 - DNA, 22 bp, Homo sapiens
ctcctgcctcagcctccctggt

SEQ ID NO: 5404019 - DNA, 18 bp, Homo sapiens
ctcctgcctcagcctcct

SEQ ID NO: 5404020 - DNA, 21 bp, Homo sapiens
ctcctgcctcagcctcctgag

SEQ ID NO: 5404021 - DNA, 16 bp, Homo sapiens
ctcctgcctcagcctt

SEQ ID NO: 5404022 - DNA, 13 bp, Homo sapiens
ctcctgcctccgc

SEQ ID NO: 5404023 - DNA, 22 bp, Homo sapiens
ctcctgcctcgaactggctgca

SEQ ID NO: 5404024 - DNA, 22 bp, Homo sapiens
ctcctgcctctactgggaaggc

SEQ ID NO: 5404025 - DNA, 21 bp, Homo sapiens
ctcctgcctgagtttccagcc

SEQ ID NO: 5404026 - DNA, 15 bp, Homo sapiens
ctcctgcctgccctg

SEQ ID NO: 5404027 - DNA, 16 bp, Homo sapiens
ctcctgcctgccctgc

SEQ ID NO: 5404028 - DNA, 21 bp, Homo sapiens
ctcctgcctgcgcagctcctt

SEQ ID NO: 5404029 - DNA, 16 bp, Homo sapiens
ctcctgcctgtagcag

SEQ ID NO: 5404030 - DNA, 18 bp, Homo sapiens
ctcctgcctgtagcagtg

SEQ ID NO: 5404031 - DNA, 19 bp, Homo sapiens
ctcctgcctgtagcagtga

SEQ ID NO: 5404032 - DNA, 12 bp, Homo sapiens
ctcctgcctgtg

SEQ ID NO: 5404033 - DNA, 14 bp, Homo sapiens
ctcctgcctgtgct

SEQ ID NO: 5404034 - DNA, 14 bp, Homo sapiens
ctcctgcctgtgtt

SEQ ID NO: 5404035 - DNA, 21 bp, Homo sapiens
ctcctgccttctgtcctggtg

SEQ ID NO: 5404036 - DNA, 14 bp, Homo sapiens
ctcctgccttgaaa

SEQ ID NO: 5404037 - DNA, 21 bp, Homo sapiens
ctcctgccttgaaaaagacat

SEQ ID NO: 5404038 - DNA, 19 bp, Homo sapiens
ctcctgcctttctcaactg

SEQ ID NO: 5404039 - DNA, 12 bp, Homo sapiens
ctcctgcctttg

SEQ ID NO: 5404040 - DNA, 15 bp, Homo sapiens
ctcctgcctttgcct

SEQ ID NO: 5404041 - DNA, 22 bp, Homo sapiens
ctcctgcggctcagccttgcac

SEQ ID NO: 5404042 - DNA, 23 bp, Homo sapiens
ctcctgctaacggtgctcagggg

SEQ ID NO: 5404043 - DNA, 18 bp, Homo sapiens
ctcctgctactctgttcc

SEQ ID NO: 5404044 - DNA, 18 bp, Homo sapiens
ctcctgctacttccccag

SEQ ID NO: 5404045 - DNA, 12 bp, Homo sapiens
ctcctgctcacc

SEQ ID NO: 5404046 - DNA, 14 bp, Homo sapiens
ctcctgctcaccac

SEQ ID NO: 5404047 - DNA, 11 bp, Homo sapiens
ctcctgctcct

SEQ ID NO: 5404048 - DNA, 12 bp, Homo sapiens
ctcctgctcctc

SEQ ID NO: 5404049 - DNA, 14 bp, Homo sapiens
ctcctgctcctccc

SEQ ID NO: 5404050 - DNA, 23 bp, Homo sapiens
ctcctgctcctccctgcccccca

SEQ ID NO: 5404051 - DNA, 14 bp, Homo sapiens
ctcctgctctctat

SEQ ID NO: 5404052 - DNA, 15 bp, Homo sapiens
ctcctgctctgcttc

SEQ ID NO: 5404053 - DNA, 19 bp, Homo sapiens
ctcctgctctgcttcctca

SEQ ID NO: 5404054 - DNA, 21 bp, Homo sapiens
ctcctgctctgcttcctcagg

SEQ ID NO: 5404055 - DNA, 12 bp, Homo sapiens
ctcctgctgaaa

SEQ ID NO: 5404056 - DNA, 23 bp, Homo sapiens
ctcctgctgaaacacctcccagg

SEQ ID NO: 5404057 - DNA, 21 bp, Homo sapiens
ctcctgctgagctgcccctgc

SEQ ID NO: 5404058 - DNA, 10 bp, Homo sapiens
ctcctgctgc

SEQ ID NO: 5404059 - DNA, 14 bp, Homo sapiens
ctcctgctgcacag

SEQ ID NO: 5404060 - DNA, 16 bp, Homo sapiens
ctcctgctgcagaggg

SEQ ID NO: 5404061 - DNA, 14 bp, Homo sapiens
ctcctgctgccaca

SEQ ID NO: 5404062 - DNA, 18 bp, Homo sapiens
ctcctgctgcctaataaa

SEQ ID NO: 5404063 - DNA, 23 bp, Homo sapiens
ctcctgctgccttttctggagtt

SEQ ID NO: 5404064 - DNA, 17 bp, Homo sapiens
ctcctgctgctccctca

SEQ ID NO: 5404065 - DNA, 20 bp, Homo sapiens
ctcctgctgctccctcagac

SEQ ID NO: 5404066 - DNA, 14 bp, Homo sapiens
ctcctgctgctcct

SEQ ID NO: 5404067 - DNA, 14 bp, Homo sapiens
ctcctgctggctct

SEQ ID NO: 5404068 - DNA, 14 bp, Homo sapiens
ctcctgctggctga

SEQ ID NO: 5404069 - DNA, 18 bp, Homo sapiens
ctcctgctggctgaggct

SEQ ID NO: 5404070 - DNA, 22 bp, Homo sapiens
ctcctgctggggggcagggccc

SEQ ID NO: 5404071 - DNA, 17 bp, Homo sapiens
ctcctgctggtacctgc

SEQ ID NO: 5404072 - DNA, 14 bp, Homo sapiens
ctcctgctgtaaat

SEQ ID NO: 5404073 - DNA, 11 bp, Homo sapiens
ctcctgctgtg

SEQ ID NO: 5404074 - DNA, 23 bp, Homo sapiens
ctcctgctgtgcctcgcatccta

SEQ ID NO: 5404075 - DNA, 19 bp, Homo sapiens
ctcctgcttaatcttcaaa

SEQ ID NO: 5404076 - DNA, 12 bp, Homo sapiens
ctcctgcttccc

SEQ ID NO: 5404077 - DNA, 15 bp, Homo sapiens
ctcctgcttcccctc

SEQ ID NO: 5404078 - DNA, 13 bp, Homo sapiens
ctcctgcttttct

SEQ ID NO: 5404079 - DNA, 20 bp, Homo sapiens
ctcctgcttttctgtcctgg

SEQ ID NO: 5404080 - DNA, 20 bp, Homo sapiens
ctcctgcttttggggctctt

SEQ ID NO: 5404081 - DNA, 20 bp, Homo sapiens
ctcctggaaacagacaggga

SEQ ID NO: 5404082 - DNA, 22 bp, Homo sapiens
ctcctggaaacagacagggaga

SEQ ID NO: 5404083 - DNA, 12 bp, Homo sapiens
ctcctggaaact

SEQ ID NO: 5404084 - DNA, 19 bp, Homo sapiens
ctcctggaaacttagcttt

SEQ ID NO: 5404085 - DNA, 19 bp, Homo sapiens
ctcctggaaaggctcagtc

SEQ ID NO: 5404086 - DNA, 23 bp, Homo sapiens
ctcctggaaaggctcagtctcag

SEQ ID NO: 5404087 - DNA, 15 bp, Homo sapiens
ctcctggaacctggc

SEQ ID NO: 5404088 - DNA, 16 bp, Homo sapiens
ctcctggaacctggca

SEQ ID NO: 5404089 - DNA, 17 bp, Homo sapiens
ctcctggaagctgtgtc

SEQ ID NO: 5404090 - DNA, 20 bp, Homo sapiens
ctcctggaagctgtgtcctt

SEQ ID NO: 5404091 - DNA, 23 bp, Homo sapiens
ctcctggaagctgtgtccttgca

SEQ ID NO: 5404092 - DNA, 16 bp, Homo sapiens
ctcctggacacggcct

SEQ ID NO: 5404093 - DNA, 21 bp, Homo sapiens
ctcctggacccccctttcaca

SEQ ID NO: 5404094 - DNA, 14 bp, Homo sapiens
ctctcccctccagc

SEQ ID NO: 5404095 - DNA, 15 bp, Homo sapiens
ctctcccctccagcc

SEQ ID NO: 5404096 - DNA, 15 bp, Homo sapiens
ctctcccctccccat

SEQ ID NO: 5404097 - DNA, 22 bp, Homo sapiens
ctctcccctccccatctgtgtt

SEQ ID NO: 5404098 - DNA, 18 bp, Homo sapiens
ctctcccctcctctgaat

SEQ ID NO: 5404099 - DNA, 14 bp, Homo sapiens
ctctcccctcctgc

SEQ ID NO: 5404100 - DNA, 17 bp, Homo sapiens
ctctcccctcctgctgg

SEQ ID NO: 5404101 - DNA, 23 bp, Homo sapiens
ctctcccctctcgccccatccct

SEQ ID NO: 5404102 - DNA, 16 bp, Homo sapiens
ctctcccctctctgct

SEQ ID NO: 5404103 - DNA, 15 bp, Homo sapiens
ctctcccctctgccc

SEQ ID NO: 5404104 - DNA, 17 bp, Homo sapiens
ctctcccctgacctgtg

SEQ ID NO: 5404105 - DNA, 20 bp, Homo sapiens
ctctcccctgccccctgcag

SEQ ID NO: 5404106 - DNA, 19 bp, Homo sapiens
ctctcccctgcgcaggccc

SEQ ID NO: 5404107 - DNA, 20 bp, Homo sapiens
ctctcccctgcgcaggccct

SEQ ID NO: 5404108 - DNA, 15 bp, Homo sapiens
ctctccccttggttc

SEQ ID NO: 5404109 - DNA, 16 bp, Homo sapiens
ctctccccttggttct

SEQ ID NO: 5404110 - DNA, 18 bp, Homo sapiens
ctctcccggctgcctgcc

SEQ ID NO: 5404111 - DNA, 15 bp, Homo sapiens
ctctcccgtcagggc

SEQ ID NO: 5404112 - DNA, 17 bp, Homo sapiens
ctctcccgtctcgcctg

SEQ ID NO: 5404113 - DNA, 15 bp, Homo sapiens
ctctccctaccctct

SEQ ID NO: 5404114 - DNA, 20 bp, Homo sapiens
ctctccctaccctcttctca

SEQ ID NO: 5404115 - DNA, 15 bp, Homo sapiens
ctctccctacctccc

SEQ ID NO: 5404116 - DNA, 17 bp, Homo sapiens
ctctccctacctccctc

SEQ ID NO: 5404117 - DNA, 20 bp, Homo sapiens
ctctccctacctccctcctc

SEQ ID NO: 5404118 - DNA, 21 bp, Homo sapiens
ctctccctacctccctcctca

SEQ ID NO: 5404119 - DNA, 24 bp, Homo sapiens
ctctccctacctccctcctcaggg

SEQ ID NO: 5404120 - DNA, 13 bp, Homo sapiens
ctctccctacctt

SEQ ID NO: 5404121 - DNA, 23 bp, Homo sapiens
ctctccctcaacaagggagagac

SEQ ID NO: 5404122 - DNA, 13 bp, Homo sapiens
ctctccctcaggg

SEQ ID NO: 5404123 - DNA, 14 bp, Homo sapiens
ctctccctcagggg

SEQ ID NO: 5404124 - DNA, 12 bp, Homo sapiens
ctctccctcagt

SEQ ID NO: 5404125 - DNA, 16 bp, Homo sapiens
ctctccctcagtcctt

SEQ ID NO: 5404126 - DNA, 18 bp, Homo sapiens
ctctccctccactcctcc

SEQ ID NO: 5404127 - DNA, 19 bp, Homo sapiens
ctctccctccactcctccc

SEQ ID NO: 5404128 - DNA, 18 bp, Homo sapiens
ctctccctcccccagagc

SEQ ID NO: 5404129 - DNA, 19 bp, Homo sapiens
ctctccctcccccagagcc

SEQ ID NO: 5404130 - DNA, 17 bp, Homo sapiens
ctctccctcccctgcca

SEQ ID NO: 5404131 - DNA, 15 bp, Homo sapiens
ctctccctcctcagc

SEQ ID NO: 5404132 - DNA, 17 bp, Homo sapiens
ctctccctcctggccag

SEQ ID NO: 5404133 - DNA, 17 bp, Homo sapiens
ctctccctcctggtgaa

SEQ ID NO: 5404134 - DNA, 15 bp, Homo sapiens
ctctccctctaggct

SEQ ID NO: 5404135 - DNA, 14 bp, Homo sapiens
ctctccctctctct

SEQ ID NO: 5404136 - DNA, 15 bp, Homo sapiens
ctctccctctctctg

SEQ ID NO: 5404137 - DNA, 13 bp, Homo sapiens
ctctccctgcact

SEQ ID NO: 5404138 - DNA, 14 bp, Homo sapiens
ctctccctgcatcc

SEQ ID NO: 5404139 - DNA, 21 bp, Homo sapiens
ctctccctgcatcctgaggcc

SEQ ID NO: 5404140 - DNA, 14 bp, Homo sapiens
ctctccctgcatgg

SEQ ID NO: 5404141 - DNA, 12 bp, Homo sapiens
ctctccctgcct

SEQ ID NO: 5404142 - DNA, 14 bp, Homo sapiens
ctctccctgcctca

SEQ ID NO: 5404143 - DNA, 16 bp, Homo sapiens
ctctccctgcctcaca

SEQ ID NO: 5404144 - DNA, 14 bp, Homo sapiens
ctctccctgcgcac

SEQ ID NO: 5404145 - DNA, 13 bp, Homo sapiens
ctctccctgctgc

SEQ ID NO: 5404146 - DNA, 19 bp, Homo sapiens
ctctccctgctgctcctag

SEQ ID NO: 5404147 - DNA, 13 bp, Homo sapiens
ctctccctgggtc

SEQ ID NO: 5404148 - DNA, 18 bp, Homo sapiens
ctctccctggtcccctcc

SEQ ID NO: 5404149 - DNA, 14 bp, Homo sapiens
ctctccctgtcaca

SEQ ID NO: 5404150 - DNA, 18 bp, Homo sapiens
ctctccctgtcacacact

SEQ ID NO: 5404151 - DNA, 21 bp, Homo sapiens
ctctccctgtcacacactgga

SEQ ID NO: 5404152 - DNA, 20 bp, Homo sapiens
ctctccctgtcacgctcatg

SEQ ID NO: 5404153 - DNA, 12 bp, Homo sapiens
ctctccctgttg

SEQ ID NO: 5404154 - DNA, 13 bp, Homo sapiens
ctctcccttccct

SEQ ID NO: 5404155 - DNA, 15 bp, Homo sapiens
ctctcccttccctcc

SEQ ID NO: 5404156 - DNA, 14 bp, Homo sapiens
ctctcccttcttta

SEQ ID NO: 5404157 - DNA, 13 bp, Homo sapiens
ctctcccttggat

SEQ ID NO: 5404158 - DNA, 18 bp, Homo sapiens
ctctcccttgggctctga

SEQ ID NO: 5404159 - DNA, 19 bp, Homo sapiens
ctctcccttgggctctgat

SEQ ID NO: 5404160 - DNA, 15 bp, Homo sapiens
ctctcccttttcaga

SEQ ID NO: 5404161 - DNA, 22 bp, Homo sapiens
ctctccgaaagaagacacagaa

SEQ ID NO: 5404162 - DNA, 16 bp, Homo sapiens
ctctccgaccagacac

SEQ ID NO: 5404163 - DNA, 23 bp, Homo sapiens
ctctccgactctgcacccgcctc

SEQ ID NO: 5404164 - DNA, 18 bp, Homo sapiens
ctctccgacttcccctgg

SEQ ID NO: 5404165 - DNA, 22 bp, Homo sapiens
ctctccgacttcccctgggcaa

SEQ ID NO: 5404166 - DNA, 14 bp, Homo sapiens
ctctccgagctctg

SEQ ID NO: 5404167 - DNA, 18 bp, Homo sapiens
ctctccgagctctggtgc

SEQ ID NO: 5404168 - DNA, 16 bp, Homo sapiens
ctctccgaggggtgga

SEQ ID NO: 5404169 - DNA, 16 bp, Homo sapiens
ctctccgccccggaca

SEQ ID NO: 5404170 - DNA, 14 bp, Homo sapiens
ctctccgcgggtgg

SEQ ID NO: 5404171 - DNA, 22 bp, Homo sapiens
ctctcctaactgccagccccct

SEQ ID NO: 5404172 - DNA, 21 bp, Homo sapiens
ctctcctaccccacctcatgc

SEQ ID NO: 5404173 - DNA, 18 bp, Homo sapiens
ctctcctactcggctctg

SEQ ID NO: 5404174 - DNA, 19 bp, Homo sapiens
ctctcctactcggctctgc

SEQ ID NO: 5404175 - DNA, 18 bp, Homo sapiens
ctctcctagcccctctct

SEQ ID NO: 5404176 - DNA, 21 bp, Homo sapiens
ctctcctagccctcctgaggg

SEQ ID NO: 5404177 - DNA, 14 bp, Homo sapiens
ctctcctcagactg

SEQ ID NO: 5404178 - DNA, 19 bp, Homo sapiens
ctctcctcatctccaaggc

SEQ ID NO: 5404179 - DNA, 14 bp, Homo sapiens
ctctcctcatctct

SEQ ID NO: 5404180 - DNA, 20 bp, Homo sapiens
ctctcctcatgttctgcttt

SEQ ID NO: 5404181 - DNA, 13 bp, Homo sapiens
ctctcctccagcc

SEQ ID NO: 5404182 - DNA, 16 bp, Homo sapiens
ctctcctccagccctg

SEQ ID NO: 5404183 - DNA, 20 bp, Homo sapiens
ctctcctccagccctgggca

SEQ ID NO: 5404184 - DNA, 14 bp, Homo sapiens
ctctcctcccagct

SEQ ID NO: 5404185 - DNA, 19 bp, Homo sapiens
ctctcctcccagctgcttt

SEQ ID NO: 5404186 - DNA, 20 bp, Homo sapiens
ctctcctcccagctgcttta

SEQ ID NO: 5404187 - DNA, 14 bp, Homo sapiens
ctctcctcccctac

SEQ ID NO: 5404188 - DNA, 13 bp, Homo sapiens
ctctcctccgtgg

SEQ ID NO: 5404189 - DNA, 17 bp, Homo sapiens
ctctcctccgtggcaca

SEQ ID NO: 5404190 - DNA, 12 bp, Homo sapiens
ctctcctcctcc

SEQ ID NO: 5404191 - DNA, 14 bp, Homo sapiens
ctctcctcctcccc

SEQ ID NO: 5404192 - DNA, 17 bp, Homo sapiens
ctctcctcctcccctcc

SEQ ID NO: 5404193 - DNA, 19 bp, Homo sapiens
ctctcctccttgggcaggg

SEQ ID NO: 5404194 - DNA, 22 bp, Homo sapiens
ctctcctcggacacccagggtc

SEQ ID NO: 5404195 - DNA, 16 bp, Homo sapiens
ctctcctcgggccctg

SEQ ID NO: 5404196 - DNA, 17 bp, Homo sapiens
ctctcctcggtggcatt

SEQ ID NO: 5404197 - DNA, 10 bp, Homo sapiens
ctctcctctc

SEQ ID NO: 5404198 - DNA, 16 bp, Homo sapiens
ctctcctctcccccag

SEQ ID NO: 5404199 - DNA, 17 bp, Homo sapiens
ctctcctctctctccct

SEQ ID NO: 5404200 - DNA, 15 bp, Homo sapiens
ctctcctctgcctca

SEQ ID NO: 5404201 - DNA, 15 bp, Homo sapiens
ctctcctctggctag

SEQ ID NO: 5404202 - DNA, 12 bp, Homo sapiens
ctctcctcttct

SEQ ID NO: 5404203 - DNA, 14 bp, Homo sapiens
ctctcctcttgcca

SEQ ID NO: 5404204 - DNA, 15 bp, Homo sapiens
ctctcctcttgccac

SEQ ID NO: 5404205 - DNA, 17 bp, Homo sapiens
ctctcctcttgccactg

SEQ ID NO: 5404206 - DNA, 13 bp, Homo sapiens
ctctcctgagagg

SEQ ID NO: 5404207 - DNA, 18 bp, Homo sapiens
ctctcctgagaggtgctg

SEQ ID NO: 5404208 - DNA, 20 bp, Homo sapiens
ctctcctgagcctgtctctc

SEQ ID NO: 5404209 - DNA, 12 bp, Homo sapiens
ctctcctgccca

SEQ ID NO: 5404210 - DNA, 19 bp, Homo sapiens
ctctcctgcccaagcactt

SEQ ID NO: 5404211 - DNA, 17 bp, Homo sapiens
ctctcctgcccagctct

SEQ ID NO: 5404212 - DNA, 22 bp, Homo sapiens
ctctcctgcccagctctgaccc

SEQ ID NO: 5404213 - DNA, 16 bp, Homo sapiens
ctctcctgccctctgc

SEQ ID NO: 5404214 - DNA, 13 bp, Homo sapiens
ctctcctgcctac

SEQ ID NO: 5404215 - DNA, 12 bp, Homo sapiens
ctctcctggacg

SEQ ID NO: 5404216 - DNA, 22 bp, Homo sapiens
ctctcctggagcaagctctgcc

SEQ ID NO: 5404217 - DNA, 12 bp, Homo sapiens
ctctcctggagg

SEQ ID NO: 5404218 - DNA, 13 bp, Homo sapiens
ctctcctggagga

SEQ ID NO: 5404219 - DNA, 16 bp, Homo sapiens
ctctcctggagggcgc

SEQ ID NO: 5404220 - DNA, 20 bp, Homo sapiens
ctctcctggagtctgaagcc

SEQ ID NO: 5404221 - DNA, 13 bp, Homo sapiens
ctctcctggccta

SEQ ID NO: 5404222 - DNA, 12 bp, Homo sapiens
ctctcctggctg

SEQ ID NO: 5404223 - DNA, 13 bp, Homo sapiens
ctctcctggctgg

SEQ ID NO: 5404224 - DNA, 13 bp, Homo sapiens
ctctcctggctgt

SEQ ID NO: 5404225 - DNA, 17 bp, Homo sapiens
ctctcctggcttcccat

SEQ ID NO: 5404226 - DNA, 18 bp, Homo sapiens
ctctcctgggcagctgcc

SEQ ID NO: 5404227 - DNA, 20 bp, Homo sapiens
ctctcctgggcagctgcctc

SEQ ID NO: 5404228 - DNA, 20 bp, Homo sapiens
ctctcctgggggtggcaggc

SEQ ID NO: 5404229 - DNA, 19 bp, Homo sapiens
ctctcctgtaagccaaaga

SEQ ID NO: 5404230 - DNA, 20 bp, Homo sapiens
ctctcctgtaagccaaagaa

SEQ ID NO: 5404231 - DNA, 18 bp, Homo sapiens
ctctcctgtactttttcc

SEQ ID NO: 5404232 - DNA, 20 bp, Homo sapiens
ctctcctgtccccgccgggc

SEQ ID NO: 5404233 - DNA, 12 bp, Homo sapiens
ctctcctgtcct

SEQ ID NO: 5404234 - DNA, 13 bp, Homo sapiens
ctctcctgtctga

SEQ ID NO: 5404235 - DNA, 20 bp, Homo sapiens
ctctcctgtctgccctctgg

SEQ ID NO: 5404236 - DNA, 13 bp, Homo sapiens
ctctcctgtgtct

SEQ ID NO: 5404237 - DNA, 17 bp, Homo sapiens
ctctcctgtgtgcttgt

SEQ ID NO: 5404238 - DNA, 20 bp, Homo sapiens
ctctcctgtttcccttccct

SEQ ID NO: 5404239 - DNA, 22 bp, Homo sapiens
ctctccttaacctccagcagac

SEQ ID NO: 5404240 - DNA, 22 bp, Homo sapiens
ctctccttcatgacagcctcca

SEQ ID NO: 5404241 - DNA, 13 bp, Homo sapiens
ctctccttcccac

SEQ ID NO: 5404242 - DNA, 13 bp, Homo sapiens
ctctccttccctc

SEQ ID NO: 5404243 - DNA, 15 bp, Homo sapiens
ctctccttcctcaga

SEQ ID NO: 5404244 - DNA, 16 bp, Homo sapiens
ctctccttctcctagc

SEQ ID NO: 5404245 - DNA, 20 bp, Homo sapiens
ctctccttctcctagctctg

SEQ ID NO: 5404246 - DNA, 14 bp, Homo sapiens
ctctccttgccccc

SEQ ID NO: 5404247 - DNA, 16 bp, Homo sapiens
ctctccttgcccccag

SEQ ID NO: 5404248 - DNA, 13 bp, Homo sapiens
ctctccttgccct

SEQ ID NO: 5404249 - DNA, 19 bp, Homo sapiens
ctctccttgccctgggcca

SEQ ID NO: 5404250 - DNA, 16 bp, Homo sapiens
ctctccttggccacag

SEQ ID NO: 5404251 - DNA, 21 bp, Homo sapiens
ctctccttggcctttcctgga

SEQ ID NO: 5404252 - DNA, 17 bp, Homo sapiens
ctctccttgggctcctg

SEQ ID NO: 5404253 - DNA, 18 bp, Homo sapiens
ctctccttgggctcctgg

SEQ ID NO: 5404254 - DNA, 18 bp, Homo sapiens
ctctccttgttgccccca

SEQ ID NO: 5404255 - DNA, 14 bp, Homo sapiens
ctctcctttctccc

SEQ ID NO: 5404256 - DNA, 14 bp, Homo sapiens
ctctcctttctttt

SEQ ID NO: 5404257 - DNA, 21 bp, Homo sapiens
ctctcctttgaaacctgctct

SEQ ID NO: 5404258 - DNA, 18 bp, Homo sapiens
ctctcctttgtatattat

SEQ ID NO: 5404259 - DNA, 21 bp, Homo sapiens
ctctcctttgtgtggctgccc

SEQ ID NO: 5404260 - DNA, 18 bp, Homo sapiens
ctctcctttgttcccggc

SEQ ID NO: 5404261 - DNA, 12 bp, Homo sapiens
ctctccttttct

SEQ ID NO: 5404262 - DNA, 15 bp, Homo sapiens
ctctccttttctcca

SEQ ID NO: 5404263 - DNA, 17 bp, Homo sapiens
ctctccttttcttttgt

SEQ ID NO: 5404264 - DNA, 21 bp, Homo sapiens
ctctccttttcttttgttact

SEQ ID NO: 5404265 - DNA, 22 bp, Homo sapiens
ctctccttttcttttgttactg

SEQ ID NO: 5404266 - DNA, 16 bp, Homo sapiens
ctctccttttgaggct

SEQ ID NO: 5404267 - DNA, 22 bp, Homo sapiens
ctctccttttgaggcttctcct

SEQ ID NO: 5404268 - DNA, 17 bp, Homo sapiens
ctctcgaccggccctgc

SEQ ID NO: 5404269 - DNA, 16 bp, Homo sapiens
ctctcgacggcacgca

SEQ ID NO: 5404270 - DNA, 18 bp, Homo sapiens
ctctcgacggcacgcact

SEQ ID NO: 5404271 - DNA, 23 bp, Homo sapiens
ctctcgacggcacgcacttgcct

SEQ ID NO: 5404272 - DNA, 15 bp, Homo sapiens
ctctcgcggcctctt

SEQ ID NO: 5404273 - DNA, 22 bp, Homo sapiens
ctctcgcggcctcttctctcag

SEQ ID NO: 5404274 - DNA, 21 bp, Homo sapiens
ctctgaatttgtcgggttctc

SEQ ID NO: 5404275 - DNA, 16 bp, Homo sapiens
ctctgacaacagactt

SEQ ID NO: 5404276 - DNA, 21 bp, Homo sapiens
ctctgacaacagacttctgaa

SEQ ID NO: 5404277 - DNA, 17 bp, Homo sapiens
ctctgacaagggctgac

SEQ ID NO: 5404278 - DNA, 17 bp, Homo sapiens
ctctgacacacagctct

SEQ ID NO: 5404279 - DNA, 17 bp, Homo sapiens
ctctgacagcagcatct

SEQ ID NO: 5404280 - DNA, 16 bp, Homo sapiens
ctctgacagcagcctg

SEQ ID NO: 5404281 - DNA, 21 bp, Homo sapiens
ctctgacagcagcctgtgagg

SEQ ID NO: 5404282 - DNA, 22 bp, Homo sapiens
ctctgacagccctgcggagacc

SEQ ID NO: 5404283 - DNA, 22 bp, Homo sapiens
ctctgacagtccacaggggcca

SEQ ID NO: 5404284 - DNA, 18 bp, Homo sapiens
ctctgacatcaagtgtaa

SEQ ID NO: 5404285 - DNA, 16 bp, Homo sapiens
ctctgacatcccttcc

SEQ ID NO: 5404286 - DNA, 17 bp, Homo sapiens
ctctgacatcccttcct

SEQ ID NO: 5404287 - DNA, 20 bp, Homo sapiens
ctctgacatcccttcctgga

SEQ ID NO: 5404288 - DNA, 17 bp, Homo sapiens
ctctgaccacagcccgc

SEQ ID NO: 5404289 - DNA, 23 bp, Homo sapiens
ctctgacccaagtggggcctcct

SEQ ID NO: 5404290 - DNA, 20 bp, Homo sapiens
ctctgaccccagcattctca

SEQ ID NO: 5404291 - DNA, 16 bp, Homo sapiens
ctctgacccctcctca

SEQ ID NO: 5404292 - DNA, 22 bp, Homo sapiens
ctctgacccggttgcagtcact

SEQ ID NO: 5404293 - DNA, 17 bp, Homo sapiens
ctctgaccctccttcta

SEQ ID NO: 5404294 - DNA, 22 bp, Homo sapiens
ctctgaccctctggaaatatgt

SEQ ID NO: 5404295 - DNA, 15 bp, Homo sapiens
ctctgacccttgggc

SEQ ID NO: 5404296 - DNA, 21 bp, Homo sapiens
ctctgacccttgggcctgggc

SEQ ID NO: 5404297 - DNA, 24 bp, Homo sapiens
ctctgacccttgggcctgggcctc

SEQ ID NO: 5404298 - DNA, 16 bp, Homo sapiens
ctctgaccgattcctt

SEQ ID NO: 5404299 - DNA, 18 bp, Homo sapiens
ctctgaccgattccttta

SEQ ID NO: 5404300 - DNA, 23 bp, Homo sapiens
ctctgacctactcgagggactta

SEQ ID NO: 5404301 - DNA, 20 bp, Homo sapiens
ctctgacctcctctgggccc

SEQ ID NO: 5404302 - DNA, 18 bp, Homo sapiens
ctctgacctctgctgagt

SEQ ID NO: 5404303 - DNA, 15 bp, Homo sapiens
ctctgacctgcaggc

SEQ ID NO: 5404304 - DNA, 21 bp, Homo sapiens
ctctgaccttcacagggacag

SEQ ID NO: 5404305 - DNA, 18 bp, Homo sapiens
ctctgaccttccagagcc

SEQ ID NO: 5404306 - DNA, 23 bp, Homo sapiens
ctctgaccttccagagcccaagg

SEQ ID NO: 5404307 - DNA, 14 bp, Homo sapiens
ctctgacctttcat

SEQ ID NO: 5404308 - DNA, 15 bp, Homo sapiens
ctctgacgcttgtga

SEQ ID NO: 5404309 - DNA, 20 bp, Homo sapiens
ctctgacgcttgtgacagtg

SEQ ID NO: 5404310 - DNA, 22 bp, Homo sapiens
ctctgactcaccacgatgacgc

SEQ ID NO: 5404311 - DNA, 15 bp, Homo sapiens
ctctgactcagggct

SEQ ID NO: 5404312 - DNA, 16 bp, Homo sapiens
ctctgactcagggctc

SEQ ID NO: 5404313 - DNA, 17 bp, Homo sapiens
ctctgactcagggctcc

SEQ ID NO: 5404314 - DNA, 18 bp, Homo sapiens
ctctgactccactcaaag

SEQ ID NO: 5404315 - DNA, 19 bp, Homo sapiens
ctctgactccactcaaaga

SEQ ID NO: 5404316 - DNA, 18 bp, Homo sapiens
ctctgactcccaaagagc

SEQ ID NO: 5404317 - DNA, 21 bp, Homo sapiens
ctctgactcccaaagagctgc

SEQ ID NO: 5404318 - DNA, 22 bp, Homo sapiens
ctctgactcccaaagagctgcc

SEQ ID NO: 5404319 - DNA, 23 bp, Homo sapiens
ctctgactccttcggtagctgca

SEQ ID NO: 5404320 - DNA, 17 bp, Homo sapiens
ctctgactctgccaggg

SEQ ID NO: 5404321 - DNA, 19 bp, Homo sapiens
ctctgactctgccagggtg

SEQ ID NO: 5404322 - DNA, 15 bp, Homo sapiens
ctctgactcttgcct

SEQ ID NO: 5404323 - DNA, 16 bp, Homo sapiens
ctctgactcttgcctt

SEQ ID NO: 5404324 - DNA, 18 bp, Homo sapiens
ctctgactggcacagtct

SEQ ID NO: 5404325 - DNA, 23 bp, Homo sapiens
ctctgacttccccaaacccagaa

SEQ ID NO: 5404326 - DNA, 22 bp, Homo sapiens
ctctgagaaaatgcgagactct

SEQ ID NO: 5404327 - DNA, 14 bp, Homo sapiens
ctctgagaaattga

SEQ ID NO: 5404328 - DNA, 10 bp, Homo sapiens
ctctgagaac

SEQ ID NO: 5404329 - DNA, 14 bp, Homo sapiens
ctctgagaaccaaa

SEQ ID NO: 5404330 - DNA, 16 bp, Homo sapiens
ctctgagaagaggagc

SEQ ID NO: 5404331 - DNA, 16 bp, Homo sapiens
ctctgagaagctctga

SEQ ID NO: 5404332 - DNA, 18 bp, Homo sapiens
ctctgagaattccaagga

SEQ ID NO: 5404333 - DNA, 21 bp, Homo sapiens
ctctgagaattccaaggagtt

SEQ ID NO: 5404334 - DNA, 20 bp, Homo sapiens
ctctgagaattgttgagata

SEQ ID NO: 5404335 - DNA, 23 bp, Homo sapiens
ctctgagacaaaagaaaaaatat

SEQ ID NO: 5404336 - DNA, 15 bp, Homo sapiens
ctctgagacacaccc

SEQ ID NO: 5404337 - DNA, 23 bp, Homo sapiens
ctctgagacagagagccaagcta

SEQ ID NO: 5404338 - DNA, 14 bp, Homo sapiens
ctctgagacagcag

SEQ ID NO: 5404339 - DNA, 20 bp, Homo sapiens
ctctgagacccttttctcag

SEQ ID NO: 5404340 - DNA, 23 bp, Homo sapiens
ctctgagacggatggaaggagag

SEQ ID NO: 5404341 - DNA, 21 bp, Homo sapiens
ctctgagactcgcgacaatgc

SEQ ID NO: 5404342 - DNA, 21 bp, Homo sapiens
ctctgagactctttagagcag

SEQ ID NO: 5404343 - DNA, 22 bp, Homo sapiens
ctctgagactctttagagcagc

SEQ ID NO: 5404344 - DNA, 23 bp, Homo sapiens
ctctgagactctttagagcagct

SEQ ID NO: 5404345 - DNA, 16 bp, Homo sapiens
ctctgagactgctaag

SEQ ID NO: 5404346 - DNA, 21 bp, Homo sapiens
ctctgagactggcagatcgct

SEQ ID NO: 5404347 - DNA, 21 bp, Homo sapiens
ctctgagagccccaggactgg

SEQ ID NO: 5404348 - DNA, 16 bp, Homo sapiens
ctctgagaggccctgg

SEQ ID NO: 5404349 - DNA, 15 bp, Homo sapiens
ctctgagagtctaga

SEQ ID NO: 5404350 - DNA, 22 bp, Homo sapiens
ctctgagatctaaggatgtcac

SEQ ID NO: 5404351 - DNA, 20 bp, Homo sapiens
ctctgagatgtggagactga

SEQ ID NO: 5404352 - DNA, 16 bp, Homo sapiens
ctctgagcaaatgtgg

SEQ ID NO: 5404353 - DNA, 18 bp, Homo sapiens
ctctgagcaactgtgcag

SEQ ID NO: 5404354 - DNA, 20 bp, Homo sapiens
ctctgagcaactgtgcagca

SEQ ID NO: 5404355 - DNA, 22 bp, Homo sapiens
ctctgagcacatagtgtcctgc

SEQ ID NO: 5404356 - DNA, 19 bp, Homo sapiens
ctctgagcagcctctgcca

SEQ ID NO: 5404357 - DNA, 13 bp, Homo sapiens
ctctgagcagggg

SEQ ID NO: 5404358 - DNA, 14 bp, Homo sapiens
ctctgagcaggggc

SEQ ID NO: 5404359 - DNA, 20 bp, Homo sapiens
ctctgagcaggggcaggcgc

SEQ ID NO: 5404360 - DNA, 21 bp, Homo sapiens
ctctgagcaggggcaggcgca

SEQ ID NO: 5404361 - DNA, 12 bp, Homo sapiens
ctctgagcagtg

SEQ ID NO: 5404362 - DNA, 13 bp, Homo sapiens
ctctgagcagtga

SEQ ID NO: 5404363 - DNA, 15 bp, Homo sapiens
ctctgagcagtgggg

SEQ ID NO: 5404364 - DNA, 14 bp, Homo sapiens
ctctgagccaacct

SEQ ID NO: 5404365 - DNA, 17 bp, Homo sapiens
ctctgagccaaccttgc

SEQ ID NO: 5404366 - DNA, 15 bp, Homo sapiens
ctctgagccaaggga

SEQ ID NO: 5404367 - DNA, 13 bp, Homo sapiens
ctctgagccagga

SEQ ID NO: 5404368 - DNA, 14 bp, Homo sapiens
ctctgagcccagct

SEQ ID NO: 5404369 - DNA, 17 bp, Homo sapiens
ctctgagcccagctgcc

SEQ ID NO: 5404370 - DNA, 18 bp, Homo sapiens
ctctgagcccagctgcct

SEQ ID NO: 5404371 - DNA, 13 bp, Homo sapiens
ctctgagcccatg

SEQ ID NO: 5404372 - DNA, 14 bp, Homo sapiens
ctctgagccccctg

SEQ ID NO: 5404373 - DNA, 21 bp, Homo sapiens
ctctgagccccctgtgcccac

SEQ ID NO: 5404374 - DNA, 12 bp, Homo sapiens
ctctgagccgca

SEQ ID NO: 5404375 - DNA, 13 bp, Homo sapiens
ctctgagccgcag

SEQ ID NO: 5404376 - DNA, 15 bp, Homo sapiens
ctctgagcgggaggc

SEQ ID NO: 5404377 - DNA, 16 bp, Homo sapiens
ctctgagcgggaggca

SEQ ID NO: 5404378 - DNA, 17 bp, Homo sapiens
ctctgagctgctcaccg

SEQ ID NO: 5404379 - DNA, 14 bp, Homo sapiens
ctctgagctgggga

SEQ ID NO: 5404380 - DNA, 19 bp, Homo sapiens
ctctgagctgtcaacgaga

SEQ ID NO: 5404381 - DNA, 15 bp, Homo sapiens
ctctgagctgttatc

SEQ ID NO: 5404382 - DNA, 19 bp, Homo sapiens
ctctgagctgttatcttgt

SEQ ID NO: 5404383 - DNA, 13 bp, Homo sapiens
ctctgagctttgc

SEQ ID NO: 5404384 - DNA, 17 bp, Homo sapiens
ctctgagctttgcatgt

SEQ ID NO: 5404385 - DNA, 20 bp, Homo sapiens
ctctgagctttgttactgaa

SEQ ID NO: 5404386 - DNA, 13 bp, Homo sapiens
ctctgaggaagct

SEQ ID NO: 5404387 - DNA, 12 bp, Homo sapiens
ctctgaggacag

SEQ ID NO: 5404388 - DNA, 15 bp, Homo sapiens
ctctgaggacagagc

SEQ ID NO: 5404389 - DNA, 22 bp, Homo sapiens
ctctgaggacaggctctagaga

SEQ ID NO: 5404390 - DNA, 19 bp, Homo sapiens
ctctgaggactctggaccc

SEQ ID NO: 5404391 - DNA, 18 bp, Homo sapiens
ctctgaggagcccacggg

SEQ ID NO: 5404392 - DNA, 23 bp, Homo sapiens
ctctgaggagtggagttctctgt

SEQ ID NO: 5404393 - DNA, 20 bp, Homo sapiens
ctctgaggcaaggcccagac

SEQ ID NO: 5404394 - DNA, 24 bp, Homo sapiens
ctctgaggcaaggcccagacctgg

SEQ ID NO: 5404395 - DNA, 16 bp, Homo sapiens
ctctgaggccagcctg

SEQ ID NO: 5404396 - DNA, 23 bp, Homo sapiens
ctctgaggcgccccaacccgtgg

SEQ ID NO: 5404397 - DNA, 13 bp, Homo sapiens
ctctgaggctcag

SEQ ID NO: 5404398 - DNA, 16 bp, Homo sapiens
ctctgaggctcagccc

SEQ ID NO: 5404399 - DNA, 17 bp, Homo sapiens
ctctgaggctcagccct

SEQ ID NO: 5404400 - DNA, 21 bp, Homo sapiens
ctctgaggctcagccctgagc

SEQ ID NO: 5404401 - DNA, 19 bp, Homo sapiens
ctctgaggcttccagagag

SEQ ID NO: 5404402 - DNA, 22 bp, Homo sapiens
ctctgagggagaggctgtggtg

SEQ ID NO: 5404403 - DNA, 17 bp, Homo sapiens
ctctgagggcttccttt

SEQ ID NO: 5404404 - DNA, 18 bp, Homo sapiens
ctctgagggcttcctttg

SEQ ID NO: 5404405 - DNA, 22 bp, Homo sapiens
ctctgaggggaggcacctccag

SEQ ID NO: 5404406 - DNA, 20 bp, Homo sapiens
ctctgaggggctaccaggaa

SEQ ID NO: 5404407 - DNA, 18 bp, Homo sapiens
ctctgaggtcaataaagc

SEQ ID NO: 5404408 - DNA, 20 bp, Homo sapiens
ctctgaggtcaataaagcag

SEQ ID NO: 5404409 - DNA, 22 bp, Homo sapiens
ctctgaggtcaataaagcagag

SEQ ID NO: 5404410 - DNA, 15 bp, Homo sapiens
ctctgaggtcccttc

SEQ ID NO: 5404411 - DNA, 18 bp, Homo sapiens
ctctgaggtctcaccttc

SEQ ID NO: 5404412 - DNA, 17 bp, Homo sapiens
ctctgagtagctttaca

SEQ ID NO: 5404413 - DNA, 14 bp, Homo sapiens
ctctgagtcaaatc

SEQ ID NO: 5404414 - DNA, 15 bp, Homo sapiens
ctctgagtcaaatcc

SEQ ID NO: 5404415 - DNA, 19 bp, Homo sapiens
ctctgagtcaaatccagtg

SEQ ID NO: 5404416 - DNA, 23 bp, Homo sapiens
ctctgagtcaaatccagtggtgg

SEQ ID NO: 5404417 - DNA, 19 bp, Homo sapiens
ctctgagtcacaggtgtgg

SEQ ID NO: 5404418 - DNA, 15 bp, Homo sapiens
ctctgagtcctggcc

SEQ ID NO: 5404419 - DNA, 17 bp, Homo sapiens
ctctgagtcctggccca

SEQ ID NO: 5404420 - DNA, 18 bp, Homo sapiens
ctctgagtcctggcccaa

SEQ ID NO: 5404421 - DNA, 18 bp, Homo sapiens
ctctgagtgaagtccagt

SEQ ID NO: 5404422 - DNA, 19 bp, Homo sapiens
ctctgagtggtggttcctt

SEQ ID NO: 5404423 - DNA, 23 bp, Homo sapiens
ctctgagtgtctctgcctggagc

SEQ ID NO: 5404424 - DNA, 24 bp, Homo sapiens
ctctgagtgtctctgcctggagca

SEQ ID NO: 5404425 - DNA, 12 bp, Homo sapiens
ctctgagtgtga

SEQ ID NO: 5404426 - DNA, 19 bp, Homo sapiens
ctctgagttccggcaccag

SEQ ID NO: 5404427 - DNA, 21 bp, Homo sapiens
ctctgagttccggcaccagta

SEQ ID NO: 5404428 - DNA, 23 bp, Homo sapiens
ctctgagttccggcaccagtagc

SEQ ID NO: 5404429 - DNA, 16 bp, Homo sapiens
ctctgagttctgtact

SEQ ID NO: 5404430 - DNA, 21 bp, Homo sapiens
ctctgagtttaccatttgtaa

SEQ ID NO: 5404431 - DNA, 13 bp, Homo sapiens
ctctgagtttttg

SEQ ID NO: 5404432 - DNA, 16 bp, Homo sapiens
ctctgagtttttgtat

SEQ ID NO: 5404433 - DNA, 14 bp, Homo sapiens
ctctgataagagaa

SEQ ID NO: 5404434 - DNA, 20 bp, Homo sapiens
ctctgatagctgtttcaaat

SEQ ID NO: 5404435 - DNA, 23 bp, Homo sapiens
ctctgatagctgtttcaaatgtg

SEQ ID NO: 5404436 - DNA, 21 bp, Homo sapiens
ctctgatatgggactgagcct

SEQ ID NO: 5404437 - DNA, 23 bp, Homo sapiens
ctctgatattccatgaatgtatc

SEQ ID NO: 5404438 - DNA, 17 bp, Homo sapiens
ctctgatcaaagcacct

SEQ ID NO: 5404439 - DNA, 22 bp, Homo sapiens
ctctgatccctctacagagctt

SEQ ID NO: 5404440 - DNA, 15 bp, Homo sapiens
ctctgatccctctgg

SEQ ID NO: 5404441 - DNA, 13 bp, Homo sapiens
ctctgatctaaca

SEQ ID NO: 5404442 - DNA, 15 bp, Homo sapiens
ctctgatctaacaaa

SEQ ID NO: 5404443 - DNA, 18 bp, Homo sapiens
ctctgatctaacaaaata

SEQ ID NO: 5404444 - DNA, 15 bp, Homo sapiens
ctctgatctccatgg

SEQ ID NO: 5404445 - DNA, 16 bp, Homo sapiens
ctctgatcttgtgctc

SEQ ID NO: 5404446 - DNA, 17 bp, Homo sapiens
ctctgatcttgtgctca

SEQ ID NO: 5404447 - DNA, 17 bp, Homo sapiens
ctctgatgaagaggagt

SEQ ID NO: 5404448 - DNA, 13 bp, Homo sapiens
ctctgatgcagaa

SEQ ID NO: 5404449 - DNA, 12 bp, Homo sapiens
ctctgctcttgt

SEQ ID NO: 5404450 - DNA, 20 bp, Homo sapiens
ctctgctcttgtttcactcc

SEQ ID NO: 5404451 - DNA, 22 bp, Homo sapiens
ctctgctcttgtttcactccac

SEQ ID NO: 5404452 - DNA, 12 bp, Homo sapiens
ctctgctgaaca

SEQ ID NO: 5404453 - DNA, 19 bp, Homo sapiens
ctctgctgaacatttggaa

SEQ ID NO: 5404454 - DNA, 13 bp, Homo sapiens
ctctgctgaagac

SEQ ID NO: 5404455 - DNA, 13 bp, Homo sapiens
ctctgctgacaga

SEQ ID NO: 5404456 - DNA, 18 bp, Homo sapiens
ctctgctgagcagcccag

SEQ ID NO: 5404457 - DNA, 16 bp, Homo sapiens
ctctgctgagctgggc

SEQ ID NO: 5404458 - DNA, 18 bp, Homo sapiens
ctctgctgagctgggccc

SEQ ID NO: 5404459 - DNA, 19 bp, Homo sapiens
ctctgctgagctgggccca

SEQ ID NO: 5404460 - DNA, 14 bp, Homo sapiens
ctctgctgaggcca

SEQ ID NO: 5404461 - DNA, 19 bp, Homo sapiens
ctctgctgaggccagagga

SEQ ID NO: 5404462 - DNA, 14 bp, Homo sapiens
ctctgctgagggtc

SEQ ID NO: 5404463 - DNA, 14 bp, Homo sapiens
ctctgctgagtgct

SEQ ID NO: 5404464 - DNA, 23 bp, Homo sapiens
ctctgctgagtgctgggcactgc

SEQ ID NO: 5404465 - DNA, 13 bp, Homo sapiens
ctctgctgcaaca

SEQ ID NO: 5404466 - DNA, 13 bp, Homo sapiens
ctctgctgcatcc

SEQ ID NO: 5404467 - DNA, 19 bp, Homo sapiens
ctctgctgcatccccttcc

SEQ ID NO: 5404468 - DNA, 20 bp, Homo sapiens
ctctgctgcatccccttcca

SEQ ID NO: 5404469 - DNA, 22 bp, Homo sapiens
ctctgctgcatccccttccagc

SEQ ID NO: 5404470 - DNA, 13 bp, Homo sapiens
ctctgctgccatg

SEQ ID NO: 5404471 - DNA, 15 bp, Homo sapiens
ctctgctgccatggc

SEQ ID NO: 5404472 - DNA, 19 bp, Homo sapiens
ctctgctgcccacggccac

SEQ ID NO: 5404473 - DNA, 15 bp, Homo sapiens
ctctgctgccccctt

SEQ ID NO: 5404474 - DNA, 16 bp, Homo sapiens
ctctgctgcccccttc

SEQ ID NO: 5404475 - DNA, 19 bp, Homo sapiens
ctctgctgcccccttcccc

SEQ ID NO: 5404476 - DNA, 13 bp, Homo sapiens
ctctgctgccgcc

SEQ ID NO: 5404477 - DNA, 22 bp, Homo sapiens
ctctgctgccggctctgggcct

SEQ ID NO: 5404478 - DNA, 13 bp, Homo sapiens
ctctgctgcctct

SEQ ID NO: 5404479 - DNA, 16 bp, Homo sapiens
ctctgctgcctctgtg

SEQ ID NO: 5404480 - DNA, 12 bp, Homo sapiens
ctctgctgcctg

SEQ ID NO: 5404481 - DNA, 16 bp, Homo sapiens
ctctgctgcctgtaca

SEQ ID NO: 5404482 - DNA, 17 bp, Homo sapiens
ctctgctgcctgtacag

SEQ ID NO: 5404483 - DNA, 14 bp, Homo sapiens
ctctgctgctggct

SEQ ID NO: 5404484 - DNA, 16 bp, Homo sapiens
ctctgctgctgtccct

SEQ ID NO: 5404485 - DNA, 13 bp, Homo sapiens
ctctgctgcttag

SEQ ID NO: 5404486 - DNA, 18 bp, Homo sapiens
ctctgctggacgtccagg

SEQ ID NO: 5404487 - DNA, 16 bp, Homo sapiens
ctctgctggagaaagc

SEQ ID NO: 5404488 - DNA, 21 bp, Homo sapiens
ctctgctggagaaagccacgc

SEQ ID NO: 5404489 - DNA, 13 bp, Homo sapiens
ctctgctggcagg

SEQ ID NO: 5404490 - DNA, 14 bp, Homo sapiens
ctctgctggcccag

SEQ ID NO: 5404491 - DNA, 20 bp, Homo sapiens
ctctgctggccgggcacagc

SEQ ID NO: 5404492 - DNA, 21 bp, Homo sapiens
ctctgctggccgggcacagct

SEQ ID NO: 5404493 - DNA, 22 bp, Homo sapiens
ctctgctggccgggcacagctg

SEQ ID NO: 5404494 - DNA, 15 bp, Homo sapiens
ctctgctggcctggc

SEQ ID NO: 5404495 - DNA, 21 bp, Homo sapiens
ctctgctggcctggccggcaa

SEQ ID NO: 5404496 - DNA, 15 bp, Homo sapiens
ctctgctggcgggaa

SEQ ID NO: 5404497 - DNA, 15 bp, Homo sapiens
ctctgctgggtttcc

SEQ ID NO: 5404498 - DNA, 18 bp, Homo sapiens
ctctgctggtcttcaatt

SEQ ID NO: 5404499 - DNA, 21 bp, Homo sapiens
ctctgctggttcctgactggc

SEQ ID NO: 5404500 - DNA, 22 bp, Homo sapiens
ctctgctggttcctgactggca

SEQ ID NO: 5404501 - DNA, 13 bp, Homo sapiens
ctctgctgtagct

SEQ ID NO: 5404502 - DNA, 11 bp, Homo sapiens
ctctgctgtcc

SEQ ID NO: 5404503 - DNA, 12 bp, Homo sapiens
ctctgctgtcct

SEQ ID NO: 5404504 - DNA, 15 bp, Homo sapiens
ctctgctgtcctgca

SEQ ID NO: 5404505 - DNA, 16 bp, Homo sapiens
ctctgctgtcctgcag

SEQ ID NO: 5404506 - DNA, 11 bp, Homo sapiens
ctctgctgtgg

SEQ ID NO: 5404507 - DNA, 18 bp, Homo sapiens
ctctgcttaaacaaagca

SEQ ID NO: 5404508 - DNA, 15 bp, Homo sapiens
ctctgcttcagcttg

SEQ ID NO: 5404509 - DNA, 16 bp, Homo sapiens
ctctgcttcagtccac

SEQ ID NO: 5404510 - DNA, 10 bp, Homo sapiens
ctctgcttcc

SEQ ID NO: 5404511 - DNA, 13 bp, Homo sapiens
ctctgcttcccag

SEQ ID NO: 5404512 - DNA, 14 bp, Homo sapiens
ctctgcttcccagg

SEQ ID NO: 5404513 - DNA, 12 bp, Homo sapiens
ctctgcttcctc

SEQ ID NO: 5404514 - DNA, 18 bp, Homo sapiens
ctctgcttcctcagggcc

SEQ ID NO: 5404515 - DNA, 14 bp, Homo sapiens
ctctgcttctcacg

SEQ ID NO: 5404516 - DNA, 15 bp, Homo sapiens
ctctgcttctctgac

SEQ ID NO: 5404517 - DNA, 21 bp, Homo sapiens
ctctgcttctctgacttctgc

SEQ ID NO: 5404518 - DNA, 22 bp, Homo sapiens
ctctgcttgcatcacttggggt

SEQ ID NO: 5404519 - DNA, 12 bp, Homo sapiens
ctctgcttgcca

SEQ ID NO: 5404520 - DNA, 13 bp, Homo sapiens
ctctgcttgccga

SEQ ID NO: 5404521 - DNA, 22 bp, Homo sapiens
ctctgcttgccgaaactggaag

SEQ ID NO: 5404522 - DNA, 17 bp, Homo sapiens
ctctgcttgcctagccc

SEQ ID NO: 5404523 - DNA, 13 bp, Homo sapiens
ctctgcttggctg

SEQ ID NO: 5404524 - DNA, 15 bp, Homo sapiens
ctctgcttggctgtc

SEQ ID NO: 5404525 - DNA, 17 bp, Homo sapiens
ctctgcttggctgtccc

SEQ ID NO: 5404526 - DNA, 22 bp, Homo sapiens
ctctgcttggcttcccctccac

SEQ ID NO: 5404527 - DNA, 13 bp, Homo sapiens
ctctgctttctga

SEQ ID NO: 5404528 - DNA, 13 bp, Homo sapiens
ctctgctttgaaa

SEQ ID NO: 5404529 - DNA, 13 bp, Homo sapiens
ctctgctttgcat

SEQ ID NO: 5404530 - DNA, 20 bp, Homo sapiens
ctctgcttttagttcatata

SEQ ID NO: 5404531 - DNA, 18 bp, Homo sapiens
ctctgcttttccattctg

SEQ ID NO: 5404532 - DNA, 12 bp, Homo sapiens
ctctggaaaaat

SEQ ID NO: 5404533 - DNA, 21 bp, Homo sapiens
ctctggaaaatgtgacccaga

SEQ ID NO: 5404534 - DNA, 22 bp, Homo sapiens
ctctggaaagaggctctggaca

SEQ ID NO: 5404535 - DNA, 13 bp, Homo sapiens
ctctggaaagcaa

SEQ ID NO: 5404536 - DNA, 16 bp, Homo sapiens
ctctggaaccccccag

SEQ ID NO: 5404537 - DNA, 12 bp, Homo sapiens
ctctggaacctg

SEQ ID NO: 5404538 - DNA, 13 bp, Homo sapiens
ctctggaagaaga

SEQ ID NO: 5404539 - DNA, 17 bp, Homo sapiens
ctctggaagagggaggg

SEQ ID NO: 5404540 - DNA, 18 bp, Homo sapiens
ctctggaagccctggaga

SEQ ID NO: 5404541 - DNA, 17 bp, Homo sapiens
ctctggaagcctgctga

SEQ ID NO: 5404542 - DNA, 16 bp, Homo sapiens
ctctggaagcctggac

SEQ ID NO: 5404543 - DNA, 18 bp, Homo sapiens
ctctggaagggagggctt

SEQ ID NO: 5404544 - DNA, 10 bp, Homo sapiens
ctctggaagt

SEQ ID NO: 5404545 - DNA, 13 bp, Homo sapiens
ctctggaatgcac

SEQ ID NO: 5404546 - DNA, 19 bp, Homo sapiens
ctctggaattgttgaatgt

SEQ ID NO: 5404547 - DNA, 20 bp, Homo sapiens
ctctggaatttgcaagtcat

SEQ ID NO: 5404548 - DNA, 21 bp, Homo sapiens
ctctggacaatctcacacctt

SEQ ID NO: 5404549 - DNA, 19 bp, Homo sapiens
ctctggacactctatatgt

SEQ ID NO: 5404550 - DNA, 15 bp, Homo sapiens
ctctggacagatgga

SEQ ID NO: 5404551 - DNA, 20 bp, Homo sapiens
ctctggacagatggacgcag

SEQ ID NO: 5404552 - DNA, 14 bp, Homo sapiens
ctctggacagcaga

SEQ ID NO: 5404553 - DNA, 18 bp, Homo sapiens
ctctggacagcagaagcc

SEQ ID NO: 5404554 - DNA, 22 bp, Homo sapiens
ctctggacagcagaagcctcca

SEQ ID NO: 5404555 - DNA, 16 bp, Homo sapiens
ctctggacaggcatgt

SEQ ID NO: 5404556 - DNA, 22 bp, Homo sapiens
ctctggaccaaccctgtttcct

SEQ ID NO: 5404557 - DNA, 14 bp, Homo sapiens
ctctggaccagcct

SEQ ID NO: 5404558 - DNA, 20 bp, Homo sapiens
ctctggaccagcctgttgga

SEQ ID NO: 5404559 - DNA, 19 bp, Homo sapiens
ctctggaccatgctgagac

SEQ ID NO: 5404560 - DNA, 13 bp, Homo sapiens
ctctggacctcag

SEQ ID NO: 5404561 - DNA, 14 bp, Homo sapiens
ctctggacctcagt

SEQ ID NO: 5404562 - DNA, 16 bp, Homo sapiens
ctctggacctcagttt

SEQ ID NO: 5404563 - DNA, 19 bp, Homo sapiens
ctctggacctcggtgatgc

SEQ ID NO: 5404564 - DNA, 17 bp, Homo sapiens
ctctggacggcaggctc

SEQ ID NO: 5404565 - DNA, 18 bp, Homo sapiens
ctctggacggcaggctca

SEQ ID NO: 5404566 - DNA, 15 bp, Homo sapiens
ctctggactccacga

SEQ ID NO: 5404567 - DNA, 14 bp, Homo sapiens
ctctggactggcct

SEQ ID NO: 5404568 - DNA, 16 bp, Homo sapiens
ctctggactggctaga

SEQ ID NO: 5404569 - DNA, 16 bp, Homo sapiens
ctctggactgggaagg

SEQ ID NO: 5404570 - DNA, 21 bp, Homo sapiens
ctctggactgggaagggggca

SEQ ID NO: 5404571 - DNA, 21 bp, Homo sapiens
ctctggacttgccctctccct

SEQ ID NO: 5404572 - DNA, 21 bp, Homo sapiens
ctctggactttctctaataat

SEQ ID NO: 5404573 - DNA, 17 bp, Homo sapiens
ctctggagaaggcctgg

SEQ ID NO: 5404574 - DNA, 18 bp, Homo sapiens
ctctggagacagccccag

SEQ ID NO: 5404575 - DNA, 19 bp, Homo sapiens
ctctggagacagccccaga

SEQ ID NO: 5404576 - DNA, 20 bp, Homo sapiens
ctctggagacagccccagag

SEQ ID NO: 5404577 - DNA, 24 bp, Homo sapiens
ctctggagacagccccagagcagg

SEQ ID NO: 5404578 - DNA, 13 bp, Homo sapiens
ctctggagagaaa

SEQ ID NO: 5404579 - DNA, 17 bp, Homo sapiens
ctctggagcaagccctg

SEQ ID NO: 5404580 - DNA, 12 bp, Homo sapiens
ctctggagcagc

SEQ ID NO: 5404581 - DNA, 13 bp, Homo sapiens
ctctggagccaag

SEQ ID NO: 5404582 - DNA, 19 bp, Homo sapiens
ctctggagccaagtccaga

SEQ ID NO: 5404583 - DNA, 14 bp, Homo sapiens
ctctggagccacct

SEQ ID NO: 5404584 - DNA, 20 bp, Homo sapiens
ctctggagccacctgtccca

SEQ ID NO: 5404585 - DNA, 22 bp, Homo sapiens
ctctggagccacctgtcccacc

SEQ ID NO: 5404586 - DNA, 14 bp, Homo sapiens
ctctggagccagag

SEQ ID NO: 5404587 - DNA, 15 bp, Homo sapiens
ctctggagccagaga

SEQ ID NO: 5404588 - DNA, 16 bp, Homo sapiens
ctctggagccagagag

SEQ ID NO: 5404589 - DNA, 13 bp, Homo sapiens
ctctggagccagc

SEQ ID NO: 5404590 - DNA, 21 bp, Homo sapiens
ctctggagccagccgagcagg

SEQ ID NO: 5404591 - DNA, 19 bp, Homo sapiens
ctctggagcccactgtact

SEQ ID NO: 5404592 - DNA, 17 bp, Homo sapiens
ctctggaggaagttctc

SEQ ID NO: 5404593 - DNA, 23 bp, Homo sapiens
ctctggaggaagttctccagctt

SEQ ID NO: 5404594 - DNA, 20 bp, Homo sapiens
ctctggaggcctctggccct

SEQ ID NO: 5404595 - DNA, 16 bp, Homo sapiens
ctctggaggggagggg

SEQ ID NO: 5404596 - DNA, 21 bp, Homo sapiens
ctctggaggtcatctggcgga

SEQ ID NO: 5404597 - DNA, 20 bp, Homo sapiens
ctctggagtgatggtgtcct

SEQ ID NO: 5404598 - DNA, 21 bp, Homo sapiens
ctctggagtgatggtgtcctt

SEQ ID NO: 5404599 - DNA, 21 bp, Homo sapiens
ctctggagtgcccccagccca

SEQ ID NO: 5404600 - DNA, 12 bp, Homo sapiens
ctctggagtggc

SEQ ID NO: 5404601 - DNA, 14 bp, Homo sapiens
ctctggagtggcca

SEQ ID NO: 5404602 - DNA, 15 bp, Homo sapiens
ctctggagtggccac

SEQ ID NO: 5404603 - DNA, 20 bp, Homo sapiens
ctctggagtggccactaagc

SEQ ID NO: 5404604 - DNA, 12 bp, Homo sapiens
ctctggatattt

SEQ ID NO: 5404605 - DNA, 22 bp, Homo sapiens
ctctggatcaaagtaggcagga

SEQ ID NO: 5404606 - DNA, 15 bp, Homo sapiens
ctctggatcctgcac

SEQ ID NO: 5404607 - DNA, 16 bp, Homo sapiens
ctctggatcctgcact

SEQ ID NO: 5404608 - DNA, 17 bp, Homo sapiens
ctctggatcctgcactc

SEQ ID NO: 5404609 - DNA, 17 bp, Homo sapiens
ctctggatcctgctgtg

SEQ ID NO: 5404610 - DNA, 23 bp, Homo sapiens
ctctggatcctgctgtggcctca

SEQ ID NO: 5404611 - DNA, 21 bp, Homo sapiens
ctctggatgatggattccaca

SEQ ID NO: 5404612 - DNA, 19 bp, Homo sapiens
ctctggattatattatgaa

SEQ ID NO: 5404613 - DNA, 16 bp, Homo sapiens
ctctggattcagcctt

SEQ ID NO: 5404614 - DNA, 16 bp, Homo sapiens
ctctggattcctgtca

SEQ ID NO: 5404615 - DNA, 17 bp, Homo sapiens
ctctggattcctgtcat

SEQ ID NO: 5404616 - DNA, 23 bp, Homo sapiens
ctctggattgggacgcacagtgc

SEQ ID NO: 5404617 - DNA, 18 bp, Homo sapiens
ctctggattgtgggaatt

SEQ ID NO: 5404618 - DNA, 15 bp, Homo sapiens
ctctggcaaactttt

SEQ ID NO: 5404619 - DNA, 12 bp, Homo sapiens
ctctggcacagt

SEQ ID NO: 5404620 - DNA, 14 bp, Homo sapiens
ctctggcacagtga

SEQ ID NO: 5404621 - DNA, 13 bp, Homo sapiens
ctctggcaccaca

SEQ ID NO: 5404622 - DNA, 13 bp, Homo sapiens
ctctggcaccatc

SEQ ID NO: 5404623 - DNA, 16 bp, Homo sapiens
ctctggcaccatcagc

SEQ ID NO: 5404624 - DNA, 19 bp, Homo sapiens
ctctggcaccatcagcctg

SEQ ID NO: 5404625 - DNA, 13 bp, Homo sapiens
ctctggcacctgg

SEQ ID NO: 5404626 - DNA, 14 bp, Homo sapiens
ctctggcacctggg

SEQ ID NO: 5404627 - DNA, 14 bp, Homo sapiens
ctctggcacttcca

SEQ ID NO: 5404628 - DNA, 22 bp, Homo sapiens
ctctggcagcctcagaggcccc

SEQ ID NO: 5404629 - DNA, 23 bp, Homo sapiens
ctctggcagcctcagaggcccct

SEQ ID NO: 5404630 - DNA, 21 bp, Homo sapiens
ctcttaacactggttaaatta

SEQ ID NO: 5404631 - DNA, 20 bp, Homo sapiens
ctcttaacttaaaagaacat

SEQ ID NO: 5404632 - DNA, 19 bp, Homo sapiens
ctcttaacttaccattcct

SEQ ID NO: 5404633 - DNA, 12 bp, Homo sapiens
ctcttaagagaa

SEQ ID NO: 5404634 - DNA, 19 bp, Homo sapiens
ctcttaagatgtccagggc

SEQ ID NO: 5404635 - DNA, 21 bp, Homo sapiens
ctcttaagccatcttggtaaa

SEQ ID NO: 5404636 - DNA, 22 bp, Homo sapiens
ctcttaagccatcttggtaaat

SEQ ID NO: 5404637 - DNA, 22 bp, Homo sapiens
ctcttaagcttccgccgtctca

SEQ ID NO: 5404638 - DNA, 21 bp, Homo sapiens
ctcttaaggcattgagggctc

SEQ ID NO: 5404639 - DNA, 21 bp, Homo sapiens
ctcttaagtggtctagtcaag

SEQ ID NO: 5404640 - DNA, 21 bp, Homo sapiens
ctcttaataatctcatgctgt

SEQ ID NO: 5404641 - DNA, 17 bp, Homo sapiens
ctcttaatcactactgt

SEQ ID NO: 5404642 - DNA, 13 bp, Homo sapiens
ctcttaatctgtg

SEQ ID NO: 5404643 - DNA, 21 bp, Homo sapiens
ctcttaatctgtgtgtatatt

SEQ ID NO: 5404644 - DNA, 19 bp, Homo sapiens
ctcttaatgatgttatctt

SEQ ID NO: 5404645 - DNA, 22 bp, Homo sapiens
ctcttaatgccacggcagccac

SEQ ID NO: 5404646 - DNA, 23 bp, Homo sapiens
ctcttaatgccacggcagccacc

SEQ ID NO: 5404647 - DNA, 14 bp, Homo sapiens
ctcttaattctgat

SEQ ID NO: 5404648 - DNA, 23 bp, Homo sapiens
ctcttaattgccacctctaacag

SEQ ID NO: 5404649 - DNA, 14 bp, Homo sapiens
ctcttacagagcct

SEQ ID NO: 5404650 - DNA, 17 bp, Homo sapiens
ctcttacagctttgcct

SEQ ID NO: 5404651 - DNA, 20 bp, Homo sapiens
ctcttacagctttgccttgt

SEQ ID NO: 5404652 - DNA, 20 bp, Homo sapiens
ctcttacatcagtagcattt

SEQ ID NO: 5404653 - DNA, 13 bp, Homo sapiens
ctcttacattttc

SEQ ID NO: 5404654 - DNA, 19 bp, Homo sapiens
ctcttaccagtatttaact

SEQ ID NO: 5404655 - DNA, 13 bp, Homo sapiens
ctcttacccagaa

SEQ ID NO: 5404656 - DNA, 13 bp, Homo sapiens
ctcttaccccgtc

SEQ ID NO: 5404657 - DNA, 20 bp, Homo sapiens
ctcttaccccgtccctttcc

SEQ ID NO: 5404658 - DNA, 22 bp, Homo sapiens
ctcttaccccgtccctttccct

SEQ ID NO: 5404659 - DNA, 15 bp, Homo sapiens
ctcttacccttctgt

SEQ ID NO: 5404660 - DNA, 16 bp, Homo sapiens
ctcttacccttctgtg

SEQ ID NO: 5404661 - DNA, 20 bp, Homo sapiens
ctcttacccttctgtgccca

SEQ ID NO: 5404662 - DNA, 23 bp, Homo sapiens
ctcttacccttctgtgcccagct

SEQ ID NO: 5404663 - DNA, 20 bp, Homo sapiens
ctcttacctgtaatagcctc

SEQ ID NO: 5404664 - DNA, 17 bp, Homo sapiens
ctcttaccttcccgcct

SEQ ID NO: 5404665 - DNA, 22 bp, Homo sapiens
ctcttacgcccaacccttcccc

SEQ ID NO: 5404666 - DNA, 16 bp, Homo sapiens
ctcttacgctctctgt

SEQ ID NO: 5404667 - DNA, 17 bp, Homo sapiens
ctcttactaatgtaaaa

SEQ ID NO: 5404668 - DNA, 16 bp, Homo sapiens
ctcttactctttccta

SEQ ID NO: 5404669 - DNA, 19 bp, Homo sapiens
ctcttactgcaaatgtcat

SEQ ID NO: 5404670 - DNA, 14 bp, Homo sapiens
ctcttactgttttg

SEQ ID NO: 5404671 - DNA, 19 bp, Homo sapiens
ctcttactgttttgaggaa

SEQ ID NO: 5404672 - DNA, 13 bp, Homo sapiens
ctcttacttcccc

SEQ ID NO: 5404673 - DNA, 16 bp, Homo sapiens
ctcttactttcagttt

SEQ ID NO: 5404674 - DNA, 19 bp, Homo sapiens
ctcttacttttccagtctg

SEQ ID NO: 5404675 - DNA, 23 bp, Homo sapiens
ctcttacttttccagtctgtaca

SEQ ID NO: 5404676 - DNA, 15 bp, Homo sapiens
ctcttagaaaaacca

SEQ ID NO: 5404677 - DNA, 22 bp, Homo sapiens
ctcttagaaaaggtgataaaat

SEQ ID NO: 5404678 - DNA, 16 bp, Homo sapiens
ctcttagaaatgaagg

SEQ ID NO: 5404679 - DNA, 18 bp, Homo sapiens
ctcttagaagaatattgt

SEQ ID NO: 5404680 - DNA, 22 bp, Homo sapiens
ctcttagaagaatattgtattg

SEQ ID NO: 5404681 - DNA, 13 bp, Homo sapiens
ctcttagaagcca

SEQ ID NO: 5404682 - DNA, 20 bp, Homo sapiens
ctcttagaagccatgggacc

SEQ ID NO: 5404683 - DNA, 18 bp, Homo sapiens
ctcttagacacttttata

SEQ ID NO: 5404684 - DNA, 18 bp, Homo sapiens
ctcttagacttctgcttt

SEQ ID NO: 5404685 - DNA, 21 bp, Homo sapiens
ctcttagagattttcatttta

SEQ ID NO: 5404686 - DNA, 22 bp, Homo sapiens
ctcttagatgcagttctgaaga

SEQ ID NO: 5404687 - DNA, 18 bp, Homo sapiens
ctcttagattcttaattc

SEQ ID NO: 5404688 - DNA, 22 bp, Homo sapiens
ctcttagattgggccatggctt

SEQ ID NO: 5404689 - DNA, 19 bp, Homo sapiens
ctcttagcagcttccagat

SEQ ID NO: 5404690 - DNA, 15 bp, Homo sapiens
ctcttagcctctgga

SEQ ID NO: 5404691 - DNA, 19 bp, Homo sapiens
ctcttagctcagctgagca

SEQ ID NO: 5404692 - DNA, 12 bp, Homo sapiens
ctcttagctgag

SEQ ID NO: 5404693 - DNA, 16 bp, Homo sapiens
ctcttagcttacagga

SEQ ID NO: 5404694 - DNA, 19 bp, Homo sapiens
ctcttagcttacaggaagc

SEQ ID NO: 5404695 - DNA, 18 bp, Homo sapiens
ctcttagctttctcaggg

SEQ ID NO: 5404696 - DNA, 12 bp, Homo sapiens
ctcttaggatat

SEQ ID NO: 5404697 - DNA, 15 bp, Homo sapiens
ctcttaggatatttg

SEQ ID NO: 5404698 - DNA, 13 bp, Homo sapiens
ctcttaggcacat

SEQ ID NO: 5404699 - DNA, 22 bp, Homo sapiens
ctcttaggcatgtaggaccctg

SEQ ID NO: 5404700 - DNA, 16 bp, Homo sapiens
ctcttaggtcccggga

SEQ ID NO: 5404701 - DNA, 14 bp, Homo sapiens
ctcttagtcccaag

SEQ ID NO: 5404702 - DNA, 17 bp, Homo sapiens
ctcttagtcctccctgc

SEQ ID NO: 5404703 - DNA, 18 bp, Homo sapiens
ctcttagtctaggtcctt

SEQ ID NO: 5404704 - DNA, 18 bp, Homo sapiens
ctcttagtctctttggta

SEQ ID NO: 5404705 - DNA, 16 bp, Homo sapiens
ctcttagtgcccgcct

SEQ ID NO: 5404706 - DNA, 17 bp, Homo sapiens
ctcttagttatgtgacg

SEQ ID NO: 5404707 - DNA, 17 bp, Homo sapiens
ctcttagtttttaaaaa

SEQ ID NO: 5404708 - DNA, 20 bp, Homo sapiens
ctcttagtttttaaaaaggc

SEQ ID NO: 5404709 - DNA, 15 bp, Homo sapiens
ctcttataacttctg

SEQ ID NO: 5404710 - DNA, 23 bp, Homo sapiens
ctcttataacttctgaagtaatt

SEQ ID NO: 5404711 - DNA, 20 bp, Homo sapiens
ctcttatagaagcttcagca

SEQ ID NO: 5404712 - DNA, 17 bp, Homo sapiens
ctcttatagaatattta

SEQ ID NO: 5404713 - DNA, 22 bp, Homo sapiens
ctcttatatctaaatctgtcca

SEQ ID NO: 5404714 - DNA, 17 bp, Homo sapiens
ctcttatatgtgcccct

SEQ ID NO: 5404715 - DNA, 20 bp, Homo sapiens
ctcttatatttttctgggct

SEQ ID NO: 5404716 - DNA, 19 bp, Homo sapiens
ctcttatcactaagaaaga

SEQ ID NO: 5404717 - DNA, 21 bp, Homo sapiens
ctcttatcactaagaaagaaa

SEQ ID NO: 5404718 - DNA, 15 bp, Homo sapiens
ctcttatctcagtca

SEQ ID NO: 5404719 - DNA, 22 bp, Homo sapiens
ctcttatctcagtcatgcataa

SEQ ID NO: 5404720 - DNA, 22 bp, Homo sapiens
ctcttatcttacaactccccca

SEQ ID NO: 5404721 - DNA, 13 bp, Homo sapiens
ctcttatgagctc

SEQ ID NO: 5404722 - DNA, 18 bp, Homo sapiens
ctcttatgccatttgttt

SEQ ID NO: 5404723 - DNA, 17 bp, Homo sapiens
ctcttatgctgtaccca

SEQ ID NO: 5404724 - DNA, 19 bp, Homo sapiens
ctcttatgctgtacccagt

SEQ ID NO: 5404725 - DNA, 14 bp, Homo sapiens
ctcttatgggggtg

SEQ ID NO: 5404726 - DNA, 20 bp, Homo sapiens
ctcttatgggggtgtttcta

SEQ ID NO: 5404727 - DNA, 16 bp, Homo sapiens
ctcttatgtgtgcctt

SEQ ID NO: 5404728 - DNA, 17 bp, Homo sapiens
ctcttattcctctaggc

SEQ ID NO: 5404729 - DNA, 18 bp, Homo sapiens
ctcttattcctctaggca

SEQ ID NO: 5404730 - DNA, 16 bp, Homo sapiens
ctcttattcctttaaa

SEQ ID NO: 5404731 - DNA, 15 bp, Homo sapiens
ctcttattgcccacg

SEQ ID NO: 5404732 - DNA, 15 bp, Homo sapiens
ctcttattgtccttc

SEQ ID NO: 5404733 - DNA, 21 bp, Homo sapiens
ctcttatttctttcctttaaa

SEQ ID NO: 5404734 - DNA, 15 bp, Homo sapiens
ctcttattttacaat

SEQ ID NO: 5404735 - DNA, 15 bp, Homo sapiens
ctcttatttttgtac

SEQ ID NO: 5404736 - DNA, 18 bp, Homo sapiens
ctcttcaaaaagcagagt

SEQ ID NO: 5404737 - DNA, 20 bp, Homo sapiens
ctcttcaagtttttttcaaa

SEQ ID NO: 5404738 - DNA, 12 bp, Homo sapiens
ctcttcaataaa

SEQ ID NO: 5404739 - DNA, 15 bp, Homo sapiens
ctcttcaataaacca

SEQ ID NO: 5404740 - DNA, 16 bp, Homo sapiens
ctcttcaatctctgga

SEQ ID NO: 5404741 - DNA, 16 bp, Homo sapiens
ctcttcacaccattca

SEQ ID NO: 5404742 - DNA, 15 bp, Homo sapiens
ctcttcaccaggaag

SEQ ID NO: 5404743 - DNA, 17 bp, Homo sapiens
ctcttcaccaggaagaa

SEQ ID NO: 5404744 - DNA, 15 bp, Homo sapiens
ctcttcaccaggtgc

SEQ ID NO: 5404745 - DNA, 20 bp, Homo sapiens
ctcttcacccaccccatgga

SEQ ID NO: 5404746 - DNA, 16 bp, Homo sapiens
ctcttcaccccccact

SEQ ID NO: 5404747 - DNA, 14 bp, Homo sapiens
ctcttcaccttggt

SEQ ID NO: 5404748 - DNA, 17 bp, Homo sapiens
ctcttcaccttggttta

SEQ ID NO: 5404749 - DNA, 18 bp, Homo sapiens
ctcttcactcagccacac

SEQ ID NO: 5404750 - DNA, 20 bp, Homo sapiens
ctcttcactcagccacaccc

SEQ ID NO: 5404751 - DNA, 21 bp, Homo sapiens
ctcttcactgtggccacagcc

SEQ ID NO: 5404752 - DNA, 14 bp, Homo sapiens
ctcttcacttcctc

SEQ ID NO: 5404753 - DNA, 14 bp, Homo sapiens
ctcttcacttgagt

SEQ ID NO: 5404754 - DNA, 13 bp, Homo sapiens
ctcttcagaacac

SEQ ID NO: 5404755 - DNA, 18 bp, Homo sapiens
ctcttcagatctctaact

SEQ ID NO: 5404756 - DNA, 14 bp, Homo sapiens
ctcttcagatgcca

SEQ ID NO: 5404757 - DNA, 20 bp, Homo sapiens
ctcttcagatgccacttcta

SEQ ID NO: 5404758 - DNA, 13 bp, Homo sapiens
ctcttcagcacaa

SEQ ID NO: 5404759 - DNA, 23 bp, Homo sapiens
ctcttcagcccctagtgctattc

SEQ ID NO: 5404760 - DNA, 21 bp, Homo sapiens
ctcttcagcctcattcactgt

SEQ ID NO: 5404761 - DNA, 22 bp, Homo sapiens
ctcttcagcctcattcactgtc

SEQ ID NO: 5404762 - DNA, 14 bp, Homo sapiens
ctcttcaggcctcc

SEQ ID NO: 5404763 - DNA, 16 bp, Homo sapiens
ctcttcaggcctccct

SEQ ID NO: 5404764 - DNA, 19 bp, Homo sapiens
ctcttcaggcctccctctc

SEQ ID NO: 5404765 - DNA, 18 bp, Homo sapiens
ctcttcaggggtcacctc

SEQ ID NO: 5404766 - DNA, 19 bp, Homo sapiens
ctcttcaggggtcacctcc

SEQ ID NO: 5404767 - DNA, 20 bp, Homo sapiens
ctcttcaggggtcacctcct

SEQ ID NO: 5404768 - DNA, 12 bp, Homo sapiens
ctcttcaggttc

SEQ ID NO: 5404769 - DNA, 15 bp, Homo sapiens
ctcttcaggttctca

SEQ ID NO: 5404770 - DNA, 15 bp, Homo sapiens
ctcttcaggttctta

SEQ ID NO: 5404771 - DNA, 18 bp, Homo sapiens
ctcttcagtgactcctgc

SEQ ID NO: 5404772 - DNA, 19 bp, Homo sapiens
ctcttcagttaagcctttg

SEQ ID NO: 5404773 - DNA, 23 bp, Homo sapiens
ctcttcagttaagcctttggaaa

SEQ ID NO: 5404774 - DNA, 19 bp, Homo sapiens
ctcttcatactttttttca

SEQ ID NO: 5404775 - DNA, 17 bp, Homo sapiens
ctcttcatcccattcca

SEQ ID NO: 5404776 - DNA, 19 bp, Homo sapiens
ctcttcatcccattccagg

SEQ ID NO: 5404777 - DNA, 14 bp, Homo sapiens
ctcttcatctgcct

SEQ ID NO: 5404778 - DNA, 22 bp, Homo sapiens
ctcttcatgcgcagtccccagg

SEQ ID NO: 5404779 - DNA, 22 bp, Homo sapiens
ctcttcatgcttgacataccta

SEQ ID NO: 5404780 - DNA, 23 bp, Homo sapiens
ctcttcatgtctattccattccc

SEQ ID NO: 5404781 - DNA, 18 bp, Homo sapiens
ctcttcattcaaactgca

SEQ ID NO: 5404782 - DNA, 19 bp, Homo sapiens
ctcttcattcaaactgcac

SEQ ID NO: 5404783 - DNA, 22 bp, Homo sapiens
ctcttcattccattgacttaga

SEQ ID NO: 5404784 - DNA, 14 bp, Homo sapiens
ctcttcattcccac

SEQ ID NO: 5404785 - DNA, 14 bp, Homo sapiens
ctcttcattttgag

SEQ ID NO: 5404786 - DNA, 20 bp, Homo sapiens
ctcttccaaaggcagcgtgc

SEQ ID NO: 5404787 - DNA, 23 bp, Homo sapiens
ctcttccaagtggacggcagacc

SEQ ID NO: 5404788 - DNA, 11 bp, Homo sapiens
ctcttccacag

SEQ ID NO: 5404789 - DNA, 15 bp, Homo sapiens
ctcttccacagtggc

SEQ ID NO: 5404790 - DNA, 15 bp, Homo sapiens
ctcttccaccagagc

SEQ ID NO: 5404791 - DNA, 16 bp, Homo sapiens
ctcttccaccagagca

SEQ ID NO: 5404792 - DNA, 17 bp, Homo sapiens
ctcttccaccagagcag

SEQ ID NO: 5404793 - DNA, 14 bp, Homo sapiens
ctcttccacctctg

SEQ ID NO: 5404794 - DNA, 15 bp, Homo sapiens
ctcttccacctctgg

SEQ ID NO: 5404795 - DNA, 16 bp, Homo sapiens
ctcttccactccttct

SEQ ID NO: 5404796 - DNA, 17 bp, Homo sapiens
ctcttccactccttctc

SEQ ID NO: 5404797 - DNA, 20 bp, Homo sapiens
ctcttccagaagatgccctc

SEQ ID NO: 5404798 - DNA, 15 bp, Homo sapiens
ctcttccagcccaga

SEQ ID NO: 5404799 - DNA, 16 bp, Homo sapiens
ctcttccagcttcttt

SEQ ID NO: 5404800 - DNA, 19 bp, Homo sapiens
ctcttccaggaagcacagg

SEQ ID NO: 5404801 - DNA, 13 bp, Homo sapiens
ctcttccaggcag

SEQ ID NO: 5404802 - DNA, 14 bp, Homo sapiens
ctcttccaggctgg

SEQ ID NO: 5404803 - DNA, 21 bp, Homo sapiens
ctcttccaggctgggagagcc

SEQ ID NO: 5404804 - DNA, 22 bp, Homo sapiens
ctcttccaggctgggagagcct

SEQ ID NO: 5404805 - DNA, 23 bp, Homo sapiens
ctcttccaggctgggagagcctt

SEQ ID NO: 5404806 - DNA, 15 bp, Homo sapiens
ctctttgagatagaa

SEQ ID NO: 5404807 - DNA, 23 bp, Homo sapiens
ctctttgagatagaagaactgca

SEQ ID NO: 5404808 - DNA, 17 bp, Homo sapiens
ctctttgataacaaaaa

SEQ ID NO: 5404809 - DNA, 18 bp, Homo sapiens
ctctttgataacaaaaaa

SEQ ID NO: 5404810 - DNA, 22 bp, Homo sapiens
ctctttgatcgcttttaataaa

SEQ ID NO: 5404811 - DNA, 18 bp, Homo sapiens
ctctttgattatttgcat

SEQ ID NO: 5404812 - DNA, 19 bp, Homo sapiens
ctctttgattatttgcatg

SEQ ID NO: 5404813 - DNA, 17 bp, Homo sapiens
ctctttgcaactcctgt

SEQ ID NO: 5404814 - DNA, 16 bp, Homo sapiens
ctctttgccatttctt

SEQ ID NO: 5404815 - DNA, 19 bp, Homo sapiens
ctctttgccctgaggctca

SEQ ID NO: 5404816 - DNA, 12 bp, Homo sapiens
ctctttgcctca

SEQ ID NO: 5404817 - DNA, 20 bp, Homo sapiens
ctctttgcctgtgtgagcat

SEQ ID NO: 5404818 - DNA, 20 bp, Homo sapiens
ctctttgccttgatgttgtg

SEQ ID NO: 5404819 - DNA, 15 bp, Homo sapiens
ctctttgctacaata

SEQ ID NO: 5404820 - DNA, 16 bp, Homo sapiens
ctctttgctacaataa

SEQ ID NO: 5404821 - DNA, 18 bp, Homo sapiens
ctctttgctccagacctg

SEQ ID NO: 5404822 - DNA, 13 bp, Homo sapiens
ctctttgctgaag

SEQ ID NO: 5404823 - DNA, 12 bp, Homo sapiens
ctctttgctgca

SEQ ID NO: 5404824 - DNA, 15 bp, Homo sapiens
ctctttgctgctttg

SEQ ID NO: 5404825 - DNA, 13 bp, Homo sapiens
ctctttgctgttg

SEQ ID NO: 5404826 - DNA, 12 bp, Homo sapiens
ctctttgctttg

SEQ ID NO: 5404827 - DNA, 14 bp, Homo sapiens
ctctttgctttgct

SEQ ID NO: 5404828 - DNA, 12 bp, Homo sapiens
ctctttggaaaa

SEQ ID NO: 5404829 - DNA, 13 bp, Homo sapiens
ctctttggaaaag

SEQ ID NO: 5404830 - DNA, 15 bp, Homo sapiens
ctctttggaaactat

SEQ ID NO: 5404831 - DNA, 18 bp, Homo sapiens
ctctttggaaatagcatg

SEQ ID NO: 5404832 - DNA, 17 bp, Homo sapiens
ctctttggaacaacagc

SEQ ID NO: 5404833 - DNA, 15 bp, Homo sapiens
ctctttggacactca

SEQ ID NO: 5404834 - DNA, 18 bp, Homo sapiens
ctctttggacactcacac

SEQ ID NO: 5404835 - DNA, 15 bp, Homo sapiens
ctctttggcagtcta

SEQ ID NO: 5404836 - DNA, 16 bp, Homo sapiens
ctctttggctattgtc

SEQ ID NO: 5404837 - DNA, 21 bp, Homo sapiens
ctctttgggcagtgccatgga

SEQ ID NO: 5404838 - DNA, 17 bp, Homo sapiens
ctctttggggtcagcca

SEQ ID NO: 5404839 - DNA, 21 bp, Homo sapiens
ctctttgggtccattcagatg

SEQ ID NO: 5404840 - DNA, 16 bp, Homo sapiens
ctctttggtaggagtt

SEQ ID NO: 5404841 - DNA, 12 bp, Homo sapiens
ctctttggtgcc

SEQ ID NO: 5404842 - DNA, 12 bp, Homo sapiens
ctctttgtaaga

SEQ ID NO: 5404843 - DNA, 14 bp, Homo sapiens
ctctttgtaataaa

SEQ ID NO: 5404844 - DNA, 15 bp, Homo sapiens
ctctttgtaatttaa

SEQ ID NO: 5404845 - DNA, 22 bp, Homo sapiens
ctctttgtccattattcatttt

SEQ ID NO: 5404846 - DNA, 18 bp, Homo sapiens
ctctttgtctaaaacaat

SEQ ID NO: 5404847 - DNA, 20 bp, Homo sapiens
ctctttgtctcaccagctca

SEQ ID NO: 5404848 - DNA, 20 bp, Homo sapiens
ctctttgtggcagaagtgtt

SEQ ID NO: 5404849 - DNA, 23 bp, Homo sapiens
ctctttgtgggttggccaggagg

SEQ ID NO: 5404850 - DNA, 23 bp, Homo sapiens
ctctttgtgggtttttcatcttt

SEQ ID NO: 5404851 - DNA, 18 bp, Homo sapiens
ctctttgttatttgaaaa

SEQ ID NO: 5404852 - DNA, 17 bp, Homo sapiens
ctctttgttctcagctc

SEQ ID NO: 5404853 - DNA, 18 bp, Homo sapiens
ctctttgttcttcaatgt

SEQ ID NO: 5404854 - DNA, 16 bp, Homo sapiens
ctctttgttggaagaa

SEQ ID NO: 5404855 - DNA, 12 bp, Homo sapiens
ctctttgtttct

SEQ ID NO: 5404856 - DNA, 19 bp, Homo sapiens
ctctttgtttctgtttctt

SEQ ID NO: 5404857 - DNA, 20 bp, Homo sapiens
ctctttgttttgtgtctctt

SEQ ID NO: 5404858 - DNA, 14 bp, Homo sapiens
ctcttttaaaatat

SEQ ID NO: 5404859 - DNA, 15 bp, Homo sapiens
ctcttttaaagtatt

SEQ ID NO: 5404860 - DNA, 21 bp, Homo sapiens
ctcttttaccctggcccctct

SEQ ID NO: 5404861 - DNA, 18 bp, Homo sapiens
ctcttttacctgctgctt

SEQ ID NO: 5404862 - DNA, 11 bp, Homo sapiens
ctcttttacta

SEQ ID NO: 5404863 - DNA, 16 bp, Homo sapiens
ctcttttagatattgt

SEQ ID NO: 5404864 - DNA, 15 bp, Homo sapiens
ctcttttatatttgt

SEQ ID NO: 5404865 - DNA, 16 bp, Homo sapiens
ctcttttatatttgta

SEQ ID NO: 5404866 - DNA, 22 bp, Homo sapiens
ctcttttatctcctgaaaaaag

SEQ ID NO: 5404867 - DNA, 18 bp, Homo sapiens
ctcttttcaaacacacac

SEQ ID NO: 5404868 - DNA, 18 bp, Homo sapiens
ctcttttcccctttcctg

SEQ ID NO: 5404869 - DNA, 17 bp, Homo sapiens
ctcttttccctctctag

SEQ ID NO: 5404870 - DNA, 12 bp, Homo sapiens
ctcttttccctt

SEQ ID NO: 5404871 - DNA, 16 bp, Homo sapiens
ctcttttcctagtttt

SEQ ID NO: 5404872 - DNA, 13 bp, Homo sapiens
ctcttttcctcct

SEQ ID NO: 5404873 - DNA, 15 bp, Homo sapiens
ctcttttcctcctcc

SEQ ID NO: 5404874 - DNA, 16 bp, Homo sapiens
ctcttttcctctctct

SEQ ID NO: 5404875 - DNA, 20 bp, Homo sapiens
ctcttttcctggcagctgct

SEQ ID NO: 5404876 - DNA, 20 bp, Homo sapiens
ctcttttcctggtgctcttt

SEQ ID NO: 5404877 - DNA, 22 bp, Homo sapiens
ctcttttcctggtgctcttttt

SEQ ID NO: 5404878 - DNA, 22 bp, Homo sapiens
ctcttttcctttggtccttcaa

SEQ ID NO: 5404879 - DNA, 11 bp, Homo sapiens
ctcttttctct

SEQ ID NO: 5404880 - DNA, 10 bp, Homo sapiens
ctcttttctt

SEQ ID NO: 5404881 - DNA, 18 bp, Homo sapiens
ctcttttcttactcctcc

SEQ ID NO: 5404882 - DNA, 22 bp, Homo sapiens
ctcttttcttactcctcctctt

SEQ ID NO: 5404883 - DNA, 16 bp, Homo sapiens
ctcttttcttctcagg

SEQ ID NO: 5404884 - DNA, 20 bp, Homo sapiens
ctcttttgaatccatgcttg

SEQ ID NO: 5404885 - DNA, 18 bp, Homo sapiens
ctcttttgaggtccctgt

SEQ ID NO: 5404886 - DNA, 20 bp, Homo sapiens
ctcttttgaggtccctgtat

SEQ ID NO: 5404887 - DNA, 23 bp, Homo sapiens
ctcttttgcacaaggaaataaag

SEQ ID NO: 5404888 - DNA, 17 bp, Homo sapiens
ctcttttgctctctcat

SEQ ID NO: 5404889 - DNA, 22 bp, Homo sapiens
ctcttttgctctctcattccca

SEQ ID NO: 5404890 - DNA, 14 bp, Homo sapiens
ctcttttgtaaatt

SEQ ID NO: 5404891 - DNA, 15 bp, Homo sapiens
ctcttttgtaaatta

SEQ ID NO: 5404892 - DNA, 14 bp, Homo sapiens
ctcttttgtaagta

SEQ ID NO: 5404893 - DNA, 12 bp, Homo sapiens
ctcttttgtatt

SEQ ID NO: 5404894 - DNA, 21 bp, Homo sapiens
ctcttttgtattgtttctaca

SEQ ID NO: 5404895 - DNA, 18 bp, Homo sapiens
ctcttttgtgatgaacat

SEQ ID NO: 5404896 - DNA, 18 bp, Homo sapiens
ctcttttgttaaataata

SEQ ID NO: 5404897 - DNA, 17 bp, Homo sapiens
ctcttttgttgtccttg

SEQ ID NO: 5404898 - DNA, 17 bp, Homo sapiens
ctcttttgttgtttctt

SEQ ID NO: 5404899 - DNA, 21 bp, Homo sapiens
ctctttttacttggaaataat

SEQ ID NO: 5404900 - DNA, 22 bp, Homo sapiens
ctctttttagggccaggcaggt

SEQ ID NO: 5404901 - DNA, 12 bp, Homo sapiens
ctctttttccaa

SEQ ID NO: 5404902 - DNA, 21 bp, Homo sapiens
ctctttttccaacttggctgc

SEQ ID NO: 5404903 - DNA, 14 bp, Homo sapiens
ctctttttcctcct

SEQ ID NO: 5404904 - DNA, 15 bp, Homo sapiens
ctctttttcctcctg

SEQ ID NO: 5404905 - DNA, 15 bp, Homo sapiens
ctctttttccttctt

SEQ ID NO: 5404906 - DNA, 18 bp, Homo sapiens
ctctttttctaaagtgtt

SEQ ID NO: 5404907 - DNA, 16 bp, Homo sapiens
ctctttttctctgtat

SEQ ID NO: 5404908 - DNA, 13 bp, Homo sapiens
ctctttttctgtg

SEQ ID NO: 5404909 - DNA, 14 bp, Homo sapiens
ctctttttgaaaaa

SEQ ID NO: 5404910 - DNA, 18 bp, Homo sapiens
ctctttttgatcttgtgc

SEQ ID NO: 5404911 - DNA, 16 bp, Homo sapiens
ctctttttggaggtgc

SEQ ID NO: 5404912 - DNA, 15 bp, Homo sapiens
ctctttttgggtcca

SEQ ID NO: 5404913 - DNA, 19 bp, Homo sapiens
ctctttttggttgtcctca

SEQ ID NO: 5404914 - DNA, 15 bp, Homo sapiens
ctctttttgtgaagt

SEQ ID NO: 5404915 - DNA, 13 bp, Homo sapiens
ctctttttgtttg

SEQ ID NO: 5404916 - DNA, 15 bp, Homo sapiens
ctcttttttacaaag

SEQ ID NO: 5404917 - DNA, 16 bp, Homo sapiens
ctcttttttactcatt

SEQ ID NO: 5404918 - DNA, 21 bp, Homo sapiens
ctcttttttactcattgaaat

SEQ ID NO: 5404919 - DNA, 19 bp, Homo sapiens
ctcttttttcaactggctg

SEQ ID NO: 5404920 - DNA, 16 bp, Homo sapiens
ctcttttttcagagaa

SEQ ID NO: 5404921 - DNA, 21 bp, Homo sapiens
ctctttttttaaaaagttgat

SEQ ID NO: 5404922 - DNA, 13 bp, Homo sapiens
ctctttttttgag

SEQ ID NO: 5404923 - DNA, 16 bp, Homo sapiens
ctctttttttggccca

SEQ ID NO: 5404924 - DNA, 18 bp, Homo sapiens
ctgaaaaaaaaaaaagaa

SEQ ID NO: 5404925 - DNA, 15 bp, Homo sapiens
ctgaaaaaaagttta

SEQ ID NO: 5404926 - DNA, 18 bp, Homo sapiens
ctgaaaaaaagtttacaa

SEQ ID NO: 5404927 - DNA, 13 bp, Homo sapiens
ctgaaaaaatata

SEQ ID NO: 5404928 - DNA, 18 bp, Homo sapiens
ctgaaaaaatgctgagcc

SEQ ID NO: 5404929 - DNA, 21 bp, Homo sapiens
ctgaaaaaatgctgagccagc

SEQ ID NO: 5404930 - DNA, 14 bp, Homo sapiens
ctgaaaaagaaaaa

SEQ ID NO: 5404931 - DNA, 17 bp, Homo sapiens
ctgaaaaagaatgaaaa

SEQ ID NO: 5404932 - DNA, 20 bp, Homo sapiens
ctgaaaaagacataaaacag

SEQ ID NO: 5404933 - DNA, 11 bp, Homo sapiens
ctgaaaaagag

SEQ ID NO: 5404934 - DNA, 12 bp, Homo sapiens
ctgaaaaagaga

SEQ ID NO: 5404935 - DNA, 12 bp, Homo sapiens
ctgaaaaaggaa

SEQ ID NO: 5404936 - DNA, 15 bp, Homo sapiens
ctgaaaaagtagatt

SEQ ID NO: 5404937 - DNA, 16 bp, Homo sapiens
ctgaaaaagtgttttt

SEQ ID NO: 5404938 - DNA, 21 bp, Homo sapiens
ctgaaaaagtgtttttacata

SEQ ID NO: 5404939 - DNA, 23 bp, Homo sapiens
ctgaaaaagtgtttttacatata

SEQ ID NO: 5404940 - DNA, 19 bp, Homo sapiens
ctgaaaaatatctggttat

SEQ ID NO: 5404941 - DNA, 19 bp, Homo sapiens
ctgaaaaatctaagtgata

SEQ ID NO: 5404942 - DNA, 22 bp, Homo sapiens
ctgaaaaatctaagtgatataa

SEQ ID NO: 5404943 - DNA, 14 bp, Homo sapiens
ctgaaaaatgaatg

SEQ ID NO: 5404944 - DNA, 15 bp, Homo sapiens
ctgaaaaatgaatgt

SEQ ID NO: 5404945 - DNA, 19 bp, Homo sapiens
ctgaaaaatgcctgctgct

SEQ ID NO: 5404946 - DNA, 15 bp, Homo sapiens
ctgaaaaatggccat

SEQ ID NO: 5404947 - DNA, 21 bp, Homo sapiens
ctgaaaacacttgatgatgtg

SEQ ID NO: 5404948 - DNA, 23 bp, Homo sapiens
ctgaaaacagtaaaacaggctgc

SEQ ID NO: 5404949 - DNA, 14 bp, Homo sapiens
ctgaaaacatctgg

SEQ ID NO: 5404950 - DNA, 20 bp, Homo sapiens
ctgaaaacatttcaaagctg

SEQ ID NO: 5404951 - DNA, 18 bp, Homo sapiens
ctgaaaaccatctggcct

SEQ ID NO: 5404952 - DNA, 19 bp, Homo sapiens
ctgaaaacctaagtccttt

SEQ ID NO: 5404953 - DNA, 14 bp, Homo sapiens
ctgaaaacctacca

SEQ ID NO: 5404954 - DNA, 20 bp, Homo sapiens
ctgaaaacctctcctcatgt

SEQ ID NO: 5404955 - DNA, 15 bp, Homo sapiens
ctgaaaacgaagggg

SEQ ID NO: 5404956 - DNA, 23 bp, Homo sapiens
ctgaaaactaatgtactgtacat

SEQ ID NO: 5404957 - DNA, 15 bp, Homo sapiens
ctgaaaactggaata

SEQ ID NO: 5404958 - DNA, 19 bp, Homo sapiens
ctgaaaactggaataagaa

SEQ ID NO: 5404959 - DNA, 20 bp, Homo sapiens
ctgaaaactgtaaatacaaa

SEQ ID NO: 5404960 - DNA, 14 bp, Homo sapiens
ctgaaaactgttta

SEQ ID NO: 5404961 - DNA, 16 bp, Homo sapiens
ctgaaaacttgcctta

SEQ ID NO: 5404962 - DNA, 10 bp, Homo sapiens
ctgaaaagaa

SEQ ID NO: 5404963 - DNA, 16 bp, Homo sapiens
ctgaaaagaaggaaag

SEQ ID NO: 5404964 - DNA, 19 bp, Homo sapiens
ctgaaaagagagcagagaa

SEQ ID NO: 5404965 - DNA, 13 bp, Homo sapiens
ctgaaaagcaaag

SEQ ID NO: 5404966 - DNA, 20 bp, Homo sapiens
ctgaaaagcaattgccctgt

SEQ ID NO: 5404967 - DNA, 22 bp, Homo sapiens
ctgaaaagcagttcatgtctga

SEQ ID NO: 5404968 - DNA, 22 bp, Homo sapiens
ctgaaaaggaacggcttcctca

SEQ ID NO: 5404969 - DNA, 13 bp, Homo sapiens
ctgaaaagggcat

SEQ ID NO: 5404970 - DNA, 17 bp, Homo sapiens
ctgaaaagggcggaaga

SEQ ID NO: 5404971 - DNA, 20 bp, Homo sapiens
ctgaaaagggcggaagagtt

SEQ ID NO: 5404972 - DNA, 17 bp, Homo sapiens
ctgaaaaggtttatgaa

SEQ ID NO: 5404973 - DNA, 15 bp, Homo sapiens
ctgaaaagtaaattg

SEQ ID NO: 5404974 - DNA, 17 bp, Homo sapiens
ctgaaaatagcaggaca

SEQ ID NO: 5404975 - DNA, 22 bp, Homo sapiens
ctgaaaatatgtctgcaggttt

SEQ ID NO: 5404976 - DNA, 11 bp, Homo sapiens
ctgaaaatatt

SEQ ID NO: 5404977 - DNA, 22 bp, Homo sapiens
ctgaaaatattgttttacaata

SEQ ID NO: 5404978 - DNA, 23 bp, Homo sapiens
ctgaaaatatttttttctagcta

SEQ ID NO: 5404979 - DNA, 20 bp, Homo sapiens
ctgaaaatctaatattaaaa

SEQ ID NO: 5404980 - DNA, 13 bp, Homo sapiens
ctgaaaatgaact

SEQ ID NO: 5404981 - DNA, 20 bp, Homo sapiens
ctgaaaatgaactgtaaatg

SEQ ID NO: 5404982 - DNA, 19 bp, Homo sapiens
ctgaaaatgcaaagctgaa

SEQ ID NO: 5404983 - DNA, 16 bp, Homo sapiens
ctgaaaatgtatgtgt

SEQ ID NO: 5404984 - DNA, 17 bp, Homo sapiens
ctgaaaatgtcacattc

SEQ ID NO: 5404985 - DNA, 19 bp, Homo sapiens
ctgaagtgcatccaaaggt

SEQ ID NO: 5404986 - DNA, 21 bp, Homo sapiens
ctgaagtgcctactggggggc

SEQ ID NO: 5404987 - DNA, 15 bp, Homo sapiens
ctgaagtggactctt

SEQ ID NO: 5404988 - DNA, 20 bp, Homo sapiens
ctgaagtggctggtagaaaa

SEQ ID NO: 5404989 - DNA, 22 bp, Homo sapiens
ctgaagtgggaaaaaatagact

SEQ ID NO: 5404990 - DNA, 22 bp, Homo sapiens
ctgaagtggtttgcaggtcagc

SEQ ID NO: 5404991 - DNA, 19 bp, Homo sapiens
ctgaagtgtcgagtccagt

SEQ ID NO: 5404992 - DNA, 18 bp, Homo sapiens
ctgaagtgtgtccatcct

SEQ ID NO: 5404993 - DNA, 21 bp, Homo sapiens
ctgaagtgtttcacgagagcc

SEQ ID NO: 5404994 - DNA, 11 bp, Homo sapiens
ctgaagttcag

SEQ ID NO: 5404995 - DNA, 19 bp, Homo sapiens
ctgaagttctgcctctgat

SEQ ID NO: 5404996 - DNA, 14 bp, Homo sapiens
ctgaagttgctgct

SEQ ID NO: 5404997 - DNA, 14 bp, Homo sapiens
ctgaagttggacag

SEQ ID NO: 5404998 - DNA, 13 bp, Homo sapiens
ctgaagttggcca

SEQ ID NO: 5404999 - DNA, 15 bp, Homo sapiens
ctgaagttggccacc

SEQ ID NO: 5405000 - DNA, 15 bp, Homo sapiens
ctgaagtttcattta

SEQ ID NO: 5405001 - DNA, 22 bp, Homo sapiens
ctgaagtttgataaatagtgtt

SEQ ID NO: 5405002 - DNA, 15 bp, Homo sapiens
ctgaagtttttgaaa

SEQ ID NO: 5405003 - DNA, 18 bp, Homo sapiens
ctgaagtttttgaaatac

SEQ ID NO: 5405004 - DNA, 19 bp, Homo sapiens
ctgaataaaaaagattcta

SEQ ID NO: 5405005 - DNA, 20 bp, Homo sapiens
ctgaataaaaaagattctac

SEQ ID NO: 5405006 - DNA, 15 bp, Homo sapiens
ctgaataaaaaataa

SEQ ID NO: 5405007 - DNA, 15 bp, Homo sapiens
ctgaataaaccaaga

SEQ ID NO: 5405008 - DNA, 21 bp, Homo sapiens
ctgaataaactcaaaactctt

SEQ ID NO: 5405009 - DNA, 18 bp, Homo sapiens
ctgaataaagcctttgat

SEQ ID NO: 5405010 - DNA, 18 bp, Homo sapiens
ctgaataaagtgtaacaa

SEQ ID NO: 5405011 - DNA, 23 bp, Homo sapiens
ctgaataaataagtaaatacatt

SEQ ID NO: 5405012 - DNA, 15 bp, Homo sapiens
ctgaataaatacctc

SEQ ID NO: 5405013 - DNA, 12 bp, Homo sapiens
ctgaataaatgt

SEQ ID NO: 5405014 - DNA, 22 bp, Homo sapiens
ctgaataacaacaatttaggaa

SEQ ID NO: 5405015 - DNA, 15 bp, Homo sapiens
ctgaataacatttgt

SEQ ID NO: 5405016 - DNA, 16 bp, Homo sapiens
ctgaataacctgcaca

SEQ ID NO: 5405017 - DNA, 19 bp, Homo sapiens
ctgaataacctgcacaggc

SEQ ID NO: 5405018 - DNA, 16 bp, Homo sapiens
ctgaataagcactttt

SEQ ID NO: 5405019 - DNA, 16 bp, Homo sapiens
ctgaataatgaagatt

SEQ ID NO: 5405020 - DNA, 23 bp, Homo sapiens
ctgaataatgctaccaggatgct

SEQ ID NO: 5405021 - DNA, 22 bp, Homo sapiens
ctgaataatggaattatgtata

SEQ ID NO: 5405022 - DNA, 15 bp, Homo sapiens
ctgaatacaaataga

SEQ ID NO: 5405023 - DNA, 17 bp, Homo sapiens
ctgaataccaagtgtgt

SEQ ID NO: 5405024 - DNA, 14 bp, Homo sapiens
ctgaataccactta

SEQ ID NO: 5405025 - DNA, 18 bp, Homo sapiens
ctgaatacctctttgaaa

SEQ ID NO: 5405026 - DNA, 22 bp, Homo sapiens
ctgaatacgctaagcctggaag

SEQ ID NO: 5405027 - DNA, 15 bp, Homo sapiens
ctgaatagatatgaa

SEQ ID NO: 5405028 - DNA, 23 bp, Homo sapiens
ctgaatagctcccagatttcagt

SEQ ID NO: 5405029 - DNA, 20 bp, Homo sapiens
ctgaataggaaaatgtacat

SEQ ID NO: 5405030 - DNA, 19 bp, Homo sapiens
ctgaatagtcttcagagat

SEQ ID NO: 5405031 - DNA, 13 bp, Homo sapiens
ctgaatagttaaa

SEQ ID NO: 5405032 - DNA, 21 bp, Homo sapiens
ctgaatagttaaaaattaaat

SEQ ID NO: 5405033 - DNA, 16 bp, Homo sapiens
ctgaatataaagctta

SEQ ID NO: 5405034 - DNA, 22 bp, Homo sapiens
ctgaatataaagcttaataaaa

SEQ ID NO: 5405035 - DNA, 21 bp, Homo sapiens
ctgaatataacaacctttaaa

SEQ ID NO: 5405036 - DNA, 17 bp, Homo sapiens
ctgaatatacagcaggt

SEQ ID NO: 5405037 - DNA, 15 bp, Homo sapiens
ctgaatatataaaca

SEQ ID NO: 5405038 - DNA, 18 bp, Homo sapiens
ctgaatatataaacactc

SEQ ID NO: 5405039 - DNA, 14 bp, Homo sapiens
ctgaatatatgatt

SEQ ID NO: 5405040 - DNA, 21 bp, Homo sapiens
ctgaatatatgatttgcatgt

SEQ ID NO: 5405041 - DNA, 21 bp, Homo sapiens
ctgaatatgaacggtgagcat

SEQ ID NO: 5405042 - DNA, 14 bp, Homo sapiens
ctgaatattaagaa

SEQ ID NO: 5405043 - DNA, 12 bp, Homo sapiens
ctgaatattaga

SEQ ID NO: 5405044 - DNA, 23 bp, Homo sapiens
ctgaatattagatgctctgagaa

SEQ ID NO: 5405045 - DNA, 16 bp, Homo sapiens
ctgaatattatcattt

SEQ ID NO: 5405046 - DNA, 16 bp, Homo sapiens
ctgaatattctagaac

SEQ ID NO: 5405047 - DNA, 16 bp, Homo sapiens
ctgaatatttatattt

SEQ ID NO: 5405048 - DNA, 21 bp, Homo sapiens
ctgaatatttatatttcacta

SEQ ID NO: 5405049 - DNA, 12 bp, Homo sapiens
ctgaatatttta

SEQ ID NO: 5405050 - DNA, 14 bp, Homo sapiens
ctgaatattttgga

SEQ ID NO: 5405051 - DNA, 17 bp, Homo sapiens
ctgaatattttggaaac

SEQ ID NO: 5405052 - DNA, 19 bp, Homo sapiens
ctgaatattttggaaactg

SEQ ID NO: 5405053 - DNA, 20 bp, Homo sapiens
ctgaatattttttatttcta

SEQ ID NO: 5405054 - DNA, 22 bp, Homo sapiens
ctgaatattttttatttctaag

SEQ ID NO: 5405055 - DNA, 14 bp, Homo sapiens
ctgaatattttttg

SEQ ID NO: 5405056 - DNA, 20 bp, Homo sapiens
ctgaatcaaagacatttcat

SEQ ID NO: 5405057 - DNA, 22 bp, Homo sapiens
ctgaatcaaagacatttcatcc

SEQ ID NO: 5405058 - DNA, 17 bp, Homo sapiens
ctgaatcaccaattaaa

SEQ ID NO: 5405059 - DNA, 16 bp, Homo sapiens
ctgaatcagaaaagct

SEQ ID NO: 5405060 - DNA, 17 bp, Homo sapiens
ctgaatcagaaaagcta

SEQ ID NO: 5405061 - DNA, 17 bp, Homo sapiens
ctgaatcagaggcagag

SEQ ID NO: 5405062 - DNA, 14 bp, Homo sapiens
ctgaatcagctgct

SEQ ID NO: 5405063 - DNA, 17 bp, Homo sapiens
ctgaatcagctggacat

SEQ ID NO: 5405064 - DNA, 13 bp, Homo sapiens
ctgaatcaggaaa

SEQ ID NO: 5405065 - DNA, 18 bp, Homo sapiens
ctgaatcaggaaactcaa

SEQ ID NO: 5405066 - DNA, 20 bp, Homo sapiens
ctgaatcatgagcctgctgg

SEQ ID NO: 5405067 - DNA, 22 bp, Homo sapiens
ctgaatcattctcgatttaact

SEQ ID NO: 5405068 - DNA, 15 bp, Homo sapiens
ctgaatcatttctta

SEQ ID NO: 5405069 - DNA, 18 bp, Homo sapiens
ctgaatccacctcggagc

SEQ ID NO: 5405070 - DNA, 19 bp, Homo sapiens
ctgaatccacctgcagtta

SEQ ID NO: 5405071 - DNA, 17 bp, Homo sapiens
ctgaatccagcattgtt

SEQ ID NO: 5405072 - DNA, 19 bp, Homo sapiens
ctgaatccatcaggacttg

SEQ ID NO: 5405073 - DNA, 20 bp, Homo sapiens
ctgaatccattaaaaatggg

SEQ ID NO: 5405074 - DNA, 19 bp, Homo sapiens
ctgaatcccccttgccacc

SEQ ID NO: 5405075 - DNA, 20 bp, Homo sapiens
ctgaatcccccttgccaccc

SEQ ID NO: 5405076 - DNA, 21 bp, Homo sapiens
ctgaatcccccttgccacccc

SEQ ID NO: 5405077 - DNA, 22 bp, Homo sapiens
ctgaatcccccttgccacccca

SEQ ID NO: 5405078 - DNA, 17 bp, Homo sapiens
ctgaatcccgggctaag

SEQ ID NO: 5405079 - DNA, 13 bp, Homo sapiens
ctgaatccctgta

SEQ ID NO: 5405080 - DNA, 21 bp, Homo sapiens
ctgaatcctggtaattaaaag

SEQ ID NO: 5405081 - DNA, 19 bp, Homo sapiens
ctgaatccttccatttctt

SEQ ID NO: 5405082 - DNA, 16 bp, Homo sapiens
ctgaatcgtttcatgt

SEQ ID NO: 5405083 - DNA, 12 bp, Homo sapiens
ctgaatctcata

SEQ ID NO: 5405084 - DNA, 13 bp, Homo sapiens
ctgaatctcccaa

SEQ ID NO: 5405085 - DNA, 20 bp, Homo sapiens
ctgaatctctcaaaatgtgc

SEQ ID NO: 5405086 - DNA, 17 bp, Homo sapiens
ctgaatctgaccacaga

SEQ ID NO: 5405087 - DNA, 15 bp, Homo sapiens
ctgaatctgagaaag

SEQ ID NO: 5405088 - DNA, 15 bp, Homo sapiens
ctgaatctgctacca

SEQ ID NO: 5405089 - DNA, 13 bp, Homo sapiens
ctgaatctgtaca

SEQ ID NO: 5405090 - DNA, 15 bp, Homo sapiens
ctgaatctgtacaga

SEQ ID NO: 5405091 - DNA, 14 bp, Homo sapiens
ctgaatctgtacat

SEQ ID NO: 5405092 - DNA, 17 bp, Homo sapiens
ctgaatctgtgcaaaca

SEQ ID NO: 5405093 - DNA, 16 bp, Homo sapiens
ctgaatctgtgcctgc

SEQ ID NO: 5405094 - DNA, 23 bp, Homo sapiens
ctgaatctgtgcctgcactgaga

SEQ ID NO: 5405095 - DNA, 12 bp, Homo sapiens
ctgaatcttctg

SEQ ID NO: 5405096 - DNA, 22 bp, Homo sapiens
ctgaatcttttttttatataaa

SEQ ID NO: 5405097 - DNA, 15 bp, Homo sapiens
ctgaatgaaaataac

SEQ ID NO: 5405098 - DNA, 18 bp, Homo sapiens
ctgaatgaaaataactga

SEQ ID NO: 5405099 - DNA, 19 bp, Homo sapiens
ctgaatgaaaataactgaa

SEQ ID NO: 5405100 - DNA, 22 bp, Homo sapiens
ctgaatgaagccttctgacctg

SEQ ID NO: 5405101 - DNA, 16 bp, Homo sapiens
ctgaatgactaatcag

SEQ ID NO: 5405102 - DNA, 23 bp, Homo sapiens
ctgaatgactccactgtttttct

SEQ ID NO: 5405103 - DNA, 19 bp, Homo sapiens
ctgaatgagaagtaaatta

SEQ ID NO: 5405104 - DNA, 21 bp, Homo sapiens
ctgaatgagaagtaaattatt

SEQ ID NO: 5405105 - DNA, 19 bp, Homo sapiens
ctgaatgagacttaatttt

SEQ ID NO: 5405106 - DNA, 22 bp, Homo sapiens
ctgaatgaggcggagctccagg

SEQ ID NO: 5405107 - DNA, 13 bp, Homo sapiens
ctgaatgcaattt

SEQ ID NO: 5405108 - DNA, 15 bp, Homo sapiens
ctgaatgcataaata

SEQ ID NO: 5405109 - DNA, 22 bp, Homo sapiens
ctgaatgcattcaggggaagga

SEQ ID NO: 5405110 - DNA, 22 bp, Homo sapiens
ctgaatgccgcgatgggtcagg

SEQ ID NO: 5405111 - DNA, 17 bp, Homo sapiens
ctgaatgcctcctgtgg

SEQ ID NO: 5405112 - DNA, 18 bp, Homo sapiens
ctgaatgcctcgctccct

SEQ ID NO: 5405113 - DNA, 14 bp, Homo sapiens
ctgaatgctgccac

SEQ ID NO: 5405114 - DNA, 20 bp, Homo sapiens
ctgaatgcttctaagtaaat

SEQ ID NO: 5405115 - DNA, 18 bp, Homo sapiens
ctgaatgcttctgagagc

SEQ ID NO: 5405116 - DNA, 22 bp, Homo sapiens
ctgaatggaaggtttgtatatt

SEQ ID NO: 5405117 - DNA, 18 bp, Homo sapiens
ctgaatggactttgcaca

SEQ ID NO: 5405118 - DNA, 18 bp, Homo sapiens
ctgaatggcatggagacc

SEQ ID NO: 5405119 - DNA, 21 bp, Homo sapiens
ctgaatggcggtttttatcca

SEQ ID NO: 5405120 - DNA, 23 bp, Homo sapiens
ctgaatggcttgcagttgttcct

SEQ ID NO: 5405121 - DNA, 16 bp, Homo sapiens
ctgaatggctttgtct

SEQ ID NO: 5405122 - DNA, 15 bp, Homo sapiens
ctgaatggtccaggg

SEQ ID NO: 5405123 - DNA, 20 bp, Homo sapiens
ctgaatggtgcgtgaaggct

SEQ ID NO: 5405124 - DNA, 18 bp, Homo sapiens
ctgaatggttccatgcct

SEQ ID NO: 5405125 - DNA, 13 bp, Homo sapiens
ctgaatgtaaaag

SEQ ID NO: 5405126 - DNA, 13 bp, Homo sapiens
ctgaatgtaattt

SEQ ID NO: 5405127 - DNA, 16 bp, Homo sapiens
ctgaatgtagccagcc

SEQ ID NO: 5405128 - DNA, 12 bp, Homo sapiens
ctgaatgtatgt

SEQ ID NO: 5405129 - DNA, 13 bp, Homo sapiens
ctgaatgtatgta

SEQ ID NO: 5405130 - DNA, 18 bp, Homo sapiens
ctgaatgtatgtcagtgc

SEQ ID NO: 5405131 - DNA, 18 bp, Homo sapiens
ctgaatgtattatcctgt

SEQ ID NO: 5405132 - DNA, 14 bp, Homo sapiens
ctgaatgtatttat

SEQ ID NO: 5405133 - DNA, 21 bp, Homo sapiens
ctgaatgtatttatgtgtata

SEQ ID NO: 5405134 - DNA, 23 bp, Homo sapiens
ctgaatgtcattatttgataaca

SEQ ID NO: 5405135 - DNA, 17 bp, Homo sapiens
ctgaatgtcccagaggc

SEQ ID NO: 5405136 - DNA, 23 bp, Homo sapiens
ctgaatgtggtttcaatctaatt

SEQ ID NO: 5405137 - DNA, 11 bp, Homo sapiens
ctgaatgttct

SEQ ID NO: 5405138 - DNA, 14 bp, Homo sapiens
ctgaatgttctgac

SEQ ID NO: 5405139 - DNA, 18 bp, Homo sapiens
ctgaatgttctgacatta

SEQ ID NO: 5405140 - DNA, 22 bp, Homo sapiens
ctgaatgttctgacattaacag

SEQ ID NO: 5405141 - DNA, 20 bp, Homo sapiens
ctgaatgttcttgaattata

SEQ ID NO: 5405142 - DNA, 18 bp, Homo sapiens
ctgaatgtttgtgtctgt

SEQ ID NO: 5405143 - DNA, 18 bp, Homo sapiens
ctgaatgtttgtttcagt

SEQ ID NO: 5405144 - DNA, 12 bp, Homo sapiens
ctgaatgtttta

SEQ ID NO: 5405145 - DNA, 14 bp, Homo sapiens
ctgaatgtttttct

SEQ ID NO: 5405146 - DNA, 15 bp, Homo sapiens
ctgaatgtttttcta

SEQ ID NO: 5405147 - DNA, 17 bp, Homo sapiens
ctgaatgtttttctaaa

SEQ ID NO: 5405148 - DNA, 20 bp, Homo sapiens
ctgaatgtttttctaaagga

SEQ ID NO: 5405149 - DNA, 23 bp, Homo sapiens
ctgaatgtttttctaaaggagtt

SEQ ID NO: 5405150 - DNA, 12 bp, Homo sapiens
ctgaattaaaat

SEQ ID NO: 5405151 - DNA, 15 bp, Homo sapiens
ctgaattaaacttaa

SEQ ID NO: 5405152 - DNA, 15 bp, Homo sapiens
ctgaattaaataaat

SEQ ID NO: 5405153 - DNA, 18 bp, Homo sapiens
ctgaattaagttattgat

SEQ ID NO: 5405154 - DNA, 16 bp, Homo sapiens
ctgaattaattaattt

SEQ ID NO: 5405155 - DNA, 23 bp, Homo sapiens
ctgaattacagtgaaattttggt

SEQ ID NO: 5405156 - DNA, 22 bp, Homo sapiens
ctgaattagtccttgcttggct

SEQ ID NO: 5405157 - DNA, 23 bp, Homo sapiens
ctgaattatctatacatatcttt

SEQ ID NO: 5405158 - DNA, 17 bp, Homo sapiens
ctgaattattaatgaat

SEQ ID NO: 5405159 - DNA, 19 bp, Homo sapiens
ctgaattattaatgaatgc

SEQ ID NO: 5405160 - DNA, 12 bp, Homo sapiens
ctgaattattct

SEQ ID NO: 5405161 - DNA, 14 bp, Homo sapiens
ctgaattattttgt

SEQ ID NO: 5405162 - DNA, 22 bp, Homo sapiens
ctgacccggattggccctgccc

SEQ ID NO: 5405163 - DNA, 22 bp, Homo sapiens
ctgacccggcctctctgcccca

SEQ ID NO: 5405164 - DNA, 12 bp, Homo sapiens
ctgaccctcact

SEQ ID NO: 5405165 - DNA, 22 bp, Homo sapiens
ctgaccctcaggcacaccttgc

SEQ ID NO: 5405166 - DNA, 18 bp, Homo sapiens
ctgaccctcatctttctt

SEQ ID NO: 5405167 - DNA, 18 bp, Homo sapiens
ctgaccctcccactccca

SEQ ID NO: 5405168 - DNA, 14 bp, Homo sapiens
ctgaccctcccagt

SEQ ID NO: 5405169 - DNA, 22 bp, Homo sapiens
ctgaccctccccaaaggctttg

SEQ ID NO: 5405170 - DNA, 18 bp, Homo sapiens
ctgaccctccctacctga

SEQ ID NO: 5405171 - DNA, 12 bp, Homo sapiens
ctgaccctctgc

SEQ ID NO: 5405172 - DNA, 16 bp, Homo sapiens
ctgaccctctgcggcc

SEQ ID NO: 5405173 - DNA, 13 bp, Homo sapiens
ctgaccctgagga

SEQ ID NO: 5405174 - DNA, 18 bp, Homo sapiens
ctgaccctgcagagatgc

SEQ ID NO: 5405175 - DNA, 16 bp, Homo sapiens
ctgaccctgctcctag

SEQ ID NO: 5405176 - DNA, 20 bp, Homo sapiens
ctgaccctggagcggctctc

SEQ ID NO: 5405177 - DNA, 21 bp, Homo sapiens
ctgaccctggagcggctctcc

SEQ ID NO: 5405178 - DNA, 13 bp, Homo sapiens
ctgaccctgggct

SEQ ID NO: 5405179 - DNA, 20 bp, Homo sapiens
ctgaccctggggctggcttt

SEQ ID NO: 5405180 - DNA, 20 bp, Homo sapiens
ctgaccctgtatatagccca

SEQ ID NO: 5405181 - DNA, 13 bp, Homo sapiens
ctgaccctgtgcc

SEQ ID NO: 5405182 - DNA, 13 bp, Homo sapiens
ctgaccctgtgga

SEQ ID NO: 5405183 - DNA, 20 bp, Homo sapiens
ctgacccttacagcctctga

SEQ ID NO: 5405184 - DNA, 17 bp, Homo sapiens
ctgacccttctctcact

SEQ ID NO: 5405185 - DNA, 23 bp, Homo sapiens
ctgacccttgggcctgggcctct

SEQ ID NO: 5405186 - DNA, 14 bp, Homo sapiens
ctgacccttttctg

SEQ ID NO: 5405187 - DNA, 21 bp, Homo sapiens
ctgaccgatgtgtctcccaga

SEQ ID NO: 5405188 - DNA, 15 bp, Homo sapiens
ctgaccgctgcccag

SEQ ID NO: 5405189 - DNA, 16 bp, Homo sapiens
ctgaccgctgcccagg

SEQ ID NO: 5405190 - DNA, 20 bp, Homo sapiens
ctgaccgctgcccaggtggg

SEQ ID NO: 5405191 - DNA, 16 bp, Homo sapiens
ctgaccgggtctgctt

SEQ ID NO: 5405192 - DNA, 15 bp, Homo sapiens
ctgaccggtgctttt

SEQ ID NO: 5405193 - DNA, 13 bp, Homo sapiens
ctgaccgtgggcg

SEQ ID NO: 5405194 - DNA, 18 bp, Homo sapiens
ctgaccgtgtacatagcc

SEQ ID NO: 5405195 - DNA, 20 bp, Homo sapiens
ctgacctaaaagttgaaaag

SEQ ID NO: 5405196 - DNA, 16 bp, Homo sapiens
ctgacctaacctagga

SEQ ID NO: 5405197 - DNA, 18 bp, Homo sapiens
ctgacctaatatttggag

SEQ ID NO: 5405198 - DNA, 14 bp, Homo sapiens
ctgacctaccccag

SEQ ID NO: 5405199 - DNA, 15 bp, Homo sapiens
ctgacctaccccagc

SEQ ID NO: 5405200 - DNA, 18 bp, Homo sapiens
ctgacctaccccagccag

SEQ ID NO: 5405201 - DNA, 21 bp, Homo sapiens
ctgacctaccccagccaggct

SEQ ID NO: 5405202 - DNA, 20 bp, Homo sapiens
ctgacctacctcaaagggca

SEQ ID NO: 5405203 - DNA, 22 bp, Homo sapiens
ctgacctacctcaaagggcagt

SEQ ID NO: 5405204 - DNA, 17 bp, Homo sapiens
ctgacctatcacttcca

SEQ ID NO: 5405205 - DNA, 16 bp, Homo sapiens
ctgacctcaagtgatc

SEQ ID NO: 5405206 - DNA, 17 bp, Homo sapiens
ctgacctcaagtgatct

SEQ ID NO: 5405207 - DNA, 23 bp, Homo sapiens
ctgacctcacagagtatgatctc

SEQ ID NO: 5405208 - DNA, 20 bp, Homo sapiens
ctgacctcaccggcatgctg

SEQ ID NO: 5405209 - DNA, 22 bp, Homo sapiens
ctgacctcaccggcatgctggc

SEQ ID NO: 5405210 - DNA, 15 bp, Homo sapiens
ctgacctcacctggt

SEQ ID NO: 5405211 - DNA, 17 bp, Homo sapiens
ctgacctcacctggtcc

SEQ ID NO: 5405212 - DNA, 18 bp, Homo sapiens
ctgacctcacctggtcct

SEQ ID NO: 5405213 - DNA, 20 bp, Homo sapiens
ctgacctcacctggtcctcc

SEQ ID NO: 5405214 - DNA, 11 bp, Homo sapiens
ctgacctcagc

SEQ ID NO: 5405215 - DNA, 15 bp, Homo sapiens
ctgacctcaggtgat

SEQ ID NO: 5405216 - DNA, 18 bp, Homo sapiens
ctgacctcatgagtgtca

SEQ ID NO: 5405217 - DNA, 15 bp, Homo sapiens
ctgacctccacagct

SEQ ID NO: 5405218 - DNA, 12 bp, Homo sapiens
ctgacctccagt

SEQ ID NO: 5405219 - DNA, 18 bp, Homo sapiens
ctgacctccagtcctgct

SEQ ID NO: 5405220 - DNA, 19 bp, Homo sapiens
ctgacctccagtcctgctg

SEQ ID NO: 5405221 - DNA, 23 bp, Homo sapiens
ctgacctccagtcctgctggcct

SEQ ID NO: 5405222 - DNA, 13 bp, Homo sapiens
ctgacctcccagc

SEQ ID NO: 5405223 - DNA, 14 bp, Homo sapiens
ctgacctcccagcc

SEQ ID NO: 5405224 - DNA, 17 bp, Homo sapiens
ctgacctcccagcccta

SEQ ID NO: 5405225 - DNA, 22 bp, Homo sapiens
ctgacctcccagccctatggat

SEQ ID NO: 5405226 - DNA, 18 bp, Homo sapiens
ctgacctccctctaattt

SEQ ID NO: 5405227 - DNA, 21 bp, Homo sapiens
ctgacctccctctaatttatc

SEQ ID NO: 5405228 - DNA, 14 bp, Homo sapiens
ctgacctccgccat

SEQ ID NO: 5405229 - DNA, 18 bp, Homo sapiens
ctgacctccgcccctgcc

SEQ ID NO: 5405230 - DNA, 23 bp, Homo sapiens
ctgacctcgtgatttgcctgcct

SEQ ID NO: 5405231 - DNA, 18 bp, Homo sapiens
ctgacctctgaagagctg

SEQ ID NO: 5405232 - DNA, 13 bp, Homo sapiens
ctgacctctgctg

SEQ ID NO: 5405233 - DNA, 19 bp, Homo sapiens
ctgacctctgctgagtgct

SEQ ID NO: 5405234 - DNA, 21 bp, Homo sapiens
ctgacctctgctgagtgctgg

SEQ ID NO: 5405235 - DNA, 12 bp, Homo sapiens
ctgacctctggt

SEQ ID NO: 5405236 - DNA, 17 bp, Homo sapiens
ctgacctcttgctgtct

SEQ ID NO: 5405237 - DNA, 23 bp, Homo sapiens
ctgacctcttgctgtctctgctc

SEQ ID NO: 5405238 - DNA, 21 bp, Homo sapiens
ctgacctgaggctcctgtgct

SEQ ID NO: 5405239 - DNA, 19 bp, Homo sapiens
ctgacctgatcacctctgg

SEQ ID NO: 5405240 - DNA, 21 bp, Homo sapiens
ctgacctgatcacctctggct

SEQ ID NO: 5405241 - DNA, 14 bp, Homo sapiens
ctgacctgcactgg

SEQ ID NO: 5405242 - DNA, 14 bp, Homo sapiens
ctgacctgccagcc

SEQ ID NO: 5405243 - DNA, 23 bp, Homo sapiens
ctgacctgcccatgtccagaggg

SEQ ID NO: 5405244 - DNA, 15 bp, Homo sapiens
ctgacctgcccccgc

SEQ ID NO: 5405245 - DNA, 22 bp, Homo sapiens
ctgacctgcccccgctctgcca

SEQ ID NO: 5405246 - DNA, 24 bp, Homo sapiens
ctgacctgcccccgctctgccatc

SEQ ID NO: 5405247 - DNA, 13 bp, Homo sapiens
ctgacctgcccct

SEQ ID NO: 5405248 - DNA, 20 bp, Homo sapiens
ctgacctgcgggtcctcagc

SEQ ID NO: 5405249 - DNA, 18 bp, Homo sapiens
ctgacctgctccgccagg

SEQ ID NO: 5405250 - DNA, 15 bp, Homo sapiens
ctgacctgctgtgga

SEQ ID NO: 5405251 - DNA, 23 bp, Homo sapiens
ctgacctgctgtggatgtcccta

SEQ ID NO: 5405252 - DNA, 13 bp, Homo sapiens
ctgacctggcccc

SEQ ID NO: 5405253 - DNA, 19 bp, Homo sapiens
ctgacctgggcccacagag

SEQ ID NO: 5405254 - DNA, 17 bp, Homo sapiens
ctgacctggtccacagg

SEQ ID NO: 5405255 - DNA, 21 bp, Homo sapiens
ctgacctggtccacagggcac

SEQ ID NO: 5405256 - DNA, 13 bp, Homo sapiens
ctgacctggtggg

SEQ ID NO: 5405257 - DNA, 18 bp, Homo sapiens
ctgacctggttgtccagg

SEQ ID NO: 5405258 - DNA, 22 bp, Homo sapiens
ctgacctgtaggtcaggaccat

SEQ ID NO: 5405259 - DNA, 18 bp, Homo sapiens
ctgacctgtcatgccccc

SEQ ID NO: 5405260 - DNA, 17 bp, Homo sapiens
ctgacctgtgagcccag

SEQ ID NO: 5405261 - DNA, 18 bp, Homo sapiens
ctgacctgtgagcccagc

SEQ ID NO: 5405262 - DNA, 19 bp, Homo sapiens
ctgaccttaaatgcaacca

SEQ ID NO: 5405263 - DNA, 17 bp, Homo sapiens
ctgaccttagcgttctg

SEQ ID NO: 5405264 - DNA, 21 bp, Homo sapiens
ctgaccttcctcgcagagagg

SEQ ID NO: 5405265 - DNA, 15 bp, Homo sapiens
ctgaccttccttcct

SEQ ID NO: 5405266 - DNA, 19 bp, Homo sapiens
ctgaccttcggcagtggct

SEQ ID NO: 5405267 - DNA, 15 bp, Homo sapiens
ctgaccttctccagg

SEQ ID NO: 5405268 - DNA, 18 bp, Homo sapiens
ctgaccttctccagggac

SEQ ID NO: 5405269 - DNA, 19 bp, Homo sapiens
ctgaccttctccagggaca

SEQ ID NO: 5405270 - DNA, 16 bp, Homo sapiens
ctgaccttgatgagct

SEQ ID NO: 5405271 - DNA, 20 bp, Homo sapiens
ctgaccttgctgccacaacc

SEQ ID NO: 5405272 - DNA, 22 bp, Homo sapiens
ctgaccttggaggaatgacaat

SEQ ID NO: 5405273 - DNA, 21 bp, Homo sapiens
ctgaccttggctgactggggc

SEQ ID NO: 5405274 - DNA, 14 bp, Homo sapiens
ctgaccttgggtcc

SEQ ID NO: 5405275 - DNA, 18 bp, Homo sapiens
ctgaccttgggtcctgaa

SEQ ID NO: 5405276 - DNA, 17 bp, Homo sapiens
ctgacgaaatggaaaca

SEQ ID NO: 5405277 - DNA, 13 bp, Homo sapiens
ctgacgacactga

SEQ ID NO: 5405278 - DNA, 21 bp, Homo sapiens
ctgacgaggctgggccaagcc

SEQ ID NO: 5405279 - DNA, 18 bp, Homo sapiens
ctgacgatcttccccctt

SEQ ID NO: 5405280 - DNA, 19 bp, Homo sapiens
ctgacgcaccactgccaat

SEQ ID NO: 5405281 - DNA, 14 bp, Homo sapiens
ctgacgcagcctga

SEQ ID NO: 5405282 - DNA, 17 bp, Homo sapiens
ctgacgcagcctgagaa

SEQ ID NO: 5405283 - DNA, 18 bp, Homo sapiens
ctgacgcagcctgagaat

SEQ ID NO: 5405284 - DNA, 22 bp, Homo sapiens
ctgacgcattctcgtatccaac

SEQ ID NO: 5405285 - DNA, 23 bp, Homo sapiens
ctgacgccaataataaaaaacaa

SEQ ID NO: 5405286 - DNA, 24 bp, Homo sapiens
ctgacgcccgagagcctcgctttt

SEQ ID NO: 5405287 - DNA, 21 bp, Homo sapiens
ctgacgccctgcgttggagcc

SEQ ID NO: 5405288 - DNA, 15 bp, Homo sapiens
ctgacgctcagcccc

SEQ ID NO: 5405289 - DNA, 21 bp, Homo sapiens
ctgacgctcagccccaggcca

SEQ ID NO: 5405290 - DNA, 22 bp, Homo sapiens
ctgacgctcagccccaggccag

SEQ ID NO: 5405291 - DNA, 15 bp, Homo sapiens
ctgacgctgacaata

SEQ ID NO: 5405292 - DNA, 13 bp, Homo sapiens
ctgacgcttgtga

SEQ ID NO: 5405293 - DNA, 19 bp, Homo sapiens
ctgacgcttgtgacagtgc

SEQ ID NO: 5405294 - DNA, 22 bp, Homo sapiens
ctgacgcttgtgacagtgcctc

SEQ ID NO: 5405295 - DNA, 14 bp, Homo sapiens
ctgacggccctgca

SEQ ID NO: 5405296 - DNA, 14 bp, Homo sapiens
ctgacggctgtgta

SEQ ID NO: 5405297 - DNA, 15 bp, Homo sapiens
ctgacggctgtgtat

SEQ ID NO: 5405298 - DNA, 23 bp, Homo sapiens
ctgacggctgtgtatttctgtag

SEQ ID NO: 5405299 - DNA, 16 bp, Homo sapiens
ctgacgggaggcccca

SEQ ID NO: 5405300 - DNA, 21 bp, Homo sapiens
ctgacgggaggccccagctct

SEQ ID NO: 5405301 - DNA, 21 bp, Homo sapiens
ctgacggggaggaaccactgc

SEQ ID NO: 5405302 - DNA, 19 bp, Homo sapiens
ctgacgtagaaagatcctt

SEQ ID NO: 5405303 - DNA, 24 bp, Homo sapiens
ctgacgtcagtagtttgagaccag

SEQ ID NO: 5405304 - DNA, 15 bp, Homo sapiens
ctgacgtctgccacc

SEQ ID NO: 5405305 - DNA, 18 bp, Homo sapiens
ctgacgtctgccaccagc

SEQ ID NO: 5405306 - DNA, 14 bp, Homo sapiens
ctgacgtgcctttt

SEQ ID NO: 5405307 - DNA, 20 bp, Homo sapiens
ctgacgtgccttttgcaccc

SEQ ID NO: 5405308 - DNA, 18 bp, Homo sapiens
ctgacgttaggaccagga

SEQ ID NO: 5405309 - DNA, 20 bp, Homo sapiens
ctgacgttaggaccaggaga

SEQ ID NO: 5405310 - DNA, 23 bp, Homo sapiens
ctgacgttccgggcaaatgccag

SEQ ID NO: 5405311 - DNA, 15 bp, Homo sapiens
ctgacgtttgacacc

SEQ ID NO: 5405312 - DNA, 17 bp, Homo sapiens
ctgacgtttgacaccag

SEQ ID NO: 5405313 - DNA, 19 bp, Homo sapiens
ctgacgtttgacaccaggg

SEQ ID NO: 5405314 - DNA, 15 bp, Homo sapiens
ctgactaaaatgttt

SEQ ID NO: 5405315 - DNA, 16 bp, Homo sapiens
ctgactaaactaccac

SEQ ID NO: 5405316 - DNA, 17 bp, Homo sapiens
ctgactaaactaccacc

SEQ ID NO: 5405317 - DNA, 19 bp, Homo sapiens
ctgactaaactaccacctc

SEQ ID NO: 5405318 - DNA, 22 bp, Homo sapiens
ctgactaaactttttttctgta

SEQ ID NO: 5405319 - DNA, 12 bp, Homo sapiens
ctgactaaattt

SEQ ID NO: 5405320 - DNA, 15 bp, Homo sapiens
ctgactacttgatat

SEQ ID NO: 5405321 - DNA, 15 bp, Homo sapiens
ctgactactttgcct

SEQ ID NO: 5405322 - DNA, 20 bp, Homo sapiens
ctgactagtttaaagatgga

SEQ ID NO: 5405323 - DNA, 19 bp, Homo sapiens
ctgactattcttgatgtaa

SEQ ID NO: 5405324 - DNA, 21 bp, Homo sapiens
ctgactattcttgatgtaaaa

SEQ ID NO: 5405325 - DNA, 23 bp, Homo sapiens
ctgactattcttgatgtaaaatc

SEQ ID NO: 5405326 - DNA, 17 bp, Homo sapiens
ctgactcaattatttgc

SEQ ID NO: 5405327 - DNA, 14 bp, Homo sapiens
ctgactcacaagaa

SEQ ID NO: 5405328 - DNA, 17 bp, Homo sapiens
ctgactcacattgcctt

SEQ ID NO: 5405329 - DNA, 22 bp, Homo sapiens
ctgactcacattgccttgagct

SEQ ID NO: 5405330 - DNA, 16 bp, Homo sapiens
ctgactcagctaatgt

SEQ ID NO: 5405331 - DNA, 18 bp, Homo sapiens
ctgactcaggcgcctggc

SEQ ID NO: 5405332 - DNA, 20 bp, Homo sapiens
ctgactcaggcgcctggcac

SEQ ID NO: 5405333 - DNA, 22 bp, Homo sapiens
ctgactcaggcgcctggcacat

SEQ ID NO: 5405334 - DNA, 15 bp, Homo sapiens
ctgactcagggctcc

SEQ ID NO: 5405335 - DNA, 18 bp, Homo sapiens
ctgactcagggctcctgg

SEQ ID NO: 5405336 - DNA, 14 bp, Homo sapiens
ctgactcagtccag

SEQ ID NO: 5405337 - DNA, 21 bp, Homo sapiens
ctgactcagtgcagggacagc

SEQ ID NO: 5405338 - DNA, 23 bp, Homo sapiens
ctgagatttaaatgcaaccagaa

SEQ ID NO: 5405339 - DNA, 14 bp, Homo sapiens
ctgagatttattaa

SEQ ID NO: 5405340 - DNA, 14 bp, Homo sapiens
ctgagatttcatct

SEQ ID NO: 5405341 - DNA, 16 bp, Homo sapiens
ctgagatttcatctgc

SEQ ID NO: 5405342 - DNA, 21 bp, Homo sapiens
ctgagatttcttaaatctttc

SEQ ID NO: 5405343 - DNA, 20 bp, Homo sapiens
ctgagatttgtaaatctttg

SEQ ID NO: 5405344 - DNA, 13 bp, Homo sapiens
ctgagattttagt

SEQ ID NO: 5405345 - DNA, 15 bp, Homo sapiens
ctgagatttttgata

SEQ ID NO: 5405346 - DNA, 18 bp, Homo sapiens
ctgagatttttttgtgta

SEQ ID NO: 5405347 - DNA, 14 bp, Homo sapiens
ctgagcaaagcatc

SEQ ID NO: 5405348 - DNA, 18 bp, Homo sapiens
ctgagcaaaggccctggg

SEQ ID NO: 5405349 - DNA, 19 bp, Homo sapiens
ctgagcaaaggccctgggt

SEQ ID NO: 5405350 - DNA, 20 bp, Homo sapiens
ctgagcaaaggccctgggta

SEQ ID NO: 5405351 - DNA, 17 bp, Homo sapiens
ctgagcaaatgtggctc

SEQ ID NO: 5405352 - DNA, 18 bp, Homo sapiens
ctgagcaacatctcggga

SEQ ID NO: 5405353 - DNA, 20 bp, Homo sapiens
ctgagcaacctcttcagctg

SEQ ID NO: 5405354 - DNA, 20 bp, Homo sapiens
ctgagcaacgctattccagc

SEQ ID NO: 5405355 - DNA, 20 bp, Homo sapiens
ctgagcaactcttgattatc

SEQ ID NO: 5405356 - DNA, 16 bp, Homo sapiens
ctgagcaactgtgcag

SEQ ID NO: 5405357 - DNA, 18 bp, Homo sapiens
ctgagcaactgtgcagca

SEQ ID NO: 5405358 - DNA, 21 bp, Homo sapiens
ctgagcaactgtgcagcaccc

SEQ ID NO: 5405359 - DNA, 22 bp, Homo sapiens
ctgagcaactgtgcagcaccct

SEQ ID NO: 5405360 - DNA, 23 bp, Homo sapiens
ctgagcaagagagagagagaatg

SEQ ID NO: 5405361 - DNA, 16 bp, Homo sapiens
ctgagcaagatcttgt

SEQ ID NO: 5405362 - DNA, 21 bp, Homo sapiens
ctgagcaagatcttgtctcca

SEQ ID NO: 5405363 - DNA, 17 bp, Homo sapiens
ctgagcaataacttcta

SEQ ID NO: 5405364 - DNA, 21 bp, Homo sapiens
ctgagcaatggtaactgcacc

SEQ ID NO: 5405365 - DNA, 22 bp, Homo sapiens
ctgagcaatggtaactgcacct

SEQ ID NO: 5405366 - DNA, 15 bp, Homo sapiens
ctgagcaatgtctgt

SEQ ID NO: 5405367 - DNA, 16 bp, Homo sapiens
ctgagcaatgtctgtg

SEQ ID NO: 5405368 - DNA, 19 bp, Homo sapiens
ctgagcaatgtctgtgcta

SEQ ID NO: 5405369 - DNA, 21 bp, Homo sapiens
ctgagcacacaacaggctgtg

SEQ ID NO: 5405370 - DNA, 16 bp, Homo sapiens
ctgagcacaggtgaca

SEQ ID NO: 5405371 - DNA, 19 bp, Homo sapiens
ctgagcacaggtgacagat

SEQ ID NO: 5405372 - DNA, 18 bp, Homo sapiens
ctgagcacatctcttcat

SEQ ID NO: 5405373 - DNA, 21 bp, Homo sapiens
ctgagcacatttgactccact

SEQ ID NO: 5405374 - DNA, 20 bp, Homo sapiens
ctgagcaccctctggattct

SEQ ID NO: 5405375 - DNA, 20 bp, Homo sapiens
ctgagcaccgtgtcaagctg

SEQ ID NO: 5405376 - DNA, 13 bp, Homo sapiens
ctgagcacctccc

SEQ ID NO: 5405377 - DNA, 17 bp, Homo sapiens
ctgagcacctcccagcc

SEQ ID NO: 5405378 - DNA, 21 bp, Homo sapiens
ctgagcacctcccagcccctg

SEQ ID NO: 5405379 - DNA, 22 bp, Homo sapiens
ctgagcacctcccagcccctgc

SEQ ID NO: 5405380 - DNA, 19 bp, Homo sapiens
ctgagcacctctcagagca

SEQ ID NO: 5405381 - DNA, 17 bp, Homo sapiens
ctgagcacctgcttcat

SEQ ID NO: 5405382 - DNA, 17 bp, Homo sapiens
ctgagcacgctaccaaa

SEQ ID NO: 5405383 - DNA, 21 bp, Homo sapiens
ctgagcacgggcaaagaaaac

SEQ ID NO: 5405384 - DNA, 16 bp, Homo sapiens
ctgagcactcctggtg

SEQ ID NO: 5405385 - DNA, 17 bp, Homo sapiens
ctgagcactcctggtgc

SEQ ID NO: 5405386 - DNA, 15 bp, Homo sapiens
ctgagcactgaacca

SEQ ID NO: 5405387 - DNA, 13 bp, Homo sapiens
ctgagcactgcca

SEQ ID NO: 5405388 - DNA, 15 bp, Homo sapiens
ctgagcactgccagg

SEQ ID NO: 5405389 - DNA, 17 bp, Homo sapiens
ctgagcactgccaggag

SEQ ID NO: 5405390 - DNA, 22 bp, Homo sapiens
ctgagcactgccaggagggaca

SEQ ID NO: 5405391 - DNA, 14 bp, Homo sapiens
ctgagcactggagt

SEQ ID NO: 5405392 - DNA, 13 bp, Homo sapiens
ctgagcactgttt

SEQ ID NO: 5405393 - DNA, 21 bp, Homo sapiens
ctgagcactgttttctagtgt

SEQ ID NO: 5405394 - DNA, 12 bp, Homo sapiens
ctgagcacttag

SEQ ID NO: 5405395 - DNA, 15 bp, Homo sapiens
ctgagcacttagcag

SEQ ID NO: 5405396 - DNA, 17 bp, Homo sapiens
ctgagcagaaagaggcc

SEQ ID NO: 5405397 - DNA, 16 bp, Homo sapiens
ctgagcagaatactgg

SEQ ID NO: 5405398 - DNA, 17 bp, Homo sapiens
ctgagcagaatactggt

SEQ ID NO: 5405399 - DNA, 15 bp, Homo sapiens
ctgagcagacagggc

SEQ ID NO: 5405400 - DNA, 23 bp, Homo sapiens
ctgagcagacagggcgtcctctc

SEQ ID NO: 5405401 - DNA, 17 bp, Homo sapiens
ctgagcagatcgtgccg

SEQ ID NO: 5405402 - DNA, 20 bp, Homo sapiens
ctgagcagatcgtgccgtgg

SEQ ID NO: 5405403 - DNA, 22 bp, Homo sapiens
ctgagcagcatccaccccaccc

SEQ ID NO: 5405404 - DNA, 16 bp, Homo sapiens
ctgagcagcccagcac

SEQ ID NO: 5405405 - DNA, 19 bp, Homo sapiens
ctgagcagccgccagctgg

SEQ ID NO: 5405406 - DNA, 19 bp, Homo sapiens
ctgagcagcctctgccagg

SEQ ID NO: 5405407 - DNA, 16 bp, Homo sapiens
ctgagcagcctctgga

SEQ ID NO: 5405408 - DNA, 17 bp, Homo sapiens
ctgagcagcgagcctgc

SEQ ID NO: 5405409 - DNA, 18 bp, Homo sapiens
ctgagcagcgagcctgct

SEQ ID NO: 5405410 - DNA, 14 bp, Homo sapiens
ctgagcaggcaggg

SEQ ID NO: 5405411 - DNA, 18 bp, Homo sapiens
ctgagcaggctgtggggt

SEQ ID NO: 5405412 - DNA, 22 bp, Homo sapiens
ctgagcaggctgtggggtggag

SEQ ID NO: 5405413 - DNA, 14 bp, Homo sapiens
ctgagcagggatct

SEQ ID NO: 5405414 - DNA, 20 bp, Homo sapiens
ctgagcagggatctgccccc

SEQ ID NO: 5405415 - DNA, 23 bp, Homo sapiens
ctgagcagggccggggaactggc

SEQ ID NO: 5405416 - DNA, 13 bp, Homo sapiens
ctgagcaggggca

SEQ ID NO: 5405417 - DNA, 19 bp, Homo sapiens
ctgagcaggggcaggcgca

SEQ ID NO: 5405418 - DNA, 16 bp, Homo sapiens
ctgagcaggggcccct

SEQ ID NO: 5405419 - DNA, 22 bp, Homo sapiens
ctgagcaggggcccctggggac

SEQ ID NO: 5405420 - DNA, 17 bp, Homo sapiens
ctgagcagggtccacag

SEQ ID NO: 5405421 - DNA, 12 bp, Homo sapiens
ctgagcagtccc

SEQ ID NO: 5405422 - DNA, 15 bp, Homo sapiens
ctgagcagtccttgg

SEQ ID NO: 5405423 - DNA, 21 bp, Homo sapiens
ctgagcagtctacttctgtgt

SEQ ID NO: 5405424 - DNA, 22 bp, Homo sapiens
ctgagcagtctacttctgtgtc

SEQ ID NO: 5405425 - DNA, 23 bp, Homo sapiens
ctgagcagtctacttctgtgtct

SEQ ID NO: 5405426 - DNA, 16 bp, Homo sapiens
ctgagcagtgcctctt

SEQ ID NO: 5405427 - DNA, 13 bp, Homo sapiens
ctgagcagtgggg

SEQ ID NO: 5405428 - DNA, 15 bp, Homo sapiens
ctgagcagttcccct

SEQ ID NO: 5405429 - DNA, 19 bp, Homo sapiens
ctgagcagttcccctggag

SEQ ID NO: 5405430 - DNA, 20 bp, Homo sapiens
ctgagcagttcccctggagc

SEQ ID NO: 5405431 - DNA, 17 bp, Homo sapiens
ctgagcagttttccagg

SEQ ID NO: 5405432 - DNA, 19 bp, Homo sapiens
ctgagcagttttccaggag

SEQ ID NO: 5405433 - DNA, 19 bp, Homo sapiens
ctgagcataagtcctctag

SEQ ID NO: 5405434 - DNA, 16 bp, Homo sapiens
ctgagcataatgctcc

SEQ ID NO: 5405435 - DNA, 22 bp, Homo sapiens
ctgagcatatgttccatgcctg

SEQ ID NO: 5405436 - DNA, 23 bp, Homo sapiens
ctgagcatatgttccatgcctgg

SEQ ID NO: 5405437 - DNA, 20 bp, Homo sapiens
ctgagcatgatgggaatagg

SEQ ID NO: 5405438 - DNA, 18 bp, Homo sapiens
ctgagcatggagacagca

SEQ ID NO: 5405439 - DNA, 20 bp, Homo sapiens
ctgagcatggagacagcagt

SEQ ID NO: 5405440 - DNA, 17 bp, Homo sapiens
ctgagcatggggcgctc

SEQ ID NO: 5405441 - DNA, 18 bp, Homo sapiens
ctgagcatggggcgctcc

SEQ ID NO: 5405442 - DNA, 22 bp, Homo sapiens
ctgagcattcgctgtacccttt

SEQ ID NO: 5405443 - DNA, 21 bp, Homo sapiens
ctgagccaaacacactgtaaa

SEQ ID NO: 5405444 - DNA, 22 bp, Homo sapiens
ctgagccaaacacactgtaaat

SEQ ID NO: 5405445 - DNA, 15 bp, Homo sapiens
ctgagccaaagagaa

SEQ ID NO: 5405446 - DNA, 14 bp, Homo sapiens
ctgagccaaagcca

SEQ ID NO: 5405447 - DNA, 19 bp, Homo sapiens
ctgagccaaatttcttttg

SEQ ID NO: 5405448 - DNA, 12 bp, Homo sapiens
ctgagccaacct

SEQ ID NO: 5405449 - DNA, 14 bp, Homo sapiens
ctgagccaaccttg

SEQ ID NO: 5405450 - DNA, 18 bp, Homo sapiens
ctgagccaaggaggcctg

SEQ ID NO: 5405451 - DNA, 19 bp, Homo sapiens
ctgagccaagggagggaag

SEQ ID NO: 5405452 - DNA, 20 bp, Homo sapiens
ctgagccaagggagggaagg

SEQ ID NO: 5405453 - DNA, 18 bp, Homo sapiens
ctgagccacagccgtgct

SEQ ID NO: 5405454 - DNA, 13 bp, Homo sapiens
ctgagccacagtg

SEQ ID NO: 5405455 - DNA, 17 bp, Homo sapiens
ctgagccacagtggggc

SEQ ID NO: 5405456 - DNA, 20 bp, Homo sapiens
ctgagccaccgcgagggcct

SEQ ID NO: 5405457 - DNA, 15 bp, Homo sapiens
ctgagccactcgcag

SEQ ID NO: 5405458 - DNA, 17 bp, Homo sapiens
ctgagccactcgcagtc

SEQ ID NO: 5405459 - DNA, 14 bp, Homo sapiens
ctgagccagattac

SEQ ID NO: 5405460 - DNA, 15 bp, Homo sapiens
ctgagccagcagggc

SEQ ID NO: 5405461 - DNA, 13 bp, Homo sapiens
ctgagccagctgc

SEQ ID NO: 5405462 - DNA, 14 bp, Homo sapiens
ctgagccagctgca

SEQ ID NO: 5405463 - DNA, 15 bp, Homo sapiens
ctgagccagctgcag

SEQ ID NO: 5405464 - DNA, 22 bp, Homo sapiens
ctgagccagcttagcaactgct

SEQ ID NO: 5405465 - DNA, 20 bp, Homo sapiens
ctgagccaggagcctcctga

SEQ ID NO: 5405466 - DNA, 11 bp, Homo sapiens
ctgagccaggg

SEQ ID NO: 5405467 - DNA, 16 bp, Homo sapiens
ctgagccagggaacag

SEQ ID NO: 5405468 - DNA, 18 bp, Homo sapiens
ctgagccagggaacagcc

SEQ ID NO: 5405469 - DNA, 17 bp, Homo sapiens
ctgagccagggtctcca

SEQ ID NO: 5405470 - DNA, 20 bp, Homo sapiens
ctgagccagggtctccagaa

SEQ ID NO: 5405471 - DNA, 18 bp, Homo sapiens
ctgagccagtcccagggg

SEQ ID NO: 5405472 - DNA, 16 bp, Homo sapiens
ctgagccagtgtcagg

SEQ ID NO: 5405473 - DNA, 22 bp, Homo sapiens
ctgagccagtgtcaggaggaag

SEQ ID NO: 5405474 - DNA, 22 bp, Homo sapiens
ctgagccatgaggagcgtggac

SEQ ID NO: 5405475 - DNA, 15 bp, Homo sapiens
ctgagccatggcggc

SEQ ID NO: 5405476 - DNA, 12 bp, Homo sapiens
ctgagccatggg

SEQ ID NO: 5405477 - DNA, 18 bp, Homo sapiens
ctgagcccaaccaggccc

SEQ ID NO: 5405478 - DNA, 21 bp, Homo sapiens
ctgagcccaaccaggccctgc

SEQ ID NO: 5405479 - DNA, 11 bp, Homo sapiens
ctgagcccact

SEQ ID NO: 5405480 - DNA, 13 bp, Homo sapiens
ctgagcccactct

SEQ ID NO: 5405481 - DNA, 18 bp, Homo sapiens
ctgagcccagccacctcc

SEQ ID NO: 5405482 - DNA, 12 bp, Homo sapiens
ctgagcccagct

SEQ ID NO: 5405483 - DNA, 14 bp, Homo sapiens
ctgagcccagctgc

SEQ ID NO: 5405484 - DNA, 22 bp, Homo sapiens
ctgagcccagctgcctggagag

SEQ ID NO: 5405485 - DNA, 23 bp, Homo sapiens
ctgagcccagctgcctggagagg

SEQ ID NO: 5405486 - DNA, 11 bp, Homo sapiens
ctgagcccagg

SEQ ID NO: 5405487 - DNA, 14 bp, Homo sapiens
ctgagcccagggag

SEQ ID NO: 5405488 - DNA, 23 bp, Homo sapiens
ctgagcccatacttttggctcct

SEQ ID NO: 5405489 - DNA, 15 bp, Homo sapiens
ctgagccccacctct

SEQ ID NO: 5405490 - DNA, 17 bp, Homo sapiens
ctgagccccacctctcc

SEQ ID NO: 5405491 - DNA, 11 bp, Homo sapiens
ctgagccccag

SEQ ID NO: 5405492 - DNA, 14 bp, Homo sapiens
ctgagccccagccc

SEQ ID NO: 5405493 - DNA, 15 bp, Homo sapiens
ctgagccccagcccc

SEQ ID NO: 5405494 - DNA, 13 bp, Homo sapiens
ctgagccccagcg

SEQ ID NO: 5405495 - DNA, 21 bp, Homo sapiens
ctgagccccagcgggctggcg

SEQ ID NO: 5405496 - DNA, 15 bp, Homo sapiens
ctgagcccccaccgg

SEQ ID NO: 5405497 - DNA, 16 bp, Homo sapiens
ctgagcccccaccgga

SEQ ID NO: 5405498 - DNA, 15 bp, Homo sapiens
ctgagcccccagctt

SEQ ID NO: 5405499 - DNA, 22 bp, Homo sapiens
ctgagcccccggctagtaccct

SEQ ID NO: 5405500 - DNA, 13 bp, Homo sapiens
ctgagccccctga

SEQ ID NO: 5405501 - DNA, 15 bp, Homo sapiens
ctgagccccctgcac

SEQ ID NO: 5405502 - DNA, 17 bp, Homo sapiens
ctgagccccctgcaccc

SEQ ID NO: 5405503 - DNA, 14 bp, Homo sapiens
ctgagccccctgtg

SEQ ID NO: 5405504 - DNA, 16 bp, Homo sapiens
ctgagccccctgtgcc

SEQ ID NO: 5405505 - DNA, 19 bp, Homo sapiens
ctgagccccctgtgcccac

SEQ ID NO: 5405506 - DNA, 20 bp, Homo sapiens
ctgagccccctgtgcccacc

SEQ ID NO: 5405507 - DNA, 18 bp, Homo sapiens
ctgagccccgccctcttc

SEQ ID NO: 5405508 - DNA, 21 bp, Homo sapiens
ctgagccccgccctcttcctg

SEQ ID NO: 5405509 - DNA, 17 bp, Homo sapiens
ctgagcccctaccccac

SEQ ID NO: 5405510 - DNA, 22 bp, Homo sapiens
ctgagcccctaccccacaccag

SEQ ID NO: 5405511 - DNA, 18 bp, Homo sapiens
ctgagcccctccctcctg

SEQ ID NO: 5405512 - DNA, 13 bp, Homo sapiens
ctgagcccctcct

SEQ ID NO: 5405513 - DNA, 14 bp, Homo sapiens
ctgagcccctcctc

SEQ ID NO: 5405514 - DNA, 14 bp, Homo sapiens
ctgagcccctgggg

SEQ ID NO: 5405515 - DNA, 21 bp, Homo sapiens
ctgaggaaattgctttgtatt

SEQ ID NO: 5405516 - DNA, 20 bp, Homo sapiens
ctgaggaacaggttcctgtg

SEQ ID NO: 5405517 - DNA, 22 bp, Homo sapiens
ctgaggaacccttacagtagga

SEQ ID NO: 5405518 - DNA, 18 bp, Homo sapiens
ctgaggaagagggactgt

SEQ ID NO: 5405519 - DNA, 23 bp, Homo sapiens
ctgaggaagagggactgttcttt

SEQ ID NO: 5405520 - DNA, 23 bp, Homo sapiens
ctgaggaagatgggggcaagaag

SEQ ID NO: 5405521 - DNA, 22 bp, Homo sapiens
ctgaggaagcagttggggccct

SEQ ID NO: 5405522 - DNA, 19 bp, Homo sapiens
ctgaggaagctggggttca

SEQ ID NO: 5405523 - DNA, 22 bp, Homo sapiens
ctgaggaaggaggggaagctgc

SEQ ID NO: 5405524 - DNA, 21 bp, Homo sapiens
ctgaggaatccagacccggct

SEQ ID NO: 5405525 - DNA, 23 bp, Homo sapiens
ctgaggaatccagacccggctgc

SEQ ID NO: 5405526 - DNA, 19 bp, Homo sapiens
ctgaggaattctgtataga

SEQ ID NO: 5405527 - DNA, 16 bp, Homo sapiens
ctgaggaatttcacct

SEQ ID NO: 5405528 - DNA, 15 bp, Homo sapiens
ctgaggacaaagtgg

SEQ ID NO: 5405529 - DNA, 20 bp, Homo sapiens
ctgaggacaaagtggaggag

SEQ ID NO: 5405530 - DNA, 23 bp, Homo sapiens
ctgaggacaaagtggaggagggc

SEQ ID NO: 5405531 - DNA, 23 bp, Homo sapiens
ctgaggacaagagaaaaaagcca

SEQ ID NO: 5405532 - DNA, 14 bp, Homo sapiens
ctgaggacaaggaa

SEQ ID NO: 5405533 - DNA, 20 bp, Homo sapiens
ctgaggacagaaagaccctg

SEQ ID NO: 5405534 - DNA, 13 bp, Homo sapiens
ctgaggacagctg

SEQ ID NO: 5405535 - DNA, 15 bp, Homo sapiens
ctgaggacagctgtc

SEQ ID NO: 5405536 - DNA, 15 bp, Homo sapiens
ctgaggacaggctct

SEQ ID NO: 5405537 - DNA, 19 bp, Homo sapiens
ctgaggacaggctctagag

SEQ ID NO: 5405538 - DNA, 23 bp, Homo sapiens
ctgaggacaggctctagagagag

SEQ ID NO: 5405539 - DNA, 19 bp, Homo sapiens
ctgaggacatggagagaga

SEQ ID NO: 5405540 - DNA, 19 bp, Homo sapiens
ctgaggacatggcttctga

SEQ ID NO: 5405541 - DNA, 19 bp, Homo sapiens
ctgaggaccctcagcccca

SEQ ID NO: 5405542 - DNA, 21 bp, Homo sapiens
ctgaggaccctcagccccagg

SEQ ID NO: 5405543 - DNA, 20 bp, Homo sapiens
ctgaggaccgccccaaccct

SEQ ID NO: 5405544 - DNA, 19 bp, Homo sapiens
ctgaggaccgctgataagc

SEQ ID NO: 5405545 - DNA, 16 bp, Homo sapiens
ctgaggacgagacccc

SEQ ID NO: 5405546 - DNA, 18 bp, Homo sapiens
ctgaggacgagaccccca

SEQ ID NO: 5405547 - DNA, 20 bp, Homo sapiens
ctgaggacgagacccccatc

SEQ ID NO: 5405548 - DNA, 20 bp, Homo sapiens
ctgaggacggggcagagctg

SEQ ID NO: 5405549 - DNA, 13 bp, Homo sapiens
ctgaggactccct

SEQ ID NO: 5405550 - DNA, 14 bp, Homo sapiens
ctgaggactcctga

SEQ ID NO: 5405551 - DNA, 11 bp, Homo sapiens
ctgaggagaaa

SEQ ID NO: 5405552 - DNA, 19 bp, Homo sapiens
ctgaggagacagaaagcct

SEQ ID NO: 5405553 - DNA, 13 bp, Homo sapiens
ctgaggagacatc

SEQ ID NO: 5405554 - DNA, 19 bp, Homo sapiens
ctgaggagatgaccaggga

SEQ ID NO: 5405555 - DNA, 15 bp, Homo sapiens
ctgaggagcaaagca

SEQ ID NO: 5405556 - DNA, 11 bp, Homo sapiens
ctgaggagcag

SEQ ID NO: 5405557 - DNA, 14 bp, Homo sapiens
ctgaggagcagcag

SEQ ID NO: 5405558 - DNA, 17 bp, Homo sapiens
ctgaggagcagccagga

SEQ ID NO: 5405559 - DNA, 18 bp, Homo sapiens
ctgaggagcagccaggac

SEQ ID NO: 5405560 - DNA, 19 bp, Homo sapiens
ctgaggagcagccaggacc

SEQ ID NO: 5405561 - DNA, 20 bp, Homo sapiens
ctgaggagcagccaggaccc

SEQ ID NO: 5405562 - DNA, 20 bp, Homo sapiens
ctgaggagcagcccacctgc

SEQ ID NO: 5405563 - DNA, 16 bp, Homo sapiens
ctgaggagcccacggg

SEQ ID NO: 5405564 - DNA, 19 bp, Homo sapiens
ctgaggagcccacggggca

SEQ ID NO: 5405565 - DNA, 16 bp, Homo sapiens
ctgaggagccctctcg

SEQ ID NO: 5405566 - DNA, 15 bp, Homo sapiens
ctgaggaggccgctt

SEQ ID NO: 5405567 - DNA, 19 bp, Homo sapiens
ctgaggaggccgcttagtg

SEQ ID NO: 5405568 - DNA, 23 bp, Homo sapiens
ctgaggaggccgcttagtgctgc

SEQ ID NO: 5405569 - DNA, 13 bp, Homo sapiens
ctgaggaggcctc

SEQ ID NO: 5405570 - DNA, 23 bp, Homo sapiens
ctgaggaggccttgggctctgct

SEQ ID NO: 5405571 - DNA, 14 bp, Homo sapiens
ctgaggagggccct

SEQ ID NO: 5405572 - DNA, 17 bp, Homo sapiens
ctgaggagggccctgag

SEQ ID NO: 5405573 - DNA, 18 bp, Homo sapiens
ctgaggagtaagtgtaca

SEQ ID NO: 5405574 - DNA, 21 bp, Homo sapiens
ctgaggagtaagtgtacaatt

SEQ ID NO: 5405575 - DNA, 14 bp, Homo sapiens
ctgaggagtccaaa

SEQ ID NO: 5405576 - DNA, 16 bp, Homo sapiens
ctgaggagtctgagga

SEQ ID NO: 5405577 - DNA, 18 bp, Homo sapiens
ctgaggagtctgaggact

SEQ ID NO: 5405578 - DNA, 21 bp, Homo sapiens
ctgaggagtctgaggactgtc

SEQ ID NO: 5405579 - DNA, 17 bp, Homo sapiens
ctgaggagtctgaggtc

SEQ ID NO: 5405580 - DNA, 18 bp, Homo sapiens
ctgaggagtctgaggtcc

SEQ ID NO: 5405581 - DNA, 19 bp, Homo sapiens
ctgaggagtctgaggtcct

SEQ ID NO: 5405582 - DNA, 20 bp, Homo sapiens
ctgaggagtctgaggtcctg

SEQ ID NO: 5405583 - DNA, 13 bp, Homo sapiens
ctgaggagtgatg

SEQ ID NO: 5405584 - DNA, 16 bp, Homo sapiens
ctgaggagtgatgggc

SEQ ID NO: 5405585 - DNA, 20 bp, Homo sapiens
ctgaggagtgatgggcaagg

SEQ ID NO: 5405586 - DNA, 22 bp, Homo sapiens
ctgaggagtgtcctgtctgctg

SEQ ID NO: 5405587 - DNA, 16 bp, Homo sapiens
ctgaggatacagctct

SEQ ID NO: 5405588 - DNA, 19 bp, Homo sapiens
ctgaggatacagctcttct

SEQ ID NO: 5405589 - DNA, 21 bp, Homo sapiens
ctgaggatacagctcttctca

SEQ ID NO: 5405590 - DNA, 23 bp, Homo sapiens
ctgaggataccccaaagtccagg

SEQ ID NO: 5405591 - DNA, 15 bp, Homo sapiens
ctgaggatcagaaag

SEQ ID NO: 5405592 - DNA, 19 bp, Homo sapiens
ctgaggatcagaaagtaat

SEQ ID NO: 5405593 - DNA, 17 bp, Homo sapiens
ctgaggatcagagtaat

SEQ ID NO: 5405594 - DNA, 19 bp, Homo sapiens
ctgaggatcagagtaatcc

SEQ ID NO: 5405595 - DNA, 22 bp, Homo sapiens
ctgaggatcctcacaggagcag

SEQ ID NO: 5405596 - DNA, 16 bp, Homo sapiens
ctgaggatctagcttc

SEQ ID NO: 5405597 - DNA, 14 bp, Homo sapiens
ctgaggatgacaga

SEQ ID NO: 5405598 - DNA, 22 bp, Homo sapiens
ctgaggatgacccggggcagct

SEQ ID NO: 5405599 - DNA, 11 bp, Homo sapiens
ctgaggattca

SEQ ID NO: 5405600 - DNA, 22 bp, Homo sapiens
ctgaggatttaagggatggaaa

SEQ ID NO: 5405601 - DNA, 14 bp, Homo sapiens
ctgaggatttcaag

SEQ ID NO: 5405602 - DNA, 16 bp, Homo sapiens
ctgaggatttcctgga

SEQ ID NO: 5405603 - DNA, 17 bp, Homo sapiens
ctgaggatttcctggag

SEQ ID NO: 5405604 - DNA, 13 bp, Homo sapiens
ctgaggatttctt

SEQ ID NO: 5405605 - DNA, 22 bp, Homo sapiens
ctgaggcaagccatggagtgag

SEQ ID NO: 5405606 - DNA, 15 bp, Homo sapiens
ctgaggcaaggccca

SEQ ID NO: 5405607 - DNA, 17 bp, Homo sapiens
ctgaggcaaggcccaga

SEQ ID NO: 5405608 - DNA, 20 bp, Homo sapiens
ctgaggcaaggcccagacct

SEQ ID NO: 5405609 - DNA, 13 bp, Homo sapiens
ctgaggcaccaga

SEQ ID NO: 5405610 - DNA, 20 bp, Homo sapiens
ctgaggcaccgtccaggccc

SEQ ID NO: 5405611 - DNA, 23 bp, Homo sapiens
ctgaggcaccgtccaggccccac

SEQ ID NO: 5405612 - DNA, 13 bp, Homo sapiens
ctgaggcacgagc

SEQ ID NO: 5405613 - DNA, 16 bp, Homo sapiens
ctgaggcagaacctgg

SEQ ID NO: 5405614 - DNA, 20 bp, Homo sapiens
ctgaggcagaacctggtggc

SEQ ID NO: 5405615 - DNA, 13 bp, Homo sapiens
ctgaggcagacag

SEQ ID NO: 5405616 - DNA, 17 bp, Homo sapiens
ctgaggcagacagcagc

SEQ ID NO: 5405617 - DNA, 18 bp, Homo sapiens
ctgaggcagacagcagct

SEQ ID NO: 5405618 - DNA, 22 bp, Homo sapiens
ctgaggcagacagcagctcagg

SEQ ID NO: 5405619 - DNA, 17 bp, Homo sapiens
ctgaggcagcagtgtga

SEQ ID NO: 5405620 - DNA, 11 bp, Homo sapiens
ctgaggcagcc

SEQ ID NO: 5405621 - DNA, 13 bp, Homo sapiens
ctgaggcagcctt

SEQ ID NO: 5405622 - DNA, 13 bp, Homo sapiens
ctgaggcaggaga

SEQ ID NO: 5405623 - DNA, 15 bp, Homo sapiens
ctgaggcaggagaac

SEQ ID NO: 5405624 - DNA, 21 bp, Homo sapiens
ctgaggcaggagggcatgtgc

SEQ ID NO: 5405625 - DNA, 20 bp, Homo sapiens
ctgaggcagggaagtcccca

SEQ ID NO: 5405626 - DNA, 22 bp, Homo sapiens
ctgaggcaggtgagaacccaga

SEQ ID NO: 5405627 - DNA, 20 bp, Homo sapiens
ctgaggcatccagcagtctc

SEQ ID NO: 5405628 - DNA, 14 bp, Homo sapiens
ctgaggcatcctct

SEQ ID NO: 5405629 - DNA, 13 bp, Homo sapiens
ctgaggccaaata

SEQ ID NO: 5405630 - DNA, 12 bp, Homo sapiens
ctgaggccacac

SEQ ID NO: 5405631 - DNA, 14 bp, Homo sapiens
ctgaggccagaaag

SEQ ID NO: 5405632 - DNA, 15 bp, Homo sapiens
ctgaggccagaaagg

SEQ ID NO: 5405633 - DNA, 22 bp, Homo sapiens
ctgaggccagaaaggtgtgagg

SEQ ID NO: 5405634 - DNA, 12 bp, Homo sapiens
ctgaggccagag

SEQ ID NO: 5405635 - DNA, 14 bp, Homo sapiens
ctgaggccagagga

SEQ ID NO: 5405636 - DNA, 21 bp, Homo sapiens
ctgaggccagaggaagggagg

SEQ ID NO: 5405637 - DNA, 22 bp, Homo sapiens
ctgaggccagaggaagggaggc

SEQ ID NO: 5405638 - DNA, 15 bp, Homo sapiens
ctgaggccagagtca

SEQ ID NO: 5405639 - DNA, 17 bp, Homo sapiens
ctgaggccagagtcacc

SEQ ID NO: 5405640 - DNA, 23 bp, Homo sapiens
ctgaggccagagtcaccttttct

SEQ ID NO: 5405641 - DNA, 14 bp, Homo sapiens
ctgaggccagcctg

SEQ ID NO: 5405642 - DNA, 19 bp, Homo sapiens
ctgaggccagcctggcctc

SEQ ID NO: 5405643 - DNA, 22 bp, Homo sapiens
ctgaggccagcctggcctcctg

SEQ ID NO: 5405644 - DNA, 13 bp, Homo sapiens
ctgaggccagtgg

SEQ ID NO: 5405645 - DNA, 17 bp, Homo sapiens
ctgaggccagtggcccc

SEQ ID NO: 5405646 - DNA, 11 bp, Homo sapiens
ctgaggcccac

SEQ ID NO: 5405647 - DNA, 12 bp, Homo sapiens
ctgaggcccaga

SEQ ID NO: 5405648 - DNA, 18 bp, Homo sapiens
ctgaggcccagagggcct

SEQ ID NO: 5405649 - DNA, 14 bp, Homo sapiens
ctgaggcccagcag

SEQ ID NO: 5405650 - DNA, 19 bp, Homo sapiens
ctgaggcccagcagagccg

SEQ ID NO: 5405651 - DNA, 15 bp, Homo sapiens
ctgaggcccagtgca

SEQ ID NO: 5405652 - DNA, 16 bp, Homo sapiens
ctgaggcccagtgcat

SEQ ID NO: 5405653 - DNA, 17 bp, Homo sapiens
ctgaggcccagtgcata

SEQ ID NO: 5405654 - DNA, 13 bp, Homo sapiens
ctgaggcccatgg

SEQ ID NO: 5405655 - DNA, 15 bp, Homo sapiens
ctgaggcccatggcc

SEQ ID NO: 5405656 - DNA, 17 bp, Homo sapiens
ctgaggcccatggccac

SEQ ID NO: 5405657 - DNA, 13 bp, Homo sapiens
ctgaggcccctgc

SEQ ID NO: 5405658 - DNA, 23 bp, Homo sapiens
ctgaggccccttaactcatctgt

SEQ ID NO: 5405659 - DNA, 22 bp, Homo sapiens
ctgaggccctcactgagcctca

SEQ ID NO: 5405660 - DNA, 16 bp, Homo sapiens
ctgaggccctgcccaa

SEQ ID NO: 5405661 - DNA, 21 bp, Homo sapiens
ctgaggccctgggctgggtgc

SEQ ID NO: 5405662 - DNA, 20 bp, Homo sapiens
ctgaggcccttctctccagc

SEQ ID NO: 5405663 - DNA, 22 bp, Homo sapiens
ctgaggcccttctctccagccc

SEQ ID NO: 5405664 - DNA, 23 bp, Homo sapiens
ctgaggcccttctctccagcccc

SEQ ID NO: 5405665 - DNA, 23 bp, Homo sapiens
ctgaggcctaaaagtaaacatta

SEQ ID NO: 5405666 - DNA, 17 bp, Homo sapiens
ctgaggcctcccttgag

SEQ ID NO: 5405667 - DNA, 22 bp, Homo sapiens
ctgaggcctgagcgctcctgcc

SEQ ID NO: 5405668 - DNA, 13 bp, Homo sapiens
ctgaggcctgagg

SEQ ID NO: 5405669 - DNA, 15 bp, Homo sapiens
ctgaggcctgaggcc

SEQ ID NO: 5405670 - DNA, 12 bp, Homo sapiens
ctgaggcctgct

SEQ ID NO: 5405671 - DNA, 14 bp, Homo sapiens
ctgaggcctgcttc

SEQ ID NO: 5405672 - DNA, 15 bp, Homo sapiens
ctgaggcctgcttcc

SEQ ID NO: 5405673 - DNA, 12 bp, Homo sapiens
ctgaggcctgga

SEQ ID NO: 5405674 - DNA, 20 bp, Homo sapiens
ctgaggcctggactttcctg

SEQ ID NO: 5405675 - DNA, 14 bp, Homo sapiens
ctgaggcctgggcc

SEQ ID NO: 5405676 - DNA, 18 bp, Homo sapiens
ctgaggccttatcattca

SEQ ID NO: 5405677 - DNA, 17 bp, Homo sapiens
ctgaggccttgtgtgtc

SEQ ID NO: 5405678 - DNA, 23 bp, Homo sapiens
ctgaggcgccccaacccgtggag

SEQ ID NO: 5405679 - DNA, 15 bp, Homo sapiens
ctgaggcggaggctg

SEQ ID NO: 5405680 - DNA, 17 bp, Homo sapiens
ctgaggcggaggctgtg

SEQ ID NO: 5405681 - DNA, 16 bp, Homo sapiens
ctgaggctcaagaggc

SEQ ID NO: 5405682 - DNA, 22 bp, Homo sapiens
ctgaggctcaagaggcccaggg

SEQ ID NO: 5405683 - DNA, 13 bp, Homo sapiens
ctgaggctcagcc

SEQ ID NO: 5405684 - DNA, 20 bp, Homo sapiens
ctgaggctcagccctgagct

SEQ ID NO: 5405685 - DNA, 16 bp, Homo sapiens
ctgaggctcagggaaa

SEQ ID NO: 5405686 - DNA, 15 bp, Homo sapiens
ctgaggctccacttg

SEQ ID NO: 5405687 - DNA, 23 bp, Homo sapiens
ctgaggctctgacccagtgagat

SEQ ID NO: 5405688 - DNA, 18 bp, Homo sapiens
ctgaggctctttctgggc

SEQ ID NO: 5405689 - DNA, 15 bp, Homo sapiens
ctgaggctgagactg

SEQ ID NO: 5405690 - DNA, 14 bp, Homo sapiens
ctgaggctgaggca

SEQ ID NO: 5405691 - DNA, 17 bp, Homo sapiens
ctgaggctggactccag

SEQ ID NO: 5405692 - DNA, 13 bp, Homo sapiens
ctgatcctctctt

SEQ ID NO: 5405693 - DNA, 20 bp, Homo sapiens
ctgatcctgaacaagaaaga

SEQ ID NO: 5405694 - DNA, 15 bp, Homo sapiens
ctgatcctggaggcc

SEQ ID NO: 5405695 - DNA, 21 bp, Homo sapiens
ctgatccttcaactctgtgag

SEQ ID NO: 5405696 - DNA, 22 bp, Homo sapiens
ctgatccttcaactctgtgagg

SEQ ID NO: 5405697 - DNA, 18 bp, Homo sapiens
ctgatcgacgtggtgacg

SEQ ID NO: 5405698 - DNA, 13 bp, Homo sapiens
ctgatcgccttcc

SEQ ID NO: 5405699 - DNA, 15 bp, Homo sapiens
ctgatcgccttcccc

SEQ ID NO: 5405700 - DNA, 14 bp, Homo sapiens
ctgatcgcttctcc

SEQ ID NO: 5405701 - DNA, 19 bp, Homo sapiens
ctgatcgggataacaaaat

SEQ ID NO: 5405702 - DNA, 18 bp, Homo sapiens
ctgatcgtctcggcccct

SEQ ID NO: 5405703 - DNA, 22 bp, Homo sapiens
ctgatcgtctcggcccctctga

SEQ ID NO: 5405704 - DNA, 21 bp, Homo sapiens
ctgatcgtgacgctgaataaa

SEQ ID NO: 5405705 - DNA, 15 bp, Homo sapiens
ctgatcgtgctaaat

SEQ ID NO: 5405706 - DNA, 19 bp, Homo sapiens
ctgatcgtgctaaattttc

SEQ ID NO: 5405707 - DNA, 15 bp, Homo sapiens
ctgatcgttctttct

SEQ ID NO: 5405708 - DNA, 14 bp, Homo sapiens
ctgatctaacaaaa

SEQ ID NO: 5405709 - DNA, 18 bp, Homo sapiens
ctgatctaacaaaataag

SEQ ID NO: 5405710 - DNA, 21 bp, Homo sapiens
ctgatctcaagtatatgtcat

SEQ ID NO: 5405711 - DNA, 12 bp, Homo sapiens
ctgatctcaggg

SEQ ID NO: 5405712 - DNA, 22 bp, Homo sapiens
ctgatctcagggaagcccagct

SEQ ID NO: 5405713 - DNA, 21 bp, Homo sapiens
ctgatctccataaacatgaaa

SEQ ID NO: 5405714 - DNA, 22 bp, Homo sapiens
ctgatctccatggcttcctcct

SEQ ID NO: 5405715 - DNA, 23 bp, Homo sapiens
ctgatctctactaccacaaggaa

SEQ ID NO: 5405716 - DNA, 17 bp, Homo sapiens
ctgatctctcgtgattg

SEQ ID NO: 5405717 - DNA, 18 bp, Homo sapiens
ctgatctctcgtgattga

SEQ ID NO: 5405718 - DNA, 15 bp, Homo sapiens
ctgatctctgctccc

SEQ ID NO: 5405719 - DNA, 17 bp, Homo sapiens
ctgatctctgctccctg

SEQ ID NO: 5405720 - DNA, 19 bp, Homo sapiens
ctgatctctgctccctgca

SEQ ID NO: 5405721 - DNA, 15 bp, Homo sapiens
ctgatctcttcctgt

SEQ ID NO: 5405722 - DNA, 19 bp, Homo sapiens
ctgatctgacatccccact

SEQ ID NO: 5405723 - DNA, 17 bp, Homo sapiens
ctgatctgcccatcgtg

SEQ ID NO: 5405724 - DNA, 21 bp, Homo sapiens
ctgatctgcccatcgtgaaga

SEQ ID NO: 5405725 - DNA, 12 bp, Homo sapiens
ctgatctgcgga

SEQ ID NO: 5405726 - DNA, 20 bp, Homo sapiens
ctgatctgcggatctcagct

SEQ ID NO: 5405727 - DNA, 16 bp, Homo sapiens
ctgatctggcccaagc

SEQ ID NO: 5405728 - DNA, 19 bp, Homo sapiens
ctgatctggcccaagctgg

SEQ ID NO: 5405729 - DNA, 22 bp, Homo sapiens
ctgatctggcccaagctgggct

SEQ ID NO: 5405730 - DNA, 16 bp, Homo sapiens
ctgatctgtactttgt

SEQ ID NO: 5405731 - DNA, 20 bp, Homo sapiens
ctgatctgtataaaaatgta

SEQ ID NO: 5405732 - DNA, 17 bp, Homo sapiens
ctgatctgtgctttcca

SEQ ID NO: 5405733 - DNA, 18 bp, Homo sapiens
ctgatctgtgctttccag

SEQ ID NO: 5405734 - DNA, 22 bp, Homo sapiens
ctgatctgtgctttccagctca

SEQ ID NO: 5405735 - DNA, 23 bp, Homo sapiens
ctgatctgtgctttccagctcac

SEQ ID NO: 5405736 - DNA, 15 bp, Homo sapiens
ctgatcttacagaaa

SEQ ID NO: 5405737 - DNA, 21 bp, Homo sapiens
ctgatcttactctactgctgc

SEQ ID NO: 5405738 - DNA, 16 bp, Homo sapiens
ctgatcttatgtgtta

SEQ ID NO: 5405739 - DNA, 14 bp, Homo sapiens
ctgatcttgcctgt

SEQ ID NO: 5405740 - DNA, 11 bp, Homo sapiens
ctgatcttgga

SEQ ID NO: 5405741 - DNA, 15 bp, Homo sapiens
ctgatcttggctcac

SEQ ID NO: 5405742 - DNA, 16 bp, Homo sapiens
ctgatcttgtgctcag

SEQ ID NO: 5405743 - DNA, 22 bp, Homo sapiens
ctgatctttaactggaaggctg

SEQ ID NO: 5405744 - DNA, 23 bp, Homo sapiens
ctgatctttaactggaaggctgc

SEQ ID NO: 5405745 - DNA, 22 bp, Homo sapiens
ctgatctttgggcatcagaaaa

SEQ ID NO: 5405746 - DNA, 17 bp, Homo sapiens
ctgatcttttaaaatca

SEQ ID NO: 5405747 - DNA, 19 bp, Homo sapiens
ctgatctttttatacacaa

SEQ ID NO: 5405748 - DNA, 23 bp, Homo sapiens
ctgatgaaaacaaaatcacagca

SEQ ID NO: 5405749 - DNA, 17 bp, Homo sapiens
ctgatgaaaataaagaa

SEQ ID NO: 5405750 - DNA, 21 bp, Homo sapiens
ctgatgaaaatattctgattg

SEQ ID NO: 5405751 - DNA, 16 bp, Homo sapiens
ctgatgaaagctttgg

SEQ ID NO: 5405752 - DNA, 23 bp, Homo sapiens
ctgatgaaatctgctagaaagtt

SEQ ID NO: 5405753 - DNA, 21 bp, Homo sapiens
ctgatgaactcttaatcaaat

SEQ ID NO: 5405754 - DNA, 12 bp, Homo sapiens
ctgatgaagaag

SEQ ID NO: 5405755 - DNA, 23 bp, Homo sapiens
ctgatgaatgtaaagttacactg

SEQ ID NO: 5405756 - DNA, 11 bp, Homo sapiens
ctgatgacaat

SEQ ID NO: 5405757 - DNA, 17 bp, Homo sapiens
ctgatgacaataaagct

SEQ ID NO: 5405758 - DNA, 15 bp, Homo sapiens
ctgatgacagagcga

SEQ ID NO: 5405759 - DNA, 13 bp, Homo sapiens
ctgatgacccagg

SEQ ID NO: 5405760 - DNA, 15 bp, Homo sapiens
ctgatgacccaggct

SEQ ID NO: 5405761 - DNA, 21 bp, Homo sapiens
ctgatgacccccccagcttca

SEQ ID NO: 5405762 - DNA, 22 bp, Homo sapiens
ctgatgacccccccagcttcac

SEQ ID NO: 5405763 - DNA, 18 bp, Homo sapiens
ctgatgacgggatgctct

SEQ ID NO: 5405764 - DNA, 14 bp, Homo sapiens
ctgatgactcaaga

SEQ ID NO: 5405765 - DNA, 18 bp, Homo sapiens
ctgatgactcaagattcc

SEQ ID NO: 5405766 - DNA, 20 bp, Homo sapiens
ctgatgactcaagattccca

SEQ ID NO: 5405767 - DNA, 22 bp, Homo sapiens
ctgatgactcaagattcccagg

SEQ ID NO: 5405768 - DNA, 23 bp, Homo sapiens
ctgatgagaatttataaattatt

SEQ ID NO: 5405769 - DNA, 18 bp, Homo sapiens
ctgatgagacaacacaca

SEQ ID NO: 5405770 - DNA, 15 bp, Homo sapiens
ctgatgagagaatgt

SEQ ID NO: 5405771 - DNA, 11 bp, Homo sapiens
ctgatgagcaa

SEQ ID NO: 5405772 - DNA, 21 bp, Homo sapiens
ctgatgagcaaccgcttccct

SEQ ID NO: 5405773 - DNA, 13 bp, Homo sapiens
ctgatgagcaaga

SEQ ID NO: 5405774 - DNA, 22 bp, Homo sapiens
ctgatgagcacatctctctgcc

SEQ ID NO: 5405775 - DNA, 15 bp, Homo sapiens
ctgatgaggcatttt

SEQ ID NO: 5405776 - DNA, 21 bp, Homo sapiens
ctgatgagggggaattcctgg

SEQ ID NO: 5405777 - DNA, 22 bp, Homo sapiens
ctgatgagggggaattcctgga

SEQ ID NO: 5405778 - DNA, 19 bp, Homo sapiens
ctgatgagtgattgacaca

SEQ ID NO: 5405779 - DNA, 21 bp, Homo sapiens
ctgatgataggttaataaaga

SEQ ID NO: 5405780 - DNA, 13 bp, Homo sapiens
ctgatgatataaa

SEQ ID NO: 5405781 - DNA, 14 bp, Homo sapiens
ctgatgatcaaaac

SEQ ID NO: 5405782 - DNA, 20 bp, Homo sapiens
ctgatgatcaaaacctgtgc

SEQ ID NO: 5405783 - DNA, 16 bp, Homo sapiens
ctgatgatccagaaca

SEQ ID NO: 5405784 - DNA, 18 bp, Homo sapiens
ctgatgatgtcttctggt

SEQ ID NO: 5405785 - DNA, 22 bp, Homo sapiens
ctgatgatgtcttctggtgtca

SEQ ID NO: 5405786 - DNA, 17 bp, Homo sapiens
ctgatgatgtgcctggg

SEQ ID NO: 5405787 - DNA, 16 bp, Homo sapiens
ctgatgattttccttt

SEQ ID NO: 5405788 - DNA, 15 bp, Homo sapiens
ctgatgcaaggatta

SEQ ID NO: 5405789 - DNA, 20 bp, Homo sapiens
ctgatgcaaggattacagaa

SEQ ID NO: 5405790 - DNA, 13 bp, Homo sapiens
ctgatgcagaaat

SEQ ID NO: 5405791 - DNA, 12 bp, Homo sapiens
ctgatgcagaca

SEQ ID NO: 5405792 - DNA, 16 bp, Homo sapiens
ctgatgcagccgtcca

SEQ ID NO: 5405793 - DNA, 12 bp, Homo sapiens
ctgatgcagctt

SEQ ID NO: 5405794 - DNA, 16 bp, Homo sapiens
ctgatgcagcttatac

SEQ ID NO: 5405795 - DNA, 19 bp, Homo sapiens
ctgatgcaggtcagcccat

SEQ ID NO: 5405796 - DNA, 23 bp, Homo sapiens
ctgatgcaggtcagcccatggag

SEQ ID NO: 5405797 - DNA, 22 bp, Homo sapiens
ctgatgcatcagaaagggaggg

SEQ ID NO: 5405798 - DNA, 13 bp, Homo sapiens
ctgatgccaaagc

SEQ ID NO: 5405799 - DNA, 18 bp, Homo sapiens
ctgatgccaaagctgctt

SEQ ID NO: 5405800 - DNA, 19 bp, Homo sapiens
ctgatgccaaagctgcttt

SEQ ID NO: 5405801 - DNA, 17 bp, Homo sapiens
ctgatgccaaggggctg

SEQ ID NO: 5405802 - DNA, 21 bp, Homo sapiens
ctgatgccccttctccccttc

SEQ ID NO: 5405803 - DNA, 23 bp, Homo sapiens
ctgatgccccttctccccttcct

SEQ ID NO: 5405804 - DNA, 20 bp, Homo sapiens
ctgatgccctcttctccttg

SEQ ID NO: 5405805 - DNA, 22 bp, Homo sapiens
ctgatgccctcttctccttgcc

SEQ ID NO: 5405806 - DNA, 17 bp, Homo sapiens
ctgatgcctccttggcc

SEQ ID NO: 5405807 - DNA, 17 bp, Homo sapiens
ctgatgccttcatctgt

SEQ ID NO: 5405808 - DNA, 13 bp, Homo sapiens
ctgatgccttttg

SEQ ID NO: 5405809 - DNA, 15 bp, Homo sapiens
ctgatgcgctgggat

SEQ ID NO: 5405810 - DNA, 16 bp, Homo sapiens
ctgatgctaattttca

SEQ ID NO: 5405811 - DNA, 14 bp, Homo sapiens
ctgatgctccctcc

SEQ ID NO: 5405812 - DNA, 17 bp, Homo sapiens
ctgatgctccctcccct

SEQ ID NO: 5405813 - DNA, 15 bp, Homo sapiens
ctgatgctgaaataa

SEQ ID NO: 5405814 - DNA, 12 bp, Homo sapiens
ctgatgctgcta

SEQ ID NO: 5405815 - DNA, 22 bp, Homo sapiens
ctgatgctgctatatccactgt

SEQ ID NO: 5405816 - DNA, 16 bp, Homo sapiens
ctgatgctgggaccct

SEQ ID NO: 5405817 - DNA, 15 bp, Homo sapiens
ctgatgctgtcatgt

SEQ ID NO: 5405818 - DNA, 21 bp, Homo sapiens
ctgatgcttaataaacgcagc

SEQ ID NO: 5405819 - DNA, 17 bp, Homo sapiens
ctgatgcttacatctgg

SEQ ID NO: 5405820 - DNA, 18 bp, Homo sapiens
ctgatgcttacatctgga

SEQ ID NO: 5405821 - DNA, 13 bp, Homo sapiens
ctgatgcttgaag

SEQ ID NO: 5405822 - DNA, 18 bp, Homo sapiens
ctgatgcttttagctcaa

SEQ ID NO: 5405823 - DNA, 19 bp, Homo sapiens
ctgatgcttttgtctaatt

SEQ ID NO: 5405824 - DNA, 14 bp, Homo sapiens
ctgatggaaacaaa

SEQ ID NO: 5405825 - DNA, 21 bp, Homo sapiens
ctgatggaactgtgtatttat

SEQ ID NO: 5405826 - DNA, 21 bp, Homo sapiens
ctgatggaagatggtccgtgc

SEQ ID NO: 5405827 - DNA, 15 bp, Homo sapiens
ctgatggaagcacac

SEQ ID NO: 5405828 - DNA, 20 bp, Homo sapiens
ctgatggaatgtgccacctg

SEQ ID NO: 5405829 - DNA, 22 bp, Homo sapiens
ctgatggaatgtgccacctgtc

SEQ ID NO: 5405830 - DNA, 14 bp, Homo sapiens
ctgatggacaagga

SEQ ID NO: 5405831 - DNA, 15 bp, Homo sapiens
ctgatggacctgccc

SEQ ID NO: 5405832 - DNA, 15 bp, Homo sapiens
ctgatggacctgtca

SEQ ID NO: 5405833 - DNA, 17 bp, Homo sapiens
ctgatggagaaggaagg

SEQ ID NO: 5405834 - DNA, 16 bp, Homo sapiens
ctgatggagaggagaa

SEQ ID NO: 5405835 - DNA, 16 bp, Homo sapiens
ctgatggagagtgaga

SEQ ID NO: 5405836 - DNA, 15 bp, Homo sapiens
ctgatggagccccac

SEQ ID NO: 5405837 - DNA, 15 bp, Homo sapiens
ctgatggagccttcc

SEQ ID NO: 5405838 - DNA, 15 bp, Homo sapiens
ctgatggagtgtgca

SEQ ID NO: 5405839 - DNA, 19 bp, Homo sapiens
ctgatggagtgtgcagaca

SEQ ID NO: 5405840 - DNA, 13 bp, Homo sapiens
ctgatggattcca

SEQ ID NO: 5405841 - DNA, 15 bp, Homo sapiens
ctgatggattccaaa

SEQ ID NO: 5405842 - DNA, 23 bp, Homo sapiens
ctgatggattccaaccttccttt

SEQ ID NO: 5405843 - DNA, 20 bp, Homo sapiens
ctgatggcacccacacagag

SEQ ID NO: 5405844 - DNA, 22 bp, Homo sapiens
ctgatggcacccacacagagga

SEQ ID NO: 5405845 - DNA, 22 bp, Homo sapiens
ctgatggcacttttgagctcct

SEQ ID NO: 5405846 - DNA, 14 bp, Homo sapiens
ctgatggcagctgg

SEQ ID NO: 5405847 - DNA, 19 bp, Homo sapiens
ctgatggcaggatggcctg

SEQ ID NO: 5405848 - DNA, 11 bp, Homo sapiens
ctgatggccaa

SEQ ID NO: 5405849 - DNA, 15 bp, Homo sapiens
ctgatggccaagagc

SEQ ID NO: 5405850 - DNA, 21 bp, Homo sapiens
ctgatggccaagggggtggac

SEQ ID NO: 5405851 - DNA, 15 bp, Homo sapiens
ctgatggccaggcct

SEQ ID NO: 5405852 - DNA, 16 bp, Homo sapiens
ctgatggcccctccag

SEQ ID NO: 5405853 - DNA, 15 bp, Homo sapiens
ctgatggccctcatc

SEQ ID NO: 5405854 - DNA, 14 bp, Homo sapiens
ctgatggctgctgg

SEQ ID NO: 5405855 - DNA, 18 bp, Homo sapiens
ctgatggctgctggaggg

SEQ ID NO: 5405856 - DNA, 16 bp, Homo sapiens
ctgatggcttgacatg

SEQ ID NO: 5405857 - DNA, 22 bp, Homo sapiens
ctgatgggaaaactgccaatat

SEQ ID NO: 5405858 - DNA, 19 bp, Homo sapiens
ctgatgggagtaggctcca

SEQ ID NO: 5405859 - DNA, 20 bp, Homo sapiens
ctgatgggagtaggctccag

SEQ ID NO: 5405860 - DNA, 21 bp, Homo sapiens
ctgatgggcaacccccagcct

SEQ ID NO: 5405861 - DNA, 22 bp, Homo sapiens
ctgatgggcaacccccagcctg

SEQ ID NO: 5405862 - DNA, 23 bp, Homo sapiens
ctgatgggcaacccccagcctgc

SEQ ID NO: 5405863 - DNA, 17 bp, Homo sapiens
ctgatgggcactggaaa

SEQ ID NO: 5405864 - DNA, 23 bp, Homo sapiens
ctgatgggctggggcaggggcct

SEQ ID NO: 5405865 - DNA, 21 bp, Homo sapiens
ctgatgggtatcatgcttcta

SEQ ID NO: 5405866 - DNA, 20 bp, Homo sapiens
ctgatgggtcccaaaagctt

SEQ ID NO: 5405867 - DNA, 14 bp, Homo sapiens
ctgatgggtcctgc

SEQ ID NO: 5405868 - DNA, 18 bp, Homo sapiens
ctgcaaggtactctggtg

SEQ ID NO: 5405869 - DNA, 18 bp, Homo sapiens
ctgcaaggtgcacctgcc

SEQ ID NO: 5405870 - DNA, 12 bp, Homo sapiens
ctgcaaggtggc

SEQ ID NO: 5405871 - DNA, 22 bp, Homo sapiens
ctgcaaggtggcctctgcctgg

SEQ ID NO: 5405872 - DNA, 23 bp, Homo sapiens
ctgcaaggtggcctctgcctggg

SEQ ID NO: 5405873 - DNA, 17 bp, Homo sapiens
ctgcaagtcacaaagga

SEQ ID NO: 5405874 - DNA, 12 bp, Homo sapiens
ctgcaagtcaga

SEQ ID NO: 5405875 - DNA, 14 bp, Homo sapiens
ctgcaagtcagagg

SEQ ID NO: 5405876 - DNA, 19 bp, Homo sapiens
ctgcaagtcagaggatggc

SEQ ID NO: 5405877 - DNA, 23 bp, Homo sapiens
ctgcaagtcagattgctgggagg

SEQ ID NO: 5405878 - DNA, 18 bp, Homo sapiens
ctgcaagtcattgagtga

SEQ ID NO: 5405879 - DNA, 23 bp, Homo sapiens
ctgcaagtccatagctgagctgg

SEQ ID NO: 5405880 - DNA, 16 bp, Homo sapiens
ctgcaagtcccaggga

SEQ ID NO: 5405881 - DNA, 15 bp, Homo sapiens
ctgcaagtccttttg

SEQ ID NO: 5405882 - DNA, 20 bp, Homo sapiens
ctgcaagtccttttgtaaag

SEQ ID NO: 5405883 - DNA, 22 bp, Homo sapiens
ctgcaagtgaggtgtgtcacaa

SEQ ID NO: 5405884 - DNA, 12 bp, Homo sapiens
ctgcaagtgccc

SEQ ID NO: 5405885 - DNA, 16 bp, Homo sapiens
ctgcaagtgcccgccc

SEQ ID NO: 5405886 - DNA, 21 bp, Homo sapiens
ctgcaagtgcccgccctgccc

SEQ ID NO: 5405887 - DNA, 15 bp, Homo sapiens
ctgcaagtgctcagg

SEQ ID NO: 5405888 - DNA, 18 bp, Homo sapiens
ctgcaagtgtctggagcg

SEQ ID NO: 5405889 - DNA, 21 bp, Homo sapiens
ctgcaagtgtctggagcggct

SEQ ID NO: 5405890 - DNA, 12 bp, Homo sapiens
ctgcaagttcaa

SEQ ID NO: 5405891 - DNA, 16 bp, Homo sapiens
ctgcaagttgctctga

SEQ ID NO: 5405892 - DNA, 17 bp, Homo sapiens
ctgcaagttgctctgac

SEQ ID NO: 5405893 - DNA, 20 bp, Homo sapiens
ctgcaataaaaaaattaccc

SEQ ID NO: 5405894 - DNA, 14 bp, Homo sapiens
ctgcaataacagtt

SEQ ID NO: 5405895 - DNA, 16 bp, Homo sapiens
ctgcaataacagtttt

SEQ ID NO: 5405896 - DNA, 17 bp, Homo sapiens
ctgcaataacttctgac

SEQ ID NO: 5405897 - DNA, 21 bp, Homo sapiens
ctgcaataatatcaaaacaag

SEQ ID NO: 5405898 - DNA, 18 bp, Homo sapiens
ctgcaatacaagtttcat

SEQ ID NO: 5405899 - DNA, 17 bp, Homo sapiens
ctgcaatacattaaaat

SEQ ID NO: 5405900 - DNA, 18 bp, Homo sapiens
ctgcaatagagactgtag

SEQ ID NO: 5405901 - DNA, 20 bp, Homo sapiens
ctgcaatagagactgtagat

SEQ ID NO: 5405902 - DNA, 16 bp, Homo sapiens
ctgcaatatttgaatt

SEQ ID NO: 5405903 - DNA, 16 bp, Homo sapiens
ctgcaatcctgtcttt

SEQ ID NO: 5405904 - DNA, 14 bp, Homo sapiens
ctgcaatctccagg

SEQ ID NO: 5405905 - DNA, 16 bp, Homo sapiens
ctgcaatctccagggc

SEQ ID NO: 5405906 - DNA, 21 bp, Homo sapiens
ctgcaatctccagggctgccc

SEQ ID NO: 5405907 - DNA, 22 bp, Homo sapiens
ctgcaatctccagggctgcccc

SEQ ID NO: 5405908 - DNA, 18 bp, Homo sapiens
ctgcaatgaagtctctga

SEQ ID NO: 5405909 - DNA, 14 bp, Homo sapiens
ctgcaatgagccat

SEQ ID NO: 5405910 - DNA, 15 bp, Homo sapiens
ctgcaatgcctagac

SEQ ID NO: 5405911 - DNA, 22 bp, Homo sapiens
ctgcaatgcgtcttgtgaaatt

SEQ ID NO: 5405912 - DNA, 23 bp, Homo sapiens
ctgcaatgcgtcttgtgaaattg

SEQ ID NO: 5405913 - DNA, 20 bp, Homo sapiens
ctgcaatgcttctgtagctt

SEQ ID NO: 5405914 - DNA, 13 bp, Homo sapiens
ctgcaatgggaga

SEQ ID NO: 5405915 - DNA, 18 bp, Homo sapiens
ctgcaatgtgggcagaga

SEQ ID NO: 5405916 - DNA, 16 bp, Homo sapiens
ctgcaatgttttcctt

SEQ ID NO: 5405917 - DNA, 21 bp, Homo sapiens
ctgcaattcaaaagttccaag

SEQ ID NO: 5405918 - DNA, 13 bp, Homo sapiens
ctgcaattcaact

SEQ ID NO: 5405919 - DNA, 19 bp, Homo sapiens
ctgcaattccctggataga

SEQ ID NO: 5405920 - DNA, 15 bp, Homo sapiens
ctgcaattgagggct

SEQ ID NO: 5405921 - DNA, 19 bp, Homo sapiens
ctgcaattgcagctcactg

SEQ ID NO: 5405922 - DNA, 19 bp, Homo sapiens
ctgcaatttgtttaaagaa

SEQ ID NO: 5405923 - DNA, 16 bp, Homo sapiens
ctgcacaaacatgaaa

SEQ ID NO: 5405924 - DNA, 20 bp, Homo sapiens
ctgcacaaagatgtcttctg

SEQ ID NO: 5405925 - DNA, 18 bp, Homo sapiens
ctgcacaaagcccttcca

SEQ ID NO: 5405926 - DNA, 20 bp, Homo sapiens
ctgcacaaagcccttccatg

SEQ ID NO: 5405927 - DNA, 17 bp, Homo sapiens
ctgcacaagatatttat

SEQ ID NO: 5405928 - DNA, 15 bp, Homo sapiens
ctgcacaagccaggg

SEQ ID NO: 5405929 - DNA, 22 bp, Homo sapiens
ctgcacaagctgcaccctcagg

SEQ ID NO: 5405930 - DNA, 20 bp, Homo sapiens
ctgcacaataaaaccaagcc

SEQ ID NO: 5405931 - DNA, 16 bp, Homo sapiens
ctgcacaataactcct

SEQ ID NO: 5405932 - DNA, 20 bp, Homo sapiens
ctgcacaataactcctccca

SEQ ID NO: 5405933 - DNA, 22 bp, Homo sapiens
ctgcacaataactcctcccagg

SEQ ID NO: 5405934 - DNA, 17 bp, Homo sapiens
ctgcacaatttaatata

SEQ ID NO: 5405935 - DNA, 11 bp, Homo sapiens
ctgcacacaag

SEQ ID NO: 5405936 - DNA, 17 bp, Homo sapiens
ctgcacacaagaggcta

SEQ ID NO: 5405937 - DNA, 14 bp, Homo sapiens
ctgcacacacagct

SEQ ID NO: 5405938 - DNA, 17 bp, Homo sapiens
ctgcacacacctccgag

SEQ ID NO: 5405939 - DNA, 20 bp, Homo sapiens
ctgcacacacctccgagaca

SEQ ID NO: 5405940 - DNA, 22 bp, Homo sapiens
ctgcacacacctccgagacagt

SEQ ID NO: 5405941 - DNA, 13 bp, Homo sapiens
ctgcacacacctg

SEQ ID NO: 5405942 - DNA, 15 bp, Homo sapiens
ctgcacacacctgca

SEQ ID NO: 5405943 - DNA, 19 bp, Homo sapiens
ctgcacacacctgcacacc

SEQ ID NO: 5405944 - DNA, 15 bp, Homo sapiens
ctgcacacacctgcc

SEQ ID NO: 5405945 - DNA, 20 bp, Homo sapiens
ctgcacacacctgcctgcag

SEQ ID NO: 5405946 - DNA, 21 bp, Homo sapiens
ctgcacacagctaggcatgcc

SEQ ID NO: 5405947 - DNA, 20 bp, Homo sapiens
ctgcacacaggacagcggga

SEQ ID NO: 5405948 - DNA, 13 bp, Homo sapiens
ctgcacacagggc

SEQ ID NO: 5405949 - DNA, 14 bp, Homo sapiens
ctgcacacataaca

SEQ ID NO: 5405950 - DNA, 15 bp, Homo sapiens
ctgcacacataacac

SEQ ID NO: 5405951 - DNA, 18 bp, Homo sapiens
ctgcacacataacacaca

SEQ ID NO: 5405952 - DNA, 17 bp, Homo sapiens
ctgcacaccaaggccct

SEQ ID NO: 5405953 - DNA, 19 bp, Homo sapiens
ctgcacaccagagacaagc

SEQ ID NO: 5405954 - DNA, 16 bp, Homo sapiens
ctgcacacccctgcac

SEQ ID NO: 5405955 - DNA, 21 bp, Homo sapiens
ctgcacacccctgcacacacc

SEQ ID NO: 5405956 - DNA, 20 bp, Homo sapiens
ctgcacaccgtccctctccc

SEQ ID NO: 5405957 - DNA, 20 bp, Homo sapiens
ctgcacacgctccttcctct

SEQ ID NO: 5405958 - DNA, 17 bp, Homo sapiens
ctgcacacggcacagag

SEQ ID NO: 5405959 - DNA, 16 bp, Homo sapiens
ctgcacactatttccc

SEQ ID NO: 5405960 - DNA, 14 bp, Homo sapiens
ctgcacactcagtg

SEQ ID NO: 5405961 - DNA, 15 bp, Homo sapiens
ctgcacactcagtgg

SEQ ID NO: 5405962 - DNA, 16 bp, Homo sapiens
ctgcacactcagtggg

SEQ ID NO: 5405963 - DNA, 14 bp, Homo sapiens
ctgcacactccagg

SEQ ID NO: 5405964 - DNA, 18 bp, Homo sapiens
ctgcacactctcttctcc

SEQ ID NO: 5405965 - DNA, 17 bp, Homo sapiens
ctgcacactgcacattt

SEQ ID NO: 5405966 - DNA, 17 bp, Homo sapiens
ctgcacagaaacttgaa

SEQ ID NO: 5405967 - DNA, 13 bp, Homo sapiens
ctgcacagaaggg

SEQ ID NO: 5405968 - DNA, 19 bp, Homo sapiens
ctgcacagacaagcagccc

SEQ ID NO: 5405969 - DNA, 21 bp, Homo sapiens
ctgcacagagcaagtcctcac

SEQ ID NO: 5405970 - DNA, 21 bp, Homo sapiens
ctgcacagagctctccagctc

SEQ ID NO: 5405971 - DNA, 23 bp, Homo sapiens
ctgcacagatacctcatcatcca

SEQ ID NO: 5405972 - DNA, 20 bp, Homo sapiens
ctgcacagatggatttgcct

SEQ ID NO: 5405973 - DNA, 23 bp, Homo sapiens
ctgcacagatggatttgcctgtg

SEQ ID NO: 5405974 - DNA, 17 bp, Homo sapiens
ctgcacagattcccagg

SEQ ID NO: 5405975 - DNA, 20 bp, Homo sapiens
ctgcacagattcccaggcca

SEQ ID NO: 5405976 - DNA, 21 bp, Homo sapiens
ctgcacagattcccaggccag

SEQ ID NO: 5405977 - DNA, 22 bp, Homo sapiens
ctgcacagcaggctgccagtgc

SEQ ID NO: 5405978 - DNA, 13 bp, Homo sapiens
ctgcacagcggcc

SEQ ID NO: 5405979 - DNA, 13 bp, Homo sapiens
ctgcacaggcagc

SEQ ID NO: 5405980 - DNA, 18 bp, Homo sapiens
ctgcacaggccctgggga

SEQ ID NO: 5405981 - DNA, 12 bp, Homo sapiens
ctgcacaggctt

SEQ ID NO: 5405982 - DNA, 21 bp, Homo sapiens
ctgcacaggcttgctgtatga

SEQ ID NO: 5405983 - DNA, 17 bp, Homo sapiens
ctgcacagggcagctgg

SEQ ID NO: 5405984 - DNA, 22 bp, Homo sapiens
ctgcacagggcagctgggccca

SEQ ID NO: 5405985 - DNA, 17 bp, Homo sapiens
ctgcacagggccctctg

SEQ ID NO: 5405986 - DNA, 13 bp, Homo sapiens
ctgcacagggtcc

SEQ ID NO: 5405987 - DNA, 22 bp, Homo sapiens
ctgcacagggtttggcccaagt

SEQ ID NO: 5405988 - DNA, 16 bp, Homo sapiens
ctgcacaggtctctgt

SEQ ID NO: 5405989 - DNA, 17 bp, Homo sapiens
ctgcacagtcagaagga

SEQ ID NO: 5405990 - DNA, 14 bp, Homo sapiens
ctgcacagtgactt

SEQ ID NO: 5405991 - DNA, 19 bp, Homo sapiens
ctgcacagtgacttctgag

SEQ ID NO: 5405992 - DNA, 21 bp, Homo sapiens
ctgcacagtgacttctgagat

SEQ ID NO: 5405993 - DNA, 15 bp, Homo sapiens
ctgcacagtggtcca

SEQ ID NO: 5405994 - DNA, 24 bp, Homo sapiens
ctgcacagtttagaacagagggac

SEQ ID NO: 5405995 - DNA, 14 bp, Homo sapiens
ctgcacataaactc

SEQ ID NO: 5405996 - DNA, 13 bp, Homo sapiens
ctgcacatacaga

SEQ ID NO: 5405997 - DNA, 20 bp, Homo sapiens
ctgcacatcatgagccttca

SEQ ID NO: 5405998 - DNA, 22 bp, Homo sapiens
ctgcacatgaatcccacccaca

SEQ ID NO: 5405999 - DNA, 22 bp, Homo sapiens
ctgcacatgactcgggggtggg

SEQ ID NO: 5406000 - DNA, 18 bp, Homo sapiens
ctgcacatgagtggaaat

SEQ ID NO: 5406001 - DNA, 17 bp, Homo sapiens
ctgcacatgatttcaca

SEQ ID NO: 5406002 - DNA, 20 bp, Homo sapiens
ctgcacatgcagctgcaccc

SEQ ID NO: 5406003 - DNA, 18 bp, Homo sapiens
ctgcacatggacagactt

SEQ ID NO: 5406004 - DNA, 21 bp, Homo sapiens
ctgcacatggacagacttcac

SEQ ID NO: 5406005 - DNA, 15 bp, Homo sapiens
ctgcacatggcctga

SEQ ID NO: 5406006 - DNA, 16 bp, Homo sapiens
ctgcacatggcctgag

SEQ ID NO: 5406007 - DNA, 14 bp, Homo sapiens
ctgcacatgtcttg

SEQ ID NO: 5406008 - DNA, 21 bp, Homo sapiens
ctgcacatgtcttgtacatgt

SEQ ID NO: 5406009 - DNA, 12 bp, Homo sapiens
ctgcacattcct

SEQ ID NO: 5406010 - DNA, 13 bp, Homo sapiens
ctgcacattcctg

SEQ ID NO: 5406011 - DNA, 18 bp, Homo sapiens
ctgcacattcctggcccc

SEQ ID NO: 5406012 - DNA, 16 bp, Homo sapiens
ctgcacattgcctgtt

SEQ ID NO: 5406013 - DNA, 21 bp, Homo sapiens
ctgcaccaacccagccgctgc

SEQ ID NO: 5406014 - DNA, 22 bp, Homo sapiens
ctgcaccaacctcactgccctc

SEQ ID NO: 5406015 - DNA, 17 bp, Homo sapiens
ctgcaccacacctggca

SEQ ID NO: 5406016 - DNA, 19 bp, Homo sapiens
ctgcaccaccatgcccagc

SEQ ID NO: 5406017 - DNA, 20 bp, Homo sapiens
ctgcaccaccgaccaactcc

SEQ ID NO: 5406018 - DNA, 12 bp, Homo sapiens
ctgcaccagagc

SEQ ID NO: 5406019 - DNA, 18 bp, Homo sapiens
ctgcaccagcccttccct

SEQ ID NO: 5406020 - DNA, 23 bp, Homo sapiens
ctgcaccagcccttccctgcttt

SEQ ID NO: 5406021 - DNA, 13 bp, Homo sapiens
ctgcaccaggaga

SEQ ID NO: 5406022 - DNA, 17 bp, Homo sapiens
ctgcaccaggagacaga

SEQ ID NO: 5406023 - DNA, 23 bp, Homo sapiens
ctgcaccaggggtgcacaataaa

SEQ ID NO: 5406024 - DNA, 22 bp, Homo sapiens
ctgcaccaggtagaacgccagg

SEQ ID NO: 5406025 - DNA, 19 bp, Homo sapiens
ctgcaccatgctgctgggg

SEQ ID NO: 5406026 - DNA, 23 bp, Homo sapiens
ctgcaccatgctgctggggaaga

SEQ ID NO: 5406027 - DNA, 14 bp, Homo sapiens
ctgcaccattgctg

SEQ ID NO: 5406028 - DNA, 18 bp, Homo sapiens
ctgcaccatttaaaaaca

SEQ ID NO: 5406029 - DNA, 12 bp, Homo sapiens
ctgcacccaact

SEQ ID NO: 5406030 - DNA, 12 bp, Homo sapiens
ctgcacccaccc

SEQ ID NO: 5406031 - DNA, 19 bp, Homo sapiens
ctgcacccacccctgccca

SEQ ID NO: 5406032 - DNA, 19 bp, Homo sapiens
ctgcacccagcagtgtcac

SEQ ID NO: 5406033 - DNA, 13 bp, Homo sapiens
ctgcacccagctc

SEQ ID NO: 5406034 - DNA, 12 bp, Homo sapiens
ctgcaccccaca

SEQ ID NO: 5406035 - DNA, 21 bp, Homo sapiens
ctgcaccccagcattccagct

SEQ ID NO: 5406036 - DNA, 16 bp, Homo sapiens
ctgcacccccctgggc

SEQ ID NO: 5406037 - DNA, 20 bp, Homo sapiens
ctgcacccccctgtgcctgc

SEQ ID NO: 5406038 - DNA, 13 bp, Homo sapiens
ctgcaccccctcc

SEQ ID NO: 5406039 - DNA, 20 bp, Homo sapiens
ctgcaccccctcctgctgca

SEQ ID NO: 5406040 - DNA, 23 bp, Homo sapiens
ctgcacccctgagttgggcagcc

SEQ ID NO: 5406041 - DNA, 15 bp, Homo sapiens
ctgcacccctgggcc

SEQ ID NO: 5406042 - DNA, 16 bp, Homo sapiens
ctgcacccctgggcca

SEQ ID NO: 5406043 - DNA, 23 bp, Homo sapiens
ctgcacccctggtgtccctgcct

SEQ ID NO: 5406044 - DNA, 16 bp, Homo sapiens
ctgcaccccttcctgg

SEQ ID NO: 5406045 - DNA, 22 bp, Homo sapiens
ctgcaggtcaagttgtcaggtt

SEQ ID NO: 5406046 - DNA, 19 bp, Homo sapiens
ctgcaggtcagttgtaata

SEQ ID NO: 5406047 - DNA, 19 bp, Homo sapiens
ctgcaggtccctaataaag

SEQ ID NO: 5406048 - DNA, 20 bp, Homo sapiens
ctgcaggtccctaataaagc

SEQ ID NO: 5406049 - DNA, 23 bp, Homo sapiens
ctgcaggtccctaataaagctgt

SEQ ID NO: 5406050 - DNA, 18 bp, Homo sapiens
ctgcaggtccggggagga

SEQ ID NO: 5406051 - DNA, 14 bp, Homo sapiens
ctgcaggtgccagg

SEQ ID NO: 5406052 - DNA, 17 bp, Homo sapiens
ctgcaggtgctgctgcg

SEQ ID NO: 5406053 - DNA, 17 bp, Homo sapiens
ctgcaggtggcctccct

SEQ ID NO: 5406054 - DNA, 20 bp, Homo sapiens
ctgcaggtggcctccctcca

SEQ ID NO: 5406055 - DNA, 22 bp, Homo sapiens
ctgcaggtggcctccctccaga

SEQ ID NO: 5406056 - DNA, 22 bp, Homo sapiens
ctgcaggtgggctgggcccacc

SEQ ID NO: 5406057 - DNA, 23 bp, Homo sapiens
ctgcaggttctctctcactgcca

SEQ ID NO: 5406058 - DNA, 20 bp, Homo sapiens
ctgcaggttcttcttcctga

SEQ ID NO: 5406059 - DNA, 21 bp, Homo sapiens
ctgcaggttcttcttcctgaa

SEQ ID NO: 5406060 - DNA, 19 bp, Homo sapiens
ctgcaggttgaagccatgt

SEQ ID NO: 5406061 - DNA, 17 bp, Homo sapiens
ctgcaggttggacccca

SEQ ID NO: 5406062 - DNA, 15 bp, Homo sapiens
ctgcaggttgggcca

SEQ ID NO: 5406063 - DNA, 20 bp, Homo sapiens
ctgcaggttgggccatactg

SEQ ID NO: 5406064 - DNA, 17 bp, Homo sapiens
ctgcagtaacactggcc

SEQ ID NO: 5406065 - DNA, 23 bp, Homo sapiens
ctgcagtaacactggccttccct

SEQ ID NO: 5406066 - DNA, 20 bp, Homo sapiens
ctgcagtaatctccagggcc

SEQ ID NO: 5406067 - DNA, 21 bp, Homo sapiens
ctgcagtacatacgtctgcca

SEQ ID NO: 5406068 - DNA, 16 bp, Homo sapiens
ctgcagtagaaggtgc

SEQ ID NO: 5406069 - DNA, 23 bp, Homo sapiens
ctgcagtagtctctgtgctttga

SEQ ID NO: 5406070 - DNA, 16 bp, Homo sapiens
ctgcagtatgaaaata

SEQ ID NO: 5406071 - DNA, 20 bp, Homo sapiens
ctgcagtatggccatgggct

SEQ ID NO: 5406072 - DNA, 21 bp, Homo sapiens
ctgcagtattctgtagccaac

SEQ ID NO: 5406073 - DNA, 13 bp, Homo sapiens
ctgcagtcacagc

SEQ ID NO: 5406074 - DNA, 18 bp, Homo sapiens
ctgcagtcacccctgtct

SEQ ID NO: 5406075 - DNA, 23 bp, Homo sapiens
ctgcagtcacgtgaggcccctgt

SEQ ID NO: 5406076 - DNA, 15 bp, Homo sapiens
ctgcagtcagcacag

SEQ ID NO: 5406077 - DNA, 16 bp, Homo sapiens
ctgcagtcagcacaga

SEQ ID NO: 5406078 - DNA, 15 bp, Homo sapiens
ctgcagtcagccctg

SEQ ID NO: 5406079 - DNA, 23 bp, Homo sapiens
ctgcagtcatctcccctcctggc

SEQ ID NO: 5406080 - DNA, 15 bp, Homo sapiens
ctgcagtcccacact

SEQ ID NO: 5406081 - DNA, 23 bp, Homo sapiens
ctgcagtcccagcggtgggacct

SEQ ID NO: 5406082 - DNA, 21 bp, Homo sapiens
ctgcagtccgcagtctggcct

SEQ ID NO: 5406083 - DNA, 23 bp, Homo sapiens
ctgcagtccgtgtggatccaatg

SEQ ID NO: 5406084 - DNA, 20 bp, Homo sapiens
ctgcagtcctcggcagctcc

SEQ ID NO: 5406085 - DNA, 12 bp, Homo sapiens
ctgcagtcctgg

SEQ ID NO: 5406086 - DNA, 17 bp, Homo sapiens
ctgcagtcctggccccc

SEQ ID NO: 5406087 - DNA, 16 bp, Homo sapiens
ctgcagtcctggtggg

SEQ ID NO: 5406088 - DNA, 19 bp, Homo sapiens
ctgcagtcgcttgccaaag

SEQ ID NO: 5406089 - DNA, 20 bp, Homo sapiens
ctgcagtcgcttgccaaagc

SEQ ID NO: 5406090 - DNA, 21 bp, Homo sapiens
ctgcagtcgcttgccaaagca

SEQ ID NO: 5406091 - DNA, 16 bp, Homo sapiens
ctgcagtcggcatgcc

SEQ ID NO: 5406092 - DNA, 17 bp, Homo sapiens
ctgcagtctcatttctc

SEQ ID NO: 5406093 - DNA, 20 bp, Homo sapiens
ctgcagtctccgcctcctga

SEQ ID NO: 5406094 - DNA, 22 bp, Homo sapiens
ctgcagtctccgcctcctgagt

SEQ ID NO: 5406095 - DNA, 21 bp, Homo sapiens
ctgcagtctgtggagcgtcct

SEQ ID NO: 5406096 - DNA, 17 bp, Homo sapiens
ctgcagtcttctctctg

SEQ ID NO: 5406097 - DNA, 19 bp, Homo sapiens
ctgcagtcttctctctggc

SEQ ID NO: 5406098 - DNA, 22 bp, Homo sapiens
ctgcagtcttctctctggctca

SEQ ID NO: 5406099 - DNA, 22 bp, Homo sapiens
ctgcagtctttatttttttccc

SEQ ID NO: 5406100 - DNA, 22 bp, Homo sapiens
ctgcagtgaaagacaagctgca

SEQ ID NO: 5406101 - DNA, 15 bp, Homo sapiens
ctgcagtgagccatg

SEQ ID NO: 5406102 - DNA, 15 bp, Homo sapiens
ctgcagtgagctgtg

SEQ ID NO: 5406103 - DNA, 16 bp, Homo sapiens
ctgcagtgaggggaga

SEQ ID NO: 5406104 - DNA, 17 bp, Homo sapiens
ctgcagtgaggggccct

SEQ ID NO: 5406105 - DNA, 17 bp, Homo sapiens
ctgcagtgattcagcag

SEQ ID NO: 5406106 - DNA, 18 bp, Homo sapiens
ctgcagtgattcagcagg

SEQ ID NO: 5406107 - DNA, 11 bp, Homo sapiens
ctgcagtgcca

SEQ ID NO: 5406108 - DNA, 17 bp, Homo sapiens
ctgcagtggcaaatggt

SEQ ID NO: 5406109 - DNA, 18 bp, Homo sapiens
ctgcagtggctcccctgc

SEQ ID NO: 5406110 - DNA, 18 bp, Homo sapiens
ctgcagtggtgtgaaaca

SEQ ID NO: 5406111 - DNA, 14 bp, Homo sapiens
ctgcagtgtgagat

SEQ ID NO: 5406112 - DNA, 15 bp, Homo sapiens
ctgcagtgtgagatt

SEQ ID NO: 5406113 - DNA, 14 bp, Homo sapiens
ctgcagtgtgcccc

SEQ ID NO: 5406114 - DNA, 14 bp, Homo sapiens
ctgcagtgttattt

SEQ ID NO: 5406115 - DNA, 17 bp, Homo sapiens
ctgcagtgttcgcttgg

SEQ ID NO: 5406116 - DNA, 19 bp, Homo sapiens
ctgcagtgttcgcttggct

SEQ ID NO: 5406117 - DNA, 14 bp, Homo sapiens
ctgcagttaattag

SEQ ID NO: 5406118 - DNA, 21 bp, Homo sapiens
ctgcagttaattagcattctg

SEQ ID NO: 5406119 - DNA, 15 bp, Homo sapiens
ctgcagttacttttg

SEQ ID NO: 5406120 - DNA, 23 bp, Homo sapiens
ctgcagttatttaccagaagttt

SEQ ID NO: 5406121 - DNA, 21 bp, Homo sapiens
ctgcagttcatccgcactgta

SEQ ID NO: 5406122 - DNA, 15 bp, Homo sapiens
ctgcagttcccctgg

SEQ ID NO: 5406123 - DNA, 17 bp, Homo sapiens
ctgcagttcccctggaa

SEQ ID NO: 5406124 - DNA, 14 bp, Homo sapiens
ctgcagttcctgag

SEQ ID NO: 5406125 - DNA, 20 bp, Homo sapiens
ctgcagttctcatgactcct

SEQ ID NO: 5406126 - DNA, 14 bp, Homo sapiens
ctgcagttcttgtg

SEQ ID NO: 5406127 - DNA, 19 bp, Homo sapiens
ctgcagttcttgtggaaga

SEQ ID NO: 5406128 - DNA, 18 bp, Homo sapiens
ctgcagttggcctcagca

SEQ ID NO: 5406129 - DNA, 17 bp, Homo sapiens
ctgcagttgtgaaagca

SEQ ID NO: 5406130 - DNA, 16 bp, Homo sapiens
ctgcagtttcctggaa

SEQ ID NO: 5406131 - DNA, 23 bp, Homo sapiens
ctgcagtttcttgtgtagatttg

SEQ ID NO: 5406132 - DNA, 17 bp, Homo sapiens
ctgcagtttggccctgg

SEQ ID NO: 5406133 - DNA, 19 bp, Homo sapiens
ctgcagtttggccctggag

SEQ ID NO: 5406134 - DNA, 22 bp, Homo sapiens
ctgcagtttggccctggagcca

SEQ ID NO: 5406135 - DNA, 19 bp, Homo sapiens
ctgcagtttgggagacatg

SEQ ID NO: 5406136 - DNA, 14 bp, Homo sapiens
ctgcagtttgtgaa

SEQ ID NO: 5406137 - DNA, 18 bp, Homo sapiens
ctgcagtttgtgaacttc

SEQ ID NO: 5406138 - DNA, 15 bp, Homo sapiens
ctgcagttttgctat

SEQ ID NO: 5406139 - DNA, 14 bp, Homo sapiens
ctgcagtttttaat

SEQ ID NO: 5406140 - DNA, 17 bp, Homo sapiens
ctgcagtttttaatttg

SEQ ID NO: 5406141 - DNA, 14 bp, Homo sapiens
ctgcagtttttcag

SEQ ID NO: 5406142 - DNA, 15 bp, Homo sapiens
ctgcagtttttcagg

SEQ ID NO: 5406143 - DNA, 17 bp, Homo sapiens
ctgcagtttttcccaag

SEQ ID NO: 5406144 - DNA, 18 bp, Homo sapiens
ctgcataaacttcatctt

SEQ ID NO: 5406145 - DNA, 15 bp, Homo sapiens
ctgcataaatttgta

SEQ ID NO: 5406146 - DNA, 18 bp, Homo sapiens
ctgcataaatttgtaata

SEQ ID NO: 5406147 - DNA, 21 bp, Homo sapiens
ctgcataaatttgtaatatat

SEQ ID NO: 5406148 - DNA, 14 bp, Homo sapiens
ctgcataaccgcac

SEQ ID NO: 5406149 - DNA, 15 bp, Homo sapiens
ctgcataagattata

SEQ ID NO: 5406150 - DNA, 14 bp, Homo sapiens
ctgcataagtaatt

SEQ ID NO: 5406151 - DNA, 14 bp, Homo sapiens
ctgcataatgtccc

SEQ ID NO: 5406152 - DNA, 17 bp, Homo sapiens
ctgcatacaggggaggg

SEQ ID NO: 5406153 - DNA, 15 bp, Homo sapiens
ctgcataccaacctg

SEQ ID NO: 5406154 - DNA, 20 bp, Homo sapiens
ctgcatactttgacaaggaa

SEQ ID NO: 5406155 - DNA, 21 bp, Homo sapiens
ctgcatactttgacaaggaaa

SEQ ID NO: 5406156 - DNA, 22 bp, Homo sapiens
ctgcatactttgacaaggaaaa

SEQ ID NO: 5406157 - DNA, 14 bp, Homo sapiens
ctgcatacttttta

SEQ ID NO: 5406158 - DNA, 13 bp, Homo sapiens
ctgcatagccggt

SEQ ID NO: 5406159 - DNA, 20 bp, Homo sapiens
ctgcatagcgaaataaaaat

SEQ ID NO: 5406160 - DNA, 19 bp, Homo sapiens
ctgcatagctctattttaa

SEQ ID NO: 5406161 - DNA, 13 bp, Homo sapiens
ctgcatagctttt

SEQ ID NO: 5406162 - DNA, 14 bp, Homo sapiens
ctgcataggaattt

SEQ ID NO: 5406163 - DNA, 22 bp, Homo sapiens
ctgcataggagtttggaggaag

SEQ ID NO: 5406164 - DNA, 18 bp, Homo sapiens
ctgcataggctccttcct

SEQ ID NO: 5406165 - DNA, 20 bp, Homo sapiens
ctgcataggctccttcctgt

SEQ ID NO: 5406166 - DNA, 17 bp, Homo sapiens
ctgcatatatgtctctt

SEQ ID NO: 5406167 - DNA, 17 bp, Homo sapiens
ctgcatatcggaggtgg

SEQ ID NO: 5406168 - DNA, 19 bp, Homo sapiens
ctgcatatcggaggtggtg

SEQ ID NO: 5406169 - DNA, 21 bp, Homo sapiens
ctgcatatcggaggtggtgga

SEQ ID NO: 5406170 - DNA, 23 bp, Homo sapiens
ctgcatatcggaggtggtggagg

SEQ ID NO: 5406171 - DNA, 14 bp, Homo sapiens
ctgcatatcttcat

SEQ ID NO: 5406172 - DNA, 13 bp, Homo sapiens
ctgcatatgcttc

SEQ ID NO: 5406173 - DNA, 16 bp, Homo sapiens
ctgcatatgcttctga

SEQ ID NO: 5406174 - DNA, 17 bp, Homo sapiens
ctgcatatgcttctgat

SEQ ID NO: 5406175 - DNA, 21 bp, Homo sapiens
ctgcatatgttgaatactttt

SEQ ID NO: 5406176 - DNA, 14 bp, Homo sapiens
ctgcatatttctgt

SEQ ID NO: 5406177 - DNA, 16 bp, Homo sapiens
ctgcatcaagacttca

SEQ ID NO: 5406178 - DNA, 17 bp, Homo sapiens
ctgcatcagcctctggc

SEQ ID NO: 5406179 - DNA, 22 bp, Homo sapiens
ctgcatcagctttttgtattaa

SEQ ID NO: 5406180 - DNA, 13 bp, Homo sapiens
ctgcatcatctgt

SEQ ID NO: 5406181 - DNA, 23 bp, Homo sapiens
ctgcatcattccccgacactgcc

SEQ ID NO: 5406182 - DNA, 22 bp, Homo sapiens
ctgcatccagagattcattttc

SEQ ID NO: 5406183 - DNA, 13 bp, Homo sapiens
ctgcatccagcct

SEQ ID NO: 5406184 - DNA, 16 bp, Homo sapiens
ctgcatccaggcctga

SEQ ID NO: 5406185 - DNA, 19 bp, Homo sapiens
ctgcatcccacgttctgtt

SEQ ID NO: 5406186 - DNA, 15 bp, Homo sapiens
ctgcatcccagcacc

SEQ ID NO: 5406187 - DNA, 20 bp, Homo sapiens
ctgcatcccagcacctgcct

SEQ ID NO: 5406188 - DNA, 21 bp, Homo sapiens
ctgcatcccagcacctgcctc

SEQ ID NO: 5406189 - DNA, 22 bp, Homo sapiens
ctgcatcccaggatgctgggtg

SEQ ID NO: 5406190 - DNA, 19 bp, Homo sapiens
ctgcatcccattgctagca

SEQ ID NO: 5406191 - DNA, 12 bp, Homo sapiens
ctgcatcccctt

SEQ ID NO: 5406192 - DNA, 13 bp, Homo sapiens
ctgcatccccttc

SEQ ID NO: 5406193 - DNA, 15 bp, Homo sapiens
ctgcatccccttcca

SEQ ID NO: 5406194 - DNA, 16 bp, Homo sapiens
ctgcatccccttccag

SEQ ID NO: 5406195 - DNA, 20 bp, Homo sapiens
ctgcatccccttccagctcc

SEQ ID NO: 5406196 - DNA, 22 bp, Homo sapiens
ctgcatccccttccagctccct

SEQ ID NO: 5406197 - DNA, 16 bp, Homo sapiens
ctgcatccccttggct

SEQ ID NO: 5406198 - DNA, 22 bp, Homo sapiens
ctgcatcccgatacctcagccc

SEQ ID NO: 5406199 - DNA, 23 bp, Homo sapiens
ctgcatccctgtgtccactgaga

SEQ ID NO: 5406200 - DNA, 15 bp, Homo sapiens
ctgcatcccttggcc

SEQ ID NO: 5406201 - DNA, 18 bp, Homo sapiens
ctgcatcccttggcccct

SEQ ID NO: 5406202 - DNA, 22 bp, Homo sapiens
ctgcatcccttggcccctctct

SEQ ID NO: 5406203 - DNA, 20 bp, Homo sapiens
ctgcatccgtagttccctga

SEQ ID NO: 5406204 - DNA, 20 bp, Homo sapiens
ctgcatcctactcctacctg

SEQ ID NO: 5406205 - DNA, 21 bp, Homo sapiens
ctgcatcctactcctacctgg

SEQ ID NO: 5406206 - DNA, 14 bp, Homo sapiens
ctgcatcctcagcc

SEQ ID NO: 5406207 - DNA, 20 bp, Homo sapiens
ctgcatcctcagccccaggg

SEQ ID NO: 5406208 - DNA, 21 bp, Homo sapiens
ctgcatcctcagccccagggc

SEQ ID NO: 5406209 - DNA, 22 bp, Homo sapiens
ctgcatcctcagccccagggcc

SEQ ID NO: 5406210 - DNA, 19 bp, Homo sapiens
ctgcatcctccgcctcccg

SEQ ID NO: 5406211 - DNA, 20 bp, Homo sapiens
ctgcatcctccgcctcccgg

SEQ ID NO: 5406212 - DNA, 13 bp, Homo sapiens
ctgcatcctgagg

SEQ ID NO: 5406213 - DNA, 15 bp, Homo sapiens
ctgcatcctgaggcc

SEQ ID NO: 5406214 - DNA, 16 bp, Homo sapiens
ctgcatccttcctggg

SEQ ID NO: 5406215 - DNA, 18 bp, Homo sapiens
ctgcatccttcctgggga

SEQ ID NO: 5406216 - DNA, 19 bp, Homo sapiens
ctgcatccttcctggggac

SEQ ID NO: 5406217 - DNA, 22 bp, Homo sapiens
ctgcatcgctgttctgggcatg

SEQ ID NO: 5406218 - DNA, 16 bp, Homo sapiens
ctgcatcgtttcatct

SEQ ID NO: 5406219 - DNA, 17 bp, Homo sapiens
ctgcatctaagcccatg

SEQ ID NO: 5406220 - DNA, 14 bp, Homo sapiens
ctgccagcccagaa

SEQ ID NO: 5406221 - DNA, 16 bp, Homo sapiens
ctgccagcccagaaca

SEQ ID NO: 5406222 - DNA, 18 bp, Homo sapiens
ctgccagcccagaacacc

SEQ ID NO: 5406223 - DNA, 16 bp, Homo sapiens
ctgccagcccagctgg

SEQ ID NO: 5406224 - DNA, 19 bp, Homo sapiens
ctgccagcccagctggccg

SEQ ID NO: 5406225 - DNA, 17 bp, Homo sapiens
ctgccagccccacacag

SEQ ID NO: 5406226 - DNA, 21 bp, Homo sapiens
ctgccagccccgccacgcttg

SEQ ID NO: 5406227 - DNA, 22 bp, Homo sapiens
ctgccagcccggctcggcccag

SEQ ID NO: 5406228 - DNA, 13 bp, Homo sapiens
ctgccagccgcca

SEQ ID NO: 5406229 - DNA, 14 bp, Homo sapiens
ctgccagccgccac

SEQ ID NO: 5406230 - DNA, 21 bp, Homo sapiens
ctgccagccgctggtgcccac

SEQ ID NO: 5406231 - DNA, 11 bp, Homo sapiens
ctgccagcctg

SEQ ID NO: 5406232 - DNA, 14 bp, Homo sapiens
ctgccagcctgagc

SEQ ID NO: 5406233 - DNA, 15 bp, Homo sapiens
ctgccagcctgagcg

SEQ ID NO: 5406234 - DNA, 16 bp, Homo sapiens
ctgccagcctgagcgg

SEQ ID NO: 5406235 - DNA, 20 bp, Homo sapiens
ctgccagcctgaggtgccca

SEQ ID NO: 5406236 - DNA, 12 bp, Homo sapiens
ctgccagcctgg

SEQ ID NO: 5406237 - DNA, 19 bp, Homo sapiens
ctgccagcctggcttctgg

SEQ ID NO: 5406238 - DNA, 20 bp, Homo sapiens
ctgccagcctggcttctgga

SEQ ID NO: 5406239 - DNA, 20 bp, Homo sapiens
ctgccagccttgagccctgg

SEQ ID NO: 5406240 - DNA, 22 bp, Homo sapiens
ctgccagccttgagccctggct

SEQ ID NO: 5406241 - DNA, 19 bp, Homo sapiens
ctgccagcggtttcctggt

SEQ ID NO: 5406242 - DNA, 12 bp, Homo sapiens
ctgccagctcca

SEQ ID NO: 5406243 - DNA, 17 bp, Homo sapiens
ctgccagctctgtatca

SEQ ID NO: 5406244 - DNA, 18 bp, Homo sapiens
ctgccagctctgtcaccc

SEQ ID NO: 5406245 - DNA, 23 bp, Homo sapiens
ctgccagctctgtcaccctggcc

SEQ ID NO: 5406246 - DNA, 12 bp, Homo sapiens
ctgccagctctt

SEQ ID NO: 5406247 - DNA, 17 bp, Homo sapiens
ctgccagctcttcctag

SEQ ID NO: 5406248 - DNA, 11 bp, Homo sapiens
ctgccagctgc

SEQ ID NO: 5406249 - DNA, 13 bp, Homo sapiens
ctgccagctgcac

SEQ ID NO: 5406250 - DNA, 19 bp, Homo sapiens
ctgccagctggatcgctgc

SEQ ID NO: 5406251 - DNA, 14 bp, Homo sapiens
ctgccagctgggcc

SEQ ID NO: 5406252 - DNA, 18 bp, Homo sapiens
ctgccagctgggcccagc

SEQ ID NO: 5406253 - DNA, 20 bp, Homo sapiens
ctgccagctgggcccagcac

SEQ ID NO: 5406254 - DNA, 15 bp, Homo sapiens
ctgccagcttcaggt

SEQ ID NO: 5406255 - DNA, 17 bp, Homo sapiens
ctgccagcttcaggtga

SEQ ID NO: 5406256 - DNA, 16 bp, Homo sapiens
ctgccagcttgtgagc

SEQ ID NO: 5406257 - DNA, 13 bp, Homo sapiens
ctgccaggaagcc

SEQ ID NO: 5406258 - DNA, 21 bp, Homo sapiens
ctgccaggaagccagcaggct

SEQ ID NO: 5406259 - DNA, 10 bp, Homo sapiens
ctgccaggac

SEQ ID NO: 5406260 - DNA, 16 bp, Homo sapiens
ctgccaggacacctgc

SEQ ID NO: 5406261 - DNA, 18 bp, Homo sapiens
ctgccaggacacctgccc

SEQ ID NO: 5406262 - DNA, 20 bp, Homo sapiens
ctgccaggacacctgcccca

SEQ ID NO: 5406263 - DNA, 21 bp, Homo sapiens
ctgccaggacacctgccccag

SEQ ID NO: 5406264 - DNA, 22 bp, Homo sapiens
ctgccaggacccaccactggaa

SEQ ID NO: 5406265 - DNA, 23 bp, Homo sapiens
ctgccaggacccaccactggaag

SEQ ID NO: 5406266 - DNA, 11 bp, Homo sapiens
ctgccaggaga

SEQ ID NO: 5406267 - DNA, 17 bp, Homo sapiens
ctgccaggagcagcctc

SEQ ID NO: 5406268 - DNA, 23 bp, Homo sapiens
ctgccaggaggacccagggctct

SEQ ID NO: 5406269 - DNA, 16 bp, Homo sapiens
ctgccaggaggctgcg

SEQ ID NO: 5406270 - DNA, 19 bp, Homo sapiens
ctgccaggaggctgcggcc

SEQ ID NO: 5406271 - DNA, 19 bp, Homo sapiens
ctgccaggcaacttttaaa

SEQ ID NO: 5406272 - DNA, 21 bp, Homo sapiens
ctgccaggcaacttttaaagc

SEQ ID NO: 5406273 - DNA, 16 bp, Homo sapiens
ctgccaggcacacaca

SEQ ID NO: 5406274 - DNA, 22 bp, Homo sapiens
ctgccaggcacacacagcccct

SEQ ID NO: 5406275 - DNA, 15 bp, Homo sapiens
ctgccaggcacaggc

SEQ ID NO: 5406276 - DNA, 18 bp, Homo sapiens
ctgccaggcacaggcagg

SEQ ID NO: 5406277 - DNA, 19 bp, Homo sapiens
ctgccaggcacaggcaggg

SEQ ID NO: 5406278 - DNA, 21 bp, Homo sapiens
ctgccaggcaccatctgccaa

SEQ ID NO: 5406279 - DNA, 14 bp, Homo sapiens
ctgccaggcacctg

SEQ ID NO: 5406280 - DNA, 18 bp, Homo sapiens
ctgccaggcacctggcct

SEQ ID NO: 5406281 - DNA, 21 bp, Homo sapiens
ctgccaggcacctggcctgct

SEQ ID NO: 5406282 - DNA, 17 bp, Homo sapiens
ctgccaggcactctcat

SEQ ID NO: 5406283 - DNA, 23 bp, Homo sapiens
ctgccaggcactgttcatctcag

SEQ ID NO: 5406284 - DNA, 13 bp, Homo sapiens
ctgccaggcaggg

SEQ ID NO: 5406285 - DNA, 13 bp, Homo sapiens
ctgccaggccagc

SEQ ID NO: 5406286 - DNA, 16 bp, Homo sapiens
ctgccaggccagcctc

SEQ ID NO: 5406287 - DNA, 18 bp, Homo sapiens
ctgccaggccagcctccg

SEQ ID NO: 5406288 - DNA, 20 bp, Homo sapiens
ctgccaggccagcctccgag

SEQ ID NO: 5406289 - DNA, 16 bp, Homo sapiens
ctgccaggcccatctc

SEQ ID NO: 5406290 - DNA, 18 bp, Homo sapiens
ctgccaggcccatctcag

SEQ ID NO: 5406291 - DNA, 20 bp, Homo sapiens
ctgccaggcccatctcaggt

SEQ ID NO: 5406292 - DNA, 22 bp, Homo sapiens
ctgccaggcccccaagcctgca

SEQ ID NO: 5406293 - DNA, 21 bp, Homo sapiens
ctgccaggcccccaccacaca

SEQ ID NO: 5406294 - DNA, 12 bp, Homo sapiens
ctgccaggcccg

SEQ ID NO: 5406295 - DNA, 16 bp, Homo sapiens
ctgccaggccctccag

SEQ ID NO: 5406296 - DNA, 17 bp, Homo sapiens
ctgccaggcctccctcg

SEQ ID NO: 5406297 - DNA, 21 bp, Homo sapiens
ctgccaggcctccctcgggct

SEQ ID NO: 5406298 - DNA, 17 bp, Homo sapiens
ctgccaggcggccctgg

SEQ ID NO: 5406299 - DNA, 22 bp, Homo sapiens
ctgccaggcggccctggggagg

SEQ ID NO: 5406300 - DNA, 14 bp, Homo sapiens
ctgccaggcgttgg

SEQ ID NO: 5406301 - DNA, 23 bp, Homo sapiens
ctgccaggcgttggtgccacttc

SEQ ID NO: 5406302 - DNA, 22 bp, Homo sapiens
ctgccaggctcccactgcccct

SEQ ID NO: 5406303 - DNA, 17 bp, Homo sapiens
ctgccaggctctccctc

SEQ ID NO: 5406304 - DNA, 20 bp, Homo sapiens
ctgccaggctgtcagcgcct

SEQ ID NO: 5406305 - DNA, 14 bp, Homo sapiens
ctgccaggctgttt

SEQ ID NO: 5406306 - DNA, 15 bp, Homo sapiens
ctgccagggaactgg

SEQ ID NO: 5406307 - DNA, 23 bp, Homo sapiens
ctgccagggaactggcctgctgc

SEQ ID NO: 5406308 - DNA, 14 bp, Homo sapiens
ctgccagggaagac

SEQ ID NO: 5406309 - DNA, 22 bp, Homo sapiens
ctgccagggaagacagagcagg

SEQ ID NO: 5406310 - DNA, 24 bp, Homo sapiens
ctgccagggaagacagagcaggct

SEQ ID NO: 5406311 - DNA, 15 bp, Homo sapiens
ctgccagggacagag

SEQ ID NO: 5406312 - DNA, 17 bp, Homo sapiens
ctgccagggagacagag

SEQ ID NO: 5406313 - DNA, 23 bp, Homo sapiens
ctgccagggagacagagctcaca

SEQ ID NO: 5406314 - DNA, 13 bp, Homo sapiens
ctgccagggagct

SEQ ID NO: 5406315 - DNA, 13 bp, Homo sapiens
ctgccagggatgg

SEQ ID NO: 5406316 - DNA, 17 bp, Homo sapiens
ctgccagggatggcagt

SEQ ID NO: 5406317 - DNA, 18 bp, Homo sapiens
ctgccagggatggcagtg

SEQ ID NO: 5406318 - DNA, 13 bp, Homo sapiens
ctgccagggcagt

SEQ ID NO: 5406319 - DNA, 15 bp, Homo sapiens
ctgccagggcagtgc

SEQ ID NO: 5406320 - DNA, 17 bp, Homo sapiens
ctgccagggcagtgcta

SEQ ID NO: 5406321 - DNA, 12 bp, Homo sapiens
ctgccagggccc

SEQ ID NO: 5406322 - DNA, 17 bp, Homo sapiens
ctgccagggcccctctc

SEQ ID NO: 5406323 - DNA, 18 bp, Homo sapiens
ctgccagggcccctctcc

SEQ ID NO: 5406324 - DNA, 17 bp, Homo sapiens
ctgccagggcccgacct

SEQ ID NO: 5406325 - DNA, 18 bp, Homo sapiens
ctgccagggcccgacctg

SEQ ID NO: 5406326 - DNA, 16 bp, Homo sapiens
ctgccagggctcgggc

SEQ ID NO: 5406327 - DNA, 22 bp, Homo sapiens
ctgccaggggtaacctggccac

SEQ ID NO: 5406328 - DNA, 19 bp, Homo sapiens
ctgccaggggttcttgagc

SEQ ID NO: 5406329 - DNA, 18 bp, Homo sapiens
ctgccagtcctagctgca

SEQ ID NO: 5406330 - DNA, 21 bp, Homo sapiens
ctgccagtcctagctgcacag

SEQ ID NO: 5406331 - DNA, 16 bp, Homo sapiens
ctgccagtcctgtcct

SEQ ID NO: 5406332 - DNA, 23 bp, Homo sapiens
ctgccagtgacagacaggctctt

SEQ ID NO: 5406333 - DNA, 16 bp, Homo sapiens
ctgccagtgcagccac

SEQ ID NO: 5406334 - DNA, 16 bp, Homo sapiens
ctgccagtgccagggt

SEQ ID NO: 5406335 - DNA, 13 bp, Homo sapiens
ctgccagtgcctg

SEQ ID NO: 5406336 - DNA, 17 bp, Homo sapiens
ctgccagtgccttacct

SEQ ID NO: 5406337 - DNA, 21 bp, Homo sapiens
ctgccagtgccttacctcctg

SEQ ID NO: 5406338 - DNA, 23 bp, Homo sapiens
ctgccagtgccttacctcctgcc

SEQ ID NO: 5406339 - DNA, 15 bp, Homo sapiens
ctgccagtggagacg

SEQ ID NO: 5406340 - DNA, 15 bp, Homo sapiens
ctgccagtggatccc

SEQ ID NO: 5406341 - DNA, 21 bp, Homo sapiens
ctgccagtggatcccctgcgg

SEQ ID NO: 5406342 - DNA, 23 bp, Homo sapiens
ctgccagtggggtcgtgaggcaa

SEQ ID NO: 5406343 - DNA, 15 bp, Homo sapiens
ctgccagtgtggaac

SEQ ID NO: 5406344 - DNA, 20 bp, Homo sapiens
ctgccagttacttgggcttc

SEQ ID NO: 5406345 - DNA, 19 bp, Homo sapiens
ctgccataaaatctcacgc

SEQ ID NO: 5406346 - DNA, 20 bp, Homo sapiens
ctgccataaaatctcacgct

SEQ ID NO: 5406347 - DNA, 22 bp, Homo sapiens
ctgccatacataatatatgact

SEQ ID NO: 5406348 - DNA, 15 bp, Homo sapiens
ctgccatagccagga

SEQ ID NO: 5406349 - DNA, 15 bp, Homo sapiens
ctgccatagggtctg

SEQ ID NO: 5406350 - DNA, 19 bp, Homo sapiens
ctgccatagggtctgcagc

SEQ ID NO: 5406351 - DNA, 15 bp, Homo sapiens
ctgccatatcaccac

SEQ ID NO: 5406352 - DNA, 18 bp, Homo sapiens
ctgccatatgatttacat

SEQ ID NO: 5406353 - DNA, 14 bp, Homo sapiens
ctgccatattaaat

SEQ ID NO: 5406354 - DNA, 22 bp, Homo sapiens
ctgccatattctgttggccagt

SEQ ID NO: 5406355 - DNA, 16 bp, Homo sapiens
ctgccatcacctgctg

SEQ ID NO: 5406356 - DNA, 16 bp, Homo sapiens
ctgccatcagaaattt

SEQ ID NO: 5406357 - DNA, 22 bp, Homo sapiens
ctgccatcagaaattttctaca

SEQ ID NO: 5406358 - DNA, 15 bp, Homo sapiens
ctgccatcagcccct

SEQ ID NO: 5406359 - DNA, 17 bp, Homo sapiens
ctgccatcagcccctgc

SEQ ID NO: 5406360 - DNA, 18 bp, Homo sapiens
ctgccatcagtctagtgg

SEQ ID NO: 5406361 - DNA, 22 bp, Homo sapiens
ctgccatcatgtttacagagga

SEQ ID NO: 5406362 - DNA, 17 bp, Homo sapiens
ctgccatccagggatgc

SEQ ID NO: 5406363 - DNA, 16 bp, Homo sapiens
ctgccatccaggttca

SEQ ID NO: 5406364 - DNA, 21 bp, Homo sapiens
ctgccatccaggttcagcttg

SEQ ID NO: 5406365 - DNA, 14 bp, Homo sapiens
ctgccatccccctc

SEQ ID NO: 5406366 - DNA, 21 bp, Homo sapiens
ctgccatcctccctgttcccc

SEQ ID NO: 5406367 - DNA, 16 bp, Homo sapiens
ctgccatcctggccca

SEQ ID NO: 5406368 - DNA, 21 bp, Homo sapiens
ctgccatcctggcccagggca

SEQ ID NO: 5406369 - DNA, 15 bp, Homo sapiens
ctgccatccttgctg

SEQ ID NO: 5406370 - DNA, 23 bp, Homo sapiens
ctgccatcttagtttggattctt

SEQ ID NO: 5406371 - DNA, 18 bp, Homo sapiens
ctgccatcttctccccga

SEQ ID NO: 5406372 - DNA, 23 bp, Homo sapiens
ctgccatgaactggaggccagga

SEQ ID NO: 5406373 - DNA, 18 bp, Homo sapiens
ctgccatgatagctgggg

SEQ ID NO: 5406374 - DNA, 17 bp, Homo sapiens
ctgccatgatgtatatc

SEQ ID NO: 5406375 - DNA, 17 bp, Homo sapiens
ctgccatgatgtttaca

SEQ ID NO: 5406376 - DNA, 19 bp, Homo sapiens
ctgccatgccactgccagg

SEQ ID NO: 5406377 - DNA, 24 bp, Homo sapiens
ctgccatgccactgccaggcacct

SEQ ID NO: 5406378 - DNA, 19 bp, Homo sapiens
ctgccatgccagcttatct

SEQ ID NO: 5406379 - DNA, 14 bp, Homo sapiens
ctgccatgccagga

SEQ ID NO: 5406380 - DNA, 12 bp, Homo sapiens
ctgccatgccca

SEQ ID NO: 5406381 - DNA, 15 bp, Homo sapiens
ctgccatgcccacca

SEQ ID NO: 5406382 - DNA, 17 bp, Homo sapiens
ctgccatgcccaccatc

SEQ ID NO: 5406383 - DNA, 16 bp, Homo sapiens
ctgccatgcccagaga

SEQ ID NO: 5406384 - DNA, 15 bp, Homo sapiens
ctgccatgctctgga

SEQ ID NO: 5406385 - DNA, 17 bp, Homo sapiens
ctgccatggaactgttt

SEQ ID NO: 5406386 - DNA, 20 bp, Homo sapiens
ctgccatggaactgtttcct

SEQ ID NO: 5406387 - DNA, 23 bp, Homo sapiens
ctgccatggaattccctcctgag

SEQ ID NO: 5406388 - DNA, 22 bp, Homo sapiens
ctgccatggccttggcaggctg

SEQ ID NO: 5406389 - DNA, 23 bp, Homo sapiens
ctgccatggctaggtagaagtga

SEQ ID NO: 5406390 - DNA, 15 bp, Homo sapiens
ctgccatgggagagt

SEQ ID NO: 5406391 - DNA, 18 bp, Homo sapiens
ctgccatgggagagtcca

SEQ ID NO: 5406392 - DNA, 19 bp, Homo sapiens
ctgccatgggagagtccag

SEQ ID NO: 5406393 - DNA, 22 bp, Homo sapiens
ctgccatgggagagtccaggcc

SEQ ID NO: 5406394 - DNA, 14 bp, Homo sapiens
ctgccatgggccag

SEQ ID NO: 5406395 - DNA, 19 bp, Homo sapiens
ctgccatgggccagcctag

SEQ ID NO: 5406396 - DNA, 12 bp, Homo sapiens
ctgccctcctct

SEQ ID NO: 5406397 - DNA, 13 bp, Homo sapiens
ctgccctcctctc

SEQ ID NO: 5406398 - DNA, 16 bp, Homo sapiens
ctgccctcctctcccg

SEQ ID NO: 5406399 - DNA, 14 bp, Homo sapiens
ctgccctcctgcca

SEQ ID NO: 5406400 - DNA, 12 bp, Homo sapiens
ctgccctcctgt

SEQ ID NO: 5406401 - DNA, 17 bp, Homo sapiens
ctgccctccttaatttg

SEQ ID NO: 5406402 - DNA, 12 bp, Homo sapiens
ctgccctcgcac

SEQ ID NO: 5406403 - DNA, 11 bp, Homo sapiens
ctgccctcggc

SEQ ID NO: 5406404 - DNA, 16 bp, Homo sapiens
ctgccctcgggtctcc

SEQ ID NO: 5406405 - DNA, 22 bp, Homo sapiens
ctgccctcgtctccctggccac

SEQ ID NO: 5406406 - DNA, 20 bp, Homo sapiens
ctgccctctatttattagcc

SEQ ID NO: 5406407 - DNA, 22 bp, Homo sapiens
ctgccctctcccaaaaaactac

SEQ ID NO: 5406408 - DNA, 18 bp, Homo sapiens
ctgccctctccctgtgtt

SEQ ID NO: 5406409 - DNA, 14 bp, Homo sapiens
ctgccctctcctgg

SEQ ID NO: 5406410 - DNA, 15 bp, Homo sapiens
ctgccctctcctggg

SEQ ID NO: 5406411 - DNA, 18 bp, Homo sapiens
ctgccctctcctgggcag

SEQ ID NO: 5406412 - DNA, 15 bp, Homo sapiens
ctgccctctctcagt

SEQ ID NO: 5406413 - DNA, 21 bp, Homo sapiens
ctgccctctctgcgctgaggc

SEQ ID NO: 5406414 - DNA, 20 bp, Homo sapiens
ctgccctctgcatcctctgg

SEQ ID NO: 5406415 - DNA, 15 bp, Homo sapiens
ctgccctctgcccca

SEQ ID NO: 5406416 - DNA, 15 bp, Homo sapiens
ctgccctctgctcta

SEQ ID NO: 5406417 - DNA, 18 bp, Homo sapiens
ctgccctctgctctgcct

SEQ ID NO: 5406418 - DNA, 20 bp, Homo sapiens
ctgccctctgctctgcctgg

SEQ ID NO: 5406419 - DNA, 21 bp, Homo sapiens
ctgccctctgctctgcctgga

SEQ ID NO: 5406420 - DNA, 16 bp, Homo sapiens
ctgccctctgctgctg

SEQ ID NO: 5406421 - DNA, 12 bp, Homo sapiens
ctgccctctggg

SEQ ID NO: 5406422 - DNA, 19 bp, Homo sapiens
ctgccctctgttcagtaac

SEQ ID NO: 5406423 - DNA, 19 bp, Homo sapiens
ctgccctcttaagatctga

SEQ ID NO: 5406424 - DNA, 17 bp, Homo sapiens
ctgccctgaaagtccca

SEQ ID NO: 5406425 - DNA, 13 bp, Homo sapiens
ctgccctgaggag

SEQ ID NO: 5406426 - DNA, 18 bp, Homo sapiens
ctgccctgaggctgtgag

SEQ ID NO: 5406427 - DNA, 13 bp, Homo sapiens
ctgccctgagggg

SEQ ID NO: 5406428 - DNA, 21 bp, Homo sapiens
ctgccctgatgcgtctaccca

SEQ ID NO: 5406429 - DNA, 13 bp, Homo sapiens
ctgccctgcacct

SEQ ID NO: 5406430 - DNA, 15 bp, Homo sapiens
ctgccctgccacctg

SEQ ID NO: 5406431 - DNA, 18 bp, Homo sapiens
ctgccctgccacctgtct

SEQ ID NO: 5406432 - DNA, 13 bp, Homo sapiens
ctgccctgccact

SEQ ID NO: 5406433 - DNA, 16 bp, Homo sapiens
ctgccctgcccaagtg

SEQ ID NO: 5406434 - DNA, 15 bp, Homo sapiens
ctgccctgcccaggt

SEQ ID NO: 5406435 - DNA, 13 bp, Homo sapiens
ctgccctgcccat

SEQ ID NO: 5406436 - DNA, 23 bp, Homo sapiens
ctgccctgcccatactgagcctg

SEQ ID NO: 5406437 - DNA, 12 bp, Homo sapiens
ctgccctgccct

SEQ ID NO: 5406438 - DNA, 14 bp, Homo sapiens
ctgccctgccctca

SEQ ID NO: 5406439 - DNA, 13 bp, Homo sapiens
ctgccctgccctg

SEQ ID NO: 5406440 - DNA, 14 bp, Homo sapiens
ctgccctgccctgc

SEQ ID NO: 5406441 - DNA, 15 bp, Homo sapiens
ctgccctgccctgcc

SEQ ID NO: 5406442 - DNA, 13 bp, Homo sapiens
ctgccctgcctga

SEQ ID NO: 5406443 - DNA, 15 bp, Homo sapiens
ctgccctgcctgagg

SEQ ID NO: 5406444 - DNA, 13 bp, Homo sapiens
ctgccctgcctgc

SEQ ID NO: 5406445 - DNA, 18 bp, Homo sapiens
ctgccctgcctgcccact

SEQ ID NO: 5406446 - DNA, 20 bp, Homo sapiens
ctgccctgccttgccgctcc

SEQ ID NO: 5406447 - DNA, 22 bp, Homo sapiens
ctgccctgccttgccgctcccc

SEQ ID NO: 5406448 - DNA, 22 bp, Homo sapiens
ctgccctgcgaagtggctctca

SEQ ID NO: 5406449 - DNA, 20 bp, Homo sapiens
ctgccctgcgggtcacagga

SEQ ID NO: 5406450 - DNA, 12 bp, Homo sapiens
ctgccctgctcc

SEQ ID NO: 5406451 - DNA, 13 bp, Homo sapiens
ctgccctgctcct

SEQ ID NO: 5406452 - DNA, 17 bp, Homo sapiens
ctgccctgctctgccca

SEQ ID NO: 5406453 - DNA, 21 bp, Homo sapiens
ctgccctgctctgcccaggca

SEQ ID NO: 5406454 - DNA, 15 bp, Homo sapiens
ctgccctgctctggg

SEQ ID NO: 5406455 - DNA, 16 bp, Homo sapiens
ctgccctgctctgggg

SEQ ID NO: 5406456 - DNA, 19 bp, Homo sapiens
ctgccctgctgagcacaga

SEQ ID NO: 5406457 - DNA, 22 bp, Homo sapiens
ctgccctgctgagtcccaggct

SEQ ID NO: 5406458 - DNA, 17 bp, Homo sapiens
ctgccctgctgtggaag

SEQ ID NO: 5406459 - DNA, 14 bp, Homo sapiens
ctgccctgctgttt

SEQ ID NO: 5406460 - DNA, 11 bp, Homo sapiens
ctgccctggaa

SEQ ID NO: 5406461 - DNA, 15 bp, Homo sapiens
ctgccctggaggaag

SEQ ID NO: 5406462 - DNA, 13 bp, Homo sapiens
ctgccctggcagc

SEQ ID NO: 5406463 - DNA, 16 bp, Homo sapiens
ctgccctggccactgg

SEQ ID NO: 5406464 - DNA, 18 bp, Homo sapiens
ctgccctggccactggcc

SEQ ID NO: 5406465 - DNA, 20 bp, Homo sapiens
ctgccctggccactggccct

SEQ ID NO: 5406466 - DNA, 12 bp, Homo sapiens
ctgccctggccc

SEQ ID NO: 5406467 - DNA, 15 bp, Homo sapiens
ctgccctggccctga

SEQ ID NO: 5406468 - DNA, 14 bp, Homo sapiens
ctgccctggcctac

SEQ ID NO: 5406469 - DNA, 16 bp, Homo sapiens
ctgccctggcctacca

SEQ ID NO: 5406470 - DNA, 13 bp, Homo sapiens
ctgccctggctgt

SEQ ID NO: 5406471 - DNA, 17 bp, Homo sapiens
ctgccctggctgtgggt

SEQ ID NO: 5406472 - DNA, 12 bp, Homo sapiens
ctgccctgggag

SEQ ID NO: 5406473 - DNA, 15 bp, Homo sapiens
ctgccctgggaggca

SEQ ID NO: 5406474 - DNA, 21 bp, Homo sapiens
ctgccctgggatgtccacaga

SEQ ID NO: 5406475 - DNA, 20 bp, Homo sapiens
ctgccctgggcgagcccctc

SEQ ID NO: 5406476 - DNA, 21 bp, Homo sapiens
ctgccctgggcgagcccctcc

SEQ ID NO: 5406477 - DNA, 22 bp, Homo sapiens
ctgccctgggcgagcccctcct

SEQ ID NO: 5406478 - DNA, 16 bp, Homo sapiens
ctgccctgggctcctc

SEQ ID NO: 5406479 - DNA, 21 bp, Homo sapiens
ctgccctgggtcctgcctgca

SEQ ID NO: 5406480 - DNA, 22 bp, Homo sapiens
ctgccctgggtcctgcctgcag

SEQ ID NO: 5406481 - DNA, 21 bp, Homo sapiens
ctgccctgggttcttccacag

SEQ ID NO: 5406482 - DNA, 20 bp, Homo sapiens
ctgccctggtccagggaagc

SEQ ID NO: 5406483 - DNA, 18 bp, Homo sapiens
ctgccctggtgctgccac

SEQ ID NO: 5406484 - DNA, 19 bp, Homo sapiens
ctgccctggtgctgccaca

SEQ ID NO: 5406485 - DNA, 19 bp, Homo sapiens
ctgccctggtttcctgccc

SEQ ID NO: 5406486 - DNA, 23 bp, Homo sapiens
ctgccctggtttcctgccctggg

SEQ ID NO: 5406487 - DNA, 11 bp, Homo sapiens
ctgccctgtac

SEQ ID NO: 5406488 - DNA, 19 bp, Homo sapiens
ctgccctgtatataatact

SEQ ID NO: 5406489 - DNA, 17 bp, Homo sapiens
ctgccctgtccaaaagc

SEQ ID NO: 5406490 - DNA, 23 bp, Homo sapiens
ctgccctgtccactctgctcagg

SEQ ID NO: 5406491 - DNA, 17 bp, Homo sapiens
ctgccctgtcctccagc

SEQ ID NO: 5406492 - DNA, 22 bp, Homo sapiens
ctgccctgtcctccagcttccc

SEQ ID NO: 5406493 - DNA, 12 bp, Homo sapiens
ctgccctgtcta

SEQ ID NO: 5406494 - DNA, 12 bp, Homo sapiens
ctgccctgtgat

SEQ ID NO: 5406495 - DNA, 22 bp, Homo sapiens
ctgccctgtgatatgtctgctg

SEQ ID NO: 5406496 - DNA, 12 bp, Homo sapiens
ctgccctgtgcc

SEQ ID NO: 5406497 - DNA, 17 bp, Homo sapiens
ctgccctgtggacagga

SEQ ID NO: 5406498 - DNA, 14 bp, Homo sapiens
ctgccctgtgggcc

SEQ ID NO: 5406499 - DNA, 15 bp, Homo sapiens
ctgccctgtgggccc

SEQ ID NO: 5406500 - DNA, 18 bp, Homo sapiens
ctgccctgtgggccccca

SEQ ID NO: 5406501 - DNA, 16 bp, Homo sapiens
ctgccctgttcatgtg

SEQ ID NO: 5406502 - DNA, 15 bp, Homo sapiens
ctgccctgtttctgt

SEQ ID NO: 5406503 - DNA, 17 bp, Homo sapiens
ctgcccttacctgccag

SEQ ID NO: 5406504 - DNA, 19 bp, Homo sapiens
ctgcccttacctgccagga

SEQ ID NO: 5406505 - DNA, 15 bp, Homo sapiens
ctgcccttaggccac

SEQ ID NO: 5406506 - DNA, 16 bp, Homo sapiens
ctgcccttcaccccag

SEQ ID NO: 5406507 - DNA, 16 bp, Homo sapiens
ctgcccttcagcatcc

SEQ ID NO: 5406508 - DNA, 21 bp, Homo sapiens
ctgcccttcagcatcctcagt

SEQ ID NO: 5406509 - DNA, 15 bp, Homo sapiens
ctgcccttccccctg

SEQ ID NO: 5406510 - DNA, 14 bp, Homo sapiens
ctgcccttcccctc

SEQ ID NO: 5406511 - DNA, 16 bp, Homo sapiens
ctgcccttccctctgg

SEQ ID NO: 5406512 - DNA, 17 bp, Homo sapiens
ctgcccttccctctggg

SEQ ID NO: 5406513 - DNA, 15 bp, Homo sapiens
ctgcccttcctcagg

SEQ ID NO: 5406514 - DNA, 21 bp, Homo sapiens
ctgcccttcctcagggcccct

SEQ ID NO: 5406515 - DNA, 19 bp, Homo sapiens
ctgcccttcctcctgatgg

SEQ ID NO: 5406516 - DNA, 22 bp, Homo sapiens
ctgcccttcctcctgatggagt

SEQ ID NO: 5406517 - DNA, 17 bp, Homo sapiens
ctgcccttcgctgccag

SEQ ID NO: 5406518 - DNA, 18 bp, Homo sapiens
ctgcccttcgctgccagg

SEQ ID NO: 5406519 - DNA, 21 bp, Homo sapiens
ctgcccttcgctgccaggaca

SEQ ID NO: 5406520 - DNA, 14 bp, Homo sapiens
ctgcccttctcaag

SEQ ID NO: 5406521 - DNA, 16 bp, Homo sapiens
ctgcccttctcaagac

SEQ ID NO: 5406522 - DNA, 18 bp, Homo sapiens
ctgcccttcttccccttc

SEQ ID NO: 5406523 - DNA, 10 bp, Homo sapiens
ctgcccttga

SEQ ID NO: 5406524 - DNA, 21 bp, Homo sapiens
ctgcccttgaaccccctccct

SEQ ID NO: 5406525 - DNA, 22 bp, Homo sapiens
ctgcccttgaaccccctccctg

SEQ ID NO: 5406526 - DNA, 12 bp, Homo sapiens
ctgcccttgcag

SEQ ID NO: 5406527 - DNA, 17 bp, Homo sapiens
ctgcccttgcagggtgg

SEQ ID NO: 5406528 - DNA, 13 bp, Homo sapiens
ctgcccttggcac

SEQ ID NO: 5406529 - DNA, 22 bp, Homo sapiens
ctgcccttggcaccaccagggt

SEQ ID NO: 5406530 - DNA, 11 bp, Homo sapiens
ctgcccttggg

SEQ ID NO: 5406531 - DNA, 13 bp, Homo sapiens
ctgcccttgggcc

SEQ ID NO: 5406532 - DNA, 18 bp, Homo sapiens
ctgcccttgtcccactca

SEQ ID NO: 5406533 - DNA, 23 bp, Homo sapiens
ctgcccttgtcccactcaagcca

SEQ ID NO: 5406534 - DNA, 22 bp, Homo sapiens
ctgcccttgttgcctgcaccct

SEQ ID NO: 5406535 - DNA, 12 bp, Homo sapiens
ctgcccttgttt

SEQ ID NO: 5406536 - DNA, 21 bp, Homo sapiens
ctgcccttgtttggggcagga

SEQ ID NO: 5406537 - DNA, 23 bp, Homo sapiens
ctgcccttgtttggggcaggagt

SEQ ID NO: 5406538 - DNA, 23 bp, Homo sapiens
ctgccctttcccaggtaatttaa

SEQ ID NO: 5406539 - DNA, 16 bp, Homo sapiens
ctgccctttccctgca

SEQ ID NO: 5406540 - DNA, 15 bp, Homo sapiens
ctgccctttcctagg

SEQ ID NO: 5406541 - DNA, 20 bp, Homo sapiens
ctgccctttctgctcctttc

SEQ ID NO: 5406542 - DNA, 21 bp, Homo sapiens
ctgccctttctgggcaccggg

SEQ ID NO: 5406543 - DNA, 20 bp, Homo sapiens
ctgccctttgcagtgtgcag

SEQ ID NO: 5406544 - DNA, 20 bp, Homo sapiens
ctgccctttggccaacaggg

SEQ ID NO: 5406545 - DNA, 18 bp, Homo sapiens
ctgccctttgtcctcctg

SEQ ID NO: 5406546 - DNA, 20 bp, Homo sapiens
ctgccctttgtcctcctgct

SEQ ID NO: 5406547 - DNA, 23 bp, Homo sapiens
ctgccctttgtcctcctgctgcc

SEQ ID NO: 5406548 - DNA, 13 bp, Homo sapiens
ctgcccttttcct

SEQ ID NO: 5406549 - DNA, 14 bp, Homo sapiens
ctgcccttttcctg

SEQ ID NO: 5406550 - DNA, 21 bp, Homo sapiens
ctgcccttttctctcacccat

SEQ ID NO: 5406551 - DNA, 18 bp, Homo sapiens
ctgccctttttgaaatca

SEQ ID NO: 5406552 - DNA, 19 bp, Homo sapiens
ctgcccttttttctgcctc

SEQ ID NO: 5406553 - DNA, 21 bp, Homo sapiens
ctgcccttttttctgcctcct

SEQ ID NO: 5406554 - DNA, 16 bp, Homo sapiens
ctgccgacatcagcat

SEQ ID NO: 5406555 - DNA, 17 bp, Homo sapiens
ctgccgacatccctccc

SEQ ID NO: 5406556 - DNA, 13 bp, Homo sapiens
ctgccgaccagag

SEQ ID NO: 5406557 - DNA, 21 bp, Homo sapiens
ctgccgaccgaggctggagct

SEQ ID NO: 5406558 - DNA, 23 bp, Homo sapiens
ctgccgaccgaggctggagctgg

SEQ ID NO: 5406559 - DNA, 14 bp, Homo sapiens
ctgccgaccgcctg

SEQ ID NO: 5406560 - DNA, 15 bp, Homo sapiens
ctgccgaccgcctgc

SEQ ID NO: 5406561 - DNA, 18 bp, Homo sapiens
ctgccgaccgcctgcttc

SEQ ID NO: 5406562 - DNA, 21 bp, Homo sapiens
ctgccgaccgcctgcttcaca

SEQ ID NO: 5406563 - DNA, 15 bp, Homo sapiens
ctgccgacttggaga

SEQ ID NO: 5406564 - DNA, 17 bp, Homo sapiens
ctgccgacttggagact

SEQ ID NO: 5406565 - DNA, 22 bp, Homo sapiens
ctgccgacttggagactcctgg

SEQ ID NO: 5406566 - DNA, 16 bp, Homo sapiens
ctgccgagacagaccc

SEQ ID NO: 5406567 - DNA, 23 bp, Homo sapiens
ctgccgagagtccatcagcctcc

SEQ ID NO: 5406568 - DNA, 13 bp, Homo sapiens
ctgccgagccacc

SEQ ID NO: 5406569 - DNA, 21 bp, Homo sapiens
ctgccgagtggtcactgtcag

SEQ ID NO: 5406570 - DNA, 18 bp, Homo sapiens
ctgccgattttgtaaatg

SEQ ID NO: 5406571 - DNA, 18 bp, Homo sapiens
ctgccgcaatacaggaac

SEQ ID NO: 5406572 - DNA, 15 bp, Homo sapiens
ctgccgcaccccaga

SEQ ID NO: 5406573 - DNA, 16 bp, Homo sapiens
ctgccgcagacgggca

SEQ ID NO: 5406574 - DNA, 20 bp, Homo sapiens
ctgccgcagacgggcacaga

SEQ ID NO: 5406575 - DNA, 15 bp, Homo sapiens
ctgcctgagggcccc

SEQ ID NO: 5406576 - DNA, 20 bp, Homo sapiens
ctgcctgagggcccctctgc

SEQ ID NO: 5406577 - DNA, 22 bp, Homo sapiens
ctgcctgagggcccctctgccc

SEQ ID NO: 5406578 - DNA, 23 bp, Homo sapiens
ctgcctgagggcccctctgccca

SEQ ID NO: 5406579 - DNA, 22 bp, Homo sapiens
ctgcctgaggggcagcctgcct

SEQ ID NO: 5406580 - DNA, 14 bp, Homo sapiens
ctgcctgagggtgg

SEQ ID NO: 5406581 - DNA, 15 bp, Homo sapiens
ctgcctgagggtggg

SEQ ID NO: 5406582 - DNA, 19 bp, Homo sapiens
ctgcctgagggtgggcttt

SEQ ID NO: 5406583 - DNA, 16 bp, Homo sapiens
ctgcctgagtattact

SEQ ID NO: 5406584 - DNA, 19 bp, Homo sapiens
ctgcctgagtcgtgacctg

SEQ ID NO: 5406585 - DNA, 21 bp, Homo sapiens
ctgcctgagtcgtgacctgct

SEQ ID NO: 5406586 - DNA, 19 bp, Homo sapiens
ctgcctgatccctgaaccc

SEQ ID NO: 5406587 - DNA, 22 bp, Homo sapiens
ctgcctgcaaacctgctggtgg

SEQ ID NO: 5406588 - DNA, 18 bp, Homo sapiens
ctgcctgcaatatttgaa

SEQ ID NO: 5406589 - DNA, 17 bp, Homo sapiens
ctgcctgcactccctgg

SEQ ID NO: 5406590 - DNA, 18 bp, Homo sapiens
ctgcctgcactccctggc

SEQ ID NO: 5406591 - DNA, 20 bp, Homo sapiens
ctgcctgcactccctggcct

SEQ ID NO: 5406592 - DNA, 23 bp, Homo sapiens
ctgcctgcactccctggccttgc

SEQ ID NO: 5406593 - DNA, 16 bp, Homo sapiens
ctgcctgcagaggtct

SEQ ID NO: 5406594 - DNA, 14 bp, Homo sapiens
ctgcctgcagcaca

SEQ ID NO: 5406595 - DNA, 17 bp, Homo sapiens
ctgcctgcagcacatgc

SEQ ID NO: 5406596 - DNA, 18 bp, Homo sapiens
ctgcctgcagcacatgcg

SEQ ID NO: 5406597 - DNA, 17 bp, Homo sapiens
ctgcctgcagccagggc

SEQ ID NO: 5406598 - DNA, 20 bp, Homo sapiens
ctgcctgcagccagggctgg

SEQ ID NO: 5406599 - DNA, 19 bp, Homo sapiens
ctgcctgcagcctccccca

SEQ ID NO: 5406600 - DNA, 12 bp, Homo sapiens
ctgcctgcagct

SEQ ID NO: 5406601 - DNA, 21 bp, Homo sapiens
ctgcctgcagtactttacctc

SEQ ID NO: 5406602 - DNA, 23 bp, Homo sapiens
ctgcctgcagtattacagaggtc

SEQ ID NO: 5406603 - DNA, 16 bp, Homo sapiens
ctgcctgcatctattc

SEQ ID NO: 5406604 - DNA, 12 bp, Homo sapiens
ctgcctgccaag

SEQ ID NO: 5406605 - DNA, 14 bp, Homo sapiens
ctgcctgccaagcg

SEQ ID NO: 5406606 - DNA, 15 bp, Homo sapiens
ctgcctgccagctgc

SEQ ID NO: 5406607 - DNA, 16 bp, Homo sapiens
ctgcctgccagctgca

SEQ ID NO: 5406608 - DNA, 13 bp, Homo sapiens
ctgcctgccatgt

SEQ ID NO: 5406609 - DNA, 14 bp, Homo sapiens
ctgcctgccatgtg

SEQ ID NO: 5406610 - DNA, 16 bp, Homo sapiens
ctgcctgccatgtgtg

SEQ ID NO: 5406611 - DNA, 15 bp, Homo sapiens
ctgcctgcccacccg

SEQ ID NO: 5406612 - DNA, 13 bp, Homo sapiens
ctgcctgcccact

SEQ ID NO: 5406613 - DNA, 15 bp, Homo sapiens
ctgcctgcccaggcc

SEQ ID NO: 5406614 - DNA, 22 bp, Homo sapiens
ctgcctgcccaggcccctgcca

SEQ ID NO: 5406615 - DNA, 20 bp, Homo sapiens
ctgcctgccccacacggact

SEQ ID NO: 5406616 - DNA, 21 bp, Homo sapiens
ctgcctgccccacccacccca

SEQ ID NO: 5406617 - DNA, 12 bp, Homo sapiens
ctgcctgccccc

SEQ ID NO: 5406618 - DNA, 17 bp, Homo sapiens
ctgcctgcccccacacc

SEQ ID NO: 5406619 - DNA, 15 bp, Homo sapiens
ctgcctgccccccag

SEQ ID NO: 5406620 - DNA, 16 bp, Homo sapiens
ctgcctgccccccagt

SEQ ID NO: 5406621 - DNA, 20 bp, Homo sapiens
ctgcctgccccccagtctcc

SEQ ID NO: 5406622 - DNA, 23 bp, Homo sapiens
ctgcctgccccccagtctcccca

SEQ ID NO: 5406623 - DNA, 22 bp, Homo sapiens
ctgcctgccccgcccccagtcc

SEQ ID NO: 5406624 - DNA, 20 bp, Homo sapiens
ctgcctgcccgcacagcagc

SEQ ID NO: 5406625 - DNA, 17 bp, Homo sapiens
ctgcctgccctgcctca

SEQ ID NO: 5406626 - DNA, 18 bp, Homo sapiens
ctgcctgccctgcctcag

SEQ ID NO: 5406627 - DNA, 16 bp, Homo sapiens
ctgcctgccgctgcag

SEQ ID NO: 5406628 - DNA, 20 bp, Homo sapiens
ctgcctgccgctgcaggaaa

SEQ ID NO: 5406629 - DNA, 16 bp, Homo sapiens
ctgcctgcctcatgct

SEQ ID NO: 5406630 - DNA, 13 bp, Homo sapiens
ctgcctgcctcca

SEQ ID NO: 5406631 - DNA, 14 bp, Homo sapiens
ctgcctgcctggga

SEQ ID NO: 5406632 - DNA, 12 bp, Homo sapiens
ctgcctgcctgt

SEQ ID NO: 5406633 - DNA, 18 bp, Homo sapiens
ctgcctgccttaagtgag

SEQ ID NO: 5406634 - DNA, 22 bp, Homo sapiens
ctgcctgccttaagtgaggaaa

SEQ ID NO: 5406635 - DNA, 21 bp, Homo sapiens
ctgcctgcgaaacccagcgtt

SEQ ID NO: 5406636 - DNA, 18 bp, Homo sapiens
ctgcctgcgcagctcctt

SEQ ID NO: 5406637 - DNA, 20 bp, Homo sapiens
ctgcctgcgttctccccatg

SEQ ID NO: 5406638 - DNA, 20 bp, Homo sapiens
ctgcctgctcatggccctcg

SEQ ID NO: 5406639 - DNA, 15 bp, Homo sapiens
ctgcctgctctgcag

SEQ ID NO: 5406640 - DNA, 16 bp, Homo sapiens
ctgcctgctgagatga

SEQ ID NO: 5406641 - DNA, 13 bp, Homo sapiens
ctgcctgctgcag

SEQ ID NO: 5406642 - DNA, 12 bp, Homo sapiens
ctgcctgctgtg

SEQ ID NO: 5406643 - DNA, 14 bp, Homo sapiens
ctgcctgctgtgct

SEQ ID NO: 5406644 - DNA, 17 bp, Homo sapiens
ctgcctgctgtgctggg

SEQ ID NO: 5406645 - DNA, 18 bp, Homo sapiens
ctgcctgctgtgctggga

SEQ ID NO: 5406646 - DNA, 14 bp, Homo sapiens
ctgcctgctgtgga

SEQ ID NO: 5406647 - DNA, 16 bp, Homo sapiens
ctgcctgctgtggagc

SEQ ID NO: 5406648 - DNA, 16 bp, Homo sapiens
ctgcctgcttcctgga

SEQ ID NO: 5406649 - DNA, 17 bp, Homo sapiens
ctgcctgcttcctggac

SEQ ID NO: 5406650 - DNA, 13 bp, Homo sapiens
ctgcctgctttgg

SEQ ID NO: 5406651 - DNA, 22 bp, Homo sapiens
ctgcctgctttttatggcctgt

SEQ ID NO: 5406652 - DNA, 21 bp, Homo sapiens
ctgcctggaaattctggaact

SEQ ID NO: 5406653 - DNA, 19 bp, Homo sapiens
ctgcctggaagagcagccc

SEQ ID NO: 5406654 - DNA, 22 bp, Homo sapiens
ctgcctggacttggcccctgcc

SEQ ID NO: 5406655 - DNA, 16 bp, Homo sapiens
ctgcctggagaaagga

SEQ ID NO: 5406656 - DNA, 20 bp, Homo sapiens
ctgcctggagacaaggtgct

SEQ ID NO: 5406657 - DNA, 16 bp, Homo sapiens
ctgcctggagagggtc

SEQ ID NO: 5406658 - DNA, 17 bp, Homo sapiens
ctgcctggagagggtct

SEQ ID NO: 5406659 - DNA, 18 bp, Homo sapiens
ctgcctggagagggtctc

SEQ ID NO: 5406660 - DNA, 22 bp, Homo sapiens
ctgcctggagagggtctcgctg

SEQ ID NO: 5406661 - DNA, 12 bp, Homo sapiens
ctgcctggagca

SEQ ID NO: 5406662 - DNA, 16 bp, Homo sapiens
ctgcctggagcagggg

SEQ ID NO: 5406663 - DNA, 12 bp, Homo sapiens
ctgcctggagcc

SEQ ID NO: 5406664 - DNA, 19 bp, Homo sapiens
ctgcctggagccccactgc

SEQ ID NO: 5406665 - DNA, 13 bp, Homo sapiens
ctgcctggagcct

SEQ ID NO: 5406666 - DNA, 14 bp, Homo sapiens
ctgcctggagcctg

SEQ ID NO: 5406667 - DNA, 11 bp, Homo sapiens
ctgcctggagg

SEQ ID NO: 5406668 - DNA, 12 bp, Homo sapiens
ctgcctggagga

SEQ ID NO: 5406669 - DNA, 16 bp, Homo sapiens
ctgcctggaggacctg

SEQ ID NO: 5406670 - DNA, 17 bp, Homo sapiens
ctgcctggaggacctga

SEQ ID NO: 5406671 - DNA, 18 bp, Homo sapiens
ctgcctggaggacctgag

SEQ ID NO: 5406672 - DNA, 19 bp, Homo sapiens
ctgcctggaggagaaggag

SEQ ID NO: 5406673 - DNA, 23 bp, Homo sapiens
ctgcctggaggatagcagagaag

SEQ ID NO: 5406674 - DNA, 20 bp, Homo sapiens
ctgcctggaggcaaaggcct

SEQ ID NO: 5406675 - DNA, 21 bp, Homo sapiens
ctgcctggaggcaaaggcctg

SEQ ID NO: 5406676 - DNA, 20 bp, Homo sapiens
ctgcctggagtgctgtgctg

SEQ ID NO: 5406677 - DNA, 15 bp, Homo sapiens
ctgcctggatttctt

SEQ ID NO: 5406678 - DNA, 19 bp, Homo sapiens
ctgcctggatttcttccta

SEQ ID NO: 5406679 - DNA, 9 bp, Homo sapiens
ctgcctggc

SEQ ID NO: 5406680 - DNA, 13 bp, Homo sapiens
ctgcctggcacag

SEQ ID NO: 5406681 - DNA, 22 bp, Homo sapiens
ctgcctggcacagaccaggcct

SEQ ID NO: 5406682 - DNA, 21 bp, Homo sapiens
ctgcctggccactgctcccta

SEQ ID NO: 5406683 - DNA, 16 bp, Homo sapiens
ctgcctggccaggcag

SEQ ID NO: 5406684 - DNA, 21 bp, Homo sapiens
ctgcctggccaggcagatctg

SEQ ID NO: 5406685 - DNA, 15 bp, Homo sapiens
ctgcctggccaggcc

SEQ ID NO: 5406686 - DNA, 22 bp, Homo sapiens
ctgcctggccaggccctgggtc

SEQ ID NO: 5406687 - DNA, 13 bp, Homo sapiens
ctgcctggccatg

SEQ ID NO: 5406688 - DNA, 14 bp, Homo sapiens
ctgcctggcccagg

SEQ ID NO: 5406689 - DNA, 12 bp, Homo sapiens
ctgcctggccct

SEQ ID NO: 5406690 - DNA, 22 bp, Homo sapiens
ctgcctggccggccagccagcc

SEQ ID NO: 5406691 - DNA, 12 bp, Homo sapiens
ctgcctggcctg

SEQ ID NO: 5406692 - DNA, 14 bp, Homo sapiens
ctgcctggcctggc

SEQ ID NO: 5406693 - DNA, 15 bp, Homo sapiens
ctgcctggcctggca

SEQ ID NO: 5406694 - DNA, 16 bp, Homo sapiens
ctgcctggcctggctc

SEQ ID NO: 5406695 - DNA, 18 bp, Homo sapiens
ctgcctggcggcaggggt

SEQ ID NO: 5406696 - DNA, 16 bp, Homo sapiens
ctgcctggcgggcagc

SEQ ID NO: 5406697 - DNA, 19 bp, Homo sapiens
ctgcctggcgggcagcccc

SEQ ID NO: 5406698 - DNA, 21 bp, Homo sapiens
ctgcctggcgggcagcccctg

SEQ ID NO: 5406699 - DNA, 11 bp, Homo sapiens
ctgcctgggaa

SEQ ID NO: 5406700 - DNA, 20 bp, Homo sapiens
ctgcctgggaacggggtgga

SEQ ID NO: 5406701 - DNA, 16 bp, Homo sapiens
ctgcctgggacagcca

SEQ ID NO: 5406702 - DNA, 22 bp, Homo sapiens
ctgcctgggagagcccttgtgg

SEQ ID NO: 5406703 - DNA, 16 bp, Homo sapiens
ctgcctgggatgccct

SEQ ID NO: 5406704 - DNA, 23 bp, Homo sapiens
ctgcctgggatgcccttccccct

SEQ ID NO: 5406705 - DNA, 22 bp, Homo sapiens
ctgcctgggatgggctcccacc

SEQ ID NO: 5406706 - DNA, 11 bp, Homo sapiens
ctgcctgggca

SEQ ID NO: 5406707 - DNA, 17 bp, Homo sapiens
ctgcctgggcaatggcc

SEQ ID NO: 5406708 - DNA, 19 bp, Homo sapiens
ctgcctgggcaatggccag

SEQ ID NO: 5406709 - DNA, 23 bp, Homo sapiens
ctgcctgggcaatggccaggggc

SEQ ID NO: 5406710 - DNA, 23 bp, Homo sapiens
ctgcctgggccatgcgaggggcc

SEQ ID NO: 5406711 - DNA, 17 bp, Homo sapiens
ctgcctgggccgtggca

SEQ ID NO: 5406712 - DNA, 13 bp, Homo sapiens
ctgcctgggcctg

SEQ ID NO: 5406713 - DNA, 14 bp, Homo sapiens
ctgcctgggcctgt

SEQ ID NO: 5406714 - DNA, 15 bp, Homo sapiens
ctgcctgggcctgtg

SEQ ID NO: 5406715 - DNA, 11 bp, Homo sapiens
ctgcctgggct

SEQ ID NO: 5406716 - DNA, 16 bp, Homo sapiens
ctgcctgggctgttgg

SEQ ID NO: 5406717 - DNA, 24 bp, Homo sapiens
ctgcctggggattgggagggacag

SEQ ID NO: 5406718 - DNA, 19 bp, Homo sapiens
ctgcctggggcccaagttg

SEQ ID NO: 5406719 - DNA, 17 bp, Homo sapiens
ctgcctggggcctccag

SEQ ID NO: 5406720 - DNA, 21 bp, Homo sapiens
ctgcctggggtggcctggccc

SEQ ID NO: 5406721 - DNA, 21 bp, Homo sapiens
ctgcctgggtaggccccacaa

SEQ ID NO: 5406722 - DNA, 22 bp, Homo sapiens
ctgcctgggtaggccccacaag

SEQ ID NO: 5406723 - DNA, 14 bp, Homo sapiens
ctgcctgggtggga

SEQ ID NO: 5406724 - DNA, 17 bp, Homo sapiens
ctgcctgggtgggacag

SEQ ID NO: 5406725 - DNA, 22 bp, Homo sapiens
ctgcctgggtgggacagcctct

SEQ ID NO: 5406726 - DNA, 22 bp, Homo sapiens
ctgcctgggttccaatcctggc

SEQ ID NO: 5406727 - DNA, 18 bp, Homo sapiens
ctgcctgggttgggggca

SEQ ID NO: 5406728 - DNA, 15 bp, Homo sapiens
ctgcctgggttttct

SEQ ID NO: 5406729 - DNA, 21 bp, Homo sapiens
ctgcctgggttttctaactgt

SEQ ID NO: 5406730 - DNA, 13 bp, Homo sapiens
ctgcctggtaaaa

SEQ ID NO: 5406731 - DNA, 20 bp, Homo sapiens
ctgcctggtatatccaaaag

SEQ ID NO: 5406732 - DNA, 19 bp, Homo sapiens
ctgcctggtcctcacactc

SEQ ID NO: 5406733 - DNA, 20 bp, Homo sapiens
ctgcctggtcctccctccca

SEQ ID NO: 5406734 - DNA, 21 bp, Homo sapiens
ctgcctggtcctccctcccaa

SEQ ID NO: 5406735 - DNA, 17 bp, Homo sapiens
ctgcctggtctcctgcc

SEQ ID NO: 5406736 - DNA, 17 bp, Homo sapiens
ctgcctggtctctagag

SEQ ID NO: 5406737 - DNA, 17 bp, Homo sapiens
ctgcctggtctgtctgg

SEQ ID NO: 5406738 - DNA, 19 bp, Homo sapiens
ctgcctggtctgtctggat

SEQ ID NO: 5406739 - DNA, 19 bp, Homo sapiens
ctgcctggtgcattgctgt

SEQ ID NO: 5406740 - DNA, 20 bp, Homo sapiens
ctgcctggtgcattgctgtg

SEQ ID NO: 5406741 - DNA, 21 bp, Homo sapiens
ctgcctggtgcattgctgtgt

SEQ ID NO: 5406742 - DNA, 20 bp, Homo sapiens
ctgcctggtggtcagatgca

SEQ ID NO: 5406743 - DNA, 22 bp, Homo sapiens
ctgcctggtggtcagatgcagg

SEQ ID NO: 5406744 - DNA, 19 bp, Homo sapiens
ctgcctggttccctcccca

SEQ ID NO: 5406745 - DNA, 21 bp, Homo sapiens
ctgcctggttccctccccaag

SEQ ID NO: 5406746 - DNA, 15 bp, Homo sapiens
ctgcctggttttatt

SEQ ID NO: 5406747 - DNA, 17 bp, Homo sapiens
ctgcctgtagcaatggc

SEQ ID NO: 5406748 - DNA, 19 bp, Homo sapiens
ctgcctgtagcccactctg

SEQ ID NO: 5406749 - DNA, 22 bp, Homo sapiens
ctgcctgtagcccactctgctc

SEQ ID NO: 5406750 - DNA, 23 bp, Homo sapiens
ctgcctgtagcccactctgctcg

SEQ ID NO: 5406751 - DNA, 15 bp, Homo sapiens
ctgcctgtagttagg

SEQ ID NO: 5406752 - DNA, 17 bp, Homo sapiens
ctgctcagcaggcccta

SEQ ID NO: 5406753 - DNA, 23 bp, Homo sapiens
ctgctcagcagtgagagcagatg

SEQ ID NO: 5406754 - DNA, 16 bp, Homo sapiens
ctgctcagcccatccc

SEQ ID NO: 5406755 - DNA, 23 bp, Homo sapiens
ctgctcagcccatcccctgcctc

SEQ ID NO: 5406756 - DNA, 15 bp, Homo sapiens
ctgctcagccctgca

SEQ ID NO: 5406757 - DNA, 15 bp, Homo sapiens
ctgctcagccctgga

SEQ ID NO: 5406758 - DNA, 18 bp, Homo sapiens
ctgctcagccctggaggt

SEQ ID NO: 5406759 - DNA, 14 bp, Homo sapiens
ctgctcagctctgg

SEQ ID NO: 5406760 - DNA, 16 bp, Homo sapiens
ctgctcagctctgggc

SEQ ID NO: 5406761 - DNA, 15 bp, Homo sapiens
ctgctcagctctggt

SEQ ID NO: 5406762 - DNA, 15 bp, Homo sapiens
ctgctcagctggccg

SEQ ID NO: 5406763 - DNA, 16 bp, Homo sapiens
ctgctcagctggccgg

SEQ ID NO: 5406764 - DNA, 23 bp, Homo sapiens
ctgctcaggaattgaagatgtaa

SEQ ID NO: 5406765 - DNA, 17 bp, Homo sapiens
ctgctcaggcctcacct

SEQ ID NO: 5406766 - DNA, 19 bp, Homo sapiens
ctgctcaggcctcacctcc

SEQ ID NO: 5406767 - DNA, 19 bp, Homo sapiens
ctgctcaggcctccctagc

SEQ ID NO: 5406768 - DNA, 22 bp, Homo sapiens
ctgctcaggcgtcgctggattt

SEQ ID NO: 5406769 - DNA, 13 bp, Homo sapiens
ctgctcaggctgc

SEQ ID NO: 5406770 - DNA, 17 bp, Homo sapiens
ctgctcaggtaaatctt

SEQ ID NO: 5406771 - DNA, 13 bp, Homo sapiens
ctgctcaggtgct

SEQ ID NO: 5406772 - DNA, 18 bp, Homo sapiens
ctgctcagtaaagcactt

SEQ ID NO: 5406773 - DNA, 19 bp, Homo sapiens
ctgctcagtaaagcacttg

SEQ ID NO: 5406774 - DNA, 18 bp, Homo sapiens
ctgctcagtgcttgggct

SEQ ID NO: 5406775 - DNA, 20 bp, Homo sapiens
ctgctcagtgcttgggctcc

SEQ ID NO: 5406776 - DNA, 22 bp, Homo sapiens
ctgctcagtgcttgggctccac

SEQ ID NO: 5406777 - DNA, 15 bp, Homo sapiens
ctgctcataacatct

SEQ ID NO: 5406778 - DNA, 15 bp, Homo sapiens
ctgctcatcacccag

SEQ ID NO: 5406779 - DNA, 18 bp, Homo sapiens
ctgctcatcacccagtcc

SEQ ID NO: 5406780 - DNA, 22 bp, Homo sapiens
ctgctcatcacccagtcctggc

SEQ ID NO: 5406781 - DNA, 12 bp, Homo sapiens
ctgctcatcatt

SEQ ID NO: 5406782 - DNA, 18 bp, Homo sapiens
ctgctcatcattctctgt

SEQ ID NO: 5406783 - DNA, 22 bp, Homo sapiens
ctgctcatcattctctgtctca

SEQ ID NO: 5406784 - DNA, 17 bp, Homo sapiens
ctgctcatccaaagttg

SEQ ID NO: 5406785 - DNA, 17 bp, Homo sapiens
ctgctcatccagggtgt

SEQ ID NO: 5406786 - DNA, 15 bp, Homo sapiens
ctgctcatgggtggc

SEQ ID NO: 5406787 - DNA, 22 bp, Homo sapiens
ctgctcattacagttctttcct

SEQ ID NO: 5406788 - DNA, 18 bp, Homo sapiens
ctgctcattccacactgt

SEQ ID NO: 5406789 - DNA, 16 bp, Homo sapiens
ctgctcattccgaggg

SEQ ID NO: 5406790 - DNA, 22 bp, Homo sapiens
ctgctcattctaatgatggccc

SEQ ID NO: 5406791 - DNA, 15 bp, Homo sapiens
ctgctcatttgagaa

SEQ ID NO: 5406792 - DNA, 20 bp, Homo sapiens
ctgctccaacagacaccctc

SEQ ID NO: 5406793 - DNA, 23 bp, Homo sapiens
ctgctccaacccccgccacctca

SEQ ID NO: 5406794 - DNA, 17 bp, Homo sapiens
ctgctccacagaaaccc

SEQ ID NO: 5406795 - DNA, 20 bp, Homo sapiens
ctgctccacagaaaccctgt

SEQ ID NO: 5406796 - DNA, 12 bp, Homo sapiens
ctgctccacagt

SEQ ID NO: 5406797 - DNA, 14 bp, Homo sapiens
ctgctccacagtgt

SEQ ID NO: 5406798 - DNA, 11 bp, Homo sapiens
ctgctccacca

SEQ ID NO: 5406799 - DNA, 21 bp, Homo sapiens
ctgctccaccaaggggctctt

SEQ ID NO: 5406800 - DNA, 16 bp, Homo sapiens
ctgctccaccacatcc

SEQ ID NO: 5406801 - DNA, 15 bp, Homo sapiens
ctgctccaccagcag

SEQ ID NO: 5406802 - DNA, 16 bp, Homo sapiens
ctgctccaccagcagc

SEQ ID NO: 5406803 - DNA, 20 bp, Homo sapiens
ctgctccaccagcagcatgg

SEQ ID NO: 5406804 - DNA, 14 bp, Homo sapiens
ctgctccaccctcc

SEQ ID NO: 5406805 - DNA, 14 bp, Homo sapiens
ctgctccacccttg

SEQ ID NO: 5406806 - DNA, 15 bp, Homo sapiens
ctgctccacccttgg

SEQ ID NO: 5406807 - DNA, 18 bp, Homo sapiens
ctgctccacccttggcct

SEQ ID NO: 5406808 - DNA, 21 bp, Homo sapiens
ctgctccacctttcagcccac

SEQ ID NO: 5406809 - DNA, 24 bp, Homo sapiens
ctgctccacctttcagcccacgtc

SEQ ID NO: 5406810 - DNA, 13 bp, Homo sapiens
ctgctccacgcgc

SEQ ID NO: 5406811 - DNA, 20 bp, Homo sapiens
ctgctccacgcgcttcgact

SEQ ID NO: 5406812 - DNA, 21 bp, Homo sapiens
ctgctccagaatttggaaatc

SEQ ID NO: 5406813 - DNA, 22 bp, Homo sapiens
ctgctccagcaactgcccttcc

SEQ ID NO: 5406814 - DNA, 13 bp, Homo sapiens
ctgctccagcagc

SEQ ID NO: 5406815 - DNA, 14 bp, Homo sapiens
ctgctccagcagca

SEQ ID NO: 5406816 - DNA, 18 bp, Homo sapiens
ctgctccagcagcacacc

SEQ ID NO: 5406817 - DNA, 19 bp, Homo sapiens
ctgctccagcagcacacct

SEQ ID NO: 5406818 - DNA, 14 bp, Homo sapiens
ctgctccagcccct

SEQ ID NO: 5406819 - DNA, 22 bp, Homo sapiens
ctgctccagcccctttgcctct

SEQ ID NO: 5406820 - DNA, 15 bp, Homo sapiens
ctgctccagcctctg

SEQ ID NO: 5406821 - DNA, 18 bp, Homo sapiens
ctgctccagcctctgccg

SEQ ID NO: 5406822 - DNA, 19 bp, Homo sapiens
ctgctccagcctctgccgc

SEQ ID NO: 5406823 - DNA, 23 bp, Homo sapiens
ctgctccagcctctgccgctgcc

SEQ ID NO: 5406824 - DNA, 19 bp, Homo sapiens
ctgctccaggcctgcagca

SEQ ID NO: 5406825 - DNA, 17 bp, Homo sapiens
ctgctccagtgggcagg

SEQ ID NO: 5406826 - DNA, 21 bp, Homo sapiens
ctgctccatccccctgcctcc

SEQ ID NO: 5406827 - DNA, 21 bp, Homo sapiens
ctgctccatcggggcaggggg

SEQ ID NO: 5406828 - DNA, 16 bp, Homo sapiens
ctgctccatgcagatc

SEQ ID NO: 5406829 - DNA, 22 bp, Homo sapiens
ctgctccatgcagatctagcca

SEQ ID NO: 5406830 - DNA, 14 bp, Homo sapiens
ctgctccatgggca

SEQ ID NO: 5406831 - DNA, 14 bp, Homo sapiens
ctgctcccacactt

SEQ ID NO: 5406832 - DNA, 12 bp, Homo sapiens
ctgctcccaccc

SEQ ID NO: 5406833 - DNA, 13 bp, Homo sapiens
ctgctcccacccc

SEQ ID NO: 5406834 - DNA, 17 bp, Homo sapiens
ctgctcccaccccagaa

SEQ ID NO: 5406835 - DNA, 22 bp, Homo sapiens
ctgctcccaccccagaaatcac

SEQ ID NO: 5406836 - DNA, 17 bp, Homo sapiens
ctgctcccacgcctgct

SEQ ID NO: 5406837 - DNA, 19 bp, Homo sapiens
ctgctcccagatgccttct

SEQ ID NO: 5406838 - DNA, 23 bp, Homo sapiens
ctgctcccagatgccttctagat

SEQ ID NO: 5406839 - DNA, 22 bp, Homo sapiens
ctgctcccagattactccttcc

SEQ ID NO: 5406840 - DNA, 14 bp, Homo sapiens
ctgctcccagcagc

SEQ ID NO: 5406841 - DNA, 16 bp, Homo sapiens
ctgctcccagcagccc

SEQ ID NO: 5406842 - DNA, 17 bp, Homo sapiens
ctgctcccagcagccct

SEQ ID NO: 5406843 - DNA, 21 bp, Homo sapiens
ctgctcccagcagccctaagg

SEQ ID NO: 5406844 - DNA, 22 bp, Homo sapiens
ctgctcccagcagccctaagga

SEQ ID NO: 5406845 - DNA, 13 bp, Homo sapiens
ctgctcccagcct

SEQ ID NO: 5406846 - DNA, 16 bp, Homo sapiens
ctgctcccagcctgct

SEQ ID NO: 5406847 - DNA, 22 bp, Homo sapiens
ctgctcccagcctgctgagagc

SEQ ID NO: 5406848 - DNA, 21 bp, Homo sapiens
ctgctcccagctctctctcct

SEQ ID NO: 5406849 - DNA, 24 bp, Homo sapiens
ctgctcccagctctctctcctgga

SEQ ID NO: 5406850 - DNA, 18 bp, Homo sapiens
ctgctcccaggccccagg

SEQ ID NO: 5406851 - DNA, 14 bp, Homo sapiens
ctgctcccagggac

SEQ ID NO: 5406852 - DNA, 15 bp, Homo sapiens
ctgctcccagtcctg

SEQ ID NO: 5406853 - DNA, 19 bp, Homo sapiens
ctgctcccagtcctgcctg

SEQ ID NO: 5406854 - DNA, 13 bp, Homo sapiens
ctgctcccagtgg

SEQ ID NO: 5406855 - DNA, 22 bp, Homo sapiens
ctgctcccagtgggagcttccc

SEQ ID NO: 5406856 - DNA, 23 bp, Homo sapiens
ctgctcccagtgggagcttcccg

SEQ ID NO: 5406857 - DNA, 19 bp, Homo sapiens
ctgctcccatcctcaccca

SEQ ID NO: 5406858 - DNA, 20 bp, Homo sapiens
ctgctcccatcctcacccag

SEQ ID NO: 5406859 - DNA, 18 bp, Homo sapiens
ctgctcccatcctgtgtg

SEQ ID NO: 5406860 - DNA, 18 bp, Homo sapiens
ctgctcccatctgcacta

SEQ ID NO: 5406861 - DNA, 17 bp, Homo sapiens
ctgctcccattcctccc

SEQ ID NO: 5406862 - DNA, 20 bp, Homo sapiens
ctgctccccaacacctgcct

SEQ ID NO: 5406863 - DNA, 17 bp, Homo sapiens
ctgctccccacccgcct

SEQ ID NO: 5406864 - DNA, 19 bp, Homo sapiens
ctgctccccagccctggct

SEQ ID NO: 5406865 - DNA, 16 bp, Homo sapiens
ctgctccccaggccac

SEQ ID NO: 5406866 - DNA, 17 bp, Homo sapiens
ctgctccccaggccacc

SEQ ID NO: 5406867 - DNA, 18 bp, Homo sapiens
ctgctccccaggccaccc

SEQ ID NO: 5406868 - DNA, 13 bp, Homo sapiens
ctgctcccccacc

SEQ ID NO: 5406869 - DNA, 17 bp, Homo sapiens
ctgctcccccaccccct

SEQ ID NO: 5406870 - DNA, 21 bp, Homo sapiens
ctgctcccccaccccctcccc

SEQ ID NO: 5406871 - DNA, 14 bp, Homo sapiens
ctgctccccctttt

SEQ ID NO: 5406872 - DNA, 21 bp, Homo sapiens
ctgctcccctaaagccaggct

SEQ ID NO: 5406873 - DNA, 14 bp, Homo sapiens
ctgctcccctaacc

SEQ ID NO: 5406874 - DNA, 17 bp, Homo sapiens
ctgctcccctccctcct

SEQ ID NO: 5406875 - DNA, 21 bp, Homo sapiens
ctgctcccctctgcacggacc

SEQ ID NO: 5406876 - DNA, 15 bp, Homo sapiens
ctgctcccctgccac

SEQ ID NO: 5406877 - DNA, 14 bp, Homo sapiens
ctgctcccctttgg

SEQ ID NO: 5406878 - DNA, 14 bp, Homo sapiens
ctgctcccgcctga

SEQ ID NO: 5406879 - DNA, 14 bp, Homo sapiens
ctgctccctcagac

SEQ ID NO: 5406880 - DNA, 15 bp, Homo sapiens
ctgctccctccagaa

SEQ ID NO: 5406881 - DNA, 23 bp, Homo sapiens
ctgctccctccagaatggaactc

SEQ ID NO: 5406882 - DNA, 16 bp, Homo sapiens
ctgctccctccctcca

SEQ ID NO: 5406883 - DNA, 12 bp, Homo sapiens
ctgctccctctc

SEQ ID NO: 5406884 - DNA, 15 bp, Homo sapiens
ctgctccctgaagcc

SEQ ID NO: 5406885 - DNA, 22 bp, Homo sapiens
ctgctccctgaagccagccttc

SEQ ID NO: 5406886 - DNA, 23 bp, Homo sapiens
ctgctccctgagggcggagcgcc

SEQ ID NO: 5406887 - DNA, 12 bp, Homo sapiens
ctgctccctgcc

SEQ ID NO: 5406888 - DNA, 14 bp, Homo sapiens
ctgctccctgcctc

SEQ ID NO: 5406889 - DNA, 16 bp, Homo sapiens
ctgctccctgcctcct

SEQ ID NO: 5406890 - DNA, 20 bp, Homo sapiens
ctgctccctgcctcctgcct

SEQ ID NO: 5406891 - DNA, 14 bp, Homo sapiens
ctgctccctgctcc

SEQ ID NO: 5406892 - DNA, 18 bp, Homo sapiens
ctgctccctgctcccagg

SEQ ID NO: 5406893 - DNA, 19 bp, Homo sapiens
ctgctccctgctcccaggg

SEQ ID NO: 5406894 - DNA, 22 bp, Homo sapiens
ctgctccctgctttggctgagg

SEQ ID NO: 5406895 - DNA, 14 bp, Homo sapiens
ctgctccctggggt

SEQ ID NO: 5406896 - DNA, 22 bp, Homo sapiens
ctgctccctggggttctctaca

SEQ ID NO: 5406897 - DNA, 19 bp, Homo sapiens
ctgctccctgtagggtcca

SEQ ID NO: 5406898 - DNA, 20 bp, Homo sapiens
ctgctccctgtggcactcag

SEQ ID NO: 5406899 - DNA, 16 bp, Homo sapiens
ctgctcccttcgctct

SEQ ID NO: 5406900 - DNA, 16 bp, Homo sapiens
ctgctccgaggggctc

SEQ ID NO: 5406901 - DNA, 17 bp, Homo sapiens
ctgctccgaggggctca

SEQ ID NO: 5406902 - DNA, 14 bp, Homo sapiens
ctgctccgccagga

SEQ ID NO: 5406903 - DNA, 16 bp, Homo sapiens
ctgctccgccaggaaa

SEQ ID NO: 5406904 - DNA, 14 bp, Homo sapiens
ctgctccgctgcct

SEQ ID NO: 5406905 - DNA, 16 bp, Homo sapiens
ctgctccgctgctcct

SEQ ID NO: 5406906 - DNA, 21 bp, Homo sapiens
ctgctccgctgctccttggct

SEQ ID NO: 5406907 - DNA, 15 bp, Homo sapiens
ctgctccgtggagga

SEQ ID NO: 5406908 - DNA, 15 bp, Homo sapiens
ctgctccgtgtgtct

SEQ ID NO: 5406909 - DNA, 17 bp, Homo sapiens
ctgctccgtgtgtctca

SEQ ID NO: 5406910 - DNA, 21 bp, Homo sapiens
ctgctcctacatccagctcct

SEQ ID NO: 5406911 - DNA, 14 bp, Homo sapiens
ctgctcctagaggg

SEQ ID NO: 5406912 - DNA, 15 bp, Homo sapiens
ctgctcctagaggga

SEQ ID NO: 5406913 - DNA, 20 bp, Homo sapiens
ctgctcctagcaccctggag

SEQ ID NO: 5406914 - DNA, 18 bp, Homo sapiens
ctgctcctagcccagcag

SEQ ID NO: 5406915 - DNA, 14 bp, Homo sapiens
ctgctcctcactgg

SEQ ID NO: 5406916 - DNA, 18 bp, Homo sapiens
ctgctcctcactggagga

SEQ ID NO: 5406917 - DNA, 14 bp, Homo sapiens
ctgctcctcaggaa

SEQ ID NO: 5406918 - DNA, 12 bp, Homo sapiens
ctgctcctcatg

SEQ ID NO: 5406919 - DNA, 12 bp, Homo sapiens
ctgctcctccag

SEQ ID NO: 5406920 - DNA, 16 bp, Homo sapiens
ctgctcctccagccct

SEQ ID NO: 5406921 - DNA, 16 bp, Homo sapiens
ctgctcctccagggcc

SEQ ID NO: 5406922 - DNA, 14 bp, Homo sapiens
ctgctcctcccaac

SEQ ID NO: 5406923 - DNA, 13 bp, Homo sapiens
ctgctcctcccat

SEQ ID NO: 5406924 - DNA, 14 bp, Homo sapiens
ctgctcctccctct

SEQ ID NO: 5406925 - DNA, 19 bp, Homo sapiens
ctgctcctccctgcccccc

SEQ ID NO: 5406926 - DNA, 15 bp, Homo sapiens
ctgctcctccctggc

SEQ ID NO: 5406927 - DNA, 23 bp, Homo sapiens
ctgctcctccctggctgccctgg

SEQ ID NO: 5406928 - DNA, 13 bp, Homo sapiens
ctgctcctcgcag

SEQ ID NO: 5406929 - DNA, 19 bp, Homo sapiens
ctgctcctcgctcgcacct

SEQ ID NO: 5406930 - DNA, 21 bp, Homo sapiens
ctgctgctaatcttcagggca

SEQ ID NO: 5406931 - DNA, 16 bp, Homo sapiens
ctgctgctattgctgt

SEQ ID NO: 5406932 - DNA, 21 bp, Homo sapiens
ctgctgctattgctgtctggt

SEQ ID NO: 5406933 - DNA, 14 bp, Homo sapiens
ctgctgctcattcc

SEQ ID NO: 5406934 - DNA, 21 bp, Homo sapiens
ctgctgctcattccacactgt

SEQ ID NO: 5406935 - DNA, 23 bp, Homo sapiens
ctgctgctcattccacactgttg

SEQ ID NO: 5406936 - DNA, 14 bp, Homo sapiens
ctgctgctcccagc

SEQ ID NO: 5406937 - DNA, 15 bp, Homo sapiens
ctgctgctccccacc

SEQ ID NO: 5406938 - DNA, 19 bp, Homo sapiens
ctgctgctccccaccccta

SEQ ID NO: 5406939 - DNA, 12 bp, Homo sapiens
ctgctgctccct

SEQ ID NO: 5406940 - DNA, 21 bp, Homo sapiens
ctgctgctccctcagactggg

SEQ ID NO: 5406941 - DNA, 18 bp, Homo sapiens
ctgctgctcctaggaccc

SEQ ID NO: 5406942 - DNA, 16 bp, Homo sapiens
ctgctgctcctccctc

SEQ ID NO: 5406943 - DNA, 14 bp, Homo sapiens
ctgctgctcctcgg

SEQ ID NO: 5406944 - DNA, 16 bp, Homo sapiens
ctgctgctcctcggcc

SEQ ID NO: 5406945 - DNA, 20 bp, Homo sapiens
ctgctgctcctcggccagag

SEQ ID NO: 5406946 - DNA, 22 bp, Homo sapiens
ctgctgctcctcggccagagct

SEQ ID NO: 5406947 - DNA, 17 bp, Homo sapiens
ctgctgctcctctttcc

SEQ ID NO: 5406948 - DNA, 19 bp, Homo sapiens
ctgctgctcctctttcccc

SEQ ID NO: 5406949 - DNA, 22 bp, Homo sapiens
ctgctgctcgggaaggcctgag

SEQ ID NO: 5406950 - DNA, 14 bp, Homo sapiens
ctgctgctctcagg

SEQ ID NO: 5406951 - DNA, 14 bp, Homo sapiens
ctgctgctctgacc

SEQ ID NO: 5406952 - DNA, 19 bp, Homo sapiens
ctgctgctctgaccttcca

SEQ ID NO: 5406953 - DNA, 13 bp, Homo sapiens
ctgctgctgaccc

SEQ ID NO: 5406954 - DNA, 15 bp, Homo sapiens
ctgctgctgacccct

SEQ ID NO: 5406955 - DNA, 16 bp, Homo sapiens
ctgctgctgagaacct

SEQ ID NO: 5406956 - DNA, 20 bp, Homo sapiens
ctgctgctgagaacctggcc

SEQ ID NO: 5406957 - DNA, 13 bp, Homo sapiens
ctgctgctgcacc

SEQ ID NO: 5406958 - DNA, 19 bp, Homo sapiens
ctgctgctgccagggcttc

SEQ ID NO: 5406959 - DNA, 14 bp, Homo sapiens
ctgctgctgcctgg

SEQ ID NO: 5406960 - DNA, 17 bp, Homo sapiens
ctgctgctgcctggcca

SEQ ID NO: 5406961 - DNA, 17 bp, Homo sapiens
ctgctgctgctattgct

SEQ ID NO: 5406962 - DNA, 15 bp, Homo sapiens
ctgctgctgggactt

SEQ ID NO: 5406963 - DNA, 17 bp, Homo sapiens
ctgctgctgggacttga

SEQ ID NO: 5406964 - DNA, 19 bp, Homo sapiens
ctgctgctgggacttgaac

SEQ ID NO: 5406965 - DNA, 13 bp, Homo sapiens
ctgctgctgggct

SEQ ID NO: 5406966 - DNA, 15 bp, Homo sapiens
ctgctgctgggctca

SEQ ID NO: 5406967 - DNA, 13 bp, Homo sapiens
ctgctgctggtca

SEQ ID NO: 5406968 - DNA, 10 bp, Homo sapiens
ctgctgctgt

SEQ ID NO: 5406969 - DNA, 18 bp, Homo sapiens
ctgctgctgtctgggtgc

SEQ ID NO: 5406970 - DNA, 16 bp, Homo sapiens
ctgctgctgtgcagca

SEQ ID NO: 5406971 - DNA, 17 bp, Homo sapiens
ctgctgctgtgcttttg

SEQ ID NO: 5406972 - DNA, 11 bp, Homo sapiens
ctgctgcttct

SEQ ID NO: 5406973 - DNA, 16 bp, Homo sapiens
ctgctgcttctccctg

SEQ ID NO: 5406974 - DNA, 17 bp, Homo sapiens
ctgctgcttctgctcca

SEQ ID NO: 5406975 - DNA, 19 bp, Homo sapiens
ctgctgcttctgctccagc

SEQ ID NO: 5406976 - DNA, 22 bp, Homo sapiens
ctgctgcttctgctccagcccc

SEQ ID NO: 5406977 - DNA, 19 bp, Homo sapiens
ctgctgcttctgggcctga

SEQ ID NO: 5406978 - DNA, 13 bp, Homo sapiens
ctgctgcttctta

SEQ ID NO: 5406979 - DNA, 18 bp, Homo sapiens
ctgctgcttcttgcttcc

SEQ ID NO: 5406980 - DNA, 18 bp, Homo sapiens
ctgctgcttgggacgtgt

SEQ ID NO: 5406981 - DNA, 20 bp, Homo sapiens
ctgctgctttttgaggtggc

SEQ ID NO: 5406982 - DNA, 20 bp, Homo sapiens
ctgctggaaaggcccggaga

SEQ ID NO: 5406983 - DNA, 23 bp, Homo sapiens
ctgctggaagctgtcaggctggg

SEQ ID NO: 5406984 - DNA, 20 bp, Homo sapiens
ctgctggacagagactcagc

SEQ ID NO: 5406985 - DNA, 16 bp, Homo sapiens
ctgctggacagcctcc

SEQ ID NO: 5406986 - DNA, 19 bp, Homo sapiens
ctgctggacagcctccgcc

SEQ ID NO: 5406987 - DNA, 15 bp, Homo sapiens
ctgctggacagtatc

SEQ ID NO: 5406988 - DNA, 20 bp, Homo sapiens
ctgctggacagtatcactgt

SEQ ID NO: 5406989 - DNA, 22 bp, Homo sapiens
ctgctggactgtggagggtcac

SEQ ID NO: 5406990 - DNA, 17 bp, Homo sapiens
ctgctggagaaaccttc

SEQ ID NO: 5406991 - DNA, 19 bp, Homo sapiens
ctgctggagaaagccacgc

SEQ ID NO: 5406992 - DNA, 22 bp, Homo sapiens
ctgctggagaataaatttggga

SEQ ID NO: 5406993 - DNA, 15 bp, Homo sapiens
ctgctggagaggccc

SEQ ID NO: 5406994 - DNA, 20 bp, Homo sapiens
ctgctggagatcagcatgcc

SEQ ID NO: 5406995 - DNA, 22 bp, Homo sapiens
ctgctggaggaggggaagctgg

SEQ ID NO: 5406996 - DNA, 17 bp, Homo sapiens
ctgctggaggcctcagg

SEQ ID NO: 5406997 - DNA, 23 bp, Homo sapiens
ctgctggagttccggcctgggca

SEQ ID NO: 5406998 - DNA, 19 bp, Homo sapiens
ctgctggatctcccagggc

SEQ ID NO: 5406999 - DNA, 14 bp, Homo sapiens
ctgctggatcttgc

SEQ ID NO: 5407000 - DNA, 12 bp, Homo sapiens
ctgctggatgac

SEQ ID NO: 5407001 - DNA, 21 bp, Homo sapiens
ctgctggatgtcaccaagaag

SEQ ID NO: 5407002 - DNA, 13 bp, Homo sapiens
ctgctggcaaaga

SEQ ID NO: 5407003 - DNA, 21 bp, Homo sapiens
ctgctggcacatttccccaga

SEQ ID NO: 5407004 - DNA, 14 bp, Homo sapiens
ctgctggcacccac

SEQ ID NO: 5407005 - DNA, 17 bp, Homo sapiens
ctgctggcacccaccgt

SEQ ID NO: 5407006 - DNA, 20 bp, Homo sapiens
ctgctggcacctcagacaat

SEQ ID NO: 5407007 - DNA, 16 bp, Homo sapiens
ctgctggcagggccag

SEQ ID NO: 5407008 - DNA, 17 bp, Homo sapiens
ctgctggcagggccagg

SEQ ID NO: 5407009 - DNA, 20 bp, Homo sapiens
ctgctggcagggccagggca

SEQ ID NO: 5407010 - DNA, 22 bp, Homo sapiens
ctgctggcagggccagggcaat

SEQ ID NO: 5407011 - DNA, 23 bp, Homo sapiens
ctgctggcagggccagggcaatg

SEQ ID NO: 5407012 - DNA, 18 bp, Homo sapiens
ctgctggcatcaggtctg

SEQ ID NO: 5407013 - DNA, 22 bp, Homo sapiens
ctgctggcatcaggtctgggca

SEQ ID NO: 5407014 - DNA, 12 bp, Homo sapiens
ctgctggccaaa

SEQ ID NO: 5407015 - DNA, 17 bp, Homo sapiens
ctgctggccaaagtcag

SEQ ID NO: 5407016 - DNA, 14 bp, Homo sapiens
ctgctggcccacag

SEQ ID NO: 5407017 - DNA, 16 bp, Homo sapiens
ctgctggcccagccaa

SEQ ID NO: 5407018 - DNA, 15 bp, Homo sapiens
ctgctggccgcctca

SEQ ID NO: 5407019 - DNA, 20 bp, Homo sapiens
ctgctggccgcctcaccccc

SEQ ID NO: 5407020 - DNA, 20 bp, Homo sapiens
ctgctggccgggcacagctg

SEQ ID NO: 5407021 - DNA, 12 bp, Homo sapiens
ctgctggcctcc

SEQ ID NO: 5407022 - DNA, 14 bp, Homo sapiens
ctgctggcctctgc

SEQ ID NO: 5407023 - DNA, 14 bp, Homo sapiens
ctgctggcctgctc

SEQ ID NO: 5407024 - DNA, 16 bp, Homo sapiens
ctgctggcctgctctt

SEQ ID NO: 5407025 - DNA, 13 bp, Homo sapiens
ctgctggcctgtc

SEQ ID NO: 5407026 - DNA, 14 bp, Homo sapiens
ctgctggcgcctct

SEQ ID NO: 5407027 - DNA, 15 bp, Homo sapiens
ctgctggcgcctctg

SEQ ID NO: 5407028 - DNA, 16 bp, Homo sapiens
ctgctggcgggaatac

SEQ ID NO: 5407029 - DNA, 11 bp, Homo sapiens
ctgctggctga

SEQ ID NO: 5407030 - DNA, 17 bp, Homo sapiens
ctgctggctgacctggg

SEQ ID NO: 5407031 - DNA, 19 bp, Homo sapiens
ctgctggctgacctgggcc

SEQ ID NO: 5407032 - DNA, 17 bp, Homo sapiens
ctgctggctgaggcttg

SEQ ID NO: 5407033 - DNA, 15 bp, Homo sapiens
ctgctggctgcctta

SEQ ID NO: 5407034 - DNA, 15 bp, Homo sapiens
ctgctggctgcggcc

SEQ ID NO: 5407035 - DNA, 19 bp, Homo sapiens
ctgctggctgcggccccct

SEQ ID NO: 5407036 - DNA, 15 bp, Homo sapiens
ctgctggctgtgaca

SEQ ID NO: 5407037 - DNA, 18 bp, Homo sapiens
ctgctggcttcagggagg

SEQ ID NO: 5407038 - DNA, 18 bp, Homo sapiens
ctgctggcttccagcttc

SEQ ID NO: 5407039 - DNA, 20 bp, Homo sapiens
ctgctggcttccagcttcag

SEQ ID NO: 5407040 - DNA, 16 bp, Homo sapiens
ctgctggcttgcagtg

SEQ ID NO: 5407041 - DNA, 18 bp, Homo sapiens
ctgctgggaaccccgcag

SEQ ID NO: 5407042 - DNA, 20 bp, Homo sapiens
ctgctgggaaccccgcagcc

SEQ ID NO: 5407043 - DNA, 21 bp, Homo sapiens
ctgctgggaaccccgcagccc

SEQ ID NO: 5407044 - DNA, 18 bp, Homo sapiens
ctgctgggacccacctcc

SEQ ID NO: 5407045 - DNA, 19 bp, Homo sapiens
ctgctgggacccacctccc

SEQ ID NO: 5407046 - DNA, 20 bp, Homo sapiens
ctgctgggacccacctcccc

SEQ ID NO: 5407047 - DNA, 23 bp, Homo sapiens
ctgctgggacccacctccccctc

SEQ ID NO: 5407048 - DNA, 22 bp, Homo sapiens
ctgctgggaccccagctagggc

SEQ ID NO: 5407049 - DNA, 13 bp, Homo sapiens
ctgctgggacttg

SEQ ID NO: 5407050 - DNA, 21 bp, Homo sapiens
ctgctgggacttgaacaaaga

SEQ ID NO: 5407051 - DNA, 15 bp, Homo sapiens
ctgctgggagcctct

SEQ ID NO: 5407052 - DNA, 18 bp, Homo sapiens
ctgctgggaggttaaaaa

SEQ ID NO: 5407053 - DNA, 14 bp, Homo sapiens
ctgctgggcactgg

SEQ ID NO: 5407054 - DNA, 16 bp, Homo sapiens
ctgctgggcactgggc

SEQ ID NO: 5407055 - DNA, 16 bp, Homo sapiens
ctgctgggccagtggc

SEQ ID NO: 5407056 - DNA, 23 bp, Homo sapiens
ctgctgggccagtggcactctgt

SEQ ID NO: 5407057 - DNA, 18 bp, Homo sapiens
ctgctgggccccgagcca

SEQ ID NO: 5407058 - DNA, 22 bp, Homo sapiens
ctgctgggcgtgtgtgacactg

SEQ ID NO: 5407059 - DNA, 23 bp, Homo sapiens
ctgctgggctacaaaccaggagc

SEQ ID NO: 5407060 - DNA, 15 bp, Homo sapiens
ctgctgggctaggtc

SEQ ID NO: 5407061 - DNA, 14 bp, Homo sapiens
ctgctgggctcagt

SEQ ID NO: 5407062 - DNA, 12 bp, Homo sapiens
ctgctgggctct

SEQ ID NO: 5407063 - DNA, 21 bp, Homo sapiens
ctgctgggctctccacctcag

SEQ ID NO: 5407064 - DNA, 22 bp, Homo sapiens
ctgctgggctctccacctcagc

SEQ ID NO: 5407065 - DNA, 23 bp, Homo sapiens
ctgctgggctctccacctcagcc

SEQ ID NO: 5407066 - DNA, 13 bp, Homo sapiens
ctgctgggctctg

SEQ ID NO: 5407067 - DNA, 12 bp, Homo sapiens
ctgctgggctgg

SEQ ID NO: 5407068 - DNA, 14 bp, Homo sapiens
ctgctgggctgggg

SEQ ID NO: 5407069 - DNA, 15 bp, Homo sapiens
ctgctgggctggggc

SEQ ID NO: 5407070 - DNA, 18 bp, Homo sapiens
ctgctgggctggggcctg

SEQ ID NO: 5407071 - DNA, 19 bp, Homo sapiens
ctgctgggctggggcctga

SEQ ID NO: 5407072 - DNA, 21 bp, Homo sapiens
ctgctgggctggggcctgatg

SEQ ID NO: 5407073 - DNA, 23 bp, Homo sapiens
ctgctggggaagaacagccccgg

SEQ ID NO: 5407074 - DNA, 15 bp, Homo sapiens
ctgctggggaagaca

SEQ ID NO: 5407075 - DNA, 19 bp, Homo sapiens
ctgctggggaagggttttc

SEQ ID NO: 5407076 - DNA, 21 bp, Homo sapiens
ctgctggggaagggttttctt

SEQ ID NO: 5407077 - DNA, 14 bp, Homo sapiens
ctgctggggatccc

SEQ ID NO: 5407078 - DNA, 22 bp, Homo sapiens
ctgctggggatccccgcctggc

SEQ ID NO: 5407079 - DNA, 15 bp, Homo sapiens
ctgctggggcagggc

SEQ ID NO: 5407080 - DNA, 17 bp, Homo sapiens
ctgctggggcagggccc

SEQ ID NO: 5407081 - DNA, 15 bp, Homo sapiens
ctgctggggcatgtg

SEQ ID NO: 5407082 - DNA, 20 bp, Homo sapiens
ctgctggggcatgtgtgcct

SEQ ID NO: 5407083 - DNA, 16 bp, Homo sapiens
ctgctggggcctggga

SEQ ID NO: 5407084 - DNA, 18 bp, Homo sapiens
ctgctggggcctgggaca

SEQ ID NO: 5407085 - DNA, 17 bp, Homo sapiens
ctgctggggctggtgag

SEQ ID NO: 5407086 - DNA, 21 bp, Homo sapiens
ctgctgggggtgagctgtact

SEQ ID NO: 5407087 - DNA, 18 bp, Homo sapiens
ctgctggggtctcaggtc

SEQ ID NO: 5407088 - DNA, 21 bp, Homo sapiens
ctgctggggtctcaggtccag

SEQ ID NO: 5407089 - DNA, 17 bp, Homo sapiens
ctgctgggtggcccatc

SEQ ID NO: 5407090 - DNA, 17 bp, Homo sapiens
ctgctgggtgtggcgca

SEQ ID NO: 5407091 - DNA, 14 bp, Homo sapiens
ctgctggtacctgc

SEQ ID NO: 5407092 - DNA, 18 bp, Homo sapiens
ctgctggtacctgccctc

SEQ ID NO: 5407093 - DNA, 19 bp, Homo sapiens
ctgctggtacctgccctct

SEQ ID NO: 5407094 - DNA, 15 bp, Homo sapiens
ctgctggtatttcta

SEQ ID NO: 5407095 - DNA, 16 bp, Homo sapiens
ctgctggtatttctaa

SEQ ID NO: 5407096 - DNA, 17 bp, Homo sapiens
ctgctggtcacagcctc

SEQ ID NO: 5407097 - DNA, 16 bp, Homo sapiens
ctgctggtccgtggga

SEQ ID NO: 5407098 - DNA, 22 bp, Homo sapiens
ctgctggtctcatttgggggcg

SEQ ID NO: 5407099 - DNA, 14 bp, Homo sapiens
ctgctggtctctgg

SEQ ID NO: 5407100 - DNA, 15 bp, Homo sapiens
ctgctggtgcacagc

SEQ ID NO: 5407101 - DNA, 23 bp, Homo sapiens
ctgctggtgccagggtgggtgtc

SEQ ID NO: 5407102 - DNA, 12 bp, Homo sapiens
ctgctggtgggg

SEQ ID NO: 5407103 - DNA, 21 bp, Homo sapiens
ctgctggttcctgactggcaa

SEQ ID NO: 5407104 - DNA, 13 bp, Homo sapiens
ctgctgtaaaatt

SEQ ID NO: 5407105 - DNA, 19 bp, Homo sapiens
ctgctgtaaatttggcttc

SEQ ID NO: 5407106 - DNA, 22 bp, Homo sapiens
ctgctgtaaatttggcttctgt

SEQ ID NO: 5407107 - DNA, 17 bp, Homo sapiens
ctgctgtaactgctgag

SEQ ID NO: 5407108 - DNA, 17 bp, Homo sapiens
ctgcttttctcccagaa

SEQ ID NO: 5407109 - DNA, 20 bp, Homo sapiens
ctgcttttctcccagaaggc

SEQ ID NO: 5407110 - DNA, 19 bp, Homo sapiens
ctgcttttctgccctggct

SEQ ID NO: 5407111 - DNA, 24 bp, Homo sapiens
ctgcttttctgccctggctgctgc

SEQ ID NO: 5407112 - DNA, 17 bp, Homo sapiens
ctgcttttctgtcctgg

SEQ ID NO: 5407113 - DNA, 11 bp, Homo sapiens
ctgcttttctt

SEQ ID NO: 5407114 - DNA, 18 bp, Homo sapiens
ctgcttttcttttctaac

SEQ ID NO: 5407115 - DNA, 16 bp, Homo sapiens
ctgcttttgagcctca

SEQ ID NO: 5407116 - DNA, 19 bp, Homo sapiens
ctgcttttgagcctcagac

SEQ ID NO: 5407117 - DNA, 21 bp, Homo sapiens
ctgcttttgatggctatgttt

SEQ ID NO: 5407118 - DNA, 13 bp, Homo sapiens
ctgcttttgcaaa

SEQ ID NO: 5407119 - DNA, 13 bp, Homo sapiens
ctgcttttgcaga

SEQ ID NO: 5407120 - DNA, 16 bp, Homo sapiens
ctgcttttgcatcttt

SEQ ID NO: 5407121 - DNA, 20 bp, Homo sapiens
ctgcttttgcccatataaaa

SEQ ID NO: 5407122 - DNA, 14 bp, Homo sapiens
ctgcttttggcctg

SEQ ID NO: 5407123 - DNA, 18 bp, Homo sapiens
ctgcttttggggctcttg

SEQ ID NO: 5407124 - DNA, 17 bp, Homo sapiens
ctgcttttggtctgtgt

SEQ ID NO: 5407125 - DNA, 21 bp, Homo sapiens
ctgcttttgtctatgggactc

SEQ ID NO: 5407126 - DNA, 16 bp, Homo sapiens
ctgcttttgtctccct

SEQ ID NO: 5407127 - DNA, 17 bp, Homo sapiens
ctgcttttgtgtcccat

SEQ ID NO: 5407128 - DNA, 18 bp, Homo sapiens
ctgctttttatggcctgt

SEQ ID NO: 5407129 - DNA, 15 bp, Homo sapiens
ctgctttttccttag

SEQ ID NO: 5407130 - DNA, 16 bp, Homo sapiens
ctgctttttgaaatga

SEQ ID NO: 5407131 - DNA, 14 bp, Homo sapiens
ctgctttttgacat

SEQ ID NO: 5407132 - DNA, 20 bp, Homo sapiens
ctgctttttgctttcttctt

SEQ ID NO: 5407133 - DNA, 14 bp, Homo sapiens
ctgctttttggaaa

SEQ ID NO: 5407134 - DNA, 20 bp, Homo sapiens
ctgctttttggaaagtcaga

SEQ ID NO: 5407135 - DNA, 19 bp, Homo sapiens
ctgcttttttttttccagc

SEQ ID NO: 5407136 - DNA, 19 bp, Homo sapiens
ctggaaaaaaaatatatat

SEQ ID NO: 5407137 - DNA, 15 bp, Homo sapiens
ctggaaaaaaataca

SEQ ID NO: 5407138 - DNA, 21 bp, Homo sapiens
ctggaaaaaaatacaaaaagc

SEQ ID NO: 5407139 - DNA, 22 bp, Homo sapiens
ctggaaaaaaatacaaaaagca

SEQ ID NO: 5407140 - DNA, 22 bp, Homo sapiens
ctggaaaaattaagttgttgaa

SEQ ID NO: 5407141 - DNA, 14 bp, Homo sapiens
ctggaaaacagaac

SEQ ID NO: 5407142 - DNA, 14 bp, Homo sapiens
ctggaaaacctcct

SEQ ID NO: 5407143 - DNA, 21 bp, Homo sapiens
ctggaaaactattgagccttg

SEQ ID NO: 5407144 - DNA, 22 bp, Homo sapiens
ctggaaaactattgagccttgc

SEQ ID NO: 5407145 - DNA, 15 bp, Homo sapiens
ctggaaaactcagga

SEQ ID NO: 5407146 - DNA, 15 bp, Homo sapiens
ctggaaaactggctg

SEQ ID NO: 5407147 - DNA, 22 bp, Homo sapiens
ctggaaaagaagaaactttgcc

SEQ ID NO: 5407148 - DNA, 14 bp, Homo sapiens
ctggaaaagaggag

SEQ ID NO: 5407149 - DNA, 19 bp, Homo sapiens
ctggaaaaggtgaaaatgt

SEQ ID NO: 5407150 - DNA, 23 bp, Homo sapiens
ctggaaaagtatgttagtgcaaa

SEQ ID NO: 5407151 - DNA, 17 bp, Homo sapiens
ctggaaaagtcacacag

SEQ ID NO: 5407152 - DNA, 19 bp, Homo sapiens
ctggaaaagtgatgtattt

SEQ ID NO: 5407153 - DNA, 22 bp, Homo sapiens
ctggaaaagttagtattaaaat

SEQ ID NO: 5407154 - DNA, 19 bp, Homo sapiens
ctggaaaataaaaggtcta

SEQ ID NO: 5407155 - DNA, 19 bp, Homo sapiens
ctggaaaatagtcctccaa

SEQ ID NO: 5407156 - DNA, 21 bp, Homo sapiens
ctggaaaatgcttcttggctg

SEQ ID NO: 5407157 - DNA, 18 bp, Homo sapiens
ctggaaaatgtgacccag

SEQ ID NO: 5407158 - DNA, 15 bp, Homo sapiens
ctggaaacaaaacag

SEQ ID NO: 5407159 - DNA, 23 bp, Homo sapiens
ctggaaacaagtgaccccagggc

SEQ ID NO: 5407160 - DNA, 15 bp, Homo sapiens
ctggaaacacagtca

SEQ ID NO: 5407161 - DNA, 18 bp, Homo sapiens
ctggaaacagaggtaaaa

SEQ ID NO: 5407162 - DNA, 21 bp, Homo sapiens
ctggaaacagaggtaaaaaaa

SEQ ID NO: 5407163 - DNA, 16 bp, Homo sapiens
ctggaaacagcagtgt

SEQ ID NO: 5407164 - DNA, 13 bp, Homo sapiens
ctggaaacagcat

SEQ ID NO: 5407165 - DNA, 17 bp, Homo sapiens
ctggaaacagcatgaat

SEQ ID NO: 5407166 - DNA, 19 bp, Homo sapiens
ctggaaacattcaggagct

SEQ ID NO: 5407167 - DNA, 14 bp, Homo sapiens
ctggaaaccaagtc

SEQ ID NO: 5407168 - DNA, 23 bp, Homo sapiens
ctggaaaccaagtcaggccaggt

SEQ ID NO: 5407169 - DNA, 16 bp, Homo sapiens
ctggaaaccacagtcc

SEQ ID NO: 5407170 - DNA, 19 bp, Homo sapiens
ctggaaacccacctctctg

SEQ ID NO: 5407171 - DNA, 20 bp, Homo sapiens
ctggaaaccttccacccagt

SEQ ID NO: 5407172 - DNA, 17 bp, Homo sapiens
ctggaaactgctcagac

SEQ ID NO: 5407173 - DNA, 11 bp, Homo sapiens
ctggaaagaag

SEQ ID NO: 5407174 - DNA, 19 bp, Homo sapiens
ctggaaagcacaagactgg

SEQ ID NO: 5407175 - DNA, 21 bp, Homo sapiens
ctggaaagcacgccggcctgc

SEQ ID NO: 5407176 - DNA, 19 bp, Homo sapiens
ctggaaagcagagcctcct

SEQ ID NO: 5407177 - DNA, 19 bp, Homo sapiens
ctggaaagcccccccttat

SEQ ID NO: 5407178 - DNA, 19 bp, Homo sapiens
ctggaaagcccgctagaag

SEQ ID NO: 5407179 - DNA, 21 bp, Homo sapiens
ctggaaaggaaagatgatgct

SEQ ID NO: 5407180 - DNA, 15 bp, Homo sapiens
ctggaaaggcccgga

SEQ ID NO: 5407181 - DNA, 21 bp, Homo sapiens
ctggaaaggctcagtctcagg

SEQ ID NO: 5407182 - DNA, 13 bp, Homo sapiens
ctggaaaggggag

SEQ ID NO: 5407183 - DNA, 18 bp, Homo sapiens
ctggaaaggggagagcct

SEQ ID NO: 5407184 - DNA, 20 bp, Homo sapiens
ctggaaaggggagagcctgc

SEQ ID NO: 5407185 - DNA, 21 bp, Homo sapiens
ctggaaaggggagagcctgct

SEQ ID NO: 5407186 - DNA, 19 bp, Homo sapiens
ctggaaaggggggagctgg

SEQ ID NO: 5407187 - DNA, 23 bp, Homo sapiens
ctggaaaggggggagctggggaa

SEQ ID NO: 5407188 - DNA, 22 bp, Homo sapiens
ctggaaagttgggatttgcaaa

SEQ ID NO: 5407189 - DNA, 23 bp, Homo sapiens
ctggaaagttgggcccctgagga

SEQ ID NO: 5407190 - DNA, 19 bp, Homo sapiens
ctggaaataaacctggaga

SEQ ID NO: 5407191 - DNA, 23 bp, Homo sapiens
ctggaaataaacctggagatgat

SEQ ID NO: 5407192 - DNA, 23 bp, Homo sapiens
ctggaaatactagatttgggaga

SEQ ID NO: 5407193 - DNA, 23 bp, Homo sapiens
ctggaaatactgatggaagcaca

SEQ ID NO: 5407194 - DNA, 23 bp, Homo sapiens
ctggaaatatcagttactcagcc

SEQ ID NO: 5407195 - DNA, 14 bp, Homo sapiens
ctggaaatccagat

SEQ ID NO: 5407196 - DNA, 15 bp, Homo sapiens
ctggaaatctggatt

SEQ ID NO: 5407197 - DNA, 20 bp, Homo sapiens
ctggaaatctggattttcag

SEQ ID NO: 5407198 - DNA, 21 bp, Homo sapiens
ctggaaatctgttttgtatat

SEQ ID NO: 5407199 - DNA, 17 bp, Homo sapiens
ctggaaatgatgttggt

SEQ ID NO: 5407200 - DNA, 21 bp, Homo sapiens
ctggaaatgtaaaattgaaaa

SEQ ID NO: 5407201 - DNA, 22 bp, Homo sapiens
ctggaaattaattttctcttta

SEQ ID NO: 5407202 - DNA, 16 bp, Homo sapiens
ctggaaattccaggaa

SEQ ID NO: 5407203 - DNA, 18 bp, Homo sapiens
ctggaaattcttatttcc

SEQ ID NO: 5407204 - DNA, 16 bp, Homo sapiens
ctggaaattcttccct

SEQ ID NO: 5407205 - DNA, 22 bp, Homo sapiens
ctggaaattcttccctgggggt

SEQ ID NO: 5407206 - DNA, 22 bp, Homo sapiens
ctggaacaaatcgtttctcaga

SEQ ID NO: 5407207 - DNA, 16 bp, Homo sapiens
ctggaacaaattattt

SEQ ID NO: 5407208 - DNA, 20 bp, Homo sapiens
ctggaacacaaagaccaaaa

SEQ ID NO: 5407209 - DNA, 15 bp, Homo sapiens
ctggaacacaggggc

SEQ ID NO: 5407210 - DNA, 18 bp, Homo sapiens
ctggaacacaggggcctt

SEQ ID NO: 5407211 - DNA, 23 bp, Homo sapiens
ctggaacatcctttgcagggcag

SEQ ID NO: 5407212 - DNA, 16 bp, Homo sapiens
ctggaacatctcacct

SEQ ID NO: 5407213 - DNA, 23 bp, Homo sapiens
ctggaacatgggcattgggttct

SEQ ID NO: 5407214 - DNA, 17 bp, Homo sapiens
ctggaaccacattgaag

SEQ ID NO: 5407215 - DNA, 20 bp, Homo sapiens
ctggaaccacattgaagaat

SEQ ID NO: 5407216 - DNA, 13 bp, Homo sapiens
ctggaaccactga

SEQ ID NO: 5407217 - DNA, 17 bp, Homo sapiens
ctggaaccagggaggag

SEQ ID NO: 5407218 - DNA, 19 bp, Homo sapiens
ctggaaccagggaggagag

SEQ ID NO: 5407219 - DNA, 13 bp, Homo sapiens
ctggaacccagac

SEQ ID NO: 5407220 - DNA, 14 bp, Homo sapiens
ctggaacccagact

SEQ ID NO: 5407221 - DNA, 18 bp, Homo sapiens
ctggaacccaggaggtgg

SEQ ID NO: 5407222 - DNA, 13 bp, Homo sapiens
ctggaacccatgt

SEQ ID NO: 5407223 - DNA, 19 bp, Homo sapiens
ctggaaccgggaagggtgg

SEQ ID NO: 5407224 - DNA, 13 bp, Homo sapiens
ctggaacctacca

SEQ ID NO: 5407225 - DNA, 12 bp, Homo sapiens
ctggaacctcag

SEQ ID NO: 5407226 - DNA, 15 bp, Homo sapiens
ctggaacctcagcct

SEQ ID NO: 5407227 - DNA, 16 bp, Homo sapiens
ctggaacctcagcctg

SEQ ID NO: 5407228 - DNA, 18 bp, Homo sapiens
ctggaacctccctgggcc

SEQ ID NO: 5407229 - DNA, 16 bp, Homo sapiens
ctggaacctgcaaaaa

SEQ ID NO: 5407230 - DNA, 21 bp, Homo sapiens
ctggaacctgcaaaaaatact

SEQ ID NO: 5407231 - DNA, 21 bp, Homo sapiens
ctggaacctggaccccagcct

SEQ ID NO: 5407232 - DNA, 19 bp, Homo sapiens
ctggaacctggcaggccct

SEQ ID NO: 5407233 - DNA, 20 bp, Homo sapiens
ctggaacctggcaggccctg

SEQ ID NO: 5407234 - DNA, 18 bp, Homo sapiens
ctggaaccttgctgtcct

SEQ ID NO: 5407235 - DNA, 14 bp, Homo sapiens
ctggaacctttccc

SEQ ID NO: 5407236 - DNA, 12 bp, Homo sapiens
ctggaacgctct

SEQ ID NO: 5407237 - DNA, 17 bp, Homo sapiens
ctggaacgctctaggca

SEQ ID NO: 5407238 - DNA, 20 bp, Homo sapiens
ctggaacgctctaggcagaa

SEQ ID NO: 5407239 - DNA, 20 bp, Homo sapiens
ctggaacgtttcactgcaaa

SEQ ID NO: 5407240 - DNA, 17 bp, Homo sapiens
ctggaactcagtgtgac

SEQ ID NO: 5407241 - DNA, 23 bp, Homo sapiens
ctggaactctatctgggcctggg

SEQ ID NO: 5407242 - DNA, 21 bp, Homo sapiens
ctggaactgattgctcccagg

SEQ ID NO: 5407243 - DNA, 14 bp, Homo sapiens
ctggaactgctgct

SEQ ID NO: 5407244 - DNA, 17 bp, Homo sapiens
ctggaactgctgctgac

SEQ ID NO: 5407245 - DNA, 18 bp, Homo sapiens
ctggaactgctgctgacc

SEQ ID NO: 5407246 - DNA, 21 bp, Homo sapiens
ctggaactgctgctgacccct

SEQ ID NO: 5407247 - DNA, 13 bp, Homo sapiens
ctggaactgtagg

SEQ ID NO: 5407248 - DNA, 14 bp, Homo sapiens
ctggaacttgggga

SEQ ID NO: 5407249 - DNA, 14 bp, Homo sapiens
ctggaactttagtg

SEQ ID NO: 5407250 - DNA, 12 bp, Homo sapiens
ctggaagaaaaa

SEQ ID NO: 5407251 - DNA, 13 bp, Homo sapiens
ctggaagaaagca

SEQ ID NO: 5407252 - DNA, 20 bp, Homo sapiens
ctggaagaaagcaacaaaga

SEQ ID NO: 5407253 - DNA, 20 bp, Homo sapiens
ctggaagaaagccctgtgct

SEQ ID NO: 5407254 - DNA, 12 bp, Homo sapiens
ctggaagaaagg

SEQ ID NO: 5407255 - DNA, 21 bp, Homo sapiens
ctggaagaacaggcctctcca

SEQ ID NO: 5407256 - DNA, 18 bp, Homo sapiens
ctggaagaacccttctca

SEQ ID NO: 5407257 - DNA, 18 bp, Homo sapiens
ctggaagacacttcagat

SEQ ID NO: 5407258 - DNA, 20 bp, Homo sapiens
ctggaagacacttcagatct

SEQ ID NO: 5407259 - DNA, 21 bp, Homo sapiens
ctggaagacagagacctcctg

SEQ ID NO: 5407260 - DNA, 12 bp, Homo sapiens
ctggaagactgc

SEQ ID NO: 5407261 - DNA, 18 bp, Homo sapiens
ctggaagactgctcccgg

SEQ ID NO: 5407262 - DNA, 19 bp, Homo sapiens
ctggaagactgtgcagaag

SEQ ID NO: 5407263 - DNA, 12 bp, Homo sapiens
ctggaagagagg

SEQ ID NO: 5407264 - DNA, 11 bp, Homo sapiens
ctggaagagcc

SEQ ID NO: 5407265 - DNA, 13 bp, Homo sapiens
ctggaagagccaa

SEQ ID NO: 5407266 - DNA, 17 bp, Homo sapiens
ctggaagagctgagacc

SEQ ID NO: 5407267 - DNA, 19 bp, Homo sapiens
ctggaagagctgagacctt

SEQ ID NO: 5407268 - DNA, 13 bp, Homo sapiens
ctggaagagctgg

SEQ ID NO: 5407269 - DNA, 17 bp, Homo sapiens
ctggaagaggccttccc

SEQ ID NO: 5407270 - DNA, 22 bp, Homo sapiens
ctggaagagggtgaaaggcagg

SEQ ID NO: 5407271 - DNA, 19 bp, Homo sapiens
ctggaagatagctgtgact

SEQ ID NO: 5407272 - DNA, 14 bp, Homo sapiens
ctggaagatgggga

SEQ ID NO: 5407273 - DNA, 18 bp, Homo sapiens
ctggaagcacagcctcgg

SEQ ID NO: 5407274 - DNA, 14 bp, Homo sapiens
ctggaagcacagct

SEQ ID NO: 5407275 - DNA, 15 bp, Homo sapiens
ctggaagcacagctt

SEQ ID NO: 5407276 - DNA, 16 bp, Homo sapiens
ctggaagcactgctgt

SEQ ID NO: 5407277 - DNA, 13 bp, Homo sapiens
ctggaagcagaaa

SEQ ID NO: 5407278 - DNA, 21 bp, Homo sapiens
ctggaagcagaaacaaaatga

SEQ ID NO: 5407279 - DNA, 14 bp, Homo sapiens
ctggaagcagagca

SEQ ID NO: 5407280 - DNA, 22 bp, Homo sapiens
ctggaagcaggatggagctgac

SEQ ID NO: 5407281 - DNA, 23 bp, Homo sapiens
ctggaagcaggatggagctgact

SEQ ID NO: 5407282 - DNA, 19 bp, Homo sapiens
ctggaagcagtgcccaggt

SEQ ID NO: 5407283 - DNA, 22 bp, Homo sapiens
ctggaagcatttgtttctactt

SEQ ID NO: 5407284 - DNA, 17 bp, Homo sapiens
ctggacatagagaggga

SEQ ID NO: 5407285 - DNA, 23 bp, Homo sapiens
ctggacatagagagggagaagaa

SEQ ID NO: 5407286 - DNA, 16 bp, Homo sapiens
ctggacatcacagcag

SEQ ID NO: 5407287 - DNA, 18 bp, Homo sapiens
ctggacatcacagcagaa

SEQ ID NO: 5407288 - DNA, 16 bp, Homo sapiens
ctggacatgaaggaaa

SEQ ID NO: 5407289 - DNA, 20 bp, Homo sapiens
ctggacatgagatggagagg

SEQ ID NO: 5407290 - DNA, 23 bp, Homo sapiens
ctggacatgagatggagaggctg

SEQ ID NO: 5407291 - DNA, 12 bp, Homo sapiens
ctggacatggcc

SEQ ID NO: 5407292 - DNA, 18 bp, Homo sapiens
ctggacatggcccattgg

SEQ ID NO: 5407293 - DNA, 19 bp, Homo sapiens
ctggacattaacaagatca

SEQ ID NO: 5407294 - DNA, 14 bp, Homo sapiens
ctggacattctctt

SEQ ID NO: 5407295 - DNA, 22 bp, Homo sapiens
ctggacattctctttgataaca

SEQ ID NO: 5407296 - DNA, 19 bp, Homo sapiens
ctggacatttaacttttct

SEQ ID NO: 5407297 - DNA, 22 bp, Homo sapiens
ctggacatttaacttttctacc

SEQ ID NO: 5407298 - DNA, 21 bp, Homo sapiens
ctggacatttcatataaatgg

SEQ ID NO: 5407299 - DNA, 20 bp, Homo sapiens
ctggacatttgtggcagtgc

SEQ ID NO: 5407300 - DNA, 23 bp, Homo sapiens
ctggacatttgtggcagtgctga

SEQ ID NO: 5407301 - DNA, 13 bp, Homo sapiens
ctggaccaaagct

SEQ ID NO: 5407302 - DNA, 21 bp, Homo sapiens
ctggaccaaccctgtttcctg

SEQ ID NO: 5407303 - DNA, 16 bp, Homo sapiens
ctggaccaaggtgcgg

SEQ ID NO: 5407304 - DNA, 14 bp, Homo sapiens
ctggaccactgggc

SEQ ID NO: 5407305 - DNA, 15 bp, Homo sapiens
ctggaccactgggca

SEQ ID NO: 5407306 - DNA, 17 bp, Homo sapiens
ctggaccagacaatgtt

SEQ ID NO: 5407307 - DNA, 15 bp, Homo sapiens
ctggaccagagactt

SEQ ID NO: 5407308 - DNA, 14 bp, Homo sapiens
ctggaccagatgct

SEQ ID NO: 5407309 - DNA, 12 bp, Homo sapiens
ctggaccagcct

SEQ ID NO: 5407310 - DNA, 18 bp, Homo sapiens
ctggaccagcctctccac

SEQ ID NO: 5407311 - DNA, 16 bp, Homo sapiens
ctggaccatgctgaga

SEQ ID NO: 5407312 - DNA, 19 bp, Homo sapiens
ctggaccattcctgtccct

SEQ ID NO: 5407313 - DNA, 20 bp, Homo sapiens
ctggaccattcctgtccctt

SEQ ID NO: 5407314 - DNA, 11 bp, Homo sapiens
ctggacccagc

SEQ ID NO: 5407315 - DNA, 13 bp, Homo sapiens
ctggacccagcca

SEQ ID NO: 5407316 - DNA, 20 bp, Homo sapiens
ctggaccccactggctgaga

SEQ ID NO: 5407317 - DNA, 13 bp, Homo sapiens
ctggaccccagcc

SEQ ID NO: 5407318 - DNA, 14 bp, Homo sapiens
ctggaccccagcct

SEQ ID NO: 5407319 - DNA, 17 bp, Homo sapiens
ctggaccccagcctcaa

SEQ ID NO: 5407320 - DNA, 15 bp, Homo sapiens
ctggaccccagcctt

SEQ ID NO: 5407321 - DNA, 18 bp, Homo sapiens
ctggaccccagccttggt

SEQ ID NO: 5407322 - DNA, 14 bp, Homo sapiens
ctggacccccagct

SEQ ID NO: 5407323 - DNA, 14 bp, Homo sapiens
ctggaccccctgcc

SEQ ID NO: 5407324 - DNA, 15 bp, Homo sapiens
ctggaccccctgccc

SEQ ID NO: 5407325 - DNA, 20 bp, Homo sapiens
ctggaccccgcctcccagcc

SEQ ID NO: 5407326 - DNA, 13 bp, Homo sapiens
ctggacccctgca

SEQ ID NO: 5407327 - DNA, 15 bp, Homo sapiens
ctggacccctgcatt

SEQ ID NO: 5407328 - DNA, 13 bp, Homo sapiens
ctggacccctggg

SEQ ID NO: 5407329 - DNA, 16 bp, Homo sapiens
ctggacccctgggcct

SEQ ID NO: 5407330 - DNA, 17 bp, Homo sapiens
ctggacccctgggcctc

SEQ ID NO: 5407331 - DNA, 17 bp, Homo sapiens
ctggacccctggggtgg

SEQ ID NO: 5407332 - DNA, 21 bp, Homo sapiens
ctggacccctggggtggccag

SEQ ID NO: 5407333 - DNA, 23 bp, Homo sapiens
ctggacccctggggtggccaggg

SEQ ID NO: 5407334 - DNA, 15 bp, Homo sapiens
ctggacccggcctcc

SEQ ID NO: 5407335 - DNA, 20 bp, Homo sapiens
ctggacccgttcatggggga

SEQ ID NO: 5407336 - DNA, 23 bp, Homo sapiens
ctggacccgttcatgggggaggg

SEQ ID NO: 5407337 - DNA, 23 bp, Homo sapiens
ctggaccgagtggaccacgacct

SEQ ID NO: 5407338 - DNA, 17 bp, Homo sapiens
ctggaccgctgactgca

SEQ ID NO: 5407339 - DNA, 21 bp, Homo sapiens
ctggaccgctgactgcaccag

SEQ ID NO: 5407340 - DNA, 15 bp, Homo sapiens
ctggaccgtttccaa

SEQ ID NO: 5407341 - DNA, 20 bp, Homo sapiens
ctggacctagggtggcctga

SEQ ID NO: 5407342 - DNA, 14 bp, Homo sapiens
ctggacctatgcag

SEQ ID NO: 5407343 - DNA, 17 bp, Homo sapiens
ctggacctatgcaggga

SEQ ID NO: 5407344 - DNA, 19 bp, Homo sapiens
ctggacctatgtcctaagg

SEQ ID NO: 5407345 - DNA, 20 bp, Homo sapiens
ctggacctatgtcctaagga

SEQ ID NO: 5407346 - DNA, 13 bp, Homo sapiens
ctggacctcacca

SEQ ID NO: 5407347 - DNA, 18 bp, Homo sapiens
ctggacctccatccctgc

SEQ ID NO: 5407348 - DNA, 21 bp, Homo sapiens
ctggacctccatccctgctct

SEQ ID NO: 5407349 - DNA, 22 bp, Homo sapiens
ctggacctccccctcttggtcc

SEQ ID NO: 5407350 - DNA, 18 bp, Homo sapiens
ctggacctcggtgatgcc

SEQ ID NO: 5407351 - DNA, 20 bp, Homo sapiens
ctggacctcggtgatgcctt

SEQ ID NO: 5407352 - DNA, 13 bp, Homo sapiens
ctggacctctctt

SEQ ID NO: 5407353 - DNA, 17 bp, Homo sapiens
ctggacctctgacagca

SEQ ID NO: 5407354 - DNA, 14 bp, Homo sapiens
ctggacctctgggt

SEQ ID NO: 5407355 - DNA, 15 bp, Homo sapiens
ctggacctgaccaga

SEQ ID NO: 5407356 - DNA, 12 bp, Homo sapiens
ctggacctgagt

SEQ ID NO: 5407357 - DNA, 13 bp, Homo sapiens
ctggacctgagtc

SEQ ID NO: 5407358 - DNA, 12 bp, Homo sapiens
ctggacctgccc

SEQ ID NO: 5407359 - DNA, 15 bp, Homo sapiens
ctggacctgcctcct

SEQ ID NO: 5407360 - DNA, 14 bp, Homo sapiens
ctggacctgctgac

SEQ ID NO: 5407361 - DNA, 12 bp, Homo sapiens
ctggacctggaa

SEQ ID NO: 5407362 - DNA, 14 bp, Homo sapiens
ctggacctgggggt

SEQ ID NO: 5407363 - DNA, 22 bp, Homo sapiens
ctggacctgggggtagccccgc

SEQ ID NO: 5407364 - DNA, 13 bp, Homo sapiens
ctggacctggggt

SEQ ID NO: 5407365 - DNA, 16 bp, Homo sapiens
ctggacctggggtccc

SEQ ID NO: 5407366 - DNA, 20 bp, Homo sapiens
ctggacctggggtcccccct

SEQ ID NO: 5407367 - DNA, 21 bp, Homo sapiens
ctggacctggggtcccccctc

SEQ ID NO: 5407368 - DNA, 16 bp, Homo sapiens
ctggacctgtatattt

SEQ ID NO: 5407369 - DNA, 13 bp, Homo sapiens
ctggaccttgaca

SEQ ID NO: 5407370 - DNA, 19 bp, Homo sapiens
ctggacctttgggttcttt

SEQ ID NO: 5407371 - DNA, 19 bp, Homo sapiens
ctggaccttttcccttgct

SEQ ID NO: 5407372 - DNA, 22 bp, Homo sapiens
ctggaccttttcccttgctgta

SEQ ID NO: 5407373 - DNA, 18 bp, Homo sapiens
ctggacgaagagcaggcc

SEQ ID NO: 5407374 - DNA, 18 bp, Homo sapiens
ctggacgcagccacacag

SEQ ID NO: 5407375 - DNA, 22 bp, Homo sapiens
ctggacgcccagctgaggctgg

SEQ ID NO: 5407376 - DNA, 18 bp, Homo sapiens
ctggacgccgagggcagc

SEQ ID NO: 5407377 - DNA, 12 bp, Homo sapiens
ctggacgctgcc

SEQ ID NO: 5407378 - DNA, 14 bp, Homo sapiens
ctggacggaagtgg

SEQ ID NO: 5407379 - DNA, 17 bp, Homo sapiens
ctggacggaagtggtgg

SEQ ID NO: 5407380 - DNA, 13 bp, Homo sapiens
ctggacggcaggc

SEQ ID NO: 5407381 - DNA, 22 bp, Homo sapiens
ctggacggcaggctcactgcca

SEQ ID NO: 5407382 - DNA, 19 bp, Homo sapiens
ctggacggcattcctgctt

SEQ ID NO: 5407383 - DNA, 19 bp, Homo sapiens
ctggacggggcgggccctg

SEQ ID NO: 5407384 - DNA, 13 bp, Homo sapiens
ctggacgtgaaat

SEQ ID NO: 5407385 - DNA, 19 bp, Homo sapiens
ctggactaaccctgtggtt

SEQ ID NO: 5407386 - DNA, 16 bp, Homo sapiens
ctggactacacccaag

SEQ ID NO: 5407387 - DNA, 16 bp, Homo sapiens
ctggactagaaaatct

SEQ ID NO: 5407388 - DNA, 12 bp, Homo sapiens
ctggactagtgt

SEQ ID NO: 5407389 - DNA, 19 bp, Homo sapiens
ctggactatagcagggctg

SEQ ID NO: 5407390 - DNA, 19 bp, Homo sapiens
ctggactattgtgccaact

SEQ ID NO: 5407391 - DNA, 16 bp, Homo sapiens
ctggactcaggaactt

SEQ ID NO: 5407392 - DNA, 20 bp, Homo sapiens
ctggactcaggatgcccagg

SEQ ID NO: 5407393 - DNA, 23 bp, Homo sapiens
ctggactccacgatgcctttgag

SEQ ID NO: 5407394 - DNA, 15 bp, Homo sapiens
ctggactccagatct

SEQ ID NO: 5407395 - DNA, 18 bp, Homo sapiens
ctggactccagatctgca

SEQ ID NO: 5407396 - DNA, 19 bp, Homo sapiens
ctggactcccactctttga

SEQ ID NO: 5407397 - DNA, 13 bp, Homo sapiens
ctggactcccctc

SEQ ID NO: 5407398 - DNA, 18 bp, Homo sapiens
ctggactcccctccctgc

SEQ ID NO: 5407399 - DNA, 20 bp, Homo sapiens
ctggactccgaggtggttca

SEQ ID NO: 5407400 - DNA, 12 bp, Homo sapiens
ctggactccgga

SEQ ID NO: 5407401 - DNA, 14 bp, Homo sapiens
ctggactccggagg

SEQ ID NO: 5407402 - DNA, 20 bp, Homo sapiens
ctggactccggaggactgag

SEQ ID NO: 5407403 - DNA, 22 bp, Homo sapiens
ctggactccggaggactgagcc

SEQ ID NO: 5407404 - DNA, 13 bp, Homo sapiens
ctggactccggcc

SEQ ID NO: 5407405 - DNA, 15 bp, Homo sapiens
ctggactccggccct

SEQ ID NO: 5407406 - DNA, 19 bp, Homo sapiens
ctggactcctctgtccagg

SEQ ID NO: 5407407 - DNA, 20 bp, Homo sapiens
ctggactcctctgtccaggc

SEQ ID NO: 5407408 - DNA, 20 bp, Homo sapiens
ctggactcctgccaccagca

SEQ ID NO: 5407409 - DNA, 23 bp, Homo sapiens
ctggactctaaagtctgttgatt

SEQ ID NO: 5407410 - DNA, 20 bp, Homo sapiens
ctggactctaagctggagct

SEQ ID NO: 5407411 - DNA, 18 bp, Homo sapiens
ctggactctgcatcccag

SEQ ID NO: 5407412 - DNA, 14 bp, Homo sapiens
ctggactctggact

SEQ ID NO: 5407413 - DNA, 21 bp, Homo sapiens
ctggactctggactttctcta

SEQ ID NO: 5407414 - DNA, 20 bp, Homo sapiens
ctggactctgtggggccaca

SEQ ID NO: 5407415 - DNA, 23 bp, Homo sapiens
ctggactgaagcctgcaggagtt

SEQ ID NO: 5407416 - DNA, 12 bp, Homo sapiens
ctggactgaatt

SEQ ID NO: 5407417 - DNA, 17 bp, Homo sapiens
ctggactgaccaaagac

SEQ ID NO: 5407418 - DNA, 14 bp, Homo sapiens
ctggactgaccaca

SEQ ID NO: 5407419 - DNA, 19 bp, Homo sapiens
ctggactgaccctgcaggt

SEQ ID NO: 5407420 - DNA, 13 bp, Homo sapiens
ctggactgactgc

SEQ ID NO: 5407421 - DNA, 19 bp, Homo sapiens
ctggactgactgcagcccc

SEQ ID NO: 5407422 - DNA, 23 bp, Homo sapiens
ctggactgagccaaggaggcctg

SEQ ID NO: 5407423 - DNA, 15 bp, Homo sapiens
ctggactgaggacca

SEQ ID NO: 5407424 - DNA, 16 bp, Homo sapiens
ctggactgaggcctga

SEQ ID NO: 5407425 - DNA, 18 bp, Homo sapiens
ctggactgagggggcctg

SEQ ID NO: 5407426 - DNA, 20 bp, Homo sapiens
ctggactgatggttgctttg

SEQ ID NO: 5407427 - DNA, 17 bp, Homo sapiens
ctggactgcaatatcaa

SEQ ID NO: 5407428 - DNA, 20 bp, Homo sapiens
ctggactgcaatatcaacaa

SEQ ID NO: 5407429 - DNA, 17 bp, Homo sapiens
ctggactgcacaggcag

SEQ ID NO: 5407430 - DNA, 14 bp, Homo sapiens
ctggactgcatggg

SEQ ID NO: 5407431 - DNA, 23 bp, Homo sapiens
ctggactgcatggggaggcagca

SEQ ID NO: 5407432 - DNA, 22 bp, Homo sapiens
ctggactgctattctagagctt

SEQ ID NO: 5407433 - DNA, 20 bp, Homo sapiens
ctggactggaaagcacaaga

SEQ ID NO: 5407434 - DNA, 19 bp, Homo sapiens
ctggactggaggcccctgg

SEQ ID NO: 5407435 - DNA, 15 bp, Homo sapiens
ctggactggaggtgg

SEQ ID NO: 5407436 - DNA, 18 bp, Homo sapiens
ctggactggaggtgggca

SEQ ID NO: 5407437 - DNA, 24 bp, Homo sapiens
ctggactggaggtgggcatgccac

SEQ ID NO: 5407438 - DNA, 22 bp, Homo sapiens
ctggactggccatttttctggg

SEQ ID NO: 5407439 - DNA, 17 bp, Homo sapiens
ctggactggcccttgcc

SEQ ID NO: 5407440 - DNA, 14 bp, Homo sapiens
ctggactggcctgt

SEQ ID NO: 5407441 - DNA, 15 bp, Homo sapiens
ctggactggctagag

SEQ ID NO: 5407442 - DNA, 13 bp, Homo sapiens
ctggactggctgt

SEQ ID NO: 5407443 - DNA, 16 bp, Homo sapiens
ctggactggctgtcct

SEQ ID NO: 5407444 - DNA, 15 bp, Homo sapiens
ctggactgggaaggg

SEQ ID NO: 5407445 - DNA, 21 bp, Homo sapiens
ctggactgggaagggggcagg

SEQ ID NO: 5407446 - DNA, 16 bp, Homo sapiens
ctggactgggaggtag

SEQ ID NO: 5407447 - DNA, 17 bp, Homo sapiens
ctggactgggaggtaga

SEQ ID NO: 5407448 - DNA, 23 bp, Homo sapiens
ctggactgggttttgtctctgca

SEQ ID NO: 5407449 - DNA, 12 bp, Homo sapiens
ctggactggtta

SEQ ID NO: 5407450 - DNA, 18 bp, Homo sapiens
ctggactggttatcttgt

SEQ ID NO: 5407451 - DNA, 19 bp, Homo sapiens
ctggactggttatcttgtt

SEQ ID NO: 5407452 - DNA, 12 bp, Homo sapiens
ctggactgtaga

SEQ ID NO: 5407453 - DNA, 22 bp, Homo sapiens
ctggactgtaggactatataaa

SEQ ID NO: 5407454 - DNA, 14 bp, Homo sapiens
ctggactgtggagg

SEQ ID NO: 5407455 - DNA, 16 bp, Homo sapiens
ctggactgtggagggt

SEQ ID NO: 5407456 - DNA, 23 bp, Homo sapiens
ctggactgtgtgctcaggagccc

SEQ ID NO: 5407457 - DNA, 23 bp, Homo sapiens
ctggactgttactgacttggatc

SEQ ID NO: 5407458 - DNA, 19 bp, Homo sapiens
ctggacttaaagaaaaaaa

SEQ ID NO: 5407459 - DNA, 23 bp, Homo sapiens
ctggacttaagcatctggctcta

SEQ ID NO: 5407460 - DNA, 12 bp, Homo sapiens
ctggacttcctg

SEQ ID NO: 5407461 - DNA, 13 bp, Homo sapiens
ctggacttcctgt

SEQ ID NO: 5407462 - DNA, 22 bp, Homo sapiens
ctggatggggcagagcttctcc

SEQ ID NO: 5407463 - DNA, 15 bp, Homo sapiens
ctggatggggctgca

SEQ ID NO: 5407464 - DNA, 13 bp, Homo sapiens
ctggatgggggct

SEQ ID NO: 5407465 - DNA, 18 bp, Homo sapiens
ctggatggtccagtgtca

SEQ ID NO: 5407466 - DNA, 12 bp, Homo sapiens
ctggatggtggc

SEQ ID NO: 5407467 - DNA, 15 bp, Homo sapiens
ctggatggtggccag

SEQ ID NO: 5407468 - DNA, 21 bp, Homo sapiens
ctggatggtgtgccttccaga

SEQ ID NO: 5407469 - DNA, 19 bp, Homo sapiens
ctggatgtcccctgtccca

SEQ ID NO: 5407470 - DNA, 16 bp, Homo sapiens
ctggatgtctgaactt

SEQ ID NO: 5407471 - DNA, 21 bp, Homo sapiens
ctggatgtctgaactttggga

SEQ ID NO: 5407472 - DNA, 15 bp, Homo sapiens
ctggatgtgcatctg

SEQ ID NO: 5407473 - DNA, 17 bp, Homo sapiens
ctggatgtgtggggcat

SEQ ID NO: 5407474 - DNA, 13 bp, Homo sapiens
ctggatgtttctc

SEQ ID NO: 5407475 - DNA, 20 bp, Homo sapiens
ctggatgttttttccctgtt

SEQ ID NO: 5407476 - DNA, 14 bp, Homo sapiens
ctggattaaaacaa

SEQ ID NO: 5407477 - DNA, 16 bp, Homo sapiens
ctggattaggagggtg

SEQ ID NO: 5407478 - DNA, 20 bp, Homo sapiens
ctggattataagttctattt

SEQ ID NO: 5407479 - DNA, 23 bp, Homo sapiens
ctggattataagttctattttac

SEQ ID NO: 5407480 - DNA, 17 bp, Homo sapiens
ctggattatattatgaa

SEQ ID NO: 5407481 - DNA, 23 bp, Homo sapiens
ctggattattcaaaatgatgtat

SEQ ID NO: 5407482 - DNA, 20 bp, Homo sapiens
ctggattcaattcctgtcct

SEQ ID NO: 5407483 - DNA, 19 bp, Homo sapiens
ctggattcacgccctcttg

SEQ ID NO: 5407484 - DNA, 14 bp, Homo sapiens
ctggattcagcctt

SEQ ID NO: 5407485 - DNA, 15 bp, Homo sapiens
ctggattcagccttc

SEQ ID NO: 5407486 - DNA, 18 bp, Homo sapiens
ctggattcagccttcttt

SEQ ID NO: 5407487 - DNA, 16 bp, Homo sapiens
ctggattcatttcctg

SEQ ID NO: 5407488 - DNA, 21 bp, Homo sapiens
ctggattccagagcactgctc

SEQ ID NO: 5407489 - DNA, 21 bp, Homo sapiens
ctggattccccatctcaggcc

SEQ ID NO: 5407490 - DNA, 21 bp, Homo sapiens
ctggattcccgtggctttgtg

SEQ ID NO: 5407491 - DNA, 16 bp, Homo sapiens
ctggattctaaacaac

SEQ ID NO: 5407492 - DNA, 20 bp, Homo sapiens
ctggattctgcctaataaaa

SEQ ID NO: 5407493 - DNA, 18 bp, Homo sapiens
ctggattctgggaggcaa

SEQ ID NO: 5407494 - DNA, 22 bp, Homo sapiens
ctggattgatcggagcctcctc

SEQ ID NO: 5407495 - DNA, 22 bp, Homo sapiens
ctggattggcaggtgtgggctc

SEQ ID NO: 5407496 - DNA, 23 bp, Homo sapiens
ctggattggcaggtgtgggctcc

SEQ ID NO: 5407497 - DNA, 19 bp, Homo sapiens
ctggattgtactttgtgct

SEQ ID NO: 5407498 - DNA, 20 bp, Homo sapiens
ctggattgtagaacttgttg

SEQ ID NO: 5407499 - DNA, 22 bp, Homo sapiens
ctggattgtgctttggttaata

SEQ ID NO: 5407500 - DNA, 15 bp, Homo sapiens
ctggatttcttccta

SEQ ID NO: 5407501 - DNA, 13 bp, Homo sapiens
ctggatttgatga

SEQ ID NO: 5407502 - DNA, 18 bp, Homo sapiens
ctggatttgcagaagttt

SEQ ID NO: 5407503 - DNA, 19 bp, Homo sapiens
ctggatttgggagctctgc

SEQ ID NO: 5407504 - DNA, 22 bp, Homo sapiens
ctggatttgggagctctgcttg

SEQ ID NO: 5407505 - DNA, 15 bp, Homo sapiens
ctggattttaagtag

SEQ ID NO: 5407506 - DNA, 16 bp, Homo sapiens
ctggattttcaaagat

SEQ ID NO: 5407507 - DNA, 17 bp, Homo sapiens
ctggattttcaaagatt

SEQ ID NO: 5407508 - DNA, 12 bp, Homo sapiens
ctggattttctt

SEQ ID NO: 5407509 - DNA, 20 bp, Homo sapiens
ctggattttctttctatgta

SEQ ID NO: 5407510 - DNA, 13 bp, Homo sapiens
ctggattttgaac

SEQ ID NO: 5407511 - DNA, 19 bp, Homo sapiens
ctggattttgccctctcct

SEQ ID NO: 5407512 - DNA, 13 bp, Homo sapiens
ctggattttgtca

SEQ ID NO: 5407513 - DNA, 14 bp, Homo sapiens
ctggatttttacca

SEQ ID NO: 5407514 - DNA, 18 bp, Homo sapiens
ctggattttttaaatcat

SEQ ID NO: 5407515 - DNA, 17 bp, Homo sapiens
ctggcaaaataaaacat

SEQ ID NO: 5407516 - DNA, 16 bp, Homo sapiens
ctggcaaacatgaaaa

SEQ ID NO: 5407517 - DNA, 22 bp, Homo sapiens
ctggcaaacatgaaaaatcggc

SEQ ID NO: 5407518 - DNA, 22 bp, Homo sapiens
ctggcaaaccctcccagaaaca

SEQ ID NO: 5407519 - DNA, 19 bp, Homo sapiens
ctggcaaacttcagactga

SEQ ID NO: 5407520 - DNA, 12 bp, Homo sapiens
ctggcaaagcag

SEQ ID NO: 5407521 - DNA, 21 bp, Homo sapiens
ctggcaaagcagaaaattgta

SEQ ID NO: 5407522 - DNA, 17 bp, Homo sapiens
ctggcaaaggaccagcg

SEQ ID NO: 5407523 - DNA, 12 bp, Homo sapiens
ctggcaaaggcc

SEQ ID NO: 5407524 - DNA, 18 bp, Homo sapiens
ctggcaaagggagcagaa

SEQ ID NO: 5407525 - DNA, 22 bp, Homo sapiens
ctggcaaagggagcagaactga

SEQ ID NO: 5407526 - DNA, 18 bp, Homo sapiens
ctggcaaaggtggctctc

SEQ ID NO: 5407527 - DNA, 19 bp, Homo sapiens
ctggcaaatattttgtcac

SEQ ID NO: 5407528 - DNA, 21 bp, Homo sapiens
ctggcaaatattttgtcactg

SEQ ID NO: 5407529 - DNA, 16 bp, Homo sapiens
ctggcaaatccaggct

SEQ ID NO: 5407530 - DNA, 17 bp, Homo sapiens
ctggcaaatccaggctg

SEQ ID NO: 5407531 - DNA, 18 bp, Homo sapiens
ctggcaaatccaggctgg

SEQ ID NO: 5407532 - DNA, 23 bp, Homo sapiens
ctggcaacaacagcttcagtcca

SEQ ID NO: 5407533 - DNA, 15 bp, Homo sapiens
ctggcaacacagagg

SEQ ID NO: 5407534 - DNA, 14 bp, Homo sapiens
ctggcaacagagca

SEQ ID NO: 5407535 - DNA, 15 bp, Homo sapiens
ctggcaaccagccag

SEQ ID NO: 5407536 - DNA, 16 bp, Homo sapiens
ctggcaaccagccagc

SEQ ID NO: 5407537 - DNA, 18 bp, Homo sapiens
ctggcaagaaagcttgag

SEQ ID NO: 5407538 - DNA, 13 bp, Homo sapiens
ctggcaagaatgg

SEQ ID NO: 5407539 - DNA, 16 bp, Homo sapiens
ctggcaagaggcctca

SEQ ID NO: 5407540 - DNA, 22 bp, Homo sapiens
ctggcaagcagggaaagctcca

SEQ ID NO: 5407541 - DNA, 19 bp, Homo sapiens
ctggcaagctagaacctgg

SEQ ID NO: 5407542 - DNA, 13 bp, Homo sapiens
ctggcaagctgca

SEQ ID NO: 5407543 - DNA, 21 bp, Homo sapiens
ctggcaaggtgggttccaggg

SEQ ID NO: 5407544 - DNA, 13 bp, Homo sapiens
ctggcaataaact

SEQ ID NO: 5407545 - DNA, 14 bp, Homo sapiens
ctggcaataaactc

SEQ ID NO: 5407546 - DNA, 20 bp, Homo sapiens
ctggcaatagtgtgttctga

SEQ ID NO: 5407547 - DNA, 21 bp, Homo sapiens
ctggcaatgaaaaattctcag

SEQ ID NO: 5407548 - DNA, 14 bp, Homo sapiens
ctggcaatgagtgt

SEQ ID NO: 5407549 - DNA, 12 bp, Homo sapiens
ctggcaatgcca

SEQ ID NO: 5407550 - DNA, 20 bp, Homo sapiens
ctggcaatgccacagccctg

SEQ ID NO: 5407551 - DNA, 21 bp, Homo sapiens
ctggcaatgccctacctgcct

SEQ ID NO: 5407552 - DNA, 21 bp, Homo sapiens
ctggcaatggtagtttctgtg

SEQ ID NO: 5407553 - DNA, 19 bp, Homo sapiens
ctggcaatgtttatttcat

SEQ ID NO: 5407554 - DNA, 15 bp, Homo sapiens
ctggcaattgtctat

SEQ ID NO: 5407555 - DNA, 13 bp, Homo sapiens
ctggcacactccc

SEQ ID NO: 5407556 - DNA, 19 bp, Homo sapiens
ctggcacagaaagggcagc

SEQ ID NO: 5407557 - DNA, 22 bp, Homo sapiens
ctggcacagaaagggcagcttc

SEQ ID NO: 5407558 - DNA, 18 bp, Homo sapiens
ctggcacagaagaggagt

SEQ ID NO: 5407559 - DNA, 18 bp, Homo sapiens
ctggcacagaccaggcct

SEQ ID NO: 5407560 - DNA, 16 bp, Homo sapiens
ctggcacagacttcac

SEQ ID NO: 5407561 - DNA, 13 bp, Homo sapiens
ctggcacagaggt

SEQ ID NO: 5407562 - DNA, 23 bp, Homo sapiens
ctggcacagcccctggagcctca

SEQ ID NO: 5407563 - DNA, 14 bp, Homo sapiens
ctggcacagcctgg

SEQ ID NO: 5407564 - DNA, 16 bp, Homo sapiens
ctggcacagcctggct

SEQ ID NO: 5407565 - DNA, 18 bp, Homo sapiens
ctggcacaggactgattc

SEQ ID NO: 5407566 - DNA, 15 bp, Homo sapiens
ctggcacagtgatgc

SEQ ID NO: 5407567 - DNA, 18 bp, Homo sapiens
ctggcacagtgatgccgg

SEQ ID NO: 5407568 - DNA, 19 bp, Homo sapiens
ctggcacagtgatgccggg

SEQ ID NO: 5407569 - DNA, 15 bp, Homo sapiens
ctggcacagtgtctg

SEQ ID NO: 5407570 - DNA, 19 bp, Homo sapiens
ctggcacagttttctgaga

SEQ ID NO: 5407571 - DNA, 22 bp, Homo sapiens
ctggcacagttttctgagaaag

SEQ ID NO: 5407572 - DNA, 18 bp, Homo sapiens
ctggcacattcattttct

SEQ ID NO: 5407573 - DNA, 16 bp, Homo sapiens
ctggcacattgcccct

SEQ ID NO: 5407574 - DNA, 21 bp, Homo sapiens
ctggcacattgcccctctgcc

SEQ ID NO: 5407575 - DNA, 23 bp, Homo sapiens
ctggcacattgcccctctgcctt

SEQ ID NO: 5407576 - DNA, 14 bp, Homo sapiens
ctggcacatttcag

SEQ ID NO: 5407577 - DNA, 17 bp, Homo sapiens
ctggcacccggcccctg

SEQ ID NO: 5407578 - DNA, 18 bp, Homo sapiens
ctggcacccggcccctgc

SEQ ID NO: 5407579 - DNA, 19 bp, Homo sapiens
ctggcacccggcccctgct

SEQ ID NO: 5407580 - DNA, 21 bp, Homo sapiens
ctggcaccgttatccctgcac

SEQ ID NO: 5407581 - DNA, 12 bp, Homo sapiens
ctggcacctcag

SEQ ID NO: 5407582 - DNA, 16 bp, Homo sapiens
ctggcacctgaaatta

SEQ ID NO: 5407583 - DNA, 18 bp, Homo sapiens
ctggcacctgaaattaat

SEQ ID NO: 5407584 - DNA, 18 bp, Homo sapiens
ctggcacgaaatggctga

SEQ ID NO: 5407585 - DNA, 23 bp, Homo sapiens
ctggcacgccctactccactgcc

SEQ ID NO: 5407586 - DNA, 15 bp, Homo sapiens
ctggcacgtggccag

SEQ ID NO: 5407587 - DNA, 20 bp, Homo sapiens
ctggcacgtggccaggagcc

SEQ ID NO: 5407588 - DNA, 19 bp, Homo sapiens
ctggcactaccaaaggaca

SEQ ID NO: 5407589 - DNA, 20 bp, Homo sapiens
ctggcactactcagttatta

SEQ ID NO: 5407590 - DNA, 22 bp, Homo sapiens
ctggcactataatgtaagctct

SEQ ID NO: 5407591 - DNA, 14 bp, Homo sapiens
ctggcactctgtgg

SEQ ID NO: 5407592 - DNA, 13 bp, Homo sapiens
ctggcactgaacc

SEQ ID NO: 5407593 - DNA, 16 bp, Homo sapiens
ctggcactgacagcct

SEQ ID NO: 5407594 - DNA, 18 bp, Homo sapiens
ctggcactgacagcctgg

SEQ ID NO: 5407595 - DNA, 20 bp, Homo sapiens
ctggcactgacagcctgggg

SEQ ID NO: 5407596 - DNA, 21 bp, Homo sapiens
ctggcactgacagcctggggg

SEQ ID NO: 5407597 - DNA, 19 bp, Homo sapiens
ctggcactgagcctgcttg

SEQ ID NO: 5407598 - DNA, 17 bp, Homo sapiens
ctggcactgcttccagt

SEQ ID NO: 5407599 - DNA, 18 bp, Homo sapiens
ctggcactggaccccagc

SEQ ID NO: 5407600 - DNA, 19 bp, Homo sapiens
ctggcactggaccccagca

SEQ ID NO: 5407601 - DNA, 22 bp, Homo sapiens
ctggcactggcaaacagggcct

SEQ ID NO: 5407602 - DNA, 18 bp, Homo sapiens
ctggcactgggaggcagg

SEQ ID NO: 5407603 - DNA, 22 bp, Homo sapiens
ctggcactggtttgttccctgt

SEQ ID NO: 5407604 - DNA, 13 bp, Homo sapiens
ctggcactgtggc

SEQ ID NO: 5407605 - DNA, 20 bp, Homo sapiens
ctggcactgtggcactgcca

SEQ ID NO: 5407606 - DNA, 24 bp, Homo sapiens
ctggcacttactggtccttaccag

SEQ ID NO: 5407607 - DNA, 18 bp, Homo sapiens
ctggcacttagcccaaga

SEQ ID NO: 5407608 - DNA, 13 bp, Homo sapiens
ctggcacttcctt

SEQ ID NO: 5407609 - DNA, 16 bp, Homo sapiens
ctggcacttggactct

SEQ ID NO: 5407610 - DNA, 14 bp, Homo sapiens
ctggcactttaatg

SEQ ID NO: 5407611 - DNA, 19 bp, Homo sapiens
ctggcacttttttaaatat

SEQ ID NO: 5407612 - DNA, 22 bp, Homo sapiens
ctggcacttttttaaatataaa

SEQ ID NO: 5407613 - DNA, 17 bp, Homo sapiens
ctggcagaactgagctc

SEQ ID NO: 5407614 - DNA, 21 bp, Homo sapiens
ctggcagaactgagctcctct

SEQ ID NO: 5407615 - DNA, 17 bp, Homo sapiens
ctggcagaagggagcag

SEQ ID NO: 5407616 - DNA, 13 bp, Homo sapiens
ctggcagacacaa

SEQ ID NO: 5407617 - DNA, 21 bp, Homo sapiens
ctggcagactcaaggggctgg

SEQ ID NO: 5407618 - DNA, 22 bp, Homo sapiens
ctggcagactcaaggggctgga

SEQ ID NO: 5407619 - DNA, 23 bp, Homo sapiens
ctggcagactgtgtaaaatgtaa

SEQ ID NO: 5407620 - DNA, 13 bp, Homo sapiens
ctggcagagaagg

SEQ ID NO: 5407621 - DNA, 14 bp, Homo sapiens
ctggcagagaagga

SEQ ID NO: 5407622 - DNA, 14 bp, Homo sapiens
ctggcagagatgcc

SEQ ID NO: 5407623 - DNA, 15 bp, Homo sapiens
ctggcagagcacagc

SEQ ID NO: 5407624 - DNA, 17 bp, Homo sapiens
ctggcagagcacagccc

SEQ ID NO: 5407625 - DNA, 14 bp, Homo sapiens
ctggcagagcctct

SEQ ID NO: 5407626 - DNA, 16 bp, Homo sapiens
ctggcagagcctctga

SEQ ID NO: 5407627 - DNA, 14 bp, Homo sapiens
ctggcagaggaggg

SEQ ID NO: 5407628 - DNA, 16 bp, Homo sapiens
ctggcagaggggacag

SEQ ID NO: 5407629 - DNA, 22 bp, Homo sapiens
ctggcagagttgaagacagagc

SEQ ID NO: 5407630 - DNA, 19 bp, Homo sapiens
ctggcagatgagggctggc

SEQ ID NO: 5407631 - DNA, 16 bp, Homo sapiens
ctggcagcacagccca

SEQ ID NO: 5407632 - DNA, 15 bp, Homo sapiens
ctggcagcagagtgt

SEQ ID NO: 5407633 - DNA, 16 bp, Homo sapiens
ctggcagcccagagac

SEQ ID NO: 5407634 - DNA, 13 bp, Homo sapiens
ctggcagccccag

SEQ ID NO: 5407635 - DNA, 18 bp, Homo sapiens
ctggcagcccgcatcagc

SEQ ID NO: 5407636 - DNA, 20 bp, Homo sapiens
ctggcagccgtgccttcagc

SEQ ID NO: 5407637 - DNA, 21 bp, Homo sapiens
ctggcagccgtgccttcagct

SEQ ID NO: 5407638 - DNA, 21 bp, Homo sapiens
ctggcagcctcagaggcccct

SEQ ID NO: 5407639 - DNA, 12 bp, Homo sapiens
ctggccctccct

SEQ ID NO: 5407640 - DNA, 13 bp, Homo sapiens
ctggccctccctc

SEQ ID NO: 5407641 - DNA, 15 bp, Homo sapiens
ctggccctccctccc

SEQ ID NO: 5407642 - DNA, 16 bp, Homo sapiens
ctggccctccctccct

SEQ ID NO: 5407643 - DNA, 21 bp, Homo sapiens
ctggccctccctccctagccc

SEQ ID NO: 5407644 - DNA, 13 bp, Homo sapiens
ctggccctcctgg

SEQ ID NO: 5407645 - DNA, 14 bp, Homo sapiens
ctggccctcgggcc

SEQ ID NO: 5407646 - DNA, 22 bp, Homo sapiens
ctggccctctctgaaggaggcc

SEQ ID NO: 5407647 - DNA, 12 bp, Homo sapiens
ctggccctcttc

SEQ ID NO: 5407648 - DNA, 15 bp, Homo sapiens
ctggccctcttctta

SEQ ID NO: 5407649 - DNA, 17 bp, Homo sapiens
ctggccctgaggtgtgg

SEQ ID NO: 5407650 - DNA, 20 bp, Homo sapiens
ctggccctgaggtgtggggg

SEQ ID NO: 5407651 - DNA, 11 bp, Homo sapiens
ctggccctgcc

SEQ ID NO: 5407652 - DNA, 12 bp, Homo sapiens
ctggccctgccc

SEQ ID NO: 5407653 - DNA, 13 bp, Homo sapiens
ctggccctgccct

SEQ ID NO: 5407654 - DNA, 16 bp, Homo sapiens
ctggccctgccctccc

SEQ ID NO: 5407655 - DNA, 15 bp, Homo sapiens
ctggccctgccctga

SEQ ID NO: 5407656 - DNA, 13 bp, Homo sapiens
ctggccctgccgt

SEQ ID NO: 5407657 - DNA, 14 bp, Homo sapiens
ctggccctgcctca

SEQ ID NO: 5407658 - DNA, 17 bp, Homo sapiens
ctggccctgcctcactg

SEQ ID NO: 5407659 - DNA, 17 bp, Homo sapiens
ctggccctgcctcctgg

SEQ ID NO: 5407660 - DNA, 18 bp, Homo sapiens
ctggccctgcctcctggg

SEQ ID NO: 5407661 - DNA, 14 bp, Homo sapiens
ctggccctgctgcc

SEQ ID NO: 5407662 - DNA, 15 bp, Homo sapiens
ctggccctgctgccc

SEQ ID NO: 5407663 - DNA, 17 bp, Homo sapiens
ctggccctgctgccccc

SEQ ID NO: 5407664 - DNA, 21 bp, Homo sapiens
ctggccctgcttcctgcttgc

SEQ ID NO: 5407665 - DNA, 22 bp, Homo sapiens
ctggccctgcttcctgcttgcc

SEQ ID NO: 5407666 - DNA, 20 bp, Homo sapiens
ctggccctggcgggtggctg

SEQ ID NO: 5407667 - DNA, 21 bp, Homo sapiens
ctggccctggcgggtggctgc

SEQ ID NO: 5407668 - DNA, 21 bp, Homo sapiens
ctggccctgggagaatcgctc

SEQ ID NO: 5407669 - DNA, 15 bp, Homo sapiens
ctggccctggggcct

SEQ ID NO: 5407670 - DNA, 16 bp, Homo sapiens
ctggccctggggcctg

SEQ ID NO: 5407671 - DNA, 17 bp, Homo sapiens
ctggccctggggcctgt

SEQ ID NO: 5407672 - DNA, 13 bp, Homo sapiens
ctggccctggggg

SEQ ID NO: 5407673 - DNA, 13 bp, Homo sapiens
ctggccctgtgca

SEQ ID NO: 5407674 - DNA, 13 bp, Homo sapiens
ctggccctgtgcc

SEQ ID NO: 5407675 - DNA, 12 bp, Homo sapiens
ctggccctgtgt

SEQ ID NO: 5407676 - DNA, 13 bp, Homo sapiens
ctggccctgtgta

SEQ ID NO: 5407677 - DNA, 21 bp, Homo sapiens
ctggccctgtgtaggggcagg

SEQ ID NO: 5407678 - DNA, 22 bp, Homo sapiens
ctggccctgtgtaggggcaggg

SEQ ID NO: 5407679 - DNA, 14 bp, Homo sapiens
ctggccctgttgtg

SEQ ID NO: 5407680 - DNA, 15 bp, Homo sapiens
ctggccctgttgtgg

SEQ ID NO: 5407681 - DNA, 15 bp, Homo sapiens
ctggccctgtttctc

SEQ ID NO: 5407682 - DNA, 16 bp, Homo sapiens
ctggcccttacacact

SEQ ID NO: 5407683 - DNA, 17 bp, Homo sapiens
ctggcccttacacactc

SEQ ID NO: 5407684 - DNA, 14 bp, Homo sapiens
ctggcccttagaga

SEQ ID NO: 5407685 - DNA, 18 bp, Homo sapiens
ctggcccttagagacccc

SEQ ID NO: 5407686 - DNA, 14 bp, Homo sapiens
ctggcccttcagtc

SEQ ID NO: 5407687 - DNA, 20 bp, Homo sapiens
ctggcccttcagtctgctcc

SEQ ID NO: 5407688 - DNA, 14 bp, Homo sapiens
ctggcccttccttc

SEQ ID NO: 5407689 - DNA, 16 bp, Homo sapiens
ctggcccttgcccaac

SEQ ID NO: 5407690 - DNA, 22 bp, Homo sapiens
ctggcccttgcccaactcccag

SEQ ID NO: 5407691 - DNA, 22 bp, Homo sapiens
ctggcccttgccggggcctgga

SEQ ID NO: 5407692 - DNA, 15 bp, Homo sapiens
ctggcccttggaata

SEQ ID NO: 5407693 - DNA, 19 bp, Homo sapiens
ctggcccttggaataaagt

SEQ ID NO: 5407694 - DNA, 15 bp, Homo sapiens
ctggcccttggggag

SEQ ID NO: 5407695 - DNA, 23 bp, Homo sapiens
ctggccctttccccttcccctcc

SEQ ID NO: 5407696 - DNA, 18 bp, Homo sapiens
ctggccctttctggacca

SEQ ID NO: 5407697 - DNA, 15 bp, Homo sapiens
ctggccgacggaccc

SEQ ID NO: 5407698 - DNA, 17 bp, Homo sapiens
ctggccgagggtcctgg

SEQ ID NO: 5407699 - DNA, 20 bp, Homo sapiens
ctggccgagggtcctggctc

SEQ ID NO: 5407700 - DNA, 23 bp, Homo sapiens
ctggccgagtccaagctgggaga

SEQ ID NO: 5407701 - DNA, 21 bp, Homo sapiens
ctggccgcaagtccccagccc

SEQ ID NO: 5407702 - DNA, 13 bp, Homo sapiens
ctggccgcagggc

SEQ ID NO: 5407703 - DNA, 19 bp, Homo sapiens
ctggccgcctccaggagcc

SEQ ID NO: 5407704 - DNA, 17 bp, Homo sapiens
ctggccgcctgggtcca

SEQ ID NO: 5407705 - DNA, 18 bp, Homo sapiens
ctggccgcgccaaataat

SEQ ID NO: 5407706 - DNA, 18 bp, Homo sapiens
ctggccgcggagcctgca

SEQ ID NO: 5407707 - DNA, 15 bp, Homo sapiens
ctggccgctgagcgc

SEQ ID NO: 5407708 - DNA, 15 bp, Homo sapiens
ctggccgctgggaga

SEQ ID NO: 5407709 - DNA, 22 bp, Homo sapiens
ctggccgcttctccccagagct

SEQ ID NO: 5407710 - DNA, 15 bp, Homo sapiens
ctggccggaaggaga

SEQ ID NO: 5407711 - DNA, 17 bp, Homo sapiens
ctggccggaaggagact

SEQ ID NO: 5407712 - DNA, 15 bp, Homo sapiens
ctggccggccagcca

SEQ ID NO: 5407713 - DNA, 22 bp, Homo sapiens
ctggccggccagccagccactc

SEQ ID NO: 5407714 - DNA, 20 bp, Homo sapiens
ctggccggcccaggcctcca

SEQ ID NO: 5407715 - DNA, 13 bp, Homo sapiens
ctggccgggactg

SEQ ID NO: 5407716 - DNA, 14 bp, Homo sapiens
ctggccgggcacag

SEQ ID NO: 5407717 - DNA, 20 bp, Homo sapiens
ctggccgggcacagctgtgg

SEQ ID NO: 5407718 - DNA, 17 bp, Homo sapiens
ctggccgggggaggtgg

SEQ ID NO: 5407719 - DNA, 18 bp, Homo sapiens
ctggccgggtcaccctgt

SEQ ID NO: 5407720 - DNA, 21 bp, Homo sapiens
ctggccgggtcaccctgtgac

SEQ ID NO: 5407721 - DNA, 18 bp, Homo sapiens
ctggccggtaggctgctg

SEQ ID NO: 5407722 - DNA, 20 bp, Homo sapiens
ctggccggtaggctgctggc

SEQ ID NO: 5407723 - DNA, 21 bp, Homo sapiens
ctggccggtaggctgctggcg

SEQ ID NO: 5407724 - DNA, 13 bp, Homo sapiens
ctggccggtgctg

SEQ ID NO: 5407725 - DNA, 19 bp, Homo sapiens
ctggccggtgctgggttcc

SEQ ID NO: 5407726 - DNA, 20 bp, Homo sapiens
ctggccggttaacatctttt

SEQ ID NO: 5407727 - DNA, 13 bp, Homo sapiens
ctggccgtacttg

SEQ ID NO: 5407728 - DNA, 15 bp, Homo sapiens
ctggccgtccttgtc

SEQ ID NO: 5407729 - DNA, 14 bp, Homo sapiens
ctggccgtggctcc

SEQ ID NO: 5407730 - DNA, 15 bp, Homo sapiens
ctggccgtggctcca

SEQ ID NO: 5407731 - DNA, 16 bp, Homo sapiens
ctggccgtggctccag

SEQ ID NO: 5407732 - DNA, 19 bp, Homo sapiens
ctggccgttcagcctgtct

SEQ ID NO: 5407733 - DNA, 23 bp, Homo sapiens
ctggccgttgatgttggctggga

SEQ ID NO: 5407734 - DNA, 16 bp, Homo sapiens
ctggcctaaaatcttg

SEQ ID NO: 5407735 - DNA, 13 bp, Homo sapiens
ctggcctaccaca

SEQ ID NO: 5407736 - DNA, 15 bp, Homo sapiens
ctggcctaccacagc

SEQ ID NO: 5407737 - DNA, 18 bp, Homo sapiens
ctggcctaccacagctgc

SEQ ID NO: 5407738 - DNA, 19 bp, Homo sapiens
ctggcctaccacagctgcc

SEQ ID NO: 5407739 - DNA, 20 bp, Homo sapiens
ctggcctagaaagggcaagg

SEQ ID NO: 5407740 - DNA, 22 bp, Homo sapiens
ctggcctagaccagcagacaga

SEQ ID NO: 5407741 - DNA, 13 bp, Homo sapiens
ctggcctagactt

SEQ ID NO: 5407742 - DNA, 23 bp, Homo sapiens
ctggcctaggagatatctgaggg

SEQ ID NO: 5407743 - DNA, 17 bp, Homo sapiens
ctggcctaggtgggagc

SEQ ID NO: 5407744 - DNA, 19 bp, Homo sapiens
ctggcctaggtgggagcca

SEQ ID NO: 5407745 - DNA, 22 bp, Homo sapiens
ctggcctagtggggaggggcct

SEQ ID NO: 5407746 - DNA, 17 bp, Homo sapiens
ctggcctatgaccctgt

SEQ ID NO: 5407747 - DNA, 17 bp, Homo sapiens
ctggcctatttaagccc

SEQ ID NO: 5407748 - DNA, 21 bp, Homo sapiens
ctggcctcaaagcaagcattc

SEQ ID NO: 5407749 - DNA, 23 bp, Homo sapiens
ctggcctcacgcccagcctcctc

SEQ ID NO: 5407750 - DNA, 18 bp, Homo sapiens
ctggcctcactggctggg

SEQ ID NO: 5407751 - DNA, 21 bp, Homo sapiens
ctggcctcagactgcacccag

SEQ ID NO: 5407752 - DNA, 22 bp, Homo sapiens
ctggcctcagactgcacccagg

SEQ ID NO: 5407753 - DNA, 12 bp, Homo sapiens
ctggcctcagag

SEQ ID NO: 5407754 - DNA, 23 bp, Homo sapiens
ctggcctcagagcttcctgggga

SEQ ID NO: 5407755 - DNA, 15 bp, Homo sapiens
ctggcctcagcagga

SEQ ID NO: 5407756 - DNA, 20 bp, Homo sapiens
ctggcctcagcaggaacctg

SEQ ID NO: 5407757 - DNA, 22 bp, Homo sapiens
ctggcctcagccagctgcccac

SEQ ID NO: 5407758 - DNA, 16 bp, Homo sapiens
ctggcctcagggctct

SEQ ID NO: 5407759 - DNA, 15 bp, Homo sapiens
ctggcctcagttccc

SEQ ID NO: 5407760 - DNA, 18 bp, Homo sapiens
ctggcctcagttcccagc

SEQ ID NO: 5407761 - DNA, 22 bp, Homo sapiens
ctggcctcagttcccagctccc

SEQ ID NO: 5407762 - DNA, 20 bp, Homo sapiens
ctggcctcatctcagaccct

SEQ ID NO: 5407763 - DNA, 11 bp, Homo sapiens
ctggcctccag

SEQ ID NO: 5407764 - DNA, 12 bp, Homo sapiens
ctggcctccagc

SEQ ID NO: 5407765 - DNA, 14 bp, Homo sapiens
ctggcctccagcct

SEQ ID NO: 5407766 - DNA, 13 bp, Homo sapiens
ctggcctccagct

SEQ ID NO: 5407767 - DNA, 20 bp, Homo sapiens
ctggcctccagctcccactc

SEQ ID NO: 5407768 - DNA, 16 bp, Homo sapiens
ctggcctcccaaatga

SEQ ID NO: 5407769 - DNA, 19 bp, Homo sapiens
ctggcctcccaataaagct

SEQ ID NO: 5407770 - DNA, 14 bp, Homo sapiens
ctggcctcccacag

SEQ ID NO: 5407771 - DNA, 13 bp, Homo sapiens
ctggcctcccacc

SEQ ID NO: 5407772 - DNA, 15 bp, Homo sapiens
ctggcctcccacccg

SEQ ID NO: 5407773 - DNA, 13 bp, Homo sapiens
ctggcctccccca

SEQ ID NO: 5407774 - DNA, 14 bp, Homo sapiens
ctggcctcccccaa

SEQ ID NO: 5407775 - DNA, 15 bp, Homo sapiens
ctggcctcccccaac

SEQ ID NO: 5407776 - DNA, 15 bp, Homo sapiens
ctggcctcccccact

SEQ ID NO: 5407777 - DNA, 17 bp, Homo sapiens
ctggcctcccccacttt

SEQ ID NO: 5407778 - DNA, 21 bp, Homo sapiens
ctggcctcccctgccaccagg

SEQ ID NO: 5407779 - DNA, 20 bp, Homo sapiens
ctggcctccctccgtccctc

SEQ ID NO: 5407780 - DNA, 16 bp, Homo sapiens
ctggcctcccttctcc

SEQ ID NO: 5407781 - DNA, 22 bp, Homo sapiens
ctggcctcccttctcctttcta

SEQ ID NO: 5407782 - DNA, 18 bp, Homo sapiens
ctggcctccgatgcctgg

SEQ ID NO: 5407783 - DNA, 22 bp, Homo sapiens
ctggcctccgcctgggtcatgg

SEQ ID NO: 5407784 - DNA, 21 bp, Homo sapiens
ctggcctccggcgtcagcctc

SEQ ID NO: 5407785 - DNA, 21 bp, Homo sapiens
ctggcctcctaaggctcccca

SEQ ID NO: 5407786 - DNA, 23 bp, Homo sapiens
ctggcctcctaaggctccccacc

SEQ ID NO: 5407787 - DNA, 14 bp, Homo sapiens
ctggcctcctgcct

SEQ ID NO: 5407788 - DNA, 15 bp, Homo sapiens
ctggcctcctgcctc

SEQ ID NO: 5407789 - DNA, 17 bp, Homo sapiens
ctggcctccttttgctg

SEQ ID NO: 5407790 - DNA, 12 bp, Homo sapiens
ctggcctcgcct

SEQ ID NO: 5407791 - DNA, 16 bp, Homo sapiens
ctggcctcgcctgcct

SEQ ID NO: 5407792 - DNA, 19 bp, Homo sapiens
ctggcctcgcctggcctga

SEQ ID NO: 5407793 - DNA, 19 bp, Homo sapiens
ctggcctcggggcagggca

SEQ ID NO: 5407794 - DNA, 20 bp, Homo sapiens
ctggcctctaccacaagggc

SEQ ID NO: 5407795 - DNA, 15 bp, Homo sapiens
ctggcctctagaaca

SEQ ID NO: 5407796 - DNA, 20 bp, Homo sapiens
ctggcctctagaacacccac

SEQ ID NO: 5407797 - DNA, 17 bp, Homo sapiens
ctggcctctccccagga

SEQ ID NO: 5407798 - DNA, 16 bp, Homo sapiens
ctggcctctctagcac

SEQ ID NO: 5407799 - DNA, 11 bp, Homo sapiens
ctggcctctgc

SEQ ID NO: 5407800 - DNA, 12 bp, Homo sapiens
ctggcctctgca

SEQ ID NO: 5407801 - DNA, 18 bp, Homo sapiens
ctggcctctgccatcctc

SEQ ID NO: 5407802 - DNA, 14 bp, Homo sapiens
ctggcctctgcctc

SEQ ID NO: 5407803 - DNA, 16 bp, Homo sapiens
ctggcctctgcctcca

SEQ ID NO: 5407804 - DNA, 21 bp, Homo sapiens
ctggcctctgcctccaccctc

SEQ ID NO: 5407805 - DNA, 15 bp, Homo sapiens
ctggcctctggcctg

SEQ ID NO: 5407806 - DNA, 19 bp, Homo sapiens
ctggcctctggcctgggaa

SEQ ID NO: 5407807 - DNA, 17 bp, Homo sapiens
ctggcctctggctctca

SEQ ID NO: 5407808 - DNA, 14 bp, Homo sapiens
ctggcctctgggca

SEQ ID NO: 5407809 - DNA, 21 bp, Homo sapiens
ctggcctctgggcagtgtggc

SEQ ID NO: 5407810 - DNA, 23 bp, Homo sapiens
ctggcctctgggcagtgtggcct

SEQ ID NO: 5407811 - DNA, 17 bp, Homo sapiens
ctggcctctgtcatatc

SEQ ID NO: 5407812 - DNA, 13 bp, Homo sapiens
ctggcctctgtga

SEQ ID NO: 5407813 - DNA, 22 bp, Homo sapiens
ctggcctctgtgattacataga

SEQ ID NO: 5407814 - DNA, 23 bp, Homo sapiens
ctggcctctgtgattacatagat

SEQ ID NO: 5407815 - DNA, 13 bp, Homo sapiens
ctggcctctgtgc

SEQ ID NO: 5407816 - DNA, 12 bp, Homo sapiens
ctggcctcttcc

SEQ ID NO: 5407817 - DNA, 14 bp, Homo sapiens
ctggcctcttcctc

SEQ ID NO: 5407818 - DNA, 18 bp, Homo sapiens
ctggctgggcccctgggg

SEQ ID NO: 5407819 - DNA, 20 bp, Homo sapiens
ctggctgggcccctggggac

SEQ ID NO: 5407820 - DNA, 21 bp, Homo sapiens
ctggctgggcccctggggaca

SEQ ID NO: 5407821 - DNA, 14 bp, Homo sapiens
ctggctgggcctgg

SEQ ID NO: 5407822 - DNA, 15 bp, Homo sapiens
ctggctgggcctggg

SEQ ID NO: 5407823 - DNA, 20 bp, Homo sapiens
ctggctgggcctgggcttcc

SEQ ID NO: 5407824 - DNA, 11 bp, Homo sapiens
ctggctgggct

SEQ ID NO: 5407825 - DNA, 22 bp, Homo sapiens
ctggctgggctttggggctggt

SEQ ID NO: 5407826 - DNA, 15 bp, Homo sapiens
ctggctggggacttg

SEQ ID NO: 5407827 - DNA, 22 bp, Homo sapiens
ctggctggggacttggccgctt

SEQ ID NO: 5407828 - DNA, 18 bp, Homo sapiens
ctggctggggcagagggg

SEQ ID NO: 5407829 - DNA, 23 bp, Homo sapiens
ctggctggggcagaggggcagcc

SEQ ID NO: 5407830 - DNA, 20 bp, Homo sapiens
ctggctggggccggggctgc

SEQ ID NO: 5407831 - DNA, 22 bp, Homo sapiens
ctggctggggcctatcagtgtg

SEQ ID NO: 5407832 - DNA, 20 bp, Homo sapiens
ctggctgggtcgcccctcct

SEQ ID NO: 5407833 - DNA, 17 bp, Homo sapiens
ctggctgggttcaggtc

SEQ ID NO: 5407834 - DNA, 20 bp, Homo sapiens
ctggctgggttttcaggggc

SEQ ID NO: 5407835 - DNA, 19 bp, Homo sapiens
ctggctggtaagggccaag

SEQ ID NO: 5407836 - DNA, 15 bp, Homo sapiens
ctggctggtcctccc

SEQ ID NO: 5407837 - DNA, 19 bp, Homo sapiens
ctggctggtgcctgagccc

SEQ ID NO: 5407838 - DNA, 19 bp, Homo sapiens
ctggctggtgggcccccaa

SEQ ID NO: 5407839 - DNA, 20 bp, Homo sapiens
ctggctggttagaggttccc

SEQ ID NO: 5407840 - DNA, 16 bp, Homo sapiens
ctggctggttccatct

SEQ ID NO: 5407841 - DNA, 14 bp, Homo sapiens
ctggctggtttgcc

SEQ ID NO: 5407842 - DNA, 17 bp, Homo sapiens
ctggctggtttgcccag

SEQ ID NO: 5407843 - DNA, 15 bp, Homo sapiens
ctggctgtaaggctc

SEQ ID NO: 5407844 - DNA, 19 bp, Homo sapiens
ctggctgtaaggctctaga

SEQ ID NO: 5407845 - DNA, 15 bp, Homo sapiens
ctggctgtacctgtt

SEQ ID NO: 5407846 - DNA, 15 bp, Homo sapiens
ctggctgtatggaaa

SEQ ID NO: 5407847 - DNA, 19 bp, Homo sapiens
ctggctgtcagtatgacat

SEQ ID NO: 5407848 - DNA, 14 bp, Homo sapiens
ctggctgtcctacc

SEQ ID NO: 5407849 - DNA, 13 bp, Homo sapiens
ctggctgtcgaga

SEQ ID NO: 5407850 - DNA, 15 bp, Homo sapiens
ctggctgtctagaat

SEQ ID NO: 5407851 - DNA, 16 bp, Homo sapiens
ctggctgtctagaatg

SEQ ID NO: 5407852 - DNA, 15 bp, Homo sapiens
ctggctgtctgcctg

SEQ ID NO: 5407853 - DNA, 20 bp, Homo sapiens
ctggctgtcttcccccaccc

SEQ ID NO: 5407854 - DNA, 12 bp, Homo sapiens
ctggctgtgaca

SEQ ID NO: 5407855 - DNA, 13 bp, Homo sapiens
ctggctgtgacaa

SEQ ID NO: 5407856 - DNA, 17 bp, Homo sapiens
ctggctgtgacacctgg

SEQ ID NO: 5407857 - DNA, 18 bp, Homo sapiens
ctggctgtgatcttaaaa

SEQ ID NO: 5407858 - DNA, 13 bp, Homo sapiens
ctggctgtgcaca

SEQ ID NO: 5407859 - DNA, 22 bp, Homo sapiens
ctggctgtgcacattctccctt

SEQ ID NO: 5407860 - DNA, 22 bp, Homo sapiens
ctggctgtgcccagcaggccca

SEQ ID NO: 5407861 - DNA, 14 bp, Homo sapiens
ctggctgtgcccct

SEQ ID NO: 5407862 - DNA, 15 bp, Homo sapiens
ctggctgtgcccctg

SEQ ID NO: 5407863 - DNA, 15 bp, Homo sapiens
ctggctgtgcctgct

SEQ ID NO: 5407864 - DNA, 17 bp, Homo sapiens
ctggctgtgcctgcttc

SEQ ID NO: 5407865 - DNA, 17 bp, Homo sapiens
ctggctgtggaggcctg

SEQ ID NO: 5407866 - DNA, 18 bp, Homo sapiens
ctggctgtggaggcctga

SEQ ID NO: 5407867 - DNA, 21 bp, Homo sapiens
ctggctgtggaggcctgatgc

SEQ ID NO: 5407868 - DNA, 17 bp, Homo sapiens
ctggctgtggcccctcc

SEQ ID NO: 5407869 - DNA, 22 bp, Homo sapiens
ctggctgtggcccctccttctc

SEQ ID NO: 5407870 - DNA, 13 bp, Homo sapiens
ctggctgtgggct

SEQ ID NO: 5407871 - DNA, 15 bp, Homo sapiens
ctggctgtgggctcc

SEQ ID NO: 5407872 - DNA, 16 bp, Homo sapiens
ctggctgtgggctccc

SEQ ID NO: 5407873 - DNA, 18 bp, Homo sapiens
ctggctgtgggctccctt

SEQ ID NO: 5407874 - DNA, 22 bp, Homo sapiens
ctggctgtgggctcccttcctc

SEQ ID NO: 5407875 - DNA, 12 bp, Homo sapiens
ctggctgtgggt

SEQ ID NO: 5407876 - DNA, 19 bp, Homo sapiens
ctggctgtgtaaccttggg

SEQ ID NO: 5407877 - DNA, 20 bp, Homo sapiens
ctggctgtgtaaccttgggt

SEQ ID NO: 5407878 - DNA, 16 bp, Homo sapiens
ctggctgtgtcctctc

SEQ ID NO: 5407879 - DNA, 23 bp, Homo sapiens
ctggctgttctgtggttcctctg

SEQ ID NO: 5407880 - DNA, 16 bp, Homo sapiens
ctggctgttggcccct

SEQ ID NO: 5407881 - DNA, 20 bp, Homo sapiens
ctggctgttggctgggggcc

SEQ ID NO: 5407882 - DNA, 17 bp, Homo sapiens
ctggctgtttagcagaa

SEQ ID NO: 5407883 - DNA, 16 bp, Homo sapiens
ctggcttaacttagta

SEQ ID NO: 5407884 - DNA, 14 bp, Homo sapiens
ctggcttacactgg

SEQ ID NO: 5407885 - DNA, 18 bp, Homo sapiens
ctggcttacactggcaat

SEQ ID NO: 5407886 - DNA, 21 bp, Homo sapiens
ctggcttagtgccacccacct

SEQ ID NO: 5407887 - DNA, 22 bp, Homo sapiens
ctggcttagtgccacccacctt

SEQ ID NO: 5407888 - DNA, 22 bp, Homo sapiens
ctggcttatgctcagaagccag

SEQ ID NO: 5407889 - DNA, 23 bp, Homo sapiens
ctggcttatgctcagaagccagt

SEQ ID NO: 5407890 - DNA, 15 bp, Homo sapiens
ctggcttattcccaa

SEQ ID NO: 5407891 - DNA, 19 bp, Homo sapiens
ctggcttcaaaaagccaca

SEQ ID NO: 5407892 - DNA, 20 bp, Homo sapiens
ctggcttcaaaaagccacag

SEQ ID NO: 5407893 - DNA, 22 bp, Homo sapiens
ctggcttcaaaaagccacagca

SEQ ID NO: 5407894 - DNA, 24 bp, Homo sapiens
ctggcttcaaaaagccacagcaga

SEQ ID NO: 5407895 - DNA, 14 bp, Homo sapiens
ctggcttcacagat

SEQ ID NO: 5407896 - DNA, 18 bp, Homo sapiens
ctggcttcaccgcattcc

SEQ ID NO: 5407897 - DNA, 23 bp, Homo sapiens
ctggcttcaccgcattccagggg

SEQ ID NO: 5407898 - DNA, 15 bp, Homo sapiens
ctggcttcactctcc

SEQ ID NO: 5407899 - DNA, 20 bp, Homo sapiens
ctggcttcagcccccaccag

SEQ ID NO: 5407900 - DNA, 21 bp, Homo sapiens
ctggcttcagcccccaccagg

SEQ ID NO: 5407901 - DNA, 22 bp, Homo sapiens
ctggcttcaggcaattctcctg

SEQ ID NO: 5407902 - DNA, 14 bp, Homo sapiens
ctggcttcagggag

SEQ ID NO: 5407903 - DNA, 14 bp, Homo sapiens
ctggcttcatgtgg

SEQ ID NO: 5407904 - DNA, 22 bp, Homo sapiens
ctggcttcatgtggcattctct

SEQ ID NO: 5407905 - DNA, 19 bp, Homo sapiens
ctggcttccagcgggccct

SEQ ID NO: 5407906 - DNA, 23 bp, Homo sapiens
ctggcttccagcgggccctctgc

SEQ ID NO: 5407907 - DNA, 16 bp, Homo sapiens
ctggcttccagcttca

SEQ ID NO: 5407908 - DNA, 17 bp, Homo sapiens
ctggcttccagcttcag

SEQ ID NO: 5407909 - DNA, 19 bp, Homo sapiens
ctggcttccagcttcaggc

SEQ ID NO: 5407910 - DNA, 17 bp, Homo sapiens
ctggcttccatgctccg

SEQ ID NO: 5407911 - DNA, 15 bp, Homo sapiens
ctggcttcccaggac

SEQ ID NO: 5407912 - DNA, 18 bp, Homo sapiens
ctggcttcccaggaccct

SEQ ID NO: 5407913 - DNA, 15 bp, Homo sapiens
ctggcttcccatagt

SEQ ID NO: 5407914 - DNA, 18 bp, Homo sapiens
ctggcttcccatccccag

SEQ ID NO: 5407915 - DNA, 21 bp, Homo sapiens
ctggcttcccatccccagcga

SEQ ID NO: 5407916 - DNA, 13 bp, Homo sapiens
ctggcttcccctt

SEQ ID NO: 5407917 - DNA, 22 bp, Homo sapiens
ctggcttccctaaactgcagcc

SEQ ID NO: 5407918 - DNA, 17 bp, Homo sapiens
ctggcttccctctctga

SEQ ID NO: 5407919 - DNA, 20 bp, Homo sapiens
ctggcttccctctctgaaat

SEQ ID NO: 5407920 - DNA, 13 bp, Homo sapiens
ctggcttccctgc

SEQ ID NO: 5407921 - DNA, 14 bp, Homo sapiens
ctggcttccctgga

SEQ ID NO: 5407922 - DNA, 18 bp, Homo sapiens
ctggcttccctggaagct

SEQ ID NO: 5407923 - DNA, 17 bp, Homo sapiens
ctggcttctagatctgg

SEQ ID NO: 5407924 - DNA, 21 bp, Homo sapiens
ctggcttctccctggactctg

SEQ ID NO: 5407925 - DNA, 22 bp, Homo sapiens
ctggcttctctcctcagacttc

SEQ ID NO: 5407926 - DNA, 14 bp, Homo sapiens
ctggcttctctctt

SEQ ID NO: 5407927 - DNA, 16 bp, Homo sapiens
ctggcttctctctttt

SEQ ID NO: 5407928 - DNA, 19 bp, Homo sapiens
ctggcttctgaagagcctg

SEQ ID NO: 5407929 - DNA, 14 bp, Homo sapiens
ctggcttctggagc

SEQ ID NO: 5407930 - DNA, 15 bp, Homo sapiens
ctggcttctggagcc

SEQ ID NO: 5407931 - DNA, 12 bp, Homo sapiens
ctggcttctggc

SEQ ID NO: 5407932 - DNA, 13 bp, Homo sapiens
ctggcttctgtga

SEQ ID NO: 5407933 - DNA, 21 bp, Homo sapiens
ctggcttctgtggggcccctc

SEQ ID NO: 5407934 - DNA, 18 bp, Homo sapiens
ctggcttctgttgcgcca

SEQ ID NO: 5407935 - DNA, 17 bp, Homo sapiens
ctggcttgaaggactgc

SEQ ID NO: 5407936 - DNA, 16 bp, Homo sapiens
ctggcttgccccagga

SEQ ID NO: 5407937 - DNA, 23 bp, Homo sapiens
ctggcttgccccaggactctggc

SEQ ID NO: 5407938 - DNA, 21 bp, Homo sapiens
ctggcttgcccgcgctctttc

SEQ ID NO: 5407939 - DNA, 22 bp, Homo sapiens
ctggcttgctccagggtcttgg

SEQ ID NO: 5407940 - DNA, 22 bp, Homo sapiens
ctggcttgctcccgccccaggg

SEQ ID NO: 5407941 - DNA, 14 bp, Homo sapiens
ctggcttgctgtgg

SEQ ID NO: 5407942 - DNA, 16 bp, Homo sapiens
ctggcttgctgtggct

SEQ ID NO: 5407943 - DNA, 20 bp, Homo sapiens
ctggcttggccacagccagg

SEQ ID NO: 5407944 - DNA, 19 bp, Homo sapiens
ctggcttgtaactccacca

SEQ ID NO: 5407945 - DNA, 14 bp, Homo sapiens
ctggcttgtacatt

SEQ ID NO: 5407946 - DNA, 15 bp, Homo sapiens
ctggcttgtacattt

SEQ ID NO: 5407947 - DNA, 20 bp, Homo sapiens
ctggcttgttgtaaagcaat

SEQ ID NO: 5407948 - DNA, 14 bp, Homo sapiens
ctggcttgtttatt

SEQ ID NO: 5407949 - DNA, 18 bp, Homo sapiens
ctggcttgtttattttgt

SEQ ID NO: 5407950 - DNA, 21 bp, Homo sapiens
ctggctttcattttctctcag

SEQ ID NO: 5407951 - DNA, 14 bp, Homo sapiens
ctggctttcccagg

SEQ ID NO: 5407952 - DNA, 11 bp, Homo sapiens
ctggctttctc

SEQ ID NO: 5407953 - DNA, 12 bp, Homo sapiens
ctggctttctct

SEQ ID NO: 5407954 - DNA, 19 bp, Homo sapiens
ctggctttgaaacctcagg

SEQ ID NO: 5407955 - DNA, 14 bp, Homo sapiens
ctggctttgcccaa

SEQ ID NO: 5407956 - DNA, 16 bp, Homo sapiens
ctggctttgcccaacc

SEQ ID NO: 5407957 - DNA, 21 bp, Homo sapiens
ctggctttgcccaacctcagc

SEQ ID NO: 5407958 - DNA, 12 bp, Homo sapiens
ctggctttgcct

SEQ ID NO: 5407959 - DNA, 13 bp, Homo sapiens
ctggctttgcctc

SEQ ID NO: 5407960 - DNA, 13 bp, Homo sapiens
ctggctttgctct

SEQ ID NO: 5407961 - DNA, 15 bp, Homo sapiens
ctggctttgctctat

SEQ ID NO: 5407962 - DNA, 20 bp, Homo sapiens
ctggctttggaaagacctgt

SEQ ID NO: 5407963 - DNA, 24 bp, Homo sapiens
ctggctttggaaagacctgtgagg

SEQ ID NO: 5407964 - DNA, 20 bp, Homo sapiens
ctggctttggaatagatgga

SEQ ID NO: 5407965 - DNA, 11 bp, Homo sapiens
ctggctttggc

SEQ ID NO: 5407966 - DNA, 14 bp, Homo sapiens
ctggctttggcttc

SEQ ID NO: 5407967 - DNA, 18 bp, Homo sapiens
ctggctttgggaaagccc

SEQ ID NO: 5407968 - DNA, 20 bp, Homo sapiens
ctggctttgggaaagcccag

SEQ ID NO: 5407969 - DNA, 21 bp, Homo sapiens
ctggctttgggaaagcccaga

SEQ ID NO: 5407970 - DNA, 23 bp, Homo sapiens
ctggctttgggaaagcccagact

SEQ ID NO: 5407971 - DNA, 23 bp, Homo sapiens
ctggctttgggtagtgccatggc

SEQ ID NO: 5407972 - DNA, 17 bp, Homo sapiens
ctggctttggtccccag

SEQ ID NO: 5407973 - DNA, 22 bp, Homo sapiens
ctggcttttcaccccagaggac

SEQ ID NO: 5407974 - DNA, 17 bp, Homo sapiens
ctggcttttcactgctg

SEQ ID NO: 5407975 - DNA, 15 bp, Homo sapiens
ctggcttttcgcttg

SEQ ID NO: 5407976 - DNA, 22 bp, Homo sapiens
ctggcttttcgcttgcttctgc

SEQ ID NO: 5407977 - DNA, 14 bp, Homo sapiens
ctggcttttctggc

SEQ ID NO: 5407978 - DNA, 17 bp, Homo sapiens
ctggcttttctggctgg

SEQ ID NO: 5407979 - DNA, 18 bp, Homo sapiens
ctggctttttaaaatata

SEQ ID NO: 5407980 - DNA, 19 bp, Homo sapiens
ctggctttttattgtattt

SEQ ID NO: 5407981 - DNA, 17 bp, Homo sapiens
ctggctttttcccagcc

SEQ ID NO: 5407982 - DNA, 19 bp, Homo sapiens
ctggctttttcccagccct

SEQ ID NO: 5407983 - DNA, 18 bp, Homo sapiens
ctggctttttcctctgag

SEQ ID NO: 5407984 - DNA, 20 bp, Homo sapiens
ctggctttttcctctgagcc

SEQ ID NO: 5407985 - DNA, 16 bp, Homo sapiens
ctggctttttctgcca

SEQ ID NO: 5407986 - DNA, 20 bp, Homo sapiens
ctggctttttctgccactga

SEQ ID NO: 5407987 - DNA, 19 bp, Homo sapiens
ctggctttttgtcaaataa

SEQ ID NO: 5407988 - DNA, 17 bp, Homo sapiens
ctggcttttttgtgggg

SEQ ID NO: 5407989 - DNA, 23 bp, Homo sapiens
ctgggaaaaaagttttgatgaaa

SEQ ID NO: 5407990 - DNA, 18 bp, Homo sapiens
ctgggaaaacagtgaatc

SEQ ID NO: 5407991 - DNA, 19 bp, Homo sapiens
ctgggaaaatccactatga

SEQ ID NO: 5407992 - DNA, 16 bp, Homo sapiens
ctgggaaacagaggct

SEQ ID NO: 5407993 - DNA, 23 bp, Homo sapiens
ctgggaaaccccttctctgtgac

SEQ ID NO: 5407994 - DNA, 18 bp, Homo sapiens
ctgggcccctggggacag

SEQ ID NO: 5407995 - DNA, 21 bp, Homo sapiens
ctgggcccctggggacagagc

SEQ ID NO: 5407996 - DNA, 16 bp, Homo sapiens
ctgggcccctgtcccc

SEQ ID NO: 5407997 - DNA, 17 bp, Homo sapiens
ctgggcccctgtcccca

SEQ ID NO: 5407998 - DNA, 19 bp, Homo sapiens
ctgggcccctgtccccagt

SEQ ID NO: 5407999 - DNA, 13 bp, Homo sapiens
ctgggcccgagcc

SEQ ID NO: 5408000 - DNA, 19 bp, Homo sapiens
ctgggcccgagcctgaact

SEQ ID NO: 5408001 - DNA, 18 bp, Homo sapiens
ctgggcccgctttgcctg

SEQ ID NO: 5408002 - DNA, 19 bp, Homo sapiens
ctgggcccggaagggcttt

SEQ ID NO: 5408003 - DNA, 14 bp, Homo sapiens
ctgggcccgggcag

SEQ ID NO: 5408004 - DNA, 17 bp, Homo sapiens
ctgggcccgggcaggcc

SEQ ID NO: 5408005 - DNA, 20 bp, Homo sapiens
ctgggccctaggcatactct

SEQ ID NO: 5408006 - DNA, 11 bp, Homo sapiens
ctgggccctct

SEQ ID NO: 5408007 - DNA, 15 bp, Homo sapiens
ctgggccctctcttc

SEQ ID NO: 5408008 - DNA, 20 bp, Homo sapiens
ctgggccctctttccctgcg

SEQ ID NO: 5408009 - DNA, 22 bp, Homo sapiens
ctgggccctctttccctgcgag

SEQ ID NO: 5408010 - DNA, 15 bp, Homo sapiens
ctgggccctgagcca

SEQ ID NO: 5408011 - DNA, 18 bp, Homo sapiens
ctgggccctgagccagag

SEQ ID NO: 5408012 - DNA, 12 bp, Homo sapiens
ctgggccctgca

SEQ ID NO: 5408013 - DNA, 16 bp, Homo sapiens
ctgggccctgcaggag

SEQ ID NO: 5408014 - DNA, 17 bp, Homo sapiens
ctgggccctgcaggagg

SEQ ID NO: 5408015 - DNA, 18 bp, Homo sapiens
ctgggccctgcaggaggc

SEQ ID NO: 5408016 - DNA, 20 bp, Homo sapiens
ctgggccctgcaggaggcct

SEQ ID NO: 5408017 - DNA, 20 bp, Homo sapiens
ctgggccctgcctgcagcca

SEQ ID NO: 5408018 - DNA, 11 bp, Homo sapiens
ctgggccctgg

SEQ ID NO: 5408019 - DNA, 15 bp, Homo sapiens
ctgggccctggagga

SEQ ID NO: 5408020 - DNA, 17 bp, Homo sapiens
ctgggccctgggctggc

SEQ ID NO: 5408021 - DNA, 13 bp, Homo sapiens
ctgggccctgggg

SEQ ID NO: 5408022 - DNA, 15 bp, Homo sapiens
ctgggccctggggcc

SEQ ID NO: 5408023 - DNA, 22 bp, Homo sapiens
ctgggccctggggcctgtactg

SEQ ID NO: 5408024 - DNA, 16 bp, Homo sapiens
ctgggccctgggtgag

SEQ ID NO: 5408025 - DNA, 12 bp, Homo sapiens
ctgggccctgtc

SEQ ID NO: 5408026 - DNA, 17 bp, Homo sapiens
ctgggccctgtcgcccc

SEQ ID NO: 5408027 - DNA, 15 bp, Homo sapiens
ctgggcccttgtgct

SEQ ID NO: 5408028 - DNA, 16 bp, Homo sapiens
ctgggcccttgtgctc

SEQ ID NO: 5408029 - DNA, 15 bp, Homo sapiens
ctgggccgcaagggc

SEQ ID NO: 5408030 - DNA, 16 bp, Homo sapiens
ctgggccgcaagggcc

SEQ ID NO: 5408031 - DNA, 17 bp, Homo sapiens
ctgggccgcaagggcct

SEQ ID NO: 5408032 - DNA, 19 bp, Homo sapiens
ctgggccgcaagggcctgg

SEQ ID NO: 5408033 - DNA, 18 bp, Homo sapiens
ctgggccgcgtgccgggc

SEQ ID NO: 5408034 - DNA, 15 bp, Homo sapiens
ctgggccgctgccac

SEQ ID NO: 5408035 - DNA, 17 bp, Homo sapiens
ctgggccggagggtcag

SEQ ID NO: 5408036 - DNA, 14 bp, Homo sapiens
ctgggccggctgag

SEQ ID NO: 5408037 - DNA, 22 bp, Homo sapiens
ctgggccgggcccagggcctct

SEQ ID NO: 5408038 - DNA, 13 bp, Homo sapiens
ctgggccgggctg

SEQ ID NO: 5408039 - DNA, 22 bp, Homo sapiens
ctgggccgggctgtagatcagg

SEQ ID NO: 5408040 - DNA, 21 bp, Homo sapiens
ctgggccgtatctccggctcc

SEQ ID NO: 5408041 - DNA, 18 bp, Homo sapiens
ctgggccgtggcacagct

SEQ ID NO: 5408042 - DNA, 19 bp, Homo sapiens
ctgggccgtggcacagctg

SEQ ID NO: 5408043 - DNA, 12 bp, Homo sapiens
ctgggcctatgg

SEQ ID NO: 5408044 - DNA, 16 bp, Homo sapiens
ctgggcctatggagag

SEQ ID NO: 5408045 - DNA, 18 bp, Homo sapiens
ctgggcctatggagagcc

SEQ ID NO: 5408046 - DNA, 22 bp, Homo sapiens
ctgggcctatggagagccctgg

SEQ ID NO: 5408047 - DNA, 17 bp, Homo sapiens
ctgggcctcagcctcca

SEQ ID NO: 5408048 - DNA, 18 bp, Homo sapiens
ctgggcctcagcctccag

SEQ ID NO: 5408049 - DNA, 20 bp, Homo sapiens
ctgggcctcagcctccaggc

SEQ ID NO: 5408050 - DNA, 20 bp, Homo sapiens
ctgggcctcagttcaacctg

SEQ ID NO: 5408051 - DNA, 21 bp, Homo sapiens
ctgggcctcagttcaacctgg

SEQ ID NO: 5408052 - DNA, 14 bp, Homo sapiens
ctgggcctcagttt

SEQ ID NO: 5408053 - DNA, 18 bp, Homo sapiens
ctgggcctcagtttccct

SEQ ID NO: 5408054 - DNA, 12 bp, Homo sapiens
ctgggcctcatg

SEQ ID NO: 5408055 - DNA, 14 bp, Homo sapiens
ctgggcctcatggc

SEQ ID NO: 5408056 - DNA, 15 bp, Homo sapiens
ctgggcctccacctc

SEQ ID NO: 5408057 - DNA, 17 bp, Homo sapiens
ctgggcctcccctgggc

SEQ ID NO: 5408058 - DNA, 22 bp, Homo sapiens
ctgggcctcccgtccgtccgcc

SEQ ID NO: 5408059 - DNA, 18 bp, Homo sapiens
ctgggcctcccttgggct

SEQ ID NO: 5408060 - DNA, 19 bp, Homo sapiens
ctgggcctcccttgggctg

SEQ ID NO: 5408061 - DNA, 17 bp, Homo sapiens
ctgggcctcctcctagc

SEQ ID NO: 5408062 - DNA, 20 bp, Homo sapiens
ctgggcctcctcctagctgg

SEQ ID NO: 5408063 - DNA, 22 bp, Homo sapiens
ctgggcctcctcctagctggag

SEQ ID NO: 5408064 - DNA, 23 bp, Homo sapiens
ctgggcctcctcctagctggagt

SEQ ID NO: 5408065 - DNA, 16 bp, Homo sapiens
ctgggcctcctctaac

SEQ ID NO: 5408066 - DNA, 12 bp, Homo sapiens
ctgggcctcctg

SEQ ID NO: 5408067 - DNA, 13 bp, Homo sapiens
ctgggcctcctgc

SEQ ID NO: 5408068 - DNA, 19 bp, Homo sapiens
ctgggcctcggaccccact

SEQ ID NO: 5408069 - DNA, 11 bp, Homo sapiens
ctgggcctctg

SEQ ID NO: 5408070 - DNA, 14 bp, Homo sapiens
ctgggcctctgact

SEQ ID NO: 5408071 - DNA, 20 bp, Homo sapiens
ctgggcctgaccaaacagcc

SEQ ID NO: 5408072 - DNA, 15 bp, Homo sapiens
ctgggcctgagccta

SEQ ID NO: 5408073 - DNA, 21 bp, Homo sapiens
ctgggcctgagggtccacctg

SEQ ID NO: 5408074 - DNA, 21 bp, Homo sapiens
ctgggcctgatggagaggaga

SEQ ID NO: 5408075 - DNA, 21 bp, Homo sapiens
ctgggcctgatggtggggcca

SEQ ID NO: 5408076 - DNA, 16 bp, Homo sapiens
ctgggcctgcccctgt

SEQ ID NO: 5408077 - DNA, 14 bp, Homo sapiens
ctgggcctgcctca

SEQ ID NO: 5408078 - DNA, 14 bp, Homo sapiens
ctgggcctgctgct

SEQ ID NO: 5408079 - DNA, 19 bp, Homo sapiens
ctgggcctgctgctgagaa

SEQ ID NO: 5408080 - DNA, 12 bp, Homo sapiens
ctgggcctgctt

SEQ ID NO: 5408081 - DNA, 18 bp, Homo sapiens
ctgggcctggcagctcag

SEQ ID NO: 5408082 - DNA, 20 bp, Homo sapiens
ctgggcctggcagctcagct

SEQ ID NO: 5408083 - DNA, 11 bp, Homo sapiens
ctgggcctggg

SEQ ID NO: 5408084 - DNA, 17 bp, Homo sapiens
ctgggcctggggaccca

SEQ ID NO: 5408085 - DNA, 20 bp, Homo sapiens
ctgggcctgggggttttcca

SEQ ID NO: 5408086 - DNA, 16 bp, Homo sapiens
ctgggcctgggttcca

SEQ ID NO: 5408087 - DNA, 13 bp, Homo sapiens
ctgggcctggtct

SEQ ID NO: 5408088 - DNA, 16 bp, Homo sapiens
ctgggcctggtctcac

SEQ ID NO: 5408089 - DNA, 12 bp, Homo sapiens
ctgggcctgtct

SEQ ID NO: 5408090 - DNA, 14 bp, Homo sapiens
ctgggcctgtctca

SEQ ID NO: 5408091 - DNA, 12 bp, Homo sapiens
ctgggcctgtgc

SEQ ID NO: 5408092 - DNA, 15 bp, Homo sapiens
ctgggcctgtgcact

SEQ ID NO: 5408093 - DNA, 21 bp, Homo sapiens
ctgggcctgtgcactgggcag

SEQ ID NO: 5408094 - DNA, 23 bp, Homo sapiens
ctgggcctgtgcactgggcaggt

SEQ ID NO: 5408095 - DNA, 16 bp, Homo sapiens
ctgggcctgtgcagca

SEQ ID NO: 5408096 - DNA, 13 bp, Homo sapiens
ctgggcctgtgtg

SEQ ID NO: 5408097 - DNA, 16 bp, Homo sapiens
ctgggcctgtgtgtgg

SEQ ID NO: 5408098 - DNA, 20 bp, Homo sapiens
ctgggcctgtgtgtgggtgg

SEQ ID NO: 5408099 - DNA, 15 bp, Homo sapiens
ctgggcctgttctct

SEQ ID NO: 5408100 - DNA, 19 bp, Homo sapiens
ctgggcctgttctcttggc

SEQ ID NO: 5408101 - DNA, 16 bp, Homo sapiens
ctgggccttacctccc

SEQ ID NO: 5408102 - DNA, 19 bp, Homo sapiens
ctgggccttacctcccctg

SEQ ID NO: 5408103 - DNA, 21 bp, Homo sapiens
ctgggccttacctcccctgcc

SEQ ID NO: 5408104 - DNA, 14 bp, Homo sapiens
ctgggccttaggaa

SEQ ID NO: 5408105 - DNA, 15 bp, Homo sapiens
ctgggccttatgtgg

SEQ ID NO: 5408106 - DNA, 20 bp, Homo sapiens
ctgggccttatgtggggttg

SEQ ID NO: 5408107 - DNA, 16 bp, Homo sapiens
ctgggccttctcagct

SEQ ID NO: 5408108 - DNA, 17 bp, Homo sapiens
ctgggccttctcagctc

SEQ ID NO: 5408109 - DNA, 16 bp, Homo sapiens
ctgggccttggcctgg

SEQ ID NO: 5408110 - DNA, 17 bp, Homo sapiens
ctgggccttggcctgga

SEQ ID NO: 5408111 - DNA, 19 bp, Homo sapiens
ctgggccttggcctggagc

SEQ ID NO: 5408112 - DNA, 16 bp, Homo sapiens
ctgggccttggctggg

SEQ ID NO: 5408113 - DNA, 15 bp, Homo sapiens
ctgggccttgggctc

SEQ ID NO: 5408114 - DNA, 17 bp, Homo sapiens
ctgggccttgggctccg

SEQ ID NO: 5408115 - DNA, 13 bp, Homo sapiens
ctgggcctttcct

SEQ ID NO: 5408116 - DNA, 21 bp, Homo sapiens
ctgggcctttcctgtgccaac

SEQ ID NO: 5408117 - DNA, 16 bp, Homo sapiens
ctgggcctttgcaaga

SEQ ID NO: 5408118 - DNA, 23 bp, Homo sapiens
ctgggcgaatctacagaacaaag

SEQ ID NO: 5408119 - DNA, 15 bp, Homo sapiens
ctgggcgacaaaaac

SEQ ID NO: 5408120 - DNA, 14 bp, Homo sapiens
ctgggcgcagctga

SEQ ID NO: 5408121 - DNA, 21 bp, Homo sapiens
ctgggcgcagctgaagcctgg

SEQ ID NO: 5408122 - DNA, 22 bp, Homo sapiens
ctgggcgcagctgaagcctgga

SEQ ID NO: 5408123 - DNA, 18 bp, Homo sapiens
ctgggcgccctggaagcc

SEQ ID NO: 5408124 - DNA, 18 bp, Homo sapiens
ctgggcgccggttccacg

SEQ ID NO: 5408125 - DNA, 23 bp, Homo sapiens
ctgggcgcttcccttttaagcaa

SEQ ID NO: 5408126 - DNA, 16 bp, Homo sapiens
ctgggcggccagtgcg

SEQ ID NO: 5408127 - DNA, 22 bp, Homo sapiens
ctgggcggcccgtggacacccc

SEQ ID NO: 5408128 - DNA, 18 bp, Homo sapiens
ctgggcggggccgcagcc

SEQ ID NO: 5408129 - DNA, 16 bp, Homo sapiens
ctgggcggggctcgag

SEQ ID NO: 5408130 - DNA, 22 bp, Homo sapiens
ctgggcggggctcgaggctggt

SEQ ID NO: 5408131 - DNA, 16 bp, Homo sapiens
ctgggcggtccagaag

SEQ ID NO: 5408132 - DNA, 19 bp, Homo sapiens
ctgggcgtccagctcagcc

SEQ ID NO: 5408133 - DNA, 23 bp, Homo sapiens
ctgggcgtccagctcagccctgg

SEQ ID NO: 5408134 - DNA, 18 bp, Homo sapiens
ctgggcgtgacccgtcca

SEQ ID NO: 5408135 - DNA, 21 bp, Homo sapiens
ctgggcgtgtgtgacactgat

SEQ ID NO: 5408136 - DNA, 18 bp, Homo sapiens
ctgggctacaaaccagga

SEQ ID NO: 5408137 - DNA, 19 bp, Homo sapiens
ctgggctacaaaccaggag

SEQ ID NO: 5408138 - DNA, 16 bp, Homo sapiens
ctgggctacaatttgt

SEQ ID NO: 5408139 - DNA, 16 bp, Homo sapiens
ctgggctaccatctgc

SEQ ID NO: 5408140 - DNA, 17 bp, Homo sapiens
ctgggctaccatctgca

SEQ ID NO: 5408141 - DNA, 19 bp, Homo sapiens
ctgggctaccatctgcatg

SEQ ID NO: 5408142 - DNA, 19 bp, Homo sapiens
ctgggctactgccactgtg

SEQ ID NO: 5408143 - DNA, 20 bp, Homo sapiens
ctgggctactgccactgtgt

SEQ ID NO: 5408144 - DNA, 13 bp, Homo sapiens
ctgggctagggag

SEQ ID NO: 5408145 - DNA, 20 bp, Homo sapiens
ctgggctaggggacatcaga

SEQ ID NO: 5408146 - DNA, 22 bp, Homo sapiens
ctgggctaggtagaaaaagggt

SEQ ID NO: 5408147 - DNA, 21 bp, Homo sapiens
ctgggctatatgcctatattt

SEQ ID NO: 5408148 - DNA, 13 bp, Homo sapiens
ctgggctatattc

SEQ ID NO: 5408149 - DNA, 14 bp, Homo sapiens
ctgggctatattcc

SEQ ID NO: 5408150 - DNA, 14 bp, Homo sapiens
ctgggctatggaca

SEQ ID NO: 5408151 - DNA, 18 bp, Homo sapiens
ctgggctatggacacagg

SEQ ID NO: 5408152 - DNA, 16 bp, Homo sapiens
ctgggctattgctgct

SEQ ID NO: 5408153 - DNA, 23 bp, Homo sapiens
ctgggctcaaatgatcctcccac

SEQ ID NO: 5408154 - DNA, 17 bp, Homo sapiens
ctgggctcaagcagtct

SEQ ID NO: 5408155 - DNA, 17 bp, Homo sapiens
ctgggctcaagctttcc

SEQ ID NO: 5408156 - DNA, 15 bp, Homo sapiens
ctgggctcacaccag

SEQ ID NO: 5408157 - DNA, 18 bp, Homo sapiens
ctgggctcacaccagccc

SEQ ID NO: 5408158 - DNA, 12 bp, Homo sapiens
ctgggctcacag

SEQ ID NO: 5408159 - DNA, 16 bp, Homo sapiens
ctgggctcacaggcct

SEQ ID NO: 5408160 - DNA, 22 bp, Homo sapiens
ctgggctcactacatgggccag

SEQ ID NO: 5408161 - DNA, 22 bp, Homo sapiens
ctgggctcactgtgctggggca

SEQ ID NO: 5408162 - DNA, 12 bp, Homo sapiens
ctgggctcagcc

SEQ ID NO: 5408163 - DNA, 15 bp, Homo sapiens
ctgggctcagcctgg

SEQ ID NO: 5408164 - DNA, 23 bp, Homo sapiens
ctgggctcagcctggtttctggg

SEQ ID NO: 5408165 - DNA, 16 bp, Homo sapiens
ctgggctcagggctgg

SEQ ID NO: 5408166 - DNA, 17 bp, Homo sapiens
ctgggctcagggctgga

SEQ ID NO: 5408167 - DNA, 21 bp, Homo sapiens
ctgggctcagggctggagtgc

SEQ ID NO: 5408168 - DNA, 12 bp, Homo sapiens
ctgggctcagtg

SEQ ID NO: 5408169 - DNA, 18 bp, Homo sapiens
ctgggctccacacagcag

SEQ ID NO: 5408170 - DNA, 20 bp, Homo sapiens
ctgggctccacacagcagtg

SEQ ID NO: 5408171 - DNA, 22 bp, Homo sapiens
ctgggctccacacagcagtgtc

SEQ ID NO: 5408172 - DNA, 17 bp, Homo sapiens
ctgggtccatcctggtc

SEQ ID NO: 5408173 - DNA, 15 bp, Homo sapiens
ctgggtcccagcctg

SEQ ID NO: 5408174 - DNA, 13 bp, Homo sapiens
ctgggtcccaggg

SEQ ID NO: 5408175 - DNA, 21 bp, Homo sapiens
ctgggtcccagggctggccct

SEQ ID NO: 5408176 - DNA, 12 bp, Homo sapiens
ctgggtcccggg

SEQ ID NO: 5408177 - DNA, 18 bp, Homo sapiens
ctgggtccctcggagctg

SEQ ID NO: 5408178 - DNA, 14 bp, Homo sapiens
ctgggtccctgctc

SEQ ID NO: 5408179 - DNA, 15 bp, Homo sapiens
ctgggtccctgctcc

SEQ ID NO: 5408180 - DNA, 16 bp, Homo sapiens
ctgggtccctgctccc

SEQ ID NO: 5408181 - DNA, 14 bp, Homo sapiens
ctgggtcctccaaa

SEQ ID NO: 5408182 - DNA, 18 bp, Homo sapiens
ctgggtcctccaaagact

SEQ ID NO: 5408183 - DNA, 16 bp, Homo sapiens
ctgggtcctcccagct

SEQ ID NO: 5408184 - DNA, 17 bp, Homo sapiens
ctgggtcctcctttctg

SEQ ID NO: 5408185 - DNA, 18 bp, Homo sapiens
ctgggtcctcggccctgt

SEQ ID NO: 5408186 - DNA, 14 bp, Homo sapiens
ctgggtcctctgca

SEQ ID NO: 5408187 - DNA, 17 bp, Homo sapiens
ctgggtcctgccagctg

SEQ ID NO: 5408188 - DNA, 15 bp, Homo sapiens
ctgggtcctgcctgc

SEQ ID NO: 5408189 - DNA, 16 bp, Homo sapiens
ctgggtcctgcctgca

SEQ ID NO: 5408190 - DNA, 17 bp, Homo sapiens
ctgggtccttggctccc

SEQ ID NO: 5408191 - DNA, 18 bp, Homo sapiens
ctgggtccttggctcccg

SEQ ID NO: 5408192 - DNA, 17 bp, Homo sapiens
ctgggtccttgggcctg

SEQ ID NO: 5408193 - DNA, 19 bp, Homo sapiens
ctgggtccttttcagaagt

SEQ ID NO: 5408194 - DNA, 17 bp, Homo sapiens
ctgggtcgcccctcctc

SEQ ID NO: 5408195 - DNA, 14 bp, Homo sapiens
ctgggtcgggacag

SEQ ID NO: 5408196 - DNA, 19 bp, Homo sapiens
ctgggtctaatccttctca

SEQ ID NO: 5408197 - DNA, 23 bp, Homo sapiens
ctgggtctcaccggctctcacct

SEQ ID NO: 5408198 - DNA, 15 bp, Homo sapiens
ctgggtctcaggaca

SEQ ID NO: 5408199 - DNA, 17 bp, Homo sapiens
ctgggtctcagtgtcct

SEQ ID NO: 5408200 - DNA, 18 bp, Homo sapiens
ctgggtctcagtgtcctc

SEQ ID NO: 5408201 - DNA, 16 bp, Homo sapiens
ctgggtctccagggag

SEQ ID NO: 5408202 - DNA, 22 bp, Homo sapiens
ctgggtctcccactttctgttc

SEQ ID NO: 5408203 - DNA, 19 bp, Homo sapiens
ctgggtctccctttccatg

SEQ ID NO: 5408204 - DNA, 23 bp, Homo sapiens
ctgggtctccctttccatggcaa

SEQ ID NO: 5408205 - DNA, 12 bp, Homo sapiens
ctgggtctcctt

SEQ ID NO: 5408206 - DNA, 21 bp, Homo sapiens
ctgggtctgacctggtgggag

SEQ ID NO: 5408207 - DNA, 16 bp, Homo sapiens
ctgggtctgaggcccc

SEQ ID NO: 5408208 - DNA, 18 bp, Homo sapiens
ctgggtctgaggcccctg

SEQ ID NO: 5408209 - DNA, 19 bp, Homo sapiens
ctgggtctgaggcccctgc

SEQ ID NO: 5408210 - DNA, 21 bp, Homo sapiens
ctgggtctgaggcccctgcct

SEQ ID NO: 5408211 - DNA, 23 bp, Homo sapiens
ctgggtctgaggcccctgcctcc

SEQ ID NO: 5408212 - DNA, 13 bp, Homo sapiens
ctgggtctgcgat

SEQ ID NO: 5408213 - DNA, 13 bp, Homo sapiens
ctgggtctggcca

SEQ ID NO: 5408214 - DNA, 17 bp, Homo sapiens
ctgggtctgtgtctctt

SEQ ID NO: 5408215 - DNA, 14 bp, Homo sapiens
ctgggtcttcagct

SEQ ID NO: 5408216 - DNA, 21 bp, Homo sapiens
ctgggtgaaagggatactttt

SEQ ID NO: 5408217 - DNA, 13 bp, Homo sapiens
ctgggtgacagag

SEQ ID NO: 5408218 - DNA, 22 bp, Homo sapiens
ctgggtgacagagcaagactct

SEQ ID NO: 5408219 - DNA, 23 bp, Homo sapiens
ctgggtgacagagcgagactctg

SEQ ID NO: 5408220 - DNA, 17 bp, Homo sapiens
ctgggtgacagagtgag

SEQ ID NO: 5408221 - DNA, 14 bp, Homo sapiens
ctgggtgacatttg

SEQ ID NO: 5408222 - DNA, 20 bp, Homo sapiens
ctgggtgacccccactgccg

SEQ ID NO: 5408223 - DNA, 19 bp, Homo sapiens
ctgggtgaccgactacccc

SEQ ID NO: 5408224 - DNA, 16 bp, Homo sapiens
ctgggtgactggaggc

SEQ ID NO: 5408225 - DNA, 18 bp, Homo sapiens
ctgggtgagagaggaata

SEQ ID NO: 5408226 - DNA, 16 bp, Homo sapiens
ctgggtgagctcttcc

SEQ ID NO: 5408227 - DNA, 18 bp, Homo sapiens
ctgggtgagctcttccag

SEQ ID NO: 5408228 - DNA, 12 bp, Homo sapiens
ctgggtgatgga

SEQ ID NO: 5408229 - DNA, 15 bp, Homo sapiens
ctgggtgcagctgag

SEQ ID NO: 5408230 - DNA, 23 bp, Homo sapiens
ctgggtgcagtagtgagcaggac

SEQ ID NO: 5408231 - DNA, 20 bp, Homo sapiens
ctgggtgcatgatcttgagc

SEQ ID NO: 5408232 - DNA, 13 bp, Homo sapiens
ctgggtgccaggt

SEQ ID NO: 5408233 - DNA, 16 bp, Homo sapiens
ctgggtgccaggtgct

SEQ ID NO: 5408234 - DNA, 15 bp, Homo sapiens
ctgggtgccattccc

SEQ ID NO: 5408235 - DNA, 20 bp, Homo sapiens
ctgggtgcccaagctcagaa

SEQ ID NO: 5408236 - DNA, 12 bp, Homo sapiens
ctgggtgcccac

SEQ ID NO: 5408237 - DNA, 14 bp, Homo sapiens
ctgggtgcccacag

SEQ ID NO: 5408238 - DNA, 21 bp, Homo sapiens
ctgggtgccccgtccacggct

SEQ ID NO: 5408239 - DNA, 16 bp, Homo sapiens
ctgggtgccctctcag

SEQ ID NO: 5408240 - DNA, 22 bp, Homo sapiens
ctgggtgccctgaaagggccct

SEQ ID NO: 5408241 - DNA, 15 bp, Homo sapiens
ctgggtgccctggct

SEQ ID NO: 5408242 - DNA, 17 bp, Homo sapiens
ctgggtgcctcccacac

SEQ ID NO: 5408243 - DNA, 13 bp, Homo sapiens
ctgggtgcctcct

SEQ ID NO: 5408244 - DNA, 11 bp, Homo sapiens
ctgggtgcctg

SEQ ID NO: 5408245 - DNA, 12 bp, Homo sapiens
ctgggtgcctgc

SEQ ID NO: 5408246 - DNA, 22 bp, Homo sapiens
ctgggtgcctgcagcgcctccc

SEQ ID NO: 5408247 - DNA, 23 bp, Homo sapiens
ctgggtgcgaccccatctgccca

SEQ ID NO: 5408248 - DNA, 19 bp, Homo sapiens
ctgggtgcggtggctcatg

SEQ ID NO: 5408249 - DNA, 16 bp, Homo sapiens
ctgggtgcgtctccag

SEQ ID NO: 5408250 - DNA, 19 bp, Homo sapiens
ctgggtgcgtctccagtca

SEQ ID NO: 5408251 - DNA, 18 bp, Homo sapiens
ctgggtgctactggggaa

SEQ ID NO: 5408252 - DNA, 17 bp, Homo sapiens
ctgggtgctcagggcat

SEQ ID NO: 5408253 - DNA, 14 bp, Homo sapiens
ctgggtgctcccta

SEQ ID NO: 5408254 - DNA, 20 bp, Homo sapiens
ctgggtgctgatccttgcac

SEQ ID NO: 5408255 - DNA, 17 bp, Homo sapiens
ctgggtggaaggcagac

SEQ ID NO: 5408256 - DNA, 21 bp, Homo sapiens
ctgggtggaagtgcccagccc

SEQ ID NO: 5408257 - DNA, 22 bp, Homo sapiens
ctgggtggagcaggactcccac

SEQ ID NO: 5408258 - DNA, 16 bp, Homo sapiens
ctgggtggagggagac

SEQ ID NO: 5408259 - DNA, 16 bp, Homo sapiens
ctgggtggatgggcca

SEQ ID NO: 5408260 - DNA, 13 bp, Homo sapiens
ctgggtggcaggg

SEQ ID NO: 5408261 - DNA, 13 bp, Homo sapiens
ctgggtggcccat

SEQ ID NO: 5408262 - DNA, 19 bp, Homo sapiens
ctgggtggcccctgtctcg

SEQ ID NO: 5408263 - DNA, 15 bp, Homo sapiens
ctgggtggccggccc

SEQ ID NO: 5408264 - DNA, 11 bp, Homo sapiens
ctgggtggcct

SEQ ID NO: 5408265 - DNA, 16 bp, Homo sapiens
ctgggtggcctcggga

SEQ ID NO: 5408266 - DNA, 19 bp, Homo sapiens
ctgggtggcctcgggacac

SEQ ID NO: 5408267 - DNA, 12 bp, Homo sapiens
ctgggtggcctg

SEQ ID NO: 5408268 - DNA, 15 bp, Homo sapiens
ctgggtggctcactc

SEQ ID NO: 5408269 - DNA, 14 bp, Homo sapiens
ctgggtggctcagc

SEQ ID NO: 5408270 - DNA, 14 bp, Homo sapiens
ctgggtggctcctg

SEQ ID NO: 5408271 - DNA, 17 bp, Homo sapiens
ctgggtggctcctgcca

SEQ ID NO: 5408272 - DNA, 23 bp, Homo sapiens
ctgggtggctcctgccactgacc

SEQ ID NO: 5408273 - DNA, 20 bp, Homo sapiens
ctgggtgggacagcctcttc

SEQ ID NO: 5408274 - DNA, 17 bp, Homo sapiens
ctgggtgggagcatagg

SEQ ID NO: 5408275 - DNA, 13 bp, Homo sapiens
ctgggtgggccca

SEQ ID NO: 5408276 - DNA, 14 bp, Homo sapiens
ctgggtgggcccca

SEQ ID NO: 5408277 - DNA, 16 bp, Homo sapiens
ctgggtgggccccaca

SEQ ID NO: 5408278 - DNA, 20 bp, Homo sapiens
ctgggtgggcgtggcctgca

SEQ ID NO: 5408279 - DNA, 12 bp, Homo sapiens
ctgggtggggca

SEQ ID NO: 5408280 - DNA, 23 bp, Homo sapiens
ctgggtggggcagcacacctctg

SEQ ID NO: 5408281 - DNA, 20 bp, Homo sapiens
ctgggtggggcagggcctgg

SEQ ID NO: 5408282 - DNA, 13 bp, Homo sapiens
ctgggtggggctg

SEQ ID NO: 5408283 - DNA, 18 bp, Homo sapiens
ctgggtggggctgctcct

SEQ ID NO: 5408284 - DNA, 19 bp, Homo sapiens
ctgggtggtaactgccagc

SEQ ID NO: 5408285 - DNA, 20 bp, Homo sapiens
ctgggtggtaactgccagcc

SEQ ID NO: 5408286 - DNA, 21 bp, Homo sapiens
ctgggtggtagatttcctcct

SEQ ID NO: 5408287 - DNA, 16 bp, Homo sapiens
ctgggtggtctgaata

SEQ ID NO: 5408288 - DNA, 13 bp, Homo sapiens
ctgggtggtctgc

SEQ ID NO: 5408289 - DNA, 13 bp, Homo sapiens
ctgggtggttctc

SEQ ID NO: 5408290 - DNA, 17 bp, Homo sapiens
ctgggtggttctctggg

SEQ ID NO: 5408291 - DNA, 16 bp, Homo sapiens
ctgggtggttgccctt

SEQ ID NO: 5408292 - DNA, 18 bp, Homo sapiens
ctgggtggttgcccttca

SEQ ID NO: 5408293 - DNA, 15 bp, Homo sapiens
ctgggtgtaaacaca

SEQ ID NO: 5408294 - DNA, 20 bp, Homo sapiens
ctgggtgtcaagtgcctgca

SEQ ID NO: 5408295 - DNA, 13 bp, Homo sapiens
ctgggtgtcattt

SEQ ID NO: 5408296 - DNA, 18 bp, Homo sapiens
ctgggtgtccgccatcca

SEQ ID NO: 5408297 - DNA, 20 bp, Homo sapiens
ctgggtgtccgccatccagg

SEQ ID NO: 5408298 - DNA, 18 bp, Homo sapiens
ctgggtgtggcctggctt

SEQ ID NO: 5408299 - DNA, 13 bp, Homo sapiens
ctgggtgtttttt

SEQ ID NO: 5408300 - DNA, 14 bp, Homo sapiens
ctgggttaaatatt

SEQ ID NO: 5408301 - DNA, 20 bp, Homo sapiens
ctgggttaacagtaaatata

SEQ ID NO: 5408302 - DNA, 21 bp, Homo sapiens
ctgggttaggtggccgctcct

SEQ ID NO: 5408303 - DNA, 22 bp, Homo sapiens
ctgggttcaagagactctcctg

SEQ ID NO: 5408304 - DNA, 23 bp, Homo sapiens
ctgggttcacgtaatcctcctga

SEQ ID NO: 5408305 - DNA, 15 bp, Homo sapiens
ctgggttcactgcaa

SEQ ID NO: 5408306 - DNA, 19 bp, Homo sapiens
ctgggttcagcctctccca

SEQ ID NO: 5408307 - DNA, 17 bp, Homo sapiens
ctgggttcattccccgg

SEQ ID NO: 5408308 - DNA, 22 bp, Homo sapiens
ctgggttcattccccggccctc

SEQ ID NO: 5408309 - DNA, 14 bp, Homo sapiens
ctgggttcatttgt

SEQ ID NO: 5408310 - DNA, 13 bp, Homo sapiens
ctgggttcccact

SEQ ID NO: 5408311 - DNA, 15 bp, Homo sapiens
ctgggttcccactcc

SEQ ID NO: 5408312 - DNA, 16 bp, Homo sapiens
ctgggttcccactccc

SEQ ID NO: 5408313 - DNA, 23 bp, Homo sapiens
ctgggttccccaccccgggctct

SEQ ID NO: 5408314 - DNA, 13 bp, Homo sapiens
ctgggttccggga

SEQ ID NO: 5408315 - DNA, 17 bp, Homo sapiens
ctgggttccgggaggca

SEQ ID NO: 5408316 - DNA, 22 bp, Homo sapiens
ctgggttccttcctctgagcct

SEQ ID NO: 5408317 - DNA, 23 bp, Homo sapiens
ctgggttccttcctctgagcctt

SEQ ID NO: 5408318 - DNA, 16 bp, Homo sapiens
ctgggttcgttgggga

SEQ ID NO: 5408319 - DNA, 14 bp, Homo sapiens
ctgggttctaccca

SEQ ID NO: 5408320 - DNA, 12 bp, Homo sapiens
ctgggttctggg

SEQ ID NO: 5408321 - DNA, 14 bp, Homo sapiens
ctgggttctggggc

SEQ ID NO: 5408322 - DNA, 16 bp, Homo sapiens
ctgggttctgggtggt

SEQ ID NO: 5408323 - DNA, 21 bp, Homo sapiens
ctgggttcttccacagcacaa

SEQ ID NO: 5408324 - DNA, 17 bp, Homo sapiens
ctgggttcttgttttat

SEQ ID NO: 5408325 - DNA, 17 bp, Homo sapiens
ctgggttctttggaagc

SEQ ID NO: 5408326 - DNA, 18 bp, Homo sapiens
ctgggttgcagacaggaa

SEQ ID NO: 5408327 - DNA, 17 bp, Homo sapiens
ctgggttgcctttattt

SEQ ID NO: 5408328 - DNA, 15 bp, Homo sapiens
ctgggttggagggaa

SEQ ID NO: 5408329 - DNA, 15 bp, Homo sapiens
ctgggttggagggtg

SEQ ID NO: 5408330 - DNA, 20 bp, Homo sapiens
ctgggttggcgcaccctccc

SEQ ID NO: 5408331 - DNA, 13 bp, Homo sapiens
ctgggttgggggc

SEQ ID NO: 5408332 - DNA, 20 bp, Homo sapiens
ctgggttgggggcactcagc

SEQ ID NO: 5408333 - DNA, 22 bp, Homo sapiens
ctgggttgggggcactcagcca

SEQ ID NO: 5408334 - DNA, 14 bp, Homo sapiens
ctgggttggtgcac

SEQ ID NO: 5408335 - DNA, 21 bp, Homo sapiens
ctgggttgtttccaggagaaa

SEQ ID NO: 5408336 - DNA, 16 bp, Homo sapiens
ctgggtttaagcaatg

SEQ ID NO: 5408337 - DNA, 18 bp, Homo sapiens
ctgggtttaaggggagag

SEQ ID NO: 5408338 - DNA, 16 bp, Homo sapiens
ctgggtttacaacaaa

SEQ ID NO: 5408339 - DNA, 20 bp, Homo sapiens
ctgggtttagcccgaggctg

SEQ ID NO: 5408340 - DNA, 14 bp, Homo sapiens
ctgggtttatagat

SEQ ID NO: 5408341 - DNA, 19 bp, Homo sapiens
ctgggtttccacacagcct

SEQ ID NO: 5408342 - DNA, 22 bp, Homo sapiens
ctgggtttccacacagcctgtc

SEQ ID NO: 5408343 - DNA, 15 bp, Homo sapiens
ctgggtttcctgcag

SEQ ID NO: 5408344 - DNA, 16 bp, Homo sapiens
ctgggtttcctgcagg

SEQ ID NO: 5408345 - DNA, 17 bp, Homo sapiens
ctgggtttcctgcaggc

SEQ ID NO: 5408346 - DNA, 18 bp, Homo sapiens
ctgggtttctaagcagtt

SEQ ID NO: 5408347 - DNA, 18 bp, Homo sapiens
ctgggtttctctgtatag

SEQ ID NO: 5408348 - DNA, 21 bp, Homo sapiens
ctgggtttgcccagtcctggg

SEQ ID NO: 5408349 - DNA, 18 bp, Homo sapiens
ctgggtttggcaggcact

SEQ ID NO: 5408350 - DNA, 15 bp, Homo sapiens
ctgggtttggcccaa

SEQ ID NO: 5408351 - DNA, 13 bp, Homo sapiens
ctggtgcccaccc

SEQ ID NO: 5408352 - DNA, 13 bp, Homo sapiens
ctggtgcccatga

SEQ ID NO: 5408353 - DNA, 15 bp, Homo sapiens
ctggtgcccatgaag

SEQ ID NO: 5408354 - DNA, 16 bp, Homo sapiens
ctggtgcccatgaaga

SEQ ID NO: 5408355 - DNA, 19 bp, Homo sapiens
ctggtgccccacagctacc

SEQ ID NO: 5408356 - DNA, 13 bp, Homo sapiens
ctggtgccccacc

SEQ ID NO: 5408357 - DNA, 18 bp, Homo sapiens
ctggtgccccacctgcct

SEQ ID NO: 5408358 - DNA, 19 bp, Homo sapiens
ctggtgccccacctgcctg

SEQ ID NO: 5408359 - DNA, 15 bp, Homo sapiens
ctggtgcccccagac

SEQ ID NO: 5408360 - DNA, 23 bp, Homo sapiens
ctggtgcccccagacagctgctc

SEQ ID NO: 5408361 - DNA, 21 bp, Homo sapiens
ctggtgccccccacccctgga

SEQ ID NO: 5408362 - DNA, 14 bp, Homo sapiens
ctggtgccctgaga

SEQ ID NO: 5408363 - DNA, 15 bp, Homo sapiens
ctggtgccctgcttt

SEQ ID NO: 5408364 - DNA, 16 bp, Homo sapiens
ctggtgccctgctttc

SEQ ID NO: 5408365 - DNA, 19 bp, Homo sapiens
ctggtgccctgctttcaga

SEQ ID NO: 5408366 - DNA, 23 bp, Homo sapiens
ctggtgccctgctttcagatact

SEQ ID NO: 5408367 - DNA, 21 bp, Homo sapiens
ctggtgccctggatgcccagg

SEQ ID NO: 5408368 - DNA, 20 bp, Homo sapiens
ctggtgccctggcccagcct

SEQ ID NO: 5408369 - DNA, 19 bp, Homo sapiens
ctggtgcccttccctggag

SEQ ID NO: 5408370 - DNA, 20 bp, Homo sapiens
ctggtgcccttccctggagg

SEQ ID NO: 5408371 - DNA, 21 bp, Homo sapiens
ctggtgcctatctgcctggag

SEQ ID NO: 5408372 - DNA, 14 bp, Homo sapiens
ctggtgcctccaga

SEQ ID NO: 5408373 - DNA, 14 bp, Homo sapiens
ctggtgcctctgtg

SEQ ID NO: 5408374 - DNA, 13 bp, Homo sapiens
ctggtgcctgcag

SEQ ID NO: 5408375 - DNA, 14 bp, Homo sapiens
ctggtgcctttcca

SEQ ID NO: 5408376 - DNA, 16 bp, Homo sapiens
ctggtgcgaatggact

SEQ ID NO: 5408377 - DNA, 17 bp, Homo sapiens
ctggtgcgaatggactt

SEQ ID NO: 5408378 - DNA, 14 bp, Homo sapiens
ctggtgcgctgtgc

SEQ ID NO: 5408379 - DNA, 15 bp, Homo sapiens
ctggtgcgctgtgct

SEQ ID NO: 5408380 - DNA, 16 bp, Homo sapiens
ctggtgcgctgtgctc

SEQ ID NO: 5408381 - DNA, 23 bp, Homo sapiens
ctggtgcgctgtgctccagcagt

SEQ ID NO: 5408382 - DNA, 14 bp, Homo sapiens
ctggtgcggctggc

SEQ ID NO: 5408383 - DNA, 19 bp, Homo sapiens
ctggtgcggctggccatgg

SEQ ID NO: 5408384 - DNA, 15 bp, Homo sapiens
ctggtgcgtgtggcc

SEQ ID NO: 5408385 - DNA, 21 bp, Homo sapiens
ctggtgcgtgtggccctgtgg

SEQ ID NO: 5408386 - DNA, 22 bp, Homo sapiens
ctggtgcgtgtggccctgtggg

SEQ ID NO: 5408387 - DNA, 15 bp, Homo sapiens
ctggtgcgttcctaa

SEQ ID NO: 5408388 - DNA, 20 bp, Homo sapiens
ctggtgctacttgcttgaag

SEQ ID NO: 5408389 - DNA, 14 bp, Homo sapiens
ctggtgctcctgca

SEQ ID NO: 5408390 - DNA, 17 bp, Homo sapiens
ctggtgctcctgcatct

SEQ ID NO: 5408391 - DNA, 17 bp, Homo sapiens
ctggtgctcctgcccag

SEQ ID NO: 5408392 - DNA, 20 bp, Homo sapiens
ctggtgctcgggaagggagg

SEQ ID NO: 5408393 - DNA, 22 bp, Homo sapiens
ctggtgctcgggaagggagggg

SEQ ID NO: 5408394 - DNA, 22 bp, Homo sapiens
ctggtgctgaggatacagctct

SEQ ID NO: 5408395 - DNA, 13 bp, Homo sapiens
ctggtgctgagtg

SEQ ID NO: 5408396 - DNA, 14 bp, Homo sapiens
ctggtgctgagtga

SEQ ID NO: 5408397 - DNA, 15 bp, Homo sapiens
ctggtgctgcaagga

SEQ ID NO: 5408398 - DNA, 17 bp, Homo sapiens
ctggtgctgcagcaccg

SEQ ID NO: 5408399 - DNA, 17 bp, Homo sapiens
ctggtgctgcagtatgt

SEQ ID NO: 5408400 - DNA, 17 bp, Homo sapiens
ctggtgctgccgagggc

SEQ ID NO: 5408401 - DNA, 19 bp, Homo sapiens
ctggtgctgccgagggctg

SEQ ID NO: 5408402 - DNA, 20 bp, Homo sapiens
ctggtgctgccgagggctgg

SEQ ID NO: 5408403 - DNA, 12 bp, Homo sapiens
ctggtgctgctg

SEQ ID NO: 5408404 - DNA, 20 bp, Homo sapiens
ctggtgctgtggccagggtg

SEQ ID NO: 5408405 - DNA, 21 bp, Homo sapiens
ctggtgcttctcctctcctag

SEQ ID NO: 5408406 - DNA, 21 bp, Homo sapiens
ctggtggaatgcgggggagca

SEQ ID NO: 5408407 - DNA, 17 bp, Homo sapiens
ctggtggacagacccag

SEQ ID NO: 5408408 - DNA, 12 bp, Homo sapiens
ctggtggacagt

SEQ ID NO: 5408409 - DNA, 16 bp, Homo sapiens
ctggtggacagtcctg

SEQ ID NO: 5408410 - DNA, 15 bp, Homo sapiens
ctggtggaccacagg

SEQ ID NO: 5408411 - DNA, 18 bp, Homo sapiens
ctggtggaggagctgagg

SEQ ID NO: 5408412 - DNA, 23 bp, Homo sapiens
ctggtggagggggaggggagaag

SEQ ID NO: 5408413 - DNA, 20 bp, Homo sapiens
ctggtggatctaagaagggc

SEQ ID NO: 5408414 - DNA, 22 bp, Homo sapiens
ctggtggatggtgacttttgaa

SEQ ID NO: 5408415 - DNA, 17 bp, Homo sapiens
ctggtggattgggcaga

SEQ ID NO: 5408416 - DNA, 15 bp, Homo sapiens
ctggtggcacaggag

SEQ ID NO: 5408417 - DNA, 14 bp, Homo sapiens
ctggtggcaccaga

SEQ ID NO: 5408418 - DNA, 11 bp, Homo sapiens
ctggtggcacg

SEQ ID NO: 5408419 - DNA, 14 bp, Homo sapiens
ctggtggcagctca

SEQ ID NO: 5408420 - DNA, 16 bp, Homo sapiens
ctggtggcagctcacc

SEQ ID NO: 5408421 - DNA, 18 bp, Homo sapiens
ctggtggcagctcacctc

SEQ ID NO: 5408422 - DNA, 20 bp, Homo sapiens
ctggtggcagctcacctctc

SEQ ID NO: 5408423 - DNA, 13 bp, Homo sapiens
ctggtggcagctg

SEQ ID NO: 5408424 - DNA, 18 bp, Homo sapiens
ctggtggccaagcctgcc

SEQ ID NO: 5408425 - DNA, 19 bp, Homo sapiens
ctggtggccaagcctgccc

SEQ ID NO: 5408426 - DNA, 17 bp, Homo sapiens
ctggtggccactgagct

SEQ ID NO: 5408427 - DNA, 18 bp, Homo sapiens
ctggtggccactgagctg

SEQ ID NO: 5408428 - DNA, 22 bp, Homo sapiens
ctggtggccagtatcctggatt

SEQ ID NO: 5408429 - DNA, 22 bp, Homo sapiens
ctggtggcccactgactaagaa

SEQ ID NO: 5408430 - DNA, 12 bp, Homo sapiens
ctggtggcccag

SEQ ID NO: 5408431 - DNA, 16 bp, Homo sapiens
ctggtggcccagctat

SEQ ID NO: 5408432 - DNA, 12 bp, Homo sapiens
ctggtggcccca

SEQ ID NO: 5408433 - DNA, 20 bp, Homo sapiens
ctggtggccccgtttctggt

SEQ ID NO: 5408434 - DNA, 21 bp, Homo sapiens
ctggtggccccgtttctggtg

SEQ ID NO: 5408435 - DNA, 13 bp, Homo sapiens
ctggtggcccctt

SEQ ID NO: 5408436 - DNA, 15 bp, Homo sapiens
ctggtggccccttct

SEQ ID NO: 5408437 - DNA, 22 bp, Homo sapiens
ctggtggcccgacagcctggca

SEQ ID NO: 5408438 - DNA, 17 bp, Homo sapiens
ctggtggccctctcccc

SEQ ID NO: 5408439 - DNA, 22 bp, Homo sapiens
ctggtggccctctcccctgccc

SEQ ID NO: 5408440 - DNA, 13 bp, Homo sapiens
ctggtggccctgc

SEQ ID NO: 5408441 - DNA, 15 bp, Homo sapiens
ctggtggccctgcgg

SEQ ID NO: 5408442 - DNA, 16 bp, Homo sapiens
ctggtggccctgtgcc

SEQ ID NO: 5408443 - DNA, 21 bp, Homo sapiens
ctggtggcctgccccagctct

SEQ ID NO: 5408444 - DNA, 23 bp, Homo sapiens
ctggtggccttctgctgcccagg

SEQ ID NO: 5408445 - DNA, 13 bp, Homo sapiens
ctggtggccttgg

SEQ ID NO: 5408446 - DNA, 14 bp, Homo sapiens
ctggtggccttggg

SEQ ID NO: 5408447 - DNA, 17 bp, Homo sapiens
ctggtggccttgggcct

SEQ ID NO: 5408448 - DNA, 15 bp, Homo sapiens
ctggtggctcccgga

SEQ ID NO: 5408449 - DNA, 21 bp, Homo sapiens
ctggtggctcttcagaggagc

SEQ ID NO: 5408450 - DNA, 17 bp, Homo sapiens
ctggtggctctttgggc

SEQ ID NO: 5408451 - DNA, 14 bp, Homo sapiens
ctggtggctgcagg

SEQ ID NO: 5408452 - DNA, 15 bp, Homo sapiens
ctggtggctggaggc

SEQ ID NO: 5408453 - DNA, 12 bp, Homo sapiens
ctggtggctggg

SEQ ID NO: 5408454 - DNA, 16 bp, Homo sapiens
ctggtggctgggccca

SEQ ID NO: 5408455 - DNA, 19 bp, Homo sapiens
ctggtggctgggcccagca

SEQ ID NO: 5408456 - DNA, 22 bp, Homo sapiens
ctggtggctgggctgctcctga

SEQ ID NO: 5408457 - DNA, 19 bp, Homo sapiens
ctggtggcttaagtgagca

SEQ ID NO: 5408458 - DNA, 20 bp, Homo sapiens
ctggtggcttaagtgagcag

SEQ ID NO: 5408459 - DNA, 23 bp, Homo sapiens
ctggtggcttaagtgagcagaac

SEQ ID NO: 5408460 - DNA, 13 bp, Homo sapiens
ctggtgggaggca

SEQ ID NO: 5408461 - DNA, 13 bp, Homo sapiens
ctggtgggaggcc

SEQ ID NO: 5408462 - DNA, 16 bp, Homo sapiens
ctggtgggcagctgag

SEQ ID NO: 5408463 - DNA, 13 bp, Homo sapiens
ctggtgggccaac

SEQ ID NO: 5408464 - DNA, 13 bp, Homo sapiens
ctggtgggccacg

SEQ ID NO: 5408465 - DNA, 14 bp, Homo sapiens
ctggtgggccccca

SEQ ID NO: 5408466 - DNA, 20 bp, Homo sapiens
ctggtgggccttaacatccc

SEQ ID NO: 5408467 - DNA, 19 bp, Homo sapiens
ctggtgggctattgaagat

SEQ ID NO: 5408468 - DNA, 19 bp, Homo sapiens
ctggtggggaggaagaagt

SEQ ID NO: 5408469 - DNA, 20 bp, Homo sapiens
ctggtggggcagaaaggctg

SEQ ID NO: 5408470 - DNA, 21 bp, Homo sapiens
ctggtggggcagaaaggctgc

SEQ ID NO: 5408471 - DNA, 17 bp, Homo sapiens
ctggtggggcagctcct

SEQ ID NO: 5408472 - DNA, 13 bp, Homo sapiens
ctggtggggctga

SEQ ID NO: 5408473 - DNA, 16 bp, Homo sapiens
ctggtggggctgtcct

SEQ ID NO: 5408474 - DNA, 14 bp, Homo sapiens
ctggtgggggaagg

SEQ ID NO: 5408475 - DNA, 20 bp, Homo sapiens
ctggtgggggaaggggagga

SEQ ID NO: 5408476 - DNA, 19 bp, Homo sapiens
ctggtgggggttctggcag

SEQ ID NO: 5408477 - DNA, 22 bp, Homo sapiens
ctggtggggtgtgttccaactg

SEQ ID NO: 5408478 - DNA, 20 bp, Homo sapiens
ctggtgggtcagcccagcac

SEQ ID NO: 5408479 - DNA, 20 bp, Homo sapiens
ctggtgggtctgagctggac

SEQ ID NO: 5408480 - DNA, 17 bp, Homo sapiens
ctggtgggtgaaagaaa

SEQ ID NO: 5408481 - DNA, 16 bp, Homo sapiens
ctggtgggtggcccag

SEQ ID NO: 5408482 - DNA, 19 bp, Homo sapiens
ctggtggtaccattattat

SEQ ID NO: 5408483 - DNA, 15 bp, Homo sapiens
ctggtggtacctgtg

SEQ ID NO: 5408484 - DNA, 17 bp, Homo sapiens
ctggtggtacctgtgct

SEQ ID NO: 5408485 - DNA, 14 bp, Homo sapiens
ctggtggtcacagg

SEQ ID NO: 5408486 - DNA, 15 bp, Homo sapiens
ctggtggtcagatgc

SEQ ID NO: 5408487 - DNA, 15 bp, Homo sapiens
ctggtggtcagccct

SEQ ID NO: 5408488 - DNA, 19 bp, Homo sapiens
ctggtggtcagccctagga

SEQ ID NO: 5408489 - DNA, 23 bp, Homo sapiens
ctggtggtctgttggcaggctgg

SEQ ID NO: 5408490 - DNA, 15 bp, Homo sapiens
ctggtggtcttcctt

SEQ ID NO: 5408491 - DNA, 17 bp, Homo sapiens
ctggtggtgcagccttc

SEQ ID NO: 5408492 - DNA, 20 bp, Homo sapiens
ctggtggtgctggtcttttc

SEQ ID NO: 5408493 - DNA, 20 bp, Homo sapiens
ctggtggttaaggccagggc

SEQ ID NO: 5408494 - DNA, 12 bp, Homo sapiens
ctggtggttcac

SEQ ID NO: 5408495 - DNA, 23 bp, Homo sapiens
ctggtggttcactcttggagcct

SEQ ID NO: 5408496 - DNA, 18 bp, Homo sapiens
ctggtggttgatggtttt

SEQ ID NO: 5408497 - DNA, 17 bp, Homo sapiens
ctggtggttgtgccttt

SEQ ID NO: 5408498 - DNA, 16 bp, Homo sapiens
ctggtggtttcacggt

SEQ ID NO: 5408499 - DNA, 18 bp, Homo sapiens
ctggtggtttttcagctc

SEQ ID NO: 5408500 - DNA, 16 bp, Homo sapiens
ctggtgtaaaaaacaa

SEQ ID NO: 5408501 - DNA, 21 bp, Homo sapiens
ctggtgtactctaggacttca

SEQ ID NO: 5408502 - DNA, 21 bp, Homo sapiens
ctggtgtagctacagagaaac

SEQ ID NO: 5408503 - DNA, 20 bp, Homo sapiens
ctggtgtagctcctctgctg

SEQ ID NO: 5408504 - DNA, 15 bp, Homo sapiens
ctggtgtagtctttt

SEQ ID NO: 5408505 - DNA, 21 bp, Homo sapiens
ctggtgtagtgtgtcagctct

SEQ ID NO: 5408506 - DNA, 15 bp, Homo sapiens
ctggtgtatgtgtga

SEQ ID NO: 5408507 - DNA, 18 bp, Homo sapiens
ctggtgtcaccccagagc

SEQ ID NO: 5408508 - DNA, 20 bp, Homo sapiens
ctggtgtcaccccagagcca

SEQ ID NO: 5408509 - DNA, 22 bp, Homo sapiens
ctggtgtcaccccagagccaca

SEQ ID NO: 5408510 - DNA, 23 bp, Homo sapiens
ctggtgtcaccccagagccacac

SEQ ID NO: 5408511 - DNA, 15 bp, Homo sapiens
ctggtgtcacttact

SEQ ID NO: 5408512 - DNA, 16 bp, Homo sapiens
ctggtgtcataaactt

SEQ ID NO: 5408513 - DNA, 20 bp, Homo sapiens
ctggtgtccccttcccctgc

SEQ ID NO: 5408514 - DNA, 17 bp, Homo sapiens
ctggtgtccctgcctgg

SEQ ID NO: 5408515 - DNA, 12 bp, Homo sapiens
ctggtgtcctga

SEQ ID NO: 5408516 - DNA, 15 bp, Homo sapiens
ctggtgtcctgacca

SEQ ID NO: 5408517 - DNA, 18 bp, Homo sapiens
ctggtgtcctgaccaccc

SEQ ID NO: 5408518 - DNA, 22 bp, Homo sapiens
ctggtgtcctgaccaccctccc

SEQ ID NO: 5408519 - DNA, 21 bp, Homo sapiens
ctggtgtcttgagaccagcct

SEQ ID NO: 5408520 - DNA, 14 bp, Homo sapiens
ctggtgtctttgat

SEQ ID NO: 5408521 - DNA, 16 bp, Homo sapiens
ctggtgtgaactaaac

SEQ ID NO: 5408522 - DNA, 17 bp, Homo sapiens
ctggtgtgaactaaact

SEQ ID NO: 5408523 - DNA, 22 bp, Homo sapiens
ctggtgtgaactcaccctggga

SEQ ID NO: 5408524 - DNA, 16 bp, Homo sapiens
ctggtgtgacctgagg

SEQ ID NO: 5408525 - DNA, 15 bp, Homo sapiens
ctggtgtgaggctgg

SEQ ID NO: 5408526 - DNA, 23 bp, Homo sapiens
ctggtgtgaggctgggccagcct

SEQ ID NO: 5408527 - DNA, 17 bp, Homo sapiens
ctggtgtgcggaggcag

SEQ ID NO: 5408528 - DNA, 21 bp, Homo sapiens
ctggtgtgcggaggcaggagc

SEQ ID NO: 5408529 - DNA, 15 bp, Homo sapiens
ctgtagccacagctg

SEQ ID NO: 5408530 - DNA, 20 bp, Homo sapiens
ctgtagccacctccttggca

SEQ ID NO: 5408531 - DNA, 15 bp, Homo sapiens
ctgtagccagcacct

SEQ ID NO: 5408532 - DNA, 15 bp, Homo sapiens
ctgtagccatctgca

SEQ ID NO: 5408533 - DNA, 12 bp, Homo sapiens
ctgtagccatgg

SEQ ID NO: 5408534 - DNA, 17 bp, Homo sapiens
ctgtagccatggctcag

SEQ ID NO: 5408535 - DNA, 21 bp, Homo sapiens
ctgtagccatggctcaggcaa

SEQ ID NO: 5408536 - DNA, 16 bp, Homo sapiens
ctgtagcccactctgc

SEQ ID NO: 5408537 - DNA, 18 bp, Homo sapiens
ctgtagccccagtgacag

SEQ ID NO: 5408538 - DNA, 21 bp, Homo sapiens
ctgtagccccagtgacagcta

SEQ ID NO: 5408539 - DNA, 16 bp, Homo sapiens
ctgtagccctggcccg

SEQ ID NO: 5408540 - DNA, 23 bp, Homo sapiens
ctgtagccctggcccggtcccag

SEQ ID NO: 5408541 - DNA, 18 bp, Homo sapiens
ctgtagcctaaaacgaat

SEQ ID NO: 5408542 - DNA, 21 bp, Homo sapiens
ctgtagcctaaaacgaatggt

SEQ ID NO: 5408543 - DNA, 15 bp, Homo sapiens
ctgtagcctcctttg

SEQ ID NO: 5408544 - DNA, 20 bp, Homo sapiens
ctgtagcctgaagagtttgt

SEQ ID NO: 5408545 - DNA, 17 bp, Homo sapiens
ctgtagcctggtctgtg

SEQ ID NO: 5408546 - DNA, 14 bp, Homo sapiens
ctgtagctacattt

SEQ ID NO: 5408547 - DNA, 20 bp, Homo sapiens
ctgtagctacattttcagaa

SEQ ID NO: 5408548 - DNA, 12 bp, Homo sapiens
ctgtagctcagt

SEQ ID NO: 5408549 - DNA, 14 bp, Homo sapiens
ctgtagctcagtca

SEQ ID NO: 5408550 - DNA, 23 bp, Homo sapiens
ctgtagctcccctgctgaggcag

SEQ ID NO: 5408551 - DNA, 16 bp, Homo sapiens
ctgtagctccctcctc

SEQ ID NO: 5408552 - DNA, 16 bp, Homo sapiens
ctgtagctccttagct

SEQ ID NO: 5408553 - DNA, 19 bp, Homo sapiens
ctgtagctctgaatgctat

SEQ ID NO: 5408554 - DNA, 21 bp, Homo sapiens
ctgtagctgcagcctgcatcc

SEQ ID NO: 5408555 - DNA, 14 bp, Homo sapiens
ctgtagctgccatg

SEQ ID NO: 5408556 - DNA, 18 bp, Homo sapiens
ctgtagctgtattagcag

SEQ ID NO: 5408557 - DNA, 22 bp, Homo sapiens
ctgtagcttatctgcccctccc

SEQ ID NO: 5408558 - DNA, 12 bp, Homo sapiens
ctgtagctttaa

SEQ ID NO: 5408559 - DNA, 14 bp, Homo sapiens
ctgtagctttcctg

SEQ ID NO: 5408560 - DNA, 21 bp, Homo sapiens
ctgtaggaaacagaaaagaga

SEQ ID NO: 5408561 - DNA, 12 bp, Homo sapiens
ctgtaggaacaa

SEQ ID NO: 5408562 - DNA, 17 bp, Homo sapiens
ctgtaggaaggtactgt

SEQ ID NO: 5408563 - DNA, 20 bp, Homo sapiens
ctgtaggaaggtactgtatg

SEQ ID NO: 5408564 - DNA, 21 bp, Homo sapiens
ctgtaggaaggttaatgttca

SEQ ID NO: 5408565 - DNA, 19 bp, Homo sapiens
ctgtaggagagactggcca

SEQ ID NO: 5408566 - DNA, 22 bp, Homo sapiens
ctgtaggagagactggccagag

SEQ ID NO: 5408567 - DNA, 23 bp, Homo sapiens
ctgtaggagagactggccagagg

SEQ ID NO: 5408568 - DNA, 23 bp, Homo sapiens
ctgtaggagcaagggcacaaact

SEQ ID NO: 5408569 - DNA, 22 bp, Homo sapiens
ctgtaggagctacccttttcct

SEQ ID NO: 5408570 - DNA, 18 bp, Homo sapiens
ctgtaggatcttatttgg

SEQ ID NO: 5408571 - DNA, 15 bp, Homo sapiens
ctgtaggcagaggct

SEQ ID NO: 5408572 - DNA, 22 bp, Homo sapiens
ctgtaggcctcaggtgaaactc

SEQ ID NO: 5408573 - DNA, 19 bp, Homo sapiens
ctgtaggcgcccctggggt

SEQ ID NO: 5408574 - DNA, 19 bp, Homo sapiens
ctgtagggagtgaagccac

SEQ ID NO: 5408575 - DNA, 23 bp, Homo sapiens
ctgtagggatgaaataaacccca

SEQ ID NO: 5408576 - DNA, 14 bp, Homo sapiens
ctgtagggctggac

SEQ ID NO: 5408577 - DNA, 18 bp, Homo sapiens
ctgtagggctggacctat

SEQ ID NO: 5408578 - DNA, 16 bp, Homo sapiens
ctgtaggtatagaaga

SEQ ID NO: 5408579 - DNA, 18 bp, Homo sapiens
ctgtaggtcactctccag

SEQ ID NO: 5408580 - DNA, 13 bp, Homo sapiens
ctgtaggtcagga

SEQ ID NO: 5408581 - DNA, 15 bp, Homo sapiens
ctgtaggtggtatgt

SEQ ID NO: 5408582 - DNA, 23 bp, Homo sapiens
ctgtaggtggtgttgagaaagaa

SEQ ID NO: 5408583 - DNA, 16 bp, Homo sapiens
ctgtaggtgtctctgg

SEQ ID NO: 5408584 - DNA, 19 bp, Homo sapiens
ctgtaggtgttatgtattc

SEQ ID NO: 5408585 - DNA, 15 bp, Homo sapiens
ctgtaggttgcacac

SEQ ID NO: 5408586 - DNA, 17 bp, Homo sapiens
ctgtaggtttctctctt

SEQ ID NO: 5408587 - DNA, 20 bp, Homo sapiens
ctgtaggtttctctcttccc

SEQ ID NO: 5408588 - DNA, 19 bp, Homo sapiens
ctgtagtaaaatgttttca

SEQ ID NO: 5408589 - DNA, 18 bp, Homo sapiens
ctgtagtaaataatgctt

SEQ ID NO: 5408590 - DNA, 17 bp, Homo sapiens
ctgtagtaattgttaca

SEQ ID NO: 5408591 - DNA, 18 bp, Homo sapiens
ctgtagtagccctttctg

SEQ ID NO: 5408592 - DNA, 18 bp, Homo sapiens
ctgtagtaggcattttta

SEQ ID NO: 5408593 - DNA, 22 bp, Homo sapiens
ctgtagtaggcatttttaccat

SEQ ID NO: 5408594 - DNA, 13 bp, Homo sapiens
ctgtagtcacttt

SEQ ID NO: 5408595 - DNA, 14 bp, Homo sapiens
ctgtagtcagccga

SEQ ID NO: 5408596 - DNA, 17 bp, Homo sapiens
ctgtagtcccagccact

SEQ ID NO: 5408597 - DNA, 18 bp, Homo sapiens
ctgtagtcccagccactc

SEQ ID NO: 5408598 - DNA, 23 bp, Homo sapiens
ctgtagtcccagccactcgggag

SEQ ID NO: 5408599 - DNA, 14 bp, Homo sapiens
ctgtagtcccagct

SEQ ID NO: 5408600 - DNA, 22 bp, Homo sapiens
ctgtagtcccagctactcagga

SEQ ID NO: 5408601 - DNA, 18 bp, Homo sapiens
ctgtagtcccagctactt

SEQ ID NO: 5408602 - DNA, 23 bp, Homo sapiens
ctgtagtcctagccactcaggag

SEQ ID NO: 5408603 - DNA, 13 bp, Homo sapiens
ctgtagtctctga

SEQ ID NO: 5408604 - DNA, 13 bp, Homo sapiens
ctgtagtgagaaa

SEQ ID NO: 5408605 - DNA, 18 bp, Homo sapiens
ctgtagtgagaaactgat

SEQ ID NO: 5408606 - DNA, 19 bp, Homo sapiens
ctgtagtgagaaactgatt

SEQ ID NO: 5408607 - DNA, 16 bp, Homo sapiens
ctgtagtgctacaggg

SEQ ID NO: 5408608 - DNA, 21 bp, Homo sapiens
ctgtagtggcaaaaaagaaca

SEQ ID NO: 5408609 - DNA, 19 bp, Homo sapiens
ctgtagtggccccctcctc

SEQ ID NO: 5408610 - DNA, 19 bp, Homo sapiens
ctgtagtgtagtcaggtgc

SEQ ID NO: 5408611 - DNA, 21 bp, Homo sapiens
ctgtagtgtagtcaggtgctc

SEQ ID NO: 5408612 - DNA, 17 bp, Homo sapiens
ctgtagtgttttgtgga

SEQ ID NO: 5408613 - DNA, 22 bp, Homo sapiens
ctgtagttacattaatgcccag

SEQ ID NO: 5408614 - DNA, 23 bp, Homo sapiens
ctgtagttacattaatgcccagc

SEQ ID NO: 5408615 - DNA, 14 bp, Homo sapiens
ctgtagttaggcct

SEQ ID NO: 5408616 - DNA, 19 bp, Homo sapiens
ctgtagttaggcctggctc

SEQ ID NO: 5408617 - DNA, 18 bp, Homo sapiens
ctgtagttcaatttcatg

SEQ ID NO: 5408618 - DNA, 16 bp, Homo sapiens
ctgtagttctaagact

SEQ ID NO: 5408619 - DNA, 19 bp, Homo sapiens
ctgtagttctaagactcaa

SEQ ID NO: 5408620 - DNA, 23 bp, Homo sapiens
ctgtagttgacaattctgcatgt

SEQ ID NO: 5408621 - DNA, 17 bp, Homo sapiens
ctgtagttgcataagca

SEQ ID NO: 5408622 - DNA, 20 bp, Homo sapiens
ctgtagtttatgatgcaaat

SEQ ID NO: 5408623 - DNA, 12 bp, Homo sapiens
ctgtagttttat

SEQ ID NO: 5408624 - DNA, 17 bp, Homo sapiens
ctgtagttttattttat

SEQ ID NO: 5408625 - DNA, 18 bp, Homo sapiens
ctgtagttttattttatg

SEQ ID NO: 5408626 - DNA, 21 bp, Homo sapiens
ctgtagtttttgaaaattatg

SEQ ID NO: 5408627 - DNA, 14 bp, Homo sapiens
ctgtataaaaatgt

SEQ ID NO: 5408628 - DNA, 18 bp, Homo sapiens
ctgtataaaaatgtaaat

SEQ ID NO: 5408629 - DNA, 17 bp, Homo sapiens
ctgtataaaatcagcca

SEQ ID NO: 5408630 - DNA, 18 bp, Homo sapiens
ctgtataaacattaaatg

SEQ ID NO: 5408631 - DNA, 19 bp, Homo sapiens
ctgtataaacattaaatgt

SEQ ID NO: 5408632 - DNA, 21 bp, Homo sapiens
ctgtataaacattaaatgtct

SEQ ID NO: 5408633 - DNA, 21 bp, Homo sapiens
ctgtataaaggtgtgctgtgt

SEQ ID NO: 5408634 - DNA, 15 bp, Homo sapiens
ctgtataaataagag

SEQ ID NO: 5408635 - DNA, 16 bp, Homo sapiens
ctgtataaataggaga

SEQ ID NO: 5408636 - DNA, 20 bp, Homo sapiens
ctgtataaataggagaggat

SEQ ID NO: 5408637 - DNA, 13 bp, Homo sapiens
ctgtataaatgtc

SEQ ID NO: 5408638 - DNA, 19 bp, Homo sapiens
ctgtataaatgtctattat

SEQ ID NO: 5408639 - DNA, 15 bp, Homo sapiens
ctgtataaatgtctt

SEQ ID NO: 5408640 - DNA, 15 bp, Homo sapiens
ctgtataaatgtgaa

SEQ ID NO: 5408641 - DNA, 17 bp, Homo sapiens
ctgtataacattaagaa

SEQ ID NO: 5408642 - DNA, 16 bp, Homo sapiens
ctgtataaccctgtta

SEQ ID NO: 5408643 - DNA, 21 bp, Homo sapiens
ctgtataagctgtaatatcat

SEQ ID NO: 5408644 - DNA, 13 bp, Homo sapiens
ctgtataagtaag

SEQ ID NO: 5408645 - DNA, 14 bp, Homo sapiens
ctgtataagtaaga

SEQ ID NO: 5408646 - DNA, 22 bp, Homo sapiens
ctgtataagtagatctgctttc

SEQ ID NO: 5408647 - DNA, 21 bp, Homo sapiens
ctgtataagttgaaggaaaat

SEQ ID NO: 5408648 - DNA, 18 bp, Homo sapiens
ctgtataatagagataag

SEQ ID NO: 5408649 - DNA, 21 bp, Homo sapiens
ctgtataattctacaggatgg

SEQ ID NO: 5408650 - DNA, 16 bp, Homo sapiens
ctgtatacaaacaggt

SEQ ID NO: 5408651 - DNA, 16 bp, Homo sapiens
ctgtatactcctgtca

SEQ ID NO: 5408652 - DNA, 16 bp, Homo sapiens
ctgtatactcttgaat

SEQ ID NO: 5408653 - DNA, 17 bp, Homo sapiens
ctgtatactgaaggtct

SEQ ID NO: 5408654 - DNA, 19 bp, Homo sapiens
ctgtatactgaaggtctga

SEQ ID NO: 5408655 - DNA, 23 bp, Homo sapiens
ctgtatactgaaggtctgacagt

SEQ ID NO: 5408656 - DNA, 12 bp, Homo sapiens
ctgtatacttta

SEQ ID NO: 5408657 - DNA, 17 bp, Homo sapiens
ctgtatagacagtttgt

SEQ ID NO: 5408658 - DNA, 18 bp, Homo sapiens
ctgtatagacagtttgta

SEQ ID NO: 5408659 - DNA, 20 bp, Homo sapiens
ctgtatagacagtttgtaaa

SEQ ID NO: 5408660 - DNA, 21 bp, Homo sapiens
ctgtatagatgagtttttcat

SEQ ID NO: 5408661 - DNA, 19 bp, Homo sapiens
ctgtatagctcttttccta

SEQ ID NO: 5408662 - DNA, 13 bp, Homo sapiens
ctgtatataaaca

SEQ ID NO: 5408663 - DNA, 20 bp, Homo sapiens
ctgtatataaacgtgtcccg

SEQ ID NO: 5408664 - DNA, 15 bp, Homo sapiens
ctgtatataaaggtg

SEQ ID NO: 5408665 - DNA, 15 bp, Homo sapiens
ctgtatataaatgtg

SEQ ID NO: 5408666 - DNA, 14 bp, Homo sapiens
ctgtatatactttt

SEQ ID NO: 5408667 - DNA, 18 bp, Homo sapiens
ctgtatatagatgtctgt

SEQ ID NO: 5408668 - DNA, 21 bp, Homo sapiens
ctgtatatagatgtctgtgta

SEQ ID NO: 5408669 - DNA, 16 bp, Homo sapiens
ctgtatataggccttc

SEQ ID NO: 5408670 - DNA, 22 bp, Homo sapiens
ctgtatatatttatggccgggc

SEQ ID NO: 5408671 - DNA, 16 bp, Homo sapiens
ctgtatatcagctcta

SEQ ID NO: 5408672 - DNA, 18 bp, Homo sapiens
ctgtatatgattctctgt

SEQ ID NO: 5408673 - DNA, 13 bp, Homo sapiens
ctgtatatgtaaa

SEQ ID NO: 5408674 - DNA, 16 bp, Homo sapiens
ctgtatatgttgtaat

SEQ ID NO: 5408675 - DNA, 17 bp, Homo sapiens
ctgtatatgttgtaata

SEQ ID NO: 5408676 - DNA, 15 bp, Homo sapiens
ctgtatatgttgtga

SEQ ID NO: 5408677 - DNA, 13 bp, Homo sapiens
ctgtatattatgg

SEQ ID NO: 5408678 - DNA, 14 bp, Homo sapiens
ctgtatattcagga

SEQ ID NO: 5408679 - DNA, 15 bp, Homo sapiens
ctgtatattccctgt

SEQ ID NO: 5408680 - DNA, 13 bp, Homo sapiens
ctgtatattgcta

SEQ ID NO: 5408681 - DNA, 12 bp, Homo sapiens
ctgtatatttat

SEQ ID NO: 5408682 - DNA, 18 bp, Homo sapiens
ctgtatatttatgaccag

SEQ ID NO: 5408683 - DNA, 17 bp, Homo sapiens
ctgtatatttgaaactg

SEQ ID NO: 5408684 - DNA, 19 bp, Homo sapiens
ctgtatatttgtatgatat

SEQ ID NO: 5408685 - DNA, 14 bp, Homo sapiens
ctgtatatttgtca

SEQ ID NO: 5408686 - DNA, 15 bp, Homo sapiens
ctgtatattttgtta

SEQ ID NO: 5408687 - DNA, 17 bp, Homo sapiens
ctgtatcaagtcatggc

SEQ ID NO: 5408688 - DNA, 16 bp, Homo sapiens
ctgtatcaatttctaa

SEQ ID NO: 5408689 - DNA, 15 bp, Homo sapiens
ctgtatcagatgtga

SEQ ID NO: 5408690 - DNA, 16 bp, Homo sapiens
ctgtatcatctttgcc

SEQ ID NO: 5408691 - DNA, 17 bp, Homo sapiens
ctgtatcatttcatgct

SEQ ID NO: 5408692 - DNA, 16 bp, Homo sapiens
ctgtatcattttcttt

SEQ ID NO: 5408693 - DNA, 19 bp, Homo sapiens
ctgtatccaaataatgaat

SEQ ID NO: 5408694 - DNA, 15 bp, Homo sapiens
ctgtatccatgtaat

SEQ ID NO: 5408695 - DNA, 21 bp, Homo sapiens
ctgtatccatgtaatgatctt

SEQ ID NO: 5408696 - DNA, 23 bp, Homo sapiens
ctgtatcccatgagcctcagcat

SEQ ID NO: 5408697 - DNA, 13 bp, Homo sapiens
ctgtatccccagt

SEQ ID NO: 5408698 - DNA, 15 bp, Homo sapiens
ctgtatccccagtgc

SEQ ID NO: 5408699 - DNA, 18 bp, Homo sapiens
ctgtatccccagtgcccg

SEQ ID NO: 5408700 - DNA, 15 bp, Homo sapiens
ctgtatccgtgaatt

SEQ ID NO: 5408701 - DNA, 19 bp, Homo sapiens
ctgtatccgtgaattgctt

SEQ ID NO: 5408702 - DNA, 22 bp, Homo sapiens
ctgtatccgtgaattgctttat

SEQ ID NO: 5408703 - DNA, 23 bp, Homo sapiens
ctgtatccgtgaattgctttatg

SEQ ID NO: 5408704 - DNA, 21 bp, Homo sapiens
ctgtatctaaaaaataactgt

SEQ ID NO: 5408705 - DNA, 15 bp, Homo sapiens
ctgtatctatgcaaa

SEQ ID NO: 5408706 - DNA, 12 bp, Homo sapiens
ctgtccaggtga

SEQ ID NO: 5408707 - DNA, 16 bp, Homo sapiens
ctgtccagttcccaga

SEQ ID NO: 5408708 - DNA, 19 bp, Homo sapiens
ctgtccagttcccagaagg

SEQ ID NO: 5408709 - DNA, 15 bp, Homo sapiens
ctgtccatccccagt

SEQ ID NO: 5408710 - DNA, 21 bp, Homo sapiens
ctgtccatccgtctctgtccg

SEQ ID NO: 5408711 - DNA, 12 bp, Homo sapiens
ctgtccatcctc

SEQ ID NO: 5408712 - DNA, 15 bp, Homo sapiens
ctgtccatcctcctc

SEQ ID NO: 5408713 - DNA, 22 bp, Homo sapiens
ctgtccatcctcctctccatgc

SEQ ID NO: 5408714 - DNA, 13 bp, Homo sapiens
ctgtccatctgcc

SEQ ID NO: 5408715 - DNA, 17 bp, Homo sapiens
ctgtccatctgcccgcc

SEQ ID NO: 5408716 - DNA, 12 bp, Homo sapiens
ctgtccatctgt

SEQ ID NO: 5408717 - DNA, 19 bp, Homo sapiens
ctgtccatctgtctgtcct

SEQ ID NO: 5408718 - DNA, 20 bp, Homo sapiens
ctgtccatctgtctgtccta

SEQ ID NO: 5408719 - DNA, 14 bp, Homo sapiens
ctgtccatgcttct

SEQ ID NO: 5408720 - DNA, 14 bp, Homo sapiens
ctgtccatggcctt

SEQ ID NO: 5408721 - DNA, 18 bp, Homo sapiens
ctgtccatggcctttcta

SEQ ID NO: 5408722 - DNA, 12 bp, Homo sapiens
ctgtccattcca

SEQ ID NO: 5408723 - DNA, 19 bp, Homo sapiens
ctgtccattcggaaccagg

SEQ ID NO: 5408724 - DNA, 16 bp, Homo sapiens
ctgtccattgccacgg

SEQ ID NO: 5408725 - DNA, 23 bp, Homo sapiens
ctgtcccaaggtgaaatgaagca

SEQ ID NO: 5408726 - DNA, 13 bp, Homo sapiens
ctgtcccaagtct

SEQ ID NO: 5408727 - DNA, 20 bp, Homo sapiens
ctgtcccaattctgcccgct

SEQ ID NO: 5408728 - DNA, 19 bp, Homo sapiens
ctgtcccaccatgcagtgc

SEQ ID NO: 5408729 - DNA, 14 bp, Homo sapiens
ctgtcccacccaca

SEQ ID NO: 5408730 - DNA, 20 bp, Homo sapiens
ctgtcccacccacacagctg

SEQ ID NO: 5408731 - DNA, 21 bp, Homo sapiens
ctgtcccacccacacagctgc

SEQ ID NO: 5408732 - DNA, 23 bp, Homo sapiens
ctgtcccacccacacagctgccc

SEQ ID NO: 5408733 - DNA, 14 bp, Homo sapiens
ctgtcccaccccta

SEQ ID NO: 5408734 - DNA, 13 bp, Homo sapiens
ctgtcccacctca

SEQ ID NO: 5408735 - DNA, 23 bp, Homo sapiens
ctgtcccacctcttctcttcctg

SEQ ID NO: 5408736 - DNA, 14 bp, Homo sapiens
ctgtcccacctggc

SEQ ID NO: 5408737 - DNA, 18 bp, Homo sapiens
ctgtcccactacatctgg

SEQ ID NO: 5408738 - DNA, 16 bp, Homo sapiens
ctgtcccactggctcc

SEQ ID NO: 5408739 - DNA, 13 bp, Homo sapiens
ctgtcccactggg

SEQ ID NO: 5408740 - DNA, 15 bp, Homo sapiens
ctgtcccacttctca

SEQ ID NO: 5408741 - DNA, 11 bp, Homo sapiens
ctgtcccagag

SEQ ID NO: 5408742 - DNA, 13 bp, Homo sapiens
ctgtcccagagct

SEQ ID NO: 5408743 - DNA, 23 bp, Homo sapiens
ctgtcccagaggttatctgcctg

SEQ ID NO: 5408744 - DNA, 13 bp, Homo sapiens
ctgtcccagcccc

SEQ ID NO: 5408745 - DNA, 12 bp, Homo sapiens
ctgtcccagcta

SEQ ID NO: 5408746 - DNA, 22 bp, Homo sapiens
ctgtcccagctaccaagtcaga

SEQ ID NO: 5408747 - DNA, 12 bp, Homo sapiens
ctgtcccaggca

SEQ ID NO: 5408748 - DNA, 13 bp, Homo sapiens
ctgtcccaggcat

SEQ ID NO: 5408749 - DNA, 19 bp, Homo sapiens
ctgtcccaggcatgcagct

SEQ ID NO: 5408750 - DNA, 21 bp, Homo sapiens
ctgtcccaggcatgcagctgc

SEQ ID NO: 5408751 - DNA, 21 bp, Homo sapiens
ctgtcccaggccggcccagat

SEQ ID NO: 5408752 - DNA, 20 bp, Homo sapiens
ctgtcccagggccctcccag

SEQ ID NO: 5408753 - DNA, 21 bp, Homo sapiens
ctgtcccagggccctcccagc

SEQ ID NO: 5408754 - DNA, 22 bp, Homo sapiens
ctgtcccagggccctcccagcc

SEQ ID NO: 5408755 - DNA, 21 bp, Homo sapiens
ctgtcccaggggtctccctga

SEQ ID NO: 5408756 - DNA, 22 bp, Homo sapiens
ctgtcccaggggtctccctgag

SEQ ID NO: 5408757 - DNA, 13 bp, Homo sapiens
ctgtcccagttgt

SEQ ID NO: 5408758 - DNA, 17 bp, Homo sapiens
ctgtcccagttgtggca

SEQ ID NO: 5408759 - DNA, 18 bp, Homo sapiens
ctgtcccatagtccctgc

SEQ ID NO: 5408760 - DNA, 14 bp, Homo sapiens
ctgtcccatcccca

SEQ ID NO: 5408761 - DNA, 18 bp, Homo sapiens
ctgtcccatgcaggccct

SEQ ID NO: 5408762 - DNA, 18 bp, Homo sapiens
ctgtcccatggacactcc

SEQ ID NO: 5408763 - DNA, 16 bp, Homo sapiens
ctgtcccatgggctct

SEQ ID NO: 5408764 - DNA, 17 bp, Homo sapiens
ctgtcccatgggctctg

SEQ ID NO: 5408765 - DNA, 14 bp, Homo sapiens
ctgtcccattccct

SEQ ID NO: 5408766 - DNA, 16 bp, Homo sapiens
ctgtcccattccctgg

SEQ ID NO: 5408767 - DNA, 23 bp, Homo sapiens
ctgtcccattccctgggatctgg

SEQ ID NO: 5408768 - DNA, 16 bp, Homo sapiens
ctgtccccaaacagga

SEQ ID NO: 5408769 - DNA, 22 bp, Homo sapiens
ctgtccccaaacaggacagcac

SEQ ID NO: 5408770 - DNA, 23 bp, Homo sapiens
ctgtccccaacaggaatttttaa

SEQ ID NO: 5408771 - DNA, 12 bp, Homo sapiens
ctgtccccaaga

SEQ ID NO: 5408772 - DNA, 19 bp, Homo sapiens
ctgtccccaccctccactc

SEQ ID NO: 5408773 - DNA, 21 bp, Homo sapiens
ctgtccccacgaggggaccca

SEQ ID NO: 5408774 - DNA, 14 bp, Homo sapiens
ctgtccccagccct

SEQ ID NO: 5408775 - DNA, 17 bp, Homo sapiens
ctgtccccagccctgtc

SEQ ID NO: 5408776 - DNA, 14 bp, Homo sapiens
ctgtccccagcctg

SEQ ID NO: 5408777 - DNA, 15 bp, Homo sapiens
ctgtccccagcctgg

SEQ ID NO: 5408778 - DNA, 16 bp, Homo sapiens
ctgtccccagcctggg

SEQ ID NO: 5408779 - DNA, 12 bp, Homo sapiens
ctgtccccaggc

SEQ ID NO: 5408780 - DNA, 15 bp, Homo sapiens
ctgtccccaggccca

SEQ ID NO: 5408781 - DNA, 18 bp, Homo sapiens
ctgtccccaggcccagcc

SEQ ID NO: 5408782 - DNA, 23 bp, Homo sapiens
ctgtccccaggcccagccctcct

SEQ ID NO: 5408783 - DNA, 18 bp, Homo sapiens
ctgtccccaggcctggct

SEQ ID NO: 5408784 - DNA, 15 bp, Homo sapiens
ctgtcccccagctct

SEQ ID NO: 5408785 - DNA, 16 bp, Homo sapiens
ctgtcccccagctctg

SEQ ID NO: 5408786 - DNA, 13 bp, Homo sapiens
ctgtcccccaggc

SEQ ID NO: 5408787 - DNA, 15 bp, Homo sapiens
ctgtcccccaggctg

SEQ ID NO: 5408788 - DNA, 15 bp, Homo sapiens
ctgtccccctaccca

SEQ ID NO: 5408789 - DNA, 20 bp, Homo sapiens
ctgtccccctcccctcccag

SEQ ID NO: 5408790 - DNA, 23 bp, Homo sapiens
ctgtccccctgagatcagagtcc

SEQ ID NO: 5408791 - DNA, 22 bp, Homo sapiens
ctgtccccgcactgggcttggg

SEQ ID NO: 5408792 - DNA, 17 bp, Homo sapiens
ctgtccccgcagccctg

SEQ ID NO: 5408793 - DNA, 16 bp, Homo sapiens
ctgtccccgccttccc

SEQ ID NO: 5408794 - DNA, 17 bp, Homo sapiens
ctgtccccgccttccct

SEQ ID NO: 5408795 - DNA, 19 bp, Homo sapiens
ctgtccccgccttccctca

SEQ ID NO: 5408796 - DNA, 21 bp, Homo sapiens
ctgtccccgccttccctcact

SEQ ID NO: 5408797 - DNA, 18 bp, Homo sapiens
ctgtccccgtgttgcatg

SEQ ID NO: 5408798 - DNA, 15 bp, Homo sapiens
ctgtcccctatgcca

SEQ ID NO: 5408799 - DNA, 15 bp, Homo sapiens
ctgtcccctcacaga

SEQ ID NO: 5408800 - DNA, 18 bp, Homo sapiens
ctgtcccctcacagactc

SEQ ID NO: 5408801 - DNA, 18 bp, Homo sapiens
ctgtcccctccttccagc

SEQ ID NO: 5408802 - DNA, 15 bp, Homo sapiens
ctgtcccctctcccc

SEQ ID NO: 5408803 - DNA, 15 bp, Homo sapiens
ctgtcccctcttgcc

SEQ ID NO: 5408804 - DNA, 19 bp, Homo sapiens
ctgtcccctgcgaggagaa

SEQ ID NO: 5408805 - DNA, 15 bp, Homo sapiens
ctgtcccctgctaca

SEQ ID NO: 5408806 - DNA, 21 bp, Homo sapiens
ctgtcccctgctacacctatt

SEQ ID NO: 5408807 - DNA, 12 bp, Homo sapiens
ctgtcccctggg

SEQ ID NO: 5408808 - DNA, 16 bp, Homo sapiens
ctgtcccctggggctg

SEQ ID NO: 5408809 - DNA, 16 bp, Homo sapiens
ctgtcccgacacagcg

SEQ ID NO: 5408810 - DNA, 15 bp, Homo sapiens
ctgtcccgccttcct

SEQ ID NO: 5408811 - DNA, 22 bp, Homo sapiens
ctgtcccgttccccgctccaca

SEQ ID NO: 5408812 - DNA, 17 bp, Homo sapiens
ctgtccctaaacatagt

SEQ ID NO: 5408813 - DNA, 13 bp, Homo sapiens
ctgtccctaccac

SEQ ID NO: 5408814 - DNA, 20 bp, Homo sapiens
ctgtccctaccactgagccc

SEQ ID NO: 5408815 - DNA, 16 bp, Homo sapiens
ctgtccctacccactc

SEQ ID NO: 5408816 - DNA, 22 bp, Homo sapiens
ctgtccctacccactctttgct

SEQ ID NO: 5408817 - DNA, 23 bp, Homo sapiens
ctgtccctacccactctttgcta

SEQ ID NO: 5408818 - DNA, 16 bp, Homo sapiens
ctgtccctagctcaca

SEQ ID NO: 5408819 - DNA, 11 bp, Homo sapiens
ctgtccctagg

SEQ ID NO: 5408820 - DNA, 15 bp, Homo sapiens
ctgtccctagggctc

SEQ ID NO: 5408821 - DNA, 21 bp, Homo sapiens
ctgtccctagtaaaaatacaa

SEQ ID NO: 5408822 - DNA, 23 bp, Homo sapiens
ctgtccctatctattaaagtgac

SEQ ID NO: 5408823 - DNA, 18 bp, Homo sapiens
ctgtccctcaaaattgat

SEQ ID NO: 5408824 - DNA, 12 bp, Homo sapiens
ctgtccctcaca

SEQ ID NO: 5408825 - DNA, 12 bp, Homo sapiens
ctgtccctcact

SEQ ID NO: 5408826 - DNA, 15 bp, Homo sapiens
ctgtccctcatggag

SEQ ID NO: 5408827 - DNA, 14 bp, Homo sapiens
ctgtccctccaaag

SEQ ID NO: 5408828 - DNA, 16 bp, Homo sapiens
ctgtccctcccacctc

SEQ ID NO: 5408829 - DNA, 14 bp, Homo sapiens
ctgtccctcccact

SEQ ID NO: 5408830 - DNA, 15 bp, Homo sapiens
ctgtccctccccctt

SEQ ID NO: 5408831 - DNA, 13 bp, Homo sapiens
ctgtccctcctgg

SEQ ID NO: 5408832 - DNA, 15 bp, Homo sapiens
ctgtccctcctggtg

SEQ ID NO: 5408833 - DNA, 19 bp, Homo sapiens
ctgtccctctaataaagct

SEQ ID NO: 5408834 - DNA, 16 bp, Homo sapiens
ctgtccctctcaggca

SEQ ID NO: 5408835 - DNA, 17 bp, Homo sapiens
ctgtccctctcagtgcc

SEQ ID NO: 5408836 - DNA, 18 bp, Homo sapiens
ctgtccctctccttgccc

SEQ ID NO: 5408837 - DNA, 11 bp, Homo sapiens
ctgtccctctt

SEQ ID NO: 5408838 - DNA, 12 bp, Homo sapiens
ctgtccctgagg

SEQ ID NO: 5408839 - DNA, 15 bp, Homo sapiens
ctgtccctgcactgt

SEQ ID NO: 5408840 - DNA, 12 bp, Homo sapiens
ctgtccctgcag

SEQ ID NO: 5408841 - DNA, 12 bp, Homo sapiens
ctgtccctgcca

SEQ ID NO: 5408842 - DNA, 22 bp, Homo sapiens
ctgtccctgccccgccccccag

SEQ ID NO: 5408843 - DNA, 14 bp, Homo sapiens
ctgtccctggccat

SEQ ID NO: 5408844 - DNA, 16 bp, Homo sapiens
ctgtccctggccatct

SEQ ID NO: 5408845 - DNA, 17 bp, Homo sapiens
ctgtccctggccatctc

SEQ ID NO: 5408846 - DNA, 13 bp, Homo sapiens
ctgtccctgggag

SEQ ID NO: 5408847 - DNA, 23 bp, Homo sapiens
ctgtccctgggggagtaattctg

SEQ ID NO: 5408848 - DNA, 13 bp, Homo sapiens
ctgtccctgtagc

SEQ ID NO: 5408849 - DNA, 15 bp, Homo sapiens
ctgtccctgtagctc

SEQ ID NO: 5408850 - DNA, 17 bp, Homo sapiens
ctgtccctgtcaccaag

SEQ ID NO: 5408851 - DNA, 17 bp, Homo sapiens
ctgtccctgtccctgcc

SEQ ID NO: 5408852 - DNA, 18 bp, Homo sapiens
ctgtccctgtccttccct

SEQ ID NO: 5408853 - DNA, 12 bp, Homo sapiens
ctgtccctgtgg

SEQ ID NO: 5408854 - DNA, 14 bp, Homo sapiens
ctgtccctgtgggc

SEQ ID NO: 5408855 - DNA, 18 bp, Homo sapiens
ctgtccctgtgggctcac

SEQ ID NO: 5408856 - DNA, 23 bp, Homo sapiens
ctgtccctgtgggctcacaccgg

SEQ ID NO: 5408857 - DNA, 12 bp, Homo sapiens
ctgtcccttcca

SEQ ID NO: 5408858 - DNA, 13 bp, Homo sapiens
ctgtcccttccac

SEQ ID NO: 5408859 - DNA, 23 bp, Homo sapiens
ctgtcccttccccttcaccgctc

SEQ ID NO: 5408860 - DNA, 19 bp, Homo sapiens
ctgtcccttcgagtccagg

SEQ ID NO: 5408861 - DNA, 23 bp, Homo sapiens
ctgtcccttgcccccctggcctc

SEQ ID NO: 5408862 - DNA, 18 bp, Homo sapiens
ctgtcccttgctgtatgc

SEQ ID NO: 5408863 - DNA, 17 bp, Homo sapiens
ctgtcccttgcttgcct

SEQ ID NO: 5408864 - DNA, 18 bp, Homo sapiens
ctgtcccttgcttgcctg

SEQ ID NO: 5408865 - DNA, 18 bp, Homo sapiens
ctgtccctttgctcccgg

SEQ ID NO: 5408866 - DNA, 16 bp, Homo sapiens
ctgtcccttttccctt

SEQ ID NO: 5408867 - DNA, 15 bp, Homo sapiens
ctgtcccttttcttt

SEQ ID NO: 5408868 - DNA, 15 bp, Homo sapiens
ctgtccgagacagcc

SEQ ID NO: 5408869 - DNA, 16 bp, Homo sapiens
ctgtccgagacagccg

SEQ ID NO: 5408870 - DNA, 14 bp, Homo sapiens
ctgtccgcctctgc

SEQ ID NO: 5408871 - DNA, 16 bp, Homo sapiens
ctgtccgctgtctccc

SEQ ID NO: 5408872 - DNA, 20 bp, Homo sapiens
ctgtccgctgtctccctcct

SEQ ID NO: 5408873 - DNA, 22 bp, Homo sapiens
ctgtccgctgtctccctcctga

SEQ ID NO: 5408874 - DNA, 22 bp, Homo sapiens
ctgtccggagcgaccctggctc

SEQ ID NO: 5408875 - DNA, 17 bp, Homo sapiens
ctgtccggcccagtgcc

SEQ ID NO: 5408876 - DNA, 18 bp, Homo sapiens
ctgtccggcccagtgcca

SEQ ID NO: 5408877 - DNA, 23 bp, Homo sapiens
ctgtccggcccagtgccactgcc

SEQ ID NO: 5408878 - DNA, 19 bp, Homo sapiens
ctgtccggcccagtgccag

SEQ ID NO: 5408879 - DNA, 20 bp, Homo sapiens
ctgtccggcccagtgccagc

SEQ ID NO: 5408880 - DNA, 15 bp, Homo sapiens
ctgtccgtccagagc

SEQ ID NO: 5408881 - DNA, 18 bp, Homo sapiens
ctgtccgtccagagccgg

SEQ ID NO: 5408882 - DNA, 17 bp, Homo sapiens
ctgtccgtctgtcctgc

SEQ ID NO: 5408883 - DNA, 20 bp, Homo sapiens
ctgtccgtgtgcctcctgtg

SEQ ID NO: 5408884 - DNA, 17 bp, Homo sapiens
ctgtcctaaaccgtccc

SEQ ID NO: 5408885 - DNA, 17 bp, Homo sapiens
ctgtcctaagaacttca

SEQ ID NO: 5408886 - DNA, 12 bp, Homo sapiens
ctgtctgcagcc

SEQ ID NO: 5408887 - DNA, 15 bp, Homo sapiens
ctgtctgcagccttg

SEQ ID NO: 5408888 - DNA, 12 bp, Homo sapiens
ctgtctgcaggc

SEQ ID NO: 5408889 - DNA, 21 bp, Homo sapiens
ctgtctgccagccagcagcca

SEQ ID NO: 5408890 - DNA, 13 bp, Homo sapiens
ctgtctgccaggc

SEQ ID NO: 5408891 - DNA, 14 bp, Homo sapiens
ctgtctgccaggca

SEQ ID NO: 5408892 - DNA, 15 bp, Homo sapiens
ctgtctgccaggcac

SEQ ID NO: 5408893 - DNA, 16 bp, Homo sapiens
ctgtctgccaggcact

SEQ ID NO: 5408894 - DNA, 17 bp, Homo sapiens
ctgtctgccaggcactc

SEQ ID NO: 5408895 - DNA, 13 bp, Homo sapiens
ctgtctgccccag

SEQ ID NO: 5408896 - DNA, 19 bp, Homo sapiens
ctgtctgccccagcccaga

SEQ ID NO: 5408897 - DNA, 14 bp, Homo sapiens
ctgtctgccccgcc

SEQ ID NO: 5408898 - DNA, 16 bp, Homo sapiens
ctgtctgccctctggg

SEQ ID NO: 5408899 - DNA, 18 bp, Homo sapiens
ctgtctgcggagccagcg

SEQ ID NO: 5408900 - DNA, 23 bp, Homo sapiens
ctgtctgcggagccagcgcctgc

SEQ ID NO: 5408901 - DNA, 14 bp, Homo sapiens
ctgtctgctcaatg

SEQ ID NO: 5408902 - DNA, 15 bp, Homo sapiens
ctgtctgctcagaca

SEQ ID NO: 5408903 - DNA, 14 bp, Homo sapiens
ctgtctgctctgca

SEQ ID NO: 5408904 - DNA, 14 bp, Homo sapiens
ctgtctgctcttat

SEQ ID NO: 5408905 - DNA, 15 bp, Homo sapiens
ctgtctgctgccagc

SEQ ID NO: 5408906 - DNA, 12 bp, Homo sapiens
ctgtctgctggg

SEQ ID NO: 5408907 - DNA, 15 bp, Homo sapiens
ctgtctgcttctctc

SEQ ID NO: 5408908 - DNA, 19 bp, Homo sapiens
ctgtctgcttgcatctgca

SEQ ID NO: 5408909 - DNA, 22 bp, Homo sapiens
ctgtctgcttgcatctgcacat

SEQ ID NO: 5408910 - DNA, 23 bp, Homo sapiens
ctgtctgcttgcatctgcacata

SEQ ID NO: 5408911 - DNA, 20 bp, Homo sapiens
ctgtctggaagacgtggctc

SEQ ID NO: 5408912 - DNA, 17 bp, Homo sapiens
ctgtctggaagatgggg

SEQ ID NO: 5408913 - DNA, 18 bp, Homo sapiens
ctgtctggaagatgggga

SEQ ID NO: 5408914 - DNA, 23 bp, Homo sapiens
ctgtctggagctcacccaaggtc

SEQ ID NO: 5408915 - DNA, 22 bp, Homo sapiens
ctgtctggatccttcccaaggt

SEQ ID NO: 5408916 - DNA, 16 bp, Homo sapiens
ctgtctggattaatta

SEQ ID NO: 5408917 - DNA, 16 bp, Homo sapiens
ctgtctggcaatgcca

SEQ ID NO: 5408918 - DNA, 17 bp, Homo sapiens
ctgtctggcaatgccac

SEQ ID NO: 5408919 - DNA, 15 bp, Homo sapiens
ctgtctggccaggga

SEQ ID NO: 5408920 - DNA, 16 bp, Homo sapiens
ctgtctggcccaaagg

SEQ ID NO: 5408921 - DNA, 15 bp, Homo sapiens
ctgtctggcccccct

SEQ ID NO: 5408922 - DNA, 22 bp, Homo sapiens
ctgtctggctcggacccacccc

SEQ ID NO: 5408923 - DNA, 13 bp, Homo sapiens
ctgtctggggccc

SEQ ID NO: 5408924 - DNA, 14 bp, Homo sapiens
ctgtctggggcctt

SEQ ID NO: 5408925 - DNA, 19 bp, Homo sapiens
ctgtctgggtgctactggg

SEQ ID NO: 5408926 - DNA, 20 bp, Homo sapiens
ctgtctgtaagattttattt

SEQ ID NO: 5408927 - DNA, 16 bp, Homo sapiens
ctgtctgtagagggcc

SEQ ID NO: 5408928 - DNA, 22 bp, Homo sapiens
ctgtctgtagagggccctggtg

SEQ ID NO: 5408929 - DNA, 18 bp, Homo sapiens
ctgtctgtatataactta

SEQ ID NO: 5408930 - DNA, 21 bp, Homo sapiens
ctgtctgtatctttggttatc

SEQ ID NO: 5408931 - DNA, 16 bp, Homo sapiens
ctgtctgtcaccagct

SEQ ID NO: 5408932 - DNA, 13 bp, Homo sapiens
ctgtctgtcatct

SEQ ID NO: 5408933 - DNA, 19 bp, Homo sapiens
ctgtctgtcccagttaact

SEQ ID NO: 5408934 - DNA, 15 bp, Homo sapiens
ctgtctgtccctgaa

SEQ ID NO: 5408935 - DNA, 17 bp, Homo sapiens
ctgtctgtcccttttct

SEQ ID NO: 5408936 - DNA, 12 bp, Homo sapiens
ctgtctgtccta

SEQ ID NO: 5408937 - DNA, 13 bp, Homo sapiens
ctgtctgtcctgg

SEQ ID NO: 5408938 - DNA, 15 bp, Homo sapiens
ctgtctgtccttctg

SEQ ID NO: 5408939 - DNA, 12 bp, Homo sapiens
ctgtctgtctct

SEQ ID NO: 5408940 - DNA, 13 bp, Homo sapiens
ctgtctgtctctc

SEQ ID NO: 5408941 - DNA, 15 bp, Homo sapiens
ctgtctgtctgtccc

SEQ ID NO: 5408942 - DNA, 16 bp, Homo sapiens
ctgtctgtctgtccca

SEQ ID NO: 5408943 - DNA, 17 bp, Homo sapiens
ctgtctgtctgtcccaa

SEQ ID NO: 5408944 - DNA, 16 bp, Homo sapiens
ctgtctgtctgtgggc

SEQ ID NO: 5408945 - DNA, 14 bp, Homo sapiens
ctgtctgtgaacag

SEQ ID NO: 5408946 - DNA, 13 bp, Homo sapiens
ctgtctgtgacct

SEQ ID NO: 5408947 - DNA, 16 bp, Homo sapiens
ctgtctgtgcacatgc

SEQ ID NO: 5408948 - DNA, 17 bp, Homo sapiens
ctgtctgtgcacatgcc

SEQ ID NO: 5408949 - DNA, 14 bp, Homo sapiens
ctgtctgtgggccg

SEQ ID NO: 5408950 - DNA, 21 bp, Homo sapiens
ctgtctgtgggcttcagcact

SEQ ID NO: 5408951 - DNA, 20 bp, Homo sapiens
ctgtctgtgtgcatcatgtt

SEQ ID NO: 5408952 - DNA, 14 bp, Homo sapiens
ctgtctgtgttttt

SEQ ID NO: 5408953 - DNA, 16 bp, Homo sapiens
ctgtctgttacactgg

SEQ ID NO: 5408954 - DNA, 18 bp, Homo sapiens
ctgtctgttcccagcccc

SEQ ID NO: 5408955 - DNA, 19 bp, Homo sapiens
ctgtctgttcccagcccct

SEQ ID NO: 5408956 - DNA, 23 bp, Homo sapiens
ctgtctgttcccagcccctgcag

SEQ ID NO: 5408957 - DNA, 19 bp, Homo sapiens
ctgtctgttgtattcattg

SEQ ID NO: 5408958 - DNA, 15 bp, Homo sapiens
ctgtcttaaagaatt

SEQ ID NO: 5408959 - DNA, 20 bp, Homo sapiens
ctgtcttacgtttttctggt

SEQ ID NO: 5408960 - DNA, 19 bp, Homo sapiens
ctgtcttcaaccctgccct

SEQ ID NO: 5408961 - DNA, 21 bp, Homo sapiens
ctgtcttcaaccctgccctgc

SEQ ID NO: 5408962 - DNA, 23 bp, Homo sapiens
ctgtcttcaaccctgccctgcac

SEQ ID NO: 5408963 - DNA, 19 bp, Homo sapiens
ctgtcttcacatgtatgga

SEQ ID NO: 5408964 - DNA, 15 bp, Homo sapiens
ctgtcttcagagcaa

SEQ ID NO: 5408965 - DNA, 19 bp, Homo sapiens
ctgtcttcagatcctgctg

SEQ ID NO: 5408966 - DNA, 21 bp, Homo sapiens
ctgtcttcaggctctgcccag

SEQ ID NO: 5408967 - DNA, 18 bp, Homo sapiens
ctgtcttcagtctcacag

SEQ ID NO: 5408968 - DNA, 22 bp, Homo sapiens
ctgtcttcagtctcacagagaa

SEQ ID NO: 5408969 - DNA, 15 bp, Homo sapiens
ctgtcttccaaggag

SEQ ID NO: 5408970 - DNA, 15 bp, Homo sapiens
ctgtcttccaggccc

SEQ ID NO: 5408971 - DNA, 16 bp, Homo sapiens
ctgtcttcccagggta

SEQ ID NO: 5408972 - DNA, 14 bp, Homo sapiens
ctgtcttccccacc

SEQ ID NO: 5408973 - DNA, 13 bp, Homo sapiens
ctgtcttcccctg

SEQ ID NO: 5408974 - DNA, 15 bp, Homo sapiens
ctgtcttcccctgag

SEQ ID NO: 5408975 - DNA, 18 bp, Homo sapiens
ctgtcttcccctgagagt

SEQ ID NO: 5408976 - DNA, 13 bp, Homo sapiens
ctgtcttcctcaa

SEQ ID NO: 5408977 - DNA, 14 bp, Homo sapiens
ctgtcttcctcaaa

SEQ ID NO: 5408978 - DNA, 20 bp, Homo sapiens
ctgtcttcctcaaaataaag

SEQ ID NO: 5408979 - DNA, 14 bp, Homo sapiens
ctgtcttcctctgc

SEQ ID NO: 5408980 - DNA, 17 bp, Homo sapiens
ctgtcttcctctgcaag

SEQ ID NO: 5408981 - DNA, 18 bp, Homo sapiens
ctgtcttcctctgcaagt

SEQ ID NO: 5408982 - DNA, 23 bp, Homo sapiens
ctgtcttcctctgcaagtgctca

SEQ ID NO: 5408983 - DNA, 14 bp, Homo sapiens
ctgtcttcctgcat

SEQ ID NO: 5408984 - DNA, 18 bp, Homo sapiens
ctgtcttcctgcattcac

SEQ ID NO: 5408985 - DNA, 15 bp, Homo sapiens
ctgtcttcctggtca

SEQ ID NO: 5408986 - DNA, 21 bp, Homo sapiens
ctgtcttcctggtcataggct

SEQ ID NO: 5408987 - DNA, 19 bp, Homo sapiens
ctgtcttcgaggacagcaa

SEQ ID NO: 5408988 - DNA, 23 bp, Homo sapiens
ctgtcttcggccgagctggtttc

SEQ ID NO: 5408989 - DNA, 16 bp, Homo sapiens
ctgtcttctcccagag

SEQ ID NO: 5408990 - DNA, 16 bp, Homo sapiens
ctgtcttctccctcct

SEQ ID NO: 5408991 - DNA, 13 bp, Homo sapiens
ctgtcttctctca

SEQ ID NO: 5408992 - DNA, 17 bp, Homo sapiens
ctgtcttctctcaaagg

SEQ ID NO: 5408993 - DNA, 16 bp, Homo sapiens
ctgtcttctgctttgt

SEQ ID NO: 5408994 - DNA, 18 bp, Homo sapiens
ctgtcttctgctttgttg

SEQ ID NO: 5408995 - DNA, 12 bp, Homo sapiens
ctgtcttctgga

SEQ ID NO: 5408996 - DNA, 16 bp, Homo sapiens
ctgtcttctgggcaca

SEQ ID NO: 5408997 - DNA, 21 bp, Homo sapiens
ctgtcttctttctccatggag

SEQ ID NO: 5408998 - DNA, 22 bp, Homo sapiens
ctgtcttctttctccatggagc

SEQ ID NO: 5408999 - DNA, 18 bp, Homo sapiens
ctgtcttctttctcctgt

SEQ ID NO: 5409000 - DNA, 19 bp, Homo sapiens
ctgtcttctttctcctgtg

SEQ ID NO: 5409001 - DNA, 21 bp, Homo sapiens
ctgtcttgaataagagtgatt

SEQ ID NO: 5409002 - DNA, 19 bp, Homo sapiens
ctgtcttgatgactgctga

SEQ ID NO: 5409003 - DNA, 14 bp, Homo sapiens
ctgtcttgcagtgg

SEQ ID NO: 5409004 - DNA, 16 bp, Homo sapiens
ctgtcttgcagtggac

SEQ ID NO: 5409005 - DNA, 21 bp, Homo sapiens
ctgtcttgcagtggacggaga

SEQ ID NO: 5409006 - DNA, 17 bp, Homo sapiens
ctgtcttgccagccaga

SEQ ID NO: 5409007 - DNA, 21 bp, Homo sapiens
ctgtcttgcctttttcattat

SEQ ID NO: 5409008 - DNA, 16 bp, Homo sapiens
ctgtcttgctcctggg

SEQ ID NO: 5409009 - DNA, 22 bp, Homo sapiens
ctgtcttggaagtctgtctcag

SEQ ID NO: 5409010 - DNA, 13 bp, Homo sapiens
ctgtcttggcatt

SEQ ID NO: 5409011 - DNA, 16 bp, Homo sapiens
ctgtcttggcattaaa

SEQ ID NO: 5409012 - DNA, 12 bp, Homo sapiens
ctgtcttggcct

SEQ ID NO: 5409013 - DNA, 12 bp, Homo sapiens
ctgtcttggctg

SEQ ID NO: 5409014 - DNA, 17 bp, Homo sapiens
ctgtcttgtccccaccc

SEQ ID NO: 5409015 - DNA, 21 bp, Homo sapiens
ctgtcttgtccccacccatgc

SEQ ID NO: 5409016 - DNA, 17 bp, Homo sapiens
ctgtcttgtcctcctgt

SEQ ID NO: 5409017 - DNA, 19 bp, Homo sapiens
ctgtcttgttaatgctttt

SEQ ID NO: 5409018 - DNA, 16 bp, Homo sapiens
ctgtcttgttcatttt

SEQ ID NO: 5409019 - DNA, 15 bp, Homo sapiens
ctgtcttgtttcagt

SEQ ID NO: 5409020 - DNA, 18 bp, Homo sapiens
ctgtcttgtttcagtgag

SEQ ID NO: 5409021 - DNA, 16 bp, Homo sapiens
ctgtctttaaaagaga

SEQ ID NO: 5409022 - DNA, 16 bp, Homo sapiens
ctgtctttaaaagtca

SEQ ID NO: 5409023 - DNA, 20 bp, Homo sapiens
ctgtctttactcctcacact

SEQ ID NO: 5409024 - DNA, 21 bp, Homo sapiens
ctgtctttatgtaagaagaaa

SEQ ID NO: 5409025 - DNA, 13 bp, Homo sapiens
ctgtctttattct

SEQ ID NO: 5409026 - DNA, 14 bp, Homo sapiens
ctgtctttattctt

SEQ ID NO: 5409027 - DNA, 17 bp, Homo sapiens
ctgtctttattcttatt

SEQ ID NO: 5409028 - DNA, 18 bp, Homo sapiens
ctgtctttcaaaaggtaa

SEQ ID NO: 5409029 - DNA, 20 bp, Homo sapiens
ctgtctttcagatacatggt

SEQ ID NO: 5409030 - DNA, 17 bp, Homo sapiens
ctgtctttcagcattca

SEQ ID NO: 5409031 - DNA, 17 bp, Homo sapiens
ctgtctttcatctccca

SEQ ID NO: 5409032 - DNA, 15 bp, Homo sapiens
ctgtctttccactct

SEQ ID NO: 5409033 - DNA, 16 bp, Homo sapiens
ctgtctttccactctg

SEQ ID NO: 5409034 - DNA, 18 bp, Homo sapiens
ctgtctttccactctgga

SEQ ID NO: 5409035 - DNA, 19 bp, Homo sapiens
ctgtctttccactctggat

SEQ ID NO: 5409036 - DNA, 11 bp, Homo sapiens
ctgtctttcct

SEQ ID NO: 5409037 - DNA, 18 bp, Homo sapiens
ctgtctttcctgaaccat

SEQ ID NO: 5409038 - DNA, 16 bp, Homo sapiens
ctgtctttgcagggca

SEQ ID NO: 5409039 - DNA, 16 bp, Homo sapiens
ctgtctttgctgttta

SEQ ID NO: 5409040 - DNA, 22 bp, Homo sapiens
ctgtctttggaaaaatgtttgt

SEQ ID NO: 5409041 - DNA, 17 bp, Homo sapiens
ctgtctttgtggactgt

SEQ ID NO: 5409042 - DNA, 18 bp, Homo sapiens
ctgtctttgtggactgtg

SEQ ID NO: 5409043 - DNA, 17 bp, Homo sapiens
ctgtcttttctttgcca

SEQ ID NO: 5409044 - DNA, 23 bp, Homo sapiens
ctgtctttttcatttttttctct

SEQ ID NO: 5409045 - DNA, 23 bp, Homo sapiens
ctgtctttttccttcctgagaaa

SEQ ID NO: 5409046 - DNA, 21 bp, Homo sapiens
ctgtcttttttctaaagtaaa

SEQ ID NO: 5409047 - DNA, 18 bp, Homo sapiens
ctgtcttttttctctctt

SEQ ID NO: 5409048 - DNA, 19 bp, Homo sapiens
ctgtgaaaaaaaaaatgct

SEQ ID NO: 5409049 - DNA, 24 bp, Homo sapiens
ctgtgaaaaaaaatttgttttcaa

SEQ ID NO: 5409050 - DNA, 21 bp, Homo sapiens
ctgtgaaaaataacggtgctt

SEQ ID NO: 5409051 - DNA, 15 bp, Homo sapiens
ctgtgaaaatgagga

SEQ ID NO: 5409052 - DNA, 18 bp, Homo sapiens
ctgtgaaaatgaggagga

SEQ ID NO: 5409053 - DNA, 12 bp, Homo sapiens
ctgtgaaacagt

SEQ ID NO: 5409054 - DNA, 15 bp, Homo sapiens
ctgtgaaactgggat

SEQ ID NO: 5409055 - DNA, 15 bp, Homo sapiens
ctgtgaaagaaaata

SEQ ID NO: 5409056 - DNA, 18 bp, Homo sapiens
ctgtgaaagaaaataatg

SEQ ID NO: 5409057 - DNA, 15 bp, Homo sapiens
ctgtgaaaggaaaga

SEQ ID NO: 5409058 - DNA, 14 bp, Homo sapiens
ctgtgaaagtatgt

SEQ ID NO: 5409059 - DNA, 18 bp, Homo sapiens
ctgtgaaagtatgtgata

SEQ ID NO: 5409060 - DNA, 21 bp, Homo sapiens
ctgtgaaagtctcctgtatca

SEQ ID NO: 5409061 - DNA, 15 bp, Homo sapiens
ctgtgaaatatcatc

SEQ ID NO: 5409062 - DNA, 20 bp, Homo sapiens
ctgtgaaattctcagagtgt

SEQ ID NO: 5409063 - DNA, 21 bp, Homo sapiens
ctgtgaaatttcatgattggc

SEQ ID NO: 5409064 - DNA, 23 bp, Homo sapiens
ctgtgaaatttcatgattggctt

SEQ ID NO: 5409065 - DNA, 14 bp, Homo sapiens
ctgtgccagctgct

SEQ ID NO: 5409066 - DNA, 17 bp, Homo sapiens
ctgtgccaggactgtga

SEQ ID NO: 5409067 - DNA, 22 bp, Homo sapiens
ctgtgccaggactgtgactcat

SEQ ID NO: 5409068 - DNA, 14 bp, Homo sapiens
ctgtgccaggaggc

SEQ ID NO: 5409069 - DNA, 11 bp, Homo sapiens
ctgtgccaggc

SEQ ID NO: 5409070 - DNA, 21 bp, Homo sapiens
ctgtgccaggcgaggcccttg

SEQ ID NO: 5409071 - DNA, 12 bp, Homo sapiens
ctgtgccaggct

SEQ ID NO: 5409072 - DNA, 14 bp, Homo sapiens
ctgtgccaggctga

SEQ ID NO: 5409073 - DNA, 20 bp, Homo sapiens
ctgtgccaggctgggaggct

SEQ ID NO: 5409074 - DNA, 14 bp, Homo sapiens
ctgtgccagggcag

SEQ ID NO: 5409075 - DNA, 15 bp, Homo sapiens
ctgtgccagggcagc

SEQ ID NO: 5409076 - DNA, 14 bp, Homo sapiens
ctgtgccaggtgag

SEQ ID NO: 5409077 - DNA, 20 bp, Homo sapiens
ctgtgccaggtgaggtcagc

SEQ ID NO: 5409078 - DNA, 15 bp, Homo sapiens
ctgtgccatgtgttt

SEQ ID NO: 5409079 - DNA, 17 bp, Homo sapiens
ctgtgccatgttattca

SEQ ID NO: 5409080 - DNA, 23 bp, Homo sapiens
ctgtgccatgttattcagctcac

SEQ ID NO: 5409081 - DNA, 14 bp, Homo sapiens
ctgtgccatttctc

SEQ ID NO: 5409082 - DNA, 21 bp, Homo sapiens
ctgtgccatttctcagggaag

SEQ ID NO: 5409083 - DNA, 23 bp, Homo sapiens
ctgtgccattttaaaaatagaat

SEQ ID NO: 5409084 - DNA, 22 bp, Homo sapiens
ctgtgcccacatcccaggcttc

SEQ ID NO: 5409085 - DNA, 19 bp, Homo sapiens
ctgtgcccacggtctgagc

SEQ ID NO: 5409086 - DNA, 17 bp, Homo sapiens
ctgtgcccacgtgtgca

SEQ ID NO: 5409087 - DNA, 12 bp, Homo sapiens
ctgtgcccagca

SEQ ID NO: 5409088 - DNA, 17 bp, Homo sapiens
ctgtgcccaggccagct

SEQ ID NO: 5409089 - DNA, 22 bp, Homo sapiens
ctgtgcccagggtggctgccag

SEQ ID NO: 5409090 - DNA, 22 bp, Homo sapiens
ctgtgcccatcatctctgcctt

SEQ ID NO: 5409091 - DNA, 12 bp, Homo sapiens
ctgtgcccatgg

SEQ ID NO: 5409092 - DNA, 21 bp, Homo sapiens
ctgtgcccatgggcactgctg

SEQ ID NO: 5409093 - DNA, 14 bp, Homo sapiens
ctgtgccccacctg

SEQ ID NO: 5409094 - DNA, 15 bp, Homo sapiens
ctgtgccccagctgc

SEQ ID NO: 5409095 - DNA, 18 bp, Homo sapiens
ctgtgccccagctgccag

SEQ ID NO: 5409096 - DNA, 20 bp, Homo sapiens
ctgtgcccccagcctcagcc

SEQ ID NO: 5409097 - DNA, 13 bp, Homo sapiens
ctgtgcccccagg

SEQ ID NO: 5409098 - DNA, 13 bp, Homo sapiens
ctgtgcccccctc

SEQ ID NO: 5409099 - DNA, 16 bp, Homo sapiens
ctgtgcccccctcctc

SEQ ID NO: 5409100 - DNA, 18 bp, Homo sapiens
ctgtgccccgcctcccgg

SEQ ID NO: 5409101 - DNA, 20 bp, Homo sapiens
ctgtgccccgcgggctttgt

SEQ ID NO: 5409102 - DNA, 22 bp, Homo sapiens
ctgtgccccgcgggctttgttg

SEQ ID NO: 5409103 - DNA, 15 bp, Homo sapiens
ctgtgcccctcagag

SEQ ID NO: 5409104 - DNA, 19 bp, Homo sapiens
ctgtgcccctcagagaggc

SEQ ID NO: 5409105 - DNA, 20 bp, Homo sapiens
ctgtgcccctcagagaggca

SEQ ID NO: 5409106 - DNA, 22 bp, Homo sapiens
ctgtgcccctgatgcagcctgt

SEQ ID NO: 5409107 - DNA, 22 bp, Homo sapiens
ctgtgcccctggccttgggatc

SEQ ID NO: 5409108 - DNA, 17 bp, Homo sapiens
ctgtgccccttccgcca

SEQ ID NO: 5409109 - DNA, 21 bp, Homo sapiens
ctgtgccccttccgccactgg

SEQ ID NO: 5409110 - DNA, 22 bp, Homo sapiens
ctgtgccccttccgccactggg

SEQ ID NO: 5409111 - DNA, 19 bp, Homo sapiens
ctgtgccccttttcatggt

SEQ ID NO: 5409112 - DNA, 18 bp, Homo sapiens
ctgtgcccgcatgtgtgc

SEQ ID NO: 5409113 - DNA, 19 bp, Homo sapiens
ctgtgcccgctgcgctgcc

SEQ ID NO: 5409114 - DNA, 18 bp, Homo sapiens
ctgtgcccggcctgtgta

SEQ ID NO: 5409115 - DNA, 17 bp, Homo sapiens
ctgtgcccggtgccatc

SEQ ID NO: 5409116 - DNA, 19 bp, Homo sapiens
ctgtgcccggtgccatctt

SEQ ID NO: 5409117 - DNA, 19 bp, Homo sapiens
ctgtgccctaaagtgtatt

SEQ ID NO: 5409118 - DNA, 22 bp, Homo sapiens
ctgtgccctcaccccaatccct

SEQ ID NO: 5409119 - DNA, 16 bp, Homo sapiens
ctgtgccctccaaaga

SEQ ID NO: 5409120 - DNA, 16 bp, Homo sapiens
ctgtgccctcctgacc

SEQ ID NO: 5409121 - DNA, 16 bp, Homo sapiens
ctgtgccctccttccc

SEQ ID NO: 5409122 - DNA, 17 bp, Homo sapiens
ctgtgccctccttccca

SEQ ID NO: 5409123 - DNA, 18 bp, Homo sapiens
ctgtgccctccttcccaa

SEQ ID NO: 5409124 - DNA, 19 bp, Homo sapiens
ctgtgccctccttcccaat

SEQ ID NO: 5409125 - DNA, 12 bp, Homo sapiens
ctgtgccctctc

SEQ ID NO: 5409126 - DNA, 14 bp, Homo sapiens
ctgtgccctgcctt

SEQ ID NO: 5409127 - DNA, 20 bp, Homo sapiens
ctgtgccctggctccatgct

SEQ ID NO: 5409128 - DNA, 13 bp, Homo sapiens
ctgtgccctggtg

SEQ ID NO: 5409129 - DNA, 15 bp, Homo sapiens
ctgtgcccttgctgg

SEQ ID NO: 5409130 - DNA, 20 bp, Homo sapiens
ctgtgcccttgctgggtcca

SEQ ID NO: 5409131 - DNA, 22 bp, Homo sapiens
ctgtgccgaccacgccccagga

SEQ ID NO: 5409132 - DNA, 22 bp, Homo sapiens
ctgtgccgcactagcctccctc

SEQ ID NO: 5409133 - DNA, 20 bp, Homo sapiens
ctgtgccgcactctggcggt

SEQ ID NO: 5409134 - DNA, 17 bp, Homo sapiens
ctgtgccgggaggcagc

SEQ ID NO: 5409135 - DNA, 18 bp, Homo sapiens
ctgtgcctcagagaccag

SEQ ID NO: 5409136 - DNA, 15 bp, Homo sapiens
ctgtgcctcaggcca

SEQ ID NO: 5409137 - DNA, 19 bp, Homo sapiens
ctgtgcctcaggccagggc

SEQ ID NO: 5409138 - DNA, 15 bp, Homo sapiens
ctgtgcctccataat

SEQ ID NO: 5409139 - DNA, 14 bp, Homo sapiens
ctgtgcctcccaaa

SEQ ID NO: 5409140 - DNA, 17 bp, Homo sapiens
ctgtgcctccccccaga

SEQ ID NO: 5409141 - DNA, 18 bp, Homo sapiens
ctgtgcctccctccccag

SEQ ID NO: 5409142 - DNA, 19 bp, Homo sapiens
ctgtgcctccctccccagt

SEQ ID NO: 5409143 - DNA, 21 bp, Homo sapiens
ctgtgcctccctccccagtgc

SEQ ID NO: 5409144 - DNA, 16 bp, Homo sapiens
ctgtgcctccctctcc

SEQ ID NO: 5409145 - DNA, 15 bp, Homo sapiens
ctgtgcctcctccct

SEQ ID NO: 5409146 - DNA, 17 bp, Homo sapiens
ctgtgcctcgctcccca

SEQ ID NO: 5409147 - DNA, 24 bp, Homo sapiens
ctgtgcctcgctccccactctgct

SEQ ID NO: 5409148 - DNA, 23 bp, Homo sapiens
ctgtgcctcggcttttctcagct

SEQ ID NO: 5409149 - DNA, 13 bp, Homo sapiens
ctgtgcctctgcc

SEQ ID NO: 5409150 - DNA, 16 bp, Homo sapiens
ctgtgcctctgcctgt

SEQ ID NO: 5409151 - DNA, 17 bp, Homo sapiens
ctgtgcctctgcctgtc

SEQ ID NO: 5409152 - DNA, 18 bp, Homo sapiens
ctgtgcctcttatcaagt

SEQ ID NO: 5409153 - DNA, 17 bp, Homo sapiens
ctgtgcctgaccttgag

SEQ ID NO: 5409154 - DNA, 23 bp, Homo sapiens
ctgtgcctgactctgtgctgagc

SEQ ID NO: 5409155 - DNA, 17 bp, Homo sapiens
ctgtgcctgagaattta

SEQ ID NO: 5409156 - DNA, 20 bp, Homo sapiens
ctgtgcctgaggctggctgg

SEQ ID NO: 5409157 - DNA, 23 bp, Homo sapiens
ctgtgcctgaggctggctggggg

SEQ ID NO: 5409158 - DNA, 17 bp, Homo sapiens
ctgtgcctgattatttt

SEQ ID NO: 5409159 - DNA, 21 bp, Homo sapiens
ctgtgcctgattattttagct

SEQ ID NO: 5409160 - DNA, 15 bp, Homo sapiens
ctgtgcctgccatgg

SEQ ID NO: 5409161 - DNA, 16 bp, Homo sapiens
ctgtgcctgctagagc

SEQ ID NO: 5409162 - DNA, 18 bp, Homo sapiens
ctgtgcctgctagagcaa

SEQ ID NO: 5409163 - DNA, 17 bp, Homo sapiens
ctgtgcctgctcagcag

SEQ ID NO: 5409164 - DNA, 18 bp, Homo sapiens
ctgtgcctgctcagcagc

SEQ ID NO: 5409165 - DNA, 16 bp, Homo sapiens
ctgtgcctgctgggca

SEQ ID NO: 5409166 - DNA, 19 bp, Homo sapiens
ctgtgcctgctgggcactg

SEQ ID NO: 5409167 - DNA, 14 bp, Homo sapiens
ctgtgcctgcttct

SEQ ID NO: 5409168 - DNA, 16 bp, Homo sapiens
ctgtgcctgcttctgt

SEQ ID NO: 5409169 - DNA, 21 bp, Homo sapiens
ctgtgcctgggatcagtgggg

SEQ ID NO: 5409170 - DNA, 13 bp, Homo sapiens
ctgtgcctgggcc

SEQ ID NO: 5409171 - DNA, 14 bp, Homo sapiens
ctgtgcctgggccc

SEQ ID NO: 5409172 - DNA, 17 bp, Homo sapiens
ctgtgcctgggccctgg

SEQ ID NO: 5409173 - DNA, 18 bp, Homo sapiens
ctgtgcctgggccctggg

SEQ ID NO: 5409174 - DNA, 21 bp, Homo sapiens
ctgtgcctgggccctgggctg

SEQ ID NO: 5409175 - DNA, 15 bp, Homo sapiens
ctgtgcctggtttga

SEQ ID NO: 5409176 - DNA, 14 bp, Homo sapiens
ctgtgcctgtctgt

SEQ ID NO: 5409177 - DNA, 17 bp, Homo sapiens
ctgtgcctgtctgtcca

SEQ ID NO: 5409178 - DNA, 15 bp, Homo sapiens
ctgtgcctgtgtttc

SEQ ID NO: 5409179 - DNA, 23 bp, Homo sapiens
ctgtgcctgtgtttcatgttctg

SEQ ID NO: 5409180 - DNA, 10 bp, Homo sapiens
ctgtgcctta

SEQ ID NO: 5409181 - DNA, 11 bp, Homo sapiens
ctgtgccttac

SEQ ID NO: 5409182 - DNA, 14 bp, Homo sapiens
ctgtgccttccctt

SEQ ID NO: 5409183 - DNA, 19 bp, Homo sapiens
ctgtgccttcttttgatta

SEQ ID NO: 5409184 - DNA, 20 bp, Homo sapiens
ctgtgccttggtctctcctt

SEQ ID NO: 5409185 - DNA, 22 bp, Homo sapiens
ctgtgcctttattttgtgtcat

SEQ ID NO: 5409186 - DNA, 13 bp, Homo sapiens
ctgtgcctttcct

SEQ ID NO: 5409187 - DNA, 14 bp, Homo sapiens
ctgtgcctttccta

SEQ ID NO: 5409188 - DNA, 17 bp, Homo sapiens
ctgtgcctttcctatca

SEQ ID NO: 5409189 - DNA, 21 bp, Homo sapiens
ctgtgcgagaacacaagccac

SEQ ID NO: 5409190 - DNA, 17 bp, Homo sapiens
ctgtgcgcccagggctg

SEQ ID NO: 5409191 - DNA, 16 bp, Homo sapiens
ctgtgcgccttgtaga

SEQ ID NO: 5409192 - DNA, 20 bp, Homo sapiens
ctgtgcgccttgtagaatgc

SEQ ID NO: 5409193 - DNA, 14 bp, Homo sapiens
ctgtgcgtcccagc

SEQ ID NO: 5409194 - DNA, 17 bp, Homo sapiens
ctgtgcgtcccagctga

SEQ ID NO: 5409195 - DNA, 23 bp, Homo sapiens
ctgtgcgtcccagctgaaggcag

SEQ ID NO: 5409196 - DNA, 16 bp, Homo sapiens
ctgtgcgtctgtgtgt

SEQ ID NO: 5409197 - DNA, 21 bp, Homo sapiens
ctgtgcgtcttggtgtaattt

SEQ ID NO: 5409198 - DNA, 22 bp, Homo sapiens
ctgtgcgtggggctcccgcctc

SEQ ID NO: 5409199 - DNA, 19 bp, Homo sapiens
ctgtgcgtgtggcgtggcc

SEQ ID NO: 5409200 - DNA, 17 bp, Homo sapiens
ctgtgcgttactaattg

SEQ ID NO: 5409201 - DNA, 16 bp, Homo sapiens
ctgtgcgttttagagt

SEQ ID NO: 5409202 - DNA, 15 bp, Homo sapiens
ctgtgctaagttgtc

SEQ ID NO: 5409203 - DNA, 15 bp, Homo sapiens
ctgtgctacagagaa

SEQ ID NO: 5409204 - DNA, 13 bp, Homo sapiens
ctgtgctacctct

SEQ ID NO: 5409205 - DNA, 19 bp, Homo sapiens
ctgtgctacctctaacacc

SEQ ID NO: 5409206 - DNA, 21 bp, Homo sapiens
ctgtgctacctctaacaccac

SEQ ID NO: 5409207 - DNA, 18 bp, Homo sapiens
ctgtgctacctgagccaa

SEQ ID NO: 5409208 - DNA, 13 bp, Homo sapiens
ctgtgctacgtgt

SEQ ID NO: 5409209 - DNA, 17 bp, Homo sapiens
ctgtgctacgtgtgaaa

SEQ ID NO: 5409210 - DNA, 19 bp, Homo sapiens
ctgtgctacgtgtgaaatc

SEQ ID NO: 5409211 - DNA, 22 bp, Homo sapiens
ctgtgctactgtctttggaaaa

SEQ ID NO: 5409212 - DNA, 14 bp, Homo sapiens
ctgtgctactttgc

SEQ ID NO: 5409213 - DNA, 18 bp, Homo sapiens
ctgtgctactttgccttt

SEQ ID NO: 5409214 - DNA, 17 bp, Homo sapiens
ctgtgctagaagctcca

SEQ ID NO: 5409215 - DNA, 18 bp, Homo sapiens
ctgtgctaggtctgacca

SEQ ID NO: 5409216 - DNA, 13 bp, Homo sapiens
ctgtgctatttgt

SEQ ID NO: 5409217 - DNA, 18 bp, Homo sapiens
ctgtgctatttgtacaaa

SEQ ID NO: 5409218 - DNA, 22 bp, Homo sapiens
ctgtgctatttgtacaaataaa

SEQ ID NO: 5409219 - DNA, 23 bp, Homo sapiens
ctgtgctcaaaaatgagagtgac

SEQ ID NO: 5409220 - DNA, 16 bp, Homo sapiens
ctgtgctcacccattg

SEQ ID NO: 5409221 - DNA, 22 bp, Homo sapiens
ctgtgctcacccattgtctcat

SEQ ID NO: 5409222 - DNA, 20 bp, Homo sapiens
ctgtgctcaccctctcttgg

SEQ ID NO: 5409223 - DNA, 21 bp, Homo sapiens
ctgtgctcaccctctcttggt

SEQ ID NO: 5409224 - DNA, 16 bp, Homo sapiens
ctgtgctcagccctga

SEQ ID NO: 5409225 - DNA, 16 bp, Homo sapiens
ctgtgctcaggactca

SEQ ID NO: 5409226 - DNA, 20 bp, Homo sapiens
ctgtgctccaagttgagact

SEQ ID NO: 5409227 - DNA, 14 bp, Homo sapiens
ctgtgctccacact

SEQ ID NO: 5409228 - DNA, 20 bp, Homo sapiens
ctgtgctccagcagtgctgg

SEQ ID NO: 5409229 - DNA, 23 bp, Homo sapiens
ctgtgctccatatttgatttcta

SEQ ID NO: 5409230 - DNA, 11 bp, Homo sapiens
ctgtgctccca

SEQ ID NO: 5409231 - DNA, 22 bp, Homo sapiens
ctgtgctcccacggggaccact

SEQ ID NO: 5409232 - DNA, 17 bp, Homo sapiens
ctgtgctcccctgccac

SEQ ID NO: 5409233 - DNA, 14 bp, Homo sapiens
ctgtgctccctggt

SEQ ID NO: 5409234 - DNA, 10 bp, Homo sapiens
ctgtgctccg

SEQ ID NO: 5409235 - DNA, 23 bp, Homo sapiens
ctgtgctccgccatggtgtcccg

SEQ ID NO: 5409236 - DNA, 18 bp, Homo sapiens
ctgtgctccgtgcctcca

SEQ ID NO: 5409237 - DNA, 13 bp, Homo sapiens
ctgtgctcctgcc

SEQ ID NO: 5409238 - DNA, 19 bp, Homo sapiens
ctgtgctcctgcccaggag

SEQ ID NO: 5409239 - DNA, 22 bp, Homo sapiens
ctgtgctcctgcccaggagcag

SEQ ID NO: 5409240 - DNA, 12 bp, Homo sapiens
ctgtgctcctgt

SEQ ID NO: 5409241 - DNA, 15 bp, Homo sapiens
ctgtgctctggacag

SEQ ID NO: 5409242 - DNA, 23 bp, Homo sapiens
ctgtggtcgtcaactttcctcaa

SEQ ID NO: 5409243 - DNA, 18 bp, Homo sapiens
ctgtggtctacccgtgtc

SEQ ID NO: 5409244 - DNA, 21 bp, Homo sapiens
ctgtggtctataaaataaact

SEQ ID NO: 5409245 - DNA, 20 bp, Homo sapiens
ctgtggtctggtgttccagc

SEQ ID NO: 5409246 - DNA, 13 bp, Homo sapiens
ctgtggtctgtgt

SEQ ID NO: 5409247 - DNA, 14 bp, Homo sapiens
ctgtggtctgtgtg

SEQ ID NO: 5409248 - DNA, 22 bp, Homo sapiens
ctgtggtctgtgtgtgacacca

SEQ ID NO: 5409249 - DNA, 22 bp, Homo sapiens
ctgtggtcttcaaattgtcttt

SEQ ID NO: 5409250 - DNA, 17 bp, Homo sapiens
ctgtggtgaagtgtggc

SEQ ID NO: 5409251 - DNA, 24 bp, Homo sapiens
ctgtggtgaagtgtggctggtgtc

SEQ ID NO: 5409252 - DNA, 16 bp, Homo sapiens
ctgtggtgacaggccc

SEQ ID NO: 5409253 - DNA, 17 bp, Homo sapiens
ctgtggtgactgaacga

SEQ ID NO: 5409254 - DNA, 18 bp, Homo sapiens
ctgtggtgacttctgctg

SEQ ID NO: 5409255 - DNA, 13 bp, Homo sapiens
ctgtggtgacttt

SEQ ID NO: 5409256 - DNA, 15 bp, Homo sapiens
ctgtggtgactttgg

SEQ ID NO: 5409257 - DNA, 17 bp, Homo sapiens
ctgtggtgactttggat

SEQ ID NO: 5409258 - DNA, 20 bp, Homo sapiens
ctgtggtgactttggataat

SEQ ID NO: 5409259 - DNA, 23 bp, Homo sapiens
ctgtggtgactttggataataag

SEQ ID NO: 5409260 - DNA, 19 bp, Homo sapiens
ctgtggtgaggttgggcag

SEQ ID NO: 5409261 - DNA, 21 bp, Homo sapiens
ctgtggtgatacctataaaga

SEQ ID NO: 5409262 - DNA, 14 bp, Homo sapiens
ctgtggtgatctgt

SEQ ID NO: 5409263 - DNA, 23 bp, Homo sapiens
ctgtggtgcaaaagcagaaaata

SEQ ID NO: 5409264 - DNA, 23 bp, Homo sapiens
ctgtggtgctgggagatgctctc

SEQ ID NO: 5409265 - DNA, 21 bp, Homo sapiens
ctgtggtggctccccctctgc

SEQ ID NO: 5409266 - DNA, 18 bp, Homo sapiens
ctgtggtggggagaggca

SEQ ID NO: 5409267 - DNA, 19 bp, Homo sapiens
ctgtggtggttcattccac

SEQ ID NO: 5409268 - DNA, 14 bp, Homo sapiens
ctgtggtgtgtccc

SEQ ID NO: 5409269 - DNA, 22 bp, Homo sapiens
ctgtggttaatccaatcaattt

SEQ ID NO: 5409270 - DNA, 14 bp, Homo sapiens
ctgtggttacagtg

SEQ ID NO: 5409271 - DNA, 15 bp, Homo sapiens
ctgtggttcactgca

SEQ ID NO: 5409272 - DNA, 16 bp, Homo sapiens
ctgtggttcactgcac

SEQ ID NO: 5409273 - DNA, 19 bp, Homo sapiens
ctgtggttcctaagcctgt

SEQ ID NO: 5409274 - DNA, 18 bp, Homo sapiens
ctgtggttctataataag

SEQ ID NO: 5409275 - DNA, 19 bp, Homo sapiens
ctgtggttctataataagt

SEQ ID NO: 5409276 - DNA, 18 bp, Homo sapiens
ctgtggttctgagatggc

SEQ ID NO: 5409277 - DNA, 22 bp, Homo sapiens
ctgtggttctgagatggctccc

SEQ ID NO: 5409278 - DNA, 20 bp, Homo sapiens
ctgtggttgcagtctttccc

SEQ ID NO: 5409279 - DNA, 22 bp, Homo sapiens
ctgtggtttaagctttgtgaaa

SEQ ID NO: 5409280 - DNA, 16 bp, Homo sapiens
ctgtggtttcagatgt

SEQ ID NO: 5409281 - DNA, 23 bp, Homo sapiens
ctgtggtttcagatgtgcaataa

SEQ ID NO: 5409282 - DNA, 16 bp, Homo sapiens
ctgtggtttcatgtta

SEQ ID NO: 5409283 - DNA, 20 bp, Homo sapiens
ctgtggtttccaaggagctg

SEQ ID NO: 5409284 - DNA, 21 bp, Homo sapiens
ctgtggtttccaaggagctga

SEQ ID NO: 5409285 - DNA, 19 bp, Homo sapiens
ctgtggtttggttggggct

SEQ ID NO: 5409286 - DNA, 14 bp, Homo sapiens
ctgtggtttgttat

SEQ ID NO: 5409287 - DNA, 19 bp, Homo sapiens
ctgtggttttattacaaat

SEQ ID NO: 5409288 - DNA, 22 bp, Homo sapiens
ctgtggttttattacaaatgca

SEQ ID NO: 5409289 - DNA, 12 bp, Homo sapiens
ctgtgtaaaatc

SEQ ID NO: 5409290 - DNA, 13 bp, Homo sapiens
ctgtgtaaaatga

SEQ ID NO: 5409291 - DNA, 22 bp, Homo sapiens
ctgtgtaaaatgagtaggatgt

SEQ ID NO: 5409292 - DNA, 13 bp, Homo sapiens
ctgtgtaaagact

SEQ ID NO: 5409293 - DNA, 11 bp, Homo sapiens
ctgtgtaaagt

SEQ ID NO: 5409294 - DNA, 20 bp, Homo sapiens
ctgtgtaaatgctccagcac

SEQ ID NO: 5409295 - DNA, 14 bp, Homo sapiens
ctgtgtaacagctc

SEQ ID NO: 5409296 - DNA, 15 bp, Homo sapiens
ctgtgtaacagctcc

SEQ ID NO: 5409297 - DNA, 16 bp, Homo sapiens
ctgtgtaacagctcct

SEQ ID NO: 5409298 - DNA, 17 bp, Homo sapiens
ctgtgtaacagctcctt

SEQ ID NO: 5409299 - DNA, 15 bp, Homo sapiens
ctgtgtaacaggacc

SEQ ID NO: 5409300 - DNA, 20 bp, Homo sapiens
ctgtgtaacaggaccccaag

SEQ ID NO: 5409301 - DNA, 20 bp, Homo sapiens
ctgtgtaacatccaagccag

SEQ ID NO: 5409302 - DNA, 17 bp, Homo sapiens
ctgtgtaacatctgcca

SEQ ID NO: 5409303 - DNA, 12 bp, Homo sapiens
ctgtgtaaccag

SEQ ID NO: 5409304 - DNA, 21 bp, Homo sapiens
ctgtgtaaccagcagtcacag

SEQ ID NO: 5409305 - DNA, 18 bp, Homo sapiens
ctgtgtaacctccacagt

SEQ ID NO: 5409306 - DNA, 13 bp, Homo sapiens
ctgtgtaactgcc

SEQ ID NO: 5409307 - DNA, 16 bp, Homo sapiens
ctgtgtaactgcccaa

SEQ ID NO: 5409308 - DNA, 21 bp, Homo sapiens
ctgtgtaactttctcttaaga

SEQ ID NO: 5409309 - DNA, 22 bp, Homo sapiens
ctgtgtaagaagctgtgaatat

SEQ ID NO: 5409310 - DNA, 23 bp, Homo sapiens
ctgtgtaagggccagaaatatct

SEQ ID NO: 5409311 - DNA, 18 bp, Homo sapiens
ctgtgtaatagaataaag

SEQ ID NO: 5409312 - DNA, 23 bp, Homo sapiens
ctgtgtaatagaataaaggcctg

SEQ ID NO: 5409313 - DNA, 19 bp, Homo sapiens
ctgtgtaatcatttcttgg

SEQ ID NO: 5409314 - DNA, 16 bp, Homo sapiens
ctgtgtaatctctgat

SEQ ID NO: 5409315 - DNA, 18 bp, Homo sapiens
ctgtgtaattagtgccac

SEQ ID NO: 5409316 - DNA, 14 bp, Homo sapiens
ctgtgtacaaagaa

SEQ ID NO: 5409317 - DNA, 21 bp, Homo sapiens
ctgtgtacaactttttaaata

SEQ ID NO: 5409318 - DNA, 15 bp, Homo sapiens
ctgtgtacaatgtga

SEQ ID NO: 5409319 - DNA, 17 bp, Homo sapiens
ctgtgtacaatgtgaga

SEQ ID NO: 5409320 - DNA, 13 bp, Homo sapiens
ctgtgtacacctc

SEQ ID NO: 5409321 - DNA, 21 bp, Homo sapiens
ctgtgtacataaagtcatcaa

SEQ ID NO: 5409322 - DNA, 19 bp, Homo sapiens
ctgtgtacataactgaaaa

SEQ ID NO: 5409323 - DNA, 22 bp, Homo sapiens
ctgtgtacataactgaaaatgt

SEQ ID NO: 5409324 - DNA, 17 bp, Homo sapiens
ctgtgtaccactgggat

SEQ ID NO: 5409325 - DNA, 21 bp, Homo sapiens
ctgtgtaccacttcctgaggc

SEQ ID NO: 5409326 - DNA, 15 bp, Homo sapiens
ctgtgtaccacttct

SEQ ID NO: 5409327 - DNA, 19 bp, Homo sapiens
ctgtgtaccacttctgtgg

SEQ ID NO: 5409328 - DNA, 21 bp, Homo sapiens
ctgtgtaccacttctgtgggc

SEQ ID NO: 5409329 - DNA, 21 bp, Homo sapiens
ctgtgtacgacaaagcatcat

SEQ ID NO: 5409330 - DNA, 15 bp, Homo sapiens
ctgtgtactgcagtt

SEQ ID NO: 5409331 - DNA, 11 bp, Homo sapiens
ctgtgtactgt

SEQ ID NO: 5409332 - DNA, 12 bp, Homo sapiens
ctgtgtactgtg

SEQ ID NO: 5409333 - DNA, 16 bp, Homo sapiens
ctgtgtacttcccggg

SEQ ID NO: 5409334 - DNA, 15 bp, Homo sapiens
ctgtgtagacatggt

SEQ ID NO: 5409335 - DNA, 15 bp, Homo sapiens
ctgtgtagagaatgt

SEQ ID NO: 5409336 - DNA, 16 bp, Homo sapiens
ctgtgtagctctgtcc

SEQ ID NO: 5409337 - DNA, 23 bp, Homo sapiens
ctgtgtagctgtgacctgctgag

SEQ ID NO: 5409338 - DNA, 23 bp, Homo sapiens
ctgtgtagtagctcgtgtgctta

SEQ ID NO: 5409339 - DNA, 15 bp, Homo sapiens
ctgtgtagtagtgca

SEQ ID NO: 5409340 - DNA, 16 bp, Homo sapiens
ctgtgtagttccctct

SEQ ID NO: 5409341 - DNA, 11 bp, Homo sapiens
ctgtgtataca

SEQ ID NO: 5409342 - DNA, 16 bp, Homo sapiens
ctgtgtatatctctgt

SEQ ID NO: 5409343 - DNA, 17 bp, Homo sapiens
ctgtgtatatctctgta

SEQ ID NO: 5409344 - DNA, 12 bp, Homo sapiens
ctgtgtatatta

SEQ ID NO: 5409345 - DNA, 15 bp, Homo sapiens
ctgtgtatattattt

SEQ ID NO: 5409346 - DNA, 19 bp, Homo sapiens
ctgtgtatattatttggca

SEQ ID NO: 5409347 - DNA, 20 bp, Homo sapiens
ctgtgtatattatttggcag

SEQ ID NO: 5409348 - DNA, 20 bp, Homo sapiens
ctgtgtatatttgatttatt

SEQ ID NO: 5409349 - DNA, 22 bp, Homo sapiens
ctgtgtatatttgatttattaa

SEQ ID NO: 5409350 - DNA, 15 bp, Homo sapiens
ctgtgtatcattaaa

SEQ ID NO: 5409351 - DNA, 17 bp, Homo sapiens
ctgtgtatcattaaaat

SEQ ID NO: 5409352 - DNA, 13 bp, Homo sapiens
ctgtgtatctttt

SEQ ID NO: 5409353 - DNA, 18 bp, Homo sapiens
ctgtgtatggtgacctct

SEQ ID NO: 5409354 - DNA, 22 bp, Homo sapiens
ctgtgtatggtgacctctccgg

SEQ ID NO: 5409355 - DNA, 23 bp, Homo sapiens
ctgtgtatggtgacctctccggc

SEQ ID NO: 5409356 - DNA, 11 bp, Homo sapiens
ctgtgtatgta

SEQ ID NO: 5409357 - DNA, 23 bp, Homo sapiens
ctgtgtattaaacctttccattt

SEQ ID NO: 5409358 - DNA, 21 bp, Homo sapiens
ctgtgtattaacatgcaataa

SEQ ID NO: 5409359 - DNA, 13 bp, Homo sapiens
ctgtgtattctca

SEQ ID NO: 5409360 - DNA, 13 bp, Homo sapiens
ctgtgtatttaat

SEQ ID NO: 5409361 - DNA, 17 bp, Homo sapiens
ctgtgtatttatataaa

SEQ ID NO: 5409362 - DNA, 21 bp, Homo sapiens
ctgtgtatttatttaaaactc

SEQ ID NO: 5409363 - DNA, 22 bp, Homo sapiens
ctgtgtatttatttaaaactct

SEQ ID NO: 5409364 - DNA, 16 bp, Homo sapiens
ctgtgtatttctgtag

SEQ ID NO: 5409365 - DNA, 15 bp, Homo sapiens
ctgtgtatttgcttt

SEQ ID NO: 5409366 - DNA, 19 bp, Homo sapiens
ctgtgtattttttaaagct

SEQ ID NO: 5409367 - DNA, 18 bp, Homo sapiens
ctgtgtcaaggtgaagca

SEQ ID NO: 5409368 - DNA, 18 bp, Homo sapiens
ctgtgtcacccagactgg

SEQ ID NO: 5409369 - DNA, 21 bp, Homo sapiens
ctgtgtcacgcaggctgagtg

SEQ ID NO: 5409370 - DNA, 18 bp, Homo sapiens
ctgtgtcacgtgaccctg

SEQ ID NO: 5409371 - DNA, 21 bp, Homo sapiens
ctgtgtcacgtgaccctgtgc

SEQ ID NO: 5409372 - DNA, 15 bp, Homo sapiens
ctgtgtcactggctg

SEQ ID NO: 5409373 - DNA, 21 bp, Homo sapiens
ctgtgtcacttgtaggtttct

SEQ ID NO: 5409374 - DNA, 21 bp, Homo sapiens
ctgtgtcagaaaccctggtct

SEQ ID NO: 5409375 - DNA, 12 bp, Homo sapiens
ctgtgtcagagc

SEQ ID NO: 5409376 - DNA, 16 bp, Homo sapiens
ctgtgtcagagcccag

SEQ ID NO: 5409377 - DNA, 17 bp, Homo sapiens
ctgtgtcagagcccagc

SEQ ID NO: 5409378 - DNA, 14 bp, Homo sapiens
ctgtgtcagagcct

SEQ ID NO: 5409379 - DNA, 17 bp, Homo sapiens
ctgtgtcagcatagaag

SEQ ID NO: 5409380 - DNA, 16 bp, Homo sapiens
ctgtgtcagcatcttt

SEQ ID NO: 5409381 - DNA, 19 bp, Homo sapiens
ctgtgtcagcatctttgcc

SEQ ID NO: 5409382 - DNA, 23 bp, Homo sapiens
ctgtgtcagggaacatatttaag

SEQ ID NO: 5409383 - DNA, 21 bp, Homo sapiens
ctgtgtcaggtggggcagctt

SEQ ID NO: 5409384 - DNA, 22 bp, Homo sapiens
ctgtgtcaggtggggcagcttg

SEQ ID NO: 5409385 - DNA, 15 bp, Homo sapiens
ctgtgtcagtttatg

SEQ ID NO: 5409386 - DNA, 15 bp, Homo sapiens
ctgtgtcataaacag

SEQ ID NO: 5409387 - DNA, 14 bp, Homo sapiens
ctgtgtcatttctt

SEQ ID NO: 5409388 - DNA, 15 bp, Homo sapiens
ctgtgtcatttcttc

SEQ ID NO: 5409389 - DNA, 22 bp, Homo sapiens
ctgtgtccaaaaccgccagctc

SEQ ID NO: 5409390 - DNA, 18 bp, Homo sapiens
ctgtgtccaactccagta

SEQ ID NO: 5409391 - DNA, 23 bp, Homo sapiens
ctgtgtccacagtgattagcctc

SEQ ID NO: 5409392 - DNA, 22 bp, Homo sapiens
ctgtgtccacatctaacaaagt

SEQ ID NO: 5409393 - DNA, 19 bp, Homo sapiens
ctgtgtccagagacatggg

SEQ ID NO: 5409394 - DNA, 17 bp, Homo sapiens
ctgtgtccatctgaccg

SEQ ID NO: 5409395 - DNA, 18 bp, Homo sapiens
ctgtgtccatgcgctcag

SEQ ID NO: 5409396 - DNA, 13 bp, Homo sapiens
ctgtgtcccagat

SEQ ID NO: 5409397 - DNA, 20 bp, Homo sapiens
ctgtgtcccagatgggccac

SEQ ID NO: 5409398 - DNA, 14 bp, Homo sapiens
ctgtgtcccagcac

SEQ ID NO: 5409399 - DNA, 19 bp, Homo sapiens
ctgtgtcccagccacgcag

SEQ ID NO: 5409400 - DNA, 13 bp, Homo sapiens
ctgtgtcccagtg

SEQ ID NO: 5409401 - DNA, 16 bp, Homo sapiens
ctgtgtcccagtgtct

SEQ ID NO: 5409402 - DNA, 19 bp, Homo sapiens
ctgtgtcccagtgtctggc

SEQ ID NO: 5409403 - DNA, 23 bp, Homo sapiens
ctgtgtcccagtgtctggcccag

SEQ ID NO: 5409404 - DNA, 13 bp, Homo sapiens
ctgtgtcccatga

SEQ ID NO: 5409405 - DNA, 21 bp, Homo sapiens
ctgtgtcccatgacccacccc

SEQ ID NO: 5409406 - DNA, 22 bp, Homo sapiens
ctgtgtcccatgtcccgtgtct

SEQ ID NO: 5409407 - DNA, 22 bp, Homo sapiens
ctgtgtccccgcgggcagtgac

SEQ ID NO: 5409408 - DNA, 15 bp, Homo sapiens
ctgtgtcccctgacc

SEQ ID NO: 5409409 - DNA, 19 bp, Homo sapiens
ctgtgtccctgctggggtc

SEQ ID NO: 5409410 - DNA, 16 bp, Homo sapiens
ctgtgtcccttttgca

SEQ ID NO: 5409411 - DNA, 12 bp, Homo sapiens
ctgtgtcctccc

SEQ ID NO: 5409412 - DNA, 17 bp, Homo sapiens
ctgtgtcctctagttga

SEQ ID NO: 5409413 - DNA, 17 bp, Homo sapiens
ctgtgtcctctccagct

SEQ ID NO: 5409414 - DNA, 15 bp, Homo sapiens
ctgtgtcctctgcct

SEQ ID NO: 5409415 - DNA, 18 bp, Homo sapiens
ctgtgtcctgatggccca

SEQ ID NO: 5409416 - DNA, 14 bp, Homo sapiens
ctgtgtcctggtgc

SEQ ID NO: 5409417 - DNA, 23 bp, Homo sapiens
ctgtgtcctggtgctctctgcca

SEQ ID NO: 5409418 - DNA, 14 bp, Homo sapiens
ctgttctggcctca

SEQ ID NO: 5409419 - DNA, 19 bp, Homo sapiens
ctgttctggcctcagacca

SEQ ID NO: 5409420 - DNA, 19 bp, Homo sapiens
ctgttctgggactccaggt

SEQ ID NO: 5409421 - DNA, 12 bp, Homo sapiens
ctgttctggggg

SEQ ID NO: 5409422 - DNA, 20 bp, Homo sapiens
ctgttctgggtgcagctgag

SEQ ID NO: 5409423 - DNA, 13 bp, Homo sapiens
ctgttctggtaat

SEQ ID NO: 5409424 - DNA, 16 bp, Homo sapiens
ctgttctggtggcagt

SEQ ID NO: 5409425 - DNA, 15 bp, Homo sapiens
ctgttctggtggccc

SEQ ID NO: 5409426 - DNA, 17 bp, Homo sapiens
ctgttctgtaggagaga

SEQ ID NO: 5409427 - DNA, 14 bp, Homo sapiens
ctgttctgtggaaa

SEQ ID NO: 5409428 - DNA, 19 bp, Homo sapiens
ctgttctgtggttcctctg

SEQ ID NO: 5409429 - DNA, 21 bp, Homo sapiens
ctgttctgtggttcctctgct

SEQ ID NO: 5409430 - DNA, 13 bp, Homo sapiens
ctgttctgtgtct

SEQ ID NO: 5409431 - DNA, 14 bp, Homo sapiens
ctgttctgtgtctg

SEQ ID NO: 5409432 - DNA, 17 bp, Homo sapiens
ctgttctgtgtctgctg

SEQ ID NO: 5409433 - DNA, 19 bp, Homo sapiens
ctgttctgtgtctgctgta

SEQ ID NO: 5409434 - DNA, 24 bp, Homo sapiens
ctgttctgtttcctgtgtctccaa

SEQ ID NO: 5409435 - DNA, 22 bp, Homo sapiens
ctgttctgtttggcacttgtat

SEQ ID NO: 5409436 - DNA, 16 bp, Homo sapiens
ctgttcttacaaatgt

SEQ ID NO: 5409437 - DNA, 23 bp, Homo sapiens
ctgttcttagctcaatgagcatg

SEQ ID NO: 5409438 - DNA, 18 bp, Homo sapiens
ctgttcttcaactcctgg

SEQ ID NO: 5409439 - DNA, 15 bp, Homo sapiens
ctgttcttcagtcct

SEQ ID NO: 5409440 - DNA, 21 bp, Homo sapiens
ctgttcttcagtcctttgtct

SEQ ID NO: 5409441 - DNA, 17 bp, Homo sapiens
ctgttcttcctcagcca

SEQ ID NO: 5409442 - DNA, 18 bp, Homo sapiens
ctgttcttcctcagccag

SEQ ID NO: 5409443 - DNA, 14 bp, Homo sapiens
ctgttcttcctcca

SEQ ID NO: 5409444 - DNA, 12 bp, Homo sapiens
ctgttcttcctt

SEQ ID NO: 5409445 - DNA, 13 bp, Homo sapiens
ctgttcttccttc

SEQ ID NO: 5409446 - DNA, 18 bp, Homo sapiens
ctgttcttgaagctgggc

SEQ ID NO: 5409447 - DNA, 16 bp, Homo sapiens
ctgttcttgcataggc

SEQ ID NO: 5409448 - DNA, 12 bp, Homo sapiens
ctgttcttgctg

SEQ ID NO: 5409449 - DNA, 17 bp, Homo sapiens
ctgttcttgctgctaga

SEQ ID NO: 5409450 - DNA, 21 bp, Homo sapiens
ctgttcttgctgctagaactt

SEQ ID NO: 5409451 - DNA, 19 bp, Homo sapiens
ctgttcttggcttggaaga

SEQ ID NO: 5409452 - DNA, 20 bp, Homo sapiens
ctgttcttgggcctcaggct

SEQ ID NO: 5409453 - DNA, 13 bp, Homo sapiens
ctgttcttggggc

SEQ ID NO: 5409454 - DNA, 15 bp, Homo sapiens
ctgttcttggggccc

SEQ ID NO: 5409455 - DNA, 13 bp, Homo sapiens
ctgttcttggtaa

SEQ ID NO: 5409456 - DNA, 12 bp, Homo sapiens
ctgttctttacc

SEQ ID NO: 5409457 - DNA, 16 bp, Homo sapiens
ctgttctttccaaagt

SEQ ID NO: 5409458 - DNA, 21 bp, Homo sapiens
ctgttctttccaaagtacact

SEQ ID NO: 5409459 - DNA, 17 bp, Homo sapiens
ctgttctttttgactga

SEQ ID NO: 5409460 - DNA, 23 bp, Homo sapiens
ctgttgaaaagcacacacaataa

SEQ ID NO: 5409461 - DNA, 22 bp, Homo sapiens
ctgttgaaaagccatgtttaag

SEQ ID NO: 5409462 - DNA, 22 bp, Homo sapiens
ctgttgaaacttacactgtttc

SEQ ID NO: 5409463 - DNA, 15 bp, Homo sapiens
ctgttgaaagcaaaa

SEQ ID NO: 5409464 - DNA, 16 bp, Homo sapiens
ctgttgaaagcaaaaa

SEQ ID NO: 5409465 - DNA, 19 bp, Homo sapiens
ctgttgaaagcaaaaatgc

SEQ ID NO: 5409466 - DNA, 20 bp, Homo sapiens
ctgttgaaagcaaaaatgct

SEQ ID NO: 5409467 - DNA, 12 bp, Homo sapiens
ctgttgaacttt

SEQ ID NO: 5409468 - DNA, 17 bp, Homo sapiens
ctgttgaagacttcctc

SEQ ID NO: 5409469 - DNA, 18 bp, Homo sapiens
ctgttgaagattaacact

SEQ ID NO: 5409470 - DNA, 18 bp, Homo sapiens
ctgttgaagatttgagga

SEQ ID NO: 5409471 - DNA, 15 bp, Homo sapiens
ctgttgaaggtgcca

SEQ ID NO: 5409472 - DNA, 14 bp, Homo sapiens
ctgttgaagtgcat

SEQ ID NO: 5409473 - DNA, 22 bp, Homo sapiens
ctgttgaagtgcatgttaaaat

SEQ ID NO: 5409474 - DNA, 20 bp, Homo sapiens
ctgttgaatatttagcataa

SEQ ID NO: 5409475 - DNA, 17 bp, Homo sapiens
ctgttgaatttcccaca

SEQ ID NO: 5409476 - DNA, 17 bp, Homo sapiens
ctgttgacacaggtctt

SEQ ID NO: 5409477 - DNA, 21 bp, Homo sapiens
ctgttgacatacaaaccatga

SEQ ID NO: 5409478 - DNA, 18 bp, Homo sapiens
ctgttgacatatttaatg

SEQ ID NO: 5409479 - DNA, 21 bp, Homo sapiens
ctgttgacatatttaatgttt

SEQ ID NO: 5409480 - DNA, 23 bp, Homo sapiens
ctgttgacatatttaatgtttta

SEQ ID NO: 5409481 - DNA, 15 bp, Homo sapiens
ctgttgacatcagcc

SEQ ID NO: 5409482 - DNA, 21 bp, Homo sapiens
ctgttgaccaggctggagtga

SEQ ID NO: 5409483 - DNA, 18 bp, Homo sapiens
ctgttgacctaccctgga

SEQ ID NO: 5409484 - DNA, 15 bp, Homo sapiens
ctgttgacctgtgca

SEQ ID NO: 5409485 - DNA, 18 bp, Homo sapiens
ctgttgacgcacctgtgg

SEQ ID NO: 5409486 - DNA, 13 bp, Homo sapiens
ctgttgagaaaac

SEQ ID NO: 5409487 - DNA, 19 bp, Homo sapiens
ctgttgagaccttgtggtc

SEQ ID NO: 5409488 - DNA, 14 bp, Homo sapiens
ctgttgagacttag

SEQ ID NO: 5409489 - DNA, 16 bp, Homo sapiens
ctgttgagatgcctgt

SEQ ID NO: 5409490 - DNA, 12 bp, Homo sapiens
ctgttgagggcc

SEQ ID NO: 5409491 - DNA, 13 bp, Homo sapiens
ctgttgagggcct

SEQ ID NO: 5409492 - DNA, 14 bp, Homo sapiens
ctgttgaggtgggt

SEQ ID NO: 5409493 - DNA, 17 bp, Homo sapiens
ctgttgagtatttgctg

SEQ ID NO: 5409494 - DNA, 19 bp, Homo sapiens
ctgttgagtatttgctgtt

SEQ ID NO: 5409495 - DNA, 21 bp, Homo sapiens
ctgttgataattcttattttg

SEQ ID NO: 5409496 - DNA, 16 bp, Homo sapiens
ctgttgatacaaacca

SEQ ID NO: 5409497 - DNA, 14 bp, Homo sapiens
ctgttgatcccagt

SEQ ID NO: 5409498 - DNA, 23 bp, Homo sapiens
ctgttgatctacccgtgcctggg

SEQ ID NO: 5409499 - DNA, 16 bp, Homo sapiens
ctgttgatctttcact

SEQ ID NO: 5409500 - DNA, 15 bp, Homo sapiens
ctgttgatgtatctg

SEQ ID NO: 5409501 - DNA, 16 bp, Homo sapiens
ctgttgatgtatctga

SEQ ID NO: 5409502 - DNA, 23 bp, Homo sapiens
ctgttgatgtatctgagttgcca

SEQ ID NO: 5409503 - DNA, 13 bp, Homo sapiens
ctgttgattaatt

SEQ ID NO: 5409504 - DNA, 17 bp, Homo sapiens
ctgttgattatcttcag

SEQ ID NO: 5409505 - DNA, 23 bp, Homo sapiens
ctgttgattctttcaatccacag

SEQ ID NO: 5409506 - DNA, 17 bp, Homo sapiens
ctgttgattgctaaatg

SEQ ID NO: 5409507 - DNA, 18 bp, Homo sapiens
ctgttgattgctaaatgt

SEQ ID NO: 5409508 - DNA, 20 bp, Homo sapiens
ctgttgatttctttccagag

SEQ ID NO: 5409509 - DNA, 18 bp, Homo sapiens
ctgttgcaaattccaccc

SEQ ID NO: 5409510 - DNA, 21 bp, Homo sapiens
ctgttgcaattaggattttga

SEQ ID NO: 5409511 - DNA, 20 bp, Homo sapiens
ctgttgcacccagccctggt

SEQ ID NO: 5409512 - DNA, 15 bp, Homo sapiens
ctgttgcacgtgtgt

SEQ ID NO: 5409513 - DNA, 23 bp, Homo sapiens
ctgttgcacgtgtgtttttctat

SEQ ID NO: 5409514 - DNA, 17 bp, Homo sapiens
ctgttgcactgatgtcc

SEQ ID NO: 5409515 - DNA, 17 bp, Homo sapiens
ctgttgcacttttgaat

SEQ ID NO: 5409516 - DNA, 19 bp, Homo sapiens
ctgttgcacttttgaatgt

SEQ ID NO: 5409517 - DNA, 22 bp, Homo sapiens
ctgttgcagatgaaatgttctg

SEQ ID NO: 5409518 - DNA, 23 bp, Homo sapiens
ctgttgcagatgaaatgttctgt

SEQ ID NO: 5409519 - DNA, 13 bp, Homo sapiens
ctgttgcaggcaa

SEQ ID NO: 5409520 - DNA, 18 bp, Homo sapiens
ctgttgcagtggcctggc

SEQ ID NO: 5409521 - DNA, 19 bp, Homo sapiens
ctgttgcagtggcctggcc

SEQ ID NO: 5409522 - DNA, 13 bp, Homo sapiens
ctgttgccacaac

SEQ ID NO: 5409523 - DNA, 21 bp, Homo sapiens
ctgttgccaggctggagtgca

SEQ ID NO: 5409524 - DNA, 13 bp, Homo sapiens
ctgttgccatgga

SEQ ID NO: 5409525 - DNA, 22 bp, Homo sapiens
ctgttgccatggattcaccccc

SEQ ID NO: 5409526 - DNA, 16 bp, Homo sapiens
ctgttgcccaggctgg

SEQ ID NO: 5409527 - DNA, 20 bp, Homo sapiens
ctgttgcccaggctggagtg

SEQ ID NO: 5409528 - DNA, 18 bp, Homo sapiens
ctgttgcccaggctggcg

SEQ ID NO: 5409529 - DNA, 18 bp, Homo sapiens
ctgttgcccgccctccac

SEQ ID NO: 5409530 - DNA, 18 bp, Homo sapiens
ctgttgccgagcccagct

SEQ ID NO: 5409531 - DNA, 12 bp, Homo sapiens
ctgttgcctcct

SEQ ID NO: 5409532 - DNA, 14 bp, Homo sapiens
ctgttgcctcctct

SEQ ID NO: 5409533 - DNA, 21 bp, Homo sapiens
ctgttgcctcctctctccctg

SEQ ID NO: 5409534 - DNA, 21 bp, Homo sapiens
ctgttgcctttttacagccaa

SEQ ID NO: 5409535 - DNA, 15 bp, Homo sapiens
ctgttgcgccactga

SEQ ID NO: 5409536 - DNA, 23 bp, Homo sapiens
ctgttgcgtaactggctgtgttc

SEQ ID NO: 5409537 - DNA, 12 bp, Homo sapiens
ctgttgctaagc

SEQ ID NO: 5409538 - DNA, 14 bp, Homo sapiens
ctgttgctagggag

SEQ ID NO: 5409539 - DNA, 22 bp, Homo sapiens
ctgttgctcaaatctattcaga

SEQ ID NO: 5409540 - DNA, 15 bp, Homo sapiens
ctgttgctgaagtca

SEQ ID NO: 5409541 - DNA, 16 bp, Homo sapiens
ctgttgctgaataggc

SEQ ID NO: 5409542 - DNA, 21 bp, Homo sapiens
ctgttgctgattttattcttg

SEQ ID NO: 5409543 - DNA, 14 bp, Homo sapiens
ctgttgctgcctca

SEQ ID NO: 5409544 - DNA, 15 bp, Homo sapiens
ctgttgctgcctcat

SEQ ID NO: 5409545 - DNA, 20 bp, Homo sapiens
ctgttgctggtgtactctag

SEQ ID NO: 5409546 - DNA, 16 bp, Homo sapiens
ctgttgctgtcttcag

SEQ ID NO: 5409547 - DNA, 21 bp, Homo sapiens
ctgttgctgtgtttaatttga

SEQ ID NO: 5409548 - DNA, 12 bp, Homo sapiens
ctgttgctgttg

SEQ ID NO: 5409549 - DNA, 18 bp, Homo sapiens
ctgttgctgttgctgttg

SEQ ID NO: 5409550 - DNA, 11 bp, Homo sapiens
ctgttgcttga

SEQ ID NO: 5409551 - DNA, 18 bp, Homo sapiens
ctgttgctttaatatgag

SEQ ID NO: 5409552 - DNA, 19 bp, Homo sapiens
ctgttgctttcttcctgca

SEQ ID NO: 5409553 - DNA, 12 bp, Homo sapiens
ctgttggaagaa

SEQ ID NO: 5409554 - DNA, 11 bp, Homo sapiens
ctgttggaagc

SEQ ID NO: 5409555 - DNA, 21 bp, Homo sapiens
ctgttggaaggtagagcccac

SEQ ID NO: 5409556 - DNA, 20 bp, Homo sapiens
ctgttggaagttcactggag

SEQ ID NO: 5409557 - DNA, 18 bp, Homo sapiens
ctgttggacagctgcttg

SEQ ID NO: 5409558 - DNA, 17 bp, Homo sapiens
ctgttggagcaaaccat

SEQ ID NO: 5409559 - DNA, 18 bp, Homo sapiens
ctgttggagcaaaccatt

SEQ ID NO: 5409560 - DNA, 14 bp, Homo sapiens
ctgttggaggcaca

SEQ ID NO: 5409561 - DNA, 17 bp, Homo sapiens
ctgttggattccatgct

SEQ ID NO: 5409562 - DNA, 22 bp, Homo sapiens
ctgttggatttgtttaaaagga

SEQ ID NO: 5409563 - DNA, 21 bp, Homo sapiens
ctgttggcaaatttgtgaact

SEQ ID NO: 5409564 - DNA, 22 bp, Homo sapiens
ctgttggcactcacagacctgg

SEQ ID NO: 5409565 - DNA, 22 bp, Homo sapiens
ctgttggcaggcccactcccca

SEQ ID NO: 5409566 - DNA, 15 bp, Homo sapiens
ctgttggcaggctgg

SEQ ID NO: 5409567 - DNA, 21 bp, Homo sapiens
ctgttggcagtgagtgagcct

SEQ ID NO: 5409568 - DNA, 22 bp, Homo sapiens
ctgttggcagtgagtgagcctg

SEQ ID NO: 5409569 - DNA, 12 bp, Homo sapiens
ctgttggccagt

SEQ ID NO: 5409570 - DNA, 15 bp, Homo sapiens
ctgttggccagtgtg

SEQ ID NO: 5409571 - DNA, 19 bp, Homo sapiens
ctgttggcctcgcctgggc

SEQ ID NO: 5409572 - DNA, 20 bp, Homo sapiens
ctgttggcctcgcctgggcc

SEQ ID NO: 5409573 - DNA, 12 bp, Homo sapiens
ctgttggcctgt

SEQ ID NO: 5409574 - DNA, 19 bp, Homo sapiens
ctgttggcctgtgggcctc

SEQ ID NO: 5409575 - DNA, 23 bp, Homo sapiens
ctgttggcctgtgggcctcacct

SEQ ID NO: 5409576 - DNA, 21 bp, Homo sapiens
ctgttggctgattggaaaata

SEQ ID NO: 5409577 - DNA, 16 bp, Homo sapiens
ctgttggctgctcccc

SEQ ID NO: 5409578 - DNA, 16 bp, Homo sapiens
ctgttggctgctgcca

SEQ ID NO: 5409579 - DNA, 17 bp, Homo sapiens
ctgttgggaacagcatg

SEQ ID NO: 5409580 - DNA, 19 bp, Homo sapiens
ctgttgggagaaagcaata

SEQ ID NO: 5409581 - DNA, 22 bp, Homo sapiens
ctgttgggggcttcaggtctct

SEQ ID NO: 5409582 - DNA, 20 bp, Homo sapiens
ctgttggggtgggtataaaa

SEQ ID NO: 5409583 - DNA, 22 bp, Homo sapiens
ctgttggggtgggtataaaaga

SEQ ID NO: 5409584 - DNA, 22 bp, Homo sapiens
ctgttgggtgggtgggccctgc

SEQ ID NO: 5409585 - DNA, 19 bp, Homo sapiens
ctgttgggtttttgctgtt

SEQ ID NO: 5409586 - DNA, 16 bp, Homo sapiens
ctgttggtccactgtg

SEQ ID NO: 5409587 - DNA, 18 bp, Homo sapiens
ctgttggtcctctctctg

SEQ ID NO: 5409588 - DNA, 16 bp, Homo sapiens
ctgttggtctgccttc

SEQ ID NO: 5409589 - DNA, 20 bp, Homo sapiens
ctgttggtctgccttctgct

SEQ ID NO: 5409590 - DNA, 22 bp, Homo sapiens
ctgttggtgttctaagactctg

SEQ ID NO: 5409591 - DNA, 18 bp, Homo sapiens
ctgttggttagctggaca

SEQ ID NO: 5409592 - DNA, 23 bp, Homo sapiens
ctgttgtaaacaacgtgtatagt

SEQ ID NO: 5409593 - DNA, 18 bp, Homo sapiens
ctgttgtaaatgaccaag

SEQ ID NO: 5409594 - DNA, 16 bp, Homo sapiens
ctgttgtaactaggct

SEQ ID NO: 5409595 - DNA, 14 bp, Homo sapiens
cttaaaaccaaaga

SEQ ID NO: 5409596 - DNA, 21 bp, Homo sapiens
cttaaaaccaaagagggcttc

SEQ ID NO: 5409597 - DNA, 22 bp, Homo sapiens
cttaaaaccagagaatcttaag

SEQ ID NO: 5409598 - DNA, 12 bp, Homo sapiens
cttaaaacctgc

SEQ ID NO: 5409599 - DNA, 23 bp, Homo sapiens
cttaaaactaggcatttgtaaat

SEQ ID NO: 5409600 - DNA, 19 bp, Homo sapiens
cttaaaactttattaaaag

SEQ ID NO: 5409601 - DNA, 12 bp, Homo sapiens
cttaaaagaaaa

SEQ ID NO: 5409602 - DNA, 19 bp, Homo sapiens
cttaaaagaacataggaat

SEQ ID NO: 5409603 - DNA, 12 bp, Homo sapiens
cttaaaagagta

SEQ ID NO: 5409604 - DNA, 13 bp, Homo sapiens
cttaaaagcattt

SEQ ID NO: 5409605 - DNA, 22 bp, Homo sapiens
cttaaaagctatcttcatgtaa

SEQ ID NO: 5409606 - DNA, 20 bp, Homo sapiens
cttaaaaggtataattaaac

SEQ ID NO: 5409607 - DNA, 15 bp, Homo sapiens
cttaaaagtaataaa

SEQ ID NO: 5409608 - DNA, 16 bp, Homo sapiens
cttaaaagtaataaag

SEQ ID NO: 5409609 - DNA, 22 bp, Homo sapiens
cttaaaagtactttaaaaagga

SEQ ID NO: 5409610 - DNA, 14 bp, Homo sapiens
cttaaaagtttcta

SEQ ID NO: 5409611 - DNA, 17 bp, Homo sapiens
cttaaaataaacagttg

SEQ ID NO: 5409612 - DNA, 13 bp, Homo sapiens
cttaaaataaagt

SEQ ID NO: 5409613 - DNA, 21 bp, Homo sapiens
cttaaaataaagttaaactga

SEQ ID NO: 5409614 - DNA, 11 bp, Homo sapiens
cttaaaataag

SEQ ID NO: 5409615 - DNA, 12 bp, Homo sapiens
cttaaaataagt

SEQ ID NO: 5409616 - DNA, 16 bp, Homo sapiens
cttaaaataattaaat

SEQ ID NO: 5409617 - DNA, 19 bp, Homo sapiens
cttaaaataattcatatct

SEQ ID NO: 5409618 - DNA, 18 bp, Homo sapiens
cttaaaatacaagactgc

SEQ ID NO: 5409619 - DNA, 18 bp, Homo sapiens
cttaaaatagaaataagt

SEQ ID NO: 5409620 - DNA, 21 bp, Homo sapiens
cttaaaatatatagtgaaaaa

SEQ ID NO: 5409621 - DNA, 17 bp, Homo sapiens
cttaaaatatatttcag

SEQ ID NO: 5409622 - DNA, 22 bp, Homo sapiens
cttaaaatatccactggacact

SEQ ID NO: 5409623 - DNA, 19 bp, Homo sapiens
cttaaaatatctctaaaat

SEQ ID NO: 5409624 - DNA, 21 bp, Homo sapiens
cttaaaatatgtgaagttttc

SEQ ID NO: 5409625 - DNA, 20 bp, Homo sapiens
cttaaaatgacaaagccatt

SEQ ID NO: 5409626 - DNA, 13 bp, Homo sapiens
cttaaaatgcaat

SEQ ID NO: 5409627 - DNA, 15 bp, Homo sapiens
cttaaaatgcaatat

SEQ ID NO: 5409628 - DNA, 21 bp, Homo sapiens
cttaaaatgcaatatttgtaa

SEQ ID NO: 5409629 - DNA, 18 bp, Homo sapiens
cttaaaatggaattgaaa

SEQ ID NO: 5409630 - DNA, 20 bp, Homo sapiens
cttaaaatgtactctccttt

SEQ ID NO: 5409631 - DNA, 15 bp, Homo sapiens
cttaaaatgtgtaca

SEQ ID NO: 5409632 - DNA, 18 bp, Homo sapiens
cttaaaattaccagacaa

SEQ ID NO: 5409633 - DNA, 16 bp, Homo sapiens
cttaaaattagcatct

SEQ ID NO: 5409634 - DNA, 18 bp, Homo sapiens
cttaaaattgatattata

SEQ ID NO: 5409635 - DNA, 22 bp, Homo sapiens
cttaaaattgctagtgatttca

SEQ ID NO: 5409636 - DNA, 20 bp, Homo sapiens
cttaaaattggttaatgaaa

SEQ ID NO: 5409637 - DNA, 19 bp, Homo sapiens
cttaaaatttgaaacattg

SEQ ID NO: 5409638 - DNA, 23 bp, Homo sapiens
cttaaaatttgaaacattgcttt

SEQ ID NO: 5409639 - DNA, 19 bp, Homo sapiens
cttaaaattttcattctga

SEQ ID NO: 5409640 - DNA, 15 bp, Homo sapiens
cttaaacaaaaactt

SEQ ID NO: 5409641 - DNA, 14 bp, Homo sapiens
cttaaacaaaactg

SEQ ID NO: 5409642 - DNA, 15 bp, Homo sapiens
cttaaacaaaactgg

SEQ ID NO: 5409643 - DNA, 11 bp, Homo sapiens
cttaaacaaag

SEQ ID NO: 5409644 - DNA, 16 bp, Homo sapiens
cttaaacaaagcagta

SEQ ID NO: 5409645 - DNA, 13 bp, Homo sapiens
cttaaacaaagtg

SEQ ID NO: 5409646 - DNA, 16 bp, Homo sapiens
cttaaacaactgcaga

SEQ ID NO: 5409647 - DNA, 14 bp, Homo sapiens
cttaaacaatgtat

SEQ ID NO: 5409648 - DNA, 17 bp, Homo sapiens
cttaaacaatgtataaa

SEQ ID NO: 5409649 - DNA, 17 bp, Homo sapiens
cttaaacaatgtcctct

SEQ ID NO: 5409650 - DNA, 18 bp, Homo sapiens
cttaaacacaggctgtcc

SEQ ID NO: 5409651 - DNA, 15 bp, Homo sapiens
cttaaacacccctca

SEQ ID NO: 5409652 - DNA, 12 bp, Homo sapiens
cttaaacagcac

SEQ ID NO: 5409653 - DNA, 18 bp, Homo sapiens
cttaaacagttgcacagc

SEQ ID NO: 5409654 - DNA, 19 bp, Homo sapiens
cttaaacagttgcacagca

SEQ ID NO: 5409655 - DNA, 21 bp, Homo sapiens
cttaaacatgaatgaattctt

SEQ ID NO: 5409656 - DNA, 16 bp, Homo sapiens
cttaaacattgcctta

SEQ ID NO: 5409657 - DNA, 11 bp, Homo sapiens
cttaaacattt

SEQ ID NO: 5409658 - DNA, 14 bp, Homo sapiens
cttaaaccattttt

SEQ ID NO: 5409659 - DNA, 16 bp, Homo sapiens
cttaaaccatttttgc

SEQ ID NO: 5409660 - DNA, 22 bp, Homo sapiens
cttaaaccatttttgctgaatt

SEQ ID NO: 5409661 - DNA, 17 bp, Homo sapiens
cttaaacccacataaac

SEQ ID NO: 5409662 - DNA, 17 bp, Homo sapiens
cttaaacccatacaatg

SEQ ID NO: 5409663 - DNA, 18 bp, Homo sapiens
cttaaacccatacaatgt

SEQ ID NO: 5409664 - DNA, 23 bp, Homo sapiens
cttaaacctgaagatgtctcctc

SEQ ID NO: 5409665 - DNA, 14 bp, Homo sapiens
cttaaactaaataa

SEQ ID NO: 5409666 - DNA, 19 bp, Homo sapiens
cttaaactaaataatgaat

SEQ ID NO: 5409667 - DNA, 15 bp, Homo sapiens
cttaaactctcttct

SEQ ID NO: 5409668 - DNA, 18 bp, Homo sapiens
cttaaactctcttcttcc

SEQ ID NO: 5409669 - DNA, 20 bp, Homo sapiens
cttaaactctggacactcta

SEQ ID NO: 5409670 - DNA, 12 bp, Homo sapiens
cttaaactgaat

SEQ ID NO: 5409671 - DNA, 11 bp, Homo sapiens
cttaaactgta

SEQ ID NO: 5409672 - DNA, 17 bp, Homo sapiens
cttaaactgtacagaat

SEQ ID NO: 5409673 - DNA, 15 bp, Homo sapiens
cttaaactgtgtgga

SEQ ID NO: 5409674 - DNA, 18 bp, Homo sapiens
cttaaactgttcttcatt

SEQ ID NO: 5409675 - DNA, 17 bp, Homo sapiens
cttaaagaaacagcttt

SEQ ID NO: 5409676 - DNA, 23 bp, Homo sapiens
cttaaagaacagctaacaataaa

SEQ ID NO: 5409677 - DNA, 20 bp, Homo sapiens
cttaaagaagtatttttaga

SEQ ID NO: 5409678 - DNA, 18 bp, Homo sapiens
cttaaagaattcaaattt

SEQ ID NO: 5409679 - DNA, 15 bp, Homo sapiens
cttaaagactgaaat

SEQ ID NO: 5409680 - DNA, 18 bp, Homo sapiens
cttaaagatctcaacatg

SEQ ID NO: 5409681 - DNA, 20 bp, Homo sapiens
cttaaagatttatcaaatca

SEQ ID NO: 5409682 - DNA, 16 bp, Homo sapiens
cttaaagcaaaatagt

SEQ ID NO: 5409683 - DNA, 17 bp, Homo sapiens
cttaaagcaaaatagta

SEQ ID NO: 5409684 - DNA, 16 bp, Homo sapiens
cttaaagcaaagtcac

SEQ ID NO: 5409685 - DNA, 17 bp, Homo sapiens
cttaaagctactgtaga

SEQ ID NO: 5409686 - DNA, 18 bp, Homo sapiens
cttaaagctactgtagaa

SEQ ID NO: 5409687 - DNA, 22 bp, Homo sapiens
cttaaagctactgtagaaacaa

SEQ ID NO: 5409688 - DNA, 15 bp, Homo sapiens
cttaaagcttgattt

SEQ ID NO: 5409689 - DNA, 17 bp, Homo sapiens
cttaaagcttgatttga

SEQ ID NO: 5409690 - DNA, 20 bp, Homo sapiens
cttaaaggcaccatctaata

SEQ ID NO: 5409691 - DNA, 14 bp, Homo sapiens
cttaaaggcctgga

SEQ ID NO: 5409692 - DNA, 23 bp, Homo sapiens
cttaaaggctgtggtagtactcc

SEQ ID NO: 5409693 - DNA, 20 bp, Homo sapiens
cttaaaggggcctgcgcagg

SEQ ID NO: 5409694 - DNA, 20 bp, Homo sapiens
cttaaaggtcaaggaaggaa

SEQ ID NO: 5409695 - DNA, 14 bp, Homo sapiens
cttaaagtcaggag

SEQ ID NO: 5409696 - DNA, 14 bp, Homo sapiens
cttaaagtgaagga

SEQ ID NO: 5409697 - DNA, 19 bp, Homo sapiens
cttaaagtgaaggaaataa

SEQ ID NO: 5409698 - DNA, 20 bp, Homo sapiens
cttaaagtgaaggaaataaa

SEQ ID NO: 5409699 - DNA, 20 bp, Homo sapiens
cttaaagtggtcatattatt

SEQ ID NO: 5409700 - DNA, 18 bp, Homo sapiens
cttaaagttgaatttatt

SEQ ID NO: 5409701 - DNA, 20 bp, Homo sapiens
cttaaagttggtattaataa

SEQ ID NO: 5409702 - DNA, 15 bp, Homo sapiens
cttaaagttgtcact

SEQ ID NO: 5409703 - DNA, 16 bp, Homo sapiens
cttaaataaaaataat

SEQ ID NO: 5409704 - DNA, 13 bp, Homo sapiens
cttaaataaaact

SEQ ID NO: 5409705 - DNA, 23 bp, Homo sapiens
cttaaataaaagaaatgcacaat

SEQ ID NO: 5409706 - DNA, 12 bp, Homo sapiens
cttaaataaatt

SEQ ID NO: 5409707 - DNA, 20 bp, Homo sapiens
cttaaataacaaaactgtgc

SEQ ID NO: 5409708 - DNA, 21 bp, Homo sapiens
cttaaataataaacagtggaa

SEQ ID NO: 5409709 - DNA, 22 bp, Homo sapiens
cttaaataataaagatcatgta

SEQ ID NO: 5409710 - DNA, 16 bp, Homo sapiens
cttaaatacagctttt

SEQ ID NO: 5409711 - DNA, 16 bp, Homo sapiens
cttaaatactttaatg

SEQ ID NO: 5409712 - DNA, 17 bp, Homo sapiens
cttaaatagctttgaga

SEQ ID NO: 5409713 - DNA, 13 bp, Homo sapiens
cttaaatatagtt

SEQ ID NO: 5409714 - DNA, 15 bp, Homo sapiens
cttaaatatagttcc

SEQ ID NO: 5409715 - DNA, 22 bp, Homo sapiens
cttaaatatagttcctaagaag

SEQ ID NO: 5409716 - DNA, 22 bp, Homo sapiens
cttaaatatatcccatatattt

SEQ ID NO: 5409717 - DNA, 16 bp, Homo sapiens
cttaaatatcttttat

SEQ ID NO: 5409718 - DNA, 13 bp, Homo sapiens
cttaaatatgaat

SEQ ID NO: 5409719 - DNA, 15 bp, Homo sapiens
cttaaatatgaattc

SEQ ID NO: 5409720 - DNA, 18 bp, Homo sapiens
cttaaatatgaattctgt

SEQ ID NO: 5409721 - DNA, 12 bp, Homo sapiens
cttaaatatgta

SEQ ID NO: 5409722 - DNA, 15 bp, Homo sapiens
cttaaatattgtaat

SEQ ID NO: 5409723 - DNA, 21 bp, Homo sapiens
cttaaatattgtaatatgaca

SEQ ID NO: 5409724 - DNA, 15 bp, Homo sapiens
cttaaatatttgaaa

SEQ ID NO: 5409725 - DNA, 23 bp, Homo sapiens
cttaaatcactgaggcattttta

SEQ ID NO: 5409726 - DNA, 15 bp, Homo sapiens
cttaaatcagaataa

SEQ ID NO: 5409727 - DNA, 11 bp, Homo sapiens
cttaaatctta

SEQ ID NO: 5409728 - DNA, 13 bp, Homo sapiens
cttaaatgaacac

SEQ ID NO: 5409729 - DNA, 17 bp, Homo sapiens
cttaaatgaactactgc

SEQ ID NO: 5409730 - DNA, 20 bp, Homo sapiens
cttaaatgaactactgctat

SEQ ID NO: 5409731 - DNA, 16 bp, Homo sapiens
cttaaatgacagtgaa

SEQ ID NO: 5409732 - DNA, 16 bp, Homo sapiens
cttaaatgctcataaa

SEQ ID NO: 5409733 - DNA, 19 bp, Homo sapiens
cttaaatgctcataaagat

SEQ ID NO: 5409734 - DNA, 16 bp, Homo sapiens
cttaaatggaattatt

SEQ ID NO: 5409735 - DNA, 23 bp, Homo sapiens
cttaaatggtgtaattttgtcct

SEQ ID NO: 5409736 - DNA, 21 bp, Homo sapiens
cttaaatgtagcaatggcact

SEQ ID NO: 5409737 - DNA, 13 bp, Homo sapiens
cttaaatgtgaat

SEQ ID NO: 5409738 - DNA, 14 bp, Homo sapiens
cttaaatgtgaatt

SEQ ID NO: 5409739 - DNA, 22 bp, Homo sapiens
cttaaatgtgaattactaactt

SEQ ID NO: 5409740 - DNA, 18 bp, Homo sapiens
cttaaatgttatgtatat

SEQ ID NO: 5409741 - DNA, 20 bp, Homo sapiens
cttaaatgtttatactgtat

SEQ ID NO: 5409742 - DNA, 18 bp, Homo sapiens
cttaaatgttttcattgg

SEQ ID NO: 5409743 - DNA, 11 bp, Homo sapiens
cttaaattaaa

SEQ ID NO: 5409744 - DNA, 14 bp, Homo sapiens
cttaaattaaacaa

SEQ ID NO: 5409745 - DNA, 15 bp, Homo sapiens
cttaaattaaacaat

SEQ ID NO: 5409746 - DNA, 19 bp, Homo sapiens
cttaaattaaacaatttat

SEQ ID NO: 5409747 - DNA, 20 bp, Homo sapiens
cttaaattaaacaatttatt

SEQ ID NO: 5409748 - DNA, 22 bp, Homo sapiens
cttaaattaaacaatttatttt

SEQ ID NO: 5409749 - DNA, 19 bp, Homo sapiens
cttaaattagtacagcact

SEQ ID NO: 5409750 - DNA, 16 bp, Homo sapiens
cttaaattatgtttta

SEQ ID NO: 5409751 - DNA, 12 bp, Homo sapiens
cttaaattcatt

SEQ ID NO: 5409752 - DNA, 22 bp, Homo sapiens
cttaaattcatttctagactca

SEQ ID NO: 5409753 - DNA, 20 bp, Homo sapiens
cttaaattccaaactatgac

SEQ ID NO: 5409754 - DNA, 15 bp, Homo sapiens
cttaaattcttttga

SEQ ID NO: 5409755 - DNA, 22 bp, Homo sapiens
cttaaattgtgggcaaaagaga

SEQ ID NO: 5409756 - DNA, 16 bp, Homo sapiens
cttaaatttaatacca

SEQ ID NO: 5409757 - DNA, 14 bp, Homo sapiens
cttaaatttcttat

SEQ ID NO: 5409758 - DNA, 22 bp, Homo sapiens
cttaaatttcttatgtgacatt

SEQ ID NO: 5409759 - DNA, 13 bp, Homo sapiens
cttaaatttggtt

SEQ ID NO: 5409760 - DNA, 15 bp, Homo sapiens
cttaaatttgttctt

SEQ ID NO: 5409761 - DNA, 18 bp, Homo sapiens
cttaaattttaatttatt

SEQ ID NO: 5409762 - DNA, 17 bp, Homo sapiens
cttaaattttcttcctt

SEQ ID NO: 5409763 - DNA, 21 bp, Homo sapiens
cttaaatttttagccatttct

SEQ ID NO: 5409764 - DNA, 15 bp, Homo sapiens
cttaaatttttgtca

SEQ ID NO: 5409765 - DNA, 17 bp, Homo sapiens
cttaacaaaccaacatc

SEQ ID NO: 5409766 - DNA, 20 bp, Homo sapiens
cttaacaaaccaacatcttt

SEQ ID NO: 5409767 - DNA, 18 bp, Homo sapiens
cttaacaaactcttcagt

SEQ ID NO: 5409768 - DNA, 14 bp, Homo sapiens
cttaacaaatacat

SEQ ID NO: 5409769 - DNA, 21 bp, Homo sapiens
cttaacaacagcttcttgctt

SEQ ID NO: 5409770 - DNA, 22 bp, Homo sapiens
cttaacaagatatttatatgtt

SEQ ID NO: 5409771 - DNA, 15 bp, Homo sapiens
cttaacacctgatct

SEQ ID NO: 5409772 - DNA, 20 bp, Homo sapiens
cttaacacctgatctggccc

SEQ ID NO: 5409773 - DNA, 13 bp, Homo sapiens
cttactgcctgac

SEQ ID NO: 5409774 - DNA, 18 bp, Homo sapiens
cttactgcctgaccttgg

SEQ ID NO: 5409775 - DNA, 18 bp, Homo sapiens
cttactgctgaccttttt

SEQ ID NO: 5409776 - DNA, 12 bp, Homo sapiens
cttactggaaaa

SEQ ID NO: 5409777 - DNA, 19 bp, Homo sapiens
cttactgggccctggggaa

SEQ ID NO: 5409778 - DNA, 15 bp, Homo sapiens
cttactgtagcctca

SEQ ID NO: 5409779 - DNA, 19 bp, Homo sapiens
cttactgtcggtgtcccct

SEQ ID NO: 5409780 - DNA, 16 bp, Homo sapiens
cttactgtctcactcg

SEQ ID NO: 5409781 - DNA, 18 bp, Homo sapiens
cttactgtggaggaagga

SEQ ID NO: 5409782 - DNA, 21 bp, Homo sapiens
cttactgtgttaaaatttttt

SEQ ID NO: 5409783 - DNA, 11 bp, Homo sapiens
cttactgttga

SEQ ID NO: 5409784 - DNA, 13 bp, Homo sapiens
cttactgtttctg

SEQ ID NO: 5409785 - DNA, 16 bp, Homo sapiens
cttactgtttctgtca

SEQ ID NO: 5409786 - DNA, 23 bp, Homo sapiens
cttacttaaacccagctcccttc

SEQ ID NO: 5409787 - DNA, 16 bp, Homo sapiens
cttacttagaatttat

SEQ ID NO: 5409788 - DNA, 18 bp, Homo sapiens
cttacttattatcttcag

SEQ ID NO: 5409789 - DNA, 11 bp, Homo sapiens
cttacttccag

SEQ ID NO: 5409790 - DNA, 20 bp, Homo sapiens
cttacttccagcaaaatcca

SEQ ID NO: 5409791 - DNA, 21 bp, Homo sapiens
cttacttcccccaccctgggt

SEQ ID NO: 5409792 - DNA, 23 bp, Homo sapiens
cttacttcctggcctcttctggg

SEQ ID NO: 5409793 - DNA, 21 bp, Homo sapiens
cttacttcggttcctctgatt

SEQ ID NO: 5409794 - DNA, 14 bp, Homo sapiens
cttacttctcacta

SEQ ID NO: 5409795 - DNA, 13 bp, Homo sapiens
cttacttgcactg

SEQ ID NO: 5409796 - DNA, 24 bp, Homo sapiens
cttacttgcataccaagttgatac

SEQ ID NO: 5409797 - DNA, 19 bp, Homo sapiens
cttacttggaactgaaggg

SEQ ID NO: 5409798 - DNA, 13 bp, Homo sapiens
cttacttgtcctt

SEQ ID NO: 5409799 - DNA, 19 bp, Homo sapiens
cttactttacctctctgtc

SEQ ID NO: 5409800 - DNA, 20 bp, Homo sapiens
cttactttacctctctgtca

SEQ ID NO: 5409801 - DNA, 23 bp, Homo sapiens
cttactttcctttccccagccca

SEQ ID NO: 5409802 - DNA, 11 bp, Homo sapiens
cttactttgta

SEQ ID NO: 5409803 - DNA, 12 bp, Homo sapiens
cttactttgtaa

SEQ ID NO: 5409804 - DNA, 19 bp, Homo sapiens
cttactttgtatgatattc

SEQ ID NO: 5409805 - DNA, 17 bp, Homo sapiens
cttacttttactgtcta

SEQ ID NO: 5409806 - DNA, 17 bp, Homo sapiens
cttacttttattatttt

SEQ ID NO: 5409807 - DNA, 19 bp, Homo sapiens
cttacttttccagtctgta

SEQ ID NO: 5409808 - DNA, 22 bp, Homo sapiens
cttacttttccagtctgtacag

SEQ ID NO: 5409809 - DNA, 17 bp, Homo sapiens
cttactttttaattttt

SEQ ID NO: 5409810 - DNA, 16 bp, Homo sapiens
cttactttttatatat

SEQ ID NO: 5409811 - DNA, 17 bp, Homo sapiens
cttactttttatatata

SEQ ID NO: 5409812 - DNA, 12 bp, Homo sapiens
cttagaaaaaaa

SEQ ID NO: 5409813 - DNA, 20 bp, Homo sapiens
cttagaaaaaccaccaccat

SEQ ID NO: 5409814 - DNA, 11 bp, Homo sapiens
cttagaaaacc

SEQ ID NO: 5409815 - DNA, 23 bp, Homo sapiens
cttagaaaaccagctcagcactg

SEQ ID NO: 5409816 - DNA, 21 bp, Homo sapiens
cttagaaaataaatacaagtt

SEQ ID NO: 5409817 - DNA, 14 bp, Homo sapiens
cttagaaaattaaa

SEQ ID NO: 5409818 - DNA, 19 bp, Homo sapiens
cttagaaaattcactattg

SEQ ID NO: 5409819 - DNA, 14 bp, Homo sapiens
cttagaaacatgtt

SEQ ID NO: 5409820 - DNA, 11 bp, Homo sapiens
cttagaaactg

SEQ ID NO: 5409821 - DNA, 14 bp, Homo sapiens
cttagaaagcaggg

SEQ ID NO: 5409822 - DNA, 14 bp, Homo sapiens
cttagaaagggaag

SEQ ID NO: 5409823 - DNA, 23 bp, Homo sapiens
cttagaaatcattgtagaaacac

SEQ ID NO: 5409824 - DNA, 15 bp, Homo sapiens
cttagaaatttattt

SEQ ID NO: 5409825 - DNA, 21 bp, Homo sapiens
cttagaacagatggctgtgaa

SEQ ID NO: 5409826 - DNA, 22 bp, Homo sapiens
cttagaacagatggctgtgaaa

SEQ ID NO: 5409827 - DNA, 23 bp, Homo sapiens
cttagaacagatggctgtgaaaa

SEQ ID NO: 5409828 - DNA, 18 bp, Homo sapiens
cttagaacctttctgtgt

SEQ ID NO: 5409829 - DNA, 16 bp, Homo sapiens
cttagaagaaatatga

SEQ ID NO: 5409830 - DNA, 14 bp, Homo sapiens
cttagaagatgttg

SEQ ID NO: 5409831 - DNA, 15 bp, Homo sapiens
cttagaagatgttgt

SEQ ID NO: 5409832 - DNA, 15 bp, Homo sapiens
cttagaagcatcaga

SEQ ID NO: 5409833 - DNA, 13 bp, Homo sapiens
cttagaaggcact

SEQ ID NO: 5409834 - DNA, 18 bp, Homo sapiens
cttagaagtgttgtaaaa

SEQ ID NO: 5409835 - DNA, 19 bp, Homo sapiens
cttagaagtgttgtaaaag

SEQ ID NO: 5409836 - DNA, 18 bp, Homo sapiens
cttagaagtttgttgtga

SEQ ID NO: 5409837 - DNA, 17 bp, Homo sapiens
cttagaatccaaacttg

SEQ ID NO: 5409838 - DNA, 19 bp, Homo sapiens
cttagaatccctgtgttaa

SEQ ID NO: 5409839 - DNA, 20 bp, Homo sapiens
cttagaatccctgtgttaat

SEQ ID NO: 5409840 - DNA, 21 bp, Homo sapiens
cttagaatctgtagaggagcc

SEQ ID NO: 5409841 - DNA, 23 bp, Homo sapiens
cttagaatgtttctatttccata

SEQ ID NO: 5409842 - DNA, 18 bp, Homo sapiens
cttagaattgaggagttg

SEQ ID NO: 5409843 - DNA, 18 bp, Homo sapiens
cttagaatttatccttta

SEQ ID NO: 5409844 - DNA, 23 bp, Homo sapiens
cttagaatttgtttcatctattt

SEQ ID NO: 5409845 - DNA, 18 bp, Homo sapiens
cttagacaaatgatcacc

SEQ ID NO: 5409846 - DNA, 20 bp, Homo sapiens
cttagacaccacctggagtg

SEQ ID NO: 5409847 - DNA, 11 bp, Homo sapiens
cttagacagtc

SEQ ID NO: 5409848 - DNA, 17 bp, Homo sapiens
cttagacagtccctgcc

SEQ ID NO: 5409849 - DNA, 15 bp, Homo sapiens
cttagaccaccaagc

SEQ ID NO: 5409850 - DNA, 20 bp, Homo sapiens
cttagaccaccaagccttga

SEQ ID NO: 5409851 - DNA, 14 bp, Homo sapiens
cttagacccatgct

SEQ ID NO: 5409852 - DNA, 15 bp, Homo sapiens
cttagacccatgctg

SEQ ID NO: 5409853 - DNA, 17 bp, Homo sapiens
cttagacccgccaggtc

SEQ ID NO: 5409854 - DNA, 23 bp, Homo sapiens
cttagaccctcatgctgccaata

SEQ ID NO: 5409855 - DNA, 14 bp, Homo sapiens
cttagacctcagcc

SEQ ID NO: 5409856 - DNA, 17 bp, Homo sapiens
cttagacctcagcctgt

SEQ ID NO: 5409857 - DNA, 18 bp, Homo sapiens
cttagacctcagcctgtg

SEQ ID NO: 5409858 - DNA, 17 bp, Homo sapiens
cttagacctcttcctgg

SEQ ID NO: 5409859 - DNA, 22 bp, Homo sapiens
cttagacctcttcctggaataa

SEQ ID NO: 5409860 - DNA, 14 bp, Homo sapiens
cttagacctgccag

SEQ ID NO: 5409861 - DNA, 18 bp, Homo sapiens
cttagacctgccagccac

SEQ ID NO: 5409862 - DNA, 14 bp, Homo sapiens
cttagacttctgct

SEQ ID NO: 5409863 - DNA, 21 bp, Homo sapiens
cttagacttttccaatatgtg

SEQ ID NO: 5409864 - DNA, 22 bp, Homo sapiens
cttagacttttccaatatgtga

SEQ ID NO: 5409865 - DNA, 20 bp, Homo sapiens
cttagagaatgttctcctaa

SEQ ID NO: 5409866 - DNA, 22 bp, Homo sapiens
cttagagacaaaccttaaaaca

SEQ ID NO: 5409867 - DNA, 11 bp, Homo sapiens
cttagagagag

SEQ ID NO: 5409868 - DNA, 14 bp, Homo sapiens
cttagagaggaaaa

SEQ ID NO: 5409869 - DNA, 13 bp, Homo sapiens
cttagagatatgt

SEQ ID NO: 5409870 - DNA, 12 bp, Homo sapiens
cttagagatgat

SEQ ID NO: 5409871 - DNA, 17 bp, Homo sapiens
cttagagattttcattt

SEQ ID NO: 5409872 - DNA, 11 bp, Homo sapiens
cttagagcagt

SEQ ID NO: 5409873 - DNA, 22 bp, Homo sapiens
cttagagcagtttctgtcctgc

SEQ ID NO: 5409874 - DNA, 14 bp, Homo sapiens
cttagagccaggca

SEQ ID NO: 5409875 - DNA, 16 bp, Homo sapiens
cttagagccaggcaca

SEQ ID NO: 5409876 - DNA, 14 bp, Homo sapiens
cttagaggaaaagg

SEQ ID NO: 5409877 - DNA, 19 bp, Homo sapiens
cttagagggatttctttgc

SEQ ID NO: 5409878 - DNA, 23 bp, Homo sapiens
cttagaggggaatgaaccatggc

SEQ ID NO: 5409879 - DNA, 21 bp, Homo sapiens
cttagaggtaggtgtattccc

SEQ ID NO: 5409880 - DNA, 19 bp, Homo sapiens
cttagaggttctgcctcta

SEQ ID NO: 5409881 - DNA, 18 bp, Homo sapiens
cttagagtgcccagcaga

SEQ ID NO: 5409882 - DNA, 19 bp, Homo sapiens
cttagagtgtagctgtaag

SEQ ID NO: 5409883 - DNA, 12 bp, Homo sapiens
cttagataactt

SEQ ID NO: 5409884 - DNA, 18 bp, Homo sapiens
cttagatacactaaaaat

SEQ ID NO: 5409885 - DNA, 20 bp, Homo sapiens
cttagatatctttttattga

SEQ ID NO: 5409886 - DNA, 18 bp, Homo sapiens
cttagatattaaaatttg

SEQ ID NO: 5409887 - DNA, 14 bp, Homo sapiens
cttagatatttcat

SEQ ID NO: 5409888 - DNA, 15 bp, Homo sapiens
cttagatatttcatg

SEQ ID NO: 5409889 - DNA, 18 bp, Homo sapiens
cttagatatttcatgtgc

SEQ ID NO: 5409890 - DNA, 13 bp, Homo sapiens
cttagatcatagt

SEQ ID NO: 5409891 - DNA, 17 bp, Homo sapiens
cttagatcatagtttta

SEQ ID NO: 5409892 - DNA, 18 bp, Homo sapiens
cttagatcatagttttat

SEQ ID NO: 5409893 - DNA, 18 bp, Homo sapiens
cttagatctctcctgcaa

SEQ ID NO: 5409894 - DNA, 19 bp, Homo sapiens
cttagatgagggtgactgt

SEQ ID NO: 5409895 - DNA, 22 bp, Homo sapiens
cttagatgcagcgactgtttca

SEQ ID NO: 5409896 - DNA, 17 bp, Homo sapiens
cttagatgttaaatgtt

SEQ ID NO: 5409897 - DNA, 18 bp, Homo sapiens
cttagatgttaaatgtta

SEQ ID NO: 5409898 - DNA, 20 bp, Homo sapiens
cttagatgttccagtaatct

SEQ ID NO: 5409899 - DNA, 14 bp, Homo sapiens
cttagatgttctaa

SEQ ID NO: 5409900 - DNA, 16 bp, Homo sapiens
cttagatgtttcacac

SEQ ID NO: 5409901 - DNA, 16 bp, Homo sapiens
cttagattagctctgg

SEQ ID NO: 5409902 - DNA, 18 bp, Homo sapiens
cttagattagctctggac

SEQ ID NO: 5409903 - DNA, 20 bp, Homo sapiens
cttagattagctctggacca

SEQ ID NO: 5409904 - DNA, 17 bp, Homo sapiens
cttagattcaggggaag

SEQ ID NO: 5409905 - DNA, 19 bp, Homo sapiens
cttagattcaggggaaggg

SEQ ID NO: 5409906 - DNA, 12 bp, Homo sapiens
cttagcaacagc

SEQ ID NO: 5409907 - DNA, 12 bp, Homo sapiens
cttagcacagag

SEQ ID NO: 5409908 - DNA, 15 bp, Homo sapiens
cttagcacagagagg

SEQ ID NO: 5409909 - DNA, 16 bp, Homo sapiens
cttagcacagagaggg

SEQ ID NO: 5409910 - DNA, 11 bp, Homo sapiens
cttagcagccc

SEQ ID NO: 5409911 - DNA, 13 bp, Homo sapiens
cttagcagcccag

SEQ ID NO: 5409912 - DNA, 14 bp, Homo sapiens
cttagcagcccagc

SEQ ID NO: 5409913 - DNA, 14 bp, Homo sapiens
cttagcagccctgg

SEQ ID NO: 5409914 - DNA, 15 bp, Homo sapiens
cttagcagccctgga

SEQ ID NO: 5409915 - DNA, 13 bp, Homo sapiens
cttagcagctcag

SEQ ID NO: 5409916 - DNA, 14 bp, Homo sapiens
cttagcagctcagg

SEQ ID NO: 5409917 - DNA, 15 bp, Homo sapiens
cttagcagctcaggc

SEQ ID NO: 5409918 - DNA, 18 bp, Homo sapiens
cttagcagctcaggcgca

SEQ ID NO: 5409919 - DNA, 23 bp, Homo sapiens
cttagcagctcttcccctttcct

SEQ ID NO: 5409920 - DNA, 17 bp, Homo sapiens
cttagcagcttccagat

SEQ ID NO: 5409921 - DNA, 18 bp, Homo sapiens
cttagcagcttccagatt

SEQ ID NO: 5409922 - DNA, 14 bp, Homo sapiens
cttagcagggacag

SEQ ID NO: 5409923 - DNA, 15 bp, Homo sapiens
cttagcagggacagg

SEQ ID NO: 5409924 - DNA, 15 bp, Homo sapiens
cttagcaggggtgac

SEQ ID NO: 5409925 - DNA, 21 bp, Homo sapiens
cttagcatcagaggtttgctt

SEQ ID NO: 5409926 - DNA, 22 bp, Homo sapiens
cttagcatcctaagaaatatgt

SEQ ID NO: 5409927 - DNA, 14 bp, Homo sapiens
cttagcatgcacaa

SEQ ID NO: 5409928 - DNA, 22 bp, Homo sapiens
cttagcatgcctccaaaaattc

SEQ ID NO: 5409929 - DNA, 14 bp, Homo sapiens
cttagcatggtacc

SEQ ID NO: 5409930 - DNA, 11 bp, Homo sapiens
cttagcatgtg

SEQ ID NO: 5409931 - DNA, 21 bp, Homo sapiens
cttagcatgtgactcctgaag

SEQ ID NO: 5409932 - DNA, 14 bp, Homo sapiens
cttagccaagccct

SEQ ID NO: 5409933 - DNA, 18 bp, Homo sapiens
cttagccagttcaaagtg

SEQ ID NO: 5409934 - DNA, 14 bp, Homo sapiens
cttagcccaagagg

SEQ ID NO: 5409935 - DNA, 18 bp, Homo sapiens
cttagcccaagaggtctg

SEQ ID NO: 5409936 - DNA, 22 bp, Homo sapiens
cttagcccaagaggtctgagcc

SEQ ID NO: 5409937 - DNA, 23 bp, Homo sapiens
cttagcccaagaggtctgagccc

SEQ ID NO: 5409938 - DNA, 21 bp, Homo sapiens
cttagccccttggattcctgc

SEQ ID NO: 5409939 - DNA, 23 bp, Homo sapiens
cttagcccggatgcccacccctg

SEQ ID NO: 5409940 - DNA, 23 bp, Homo sapiens
cttagcccgtcacccttatttat

SEQ ID NO: 5409941 - DNA, 19 bp, Homo sapiens
cttagccctcaccacagcc

SEQ ID NO: 5409942 - DNA, 20 bp, Homo sapiens
cttagccctcaccacagcct

SEQ ID NO: 5409943 - DNA, 19 bp, Homo sapiens
cttagccgactgcgctgct

SEQ ID NO: 5409944 - DNA, 22 bp, Homo sapiens
cttagccgtccatggcaccagc

SEQ ID NO: 5409945 - DNA, 11 bp, Homo sapiens
cttagcctccc

SEQ ID NO: 5409946 - DNA, 21 bp, Homo sapiens
cttagcctcctgacctgaggc

SEQ ID NO: 5409947 - DNA, 22 bp, Homo sapiens
cttagcctcctgacctgaggct

SEQ ID NO: 5409948 - DNA, 14 bp, Homo sapiens
cttagcctctccca

SEQ ID NO: 5409949 - DNA, 16 bp, Homo sapiens
cttagcctctcccacc

SEQ ID NO: 5409950 - DNA, 18 bp, Homo sapiens
cttagcctctcccacccg

SEQ ID NO: 5409951 - DNA, 14 bp, Homo sapiens
cttatggcatctca

SEQ ID NO: 5409952 - DNA, 15 bp, Homo sapiens
cttatggccacagcc

SEQ ID NO: 5409953 - DNA, 20 bp, Homo sapiens
cttatgggatcatttttcca

SEQ ID NO: 5409954 - DNA, 21 bp, Homo sapiens
cttatgggctgggttctaccc

SEQ ID NO: 5409955 - DNA, 22 bp, Homo sapiens
cttatggggacagcataccttg

SEQ ID NO: 5409956 - DNA, 17 bp, Homo sapiens
cttatgggggtgtttct

SEQ ID NO: 5409957 - DNA, 20 bp, Homo sapiens
cttatgggtggctttcaagg

SEQ ID NO: 5409958 - DNA, 13 bp, Homo sapiens
cttatggtaccag

SEQ ID NO: 5409959 - DNA, 13 bp, Homo sapiens
cttatgtaaagta

SEQ ID NO: 5409960 - DNA, 14 bp, Homo sapiens
cttatgtaaagtat

SEQ ID NO: 5409961 - DNA, 17 bp, Homo sapiens
cttatgtaagtttgcat

SEQ ID NO: 5409962 - DNA, 15 bp, Homo sapiens
cttatgtacaaaact

SEQ ID NO: 5409963 - DNA, 15 bp, Homo sapiens
cttatgtacagaaaa

SEQ ID NO: 5409964 - DNA, 15 bp, Homo sapiens
cttatgtacttgata

SEQ ID NO: 5409965 - DNA, 23 bp, Homo sapiens
cttatgtacttgatactgaatgc

SEQ ID NO: 5409966 - DNA, 15 bp, Homo sapiens
cttatgtagaaactg

SEQ ID NO: 5409967 - DNA, 16 bp, Homo sapiens
cttatgtagatatttg

SEQ ID NO: 5409968 - DNA, 12 bp, Homo sapiens
cttatgtatgtg

SEQ ID NO: 5409969 - DNA, 19 bp, Homo sapiens
cttatgtattattttctat

SEQ ID NO: 5409970 - DNA, 23 bp, Homo sapiens
cttatgtcatttcttctctctgt

SEQ ID NO: 5409971 - DNA, 23 bp, Homo sapiens
cttatgtccaccacttcagggga

SEQ ID NO: 5409972 - DNA, 18 bp, Homo sapiens
cttatgtctctacatggt

SEQ ID NO: 5409973 - DNA, 14 bp, Homo sapiens
cttatgtctctgcc

SEQ ID NO: 5409974 - DNA, 19 bp, Homo sapiens
cttatgtgaaaaattaact

SEQ ID NO: 5409975 - DNA, 21 bp, Homo sapiens
cttatgtgaaaaattaacttt

SEQ ID NO: 5409976 - DNA, 23 bp, Homo sapiens
cttatgtgacattaacaaataaa

SEQ ID NO: 5409977 - DNA, 22 bp, Homo sapiens
cttatgtggggttgtcaaaact

SEQ ID NO: 5409978 - DNA, 23 bp, Homo sapiens
cttatgtgggtcttatgcttcca

SEQ ID NO: 5409979 - DNA, 17 bp, Homo sapiens
cttatgtgttacattat

SEQ ID NO: 5409980 - DNA, 21 bp, Homo sapiens
cttatgtgttacattattcca

SEQ ID NO: 5409981 - DNA, 16 bp, Homo sapiens
cttatgttgaaaaaat

SEQ ID NO: 5409982 - DNA, 18 bp, Homo sapiens
cttatgtttgaagagaaa

SEQ ID NO: 5409983 - DNA, 17 bp, Homo sapiens
cttattaaaaaatttgt

SEQ ID NO: 5409984 - DNA, 18 bp, Homo sapiens
cttattaaaaaatttgta

SEQ ID NO: 5409985 - DNA, 13 bp, Homo sapiens
cttattaaaatat

SEQ ID NO: 5409986 - DNA, 15 bp, Homo sapiens
cttattaaaatattt

SEQ ID NO: 5409987 - DNA, 23 bp, Homo sapiens
cttattaaaatattttcttaatt

SEQ ID NO: 5409988 - DNA, 20 bp, Homo sapiens
cttattaaagtttcaaaaat

SEQ ID NO: 5409989 - DNA, 23 bp, Homo sapiens
cttattaaagtttcaaaaatctg

SEQ ID NO: 5409990 - DNA, 21 bp, Homo sapiens
cttattaacaattaggcagac

SEQ ID NO: 5409991 - DNA, 22 bp, Homo sapiens
cttattaaccaaattaaccttt

SEQ ID NO: 5409992 - DNA, 15 bp, Homo sapiens
cttattaagaccaaa

SEQ ID NO: 5409993 - DNA, 18 bp, Homo sapiens
cttattaagactggcttt

SEQ ID NO: 5409994 - DNA, 21 bp, Homo sapiens
cttattaatcatacaaactct

SEQ ID NO: 5409995 - DNA, 12 bp, Homo sapiens
cttattaatttc

SEQ ID NO: 5409996 - DNA, 15 bp, Homo sapiens
cttattacagaggga

SEQ ID NO: 5409997 - DNA, 17 bp, Homo sapiens
cttattacataactgat

SEQ ID NO: 5409998 - DNA, 20 bp, Homo sapiens
cttattacataactgatcta

SEQ ID NO: 5409999 - DNA, 22 bp, Homo sapiens
cttattacataactgatctatt

SEQ ID NO: 5410000 - DNA, 14 bp, Homo sapiens
cttattacatttaa

SEQ ID NO: 5410001 - DNA, 14 bp, Homo sapiens
cttattacccaaac

SEQ ID NO: 5410002 - DNA, 17 bp, Homo sapiens
cttattacccaggaaga

SEQ ID NO: 5410003 - DNA, 22 bp, Homo sapiens
cttattactgagagtgcaaatt

SEQ ID NO: 5410004 - DNA, 20 bp, Homo sapiens
cttattagaaaaatattata

SEQ ID NO: 5410005 - DNA, 17 bp, Homo sapiens
cttattagaacaggcaa

SEQ ID NO: 5410006 - DNA, 18 bp, Homo sapiens
cttattagctgtagagtc

SEQ ID NO: 5410007 - DNA, 15 bp, Homo sapiens
cttattatagaattg

SEQ ID NO: 5410008 - DNA, 18 bp, Homo sapiens
cttattatattgtccagg

SEQ ID NO: 5410009 - DNA, 14 bp, Homo sapiens
cttattatcccagc

SEQ ID NO: 5410010 - DNA, 17 bp, Homo sapiens
cttattattaataatga

SEQ ID NO: 5410011 - DNA, 15 bp, Homo sapiens
cttattattgaagga

SEQ ID NO: 5410012 - DNA, 23 bp, Homo sapiens
cttattattgatgataagattta

SEQ ID NO: 5410013 - DNA, 14 bp, Homo sapiens
cttattatttttga

SEQ ID NO: 5410014 - DNA, 17 bp, Homo sapiens
cttattcaaagagaaaa

SEQ ID NO: 5410015 - DNA, 17 bp, Homo sapiens
cttattcaatatttact

SEQ ID NO: 5410016 - DNA, 17 bp, Homo sapiens
cttattcactgagtctc

SEQ ID NO: 5410017 - DNA, 17 bp, Homo sapiens
cttattcagttcttaca

SEQ ID NO: 5410018 - DNA, 21 bp, Homo sapiens
cttattcatgctttctccttt

SEQ ID NO: 5410019 - DNA, 17 bp, Homo sapiens
cttattcattttctcta

SEQ ID NO: 5410020 - DNA, 19 bp, Homo sapiens
cttattcattttctctaat

SEQ ID NO: 5410021 - DNA, 15 bp, Homo sapiens
cttattccaagtgca

SEQ ID NO: 5410022 - DNA, 20 bp, Homo sapiens
cttattccacagatatcttt

SEQ ID NO: 5410023 - DNA, 21 bp, Homo sapiens
cttattccaggtattaaaggt

SEQ ID NO: 5410024 - DNA, 16 bp, Homo sapiens
cttattccatattaga

SEQ ID NO: 5410025 - DNA, 22 bp, Homo sapiens
cttattccatattagaaaactt

SEQ ID NO: 5410026 - DNA, 21 bp, Homo sapiens
cttattcccaaactacagaat

SEQ ID NO: 5410027 - DNA, 19 bp, Homo sapiens
cttattcccaactgctctg

SEQ ID NO: 5410028 - DNA, 17 bp, Homo sapiens
cttattcccaattaaaa

SEQ ID NO: 5410029 - DNA, 18 bp, Homo sapiens
cttattcccaattaaaag

SEQ ID NO: 5410030 - DNA, 19 bp, Homo sapiens
cttattccctcatcctttc

SEQ ID NO: 5410031 - DNA, 18 bp, Homo sapiens
cttattccgagcattcca

SEQ ID NO: 5410032 - DNA, 18 bp, Homo sapiens
cttattcctaattcctgt

SEQ ID NO: 5410033 - DNA, 19 bp, Homo sapiens
cttattcctaattcctgta

SEQ ID NO: 5410034 - DNA, 14 bp, Homo sapiens
cttattcttaactt

SEQ ID NO: 5410035 - DNA, 16 bp, Homo sapiens
cttattctttgagtaa

SEQ ID NO: 5410036 - DNA, 13 bp, Homo sapiens
cttattcttttat

SEQ ID NO: 5410037 - DNA, 19 bp, Homo sapiens
cttattcttttataataat

SEQ ID NO: 5410038 - DNA, 11 bp, Homo sapiens
cttattgaaaa

SEQ ID NO: 5410039 - DNA, 16 bp, Homo sapiens
cttattgaaaaatcag

SEQ ID NO: 5410040 - DNA, 18 bp, Homo sapiens
cttattgaaaaatcagtg

SEQ ID NO: 5410041 - DNA, 15 bp, Homo sapiens
cttattgaagtgaat

SEQ ID NO: 5410042 - DNA, 23 bp, Homo sapiens
cttattgatcccacatttccatg

SEQ ID NO: 5410043 - DNA, 17 bp, Homo sapiens
cttattgatctttgccc

SEQ ID NO: 5410044 - DNA, 12 bp, Homo sapiens
cttattgcaaaa

SEQ ID NO: 5410045 - DNA, 13 bp, Homo sapiens
cttattgccaaaa

SEQ ID NO: 5410046 - DNA, 14 bp, Homo sapiens
cttattgcctcact

SEQ ID NO: 5410047 - DNA, 19 bp, Homo sapiens
cttattgcctcccaggcaa

SEQ ID NO: 5410048 - DNA, 14 bp, Homo sapiens
cttattgcgctgct

SEQ ID NO: 5410049 - DNA, 17 bp, Homo sapiens
cttattgcgctgctacc

SEQ ID NO: 5410050 - DNA, 19 bp, Homo sapiens
cttattgctgattttaatg

SEQ ID NO: 5410051 - DNA, 12 bp, Homo sapiens
cttattgctgcc

SEQ ID NO: 5410052 - DNA, 10 bp, Homo sapiens
cttattgctt

SEQ ID NO: 5410053 - DNA, 16 bp, Homo sapiens
cttattggaaggtatt

SEQ ID NO: 5410054 - DNA, 13 bp, Homo sapiens
cttattggccact

SEQ ID NO: 5410055 - DNA, 16 bp, Homo sapiens
cttattggccactggg

SEQ ID NO: 5410056 - DNA, 16 bp, Homo sapiens
cttattgggagtagga

SEQ ID NO: 5410057 - DNA, 18 bp, Homo sapiens
cttattgtaaattttaga

SEQ ID NO: 5410058 - DNA, 15 bp, Homo sapiens
cttattgtacctctc

SEQ ID NO: 5410059 - DNA, 18 bp, Homo sapiens
cttattgtacctctctta

SEQ ID NO: 5410060 - DNA, 15 bp, Homo sapiens
cttattgtagcatat

SEQ ID NO: 5410061 - DNA, 23 bp, Homo sapiens
cttattgtagcatcctggaatat

SEQ ID NO: 5410062 - DNA, 19 bp, Homo sapiens
cttattgtattcctcatgt

SEQ ID NO: 5410063 - DNA, 23 bp, Homo sapiens
cttattgtgtgcgctgcctggcc

SEQ ID NO: 5410064 - DNA, 14 bp, Homo sapiens
cttattgttccaag

SEQ ID NO: 5410065 - DNA, 15 bp, Homo sapiens
cttattgttccaaga

SEQ ID NO: 5410066 - DNA, 19 bp, Homo sapiens
cttattgttccaagacatt

SEQ ID NO: 5410067 - DNA, 12 bp, Homo sapiens
cttattgtttaa

SEQ ID NO: 5410068 - DNA, 18 bp, Homo sapiens
cttattgtttaatctttt

SEQ ID NO: 5410069 - DNA, 18 bp, Homo sapiens
cttattgtttctctgaaa

SEQ ID NO: 5410070 - DNA, 18 bp, Homo sapiens
cttattgtttgtaaacaa

SEQ ID NO: 5410071 - DNA, 22 bp, Homo sapiens
cttattgtttttggatggctta

SEQ ID NO: 5410072 - DNA, 13 bp, Homo sapiens
cttatttaaaaat

SEQ ID NO: 5410073 - DNA, 15 bp, Homo sapiens
cttatttaaaaatat

SEQ ID NO: 5410074 - DNA, 18 bp, Homo sapiens
cttatttaaaaatatttc

SEQ ID NO: 5410075 - DNA, 15 bp, Homo sapiens
cttatttaaaagatt

SEQ ID NO: 5410076 - DNA, 16 bp, Homo sapiens
cttatttaaaagattt

SEQ ID NO: 5410077 - DNA, 20 bp, Homo sapiens
cttatttaaaagattttatg

SEQ ID NO: 5410078 - DNA, 14 bp, Homo sapiens
cttatttaaataga

SEQ ID NO: 5410079 - DNA, 18 bp, Homo sapiens
cttatttaaatagatgac

SEQ ID NO: 5410080 - DNA, 13 bp, Homo sapiens
cttatttaagtat

SEQ ID NO: 5410081 - DNA, 16 bp, Homo sapiens
cttatttaatctccat

SEQ ID NO: 5410082 - DNA, 18 bp, Homo sapiens
cttatttaatctccattt

SEQ ID NO: 5410083 - DNA, 15 bp, Homo sapiens
cttatttaatctttt

SEQ ID NO: 5410084 - DNA, 15 bp, Homo sapiens
cttatttaatgaaag

SEQ ID NO: 5410085 - DNA, 19 bp, Homo sapiens
cttatttaatttttgcaat

SEQ ID NO: 5410086 - DNA, 19 bp, Homo sapiens
cttatttacagataacttc

SEQ ID NO: 5410087 - DNA, 19 bp, Homo sapiens
cttatttacctagtgcaaa

SEQ ID NO: 5410088 - DNA, 22 bp, Homo sapiens
cttatttacttgtagaaatctg

SEQ ID NO: 5410089 - DNA, 14 bp, Homo sapiens
cttatttatatatg

SEQ ID NO: 5410090 - DNA, 21 bp, Homo sapiens
cttatttatatgaagcaagct

SEQ ID NO: 5410091 - DNA, 23 bp, Homo sapiens
cttatttatatgaagcaagctgt

SEQ ID NO: 5410092 - DNA, 22 bp, Homo sapiens
cttatttatattcagagatgta

SEQ ID NO: 5410093 - DNA, 23 bp, Homo sapiens
cttatttatattcagagatgtac

SEQ ID NO: 5410094 - DNA, 21 bp, Homo sapiens
cttatttatattcatcaaata

SEQ ID NO: 5410095 - DNA, 19 bp, Homo sapiens
cttatttatcctagtattc

SEQ ID NO: 5410096 - DNA, 19 bp, Homo sapiens
cttatttattgttgccttt

SEQ ID NO: 5410097 - DNA, 20 bp, Homo sapiens
cttatttattgttgcctttt

SEQ ID NO: 5410098 - DNA, 21 bp, Homo sapiens
cttatttattgttgccttttc

SEQ ID NO: 5410099 - DNA, 15 bp, Homo sapiens
cttatttcataattg

SEQ ID NO: 5410100 - DNA, 18 bp, Homo sapiens
cttatttccctcatcttg

SEQ ID NO: 5410101 - DNA, 16 bp, Homo sapiens
cttatttctaactatt

SEQ ID NO: 5410102 - DNA, 20 bp, Homo sapiens
cttatttctcagctgtgcct

SEQ ID NO: 5410103 - DNA, 12 bp, Homo sapiens
cttatttctcat

SEQ ID NO: 5410104 - DNA, 14 bp, Homo sapiens
cttatttctctctc

SEQ ID NO: 5410105 - DNA, 17 bp, Homo sapiens
cttatttctgctctgga

SEQ ID NO: 5410106 - DNA, 12 bp, Homo sapiens
cttatttgaaag

SEQ ID NO: 5410107 - DNA, 15 bp, Homo sapiens
cttatttgcaataaa

SEQ ID NO: 5410108 - DNA, 16 bp, Homo sapiens
cttatttgcaataaaa

SEQ ID NO: 5410109 - DNA, 18 bp, Homo sapiens
cttatttgccagagccaa

SEQ ID NO: 5410110 - DNA, 22 bp, Homo sapiens
cttatttgccttctactcccct

SEQ ID NO: 5410111 - DNA, 13 bp, Homo sapiens
cttatttggaaat

SEQ ID NO: 5410112 - DNA, 15 bp, Homo sapiens
cttatttggaaattt

SEQ ID NO: 5410113 - DNA, 18 bp, Homo sapiens
cttatttggaattgacat

SEQ ID NO: 5410114 - DNA, 20 bp, Homo sapiens
cttatttggaattgacattc

SEQ ID NO: 5410115 - DNA, 13 bp, Homo sapiens
cttatttgtctgt

SEQ ID NO: 5410116 - DNA, 21 bp, Homo sapiens
cttatttgtctgtaaaaaatg

SEQ ID NO: 5410117 - DNA, 15 bp, Homo sapiens
cttattttacaaata

SEQ ID NO: 5410118 - DNA, 16 bp, Homo sapiens
cttattttacacagca

SEQ ID NO: 5410119 - DNA, 21 bp, Homo sapiens
cttattttagaaattataatt

SEQ ID NO: 5410120 - DNA, 14 bp, Homo sapiens
cttattttagacaa

SEQ ID NO: 5410121 - DNA, 19 bp, Homo sapiens
cttattttataattttaaa

SEQ ID NO: 5410122 - DNA, 22 bp, Homo sapiens
cttattttataattttaaaatt

SEQ ID NO: 5410123 - DNA, 18 bp, Homo sapiens
cttattttattatgagct

SEQ ID NO: 5410124 - DNA, 20 bp, Homo sapiens
cttattttatttccatcatg

SEQ ID NO: 5410125 - DNA, 12 bp, Homo sapiens
cttattttcaag

SEQ ID NO: 5410126 - DNA, 15 bp, Homo sapiens
cttattttcaagaaa

SEQ ID NO: 5410127 - DNA, 18 bp, Homo sapiens
cttattttcaagaaactg

SEQ ID NO: 5410128 - DNA, 14 bp, Homo sapiens
cttattttccaata

SEQ ID NO: 5410129 - DNA, 23 bp, Homo sapiens
cttcacaaatgtcattgtctact

SEQ ID NO: 5410130 - DNA, 15 bp, Homo sapiens
cttcacaaattctca

SEQ ID NO: 5410131 - DNA, 14 bp, Homo sapiens
cttcacaacagatt

SEQ ID NO: 5410132 - DNA, 15 bp, Homo sapiens
cttcacaaccagcca

SEQ ID NO: 5410133 - DNA, 16 bp, Homo sapiens
cttcacaatgttggcc

SEQ ID NO: 5410134 - DNA, 21 bp, Homo sapiens
cttcacaatgttggcctgtca

SEQ ID NO: 5410135 - DNA, 20 bp, Homo sapiens
cttcacaatttcaatgcttc

SEQ ID NO: 5410136 - DNA, 13 bp, Homo sapiens
cttcacacacaga

SEQ ID NO: 5410137 - DNA, 16 bp, Homo sapiens
cttcacacacaggcaa

SEQ ID NO: 5410138 - DNA, 21 bp, Homo sapiens
cttcacacacaggcaactgag

SEQ ID NO: 5410139 - DNA, 22 bp, Homo sapiens
cttcacacacaggcaactgagg

SEQ ID NO: 5410140 - DNA, 19 bp, Homo sapiens
cttcacacagacaagtggc

SEQ ID NO: 5410141 - DNA, 14 bp, Homo sapiens
cttcacaccattca

SEQ ID NO: 5410142 - DNA, 16 bp, Homo sapiens
cttcacaccccaggcc

SEQ ID NO: 5410143 - DNA, 14 bp, Homo sapiens
cttcacacccctca

SEQ ID NO: 5410144 - DNA, 20 bp, Homo sapiens
cttcacacccctcagcgctc

SEQ ID NO: 5410145 - DNA, 21 bp, Homo sapiens
cttcacacccctcagcgctcc

SEQ ID NO: 5410146 - DNA, 12 bp, Homo sapiens
cttcacactgca

SEQ ID NO: 5410147 - DNA, 13 bp, Homo sapiens
cttcacactgcaa

SEQ ID NO: 5410148 - DNA, 11 bp, Homo sapiens
cttcacagagt

SEQ ID NO: 5410149 - DNA, 13 bp, Homo sapiens
cttcacagagtgt

SEQ ID NO: 5410150 - DNA, 17 bp, Homo sapiens
cttcacagagtgtgctg

SEQ ID NO: 5410151 - DNA, 15 bp, Homo sapiens
cttcacagatgccta

SEQ ID NO: 5410152 - DNA, 23 bp, Homo sapiens
cttcacagatgggtgcttggagg

SEQ ID NO: 5410153 - DNA, 16 bp, Homo sapiens
cttcacagcagccact

SEQ ID NO: 5410154 - DNA, 23 bp, Homo sapiens
cttcacagccacacctggactga

SEQ ID NO: 5410155 - DNA, 14 bp, Homo sapiens
cttcacaggcactc

SEQ ID NO: 5410156 - DNA, 21 bp, Homo sapiens
cttcacaggcagtgcatgtga

SEQ ID NO: 5410157 - DNA, 22 bp, Homo sapiens
cttcacaggtgaggcatggcaa

SEQ ID NO: 5410158 - DNA, 17 bp, Homo sapiens
cttcacagtagagccag

SEQ ID NO: 5410159 - DNA, 20 bp, Homo sapiens
cttcacagtagagccagctt

SEQ ID NO: 5410160 - DNA, 14 bp, Homo sapiens
cttcacagtcccag

SEQ ID NO: 5410161 - DNA, 14 bp, Homo sapiens
cttcacagtctggt

SEQ ID NO: 5410162 - DNA, 16 bp, Homo sapiens
cttcacagtgacactg

SEQ ID NO: 5410163 - DNA, 20 bp, Homo sapiens
cttcacagtgacactggacc

SEQ ID NO: 5410164 - DNA, 23 bp, Homo sapiens
cttcacagtgatcgatgattcag

SEQ ID NO: 5410165 - DNA, 21 bp, Homo sapiens
cttcacagtgcagcttgcagt

SEQ ID NO: 5410166 - DNA, 22 bp, Homo sapiens
cttcacagtgcagcttgcagtc

SEQ ID NO: 5410167 - DNA, 22 bp, Homo sapiens
cttcacataagctcagaatcca

SEQ ID NO: 5410168 - DNA, 14 bp, Homo sapiens
cttcacatagtttt

SEQ ID NO: 5410169 - DNA, 19 bp, Homo sapiens
cttcacatccattgtctct

SEQ ID NO: 5410170 - DNA, 17 bp, Homo sapiens
cttcacattaaaaaatg

SEQ ID NO: 5410171 - DNA, 21 bp, Homo sapiens
cttcacattcccctggggacc

SEQ ID NO: 5410172 - DNA, 16 bp, Homo sapiens
cttcacattctgaagt

SEQ ID NO: 5410173 - DNA, 20 bp, Homo sapiens
cttcaccaaagatctgctcc

SEQ ID NO: 5410174 - DNA, 24 bp, Homo sapiens
cttcaccaaagatctgctcctcgc

SEQ ID NO: 5410175 - DNA, 15 bp, Homo sapiens
cttcaccaacactgt

SEQ ID NO: 5410176 - DNA, 19 bp, Homo sapiens
cttcaccacctcatgtcat

SEQ ID NO: 5410177 - DNA, 19 bp, Homo sapiens
cttcaccagagcatttcca

SEQ ID NO: 5410178 - DNA, 14 bp, Homo sapiens
cttcaccaggaaga

SEQ ID NO: 5410179 - DNA, 15 bp, Homo sapiens
cttcaccaggtgcat

SEQ ID NO: 5410180 - DNA, 14 bp, Homo sapiens
cttcaccagtctgt

SEQ ID NO: 5410181 - DNA, 22 bp, Homo sapiens
cttcaccagtctgtctactgtg

SEQ ID NO: 5410182 - DNA, 20 bp, Homo sapiens
cttcaccatcaatcctgatt

SEQ ID NO: 5410183 - DNA, 17 bp, Homo sapiens
cttcaccatcttggcca

SEQ ID NO: 5410184 - DNA, 17 bp, Homo sapiens
cttcaccatttggcaat

SEQ ID NO: 5410185 - DNA, 14 bp, Homo sapiens
cttcacccaccagg

SEQ ID NO: 5410186 - DNA, 23 bp, Homo sapiens
cttcacccaccaggccagctcag

SEQ ID NO: 5410187 - DNA, 15 bp, Homo sapiens
cttcacccaggccta

SEQ ID NO: 5410188 - DNA, 21 bp, Homo sapiens
cttcacccaggcctatgttga

SEQ ID NO: 5410189 - DNA, 18 bp, Homo sapiens
cttcaccccaatcccagc

SEQ ID NO: 5410190 - DNA, 19 bp, Homo sapiens
cttcaccccagtggccact

SEQ ID NO: 5410191 - DNA, 23 bp, Homo sapiens
cttcaccccagtggccactcagc

SEQ ID NO: 5410192 - DNA, 14 bp, Homo sapiens
cttcacccccaact

SEQ ID NO: 5410193 - DNA, 15 bp, Homo sapiens
cttcacccccaactt

SEQ ID NO: 5410194 - DNA, 15 bp, Homo sapiens
cttcaccccccactc

SEQ ID NO: 5410195 - DNA, 14 bp, Homo sapiens
cttcaccccggcag

SEQ ID NO: 5410196 - DNA, 18 bp, Homo sapiens
cttcaccccggcaggccc

SEQ ID NO: 5410197 - DNA, 20 bp, Homo sapiens
cttcaccccggcaggccctg

SEQ ID NO: 5410198 - DNA, 15 bp, Homo sapiens
cttcacccctgcact

SEQ ID NO: 5410199 - DNA, 17 bp, Homo sapiens
cttcacccgagttcctc

SEQ ID NO: 5410200 - DNA, 14 bp, Homo sapiens
cttcacccggctgg

SEQ ID NO: 5410201 - DNA, 16 bp, Homo sapiens
cttcacccggctgggc

SEQ ID NO: 5410202 - DNA, 13 bp, Homo sapiens
cttcaccctgtca

SEQ ID NO: 5410203 - DNA, 17 bp, Homo sapiens
cttcaccgcattccagg

SEQ ID NO: 5410204 - DNA, 22 bp, Homo sapiens
cttcaccgcattccaggggctg

SEQ ID NO: 5410205 - DNA, 17 bp, Homo sapiens
cttcaccgccgtggggt

SEQ ID NO: 5410206 - DNA, 20 bp, Homo sapiens
cttcaccgctccccacagct

SEQ ID NO: 5410207 - DNA, 20 bp, Homo sapiens
cttcacctaagtctctgtga

SEQ ID NO: 5410208 - DNA, 11 bp, Homo sapiens
cttcacctcag

SEQ ID NO: 5410209 - DNA, 19 bp, Homo sapiens
cttcacctctgggacccca

SEQ ID NO: 5410210 - DNA, 15 bp, Homo sapiens
cttcacctcttccac

SEQ ID NO: 5410211 - DNA, 16 bp, Homo sapiens
cttcacctgttatgta

SEQ ID NO: 5410212 - DNA, 11 bp, Homo sapiens
cttcaccttaa

SEQ ID NO: 5410213 - DNA, 15 bp, Homo sapiens
cttcaccttggttta

SEQ ID NO: 5410214 - DNA, 13 bp, Homo sapiens
cttcacctttcct

SEQ ID NO: 5410215 - DNA, 18 bp, Homo sapiens
cttcacctttcctctccc

SEQ ID NO: 5410216 - DNA, 19 bp, Homo sapiens
cttcacctttggtgcagag

SEQ ID NO: 5410217 - DNA, 20 bp, Homo sapiens
cttcacctttgtccccaccg

SEQ ID NO: 5410218 - DNA, 21 bp, Homo sapiens
cttcacctttgtccccaccgc

SEQ ID NO: 5410219 - DNA, 14 bp, Homo sapiens
cttcacgcctgggt

SEQ ID NO: 5410220 - DNA, 15 bp, Homo sapiens
cttcacgcctgggtg

SEQ ID NO: 5410221 - DNA, 13 bp, Homo sapiens
cttcacgctggct

SEQ ID NO: 5410222 - DNA, 19 bp, Homo sapiens
cttcacgctggcttccagc

SEQ ID NO: 5410223 - DNA, 15 bp, Homo sapiens
cttcacggaagagcc

SEQ ID NO: 5410224 - DNA, 20 bp, Homo sapiens
cttcacggactctttgctgt

SEQ ID NO: 5410225 - DNA, 20 bp, Homo sapiens
cttcacggtttcacttttaa

SEQ ID NO: 5410226 - DNA, 23 bp, Homo sapiens
cttcactaagaacaaaagaagca

SEQ ID NO: 5410227 - DNA, 14 bp, Homo sapiens
cttcactaccctga

SEQ ID NO: 5410228 - DNA, 19 bp, Homo sapiens
cttcactaggcattgtgat

SEQ ID NO: 5410229 - DNA, 14 bp, Homo sapiens
cttcactagggaat

SEQ ID NO: 5410230 - DNA, 14 bp, Homo sapiens
cttcactatgacta

SEQ ID NO: 5410231 - DNA, 18 bp, Homo sapiens
cttcactattcctaggag

SEQ ID NO: 5410232 - DNA, 14 bp, Homo sapiens
cttcactcagccac

SEQ ID NO: 5410233 - DNA, 15 bp, Homo sapiens
cttcactcagctgga

SEQ ID NO: 5410234 - DNA, 16 bp, Homo sapiens
cttcactccagacaga

SEQ ID NO: 5410235 - DNA, 14 bp, Homo sapiens
cttcactccctccc

SEQ ID NO: 5410236 - DNA, 22 bp, Homo sapiens
cttcactccggtgtgcctgcag

SEQ ID NO: 5410237 - DNA, 24 bp, Homo sapiens
cttcactccggtgtgcctgcagcc

SEQ ID NO: 5410238 - DNA, 14 bp, Homo sapiens
cttcactctccagg

SEQ ID NO: 5410239 - DNA, 13 bp, Homo sapiens
cttcactctctcc

SEQ ID NO: 5410240 - DNA, 22 bp, Homo sapiens
cttcactctctccgtctgtttt

SEQ ID NO: 5410241 - DNA, 14 bp, Homo sapiens
cttcactctggctt

SEQ ID NO: 5410242 - DNA, 13 bp, Homo sapiens
cttcactcttcac

SEQ ID NO: 5410243 - DNA, 17 bp, Homo sapiens
cttcactgaacatgcct

SEQ ID NO: 5410244 - DNA, 20 bp, Homo sapiens
cttcactgaacatgcctagt

SEQ ID NO: 5410245 - DNA, 24 bp, Homo sapiens
cttcactgcagatttctcacctgt

SEQ ID NO: 5410246 - DNA, 12 bp, Homo sapiens
cttcactgcagc

SEQ ID NO: 5410247 - DNA, 15 bp, Homo sapiens
cttcactgcagcctt

SEQ ID NO: 5410248 - DNA, 13 bp, Homo sapiens
cttcactgcccca

SEQ ID NO: 5410249 - DNA, 15 bp, Homo sapiens
cttcactgcctttgc

SEQ ID NO: 5410250 - DNA, 19 bp, Homo sapiens
cttcactgcctttgctcct

SEQ ID NO: 5410251 - DNA, 15 bp, Homo sapiens
cttcactggagaccg

SEQ ID NO: 5410252 - DNA, 18 bp, Homo sapiens
cttcactgggccagtcaa

SEQ ID NO: 5410253 - DNA, 22 bp, Homo sapiens
cttcactggtgagacaatgaaa

SEQ ID NO: 5410254 - DNA, 13 bp, Homo sapiens
cttcactgtataa

SEQ ID NO: 5410255 - DNA, 23 bp, Homo sapiens
cttcactgtataaataggagagg

SEQ ID NO: 5410256 - DNA, 17 bp, Homo sapiens
cttcactgtatataaac

SEQ ID NO: 5410257 - DNA, 17 bp, Homo sapiens
cttcactgtatatgtaa

SEQ ID NO: 5410258 - DNA, 18 bp, Homo sapiens
cttcactgtcatcttcaa

SEQ ID NO: 5410259 - DNA, 17 bp, Homo sapiens
cttcactgtcctccaag

SEQ ID NO: 5410260 - DNA, 18 bp, Homo sapiens
cttcactgtcttactcaa

SEQ ID NO: 5410261 - DNA, 21 bp, Homo sapiens
cttcactgtgctccaacctga

SEQ ID NO: 5410262 - DNA, 17 bp, Homo sapiens
cttcactgtggccacag

SEQ ID NO: 5410263 - DNA, 18 bp, Homo sapiens
cttcacttaatccattta

SEQ ID NO: 5410264 - DNA, 15 bp, Homo sapiens
cttcacttcctccag

SEQ ID NO: 5410265 - DNA, 17 bp, Homo sapiens
cttcacttctgaccaca

SEQ ID NO: 5410266 - DNA, 20 bp, Homo sapiens
cttcacttctgactcttccc

SEQ ID NO: 5410267 - DNA, 12 bp, Homo sapiens
cttcacttgagt

SEQ ID NO: 5410268 - DNA, 17 bp, Homo sapiens
cttcacttgagttggct

SEQ ID NO: 5410269 - DNA, 15 bp, Homo sapiens
cttcactttaattct

SEQ ID NO: 5410270 - DNA, 20 bp, Homo sapiens
cttcactttctcctggtgtt

SEQ ID NO: 5410271 - DNA, 20 bp, Homo sapiens
cttcactttcttaagcaaca

SEQ ID NO: 5410272 - DNA, 15 bp, Homo sapiens
cttcactttcttcaa

SEQ ID NO: 5410273 - DNA, 16 bp, Homo sapiens
cttcactttcttcaaa

SEQ ID NO: 5410274 - DNA, 21 bp, Homo sapiens
cttcactttgccttctggtta

SEQ ID NO: 5410275 - DNA, 21 bp, Homo sapiens
cttcacttttgcaaggttcca

SEQ ID NO: 5410276 - DNA, 16 bp, Homo sapiens
cttcagaaaagacact

SEQ ID NO: 5410277 - DNA, 17 bp, Homo sapiens
cttcagaaaagacactt

SEQ ID NO: 5410278 - DNA, 20 bp, Homo sapiens
cttcagaaaagacacttcaa

SEQ ID NO: 5410279 - DNA, 17 bp, Homo sapiens
cttcagaaaaggagtgg

SEQ ID NO: 5410280 - DNA, 23 bp, Homo sapiens
cttcagaaacccggcttcctgtg

SEQ ID NO: 5410281 - DNA, 20 bp, Homo sapiens
cttcagaaagtgtgctttat

SEQ ID NO: 5410282 - DNA, 18 bp, Homo sapiens
cttcagaacacacagact

SEQ ID NO: 5410283 - DNA, 23 bp, Homo sapiens
cttcagaacacacagactttctg

SEQ ID NO: 5410284 - DNA, 17 bp, Homo sapiens
cttcagaacagaggcat

SEQ ID NO: 5410285 - DNA, 19 bp, Homo sapiens
cttcagaacagaggcattt

SEQ ID NO: 5410286 - DNA, 16 bp, Homo sapiens
cttcagaacatgctgg

SEQ ID NO: 5410287 - DNA, 15 bp, Homo sapiens
cttcagaactgccct

SEQ ID NO: 5410288 - DNA, 16 bp, Homo sapiens
cttcagaagctatttt

SEQ ID NO: 5410289 - DNA, 16 bp, Homo sapiens
cttcagaaggcctcac

SEQ ID NO: 5410290 - DNA, 20 bp, Homo sapiens
cttcagaaggggacctgttt

SEQ ID NO: 5410291 - DNA, 21 bp, Homo sapiens
cttcagaatatggacaaagaa

SEQ ID NO: 5410292 - DNA, 16 bp, Homo sapiens
cttcagaatcagatat

SEQ ID NO: 5410293 - DNA, 13 bp, Homo sapiens
cttcagaattatc

SEQ ID NO: 5410294 - DNA, 18 bp, Homo sapiens
cttcagaattatccatta

SEQ ID NO: 5410295 - DNA, 19 bp, Homo sapiens
cttcagacacacggggcac

SEQ ID NO: 5410296 - DNA, 20 bp, Homo sapiens
cttcagacacatgctatgtt

SEQ ID NO: 5410297 - DNA, 11 bp, Homo sapiens
cttcagacata

SEQ ID NO: 5410298 - DNA, 13 bp, Homo sapiens
cttcagacccaga

SEQ ID NO: 5410299 - DNA, 17 bp, Homo sapiens
cttcagacgagatcctg

SEQ ID NO: 5410300 - DNA, 14 bp, Homo sapiens
cttcagactctcag

SEQ ID NO: 5410301 - DNA, 16 bp, Homo sapiens
cttcagactgcaagtg

SEQ ID NO: 5410302 - DNA, 19 bp, Homo sapiens
cttcagactttgcttccca

SEQ ID NO: 5410303 - DNA, 19 bp, Homo sapiens
cttcagacttttatcaaaa

SEQ ID NO: 5410304 - DNA, 12 bp, Homo sapiens
cttcagagaagt

SEQ ID NO: 5410305 - DNA, 17 bp, Homo sapiens
cttcagagactcctgca

SEQ ID NO: 5410306 - DNA, 20 bp, Homo sapiens
cttcagagactcctgcaggc

SEQ ID NO: 5410307 - DNA, 18 bp, Homo sapiens
cttcatttcattgtatga

SEQ ID NO: 5410308 - DNA, 20 bp, Homo sapiens
cttcatttccaccaggccgt

SEQ ID NO: 5410309 - DNA, 22 bp, Homo sapiens
cttcatttccgtgaagggcacc

SEQ ID NO: 5410310 - DNA, 20 bp, Homo sapiens
cttcatttcctctgagctgt

SEQ ID NO: 5410311 - DNA, 19 bp, Homo sapiens
cttcatttgacacaaagct

SEQ ID NO: 5410312 - DNA, 13 bp, Homo sapiens
cttcatttggaga

SEQ ID NO: 5410313 - DNA, 14 bp, Homo sapiens
cttcatttgtgtca

SEQ ID NO: 5410314 - DNA, 16 bp, Homo sapiens
cttcattttatattta

SEQ ID NO: 5410315 - DNA, 21 bp, Homo sapiens
cttcattttattaatattttt

SEQ ID NO: 5410316 - DNA, 14 bp, Homo sapiens
cttcattttcagag

SEQ ID NO: 5410317 - DNA, 19 bp, Homo sapiens
cttcattttggcaagaaga

SEQ ID NO: 5410318 - DNA, 17 bp, Homo sapiens
cttcattttgtataatc

SEQ ID NO: 5410319 - DNA, 17 bp, Homo sapiens
cttcatttttaagactg

SEQ ID NO: 5410320 - DNA, 17 bp, Homo sapiens
cttcatttttaatttgt

SEQ ID NO: 5410321 - DNA, 13 bp, Homo sapiens
cttcatttttccc

SEQ ID NO: 5410322 - DNA, 14 bp, Homo sapiens
cttcatttttccta

SEQ ID NO: 5410323 - DNA, 19 bp, Homo sapiens
cttcatttttgtaataaca

SEQ ID NO: 5410324 - DNA, 23 bp, Homo sapiens
cttcatttttgtaataacattta

SEQ ID NO: 5410325 - DNA, 16 bp, Homo sapiens
cttcattttttaatgt

SEQ ID NO: 5410326 - DNA, 14 bp, Homo sapiens
cttccaaaaattac

SEQ ID NO: 5410327 - DNA, 16 bp, Homo sapiens
cttccaaaaattatta

SEQ ID NO: 5410328 - DNA, 19 bp, Homo sapiens
cttccaaaaattattataa

SEQ ID NO: 5410329 - DNA, 18 bp, Homo sapiens
cttccaaaacctgcttcc

SEQ ID NO: 5410330 - DNA, 20 bp, Homo sapiens
cttccaaaacctgcttcctt

SEQ ID NO: 5410331 - DNA, 17 bp, Homo sapiens
cttccaaaattcttatt

SEQ ID NO: 5410332 - DNA, 13 bp, Homo sapiens
cttccaaacaaaa

SEQ ID NO: 5410333 - DNA, 17 bp, Homo sapiens
cttccaaagaattctta

SEQ ID NO: 5410334 - DNA, 21 bp, Homo sapiens
cttccaaagacaagaaaagag

SEQ ID NO: 5410335 - DNA, 19 bp, Homo sapiens
cttccaaagactccctcca

SEQ ID NO: 5410336 - DNA, 19 bp, Homo sapiens
cttccaaagagtcatcatg

SEQ ID NO: 5410337 - DNA, 13 bp, Homo sapiens
cttccaaagcaca

SEQ ID NO: 5410338 - DNA, 12 bp, Homo sapiens
cttccaaagcag

SEQ ID NO: 5410339 - DNA, 12 bp, Homo sapiens
cttccaaagctt

SEQ ID NO: 5410340 - DNA, 15 bp, Homo sapiens
cttccaaataataaa

SEQ ID NO: 5410341 - DNA, 17 bp, Homo sapiens
cttccaaataataaagt

SEQ ID NO: 5410342 - DNA, 23 bp, Homo sapiens
cttccaaatcctggaaggacaca

SEQ ID NO: 5410343 - DNA, 17 bp, Homo sapiens
cttccaacaagcctcaa

SEQ ID NO: 5410344 - DNA, 15 bp, Homo sapiens
cttccaacaaggaca

SEQ ID NO: 5410345 - DNA, 20 bp, Homo sapiens
cttccaacacatttcacttt

SEQ ID NO: 5410346 - DNA, 21 bp, Homo sapiens
cttccaacatatatttattga

SEQ ID NO: 5410347 - DNA, 17 bp, Homo sapiens
cttccaacatgtgatgt

SEQ ID NO: 5410348 - DNA, 21 bp, Homo sapiens
cttccaaccatttatcttgaa

SEQ ID NO: 5410349 - DNA, 17 bp, Homo sapiens
cttccaaccccagctgg

SEQ ID NO: 5410350 - DNA, 14 bp, Homo sapiens
cttccaactgctgc

SEQ ID NO: 5410351 - DNA, 15 bp, Homo sapiens
cttccaactgctgcc

SEQ ID NO: 5410352 - DNA, 19 bp, Homo sapiens
cttccaactgctgccccaa

SEQ ID NO: 5410353 - DNA, 12 bp, Homo sapiens
cttccaagaaaa

SEQ ID NO: 5410354 - DNA, 18 bp, Homo sapiens
cttccaagaccatttgta

SEQ ID NO: 5410355 - DNA, 14 bp, Homo sapiens
cttccaagacctga

SEQ ID NO: 5410356 - DNA, 18 bp, Homo sapiens
cttccaagacctgactca

SEQ ID NO: 5410357 - DNA, 17 bp, Homo sapiens
cttccaagactgaagac

SEQ ID NO: 5410358 - DNA, 17 bp, Homo sapiens
cttccaaggagaccaag

SEQ ID NO: 5410359 - DNA, 20 bp, Homo sapiens
cttccaaggagaccaagtcc

SEQ ID NO: 5410360 - DNA, 15 bp, Homo sapiens
cttccaaggccctgc

SEQ ID NO: 5410361 - DNA, 19 bp, Homo sapiens
cttccaagggttgaattct

SEQ ID NO: 5410362 - DNA, 19 bp, Homo sapiens
cttccaaggtcactcttgg

SEQ ID NO: 5410363 - DNA, 20 bp, Homo sapiens
cttccaaggtcactcttggt

SEQ ID NO: 5410364 - DNA, 16 bp, Homo sapiens
cttccaaggtggtctg

SEQ ID NO: 5410365 - DNA, 21 bp, Homo sapiens
cttccaagtcctttatctgca

SEQ ID NO: 5410366 - DNA, 22 bp, Homo sapiens
cttccaagtggacggcagacct

SEQ ID NO: 5410367 - DNA, 19 bp, Homo sapiens
cttccaataaagcagcctc

SEQ ID NO: 5410368 - DNA, 14 bp, Homo sapiens
cttccaatcttgct

SEQ ID NO: 5410369 - DNA, 17 bp, Homo sapiens
cttccaatgatgcttac

SEQ ID NO: 5410370 - DNA, 19 bp, Homo sapiens
cttccaatgtctggagacc

SEQ ID NO: 5410371 - DNA, 16 bp, Homo sapiens
cttccaattaatgctt

SEQ ID NO: 5410372 - DNA, 17 bp, Homo sapiens
cttccaattaatgcttt

SEQ ID NO: 5410373 - DNA, 14 bp, Homo sapiens
cttccaatttataa

SEQ ID NO: 5410374 - DNA, 19 bp, Homo sapiens
cttccaatttataatgaat

SEQ ID NO: 5410375 - DNA, 12 bp, Homo sapiens
cttccacaaaat

SEQ ID NO: 5410376 - DNA, 13 bp, Homo sapiens
cttccacaaaatt

SEQ ID NO: 5410377 - DNA, 22 bp, Homo sapiens
cttccacaaaattatgctgcat

SEQ ID NO: 5410378 - DNA, 11 bp, Homo sapiens
cttccacaaac

SEQ ID NO: 5410379 - DNA, 22 bp, Homo sapiens
cttccacaagagcccaggcctc

SEQ ID NO: 5410380 - DNA, 22 bp, Homo sapiens
cttccacacaattatttatttc

SEQ ID NO: 5410381 - DNA, 15 bp, Homo sapiens
cttccacacttctgg

SEQ ID NO: 5410382 - DNA, 14 bp, Homo sapiens
cttccacagcaaat

SEQ ID NO: 5410383 - DNA, 18 bp, Homo sapiens
cttccacagctggcctgg

SEQ ID NO: 5410384 - DNA, 13 bp, Homo sapiens
cttccacagggtc

SEQ ID NO: 5410385 - DNA, 15 bp, Homo sapiens
cttccacagggtccc

SEQ ID NO: 5410386 - DNA, 19 bp, Homo sapiens
cttccacagggtcccacag

SEQ ID NO: 5410387 - DNA, 11 bp, Homo sapiens
cttccacagtg

SEQ ID NO: 5410388 - DNA, 13 bp, Homo sapiens
cttccacagtggc

SEQ ID NO: 5410389 - DNA, 14 bp, Homo sapiens
cttccacagtggcg

SEQ ID NO: 5410390 - DNA, 17 bp, Homo sapiens
cttccacagttatctta

SEQ ID NO: 5410391 - DNA, 13 bp, Homo sapiens
cttccaccacaga

SEQ ID NO: 5410392 - DNA, 14 bp, Homo sapiens
cttccaccagagca

SEQ ID NO: 5410393 - DNA, 24 bp, Homo sapiens
cttccaccagagcaggggctgctg

SEQ ID NO: 5410394 - DNA, 17 bp, Homo sapiens
cttccaccagcctgcac

SEQ ID NO: 5410395 - DNA, 16 bp, Homo sapiens
cttccacccacaaact

SEQ ID NO: 5410396 - DNA, 20 bp, Homo sapiens
cttccacccacaaactccag

SEQ ID NO: 5410397 - DNA, 17 bp, Homo sapiens
cttccacccacacgact

SEQ ID NO: 5410398 - DNA, 14 bp, Homo sapiens
cttccacccagtgc

SEQ ID NO: 5410399 - DNA, 14 bp, Homo sapiens
cttccacccattcc

SEQ ID NO: 5410400 - DNA, 14 bp, Homo sapiens
cttccacccccagc

SEQ ID NO: 5410401 - DNA, 17 bp, Homo sapiens
cttccacccctctcctc

SEQ ID NO: 5410402 - DNA, 12 bp, Homo sapiens
cttccaccctgc

SEQ ID NO: 5410403 - DNA, 13 bp, Homo sapiens
cttccaccctgcc

SEQ ID NO: 5410404 - DNA, 14 bp, Homo sapiens
cttccaccctgccc

SEQ ID NO: 5410405 - DNA, 15 bp, Homo sapiens
cttccaccctgccct

SEQ ID NO: 5410406 - DNA, 22 bp, Homo sapiens
cttccaccctgccctggcctac

SEQ ID NO: 5410407 - DNA, 21 bp, Homo sapiens
cttccaccggcactcatgacg

SEQ ID NO: 5410408 - DNA, 17 bp, Homo sapiens
cttccaccgggcctgaa

SEQ ID NO: 5410409 - DNA, 22 bp, Homo sapiens
cttccacctcacaactccttcc

SEQ ID NO: 5410410 - DNA, 14 bp, Homo sapiens
cttccacctcaccc

SEQ ID NO: 5410411 - DNA, 17 bp, Homo sapiens
cttccacctcaccccac

SEQ ID NO: 5410412 - DNA, 18 bp, Homo sapiens
cttccacctcaccccact

SEQ ID NO: 5410413 - DNA, 16 bp, Homo sapiens
cttccacctcacctct

SEQ ID NO: 5410414 - DNA, 23 bp, Homo sapiens
cttccacctcagcctcccaggta

SEQ ID NO: 5410415 - DNA, 15 bp, Homo sapiens
cttccacctccagcc

SEQ ID NO: 5410416 - DNA, 16 bp, Homo sapiens
cttccacctcctagag

SEQ ID NO: 5410417 - DNA, 16 bp, Homo sapiens
cttccacctgctctgc

SEQ ID NO: 5410418 - DNA, 19 bp, Homo sapiens
cttccacctgtgccctcac

SEQ ID NO: 5410419 - DNA, 17 bp, Homo sapiens
cttccacgctgtctcca

SEQ ID NO: 5410420 - DNA, 18 bp, Homo sapiens
cttccacgctgtctccag

SEQ ID NO: 5410421 - DNA, 20 bp, Homo sapiens
cttccacgctgtctccagac

SEQ ID NO: 5410422 - DNA, 19 bp, Homo sapiens
cttccacggactcaagttt

SEQ ID NO: 5410423 - DNA, 14 bp, Homo sapiens
cttccacgggggct

SEQ ID NO: 5410424 - DNA, 15 bp, Homo sapiens
cttccacgggggctg

SEQ ID NO: 5410425 - DNA, 23 bp, Homo sapiens
cttccacgtaattcaatttctca

SEQ ID NO: 5410426 - DNA, 20 bp, Homo sapiens
cttccactaccaaaagacat

SEQ ID NO: 5410427 - DNA, 21 bp, Homo sapiens
cttccactaccaaaagacatt

SEQ ID NO: 5410428 - DNA, 13 bp, Homo sapiens
cttccactcaggg

SEQ ID NO: 5410429 - DNA, 15 bp, Homo sapiens
cttccactcagggct

SEQ ID NO: 5410430 - DNA, 18 bp, Homo sapiens
cttccactccttctctca

SEQ ID NO: 5410431 - DNA, 15 bp, Homo sapiens
cttccactctggaac

SEQ ID NO: 5410432 - DNA, 18 bp, Homo sapiens
cttccactgagggcagtc

SEQ ID NO: 5410433 - DNA, 16 bp, Homo sapiens
cttccactgagtcttt

SEQ ID NO: 5410434 - DNA, 13 bp, Homo sapiens
cttccactgcctc

SEQ ID NO: 5410435 - DNA, 16 bp, Homo sapiens
cttccactgtagctat

SEQ ID NO: 5410436 - DNA, 19 bp, Homo sapiens
cttccactttgtataaatt

SEQ ID NO: 5410437 - DNA, 18 bp, Homo sapiens
cttccactttttccagaa

SEQ ID NO: 5410438 - DNA, 20 bp, Homo sapiens
cttccacttttttttgtatg

SEQ ID NO: 5410439 - DNA, 16 bp, Homo sapiens
cttccagaaaacaaaa

SEQ ID NO: 5410440 - DNA, 16 bp, Homo sapiens
cttccagaaagcaagg

SEQ ID NO: 5410441 - DNA, 17 bp, Homo sapiens
cttccagaaatgccaca

SEQ ID NO: 5410442 - DNA, 18 bp, Homo sapiens
cttccagaagatgccctc

SEQ ID NO: 5410443 - DNA, 21 bp, Homo sapiens
cttccagaagctgtactttta

SEQ ID NO: 5410444 - DNA, 16 bp, Homo sapiens
cttccagaagtgtgat

SEQ ID NO: 5410445 - DNA, 16 bp, Homo sapiens
cttccagaatgctgaa

SEQ ID NO: 5410446 - DNA, 23 bp, Homo sapiens
cttccagaatgctgaactccttg

SEQ ID NO: 5410447 - DNA, 15 bp, Homo sapiens
cttccagaccacctg

SEQ ID NO: 5410448 - DNA, 17 bp, Homo sapiens
cttccagaccacctgcc

SEQ ID NO: 5410449 - DNA, 23 bp, Homo sapiens
cttccagaccacctgccagccat

SEQ ID NO: 5410450 - DNA, 13 bp, Homo sapiens
cttccagacctgc

SEQ ID NO: 5410451 - DNA, 22 bp, Homo sapiens
cttccagacctgcttcctgaaa

SEQ ID NO: 5410452 - DNA, 23 bp, Homo sapiens
cttccagagaacacagggctgca

SEQ ID NO: 5410453 - DNA, 18 bp, Homo sapiens
cttccagagagtcctctg

SEQ ID NO: 5410454 - DNA, 21 bp, Homo sapiens
cttccagagagtcctctggat

SEQ ID NO: 5410455 - DNA, 12 bp, Homo sapiens
cttccagagctc

SEQ ID NO: 5410456 - DNA, 19 bp, Homo sapiens
cttccagagctctgaccca

SEQ ID NO: 5410457 - DNA, 20 bp, Homo sapiens
cttccagaggacagctctgg

SEQ ID NO: 5410458 - DNA, 20 bp, Homo sapiens
cttccagaggagagtggcct

SEQ ID NO: 5410459 - DNA, 22 bp, Homo sapiens
cttccagaggagagtggcctgg

SEQ ID NO: 5410460 - DNA, 15 bp, Homo sapiens
cttccagatcactgc

SEQ ID NO: 5410461 - DNA, 22 bp, Homo sapiens
cttccagatgatccttgcacag

SEQ ID NO: 5410462 - DNA, 20 bp, Homo sapiens
cttccagatgcccgagcacc

SEQ ID NO: 5410463 - DNA, 19 bp, Homo sapiens
cttccagatgtctaaaaga

SEQ ID NO: 5410464 - DNA, 23 bp, Homo sapiens
cttccagatttgagctgcctgga

SEQ ID NO: 5410465 - DNA, 12 bp, Homo sapiens
cttccagatttt

SEQ ID NO: 5410466 - DNA, 18 bp, Homo sapiens
cttccagattttaaattt

SEQ ID NO: 5410467 - DNA, 14 bp, Homo sapiens
cttccagcaaaatc

SEQ ID NO: 5410468 - DNA, 21 bp, Homo sapiens
cttccagcaaaatccaaactg

SEQ ID NO: 5410469 - DNA, 16 bp, Homo sapiens
cttccagcaccctgca

SEQ ID NO: 5410470 - DNA, 12 bp, Homo sapiens
cttccagcagga

SEQ ID NO: 5410471 - DNA, 13 bp, Homo sapiens
cttccagcaggag

SEQ ID NO: 5410472 - DNA, 21 bp, Homo sapiens
cttccagccacattgagactt

SEQ ID NO: 5410473 - DNA, 12 bp, Homo sapiens
cttccagcccat

SEQ ID NO: 5410474 - DNA, 16 bp, Homo sapiens
cttccagcccatccaa

SEQ ID NO: 5410475 - DNA, 20 bp, Homo sapiens
cttccagcctgggacacaca

SEQ ID NO: 5410476 - DNA, 16 bp, Homo sapiens
cttccagcctttttag

SEQ ID NO: 5410477 - DNA, 22 bp, Homo sapiens
cttccagcctttttagggcaga

SEQ ID NO: 5410478 - DNA, 20 bp, Homo sapiens
cttccagcgggccctctgcc

SEQ ID NO: 5410479 - DNA, 16 bp, Homo sapiens
cttccagcgtctctcc

SEQ ID NO: 5410480 - DNA, 22 bp, Homo sapiens
cttccagctagtgacccacatg

SEQ ID NO: 5410481 - DNA, 17 bp, Homo sapiens
cttccagctcagtccca

SEQ ID NO: 5410482 - DNA, 23 bp, Homo sapiens
cttccagctcagtcccacagccc

SEQ ID NO: 5410483 - DNA, 15 bp, Homo sapiens
cttccagctccctcc

SEQ ID NO: 5410484 - DNA, 17 bp, Homo sapiens
cttccagctccctcccc

SEQ ID NO: 5410485 - DNA, 13 bp, Homo sapiens
cttcctattaaga

SEQ ID NO: 5410486 - DNA, 18 bp, Homo sapiens
cttcctattctcctgcca

SEQ ID NO: 5410487 - DNA, 21 bp, Homo sapiens
cttcctattgtactgcacaaa

SEQ ID NO: 5410488 - DNA, 16 bp, Homo sapiens
cttcctatttcagaag

SEQ ID NO: 5410489 - DNA, 14 bp, Homo sapiens
cttcctatttctgg

SEQ ID NO: 5410490 - DNA, 22 bp, Homo sapiens
cttcctcaaatacatgcacagt

SEQ ID NO: 5410491 - DNA, 19 bp, Homo sapiens
cttcctcacacccctgtcc

SEQ ID NO: 5410492 - DNA, 22 bp, Homo sapiens
cttcctcacacccctgtcccac

SEQ ID NO: 5410493 - DNA, 15 bp, Homo sapiens
cttcctcacactgct

SEQ ID NO: 5410494 - DNA, 16 bp, Homo sapiens
cttcctcacactgctg

SEQ ID NO: 5410495 - DNA, 21 bp, Homo sapiens
cttcctcacagtcccactgtg

SEQ ID NO: 5410496 - DNA, 15 bp, Homo sapiens
cttcctcaccctgat

SEQ ID NO: 5410497 - DNA, 10 bp, Homo sapiens
cttcctcagc

SEQ ID NO: 5410498 - DNA, 17 bp, Homo sapiens
cttcctcagccagcctc

SEQ ID NO: 5410499 - DNA, 15 bp, Homo sapiens
cttcctcagcctcca

SEQ ID NO: 5410500 - DNA, 20 bp, Homo sapiens
cttcctcagcctccaaagtg

SEQ ID NO: 5410501 - DNA, 18 bp, Homo sapiens
cttcctcagcctcccaag

SEQ ID NO: 5410502 - DNA, 19 bp, Homo sapiens
cttcctcagctcagctggg

SEQ ID NO: 5410503 - DNA, 15 bp, Homo sapiens
cttcctcagctgcct

SEQ ID NO: 5410504 - DNA, 14 bp, Homo sapiens
cttcctcagggccc

SEQ ID NO: 5410505 - DNA, 17 bp, Homo sapiens
cttcctcagggcccctg

SEQ ID NO: 5410506 - DNA, 19 bp, Homo sapiens
cttcctcagggcccctggg

SEQ ID NO: 5410507 - DNA, 18 bp, Homo sapiens
cttcctcagtcctggaag

SEQ ID NO: 5410508 - DNA, 17 bp, Homo sapiens
cttcctcagttacacaa

SEQ ID NO: 5410509 - DNA, 21 bp, Homo sapiens
cttcctcataccacatggctt

SEQ ID NO: 5410510 - DNA, 22 bp, Homo sapiens
cttcctcatccaccccatccct

SEQ ID NO: 5410511 - DNA, 18 bp, Homo sapiens
cttcctcatctccatgct

SEQ ID NO: 5410512 - DNA, 15 bp, Homo sapiens
cttcctcatctgtgc

SEQ ID NO: 5410513 - DNA, 16 bp, Homo sapiens
cttcctcatctgtgcc

SEQ ID NO: 5410514 - DNA, 17 bp, Homo sapiens
cttcctcatctgtgcct

SEQ ID NO: 5410515 - DNA, 19 bp, Homo sapiens
cttcctccaatccccactc

SEQ ID NO: 5410516 - DNA, 23 bp, Homo sapiens
cttcctccacaaggtccccccac

SEQ ID NO: 5410517 - DNA, 17 bp, Homo sapiens
cttcctccacagtcccc

SEQ ID NO: 5410518 - DNA, 13 bp, Homo sapiens
cttcctccactgc

SEQ ID NO: 5410519 - DNA, 23 bp, Homo sapiens
cttcctccactgcgcttactcct

SEQ ID NO: 5410520 - DNA, 15 bp, Homo sapiens
cttcctccacttcat

SEQ ID NO: 5410521 - DNA, 16 bp, Homo sapiens
cttcctccagaagcct

SEQ ID NO: 5410522 - DNA, 18 bp, Homo sapiens
cttcctccagaagcctcc

SEQ ID NO: 5410523 - DNA, 14 bp, Homo sapiens
cttcctccagagga

SEQ ID NO: 5410524 - DNA, 15 bp, Homo sapiens
cttcctccagctgca

SEQ ID NO: 5410525 - DNA, 17 bp, Homo sapiens
cttcctccagctgcacc

SEQ ID NO: 5410526 - DNA, 13 bp, Homo sapiens
cttcctccagtct

SEQ ID NO: 5410527 - DNA, 23 bp, Homo sapiens
cttcctccatcctcctccttcct

SEQ ID NO: 5410528 - DNA, 12 bp, Homo sapiens
cttcctcccaag

SEQ ID NO: 5410529 - DNA, 16 bp, Homo sapiens
cttcctcccagcattg

SEQ ID NO: 5410530 - DNA, 18 bp, Homo sapiens
cttcctccccaacctgca

SEQ ID NO: 5410531 - DNA, 15 bp, Homo sapiens
cttcctccccacact

SEQ ID NO: 5410532 - DNA, 16 bp, Homo sapiens
cttcctccccacactc

SEQ ID NO: 5410533 - DNA, 18 bp, Homo sapiens
cttcctccccacactcca

SEQ ID NO: 5410534 - DNA, 15 bp, Homo sapiens
cttcctccccaggac

SEQ ID NO: 5410535 - DNA, 11 bp, Homo sapiens
cttcctcccct

SEQ ID NO: 5410536 - DNA, 22 bp, Homo sapiens
cttcctccccttttgcccccgt

SEQ ID NO: 5410537 - DNA, 22 bp, Homo sapiens
cttcctcccggggccttccttt

SEQ ID NO: 5410538 - DNA, 12 bp, Homo sapiens
cttcctccctcc

SEQ ID NO: 5410539 - DNA, 19 bp, Homo sapiens
cttcctccctccctgcagg

SEQ ID NO: 5410540 - DNA, 14 bp, Homo sapiens
cttcctccctggag

SEQ ID NO: 5410541 - DNA, 17 bp, Homo sapiens
cttcctccgaggccagt

SEQ ID NO: 5410542 - DNA, 19 bp, Homo sapiens
cttcctccggctggacctg

SEQ ID NO: 5410543 - DNA, 18 bp, Homo sapiens
cttcctccgtccacccag

SEQ ID NO: 5410544 - DNA, 19 bp, Homo sapiens
cttcctccgtccacccagg

SEQ ID NO: 5410545 - DNA, 12 bp, Homo sapiens
cttcctcctcca

SEQ ID NO: 5410546 - DNA, 19 bp, Homo sapiens
cttcctcctccacagtgct

SEQ ID NO: 5410547 - DNA, 21 bp, Homo sapiens
cttcctcctccacagtgctgc

SEQ ID NO: 5410548 - DNA, 14 bp, Homo sapiens
cttcctcctccatc

SEQ ID NO: 5410549 - DNA, 12 bp, Homo sapiens
cttcctcctccc

SEQ ID NO: 5410550 - DNA, 19 bp, Homo sapiens
cttcctcctccccgctccg

SEQ ID NO: 5410551 - DNA, 14 bp, Homo sapiens
cttcctcctccctc

SEQ ID NO: 5410552 - DNA, 18 bp, Homo sapiens
cttcctcctccctcctgc

SEQ ID NO: 5410553 - DNA, 21 bp, Homo sapiens
cttcctcctccctcctgccga

SEQ ID NO: 5410554 - DNA, 13 bp, Homo sapiens
cttcctcctcctc

SEQ ID NO: 5410555 - DNA, 19 bp, Homo sapiens
cttcctcctcctcctcctg

SEQ ID NO: 5410556 - DNA, 11 bp, Homo sapiens
cttcctcctct

SEQ ID NO: 5410557 - DNA, 13 bp, Homo sapiens
cttcctcctctca

SEQ ID NO: 5410558 - DNA, 16 bp, Homo sapiens
cttcctcctctcctgg

SEQ ID NO: 5410559 - DNA, 12 bp, Homo sapiens
cttcctcctctg

SEQ ID NO: 5410560 - DNA, 10 bp, Homo sapiens
cttcctcctg

SEQ ID NO: 5410561 - DNA, 11 bp, Homo sapiens
cttcctcctga

SEQ ID NO: 5410562 - DNA, 18 bp, Homo sapiens
cttcctcctgaagcctct

SEQ ID NO: 5410563 - DNA, 20 bp, Homo sapiens
cttcctcctgaagcctctgc

SEQ ID NO: 5410564 - DNA, 14 bp, Homo sapiens
cttcctcctgacac

SEQ ID NO: 5410565 - DNA, 21 bp, Homo sapiens
cttcctcctgatggagtgtgc

SEQ ID NO: 5410566 - DNA, 15 bp, Homo sapiens
cttcctcctgatggc

SEQ ID NO: 5410567 - DNA, 21 bp, Homo sapiens
cttcctcctgatggccaagag

SEQ ID NO: 5410568 - DNA, 12 bp, Homo sapiens
cttcctcctgga

SEQ ID NO: 5410569 - DNA, 13 bp, Homo sapiens
cttcctcctggaa

SEQ ID NO: 5410570 - DNA, 14 bp, Homo sapiens
cttcctcctggaaa

SEQ ID NO: 5410571 - DNA, 14 bp, Homo sapiens
cttcctcctgggcc

SEQ ID NO: 5410572 - DNA, 19 bp, Homo sapiens
cttcctctcactcctgcct

SEQ ID NO: 5410573 - DNA, 21 bp, Homo sapiens
cttcctctcatccttttctcc

SEQ ID NO: 5410574 - DNA, 14 bp, Homo sapiens
cttcctctccacag

SEQ ID NO: 5410575 - DNA, 15 bp, Homo sapiens
cttcctctccacagg

SEQ ID NO: 5410576 - DNA, 16 bp, Homo sapiens
cttcctctccacagga

SEQ ID NO: 5410577 - DNA, 18 bp, Homo sapiens
cttcctctccacaggagc

SEQ ID NO: 5410578 - DNA, 19 bp, Homo sapiens
cttcctctccacaggagcc

SEQ ID NO: 5410579 - DNA, 13 bp, Homo sapiens
cttcctctccact

SEQ ID NO: 5410580 - DNA, 14 bp, Homo sapiens
cttcctctccactg

SEQ ID NO: 5410581 - DNA, 15 bp, Homo sapiens
cttcctctccttccc

SEQ ID NO: 5410582 - DNA, 20 bp, Homo sapiens
cttcctctcgcggccctcag

SEQ ID NO: 5410583 - DNA, 21 bp, Homo sapiens
cttcctctcgcggccctcagt

SEQ ID NO: 5410584 - DNA, 22 bp, Homo sapiens
cttcctctcggctggaagaaca

SEQ ID NO: 5410585 - DNA, 14 bp, Homo sapiens
cttcctctctaccc

SEQ ID NO: 5410586 - DNA, 19 bp, Homo sapiens
cttcctctctaccccccac

SEQ ID NO: 5410587 - DNA, 15 bp, Homo sapiens
cttcctctctctcac

SEQ ID NO: 5410588 - DNA, 12 bp, Homo sapiens
cttcctctgagg

SEQ ID NO: 5410589 - DNA, 14 bp, Homo sapiens
cttcctctgaggac

SEQ ID NO: 5410590 - DNA, 12 bp, Homo sapiens
cttcctctgcat

SEQ ID NO: 5410591 - DNA, 16 bp, Homo sapiens
cttcctctgctaaatt

SEQ ID NO: 5410592 - DNA, 15 bp, Homo sapiens
cttcctctgctcccc

SEQ ID NO: 5410593 - DNA, 13 bp, Homo sapiens
cttcctctgctgc

SEQ ID NO: 5410594 - DNA, 15 bp, Homo sapiens
cttcctctgctgcat

SEQ ID NO: 5410595 - DNA, 20 bp, Homo sapiens
cttcctctgctgcatcccct

SEQ ID NO: 5410596 - DNA, 21 bp, Homo sapiens
cttcctctgctgcatcccctt

SEQ ID NO: 5410597 - DNA, 11 bp, Homo sapiens
cttcctctgga

SEQ ID NO: 5410598 - DNA, 12 bp, Homo sapiens
cttcctctgggc

SEQ ID NO: 5410599 - DNA, 13 bp, Homo sapiens
cttcctctgggca

SEQ ID NO: 5410600 - DNA, 15 bp, Homo sapiens
cttcctctggggctc

SEQ ID NO: 5410601 - DNA, 21 bp, Homo sapiens
cttcctctggtaaacattcct

SEQ ID NO: 5410602 - DNA, 19 bp, Homo sapiens
cttcctctggttcctttca

SEQ ID NO: 5410603 - DNA, 13 bp, Homo sapiens
cttcctctggttt

SEQ ID NO: 5410604 - DNA, 21 bp, Homo sapiens
cttcctctggtttctgtgtgt

SEQ ID NO: 5410605 - DNA, 13 bp, Homo sapiens
cttcctctgtcct

SEQ ID NO: 5410606 - DNA, 17 bp, Homo sapiens
cttcctctgtgaactgt

SEQ ID NO: 5410607 - DNA, 14 bp, Homo sapiens
cttcctctgtgcca

SEQ ID NO: 5410608 - DNA, 17 bp, Homo sapiens
cttcctctgtgccacgc

SEQ ID NO: 5410609 - DNA, 17 bp, Homo sapiens
cttcctcttagcctctg

SEQ ID NO: 5410610 - DNA, 19 bp, Homo sapiens
cttcctcttcctgcccttg

SEQ ID NO: 5410611 - DNA, 19 bp, Homo sapiens
cttcctcttcggccctcag

SEQ ID NO: 5410612 - DNA, 14 bp, Homo sapiens
cttcctcttcttgt

SEQ ID NO: 5410613 - DNA, 18 bp, Homo sapiens
cttcctcttgaccctgca

SEQ ID NO: 5410614 - DNA, 20 bp, Homo sapiens
cttcctcttgaccctgcacc

SEQ ID NO: 5410615 - DNA, 16 bp, Homo sapiens
cttcctcttggctgag

SEQ ID NO: 5410616 - DNA, 18 bp, Homo sapiens
cttcctcttgtctgattt

SEQ ID NO: 5410617 - DNA, 12 bp, Homo sapiens
cttcctgaaata

SEQ ID NO: 5410618 - DNA, 18 bp, Homo sapiens
cttcctgacactttaatt

SEQ ID NO: 5410619 - DNA, 21 bp, Homo sapiens
cttcctgacccggattggccc

SEQ ID NO: 5410620 - DNA, 22 bp, Homo sapiens
cttcctgacccggattggccct

SEQ ID NO: 5410621 - DNA, 23 bp, Homo sapiens
cttcctgacccggattggccctg

SEQ ID NO: 5410622 - DNA, 19 bp, Homo sapiens
cttcctgaccctccgctgc

SEQ ID NO: 5410623 - DNA, 11 bp, Homo sapiens
cttcctgactg

SEQ ID NO: 5410624 - DNA, 23 bp, Homo sapiens
cttcctgagaaacgtccatctct

SEQ ID NO: 5410625 - DNA, 21 bp, Homo sapiens
cttcctgagaaagcccacctg

SEQ ID NO: 5410626 - DNA, 21 bp, Homo sapiens
cttcctgagcagtccctgctt

SEQ ID NO: 5410627 - DNA, 22 bp, Homo sapiens
cttcctgaggggagacagagca

SEQ ID NO: 5410628 - DNA, 15 bp, Homo sapiens
cttcctgattcccca

SEQ ID NO: 5410629 - DNA, 22 bp, Homo sapiens
cttcctgattggtttctcttct

SEQ ID NO: 5410630 - DNA, 23 bp, Homo sapiens
cttcctgattggtttctcttctc

SEQ ID NO: 5410631 - DNA, 17 bp, Homo sapiens
cttcctgcaaccactct

SEQ ID NO: 5410632 - DNA, 13 bp, Homo sapiens
cttcctgcaagga

SEQ ID NO: 5410633 - DNA, 17 bp, Homo sapiens
cttcctgcaattttcta

SEQ ID NO: 5410634 - DNA, 13 bp, Homo sapiens
cttcctgcacccg

SEQ ID NO: 5410635 - DNA, 14 bp, Homo sapiens
cttcctgcagacct

SEQ ID NO: 5410636 - DNA, 12 bp, Homo sapiens
cttcctgcagag

SEQ ID NO: 5410637 - DNA, 21 bp, Homo sapiens
cttcctgcaggcaggaacaaa

SEQ ID NO: 5410638 - DNA, 20 bp, Homo sapiens
cttcctgcagtctccgcctc

SEQ ID NO: 5410639 - DNA, 20 bp, Homo sapiens
cttcctgcattcacccagac

SEQ ID NO: 5410640 - DNA, 22 bp, Homo sapiens
cttcctgcattcacccagacag

SEQ ID NO: 5410641 - DNA, 20 bp, Homo sapiens
cttcctgcatttctcttctc

SEQ ID NO: 5410642 - DNA, 13 bp, Homo sapiens
cttcctgccacca

SEQ ID NO: 5410643 - DNA, 16 bp, Homo sapiens
cttcctgccaccagtc

SEQ ID NO: 5410644 - DNA, 18 bp, Homo sapiens
cttcctgccaccagtcac

SEQ ID NO: 5410645 - DNA, 17 bp, Homo sapiens
cttcctgccacctgctg

SEQ ID NO: 5410646 - DNA, 12 bp, Homo sapiens
cttcctgccact

SEQ ID NO: 5410647 - DNA, 13 bp, Homo sapiens
cttcctgccactg

SEQ ID NO: 5410648 - DNA, 15 bp, Homo sapiens
cttcctgccactgcc

SEQ ID NO: 5410649 - DNA, 17 bp, Homo sapiens
cttcctgccagcccctg

SEQ ID NO: 5410650 - DNA, 10 bp, Homo sapiens
cttcctgccc

SEQ ID NO: 5410651 - DNA, 15 bp, Homo sapiens
cttcctgcccctctt

SEQ ID NO: 5410652 - DNA, 12 bp, Homo sapiens
cttcctgcccta

SEQ ID NO: 5410653 - DNA, 19 bp, Homo sapiens
cttcctgccctacagaggt

SEQ ID NO: 5410654 - DNA, 16 bp, Homo sapiens
cttcctgccctagcag

SEQ ID NO: 5410655 - DNA, 14 bp, Homo sapiens
cttcctgccctgta

SEQ ID NO: 5410656 - DNA, 22 bp, Homo sapiens
cttcctgccctgtacctctctc

SEQ ID NO: 5410657 - DNA, 17 bp, Homo sapiens
cttcctgcccttccctc

SEQ ID NO: 5410658 - DNA, 19 bp, Homo sapiens
cttcctgcccttccctctg

SEQ ID NO: 5410659 - DNA, 20 bp, Homo sapiens
cttcctgcccttccctctgg

SEQ ID NO: 5410660 - DNA, 12 bp, Homo sapiens
cttcctgccggt

SEQ ID NO: 5410661 - DNA, 20 bp, Homo sapiens
cttcctgcctcccaagcagc

SEQ ID NO: 5410662 - DNA, 13 bp, Homo sapiens
cttcctgcctctc

SEQ ID NO: 5410663 - DNA, 20 bp, Homo sapiens
cttcctgcgtcctcctcacc

SEQ ID NO: 5410664 - DNA, 16 bp, Homo sapiens
cttcctgctacaggag

SEQ ID NO: 5410665 - DNA, 12 bp, Homo sapiens
cttctcccagaa

SEQ ID NO: 5410666 - DNA, 13 bp, Homo sapiens
cttctcccagaat

SEQ ID NO: 5410667 - DNA, 13 bp, Homo sapiens
cttctcccagagc

SEQ ID NO: 5410668 - DNA, 19 bp, Homo sapiens
cttctcccaggcaaggctg

SEQ ID NO: 5410669 - DNA, 21 bp, Homo sapiens
cttctcccaggcaaggctgtg

SEQ ID NO: 5410670 - DNA, 20 bp, Homo sapiens
cttctcccaggcctctgccc

SEQ ID NO: 5410671 - DNA, 13 bp, Homo sapiens
cttctcccatttc

SEQ ID NO: 5410672 - DNA, 18 bp, Homo sapiens
cttctcccatttcctgat

SEQ ID NO: 5410673 - DNA, 12 bp, Homo sapiens
cttctccccaca

SEQ ID NO: 5410674 - DNA, 17 bp, Homo sapiens
cttctccccactcccat

SEQ ID NO: 5410675 - DNA, 13 bp, Homo sapiens
cttctccccagcc

SEQ ID NO: 5410676 - DNA, 20 bp, Homo sapiens
cttctcccccacggtatcct

SEQ ID NO: 5410677 - DNA, 21 bp, Homo sapiens
cttctcccccacggtatccta

SEQ ID NO: 5410678 - DNA, 17 bp, Homo sapiens
cttctccccccatccca

SEQ ID NO: 5410679 - DNA, 21 bp, Homo sapiens
cttctccccccatcccagggt

SEQ ID NO: 5410680 - DNA, 18 bp, Homo sapiens
cttctcccccccggggct

SEQ ID NO: 5410681 - DNA, 12 bp, Homo sapiens
cttctcccccgc

SEQ ID NO: 5410682 - DNA, 17 bp, Homo sapiens
cttctcccccgccctgc

SEQ ID NO: 5410683 - DNA, 22 bp, Homo sapiens
cttctcccccgccctgccccgc

SEQ ID NO: 5410684 - DNA, 13 bp, Homo sapiens
cttctcccccttg

SEQ ID NO: 5410685 - DNA, 22 bp, Homo sapiens
cttctcccccttgtcttccccc

SEQ ID NO: 5410686 - DNA, 22 bp, Homo sapiens
cttctccccgaggctgccccag

SEQ ID NO: 5410687 - DNA, 15 bp, Homo sapiens
cttctccccgcagcc

SEQ ID NO: 5410688 - DNA, 14 bp, Homo sapiens
cttctcccctccag

SEQ ID NO: 5410689 - DNA, 19 bp, Homo sapiens
cttctcccctccccgcctg

SEQ ID NO: 5410690 - DNA, 22 bp, Homo sapiens
cttctcccctccccgcctggcc

SEQ ID NO: 5410691 - DNA, 21 bp, Homo sapiens
cttctcccctctcccagggat

SEQ ID NO: 5410692 - DNA, 15 bp, Homo sapiens
cttctcccctcttct

SEQ ID NO: 5410693 - DNA, 16 bp, Homo sapiens
cttctcccctcttctg

SEQ ID NO: 5410694 - DNA, 18 bp, Homo sapiens
cttctcccctcttctgag

SEQ ID NO: 5410695 - DNA, 14 bp, Homo sapiens
cttctcccctgccc

SEQ ID NO: 5410696 - DNA, 19 bp, Homo sapiens
cttctccccttccatttct

SEQ ID NO: 5410697 - DNA, 14 bp, Homo sapiens
cttctccccttcct

SEQ ID NO: 5410698 - DNA, 16 bp, Homo sapiens
cttctccccttcctgg

SEQ ID NO: 5410699 - DNA, 20 bp, Homo sapiens
cttctccccttcctggacac

SEQ ID NO: 5410700 - DNA, 21 bp, Homo sapiens
cttctccccttcctggacaca

SEQ ID NO: 5410701 - DNA, 17 bp, Homo sapiens
cttctcccctttcaaat

SEQ ID NO: 5410702 - DNA, 14 bp, Homo sapiens
cttctcccgccatt

SEQ ID NO: 5410703 - DNA, 19 bp, Homo sapiens
cttctcccgccattggcct

SEQ ID NO: 5410704 - DNA, 14 bp, Homo sapiens
cttctcccggacct

SEQ ID NO: 5410705 - DNA, 16 bp, Homo sapiens
cttctcccggacctgg

SEQ ID NO: 5410706 - DNA, 18 bp, Homo sapiens
cttctcccggacctggac

SEQ ID NO: 5410707 - DNA, 16 bp, Homo sapiens
cttctccctagctcct

SEQ ID NO: 5410708 - DNA, 22 bp, Homo sapiens
cttctccctcatttcaggagca

SEQ ID NO: 5410709 - DNA, 20 bp, Homo sapiens
cttctccctcctcctccttt

SEQ ID NO: 5410710 - DNA, 22 bp, Homo sapiens
cttctccctgcacaagccaggg

SEQ ID NO: 5410711 - DNA, 12 bp, Homo sapiens
cttctccctgga

SEQ ID NO: 5410712 - DNA, 13 bp, Homo sapiens
cttctccctggaa

SEQ ID NO: 5410713 - DNA, 20 bp, Homo sapiens
cttctccctggactctgtgg

SEQ ID NO: 5410714 - DNA, 13 bp, Homo sapiens
cttctccctgggg

SEQ ID NO: 5410715 - DNA, 15 bp, Homo sapiens
cttctcccttctcct

SEQ ID NO: 5410716 - DNA, 17 bp, Homo sapiens
cttctccctttagttct

SEQ ID NO: 5410717 - DNA, 15 bp, Homo sapiens
cttctccgccagcct

SEQ ID NO: 5410718 - DNA, 19 bp, Homo sapiens
cttctccgccagcctcctc

SEQ ID NO: 5410719 - DNA, 21 bp, Homo sapiens
cttctccgccagcctcctctg

SEQ ID NO: 5410720 - DNA, 14 bp, Homo sapiens
cttctcctatgtgt

SEQ ID NO: 5410721 - DNA, 16 bp, Homo sapiens
cttctcctatgtgtaa

SEQ ID NO: 5410722 - DNA, 22 bp, Homo sapiens
cttctcctatgtgtaaggtgaa

SEQ ID NO: 5410723 - DNA, 15 bp, Homo sapiens
cttctcctcccagcg

SEQ ID NO: 5410724 - DNA, 22 bp, Homo sapiens
cttctcctcccagcgtgtgtat

SEQ ID NO: 5410725 - DNA, 15 bp, Homo sapiens
cttctcctctgctag

SEQ ID NO: 5410726 - DNA, 22 bp, Homo sapiens
cttctcctctgctccaacagac

SEQ ID NO: 5410727 - DNA, 11 bp, Homo sapiens
cttctcctctt

SEQ ID NO: 5410728 - DNA, 17 bp, Homo sapiens
cttctcctgatcctgca

SEQ ID NO: 5410729 - DNA, 12 bp, Homo sapiens
cttctcctgcag

SEQ ID NO: 5410730 - DNA, 18 bp, Homo sapiens
cttctcctgcagtctgtg

SEQ ID NO: 5410731 - DNA, 16 bp, Homo sapiens
cttctcctgcagtgga

SEQ ID NO: 5410732 - DNA, 14 bp, Homo sapiens
cttctcctgcctac

SEQ ID NO: 5410733 - DNA, 20 bp, Homo sapiens
cttctcctgctgctcctgtt

SEQ ID NO: 5410734 - DNA, 21 bp, Homo sapiens
cttctcctggagttgcattga

SEQ ID NO: 5410735 - DNA, 17 bp, Homo sapiens
cttctcctgtgatgtcc

SEQ ID NO: 5410736 - DNA, 20 bp, Homo sapiens
cttctcctgtgatgtcccag

SEQ ID NO: 5410737 - DNA, 19 bp, Homo sapiens
cttctcctgttttatatat

SEQ ID NO: 5410738 - DNA, 23 bp, Homo sapiens
cttctcctgttttatatattatg

SEQ ID NO: 5410739 - DNA, 12 bp, Homo sapiens
cttctccttaac

SEQ ID NO: 5410740 - DNA, 19 bp, Homo sapiens
cttctccttagacactttg

SEQ ID NO: 5410741 - DNA, 21 bp, Homo sapiens
cttctccttagacactttgga

SEQ ID NO: 5410742 - DNA, 14 bp, Homo sapiens
cttctccttcccca

SEQ ID NO: 5410743 - DNA, 18 bp, Homo sapiens
cttctccttccccaggat

SEQ ID NO: 5410744 - DNA, 19 bp, Homo sapiens
cttctccttccccaggatg

SEQ ID NO: 5410745 - DNA, 14 bp, Homo sapiens
cttctccttggagg

SEQ ID NO: 5410746 - DNA, 16 bp, Homo sapiens
cttctccttggaggac

SEQ ID NO: 5410747 - DNA, 19 bp, Homo sapiens
cttctcctttccttcccag

SEQ ID NO: 5410748 - DNA, 21 bp, Homo sapiens
cttctcctttctaagccctgt

SEQ ID NO: 5410749 - DNA, 22 bp, Homo sapiens
cttctcctttggcatgtttaat

SEQ ID NO: 5410750 - DNA, 16 bp, Homo sapiens
cttctcgcaactgaag

SEQ ID NO: 5410751 - DNA, 22 bp, Homo sapiens
cttctcgcctaggatttcagcc

SEQ ID NO: 5410752 - DNA, 19 bp, Homo sapiens
cttctcggaggccaggccc

SEQ ID NO: 5410753 - DNA, 14 bp, Homo sapiens
cttctcggccagcc

SEQ ID NO: 5410754 - DNA, 22 bp, Homo sapiens
cttctcggctcaggctctgctg

SEQ ID NO: 5410755 - DNA, 20 bp, Homo sapiens
cttctcgtagatgctgccta

SEQ ID NO: 5410756 - DNA, 21 bp, Homo sapiens
cttctcgtagatgctgcctag

SEQ ID NO: 5410757 - DNA, 22 bp, Homo sapiens
cttctcgtcttcctctctctca

SEQ ID NO: 5410758 - DNA, 20 bp, Homo sapiens
cttctctaattcttcctttg

SEQ ID NO: 5410759 - DNA, 13 bp, Homo sapiens
cttctctacagac

SEQ ID NO: 5410760 - DNA, 20 bp, Homo sapiens
cttctctacccatctccccc

SEQ ID NO: 5410761 - DNA, 21 bp, Homo sapiens
cttctctacccatctccccca

SEQ ID NO: 5410762 - DNA, 17 bp, Homo sapiens
cttctctactcatgcca

SEQ ID NO: 5410763 - DNA, 12 bp, Homo sapiens
cttctctataaa

SEQ ID NO: 5410764 - DNA, 13 bp, Homo sapiens
cttctctatcctc

SEQ ID NO: 5410765 - DNA, 19 bp, Homo sapiens
cttctctattcctgaccct

SEQ ID NO: 5410766 - DNA, 13 bp, Homo sapiens
cttctctcaacct

SEQ ID NO: 5410767 - DNA, 23 bp, Homo sapiens
cttctctcaaccttggccttctc

SEQ ID NO: 5410768 - DNA, 14 bp, Homo sapiens
cttctctcaatccc

SEQ ID NO: 5410769 - DNA, 14 bp, Homo sapiens
cttctctcacctcc

SEQ ID NO: 5410770 - DNA, 20 bp, Homo sapiens
cttctctcagacttacttta

SEQ ID NO: 5410771 - DNA, 14 bp, Homo sapiens
cttctctcagatgg

SEQ ID NO: 5410772 - DNA, 22 bp, Homo sapiens
cttctctcagccagctgtttaa

SEQ ID NO: 5410773 - DNA, 18 bp, Homo sapiens
cttctctcagctcccagg

SEQ ID NO: 5410774 - DNA, 21 bp, Homo sapiens
cttctctcagctcccaggcca

SEQ ID NO: 5410775 - DNA, 14 bp, Homo sapiens
cttctctcatctct

SEQ ID NO: 5410776 - DNA, 19 bp, Homo sapiens
cttctctcatctgatcact

SEQ ID NO: 5410777 - DNA, 18 bp, Homo sapiens
cttctctccacagtgttg

SEQ ID NO: 5410778 - DNA, 12 bp, Homo sapiens
cttctctccact

SEQ ID NO: 5410779 - DNA, 11 bp, Homo sapiens
cttctctccag

SEQ ID NO: 5410780 - DNA, 15 bp, Homo sapiens
cttctctccagagct

SEQ ID NO: 5410781 - DNA, 19 bp, Homo sapiens
cttctctccagcccctgga

SEQ ID NO: 5410782 - DNA, 14 bp, Homo sapiens
cttctctccagctg

SEQ ID NO: 5410783 - DNA, 17 bp, Homo sapiens
cttctctccagctgact

SEQ ID NO: 5410784 - DNA, 19 bp, Homo sapiens
cttctctccagctgactaa

SEQ ID NO: 5410785 - DNA, 21 bp, Homo sapiens
cttctctccaggctgtttctt

SEQ ID NO: 5410786 - DNA, 12 bp, Homo sapiens
cttctctcccca

SEQ ID NO: 5410787 - DNA, 15 bp, Homo sapiens
cttctctcctcccca

SEQ ID NO: 5410788 - DNA, 13 bp, Homo sapiens
cttctctccttgc

SEQ ID NO: 5410789 - DNA, 20 bp, Homo sapiens
cttctctcctttctccctgc

SEQ ID NO: 5410790 - DNA, 23 bp, Homo sapiens
cttctctcggggcgacccctcag

SEQ ID NO: 5410791 - DNA, 15 bp, Homo sapiens
cttctctctcaccag

SEQ ID NO: 5410792 - DNA, 12 bp, Homo sapiens
cttctctctcca

SEQ ID NO: 5410793 - DNA, 15 bp, Homo sapiens
cttctctctccagaa

SEQ ID NO: 5410794 - DNA, 16 bp, Homo sapiens
cttctctctccagggt

SEQ ID NO: 5410795 - DNA, 15 bp, Homo sapiens
cttctctctccctgt

SEQ ID NO: 5410796 - DNA, 14 bp, Homo sapiens
cttctctctctctc

SEQ ID NO: 5410797 - DNA, 23 bp, Homo sapiens
cttctctctctctcaaaattata

SEQ ID NO: 5410798 - DNA, 15 bp, Homo sapiens
cttctctctgagctg

SEQ ID NO: 5410799 - DNA, 14 bp, Homo sapiens
cttctctctgctct

SEQ ID NO: 5410800 - DNA, 15 bp, Homo sapiens
cttctctctgtgctg

SEQ ID NO: 5410801 - DNA, 16 bp, Homo sapiens
cttctctctgtgggat

SEQ ID NO: 5410802 - DNA, 15 bp, Homo sapiens
cttctctctgttccc

SEQ ID NO: 5410803 - DNA, 14 bp, Homo sapiens
cttctctctttcta

SEQ ID NO: 5410804 - DNA, 13 bp, Homo sapiens
cttctctcttttc

SEQ ID NO: 5410805 - DNA, 13 bp, Homo sapiens
cttctctgaacac

SEQ ID NO: 5410806 - DNA, 15 bp, Homo sapiens
cttctctgaacacag

SEQ ID NO: 5410807 - DNA, 16 bp, Homo sapiens
cttctctgaacacagg

SEQ ID NO: 5410808 - DNA, 17 bp, Homo sapiens
cttctctgaacacaggc

SEQ ID NO: 5410809 - DNA, 13 bp, Homo sapiens
cttctctgaaggg

SEQ ID NO: 5410810 - DNA, 19 bp, Homo sapiens
cttctctgaatcagaaaag

SEQ ID NO: 5410811 - DNA, 15 bp, Homo sapiens
cttctctgacttctg

SEQ ID NO: 5410812 - DNA, 20 bp, Homo sapiens
cttctctgacttctgcctgg

SEQ ID NO: 5410813 - DNA, 17 bp, Homo sapiens
cttctctgcaatgcttc

SEQ ID NO: 5410814 - DNA, 21 bp, Homo sapiens
cttctctgcagtaaaacacat

SEQ ID NO: 5410815 - DNA, 18 bp, Homo sapiens
cttctctgccaagccctc

SEQ ID NO: 5410816 - DNA, 13 bp, Homo sapiens
cttctctgcccat

SEQ ID NO: 5410817 - DNA, 23 bp, Homo sapiens
cttctctgcccattccccagcct

SEQ ID NO: 5410818 - DNA, 20 bp, Homo sapiens
cttctctgccctgccctggc

SEQ ID NO: 5410819 - DNA, 13 bp, Homo sapiens
cttctctgcctcc

SEQ ID NO: 5410820 - DNA, 15 bp, Homo sapiens
cttctctgcctcctc

SEQ ID NO: 5410821 - DNA, 23 bp, Homo sapiens
cttctctgcctttgacatttaat

SEQ ID NO: 5410822 - DNA, 23 bp, Homo sapiens
cttctctgctagatttctacatt

SEQ ID NO: 5410823 - DNA, 11 bp, Homo sapiens
cttctctgctc

SEQ ID NO: 5410824 - DNA, 12 bp, Homo sapiens
cttctctgctcc

SEQ ID NO: 5410825 - DNA, 16 bp, Homo sapiens
cttctctgctccacca

SEQ ID NO: 5410826 - DNA, 17 bp, Homo sapiens
cttctctgctgcctctg

SEQ ID NO: 5410827 - DNA, 19 bp, Homo sapiens
cttctctgctgcctctgtg

SEQ ID NO: 5410828 - DNA, 21 bp, Homo sapiens
cttctctggagccaagtccag

SEQ ID NO: 5410829 - DNA, 21 bp, Homo sapiens
cttctctgggaccaggctcca

SEQ ID NO: 5410830 - DNA, 22 bp, Homo sapiens
cttctctgtaagtaattgccac

SEQ ID NO: 5410831 - DNA, 23 bp, Homo sapiens
cttctctgtagctgctagtgagc

SEQ ID NO: 5410832 - DNA, 22 bp, Homo sapiens
cttctctgtattcctagaaact

SEQ ID NO: 5410833 - DNA, 13 bp, Homo sapiens
cttctctgtctca

SEQ ID NO: 5410834 - DNA, 17 bp, Homo sapiens
cttctctgtgcaggagc

SEQ ID NO: 5410835 - DNA, 17 bp, Homo sapiens
cttctctgttcatttcc

SEQ ID NO: 5410836 - DNA, 21 bp, Homo sapiens
cttctctgttcccttgcaggg

SEQ ID NO: 5410837 - DNA, 17 bp, Homo sapiens
cttctctgttggtctgc

SEQ ID NO: 5410838 - DNA, 18 bp, Homo sapiens
cttctctgttggtctgcc

SEQ ID NO: 5410839 - DNA, 22 bp, Homo sapiens
cttctctgtttttcttctgaaa

SEQ ID NO: 5410840 - DNA, 23 bp, Homo sapiens
cttctctgtttttcttctgaaat

SEQ ID NO: 5410841 - DNA, 15 bp, Homo sapiens
cttctcttaatttaa

SEQ ID NO: 5410842 - DNA, 16 bp, Homo sapiens
cttctcttaatttaat

SEQ ID NO: 5410843 - DNA, 23 bp, Homo sapiens
cttcttcgttaatagattatttc

SEQ ID NO: 5410844 - DNA, 18 bp, Homo sapiens
cttcttctaagaagacat

SEQ ID NO: 5410845 - DNA, 19 bp, Homo sapiens
cttcttctcctaggattcc

SEQ ID NO: 5410846 - DNA, 14 bp, Homo sapiens
cttcttctgaaaga

SEQ ID NO: 5410847 - DNA, 17 bp, Homo sapiens
cttcttctgccacttct

SEQ ID NO: 5410848 - DNA, 13 bp, Homo sapiens
cttcttctgcccc

SEQ ID NO: 5410849 - DNA, 12 bp, Homo sapiens
cttcttctgtaa

SEQ ID NO: 5410850 - DNA, 13 bp, Homo sapiens
cttcttctgtaat

SEQ ID NO: 5410851 - DNA, 18 bp, Homo sapiens
cttcttctgtaatattta

SEQ ID NO: 5410852 - DNA, 22 bp, Homo sapiens
cttcttctgtaatatttacaat

SEQ ID NO: 5410853 - DNA, 21 bp, Homo sapiens
cttcttctgtccaagcagatt

SEQ ID NO: 5410854 - DNA, 12 bp, Homo sapiens
cttcttcttata

SEQ ID NO: 5410855 - DNA, 10 bp, Homo sapiens
cttcttcttc

SEQ ID NO: 5410856 - DNA, 14 bp, Homo sapiens
cttcttctttgttt

SEQ ID NO: 5410857 - DNA, 21 bp, Homo sapiens
cttcttcttttgagcaacttt

SEQ ID NO: 5410858 - DNA, 18 bp, Homo sapiens
cttcttctttttgctgtt

SEQ ID NO: 5410859 - DNA, 17 bp, Homo sapiens
cttcttgaaaataaaaa

SEQ ID NO: 5410860 - DNA, 12 bp, Homo sapiens
cttcttgaaggt

SEQ ID NO: 5410861 - DNA, 22 bp, Homo sapiens
cttcttgaatggcaatgttttg

SEQ ID NO: 5410862 - DNA, 18 bp, Homo sapiens
cttcttgcatccttccta

SEQ ID NO: 5410863 - DNA, 12 bp, Homo sapiens
cttcttgcatct

SEQ ID NO: 5410864 - DNA, 14 bp, Homo sapiens
cttcttgccccttg

SEQ ID NO: 5410865 - DNA, 17 bp, Homo sapiens
cttcttgccctgagctt

SEQ ID NO: 5410866 - DNA, 18 bp, Homo sapiens
cttcttgcctctgtgctg

SEQ ID NO: 5410867 - DNA, 14 bp, Homo sapiens
cttcttgcctgctg

SEQ ID NO: 5410868 - DNA, 19 bp, Homo sapiens
cttcttgcggcaccgccca

SEQ ID NO: 5410869 - DNA, 14 bp, Homo sapiens
cttcttgctatatg

SEQ ID NO: 5410870 - DNA, 13 bp, Homo sapiens
cttcttgctcctg

SEQ ID NO: 5410871 - DNA, 17 bp, Homo sapiens
cttcttgcttgtaaaaa

SEQ ID NO: 5410872 - DNA, 19 bp, Homo sapiens
cttcttggagctttggaat

SEQ ID NO: 5410873 - DNA, 22 bp, Homo sapiens
cttcttggagctttggaatatt

SEQ ID NO: 5410874 - DNA, 23 bp, Homo sapiens
cttcttggcgctggagagtcaaa

SEQ ID NO: 5410875 - DNA, 14 bp, Homo sapiens
cttcttggcttcct

SEQ ID NO: 5410876 - DNA, 19 bp, Homo sapiens
cttcttgggactgctgtga

SEQ ID NO: 5410877 - DNA, 20 bp, Homo sapiens
cttcttgggactgctgtgaa

SEQ ID NO: 5410878 - DNA, 18 bp, Homo sapiens
cttcttgggagtatgttg

SEQ ID NO: 5410879 - DNA, 15 bp, Homo sapiens
cttcttgggccccag

SEQ ID NO: 5410880 - DNA, 19 bp, Homo sapiens
cttcttgggccccagaccc

SEQ ID NO: 5410881 - DNA, 18 bp, Homo sapiens
cttcttgggcccggtcca

SEQ ID NO: 5410882 - DNA, 22 bp, Homo sapiens
cttcttgggcccggtccacagg

SEQ ID NO: 5410883 - DNA, 19 bp, Homo sapiens
cttcttgggctgagtgcag

SEQ ID NO: 5410884 - DNA, 20 bp, Homo sapiens
cttcttgggctgagtgcagc

SEQ ID NO: 5410885 - DNA, 19 bp, Homo sapiens
cttcttggggcccagtgca

SEQ ID NO: 5410886 - DNA, 21 bp, Homo sapiens
cttcttggggcccagtgcatg

SEQ ID NO: 5410887 - DNA, 24 bp, Homo sapiens
cttcttggggcccagtgcatggtg

SEQ ID NO: 5410888 - DNA, 18 bp, Homo sapiens
cttcttgggggcagacca

SEQ ID NO: 5410889 - DNA, 21 bp, Homo sapiens
cttcttgggggtaagctgatt

SEQ ID NO: 5410890 - DNA, 18 bp, Homo sapiens
cttcttgggtagggcaga

SEQ ID NO: 5410891 - DNA, 13 bp, Homo sapiens
cttcttgggtctg

SEQ ID NO: 5410892 - DNA, 18 bp, Homo sapiens
cttcttgggtctgccctg

SEQ ID NO: 5410893 - DNA, 22 bp, Homo sapiens
cttcttgggtctgccctgccca

SEQ ID NO: 5410894 - DNA, 20 bp, Homo sapiens
cttcttggtcttatttatta

SEQ ID NO: 5410895 - DNA, 17 bp, Homo sapiens
cttcttggtggattaga

SEQ ID NO: 5410896 - DNA, 18 bp, Homo sapiens
cttcttggttcctgggat

SEQ ID NO: 5410897 - DNA, 22 bp, Homo sapiens
cttcttggttttctctctggat

SEQ ID NO: 5410898 - DNA, 23 bp, Homo sapiens
cttcttgtcaccccagttccctt

SEQ ID NO: 5410899 - DNA, 21 bp, Homo sapiens
cttcttgtcagacataaagcc

SEQ ID NO: 5410900 - DNA, 12 bp, Homo sapiens
cttcttgtctct

SEQ ID NO: 5410901 - DNA, 13 bp, Homo sapiens
cttcttgtctctc

SEQ ID NO: 5410902 - DNA, 20 bp, Homo sapiens
cttcttgtgaaaccacaggc

SEQ ID NO: 5410903 - DNA, 23 bp, Homo sapiens
cttcttgtgatcttgctctatct

SEQ ID NO: 5410904 - DNA, 21 bp, Homo sapiens
cttcttgtgattgctgccata

SEQ ID NO: 5410905 - DNA, 15 bp, Homo sapiens
cttcttgtgtcctga

SEQ ID NO: 5410906 - DNA, 15 bp, Homo sapiens
cttcttgttctgaga

SEQ ID NO: 5410907 - DNA, 16 bp, Homo sapiens
cttcttgtttccttgt

SEQ ID NO: 5410908 - DNA, 12 bp, Homo sapiens
cttctttaaatc

SEQ ID NO: 5410909 - DNA, 18 bp, Homo sapiens
cttctttaaatcaaaagc

SEQ ID NO: 5410910 - DNA, 17 bp, Homo sapiens
cttctttaattgatcta

SEQ ID NO: 5410911 - DNA, 18 bp, Homo sapiens
cttctttagatgccaaac

SEQ ID NO: 5410912 - DNA, 18 bp, Homo sapiens
cttctttattatagtcct

SEQ ID NO: 5410913 - DNA, 15 bp, Homo sapiens
cttctttattattcc

SEQ ID NO: 5410914 - DNA, 16 bp, Homo sapiens
cttctttattctgtgt

SEQ ID NO: 5410915 - DNA, 15 bp, Homo sapiens
cttctttatttttta

SEQ ID NO: 5410916 - DNA, 19 bp, Homo sapiens
cttctttcagtgacttctt

SEQ ID NO: 5410917 - DNA, 12 bp, Homo sapiens
cttctttcatgt

SEQ ID NO: 5410918 - DNA, 14 bp, Homo sapiens
cttctttcatgtaa

SEQ ID NO: 5410919 - DNA, 19 bp, Homo sapiens
cttctttccacagaagctc

SEQ ID NO: 5410920 - DNA, 19 bp, Homo sapiens
cttctttccagaaaccaaa

SEQ ID NO: 5410921 - DNA, 14 bp, Homo sapiens
cttctttccagtat

SEQ ID NO: 5410922 - DNA, 23 bp, Homo sapiens
cttctttccatcaactcccaact

SEQ ID NO: 5410923 - DNA, 21 bp, Homo sapiens
cttctttccattcttcttgct

SEQ ID NO: 5410924 - DNA, 13 bp, Homo sapiens
cttctttccctgg

SEQ ID NO: 5410925 - DNA, 16 bp, Homo sapiens
cttctttccctggaca

SEQ ID NO: 5410926 - DNA, 22 bp, Homo sapiens
cttctttccctggacaggcagc

SEQ ID NO: 5410927 - DNA, 23 bp, Homo sapiens
cttctttccctggacaggcagcc

SEQ ID NO: 5410928 - DNA, 19 bp, Homo sapiens
cttctttcccttagtgact

SEQ ID NO: 5410929 - DNA, 20 bp, Homo sapiens
cttctttcccttagtgactc

SEQ ID NO: 5410930 - DNA, 19 bp, Homo sapiens
cttctttcccttcctccat

SEQ ID NO: 5410931 - DNA, 23 bp, Homo sapiens
cttctttcccttcctccatcctc

SEQ ID NO: 5410932 - DNA, 13 bp, Homo sapiens
cttctttcctctt

SEQ ID NO: 5410933 - DNA, 14 bp, Homo sapiens
cttctttcctctta

SEQ ID NO: 5410934 - DNA, 15 bp, Homo sapiens
cttctttcctcttcc

SEQ ID NO: 5410935 - DNA, 16 bp, Homo sapiens
cttctttccttccttt

SEQ ID NO: 5410936 - DNA, 22 bp, Homo sapiens
cttctttcctttactcctggct

SEQ ID NO: 5410937 - DNA, 20 bp, Homo sapiens
cttctttctaatacaagcat

SEQ ID NO: 5410938 - DNA, 17 bp, Homo sapiens
cttctttctagagcagt

SEQ ID NO: 5410939 - DNA, 23 bp, Homo sapiens
cttctttctctcagccttacatt

SEQ ID NO: 5410940 - DNA, 15 bp, Homo sapiens
cttctttctgactct

SEQ ID NO: 5410941 - DNA, 12 bp, Homo sapiens
cttctttctgct

SEQ ID NO: 5410942 - DNA, 17 bp, Homo sapiens
cttctttctggactggc

SEQ ID NO: 5410943 - DNA, 17 bp, Homo sapiens
cttctttcttgctttga

SEQ ID NO: 5410944 - DNA, 11 bp, Homo sapiens
cttctttcttt

SEQ ID NO: 5410945 - DNA, 15 bp, Homo sapiens
cttctttctttcttt

SEQ ID NO: 5410946 - DNA, 13 bp, Homo sapiens
cttctttctttta

SEQ ID NO: 5410947 - DNA, 18 bp, Homo sapiens
cttctttgaagttattta

SEQ ID NO: 5410948 - DNA, 23 bp, Homo sapiens
cttctttgaatttcctatctgta

SEQ ID NO: 5410949 - DNA, 14 bp, Homo sapiens
cttctttgataatg

SEQ ID NO: 5410950 - DNA, 19 bp, Homo sapiens
cttctttgcaacaataata

SEQ ID NO: 5410951 - DNA, 16 bp, Homo sapiens
cttctttgcagagcct

SEQ ID NO: 5410952 - DNA, 12 bp, Homo sapiens
cttctttgccct

SEQ ID NO: 5410953 - DNA, 18 bp, Homo sapiens
cttctttgcttctttttc

SEQ ID NO: 5410954 - DNA, 13 bp, Homo sapiens
cttctttgcttgc

SEQ ID NO: 5410955 - DNA, 20 bp, Homo sapiens
cttctttggaaataaaagat

SEQ ID NO: 5410956 - DNA, 17 bp, Homo sapiens
cttctttggacttctga

SEQ ID NO: 5410957 - DNA, 21 bp, Homo sapiens
cttctttggtgttctggcctc

SEQ ID NO: 5410958 - DNA, 16 bp, Homo sapiens
cttctttgtcttagct

SEQ ID NO: 5410959 - DNA, 14 bp, Homo sapiens
cttctttgtgcctt

SEQ ID NO: 5410960 - DNA, 18 bp, Homo sapiens
cttctttgtgcctttggc

SEQ ID NO: 5410961 - DNA, 19 bp, Homo sapiens
cttctttgtggtctttttc

SEQ ID NO: 5410962 - DNA, 21 bp, Homo sapiens
cttctttgtggtctttttcct

SEQ ID NO: 5410963 - DNA, 23 bp, Homo sapiens
cttcttttacttgaaaagaaagt

SEQ ID NO: 5410964 - DNA, 23 bp, Homo sapiens
cttcttttagcagtaaaatagct

SEQ ID NO: 5410965 - DNA, 15 bp, Homo sapiens
cttcttttcaatgca

SEQ ID NO: 5410966 - DNA, 18 bp, Homo sapiens
cttcttttcaatgcaatg

SEQ ID NO: 5410967 - DNA, 18 bp, Homo sapiens
cttcttttcctgcagggg

SEQ ID NO: 5410968 - DNA, 17 bp, Homo sapiens
cttcttttcctgggtgc

SEQ ID NO: 5410969 - DNA, 20 bp, Homo sapiens
cttcttttcctgggtgctca

SEQ ID NO: 5410970 - DNA, 12 bp, Homo sapiens
cttcttttcctt

SEQ ID NO: 5410971 - DNA, 13 bp, Homo sapiens
cttcttttctctt

SEQ ID NO: 5410972 - DNA, 16 bp, Homo sapiens
cttcttttctttgtat

SEQ ID NO: 5410973 - DNA, 12 bp, Homo sapiens
cttcttttgagc

SEQ ID NO: 5410974 - DNA, 15 bp, Homo sapiens
cttcttttgccaact

SEQ ID NO: 5410975 - DNA, 13 bp, Homo sapiens
cttcttttgctct

SEQ ID NO: 5410976 - DNA, 14 bp, Homo sapiens
cttcttttggaaag

SEQ ID NO: 5410977 - DNA, 15 bp, Homo sapiens
cttcttttggcttcc

SEQ ID NO: 5410978 - DNA, 14 bp, Homo sapiens
cttcttttgtctcc

SEQ ID NO: 5410979 - DNA, 13 bp, Homo sapiens
cttcttttgtgaa

SEQ ID NO: 5410980 - DNA, 16 bp, Homo sapiens
cttctttttaatctta

SEQ ID NO: 5410981 - DNA, 23 bp, Homo sapiens
cttctttttattttcttttgtaa

SEQ ID NO: 5410982 - DNA, 16 bp, Homo sapiens
cttctttttctggact

SEQ ID NO: 5410983 - DNA, 22 bp, Homo sapiens
cttctttttctggactctggac

SEQ ID NO: 5410984 - DNA, 18 bp, Homo sapiens
cttctttttctttgagaa

SEQ ID NO: 5410985 - DNA, 14 bp, Homo sapiens
cttcttttttatct

SEQ ID NO: 5410986 - DNA, 20 bp, Homo sapiens
cttcttttttatctggttct

SEQ ID NO: 5410987 - DNA, 20 bp, Homo sapiens
cttcttttttcaaaagaaag

SEQ ID NO: 5410988 - DNA, 16 bp, Homo sapiens
cttcttttttttcatt

SEQ ID NO: 5410989 - DNA, 17 bp, Homo sapiens
cttgaaaaaaaaaatat

SEQ ID NO: 5410990 - DNA, 14 bp, Homo sapiens
cttgaaaaaaaaca

SEQ ID NO: 5410991 - DNA, 16 bp, Homo sapiens
cttgaaaaaaaacagt

SEQ ID NO: 5410992 - DNA, 14 bp, Homo sapiens
cttgaaaaaaaata

SEQ ID NO: 5410993 - DNA, 23 bp, Homo sapiens
cttgaaaaacaaagtttctattt

SEQ ID NO: 5410994 - DNA, 14 bp, Homo sapiens
cttgaaaaagtaga

SEQ ID NO: 5410995 - DNA, 20 bp, Homo sapiens
cttgaaaaatacttttcctt

SEQ ID NO: 5410996 - DNA, 13 bp, Homo sapiens
cttgaaaaatatt

SEQ ID NO: 5410997 - DNA, 13 bp, Homo sapiens
cttgaaaaatgac

SEQ ID NO: 5410998 - DNA, 18 bp, Homo sapiens
cttgaaaaatgacaattg

SEQ ID NO: 5410999 - DNA, 18 bp, Homo sapiens
cttgaaaaatgtgcaaaa

SEQ ID NO: 5411000 - DNA, 21 bp, Homo sapiens
cttgaaaaatgtgcaaaacag

SEQ ID NO: 5411001 - DNA, 23 bp, Homo sapiens
cttgaaaacactgttctctgccc

SEQ ID NO: 5411002 - DNA, 20 bp, Homo sapiens
cttgaaaacatgttagtcaa

SEQ ID NO: 5411003 - DNA, 13 bp, Homo sapiens
cttgaaaactgtg

SEQ ID NO: 5411004 - DNA, 15 bp, Homo sapiens
cttgaaaagagacag

SEQ ID NO: 5411005 - DNA, 19 bp, Homo sapiens
cttgaaaagaggtgaccat

SEQ ID NO: 5411006 - DNA, 14 bp, Homo sapiens
cttgaaaagattct

SEQ ID NO: 5411007 - DNA, 20 bp, Homo sapiens
cttgaaaagattctgaaacc

SEQ ID NO: 5411008 - DNA, 16 bp, Homo sapiens
cttgaaaagattgcaa

SEQ ID NO: 5411009 - DNA, 15 bp, Homo sapiens
cttgaaaagggtgtt

SEQ ID NO: 5411010 - DNA, 18 bp, Homo sapiens
cttgaaaataaaaagaga

SEQ ID NO: 5411011 - DNA, 22 bp, Homo sapiens
cttgaaaataagaatagaaata

SEQ ID NO: 5411012 - DNA, 21 bp, Homo sapiens
cttgaaaataataaagtggca

SEQ ID NO: 5411013 - DNA, 15 bp, Homo sapiens
cttgaaaatgccacc

SEQ ID NO: 5411014 - DNA, 22 bp, Homo sapiens
cttgaaaatgtggcttcttcaa

SEQ ID NO: 5411015 - DNA, 12 bp, Homo sapiens
cttgaaaattaa

SEQ ID NO: 5411016 - DNA, 14 bp, Homo sapiens
cttgaaacagcctg

SEQ ID NO: 5411017 - DNA, 16 bp, Homo sapiens
cttgaaacagcctggg

SEQ ID NO: 5411018 - DNA, 17 bp, Homo sapiens
cttgaaacagcctgggt

SEQ ID NO: 5411019 - DNA, 14 bp, Homo sapiens
cttgaaacatgttc

SEQ ID NO: 5411020 - DNA, 19 bp, Homo sapiens
cttgaaacatgttcatctg

SEQ ID NO: 5411021 - DNA, 23 bp, Homo sapiens
cttgaggagctcaacggtctggc

SEQ ID NO: 5411022 - DNA, 13 bp, Homo sapiens
cttgaggaggggc

SEQ ID NO: 5411023 - DNA, 21 bp, Homo sapiens
cttgaggaggggcacctgcca

SEQ ID NO: 5411024 - DNA, 22 bp, Homo sapiens
cttgaggaggggcacctgccac

SEQ ID NO: 5411025 - DNA, 16 bp, Homo sapiens
cttgaggatggagagc

SEQ ID NO: 5411026 - DNA, 14 bp, Homo sapiens
cttgaggatgtaat

SEQ ID NO: 5411027 - DNA, 16 bp, Homo sapiens
cttgaggattgtggaa

SEQ ID NO: 5411028 - DNA, 19 bp, Homo sapiens
cttgaggattgtggaaaac

SEQ ID NO: 5411029 - DNA, 16 bp, Homo sapiens
cttgaggattttgagt

SEQ ID NO: 5411030 - DNA, 20 bp, Homo sapiens
cttgaggccaaatgagttcc

SEQ ID NO: 5411031 - DNA, 14 bp, Homo sapiens
cttgaggccaggag

SEQ ID NO: 5411032 - DNA, 22 bp, Homo sapiens
cttgaggccccgatggactcct

SEQ ID NO: 5411033 - DNA, 23 bp, Homo sapiens
cttgaggccccgatggactcctg

SEQ ID NO: 5411034 - DNA, 24 bp, Homo sapiens
cttgaggcttagctttgctctgcc

SEQ ID NO: 5411035 - DNA, 12 bp, Homo sapiens
cttgagggaggg

SEQ ID NO: 5411036 - DNA, 23 bp, Homo sapiens
cttgagggataaccccaggcact

SEQ ID NO: 5411037 - DNA, 13 bp, Homo sapiens
cttgagggccagg

SEQ ID NO: 5411038 - DNA, 16 bp, Homo sapiens
cttgagggcccagagc

SEQ ID NO: 5411039 - DNA, 18 bp, Homo sapiens
cttgagggcccagagcag

SEQ ID NO: 5411040 - DNA, 18 bp, Homo sapiens
cttgagggcctgagcagg

SEQ ID NO: 5411041 - DNA, 13 bp, Homo sapiens
cttgagggctgca

SEQ ID NO: 5411042 - DNA, 23 bp, Homo sapiens
cttgagggctgcagttctactca

SEQ ID NO: 5411043 - DNA, 15 bp, Homo sapiens
cttgaggggaagctg

SEQ ID NO: 5411044 - DNA, 16 bp, Homo sapiens
cttgaggggaccagga

SEQ ID NO: 5411045 - DNA, 17 bp, Homo sapiens
cttgaggggaccaggag

SEQ ID NO: 5411046 - DNA, 17 bp, Homo sapiens
cttgaggggagccagga

SEQ ID NO: 5411047 - DNA, 20 bp, Homo sapiens
cttgaggggagccaggaggg

SEQ ID NO: 5411048 - DNA, 15 bp, Homo sapiens
cttgaggggctaggt

SEQ ID NO: 5411049 - DNA, 23 bp, Homo sapiens
cttgagggtcattttcctttctg

SEQ ID NO: 5411050 - DNA, 16 bp, Homo sapiens
cttgagggtgggccag

SEQ ID NO: 5411051 - DNA, 21 bp, Homo sapiens
cttgagggtgggccagcatag

SEQ ID NO: 5411052 - DNA, 16 bp, Homo sapiens
cttgaggtcaggagtt

SEQ ID NO: 5411053 - DNA, 16 bp, Homo sapiens
cttgaggtctcagccc

SEQ ID NO: 5411054 - DNA, 15 bp, Homo sapiens
cttgaggtctctttt

SEQ ID NO: 5411055 - DNA, 17 bp, Homo sapiens
cttgaggtgaatttcat

SEQ ID NO: 5411056 - DNA, 21 bp, Homo sapiens
cttgaggtggtagtaaaacac

SEQ ID NO: 5411057 - DNA, 20 bp, Homo sapiens
cttgaggttctcttttgact

SEQ ID NO: 5411058 - DNA, 21 bp, Homo sapiens
cttgagtaaaatactcttttt

SEQ ID NO: 5411059 - DNA, 15 bp, Homo sapiens
cttgagtaatttaaa

SEQ ID NO: 5411060 - DNA, 18 bp, Homo sapiens
cttgagtataagaaatgc

SEQ ID NO: 5411061 - DNA, 19 bp, Homo sapiens
cttgagtataagataaaat

SEQ ID NO: 5411062 - DNA, 21 bp, Homo sapiens
cttgagtcaaaaaacatgagc

SEQ ID NO: 5411063 - DNA, 16 bp, Homo sapiens
cttgagtcacaaagaa

SEQ ID NO: 5411064 - DNA, 14 bp, Homo sapiens
cttgagtcagaaaa

SEQ ID NO: 5411065 - DNA, 18 bp, Homo sapiens
cttgagtgacatgcggct

SEQ ID NO: 5411066 - DNA, 22 bp, Homo sapiens
cttgagtgcttgttagagagaa

SEQ ID NO: 5411067 - DNA, 21 bp, Homo sapiens
cttgagtggacagcagctgga

SEQ ID NO: 5411068 - DNA, 16 bp, Homo sapiens
cttgagtgggccccct

SEQ ID NO: 5411069 - DNA, 22 bp, Homo sapiens
cttgagtggggttatctctgtg

SEQ ID NO: 5411070 - DNA, 20 bp, Homo sapiens
cttgagtgttatgtgaattt

SEQ ID NO: 5411071 - DNA, 13 bp, Homo sapiens
cttgagtgttcct

SEQ ID NO: 5411072 - DNA, 14 bp, Homo sapiens
cttgagtgttcctt

SEQ ID NO: 5411073 - DNA, 21 bp, Homo sapiens
cttgagtgttcctttttaaat

SEQ ID NO: 5411074 - DNA, 17 bp, Homo sapiens
cttgagttaacaggaca

SEQ ID NO: 5411075 - DNA, 22 bp, Homo sapiens
cttgagttaacaggacagttga

SEQ ID NO: 5411076 - DNA, 16 bp, Homo sapiens
cttgagttattaaaat

SEQ ID NO: 5411077 - DNA, 18 bp, Homo sapiens
cttgagttcaccatctct

SEQ ID NO: 5411078 - DNA, 21 bp, Homo sapiens
cttgagttcaccatctcttca

SEQ ID NO: 5411079 - DNA, 17 bp, Homo sapiens
cttgagttcccagatgg

SEQ ID NO: 5411080 - DNA, 16 bp, Homo sapiens
cttgagttcctctgca

SEQ ID NO: 5411081 - DNA, 18 bp, Homo sapiens
cttgagttcctctgcagt

SEQ ID NO: 5411082 - DNA, 19 bp, Homo sapiens
cttgagttgattcagctct

SEQ ID NO: 5411083 - DNA, 18 bp, Homo sapiens
cttgagttggctgtgttc

SEQ ID NO: 5411084 - DNA, 19 bp, Homo sapiens
cttgagttgtttttgtata

SEQ ID NO: 5411085 - DNA, 12 bp, Homo sapiens
cttgagtttgtc

SEQ ID NO: 5411086 - DNA, 21 bp, Homo sapiens
cttgagtttgtcgctcatgtg

SEQ ID NO: 5411087 - DNA, 22 bp, Homo sapiens
cttgagttttcatttcatatat

SEQ ID NO: 5411088 - DNA, 14 bp, Homo sapiens
cttgataaatggaa

SEQ ID NO: 5411089 - DNA, 14 bp, Homo sapiens
cttgataacagcta

SEQ ID NO: 5411090 - DNA, 20 bp, Homo sapiens
cttgatacattcaaatttgt

SEQ ID NO: 5411091 - DNA, 22 bp, Homo sapiens
cttgatacattcaaatttgtct

SEQ ID NO: 5411092 - DNA, 16 bp, Homo sapiens
cttgatacccccctct

SEQ ID NO: 5411093 - DNA, 15 bp, Homo sapiens
cttgatactgaatgc

SEQ ID NO: 5411094 - DNA, 16 bp, Homo sapiens
cttgatactgaatgca

SEQ ID NO: 5411095 - DNA, 18 bp, Homo sapiens
cttgatacttgttttcaa

SEQ ID NO: 5411096 - DNA, 12 bp, Homo sapiens
cttgatagaaat

SEQ ID NO: 5411097 - DNA, 17 bp, Homo sapiens
cttgatagaaatgccaa

SEQ ID NO: 5411098 - DNA, 20 bp, Homo sapiens
cttgatagacttactaataa

SEQ ID NO: 5411099 - DNA, 22 bp, Homo sapiens
cttgatagcaagcgttattttg

SEQ ID NO: 5411100 - DNA, 12 bp, Homo sapiens
cttgatagctaa

SEQ ID NO: 5411101 - DNA, 17 bp, Homo sapiens
cttgatataaaaaatct

SEQ ID NO: 5411102 - DNA, 15 bp, Homo sapiens
cttgatataataatt

SEQ ID NO: 5411103 - DNA, 19 bp, Homo sapiens
cttgatataataattactt

SEQ ID NO: 5411104 - DNA, 16 bp, Homo sapiens
cttgatataattactt

SEQ ID NO: 5411105 - DNA, 19 bp, Homo sapiens
cttgatataattacttaat

SEQ ID NO: 5411106 - DNA, 14 bp, Homo sapiens
cttgatatgtaagt

SEQ ID NO: 5411107 - DNA, 21 bp, Homo sapiens
cttgatattgaggtgtttgaa

SEQ ID NO: 5411108 - DNA, 19 bp, Homo sapiens
cttgatatttaagcagctt

SEQ ID NO: 5411109 - DNA, 13 bp, Homo sapiens
cttgatatttgta

SEQ ID NO: 5411110 - DNA, 14 bp, Homo sapiens
cttgatatttgtat

SEQ ID NO: 5411111 - DNA, 18 bp, Homo sapiens
cttgatatttgtatttat

SEQ ID NO: 5411112 - DNA, 13 bp, Homo sapiens
cttgatattttct

SEQ ID NO: 5411113 - DNA, 13 bp, Homo sapiens
cttgatcacagct

SEQ ID NO: 5411114 - DNA, 20 bp, Homo sapiens
cttgatcagacattcagaga

SEQ ID NO: 5411115 - DNA, 23 bp, Homo sapiens
cttgatcagccccaccctggcct

SEQ ID NO: 5411116 - DNA, 21 bp, Homo sapiens
cttgatcagtagtttgcattt

SEQ ID NO: 5411117 - DNA, 22 bp, Homo sapiens
cttgatcagtagtttgcatttc

SEQ ID NO: 5411118 - DNA, 13 bp, Homo sapiens
cttgatcagtgac

SEQ ID NO: 5411119 - DNA, 17 bp, Homo sapiens
cttgatcatgctgcagt

SEQ ID NO: 5411120 - DNA, 15 bp, Homo sapiens
cttgatcattccggt

SEQ ID NO: 5411121 - DNA, 16 bp, Homo sapiens
cttgatcattttggga

SEQ ID NO: 5411122 - DNA, 16 bp, Homo sapiens
cttgatccagaagagc

SEQ ID NO: 5411123 - DNA, 19 bp, Homo sapiens
cttgatcctccaatgtcta

SEQ ID NO: 5411124 - DNA, 23 bp, Homo sapiens
cttgatcgacttcttggttttct

SEQ ID NO: 5411125 - DNA, 11 bp, Homo sapiens
cttgatctatc

SEQ ID NO: 5411126 - DNA, 14 bp, Homo sapiens
cttgatctcctgag

SEQ ID NO: 5411127 - DNA, 23 bp, Homo sapiens
cttgatctctcttgtcctcttct

SEQ ID NO: 5411128 - DNA, 16 bp, Homo sapiens
cttgatctgctcagcc

SEQ ID NO: 5411129 - DNA, 19 bp, Homo sapiens
cttgatctgctcagccctg

SEQ ID NO: 5411130 - DNA, 15 bp, Homo sapiens
cttgatctgtatata

SEQ ID NO: 5411131 - DNA, 20 bp, Homo sapiens
cttgatctgtatatacaata

SEQ ID NO: 5411132 - DNA, 19 bp, Homo sapiens
cttgatctgtgatttcttc

SEQ ID NO: 5411133 - DNA, 20 bp, Homo sapiens
cttgatctgtgatttcttct

SEQ ID NO: 5411134 - DNA, 16 bp, Homo sapiens
cttgatctttgagccc

SEQ ID NO: 5411135 - DNA, 17 bp, Homo sapiens
cttgatctttgagccca

SEQ ID NO: 5411136 - DNA, 18 bp, Homo sapiens
cttgatctttgagcccat

SEQ ID NO: 5411137 - DNA, 13 bp, Homo sapiens
cttgatgaagaag

SEQ ID NO: 5411138 - DNA, 15 bp, Homo sapiens
cttgatgaagcccgt

SEQ ID NO: 5411139 - DNA, 16 bp, Homo sapiens
cttgatgaagcctgtg

SEQ ID NO: 5411140 - DNA, 20 bp, Homo sapiens
cttgatgaagcctgtgccac

SEQ ID NO: 5411141 - DNA, 22 bp, Homo sapiens
cttgatgaagcctgtgccacct

SEQ ID NO: 5411142 - DNA, 23 bp, Homo sapiens
cttgatgaagcctgtgccacctg

SEQ ID NO: 5411143 - DNA, 24 bp, Homo sapiens
cttgatgaagcctgtgccacctgc

SEQ ID NO: 5411144 - DNA, 15 bp, Homo sapiens
cttgatgactgcctt

SEQ ID NO: 5411145 - DNA, 21 bp, Homo sapiens
cttgatgactgccttgcctcc

SEQ ID NO: 5411146 - DNA, 22 bp, Homo sapiens
cttgatgactgccttgcctcct

SEQ ID NO: 5411147 - DNA, 17 bp, Homo sapiens
cttgatgactgctgatt

SEQ ID NO: 5411148 - DNA, 16 bp, Homo sapiens
cttgatgactggaatt

SEQ ID NO: 5411149 - DNA, 22 bp, Homo sapiens
cttgatgagtgtaacaagaaag

SEQ ID NO: 5411150 - DNA, 14 bp, Homo sapiens
cttgatgcacagag

SEQ ID NO: 5411151 - DNA, 19 bp, Homo sapiens
cttgatgcacagagaagct

SEQ ID NO: 5411152 - DNA, 21 bp, Homo sapiens
cttgatgcacttattttttaa

SEQ ID NO: 5411153 - DNA, 19 bp, Homo sapiens
cttgatgccagagggccag

SEQ ID NO: 5411154 - DNA, 21 bp, Homo sapiens
cttgatgccagagggccagca

SEQ ID NO: 5411155 - DNA, 12 bp, Homo sapiens
cttgatgcctgg

SEQ ID NO: 5411156 - DNA, 19 bp, Homo sapiens
cttgatggaagtgggccag

SEQ ID NO: 5411157 - DNA, 20 bp, Homo sapiens
cttgatggaagtgggccagt

SEQ ID NO: 5411158 - DNA, 22 bp, Homo sapiens
cttgatggaagtgggccagtcc

SEQ ID NO: 5411159 - DNA, 15 bp, Homo sapiens
cttgatggagaagga

SEQ ID NO: 5411160 - DNA, 19 bp, Homo sapiens
cttgatggagaaggaaaag

SEQ ID NO: 5411161 - DNA, 24 bp, Homo sapiens
cttgatggctcagagagcatcttt

SEQ ID NO: 5411162 - DNA, 18 bp, Homo sapiens
cttgatgggattctggac

SEQ ID NO: 5411163 - DNA, 13 bp, Homo sapiens
cttgatggggtga

SEQ ID NO: 5411164 - DNA, 17 bp, Homo sapiens
cttgatggggtgagaag

SEQ ID NO: 5411165 - DNA, 18 bp, Homo sapiens
cttgatggggtgagaagt

SEQ ID NO: 5411166 - DNA, 14 bp, Homo sapiens
cttgatgtaaaatc

SEQ ID NO: 5411167 - DNA, 15 bp, Homo sapiens
cttgatgtaaaatct

SEQ ID NO: 5411168 - DNA, 18 bp, Homo sapiens
cttgatgtaaaatcttgt

SEQ ID NO: 5411169 - DNA, 19 bp, Homo sapiens
cttgatgtaaggatgggca

SEQ ID NO: 5411170 - DNA, 21 bp, Homo sapiens
cttgatgtaaggatgggcatg

SEQ ID NO: 5411171 - DNA, 21 bp, Homo sapiens
cttgatgtcatgtacttcctg

SEQ ID NO: 5411172 - DNA, 17 bp, Homo sapiens
cttgatgtctgaggata

SEQ ID NO: 5411173 - DNA, 18 bp, Homo sapiens
cttgatgtgttatctctt

SEQ ID NO: 5411174 - DNA, 20 bp, Homo sapiens
cttgatgttccacctgccac

SEQ ID NO: 5411175 - DNA, 20 bp, Homo sapiens
cttgatgttccttccagatt

SEQ ID NO: 5411176 - DNA, 14 bp, Homo sapiens
cttgatgttgctta

SEQ ID NO: 5411177 - DNA, 23 bp, Homo sapiens
cttgatgttgcttagtcacttat

SEQ ID NO: 5411178 - DNA, 20 bp, Homo sapiens
cttgatgtttagaaaagtat

SEQ ID NO: 5411179 - DNA, 21 bp, Homo sapiens
cttgatgtttagaaaagtatt

SEQ ID NO: 5411180 - DNA, 13 bp, Homo sapiens
cttgatgtttcta

SEQ ID NO: 5411181 - DNA, 17 bp, Homo sapiens
cttgatgtttggggtct

SEQ ID NO: 5411182 - DNA, 12 bp, Homo sapiens
cttgattaaaca

SEQ ID NO: 5411183 - DNA, 22 bp, Homo sapiens
cttgattaagattttacaaaag

SEQ ID NO: 5411184 - DNA, 12 bp, Homo sapiens
cttgattaatgt

SEQ ID NO: 5411185 - DNA, 15 bp, Homo sapiens
cttgattaatgtact

SEQ ID NO: 5411186 - DNA, 16 bp, Homo sapiens
cttgattataaatgtt

SEQ ID NO: 5411187 - DNA, 14 bp, Homo sapiens
cttgattcaaataa

SEQ ID NO: 5411188 - DNA, 21 bp, Homo sapiens
cttgattcaggaggtcatctg

SEQ ID NO: 5411189 - DNA, 13 bp, Homo sapiens
cttgattcatctc

SEQ ID NO: 5411190 - DNA, 15 bp, Homo sapiens
cttgattcatctctg

SEQ ID NO: 5411191 - DNA, 16 bp, Homo sapiens
cttgattcatctctgg

SEQ ID NO: 5411192 - DNA, 17 bp, Homo sapiens
cttgattcatctctggt

SEQ ID NO: 5411193 - DNA, 14 bp, Homo sapiens
cttgattcccaccg

SEQ ID NO: 5411194 - DNA, 16 bp, Homo sapiens
cttgattcctggctct

SEQ ID NO: 5411195 - DNA, 13 bp, Homo sapiens
cttgattcctggt

SEQ ID NO: 5411196 - DNA, 20 bp, Homo sapiens
cttgattctgcagtaaatct

SEQ ID NO: 5411197 - DNA, 20 bp, Homo sapiens
cttgctaataaacactggct

SEQ ID NO: 5411198 - DNA, 23 bp, Homo sapiens
cttgctaataaacactggctctg

SEQ ID NO: 5411199 - DNA, 24 bp, Homo sapiens
cttgctaataaacactggctctgg

SEQ ID NO: 5411200 - DNA, 15 bp, Homo sapiens
cttgctaatcagtgt

SEQ ID NO: 5411201 - DNA, 17 bp, Homo sapiens
cttgctaatcagtgtct

SEQ ID NO: 5411202 - DNA, 18 bp, Homo sapiens
cttgctaatcagtgtctc

SEQ ID NO: 5411203 - DNA, 23 bp, Homo sapiens
cttgctaatcagtgtctcacact

SEQ ID NO: 5411204 - DNA, 17 bp, Homo sapiens
cttgctacacccctttt

SEQ ID NO: 5411205 - DNA, 17 bp, Homo sapiens
cttgctaccagtattta

SEQ ID NO: 5411206 - DNA, 23 bp, Homo sapiens
cttgctacttatcatttttgtat

SEQ ID NO: 5411207 - DNA, 13 bp, Homo sapiens
cttgctagaaaca

SEQ ID NO: 5411208 - DNA, 22 bp, Homo sapiens
cttgctagacaaggttgctgtt

SEQ ID NO: 5411209 - DNA, 14 bp, Homo sapiens
cttgctagccctgg

SEQ ID NO: 5411210 - DNA, 20 bp, Homo sapiens
cttgctagctagccagccaa

SEQ ID NO: 5411211 - DNA, 23 bp, Homo sapiens
cttgctagctatgtgaccttgag

SEQ ID NO: 5411212 - DNA, 19 bp, Homo sapiens
cttgctagtattcgctgtg

SEQ ID NO: 5411213 - DNA, 18 bp, Homo sapiens
cttgctatatgatttagc

SEQ ID NO: 5411214 - DNA, 19 bp, Homo sapiens
cttgctatattgcccaggc

SEQ ID NO: 5411215 - DNA, 13 bp, Homo sapiens
cttgctattctgt

SEQ ID NO: 5411216 - DNA, 22 bp, Homo sapiens
cttgctatttgagcatgcacag

SEQ ID NO: 5411217 - DNA, 13 bp, Homo sapiens
cttgctcaagttc

SEQ ID NO: 5411218 - DNA, 14 bp, Homo sapiens
cttgctcaataaag

SEQ ID NO: 5411219 - DNA, 22 bp, Homo sapiens
cttgctcaccaagctgttccac

SEQ ID NO: 5411220 - DNA, 21 bp, Homo sapiens
cttgctcactcactcactcca

SEQ ID NO: 5411221 - DNA, 15 bp, Homo sapiens
cttgctcactcccta

SEQ ID NO: 5411222 - DNA, 16 bp, Homo sapiens
cttgctcaggtgcaag

SEQ ID NO: 5411223 - DNA, 15 bp, Homo sapiens
cttgctcagtgcctc

SEQ ID NO: 5411224 - DNA, 19 bp, Homo sapiens
cttgctcagtgcctcctgg

SEQ ID NO: 5411225 - DNA, 21 bp, Homo sapiens
cttgctcagtgcctcctggcc

SEQ ID NO: 5411226 - DNA, 18 bp, Homo sapiens
cttgctcatgagctcctg

SEQ ID NO: 5411227 - DNA, 12 bp, Homo sapiens
cttgctccagat

SEQ ID NO: 5411228 - DNA, 14 bp, Homo sapiens
cttgctccagcctg

SEQ ID NO: 5411229 - DNA, 12 bp, Homo sapiens
cttgctcccaac

SEQ ID NO: 5411230 - DNA, 18 bp, Homo sapiens
cttgctcccaagcccctg

SEQ ID NO: 5411231 - DNA, 19 bp, Homo sapiens
cttgctcccaagcccctga

SEQ ID NO: 5411232 - DNA, 22 bp, Homo sapiens
cttgctcccaagcccctgaccc

SEQ ID NO: 5411233 - DNA, 19 bp, Homo sapiens
cttgctcccgccccagggt

SEQ ID NO: 5411234 - DNA, 21 bp, Homo sapiens
cttgctcccgccccagggtct

SEQ ID NO: 5411235 - DNA, 15 bp, Homo sapiens
cttgctccctctcca

SEQ ID NO: 5411236 - DNA, 16 bp, Homo sapiens
cttgctccctctccaa

SEQ ID NO: 5411237 - DNA, 17 bp, Homo sapiens
cttgctccctctccaag

SEQ ID NO: 5411238 - DNA, 15 bp, Homo sapiens
cttgctcctccttct

SEQ ID NO: 5411239 - DNA, 12 bp, Homo sapiens
cttgctcctgct

SEQ ID NO: 5411240 - DNA, 22 bp, Homo sapiens
cttgctcctggaacctggcagg

SEQ ID NO: 5411241 - DNA, 23 bp, Homo sapiens
cttgctcctggaacctggcaggc

SEQ ID NO: 5411242 - DNA, 23 bp, Homo sapiens
cttgctcctttccatcagcttta

SEQ ID NO: 5411243 - DNA, 20 bp, Homo sapiens
cttgctcgctgtaaaatctt

SEQ ID NO: 5411244 - DNA, 21 bp, Homo sapiens
cttgctcgcttgctggaacac

SEQ ID NO: 5411245 - DNA, 17 bp, Homo sapiens
cttgctctacctggccg

SEQ ID NO: 5411246 - DNA, 20 bp, Homo sapiens
cttgctctccctcttctcaa

SEQ ID NO: 5411247 - DNA, 19 bp, Homo sapiens
cttgctctcctcatctcca

SEQ ID NO: 5411248 - DNA, 13 bp, Homo sapiens
cttgctctcctgg

SEQ ID NO: 5411249 - DNA, 17 bp, Homo sapiens
cttgctctcctggagca

SEQ ID NO: 5411250 - DNA, 22 bp, Homo sapiens
cttgctctcgaccggccctgca

SEQ ID NO: 5411251 - DNA, 16 bp, Homo sapiens
cttgctctctctccct

SEQ ID NO: 5411252 - DNA, 19 bp, Homo sapiens
cttgctctctctccctgcc

SEQ ID NO: 5411253 - DNA, 12 bp, Homo sapiens
cttgctctctga

SEQ ID NO: 5411254 - DNA, 22 bp, Homo sapiens
cttgctctctgagagcacagcg

SEQ ID NO: 5411255 - DNA, 12 bp, Homo sapiens
cttgctctctgt

SEQ ID NO: 5411256 - DNA, 19 bp, Homo sapiens
cttgctctctgttctcttg

SEQ ID NO: 5411257 - DNA, 21 bp, Homo sapiens
cttgctctctgttctcttgct

SEQ ID NO: 5411258 - DNA, 13 bp, Homo sapiens
cttgctctcttca

SEQ ID NO: 5411259 - DNA, 15 bp, Homo sapiens
cttgctctcttcaat

SEQ ID NO: 5411260 - DNA, 12 bp, Homo sapiens
cttgctctgagc

SEQ ID NO: 5411261 - DNA, 14 bp, Homo sapiens
cttgctctgagcac

SEQ ID NO: 5411262 - DNA, 13 bp, Homo sapiens
cttgctctgcacc

SEQ ID NO: 5411263 - DNA, 21 bp, Homo sapiens
cttgctctgctcatctacaca

SEQ ID NO: 5411264 - DNA, 16 bp, Homo sapiens
cttgctctgctgacag

SEQ ID NO: 5411265 - DNA, 17 bp, Homo sapiens
cttgctctgctgacaga

SEQ ID NO: 5411266 - DNA, 23 bp, Homo sapiens
cttgctctgcttgacaacatctg

SEQ ID NO: 5411267 - DNA, 14 bp, Homo sapiens
cttgctctggacct

SEQ ID NO: 5411268 - DNA, 16 bp, Homo sapiens
cttgctctggacctgc

SEQ ID NO: 5411269 - DNA, 18 bp, Homo sapiens
cttgctctggacctgccc

SEQ ID NO: 5411270 - DNA, 12 bp, Homo sapiens
cttgctctgtcc

SEQ ID NO: 5411271 - DNA, 14 bp, Homo sapiens
cttgctctgtcccc

SEQ ID NO: 5411272 - DNA, 19 bp, Homo sapiens
cttgctctgtctcccaggc

SEQ ID NO: 5411273 - DNA, 18 bp, Homo sapiens
cttgctctgtggccttgg

SEQ ID NO: 5411274 - DNA, 23 bp, Homo sapiens
cttgctctgtggccttggccctg

SEQ ID NO: 5411275 - DNA, 16 bp, Homo sapiens
cttgctctgttgccag

SEQ ID NO: 5411276 - DNA, 18 bp, Homo sapiens
cttgctctgtttgtgggg

SEQ ID NO: 5411277 - DNA, 21 bp, Homo sapiens
cttgctcttaagtaccagaag

SEQ ID NO: 5411278 - DNA, 18 bp, Homo sapiens
cttgctcttctccttgat

SEQ ID NO: 5411279 - DNA, 12 bp, Homo sapiens
cttgctcttctt

SEQ ID NO: 5411280 - DNA, 16 bp, Homo sapiens
cttgctcttctttctg

SEQ ID NO: 5411281 - DNA, 17 bp, Homo sapiens
cttgctcttgatgcctg

SEQ ID NO: 5411282 - DNA, 18 bp, Homo sapiens
cttgctcttgatgcctgg

SEQ ID NO: 5411283 - DNA, 14 bp, Homo sapiens
cttgctcttgggga

SEQ ID NO: 5411284 - DNA, 17 bp, Homo sapiens
cttgctcttggggaagg

SEQ ID NO: 5411285 - DNA, 18 bp, Homo sapiens
cttgctcttggggaaggg

SEQ ID NO: 5411286 - DNA, 22 bp, Homo sapiens
cttgctctttctactctgaact

SEQ ID NO: 5411287 - DNA, 16 bp, Homo sapiens
cttgctgaaaaacaca

SEQ ID NO: 5411288 - DNA, 22 bp, Homo sapiens
cttgctgaaacgcatctagttc

SEQ ID NO: 5411289 - DNA, 15 bp, Homo sapiens
cttgctgaaagccaa

SEQ ID NO: 5411290 - DNA, 15 bp, Homo sapiens
cttgctgaacacaca

SEQ ID NO: 5411291 - DNA, 18 bp, Homo sapiens
cttgctgacatggctttg

SEQ ID NO: 5411292 - DNA, 15 bp, Homo sapiens
cttgctgaccccagg

SEQ ID NO: 5411293 - DNA, 21 bp, Homo sapiens
cttgctgaccccaggtcagcc

SEQ ID NO: 5411294 - DNA, 18 bp, Homo sapiens
cttgctgacctcccagcc

SEQ ID NO: 5411295 - DNA, 18 bp, Homo sapiens
cttgctgagctgtttata

SEQ ID NO: 5411296 - DNA, 16 bp, Homo sapiens
cttgctgaggggcagg

SEQ ID NO: 5411297 - DNA, 16 bp, Homo sapiens
cttgctgagtgaagga

SEQ ID NO: 5411298 - DNA, 12 bp, Homo sapiens
cttgctgagtgg

SEQ ID NO: 5411299 - DNA, 21 bp, Homo sapiens
cttgctgagtggcgcaaggcc

SEQ ID NO: 5411300 - DNA, 16 bp, Homo sapiens
cttgctgatgctcctc

SEQ ID NO: 5411301 - DNA, 21 bp, Homo sapiens
cttgctgatggctgctagatt

SEQ ID NO: 5411302 - DNA, 17 bp, Homo sapiens
cttgctgatggctgctg

SEQ ID NO: 5411303 - DNA, 21 bp, Homo sapiens
cttgctgatggctgctggagg

SEQ ID NO: 5411304 - DNA, 22 bp, Homo sapiens
cttgctgatggctgctggaggg

SEQ ID NO: 5411305 - DNA, 16 bp, Homo sapiens
cttgctgatggcttga

SEQ ID NO: 5411306 - DNA, 12 bp, Homo sapiens
cttgctgcaccc

SEQ ID NO: 5411307 - DNA, 16 bp, Homo sapiens
cttgctgcactctgta

SEQ ID NO: 5411308 - DNA, 12 bp, Homo sapiens
cttgctgcaggc

SEQ ID NO: 5411309 - DNA, 16 bp, Homo sapiens
cttgctgcaggccctc

SEQ ID NO: 5411310 - DNA, 17 bp, Homo sapiens
cttgctgcaggccctcc

SEQ ID NO: 5411311 - DNA, 18 bp, Homo sapiens
cttgctgcaggccctccc

SEQ ID NO: 5411312 - DNA, 20 bp, Homo sapiens
cttgctgcaggccctccctc

SEQ ID NO: 5411313 - DNA, 17 bp, Homo sapiens
cttgctgcagtgtccag

SEQ ID NO: 5411314 - DNA, 10 bp, Homo sapiens
cttgctgcca

SEQ ID NO: 5411315 - DNA, 20 bp, Homo sapiens
cttgctgccctgccccaagt

SEQ ID NO: 5411316 - DNA, 10 bp, Homo sapiens
cttgctgcct

SEQ ID NO: 5411317 - DNA, 13 bp, Homo sapiens
cttgctgcctcgg

SEQ ID NO: 5411318 - DNA, 14 bp, Homo sapiens
cttgctgctatttt

SEQ ID NO: 5411319 - DNA, 13 bp, Homo sapiens
cttgctgctcaca

SEQ ID NO: 5411320 - DNA, 22 bp, Homo sapiens
cttgctgctccggtttgggctg

SEQ ID NO: 5411321 - DNA, 14 bp, Homo sapiens
cttgctgctctgcg

SEQ ID NO: 5411322 - DNA, 15 bp, Homo sapiens
cttgctgctctgcgt

SEQ ID NO: 5411323 - DNA, 18 bp, Homo sapiens
cttgctgctctgcgtggc

SEQ ID NO: 5411324 - DNA, 17 bp, Homo sapiens
cttgctgctgatttaaa

SEQ ID NO: 5411325 - DNA, 11 bp, Homo sapiens
cttgctgctgc

SEQ ID NO: 5411326 - DNA, 12 bp, Homo sapiens
cttgctgctgcc

SEQ ID NO: 5411327 - DNA, 17 bp, Homo sapiens
cttgctgctgctgcacc

SEQ ID NO: 5411328 - DNA, 12 bp, Homo sapiens
cttgctgctggc

SEQ ID NO: 5411329 - DNA, 16 bp, Homo sapiens
cttgctgctgtgcctg

SEQ ID NO: 5411330 - DNA, 15 bp, Homo sapiens
cttgctgctttttct

SEQ ID NO: 5411331 - DNA, 20 bp, Homo sapiens
cttgctgctttttctgcgct

SEQ ID NO: 5411332 - DNA, 15 bp, Homo sapiens
cttgctggaaaactg

SEQ ID NO: 5411333 - DNA, 19 bp, Homo sapiens
cttgctggaaaactgccac

SEQ ID NO: 5411334 - DNA, 19 bp, Homo sapiens
cttgctggaacacaggggc

SEQ ID NO: 5411335 - DNA, 12 bp, Homo sapiens
cttgctggaaga

SEQ ID NO: 5411336 - DNA, 15 bp, Homo sapiens
cttgctggaagacag

SEQ ID NO: 5411337 - DNA, 12 bp, Homo sapiens
cttgctggagaa

SEQ ID NO: 5411338 - DNA, 20 bp, Homo sapiens
cttgctggagagtggcatca

SEQ ID NO: 5411339 - DNA, 22 bp, Homo sapiens
cttgctggccacaaggaaaagg

SEQ ID NO: 5411340 - DNA, 13 bp, Homo sapiens
cttgctggcccca

SEQ ID NO: 5411341 - DNA, 14 bp, Homo sapiens
cttgctggccccag

SEQ ID NO: 5411342 - DNA, 20 bp, Homo sapiens
cttgctggccccagccctgc

SEQ ID NO: 5411343 - DNA, 12 bp, Homo sapiens
cttgctgggcca

SEQ ID NO: 5411344 - DNA, 14 bp, Homo sapiens
cttgctgggcctgg

SEQ ID NO: 5411345 - DNA, 16 bp, Homo sapiens
cttgctgggcctgggg

SEQ ID NO: 5411346 - DNA, 15 bp, Homo sapiens
cttgctgggtccagg

SEQ ID NO: 5411347 - DNA, 12 bp, Homo sapiens
cttgctggtgca

SEQ ID NO: 5411348 - DNA, 13 bp, Homo sapiens
cttgctggtgcct

SEQ ID NO: 5411349 - DNA, 20 bp, Homo sapiens
cttgctggtgcctgccacct

SEQ ID NO: 5411350 - DNA, 17 bp, Homo sapiens
cttgctggttttctgga

SEQ ID NO: 5411351 - DNA, 19 bp, Homo sapiens
cttgctgtaactcagacat

SEQ ID NO: 5411352 - DNA, 17 bp, Homo sapiens
cttgctgtaccatattc

SEQ ID NO: 5411353 - DNA, 18 bp, Homo sapiens
cttgctgtagagacttcc

SEQ ID NO: 5411354 - DNA, 23 bp, Homo sapiens
cttgctgtatgacccctggccac

SEQ ID NO: 5411355 - DNA, 13 bp, Homo sapiens
cttgctgtatgct

SEQ ID NO: 5411356 - DNA, 13 bp, Homo sapiens
cttgctgtccagg

SEQ ID NO: 5411357 - DNA, 14 bp, Homo sapiens
cttgctgtccaggc

SEQ ID NO: 5411358 - DNA, 17 bp, Homo sapiens
cttgctgtccaggcagc

SEQ ID NO: 5411359 - DNA, 22 bp, Homo sapiens
cttgctgtccaggcagctccct

SEQ ID NO: 5411360 - DNA, 14 bp, Homo sapiens
cttgctgtctctgc

SEQ ID NO: 5411361 - DNA, 16 bp, Homo sapiens
cttgctgtctctgctc

SEQ ID NO: 5411362 - DNA, 21 bp, Homo sapiens
cttgctgtctctgctcgccct

SEQ ID NO: 5411363 - DNA, 23 bp, Homo sapiens
cttgctgtggctatgggaatcag

SEQ ID NO: 5411364 - DNA, 13 bp, Homo sapiens
cttgctgtggtct

SEQ ID NO: 5411365 - DNA, 18 bp, Homo sapiens
cttgctgtggtctctttg

SEQ ID NO: 5411366 - DNA, 12 bp, Homo sapiens
cttgctgtgtga

SEQ ID NO: 5411367 - DNA, 19 bp, Homo sapiens
cttgctgtgtgaccctggg

SEQ ID NO: 5411368 - DNA, 21 bp, Homo sapiens
cttgctgttcccatccctgaa

SEQ ID NO: 5411369 - DNA, 23 bp, Homo sapiens
cttgctgtttaccgcccacccag

SEQ ID NO: 5411370 - DNA, 13 bp, Homo sapiens
cttgcttaaatgt

SEQ ID NO: 5411371 - DNA, 16 bp, Homo sapiens
cttgcttaaatgtgaa

SEQ ID NO: 5411372 - DNA, 22 bp, Homo sapiens
cttgcttaaatgtgaattacta

SEQ ID NO: 5411373 - DNA, 22 bp, Homo sapiens
cttgcttaaatttcttatgtga

SEQ ID NO: 5411374 - DNA, 23 bp, Homo sapiens
cttgcttaaatttcttatgtgac

SEQ ID NO: 5411375 - DNA, 19 bp, Homo sapiens
cttgcttagagtgcccagc

SEQ ID NO: 5411376 - DNA, 19 bp, Homo sapiens
cttgggggggtggccgctg

SEQ ID NO: 5411377 - DNA, 24 bp, Homo sapiens
cttggggggtgatgagggcagcag

SEQ ID NO: 5411378 - DNA, 23 bp, Homo sapiens
cttgggggtcctcctccagggac

SEQ ID NO: 5411379 - DNA, 20 bp, Homo sapiens
cttgggggttttcaatgtga

SEQ ID NO: 5411380 - DNA, 22 bp, Homo sapiens
cttggggtactcttgatgtgaa

SEQ ID NO: 5411381 - DNA, 16 bp, Homo sapiens
cttggggtagagagga

SEQ ID NO: 5411382 - DNA, 17 bp, Homo sapiens
cttggggtagagaggac

SEQ ID NO: 5411383 - DNA, 13 bp, Homo sapiens
cttggggtcaggt

SEQ ID NO: 5411384 - DNA, 17 bp, Homo sapiens
cttggggtcccagggaa

SEQ ID NO: 5411385 - DNA, 18 bp, Homo sapiens
cttggggtcccagggaag

SEQ ID NO: 5411386 - DNA, 18 bp, Homo sapiens
cttggggtccctccaccc

SEQ ID NO: 5411387 - DNA, 13 bp, Homo sapiens
cttggggtggcgc

SEQ ID NO: 5411388 - DNA, 18 bp, Homo sapiens
cttggggtgggggccagg

SEQ ID NO: 5411389 - DNA, 21 bp, Homo sapiens
cttggggtgggggccaggcct

SEQ ID NO: 5411390 - DNA, 19 bp, Homo sapiens
cttggggtgtggggtgggg

SEQ ID NO: 5411391 - DNA, 22 bp, Homo sapiens
cttggggttaagtctcctgtct

SEQ ID NO: 5411392 - DNA, 21 bp, Homo sapiens
cttggggttcataggggcagg

SEQ ID NO: 5411393 - DNA, 20 bp, Homo sapiens
cttggggttcccccagacag

SEQ ID NO: 5411394 - DNA, 20 bp, Homo sapiens
cttggggttttcagtatgaa

SEQ ID NO: 5411395 - DNA, 16 bp, Homo sapiens
cttgggtagcgcactc

SEQ ID NO: 5411396 - DNA, 21 bp, Homo sapiens
cttgggtagggcagacatgcc

SEQ ID NO: 5411397 - DNA, 23 bp, Homo sapiens
cttgggtagggtagtggctgggg

SEQ ID NO: 5411398 - DNA, 15 bp, Homo sapiens
cttgggtcacatgac

SEQ ID NO: 5411399 - DNA, 18 bp, Homo sapiens
cttgggtcacatgactct

SEQ ID NO: 5411400 - DNA, 23 bp, Homo sapiens
cttgggtcaggttcttgcctttc

SEQ ID NO: 5411401 - DNA, 16 bp, Homo sapiens
cttgggtcattgacct

SEQ ID NO: 5411402 - DNA, 16 bp, Homo sapiens
cttgggtccaccatgc

SEQ ID NO: 5411403 - DNA, 19 bp, Homo sapiens
cttgggtcctactcctgga

SEQ ID NO: 5411404 - DNA, 22 bp, Homo sapiens
cttgggtcctactcctggagca

SEQ ID NO: 5411405 - DNA, 16 bp, Homo sapiens
cttgggtctctctcca

SEQ ID NO: 5411406 - DNA, 17 bp, Homo sapiens
cttgggtctctctccat

SEQ ID NO: 5411407 - DNA, 21 bp, Homo sapiens
cttgggtctctctcggcccct

SEQ ID NO: 5411408 - DNA, 15 bp, Homo sapiens
cttgggtgaaaggtg

SEQ ID NO: 5411409 - DNA, 15 bp, Homo sapiens
cttgggtggagaagc

SEQ ID NO: 5411410 - DNA, 17 bp, Homo sapiens
cttgggtggagaagcca

SEQ ID NO: 5411411 - DNA, 13 bp, Homo sapiens
cttgggtgggaca

SEQ ID NO: 5411412 - DNA, 19 bp, Homo sapiens
cttgggtgggacagggctt

SEQ ID NO: 5411413 - DNA, 21 bp, Homo sapiens
cttgggtggttcctaagggaa

SEQ ID NO: 5411414 - DNA, 14 bp, Homo sapiens
cttgggtggttttg

SEQ ID NO: 5411415 - DNA, 21 bp, Homo sapiens
cttgggtgtaacaggtctcct

SEQ ID NO: 5411416 - DNA, 15 bp, Homo sapiens
cttgggttagaccta

SEQ ID NO: 5411417 - DNA, 18 bp, Homo sapiens
cttgggttagacctacag

SEQ ID NO: 5411418 - DNA, 19 bp, Homo sapiens
cttgggttagacctacagg

SEQ ID NO: 5411419 - DNA, 22 bp, Homo sapiens
cttgggttagacctacaggggg

SEQ ID NO: 5411420 - DNA, 16 bp, Homo sapiens
cttgggttattattgt

SEQ ID NO: 5411421 - DNA, 19 bp, Homo sapiens
cttgggttccaaccaggca

SEQ ID NO: 5411422 - DNA, 14 bp, Homo sapiens
cttgggttgatctc

SEQ ID NO: 5411423 - DNA, 16 bp, Homo sapiens
cttgggttgatctctt

SEQ ID NO: 5411424 - DNA, 17 bp, Homo sapiens
cttgggtttctgtgcag

SEQ ID NO: 5411425 - DNA, 22 bp, Homo sapiens
cttggtaaagtccttttcttgc

SEQ ID NO: 5411426 - DNA, 17 bp, Homo sapiens
cttggtaagagggagcc

SEQ ID NO: 5411427 - DNA, 17 bp, Homo sapiens
cttggtaagtgaattta

SEQ ID NO: 5411428 - DNA, 14 bp, Homo sapiens
cttggtactgaaaa

SEQ ID NO: 5411429 - DNA, 18 bp, Homo sapiens
cttggtacttgctgctat

SEQ ID NO: 5411430 - DNA, 13 bp, Homo sapiens
cttggtagagttt

SEQ ID NO: 5411431 - DNA, 15 bp, Homo sapiens
cttggtagcagcctg

SEQ ID NO: 5411432 - DNA, 16 bp, Homo sapiens
cttggtagttctgtgc

SEQ ID NO: 5411433 - DNA, 15 bp, Homo sapiens
cttggtatctttctg

SEQ ID NO: 5411434 - DNA, 16 bp, Homo sapiens
cttggtatgtgccagg

SEQ ID NO: 5411435 - DNA, 17 bp, Homo sapiens
cttggtatgtgccaggc

SEQ ID NO: 5411436 - DNA, 16 bp, Homo sapiens
cttggtcaccagctcc

SEQ ID NO: 5411437 - DNA, 15 bp, Homo sapiens
cttggtcagagccac

SEQ ID NO: 5411438 - DNA, 13 bp, Homo sapiens
cttggtcccagac

SEQ ID NO: 5411439 - DNA, 16 bp, Homo sapiens
cttggtcccagacagc

SEQ ID NO: 5411440 - DNA, 22 bp, Homo sapiens
cttggtcccagacagctggacc

SEQ ID NO: 5411441 - DNA, 15 bp, Homo sapiens
cttggtcccgtgaaa

SEQ ID NO: 5411442 - DNA, 13 bp, Homo sapiens
cttggtccctctc

SEQ ID NO: 5411443 - DNA, 16 bp, Homo sapiens
cttggtccctggtccc

SEQ ID NO: 5411444 - DNA, 11 bp, Homo sapiens
cttggtcctag

SEQ ID NO: 5411445 - DNA, 17 bp, Homo sapiens
cttggtcctggcagggc

SEQ ID NO: 5411446 - DNA, 20 bp, Homo sapiens
cttggtcctgtcaccctggc

SEQ ID NO: 5411447 - DNA, 14 bp, Homo sapiens
cttggtctcagctt

SEQ ID NO: 5411448 - DNA, 19 bp, Homo sapiens
cttggtctcatgccccgcc

SEQ ID NO: 5411449 - DNA, 14 bp, Homo sapiens
cttggtctctcctt

SEQ ID NO: 5411450 - DNA, 17 bp, Homo sapiens
cttggtctctccttcct

SEQ ID NO: 5411451 - DNA, 11 bp, Homo sapiens
cttggtctctt

SEQ ID NO: 5411452 - DNA, 19 bp, Homo sapiens
cttggtctctttctttcca

SEQ ID NO: 5411453 - DNA, 22 bp, Homo sapiens
cttggtctgatcgacgtggtga

SEQ ID NO: 5411454 - DNA, 20 bp, Homo sapiens
cttggtctgatttcaggata

SEQ ID NO: 5411455 - DNA, 13 bp, Homo sapiens
cttggtctgccag

SEQ ID NO: 5411456 - DNA, 19 bp, Homo sapiens
cttggtctgtgagatgcta

SEQ ID NO: 5411457 - DNA, 14 bp, Homo sapiens
cttggtctgtgttc

SEQ ID NO: 5411458 - DNA, 17 bp, Homo sapiens
cttggtcttacatctgt

SEQ ID NO: 5411459 - DNA, 13 bp, Homo sapiens
cttggtcttccat

SEQ ID NO: 5411460 - DNA, 16 bp, Homo sapiens
cttggtctttgtatct

SEQ ID NO: 5411461 - DNA, 17 bp, Homo sapiens
cttggtgaaataataaa

SEQ ID NO: 5411462 - DNA, 20 bp, Homo sapiens
cttggtgaaataataaaatg

SEQ ID NO: 5411463 - DNA, 21 bp, Homo sapiens
cttggtgacaaaattcatttg

SEQ ID NO: 5411464 - DNA, 17 bp, Homo sapiens
cttggtgactctgtcct

SEQ ID NO: 5411465 - DNA, 22 bp, Homo sapiens
cttggtgattaaggtcctgctt

SEQ ID NO: 5411466 - DNA, 19 bp, Homo sapiens
cttggtgattacctgaaag

SEQ ID NO: 5411467 - DNA, 23 bp, Homo sapiens
cttggtgattacctgaaagccct

SEQ ID NO: 5411468 - DNA, 21 bp, Homo sapiens
cttggtgcggggttaacacct

SEQ ID NO: 5411469 - DNA, 12 bp, Homo sapiens
cttggtgctgcg

SEQ ID NO: 5411470 - DNA, 13 bp, Homo sapiens
cttggtgctggga

SEQ ID NO: 5411471 - DNA, 14 bp, Homo sapiens
cttggtgctgggaa

SEQ ID NO: 5411472 - DNA, 17 bp, Homo sapiens
cttggtgctggtttatt

SEQ ID NO: 5411473 - DNA, 16 bp, Homo sapiens
cttggtggagcagcca

SEQ ID NO: 5411474 - DNA, 19 bp, Homo sapiens
cttggtggagcagccagag

SEQ ID NO: 5411475 - DNA, 20 bp, Homo sapiens
cttggtggagcagccagagc

SEQ ID NO: 5411476 - DNA, 18 bp, Homo sapiens
cttggtggccaagcctgg

SEQ ID NO: 5411477 - DNA, 22 bp, Homo sapiens
cttggtggccaagcctggccct

SEQ ID NO: 5411478 - DNA, 13 bp, Homo sapiens
cttggtggctgag

SEQ ID NO: 5411479 - DNA, 15 bp, Homo sapiens
cttggtggctgagct

SEQ ID NO: 5411480 - DNA, 16 bp, Homo sapiens
cttggtggcttatggg

SEQ ID NO: 5411481 - DNA, 13 bp, Homo sapiens
cttggtggggagc

SEQ ID NO: 5411482 - DNA, 15 bp, Homo sapiens
cttggtgggggagcc

SEQ ID NO: 5411483 - DNA, 21 bp, Homo sapiens
cttggtgggggagcctctgga

SEQ ID NO: 5411484 - DNA, 18 bp, Homo sapiens
cttggtgggtgtggccag

SEQ ID NO: 5411485 - DNA, 23 bp, Homo sapiens
cttggtgggtgtggccagcacac

SEQ ID NO: 5411486 - DNA, 22 bp, Homo sapiens
cttggtggttctatcaggggtg

SEQ ID NO: 5411487 - DNA, 13 bp, Homo sapiens
cttggtgtaattt

SEQ ID NO: 5411488 - DNA, 17 bp, Homo sapiens
cttggtgtagttgaact

SEQ ID NO: 5411489 - DNA, 18 bp, Homo sapiens
cttggtgtcaaattttta

SEQ ID NO: 5411490 - DNA, 19 bp, Homo sapiens
cttggtgtccacctggccc

SEQ ID NO: 5411491 - DNA, 14 bp, Homo sapiens
cttggtgtcctttc

SEQ ID NO: 5411492 - DNA, 23 bp, Homo sapiens
cttggtgtctggtttctgtcccc

SEQ ID NO: 5411493 - DNA, 19 bp, Homo sapiens
cttggtgtgattgcacaga

SEQ ID NO: 5411494 - DNA, 12 bp, Homo sapiens
cttggtgttatc

SEQ ID NO: 5411495 - DNA, 17 bp, Homo sapiens
cttggtgttgttatggc

SEQ ID NO: 5411496 - DNA, 19 bp, Homo sapiens
cttggtgtttcccttcctc

SEQ ID NO: 5411497 - DNA, 15 bp, Homo sapiens
cttggtgtttgactg

SEQ ID NO: 5411498 - DNA, 19 bp, Homo sapiens
cttggttagtggctgcctc

SEQ ID NO: 5411499 - DNA, 13 bp, Homo sapiens
cttggttatacat

SEQ ID NO: 5411500 - DNA, 22 bp, Homo sapiens
cttggttcaatcaacagaattg

SEQ ID NO: 5411501 - DNA, 13 bp, Homo sapiens
cttggttcatgct

SEQ ID NO: 5411502 - DNA, 19 bp, Homo sapiens
cttggttcatgcttctact

SEQ ID NO: 5411503 - DNA, 13 bp, Homo sapiens
cttggttccagga

SEQ ID NO: 5411504 - DNA, 13 bp, Homo sapiens
cttggttccattg

SEQ ID NO: 5411505 - DNA, 18 bp, Homo sapiens
cttggttcccagaaaaca

SEQ ID NO: 5411506 - DNA, 13 bp, Homo sapiens
cttggttccccca

SEQ ID NO: 5411507 - DNA, 16 bp, Homo sapiens
cttggttccctcttcc

SEQ ID NO: 5411508 - DNA, 13 bp, Homo sapiens
cttggttcctcca

SEQ ID NO: 5411509 - DNA, 16 bp, Homo sapiens
cttggttcctctacta

SEQ ID NO: 5411510 - DNA, 13 bp, Homo sapiens
cttggttcctgat

SEQ ID NO: 5411511 - DNA, 13 bp, Homo sapiens
cttggttcctggg

SEQ ID NO: 5411512 - DNA, 14 bp, Homo sapiens
cttggttcctggga

SEQ ID NO: 5411513 - DNA, 15 bp, Homo sapiens
cttggttcctggggc

SEQ ID NO: 5411514 - DNA, 16 bp, Homo sapiens
cttggttcctggggca

SEQ ID NO: 5411515 - DNA, 18 bp, Homo sapiens
cttggttcctgtttgaaa

SEQ ID NO: 5411516 - DNA, 14 bp, Homo sapiens
cttggttctgaagc

SEQ ID NO: 5411517 - DNA, 15 bp, Homo sapiens
cttggttctgaagcc

SEQ ID NO: 5411518 - DNA, 15 bp, Homo sapiens
cttggttctgcactg

SEQ ID NO: 5411519 - DNA, 19 bp, Homo sapiens
cttggttcttgaggggacc

SEQ ID NO: 5411520 - DNA, 14 bp, Homo sapiens
cttggttgaaaaga

SEQ ID NO: 5411521 - DNA, 15 bp, Homo sapiens
cttggttgaggaaac

SEQ ID NO: 5411522 - DNA, 16 bp, Homo sapiens
cttggttgaggaaaca

SEQ ID NO: 5411523 - DNA, 18 bp, Homo sapiens
cttggttgtctccacaca

SEQ ID NO: 5411524 - DNA, 15 bp, Homo sapiens
cttggttgtctggca

SEQ ID NO: 5411525 - DNA, 21 bp, Homo sapiens
cttggttgtgaaccaactgcc

SEQ ID NO: 5411526 - DNA, 19 bp, Homo sapiens
cttggttgttcctttttct

SEQ ID NO: 5411527 - DNA, 17 bp, Homo sapiens
cttggtttagaggaacc

SEQ ID NO: 5411528 - DNA, 23 bp, Homo sapiens
cttggtttatgtcttgttcttga

SEQ ID NO: 5411529 - DNA, 17 bp, Homo sapiens
cttggtttcagccaagg

SEQ ID NO: 5411530 - DNA, 13 bp, Homo sapiens
cttggtttctggg

SEQ ID NO: 5411531 - DNA, 22 bp, Homo sapiens
cttggtttcttcaacaggagaa

SEQ ID NO: 5411532 - DNA, 22 bp, Homo sapiens
cttggtttgtggcgtctccctc

SEQ ID NO: 5411533 - DNA, 22 bp, Homo sapiens
cttggtttgttatatcagggaa

SEQ ID NO: 5411534 - DNA, 16 bp, Homo sapiens
cttggttttctctctg

SEQ ID NO: 5411535 - DNA, 16 bp, Homo sapiens
cttggttttgcctctt

SEQ ID NO: 5411536 - DNA, 20 bp, Homo sapiens
cttggtttttactgctctga

SEQ ID NO: 5411537 - DNA, 21 bp, Homo sapiens
cttggtttttactgctctgag

SEQ ID NO: 5411538 - DNA, 22 bp, Homo sapiens
cttggtttttactgctctgaga

SEQ ID NO: 5411539 - DNA, 15 bp, Homo sapiens
cttgtaaaaaaagca

SEQ ID NO: 5411540 - DNA, 17 bp, Homo sapiens
cttgtaaaaaggggagg

SEQ ID NO: 5411541 - DNA, 22 bp, Homo sapiens
cttgtaaaaagggggctgcatt

SEQ ID NO: 5411542 - DNA, 14 bp, Homo sapiens
cttgtaaaactgtg

SEQ ID NO: 5411543 - DNA, 19 bp, Homo sapiens
cttgtaaaactgtgacatt

SEQ ID NO: 5411544 - DNA, 16 bp, Homo sapiens
cttgtaaacctggagg

SEQ ID NO: 5411545 - DNA, 17 bp, Homo sapiens
cttgtaaacctggaggg

SEQ ID NO: 5411546 - DNA, 15 bp, Homo sapiens
cttgtaaacttgaaa

SEQ ID NO: 5411547 - DNA, 13 bp, Homo sapiens
cttgtaaagactg

SEQ ID NO: 5411548 - DNA, 16 bp, Homo sapiens
cttgtaaaggatatta

SEQ ID NO: 5411549 - DNA, 12 bp, Homo sapiens
cttgtaaataaa

SEQ ID NO: 5411550 - DNA, 16 bp, Homo sapiens
cttgtaaataaagccc

SEQ ID NO: 5411551 - DNA, 19 bp, Homo sapiens
cttgtaaataaagtctatt

SEQ ID NO: 5411552 - DNA, 17 bp, Homo sapiens
cttgtaaataatgctta

SEQ ID NO: 5411553 - DNA, 15 bp, Homo sapiens
cttgtaaatacacca

SEQ ID NO: 5411554 - DNA, 13 bp, Homo sapiens
cttgtaaatacat

SEQ ID NO: 5411555 - DNA, 16 bp, Homo sapiens
cttgtggccaatggaa

SEQ ID NO: 5411556 - DNA, 21 bp, Homo sapiens
cttgtggccccttttactttt

SEQ ID NO: 5411557 - DNA, 14 bp, Homo sapiens
cttgtggcctatga

SEQ ID NO: 5411558 - DNA, 20 bp, Homo sapiens
cttgtggccttttttataac

SEQ ID NO: 5411559 - DNA, 17 bp, Homo sapiens
cttgtgggaataaacag

SEQ ID NO: 5411560 - DNA, 17 bp, Homo sapiens
cttgtgggaccagtccc

SEQ ID NO: 5411561 - DNA, 21 bp, Homo sapiens
cttgtgggaccagtcccacac

SEQ ID NO: 5411562 - DNA, 20 bp, Homo sapiens
cttgtgggagacagcagcct

SEQ ID NO: 5411563 - DNA, 22 bp, Homo sapiens
cttgtgggcaaaggcagggcca

SEQ ID NO: 5411564 - DNA, 17 bp, Homo sapiens
cttgtgggcctgggctc

SEQ ID NO: 5411565 - DNA, 21 bp, Homo sapiens
cttgtgggctggtgccccaca

SEQ ID NO: 5411566 - DNA, 17 bp, Homo sapiens
cttgtggggacccaggc

SEQ ID NO: 5411567 - DNA, 15 bp, Homo sapiens
cttgtggggccagga

SEQ ID NO: 5411568 - DNA, 14 bp, Homo sapiens
cttgtgggtccatg

SEQ ID NO: 5411569 - DNA, 24 bp, Homo sapiens
cttgtgggtccatgctaacaaaga

SEQ ID NO: 5411570 - DNA, 21 bp, Homo sapiens
cttgtgggtgtgagcagcacc

SEQ ID NO: 5411571 - DNA, 15 bp, Homo sapiens
cttgtggtacctagt

SEQ ID NO: 5411572 - DNA, 15 bp, Homo sapiens
cttgtggtcccaccc

SEQ ID NO: 5411573 - DNA, 15 bp, Homo sapiens
cttgtggtggctgct

SEQ ID NO: 5411574 - DNA, 20 bp, Homo sapiens
cttgtggtggctgctccatg

SEQ ID NO: 5411575 - DNA, 20 bp, Homo sapiens
cttgtggtgtaaagctggcc

SEQ ID NO: 5411576 - DNA, 14 bp, Homo sapiens
cttgtggtgtgacc

SEQ ID NO: 5411577 - DNA, 22 bp, Homo sapiens
cttgtggtgtgaccatgttcat

SEQ ID NO: 5411578 - DNA, 23 bp, Homo sapiens
cttgtggttataacttaatgaaa

SEQ ID NO: 5411579 - DNA, 18 bp, Homo sapiens
cttgtggttctctttttg

SEQ ID NO: 5411580 - DNA, 21 bp, Homo sapiens
cttgtggttgaaaaccacagt

SEQ ID NO: 5411581 - DNA, 15 bp, Homo sapiens
cttgtggttgaaatc

SEQ ID NO: 5411582 - DNA, 21 bp, Homo sapiens
cttgtggttgtatatatcagg

SEQ ID NO: 5411583 - DNA, 21 bp, Homo sapiens
cttgtggttgtgtgtgttctg

SEQ ID NO: 5411584 - DNA, 22 bp, Homo sapiens
cttgtggttgtgtgtgttctgt

SEQ ID NO: 5411585 - DNA, 17 bp, Homo sapiens
cttgtgtaatttcctgc

SEQ ID NO: 5411586 - DNA, 21 bp, Homo sapiens
cttgtgtaatttcctgctcct

SEQ ID NO: 5411587 - DNA, 18 bp, Homo sapiens
cttgtgtaccagctgctg

SEQ ID NO: 5411588 - DNA, 17 bp, Homo sapiens
cttgtgtagatttgaaa

SEQ ID NO: 5411589 - DNA, 14 bp, Homo sapiens
cttgtgtatccatt

SEQ ID NO: 5411590 - DNA, 15 bp, Homo sapiens
cttgtgtatccatta

SEQ ID NO: 5411591 - DNA, 16 bp, Homo sapiens
cttgtgtatccattat

SEQ ID NO: 5411592 - DNA, 12 bp, Homo sapiens
cttgtgtatctt

SEQ ID NO: 5411593 - DNA, 14 bp, Homo sapiens
cttgtgtatcttga

SEQ ID NO: 5411594 - DNA, 17 bp, Homo sapiens
cttgtgtatgtgactcc

SEQ ID NO: 5411595 - DNA, 16 bp, Homo sapiens
cttgtgtattagatat

SEQ ID NO: 5411596 - DNA, 18 bp, Homo sapiens
cttgtgtatttctctgtg

SEQ ID NO: 5411597 - DNA, 19 bp, Homo sapiens
cttgtgtatttctctgtga

SEQ ID NO: 5411598 - DNA, 16 bp, Homo sapiens
cttgtgtcaaacagta

SEQ ID NO: 5411599 - DNA, 18 bp, Homo sapiens
cttgtgtcaagacatttc

SEQ ID NO: 5411600 - DNA, 21 bp, Homo sapiens
cttgtgtcaagacatttctct

SEQ ID NO: 5411601 - DNA, 14 bp, Homo sapiens
cttgtgtcccatga

SEQ ID NO: 5411602 - DNA, 12 bp, Homo sapiens
cttgtgtcctga

SEQ ID NO: 5411603 - DNA, 13 bp, Homo sapiens
cttgtgtctgcgt

SEQ ID NO: 5411604 - DNA, 12 bp, Homo sapiens
cttgtgtctgta

SEQ ID NO: 5411605 - DNA, 23 bp, Homo sapiens
cttgtgtctttggaggtgctgct

SEQ ID NO: 5411606 - DNA, 14 bp, Homo sapiens
cttgtgtgcaaaag

SEQ ID NO: 5411607 - DNA, 22 bp, Homo sapiens
cttgtgtgcatggaagtaatta

SEQ ID NO: 5411608 - DNA, 23 bp, Homo sapiens
cttgtgtgtaccacaccctgcct

SEQ ID NO: 5411609 - DNA, 14 bp, Homo sapiens
cttgtgtgtatgtc

SEQ ID NO: 5411610 - DNA, 17 bp, Homo sapiens
cttgtgtgtatgtctat

SEQ ID NO: 5411611 - DNA, 21 bp, Homo sapiens
cttgtgtgtatgtctatgtgt

SEQ ID NO: 5411612 - DNA, 20 bp, Homo sapiens
cttgtgtgtcaggccctctg

SEQ ID NO: 5411613 - DNA, 14 bp, Homo sapiens
cttgtgtgtgccct

SEQ ID NO: 5411614 - DNA, 20 bp, Homo sapiens
cttgtgtgtgccctgggcca

SEQ ID NO: 5411615 - DNA, 21 bp, Homo sapiens
cttgtgtgtgggctgtgagtg

SEQ ID NO: 5411616 - DNA, 16 bp, Homo sapiens
cttgtgtgtgtacctg

SEQ ID NO: 5411617 - DNA, 11 bp, Homo sapiens
cttgtgtgttt

SEQ ID NO: 5411618 - DNA, 18 bp, Homo sapiens
cttgtgtgtttcactttt

SEQ ID NO: 5411619 - DNA, 19 bp, Homo sapiens
cttgtgtgtttcactttta

SEQ ID NO: 5411620 - DNA, 13 bp, Homo sapiens
cttgtgtgttttt

SEQ ID NO: 5411621 - DNA, 20 bp, Homo sapiens
cttgtgttaacttgcctcca

SEQ ID NO: 5411622 - DNA, 23 bp, Homo sapiens
cttgtgttaacttgcctccatct

SEQ ID NO: 5411623 - DNA, 19 bp, Homo sapiens
cttgtgttaagtatgtgta

SEQ ID NO: 5411624 - DNA, 14 bp, Homo sapiens
cttgtgttactaat

SEQ ID NO: 5411625 - DNA, 23 bp, Homo sapiens
cttgtgttactaatttgtataac

SEQ ID NO: 5411626 - DNA, 16 bp, Homo sapiens
cttgtgttcagaagaa

SEQ ID NO: 5411627 - DNA, 20 bp, Homo sapiens
cttgtgttcagaagaatctt

SEQ ID NO: 5411628 - DNA, 17 bp, Homo sapiens
cttgtgttcatgtggag

SEQ ID NO: 5411629 - DNA, 19 bp, Homo sapiens
cttgtgttccttctgtgaa

SEQ ID NO: 5411630 - DNA, 21 bp, Homo sapiens
cttgtgttccttctgtgaaga

SEQ ID NO: 5411631 - DNA, 14 bp, Homo sapiens
cttgtgttggctgt

SEQ ID NO: 5411632 - DNA, 20 bp, Homo sapiens
cttgtgttgttttctctgat

SEQ ID NO: 5411633 - DNA, 20 bp, Homo sapiens
cttgtgtttaactgtgaaca

SEQ ID NO: 5411634 - DNA, 17 bp, Homo sapiens
cttgtgtttaagcacca

SEQ ID NO: 5411635 - DNA, 14 bp, Homo sapiens
cttgtgtttgagaa

SEQ ID NO: 5411636 - DNA, 14 bp, Homo sapiens
cttgtgtttgctgc

SEQ ID NO: 5411637 - DNA, 14 bp, Homo sapiens
cttgtgtttgctta

SEQ ID NO: 5411638 - DNA, 22 bp, Homo sapiens
cttgtgtttgcttaaacaaagt

SEQ ID NO: 5411639 - DNA, 18 bp, Homo sapiens
cttgttaaagagcactgg

SEQ ID NO: 5411640 - DNA, 16 bp, Homo sapiens
cttgttaatattcttt

SEQ ID NO: 5411641 - DNA, 13 bp, Homo sapiens
cttgttaatgtca

SEQ ID NO: 5411642 - DNA, 14 bp, Homo sapiens
cttgttaatgtcat

SEQ ID NO: 5411643 - DNA, 21 bp, Homo sapiens
cttgttaatttcattccaaac

SEQ ID NO: 5411644 - DNA, 18 bp, Homo sapiens
cttgttactgctgattct

SEQ ID NO: 5411645 - DNA, 23 bp, Homo sapiens
cttgttactgctgattcttgtaa

SEQ ID NO: 5411646 - DNA, 13 bp, Homo sapiens
cttgttactgtga

SEQ ID NO: 5411647 - DNA, 15 bp, Homo sapiens
cttgttacttctgag

SEQ ID NO: 5411648 - DNA, 16 bp, Homo sapiens
cttgttacttgcagca

SEQ ID NO: 5411649 - DNA, 16 bp, Homo sapiens
cttgttagatttttaa

SEQ ID NO: 5411650 - DNA, 19 bp, Homo sapiens
cttgttagccaacttcaag

SEQ ID NO: 5411651 - DNA, 15 bp, Homo sapiens
cttgttatgtacaaa

SEQ ID NO: 5411652 - DNA, 17 bp, Homo sapiens
cttgttatgtacaaact

SEQ ID NO: 5411653 - DNA, 23 bp, Homo sapiens
cttgttatgtacaaactagtttt

SEQ ID NO: 5411654 - DNA, 15 bp, Homo sapiens
cttgttatgttgtaa

SEQ ID NO: 5411655 - DNA, 18 bp, Homo sapiens
cttgttattaatgtttct

SEQ ID NO: 5411656 - DNA, 21 bp, Homo sapiens
cttgttattaccaaaacagga

SEQ ID NO: 5411657 - DNA, 15 bp, Homo sapiens
cttgttattattgtt

SEQ ID NO: 5411658 - DNA, 17 bp, Homo sapiens
cttgttattgaagtgtt

SEQ ID NO: 5411659 - DNA, 13 bp, Homo sapiens
cttgttattgtga

SEQ ID NO: 5411660 - DNA, 13 bp, Homo sapiens
cttgttatttata

SEQ ID NO: 5411661 - DNA, 17 bp, Homo sapiens
cttgttcaacagtttct

SEQ ID NO: 5411662 - DNA, 19 bp, Homo sapiens
cttgttcaacagtttctca

SEQ ID NO: 5411663 - DNA, 16 bp, Homo sapiens
cttgttcactgcagca

SEQ ID NO: 5411664 - DNA, 19 bp, Homo sapiens
cttgttcactgcagcatgc

SEQ ID NO: 5411665 - DNA, 15 bp, Homo sapiens
cttgttcagcaggct

SEQ ID NO: 5411666 - DNA, 22 bp, Homo sapiens
cttgttcagtcacttgtttgtg

SEQ ID NO: 5411667 - DNA, 22 bp, Homo sapiens
cttgttcatcatccagatgtgg

SEQ ID NO: 5411668 - DNA, 19 bp, Homo sapiens
cttgttcatggagagctgt

SEQ ID NO: 5411669 - DNA, 15 bp, Homo sapiens
cttgttcatttctgt

SEQ ID NO: 5411670 - DNA, 12 bp, Homo sapiens
cttgttcatttt

SEQ ID NO: 5411671 - DNA, 17 bp, Homo sapiens
cttgttccaaggccagg

SEQ ID NO: 5411672 - DNA, 21 bp, Homo sapiens
cttgttccaatgccacatact

SEQ ID NO: 5411673 - DNA, 16 bp, Homo sapiens
cttgttccagctcttt

SEQ ID NO: 5411674 - DNA, 16 bp, Homo sapiens
cttgttccagctttga

SEQ ID NO: 5411675 - DNA, 21 bp, Homo sapiens
cttgttccccactgacagcct

SEQ ID NO: 5411676 - DNA, 16 bp, Homo sapiens
cttgttccgtgccagg

SEQ ID NO: 5411677 - DNA, 12 bp, Homo sapiens
cttgttcctaga

SEQ ID NO: 5411678 - DNA, 14 bp, Homo sapiens
cttgttcctgctct

SEQ ID NO: 5411679 - DNA, 15 bp, Homo sapiens
cttgttccttctgct

SEQ ID NO: 5411680 - DNA, 21 bp, Homo sapiens
cttgttcgtgggtcatcggga

SEQ ID NO: 5411681 - DNA, 16 bp, Homo sapiens
cttgttctagaatcat

SEQ ID NO: 5411682 - DNA, 20 bp, Homo sapiens
cttgttctatttttcaatca

SEQ ID NO: 5411683 - DNA, 12 bp, Homo sapiens
cttgttctctgc

SEQ ID NO: 5411684 - DNA, 18 bp, Homo sapiens
cttgttctgagtaagtgt

SEQ ID NO: 5411685 - DNA, 18 bp, Homo sapiens
cttgttctgtcccttcca

SEQ ID NO: 5411686 - DNA, 12 bp, Homo sapiens
cttgttctgttt

SEQ ID NO: 5411687 - DNA, 16 bp, Homo sapiens
cttgttctgttttgtt

SEQ ID NO: 5411688 - DNA, 14 bp, Homo sapiens
cttgttcttttctg

SEQ ID NO: 5411689 - DNA, 16 bp, Homo sapiens
cttgttcttttctggt

SEQ ID NO: 5411690 - DNA, 19 bp, Homo sapiens
cttgttgaagtgctgtttt

SEQ ID NO: 5411691 - DNA, 13 bp, Homo sapiens
cttgttgaatgtc

SEQ ID NO: 5411692 - DNA, 16 bp, Homo sapiens
cttgttgagggtatgt

SEQ ID NO: 5411693 - DNA, 20 bp, Homo sapiens
cttgttgagggtatgtttta

SEQ ID NO: 5411694 - DNA, 21 bp, Homo sapiens
cttgttgagggtatgttttat

SEQ ID NO: 5411695 - DNA, 22 bp, Homo sapiens
cttgttgagggtatgttttata

SEQ ID NO: 5411696 - DNA, 21 bp, Homo sapiens
cttgttgatagtgatgtattt

SEQ ID NO: 5411697 - DNA, 16 bp, Homo sapiens
cttgttgcactgcccc

SEQ ID NO: 5411698 - DNA, 19 bp, Homo sapiens
cttgttgcatgatgtattt

SEQ ID NO: 5411699 - DNA, 18 bp, Homo sapiens
cttgttgcatttccagct

SEQ ID NO: 5411700 - DNA, 24 bp, Homo sapiens
cttgttgcatttccagctgtgcag

SEQ ID NO: 5411701 - DNA, 13 bp, Homo sapiens
cttgttgcccagg

SEQ ID NO: 5411702 - DNA, 13 bp, Homo sapiens
cttgttgcctgca

SEQ ID NO: 5411703 - DNA, 21 bp, Homo sapiens
cttgttgcctgcacccttccc

SEQ ID NO: 5411704 - DNA, 22 bp, Homo sapiens
cttgttgcctgcacccttccct

SEQ ID NO: 5411705 - DNA, 23 bp, Homo sapiens
cttgttgcctgcacccttccctc

SEQ ID NO: 5411706 - DNA, 23 bp, Homo sapiens
cttgttgctgagtctgcagatga

SEQ ID NO: 5411707 - DNA, 22 bp, Homo sapiens
cttgttgctgttgatgttttgt

SEQ ID NO: 5411708 - DNA, 13 bp, Homo sapiens
cttgttgctttgt

SEQ ID NO: 5411709 - DNA, 15 bp, Homo sapiens
cttgttgctttgttg

SEQ ID NO: 5411710 - DNA, 21 bp, Homo sapiens
cttgttgctttgttgcactga

SEQ ID NO: 5411711 - DNA, 18 bp, Homo sapiens
cttgttggagcctgcagg

SEQ ID NO: 5411712 - DNA, 22 bp, Homo sapiens
cttgttggcgtaggctacagag

SEQ ID NO: 5411713 - DNA, 18 bp, Homo sapiens
cttgttgggattcctgac

SEQ ID NO: 5411714 - DNA, 12 bp, Homo sapiens
cttgttggtgga

SEQ ID NO: 5411715 - DNA, 16 bp, Homo sapiens
cttgttgtaaagcaat

SEQ ID NO: 5411716 - DNA, 17 bp, Homo sapiens
cttgttgtaaagcaata

SEQ ID NO: 5411717 - DNA, 15 bp, Homo sapiens
cttgttgtcaagtat

SEQ ID NO: 5411718 - DNA, 16 bp, Homo sapiens
cttgttgtcaagtata

SEQ ID NO: 5411719 - DNA, 21 bp, Homo sapiens
cttgttgtcccaatgaaatac

SEQ ID NO: 5411720 - DNA, 15 bp, Homo sapiens
cttgttgtgctttta

SEQ ID NO: 5411721 - DNA, 15 bp, Homo sapiens
cttgttgtggctctt

SEQ ID NO: 5411722 - DNA, 20 bp, Homo sapiens
cttgttgtggctcttatttc

SEQ ID NO: 5411723 - DNA, 15 bp, Homo sapiens
cttgttgttcatata

SEQ ID NO: 5411724 - DNA, 13 bp, Homo sapiens
cttgttgttgtta

SEQ ID NO: 5411725 - DNA, 15 bp, Homo sapiens
cttgttgtttaatgt

SEQ ID NO: 5411726 - DNA, 13 bp, Homo sapiens
cttgttgtttata

SEQ ID NO: 5411727 - DNA, 18 bp, Homo sapiens
cttgttgtttatatgaaa

SEQ ID NO: 5411728 - DNA, 21 bp, Homo sapiens
cttgttgtttatatgaaaaca

SEQ ID NO: 5411729 - DNA, 16 bp, Homo sapiens
cttgttgtttcttgcc

SEQ ID NO: 5411730 - DNA, 21 bp, Homo sapiens
cttgttgtttgtaacaagaaa

SEQ ID NO: 5411731 - DNA, 15 bp, Homo sapiens
cttgttgtttttaag

SEQ ID NO: 5411732 - DNA, 18 bp, Homo sapiens
ctttatcttgaataatgt

SEQ ID NO: 5411733 - DNA, 21 bp, Homo sapiens
ctttatcttgaataatgtaag

SEQ ID NO: 5411734 - DNA, 15 bp, Homo sapiens
ctttatctttgtgta

SEQ ID NO: 5411735 - DNA, 13 bp, Homo sapiens
ctttatcttttca

SEQ ID NO: 5411736 - DNA, 17 bp, Homo sapiens
ctttatgaaaaaaatat

SEQ ID NO: 5411737 - DNA, 23 bp, Homo sapiens
ctttatgactgtttttgtagtgg

SEQ ID NO: 5411738 - DNA, 20 bp, Homo sapiens
ctttatgaggtcgtataatt

SEQ ID NO: 5411739 - DNA, 13 bp, Homo sapiens
ctttatgatttca

SEQ ID NO: 5411740 - DNA, 16 bp, Homo sapiens
ctttatgattttcata

SEQ ID NO: 5411741 - DNA, 20 bp, Homo sapiens
ctttatgcaaaaacatatgt

SEQ ID NO: 5411742 - DNA, 15 bp, Homo sapiens
ctttatgcaaataca

SEQ ID NO: 5411743 - DNA, 21 bp, Homo sapiens
ctttatgcaaatacaatcagc

SEQ ID NO: 5411744 - DNA, 14 bp, Homo sapiens
ctttatgcatctct

SEQ ID NO: 5411745 - DNA, 19 bp, Homo sapiens
ctttatgccggatgtgctt

SEQ ID NO: 5411746 - DNA, 16 bp, Homo sapiens
ctttatgctgtgttta

SEQ ID NO: 5411747 - DNA, 13 bp, Homo sapiens
ctttatggctgct

SEQ ID NO: 5411748 - DNA, 16 bp, Homo sapiens
ctttatggtaaagatg

SEQ ID NO: 5411749 - DNA, 17 bp, Homo sapiens
ctttatgtaagaagaaa

SEQ ID NO: 5411750 - DNA, 19 bp, Homo sapiens
ctttatgtaagaagaaact

SEQ ID NO: 5411751 - DNA, 17 bp, Homo sapiens
ctttatgtaagtttatg

SEQ ID NO: 5411752 - DNA, 16 bp, Homo sapiens
ctttatgtaataatgt

SEQ ID NO: 5411753 - DNA, 21 bp, Homo sapiens
ctttatgtatctaatttcatt

SEQ ID NO: 5411754 - DNA, 22 bp, Homo sapiens
ctttatgtatctaatttcattc

SEQ ID NO: 5411755 - DNA, 13 bp, Homo sapiens
ctttatgtatctc

SEQ ID NO: 5411756 - DNA, 12 bp, Homo sapiens
ctttatgtattc

SEQ ID NO: 5411757 - DNA, 15 bp, Homo sapiens
ctttatgtattctct

SEQ ID NO: 5411758 - DNA, 13 bp, Homo sapiens
ctttatgtgaatt

SEQ ID NO: 5411759 - DNA, 14 bp, Homo sapiens
ctttatgtgaattt

SEQ ID NO: 5411760 - DNA, 23 bp, Homo sapiens
ctttatgtggaaaacagaacatc

SEQ ID NO: 5411761 - DNA, 14 bp, Homo sapiens
ctttatgtgtaaat

SEQ ID NO: 5411762 - DNA, 14 bp, Homo sapiens
ctttatgtttttct

SEQ ID NO: 5411763 - DNA, 17 bp, Homo sapiens
ctttatgtttttggtta

SEQ ID NO: 5411764 - DNA, 17 bp, Homo sapiens
ctttattaaaaactgag

SEQ ID NO: 5411765 - DNA, 23 bp, Homo sapiens
ctttattaaaaccattgtcctaa

SEQ ID NO: 5411766 - DNA, 13 bp, Homo sapiens
ctttattaaaaga

SEQ ID NO: 5411767 - DNA, 18 bp, Homo sapiens
ctttattaacaaacagga

SEQ ID NO: 5411768 - DNA, 20 bp, Homo sapiens
ctttattaaccctctgagtt

SEQ ID NO: 5411769 - DNA, 16 bp, Homo sapiens
ctttattaacctcagc

SEQ ID NO: 5411770 - DNA, 19 bp, Homo sapiens
ctttattaacctcagcatt

SEQ ID NO: 5411771 - DNA, 14 bp, Homo sapiens
ctttattaagtaga

SEQ ID NO: 5411772 - DNA, 16 bp, Homo sapiens
ctttattaatgaactg

SEQ ID NO: 5411773 - DNA, 22 bp, Homo sapiens
ctttattaatgaactgtgacag

SEQ ID NO: 5411774 - DNA, 19 bp, Homo sapiens
ctttattaatgttttcaaa

SEQ ID NO: 5411775 - DNA, 16 bp, Homo sapiens
ctttattaattcatta

SEQ ID NO: 5411776 - DNA, 14 bp, Homo sapiens
ctttattaccccct

SEQ ID NO: 5411777 - DNA, 18 bp, Homo sapiens
ctttattagtaacatcat

SEQ ID NO: 5411778 - DNA, 14 bp, Homo sapiens
ctttattagtgaag

SEQ ID NO: 5411779 - DNA, 11 bp, Homo sapiens
ctttattataa

SEQ ID NO: 5411780 - DNA, 13 bp, Homo sapiens
ctttattataaaa

SEQ ID NO: 5411781 - DNA, 15 bp, Homo sapiens
ctttattataaaatg

SEQ ID NO: 5411782 - DNA, 14 bp, Homo sapiens
ctttattatggaaa

SEQ ID NO: 5411783 - DNA, 20 bp, Homo sapiens
ctttattatggcttgtgaac

SEQ ID NO: 5411784 - DNA, 22 bp, Homo sapiens
ctttattatggcttgtgaactg

SEQ ID NO: 5411785 - DNA, 12 bp, Homo sapiens
ctttattattta

SEQ ID NO: 5411786 - DNA, 13 bp, Homo sapiens
ctttattatttat

SEQ ID NO: 5411787 - DNA, 18 bp, Homo sapiens
ctttattcattaagcttt

SEQ ID NO: 5411788 - DNA, 21 bp, Homo sapiens
ctttattctcagtaactttta

SEQ ID NO: 5411789 - DNA, 15 bp, Homo sapiens
ctttattctgtgtta

SEQ ID NO: 5411790 - DNA, 17 bp, Homo sapiens
ctttattcttccaagtt

SEQ ID NO: 5411791 - DNA, 18 bp, Homo sapiens
ctttattcttgaaagaag

SEQ ID NO: 5411792 - DNA, 12 bp, Homo sapiens
ctttattcttta

SEQ ID NO: 5411793 - DNA, 21 bp, Homo sapiens
ctttattctttaattgttgct

SEQ ID NO: 5411794 - DNA, 13 bp, Homo sapiens
ctttattgagaaa

SEQ ID NO: 5411795 - DNA, 17 bp, Homo sapiens
ctttattgatatctcca

SEQ ID NO: 5411796 - DNA, 19 bp, Homo sapiens
ctttattgattttctttct

SEQ ID NO: 5411797 - DNA, 13 bp, Homo sapiens
ctttattgcatat

SEQ ID NO: 5411798 - DNA, 18 bp, Homo sapiens
ctttattgcccatgggat

SEQ ID NO: 5411799 - DNA, 22 bp, Homo sapiens
ctttattgctatcgccctcctt

SEQ ID NO: 5411800 - DNA, 21 bp, Homo sapiens
ctttattgcttaatttctgcc

SEQ ID NO: 5411801 - DNA, 13 bp, Homo sapiens
ctttattggtctt

SEQ ID NO: 5411802 - DNA, 13 bp, Homo sapiens
ctttattgtacag

SEQ ID NO: 5411803 - DNA, 24 bp, Homo sapiens
ctttattgtacagactgttttact

SEQ ID NO: 5411804 - DNA, 18 bp, Homo sapiens
ctttattgtctgtaaatc

SEQ ID NO: 5411805 - DNA, 22 bp, Homo sapiens
ctttattgtcttggttgccagt

SEQ ID NO: 5411806 - DNA, 14 bp, Homo sapiens
ctttattgtgatta

SEQ ID NO: 5411807 - DNA, 18 bp, Homo sapiens
ctttatttaaaaaagaaa

SEQ ID NO: 5411808 - DNA, 13 bp, Homo sapiens
ctttatttaaatg

SEQ ID NO: 5411809 - DNA, 16 bp, Homo sapiens
ctttatttaaatgcat

SEQ ID NO: 5411810 - DNA, 14 bp, Homo sapiens
ctttatttaatttc

SEQ ID NO: 5411811 - DNA, 16 bp, Homo sapiens
ctttatttaatttcat

SEQ ID NO: 5411812 - DNA, 17 bp, Homo sapiens
ctttatttaatttcata

SEQ ID NO: 5411813 - DNA, 16 bp, Homo sapiens
ctttatttaggaaaca

SEQ ID NO: 5411814 - DNA, 21 bp, Homo sapiens
ctttatttaggaaacaccatt

SEQ ID NO: 5411815 - DNA, 13 bp, Homo sapiens
ctttatttatggc

SEQ ID NO: 5411816 - DNA, 21 bp, Homo sapiens
ctttatttatggcttataaat

SEQ ID NO: 5411817 - DNA, 22 bp, Homo sapiens
ctttatttatggcttataaatg

SEQ ID NO: 5411818 - DNA, 20 bp, Homo sapiens
ctttatttattgcttagtga

SEQ ID NO: 5411819 - DNA, 16 bp, Homo sapiens
ctttatttatttatat

SEQ ID NO: 5411820 - DNA, 14 bp, Homo sapiens
ctttatttcacata

SEQ ID NO: 5411821 - DNA, 17 bp, Homo sapiens
ctttatttctagcagag

SEQ ID NO: 5411822 - DNA, 14 bp, Homo sapiens
ctttatttctcttc

SEQ ID NO: 5411823 - DNA, 20 bp, Homo sapiens
ctttatttctcttctaccct

SEQ ID NO: 5411824 - DNA, 11 bp, Homo sapiens
ctttatttctg

SEQ ID NO: 5411825 - DNA, 15 bp, Homo sapiens
ctttatttctgagca

SEQ ID NO: 5411826 - DNA, 20 bp, Homo sapiens
ctttatttgaacaatgaagt

SEQ ID NO: 5411827 - DNA, 17 bp, Homo sapiens
ctttatttgtaaaccat

SEQ ID NO: 5411828 - DNA, 22 bp, Homo sapiens
ctttatttgtaaaccattgtaa

SEQ ID NO: 5411829 - DNA, 22 bp, Homo sapiens
ctttatttgtagccaaagaaat

SEQ ID NO: 5411830 - DNA, 22 bp, Homo sapiens
ctttatttgtttatatttaatt

SEQ ID NO: 5411831 - DNA, 20 bp, Homo sapiens
ctttattttaaatgatctgt

SEQ ID NO: 5411832 - DNA, 15 bp, Homo sapiens
ctttattttattgaa

SEQ ID NO: 5411833 - DNA, 20 bp, Homo sapiens
ctttattttattgaaatgta

SEQ ID NO: 5411834 - DNA, 12 bp, Homo sapiens
ctttattttccc

SEQ ID NO: 5411835 - DNA, 21 bp, Homo sapiens
ctttattttcccctatcattt

SEQ ID NO: 5411836 - DNA, 11 bp, Homo sapiens
ctttattttct

SEQ ID NO: 5411837 - DNA, 19 bp, Homo sapiens
ctttattttgagatgtaaa

SEQ ID NO: 5411838 - DNA, 22 bp, Homo sapiens
ctttattttgagatgtaaaaag

SEQ ID NO: 5411839 - DNA, 16 bp, Homo sapiens
ctttattttgtgtaaa

SEQ ID NO: 5411840 - DNA, 17 bp, Homo sapiens
ctttattttgtgtaaaa

SEQ ID NO: 5411841 - DNA, 18 bp, Homo sapiens
ctttattttgtgtaaaaa

SEQ ID NO: 5411842 - DNA, 12 bp, Homo sapiens
ctttatttttca

SEQ ID NO: 5411843 - DNA, 16 bp, Homo sapiens
ctttatttttcattac

SEQ ID NO: 5411844 - DNA, 20 bp, Homo sapiens
ctttatttttctctttctcc

SEQ ID NO: 5411845 - DNA, 22 bp, Homo sapiens
ctttatttttctttaaagccag

SEQ ID NO: 5411846 - DNA, 18 bp, Homo sapiens
ctttattttttaagtatt

SEQ ID NO: 5411847 - DNA, 20 bp, Homo sapiens
ctttatttttttgaactctt

SEQ ID NO: 5411848 - DNA, 19 bp, Homo sapiens
ctttcaaaaccttttgaaa

SEQ ID NO: 5411849 - DNA, 13 bp, Homo sapiens
ctttcaaaagaca

SEQ ID NO: 5411850 - DNA, 15 bp, Homo sapiens
ctttcaaaccagctt

SEQ ID NO: 5411851 - DNA, 15 bp, Homo sapiens
ctttcaaagaaggaa

SEQ ID NO: 5411852 - DNA, 14 bp, Homo sapiens
ctttcaaagacaat

SEQ ID NO: 5411853 - DNA, 22 bp, Homo sapiens
ctttcaaagacaatcactgaaa

SEQ ID NO: 5411854 - DNA, 20 bp, Homo sapiens
ctttcaaaggagaatgaatc

SEQ ID NO: 5411855 - DNA, 14 bp, Homo sapiens
ctttcaaattatat

SEQ ID NO: 5411856 - DNA, 18 bp, Homo sapiens
ctttcaaattgaaatgac

SEQ ID NO: 5411857 - DNA, 13 bp, Homo sapiens
ctttcaacatgta

SEQ ID NO: 5411858 - DNA, 20 bp, Homo sapiens
ctttcaacttaaatcactga

SEQ ID NO: 5411859 - DNA, 21 bp, Homo sapiens
ctttcaacttaaatcactgag

SEQ ID NO: 5411860 - DNA, 14 bp, Homo sapiens
ctttcaacttgcat

SEQ ID NO: 5411861 - DNA, 18 bp, Homo sapiens
ctttcaagaactatatat

SEQ ID NO: 5411862 - DNA, 16 bp, Homo sapiens
ctttcaagaacttgtt

SEQ ID NO: 5411863 - DNA, 13 bp, Homo sapiens
ctttcaagaatga

SEQ ID NO: 5411864 - DNA, 15 bp, Homo sapiens
ctttcaagctgcact

SEQ ID NO: 5411865 - DNA, 13 bp, Homo sapiens
ctttcaaggctgg

SEQ ID NO: 5411866 - DNA, 17 bp, Homo sapiens
ctttcaagtattatatt

SEQ ID NO: 5411867 - DNA, 22 bp, Homo sapiens
ctttcaagtattatattttatt

SEQ ID NO: 5411868 - DNA, 22 bp, Homo sapiens
ctttcaataaactaaagaaaaa

SEQ ID NO: 5411869 - DNA, 14 bp, Homo sapiens
ctttcaataaagtt

SEQ ID NO: 5411870 - DNA, 23 bp, Homo sapiens
ctttcaataaagttgttgcattc

SEQ ID NO: 5411871 - DNA, 18 bp, Homo sapiens
ctttcaataaatgtatca

SEQ ID NO: 5411872 - DNA, 22 bp, Homo sapiens
ctttcaataaatgtatcatttt

SEQ ID NO: 5411873 - DNA, 16 bp, Homo sapiens
ctttcaataacgaagt

SEQ ID NO: 5411874 - DNA, 19 bp, Homo sapiens
ctttcaatacagatatatt

SEQ ID NO: 5411875 - DNA, 15 bp, Homo sapiens
ctttcaataggaaaa

SEQ ID NO: 5411876 - DNA, 20 bp, Homo sapiens
ctttcaataggaaaaactga

SEQ ID NO: 5411877 - DNA, 22 bp, Homo sapiens
ctttcaataggaaaaactgatt

SEQ ID NO: 5411878 - DNA, 23 bp, Homo sapiens
ctttcaataggaaaaactgattt

SEQ ID NO: 5411879 - DNA, 15 bp, Homo sapiens
ctttcaatatcatta

SEQ ID NO: 5411880 - DNA, 22 bp, Homo sapiens
ctttcaatatttatttccagag

SEQ ID NO: 5411881 - DNA, 14 bp, Homo sapiens
ctttcaatccacag

SEQ ID NO: 5411882 - DNA, 16 bp, Homo sapiens
ctttcaatccacagta

SEQ ID NO: 5411883 - DNA, 19 bp, Homo sapiens
ctttcaatccacagtattg

SEQ ID NO: 5411884 - DNA, 23 bp, Homo sapiens
ctttcaatccacagtattgttct

SEQ ID NO: 5411885 - DNA, 15 bp, Homo sapiens
ctttcaatgcagcac

SEQ ID NO: 5411886 - DNA, 13 bp, Homo sapiens
ctttcaatgcagt

SEQ ID NO: 5411887 - DNA, 21 bp, Homo sapiens
ctttcaatggtttgcaaggaa

SEQ ID NO: 5411888 - DNA, 19 bp, Homo sapiens
ctttcaattccaccagggc

SEQ ID NO: 5411889 - DNA, 21 bp, Homo sapiens
ctttcaattccaccagggcca

SEQ ID NO: 5411890 - DNA, 21 bp, Homo sapiens
ctttcaattccgtagccagct

SEQ ID NO: 5411891 - DNA, 14 bp, Homo sapiens
ctttcaattgacaa

SEQ ID NO: 5411892 - DNA, 12 bp, Homo sapiens
ctttcaattgta

SEQ ID NO: 5411893 - DNA, 17 bp, Homo sapiens
ctttcacaaaattttat

SEQ ID NO: 5411894 - DNA, 20 bp, Homo sapiens
ctttcacaacatttgcagat

SEQ ID NO: 5411895 - DNA, 16 bp, Homo sapiens
ctttcacaaccttctg

SEQ ID NO: 5411896 - DNA, 23 bp, Homo sapiens
ctttcacacatctgggtgccctg

SEQ ID NO: 5411897 - DNA, 20 bp, Homo sapiens
ctttcacactgtggtgtctc

SEQ ID NO: 5411898 - DNA, 16 bp, Homo sapiens
ctttcacacttccacc

SEQ ID NO: 5411899 - DNA, 15 bp, Homo sapiens
ctttcacagcttctt

SEQ ID NO: 5411900 - DNA, 14 bp, Homo sapiens
ctttcacaggcagc

SEQ ID NO: 5411901 - DNA, 17 bp, Homo sapiens
ctttcacatagagatca

SEQ ID NO: 5411902 - DNA, 16 bp, Homo sapiens
ctttcacatagatgtc

SEQ ID NO: 5411903 - DNA, 14 bp, Homo sapiens
ctttcacatctctg

SEQ ID NO: 5411904 - DNA, 19 bp, Homo sapiens
ctttcaccaagtaaatttg

SEQ ID NO: 5411905 - DNA, 15 bp, Homo sapiens
ctttcaccagaattt

SEQ ID NO: 5411906 - DNA, 19 bp, Homo sapiens
ctttcacccacagaaagag

SEQ ID NO: 5411907 - DNA, 15 bp, Homo sapiens
ctttcaccccagggc

SEQ ID NO: 5411908 - DNA, 16 bp, Homo sapiens
ctttcaccccagggcc

SEQ ID NO: 5411909 - DNA, 23 bp, Homo sapiens
ctttcaccccagggcctgagcct

SEQ ID NO: 5411910 - DNA, 14 bp, Homo sapiens
ctttccttctgccc

SEQ ID NO: 5411911 - DNA, 18 bp, Homo sapiens
ctttccttctggctccaa

SEQ ID NO: 5411912 - DNA, 14 bp, Homo sapiens
ctttccttcttgcc

SEQ ID NO: 5411913 - DNA, 15 bp, Homo sapiens
ctttccttgctcaac

SEQ ID NO: 5411914 - DNA, 16 bp, Homo sapiens
ctttccttggctccca

SEQ ID NO: 5411915 - DNA, 22 bp, Homo sapiens
ctttccttggctcccattcact

SEQ ID NO: 5411916 - DNA, 15 bp, Homo sapiens
ctttccttggcttta

SEQ ID NO: 5411917 - DNA, 17 bp, Homo sapiens
ctttccttggctttatg

SEQ ID NO: 5411918 - DNA, 13 bp, Homo sapiens
ctttccttgtctc

SEQ ID NO: 5411919 - DNA, 17 bp, Homo sapiens
ctttccttgtctctcat

SEQ ID NO: 5411920 - DNA, 19 bp, Homo sapiens
ctttccttgttccccatca

SEQ ID NO: 5411921 - DNA, 12 bp, Homo sapiens
ctttcctttaaa

SEQ ID NO: 5411922 - DNA, 20 bp, Homo sapiens
ctttcctttcatcctcagca

SEQ ID NO: 5411923 - DNA, 13 bp, Homo sapiens
ctttcctttcatt

SEQ ID NO: 5411924 - DNA, 11 bp, Homo sapiens
ctttcctttcc

SEQ ID NO: 5411925 - DNA, 21 bp, Homo sapiens
ctttcctttccccagcccagg

SEQ ID NO: 5411926 - DNA, 14 bp, Homo sapiens
ctttcctttccttt

SEQ ID NO: 5411927 - DNA, 17 bp, Homo sapiens
ctttcctttcctttcat

SEQ ID NO: 5411928 - DNA, 15 bp, Homo sapiens
ctttcctttgctctg

SEQ ID NO: 5411929 - DNA, 16 bp, Homo sapiens
ctttcctttgctctgg

SEQ ID NO: 5411930 - DNA, 18 bp, Homo sapiens
ctttcctttgctctggat

SEQ ID NO: 5411931 - DNA, 21 bp, Homo sapiens
ctttccttttcgcctttcctc

SEQ ID NO: 5411932 - DNA, 12 bp, Homo sapiens
ctttccttttct

SEQ ID NO: 5411933 - DNA, 13 bp, Homo sapiens
ctttccttttctc

SEQ ID NO: 5411934 - DNA, 16 bp, Homo sapiens
ctttccttttcttcct

SEQ ID NO: 5411935 - DNA, 17 bp, Homo sapiens
ctttccttttcttcctt

SEQ ID NO: 5411936 - DNA, 20 bp, Homo sapiens
ctttccttttcttccttctt

SEQ ID NO: 5411937 - DNA, 19 bp, Homo sapiens
ctttccttttcttgtctct

SEQ ID NO: 5411938 - DNA, 20 bp, Homo sapiens
ctttccttttcttgtctctg

SEQ ID NO: 5411939 - DNA, 23 bp, Homo sapiens
ctttccttttcttgtctctgagg

SEQ ID NO: 5411940 - DNA, 21 bp, Homo sapiens
ctttcctttttctttcctttc

SEQ ID NO: 5411941 - DNA, 20 bp, Homo sapiens
ctttccttttttgagatttt

SEQ ID NO: 5411942 - DNA, 13 bp, Homo sapiens
ctttcgaggcctg

SEQ ID NO: 5411943 - DNA, 14 bp, Homo sapiens
ctttcgaggcctga

SEQ ID NO: 5411944 - DNA, 19 bp, Homo sapiens
ctttcgatacccaggacca

SEQ ID NO: 5411945 - DNA, 18 bp, Homo sapiens
ctttcgcctcctccagct

SEQ ID NO: 5411946 - DNA, 20 bp, Homo sapiens
ctttcggaatttttaaaata

SEQ ID NO: 5411947 - DNA, 15 bp, Homo sapiens
ctttcggagcctgcc

SEQ ID NO: 5411948 - DNA, 22 bp, Homo sapiens
ctttcggggagaggctgaggac

SEQ ID NO: 5411949 - DNA, 15 bp, Homo sapiens
ctttcggggagggcg

SEQ ID NO: 5411950 - DNA, 15 bp, Homo sapiens
ctttcggtctcctta

SEQ ID NO: 5411951 - DNA, 22 bp, Homo sapiens
ctttcgtgatcttattgcttgc

SEQ ID NO: 5411952 - DNA, 23 bp, Homo sapiens
ctttcgttctgctgaccaaatgg

SEQ ID NO: 5411953 - DNA, 17 bp, Homo sapiens
ctttcgttggttgtttc

SEQ ID NO: 5411954 - DNA, 22 bp, Homo sapiens
ctttcgttggttgtttctctga

SEQ ID NO: 5411955 - DNA, 22 bp, Homo sapiens
ctttcgtttccagcctttgtca

SEQ ID NO: 5411956 - DNA, 17 bp, Homo sapiens
ctttctaactgtagcta

SEQ ID NO: 5411957 - DNA, 14 bp, Homo sapiens
ctttctaagaaatc

SEQ ID NO: 5411958 - DNA, 16 bp, Homo sapiens
ctttctaagaaatcaa

SEQ ID NO: 5411959 - DNA, 17 bp, Homo sapiens
ctttctaagagaagcaa

SEQ ID NO: 5411960 - DNA, 22 bp, Homo sapiens
ctttctaagcaaccacactgct

SEQ ID NO: 5411961 - DNA, 19 bp, Homo sapiens
ctttctaagccctgttctc

SEQ ID NO: 5411962 - DNA, 19 bp, Homo sapiens
ctttctaaggatagccttt

SEQ ID NO: 5411963 - DNA, 20 bp, Homo sapiens
ctttctaaggatagcctttg

SEQ ID NO: 5411964 - DNA, 22 bp, Homo sapiens
ctttctaatcctatctggggag

SEQ ID NO: 5411965 - DNA, 20 bp, Homo sapiens
ctttctaattaaaaaaataa

SEQ ID NO: 5411966 - DNA, 19 bp, Homo sapiens
ctttctacaactgattgca

SEQ ID NO: 5411967 - DNA, 15 bp, Homo sapiens
ctttctacaatgtga

SEQ ID NO: 5411968 - DNA, 14 bp, Homo sapiens
ctttctacaggcca

SEQ ID NO: 5411969 - DNA, 17 bp, Homo sapiens
ctttctacatgcaaatc

SEQ ID NO: 5411970 - DNA, 14 bp, Homo sapiens
ctttctactcattt

SEQ ID NO: 5411971 - DNA, 14 bp, Homo sapiens
ctttctagaaagaa

SEQ ID NO: 5411972 - DNA, 19 bp, Homo sapiens
ctttctagccataataaaa

SEQ ID NO: 5411973 - DNA, 13 bp, Homo sapiens
ctttctagcctgg

SEQ ID NO: 5411974 - DNA, 16 bp, Homo sapiens
ctttctagcctggcta

SEQ ID NO: 5411975 - DNA, 15 bp, Homo sapiens
ctttctagcctgggg

SEQ ID NO: 5411976 - DNA, 22 bp, Homo sapiens
ctttctagcctggggcttgaat

SEQ ID NO: 5411977 - DNA, 14 bp, Homo sapiens
ctttctagccttag

SEQ ID NO: 5411978 - DNA, 17 bp, Homo sapiens
ctttctagctaatggaa

SEQ ID NO: 5411979 - DNA, 14 bp, Homo sapiens
ctttctagctgttg

SEQ ID NO: 5411980 - DNA, 15 bp, Homo sapiens
ctttctagcttccct

SEQ ID NO: 5411981 - DNA, 18 bp, Homo sapiens
ctttctagggacatgaaa

SEQ ID NO: 5411982 - DNA, 16 bp, Homo sapiens
ctttctagtggtcttt

SEQ ID NO: 5411983 - DNA, 19 bp, Homo sapiens
ctttctagtggtctttgta

SEQ ID NO: 5411984 - DNA, 20 bp, Homo sapiens
ctttctagtggtctttgtaa

SEQ ID NO: 5411985 - DNA, 23 bp, Homo sapiens
ctttctagtggtctttgtaagag

SEQ ID NO: 5411986 - DNA, 13 bp, Homo sapiens
ctttctagttcaa

SEQ ID NO: 5411987 - DNA, 13 bp, Homo sapiens
ctttctagtttgt

SEQ ID NO: 5411988 - DNA, 17 bp, Homo sapiens
ctttctataattttaca

SEQ ID NO: 5411989 - DNA, 18 bp, Homo sapiens
ctttctatatccttgaca

SEQ ID NO: 5411990 - DNA, 12 bp, Homo sapiens
ctttctatcatt

SEQ ID NO: 5411991 - DNA, 15 bp, Homo sapiens
ctttctatcctgctc

SEQ ID NO: 5411992 - DNA, 14 bp, Homo sapiens
ctttctatctaatt

SEQ ID NO: 5411993 - DNA, 18 bp, Homo sapiens
ctttctatctaattttta

SEQ ID NO: 5411994 - DNA, 15 bp, Homo sapiens
ctttctatctcatct

SEQ ID NO: 5411995 - DNA, 21 bp, Homo sapiens
ctttctatctcatctgtctcg

SEQ ID NO: 5411996 - DNA, 22 bp, Homo sapiens
ctttctattacccctcatttaa

SEQ ID NO: 5411997 - DNA, 13 bp, Homo sapiens
ctttctattcata

SEQ ID NO: 5411998 - DNA, 19 bp, Homo sapiens
ctttctattgttaaacaaa

SEQ ID NO: 5411999 - DNA, 23 bp, Homo sapiens
ctttctattgttaaacaaatgat

SEQ ID NO: 5412000 - DNA, 15 bp, Homo sapiens
ctttctattttcaca

SEQ ID NO: 5412001 - DNA, 18 bp, Homo sapiens
ctttctcaaagaaatatt

SEQ ID NO: 5412002 - DNA, 20 bp, Homo sapiens
ctttctcaaagaaatattaa

SEQ ID NO: 5412003 - DNA, 21 bp, Homo sapiens
ctttctcaaagagggggctct

SEQ ID NO: 5412004 - DNA, 15 bp, Homo sapiens
ctttctcaactgtcc

SEQ ID NO: 5412005 - DNA, 14 bp, Homo sapiens
ctttctcaatgtct

SEQ ID NO: 5412006 - DNA, 17 bp, Homo sapiens
ctttctcaatgtcttcc

SEQ ID NO: 5412007 - DNA, 17 bp, Homo sapiens
ctttctcacccaggcaa

SEQ ID NO: 5412008 - DNA, 13 bp, Homo sapiens
ctttctcactgcc

SEQ ID NO: 5412009 - DNA, 17 bp, Homo sapiens
ctttctcactgcctttg

SEQ ID NO: 5412010 - DNA, 14 bp, Homo sapiens
ctttctcactgctg

SEQ ID NO: 5412011 - DNA, 16 bp, Homo sapiens
ctttctcacttttgga

SEQ ID NO: 5412012 - DNA, 12 bp, Homo sapiens
ctttctcagagg

SEQ ID NO: 5412013 - DNA, 13 bp, Homo sapiens
ctttctcagaggg

SEQ ID NO: 5412014 - DNA, 22 bp, Homo sapiens
ctttctcagccgcttctgactg

SEQ ID NO: 5412015 - DNA, 20 bp, Homo sapiens
ctttctcagcctctgaatat

SEQ ID NO: 5412016 - DNA, 22 bp, Homo sapiens
ctttctcaggcttctcatgtgt

SEQ ID NO: 5412017 - DNA, 14 bp, Homo sapiens
ctttctcagtgtgt

SEQ ID NO: 5412018 - DNA, 15 bp, Homo sapiens
ctttctcagttttca

SEQ ID NO: 5412019 - DNA, 22 bp, Homo sapiens
ctttctcataaaactgtgacta

SEQ ID NO: 5412020 - DNA, 17 bp, Homo sapiens
ctttctcatttctttct

SEQ ID NO: 5412021 - DNA, 22 bp, Homo sapiens
ctttctccaaaggcactgaccc

SEQ ID NO: 5412022 - DNA, 15 bp, Homo sapiens
ctttctccaaagtta

SEQ ID NO: 5412023 - DNA, 13 bp, Homo sapiens
ctttctccagcca

SEQ ID NO: 5412024 - DNA, 16 bp, Homo sapiens
ctttctccagccagca

SEQ ID NO: 5412025 - DNA, 14 bp, Homo sapiens
ctttctccagtgta

SEQ ID NO: 5412026 - DNA, 14 bp, Homo sapiens
ctttctccatggag

SEQ ID NO: 5412027 - DNA, 16 bp, Homo sapiens
ctttctccatggagcc

SEQ ID NO: 5412028 - DNA, 21 bp, Homo sapiens
ctttctccctcaactgaaggg

SEQ ID NO: 5412029 - DNA, 15 bp, Homo sapiens
ctttctccctgcagc

SEQ ID NO: 5412030 - DNA, 21 bp, Homo sapiens
ctttctcctcatccatttctt

SEQ ID NO: 5412031 - DNA, 13 bp, Homo sapiens
ctttctcctcccc

SEQ ID NO: 5412032 - DNA, 17 bp, Homo sapiens
ctttctcctccccacct

SEQ ID NO: 5412033 - DNA, 21 bp, Homo sapiens
ctttctcctccccacctgtag

SEQ ID NO: 5412034 - DNA, 17 bp, Homo sapiens
ctttctcctctgctatg

SEQ ID NO: 5412035 - DNA, 19 bp, Homo sapiens
ctttctcctctgctatgca

SEQ ID NO: 5412036 - DNA, 15 bp, Homo sapiens
ctttctcctgcccca

SEQ ID NO: 5412037 - DNA, 20 bp, Homo sapiens
ctttctcctggagatagctg

SEQ ID NO: 5412038 - DNA, 21 bp, Homo sapiens
ctttctcctggagatagctgg

SEQ ID NO: 5412039 - DNA, 12 bp, Homo sapiens
ctttctcctggt

SEQ ID NO: 5412040 - DNA, 12 bp, Homo sapiens
ctttctcctgtt

SEQ ID NO: 5412041 - DNA, 21 bp, Homo sapiens
ctttctccttagtcttctcat

SEQ ID NO: 5412042 - DNA, 18 bp, Homo sapiens
ctttctcctttaattgta

SEQ ID NO: 5412043 - DNA, 20 bp, Homo sapiens
ctttctcgcgccctccccca

SEQ ID NO: 5412044 - DNA, 20 bp, Homo sapiens
ctttctcgtggtagaagcca

SEQ ID NO: 5412045 - DNA, 21 bp, Homo sapiens
ctttctcgtggtagaagccag

SEQ ID NO: 5412046 - DNA, 14 bp, Homo sapiens
ctttctctaataat

SEQ ID NO: 5412047 - DNA, 16 bp, Homo sapiens
ctttctctaataataa

SEQ ID NO: 5412048 - DNA, 17 bp, Homo sapiens
ctttctctaataataaa

SEQ ID NO: 5412049 - DNA, 18 bp, Homo sapiens
ctttctctaataataaat

SEQ ID NO: 5412050 - DNA, 19 bp, Homo sapiens
ctttctctaataataaata

SEQ ID NO: 5412051 - DNA, 22 bp, Homo sapiens
ctttctctcagccttacatttg

SEQ ID NO: 5412052 - DNA, 13 bp, Homo sapiens
ctttctctcagtg

SEQ ID NO: 5412053 - DNA, 14 bp, Homo sapiens
ctttctctcagtga

SEQ ID NO: 5412054 - DNA, 15 bp, Homo sapiens
ctttctctcagtgaa

SEQ ID NO: 5412055 - DNA, 13 bp, Homo sapiens
ctttctctcccca

SEQ ID NO: 5412056 - DNA, 18 bp, Homo sapiens
ctttctctccccaacccc

SEQ ID NO: 5412057 - DNA, 15 bp, Homo sapiens
ctttctctcctggct

SEQ ID NO: 5412058 - DNA, 14 bp, Homo sapiens
ctttctctccttgg

SEQ ID NO: 5412059 - DNA, 16 bp, Homo sapiens
ctttctctcctttctt

SEQ ID NO: 5412060 - DNA, 23 bp, Homo sapiens
ctttctctctcatgcctcctgag

SEQ ID NO: 5412061 - DNA, 14 bp, Homo sapiens
ctttctctctccac

SEQ ID NO: 5412062 - DNA, 11 bp, Homo sapiens
ctttctctctg

SEQ ID NO: 5412063 - DNA, 14 bp, Homo sapiens
ctttctctctgtgt

SEQ ID NO: 5412064 - DNA, 12 bp, Homo sapiens
ctttctctgaga

SEQ ID NO: 5412065 - DNA, 11 bp, Homo sapiens
ctttctctgcc

SEQ ID NO: 5412066 - DNA, 13 bp, Homo sapiens
ctttctctgccag

SEQ ID NO: 5412067 - DNA, 13 bp, Homo sapiens
ctttctctgcctg

SEQ ID NO: 5412068 - DNA, 14 bp, Homo sapiens
ctttctctgcctgg

SEQ ID NO: 5412069 - DNA, 20 bp, Homo sapiens
ctttctctggcttccttggc

SEQ ID NO: 5412070 - DNA, 14 bp, Homo sapiens
ctttctctgggctt

SEQ ID NO: 5412071 - DNA, 15 bp, Homo sapiens
ctttctctgggctta

SEQ ID NO: 5412072 - DNA, 17 bp, Homo sapiens
ctttctctgtagttcct

SEQ ID NO: 5412073 - DNA, 12 bp, Homo sapiens
ctttctctgtat

SEQ ID NO: 5412074 - DNA, 14 bp, Homo sapiens
ctttctctgtatat

SEQ ID NO: 5412075 - DNA, 15 bp, Homo sapiens
ctttctctgtatatt

SEQ ID NO: 5412076 - DNA, 13 bp, Homo sapiens
ctttctcttacct

SEQ ID NO: 5412077 - DNA, 15 bp, Homo sapiens
ctttctcttacctgt

SEQ ID NO: 5412078 - DNA, 22 bp, Homo sapiens
ctttctcttccccttcctgttt

SEQ ID NO: 5412079 - DNA, 21 bp, Homo sapiens
ctttctcttccctccttccct

SEQ ID NO: 5412080 - DNA, 24 bp, Homo sapiens
ctttctcttccctgaacgttttct

SEQ ID NO: 5412081 - DNA, 15 bp, Homo sapiens
ctttctcttgctgtt

SEQ ID NO: 5412082 - DNA, 18 bp, Homo sapiens
ctttctctttccctggtc

SEQ ID NO: 5412083 - DNA, 21 bp, Homo sapiens
ctttctctttccctggtccct

SEQ ID NO: 5412084 - DNA, 20 bp, Homo sapiens
ctttctctttgttcttcaat

SEQ ID NO: 5412085 - DNA, 13 bp, Homo sapiens
ctttctcttttcc

SEQ ID NO: 5412086 - DNA, 23 bp, Homo sapiens
ctttctcttttcccctttcctgt

SEQ ID NO: 5412087 - DNA, 20 bp, Homo sapiens
ctttctcttttcctctacca

SEQ ID NO: 5412088 - DNA, 17 bp, Homo sapiens
ctttctcttttctaaaa

SEQ ID NO: 5412089 - DNA, 16 bp, Homo sapiens
ctttctgaaaatttat

SEQ ID NO: 5412090 - DNA, 19 bp, Homo sapiens
ctttgatgaattcttcctc

SEQ ID NO: 5412091 - DNA, 14 bp, Homo sapiens
ctttgatgagcatt

SEQ ID NO: 5412092 - DNA, 17 bp, Homo sapiens
ctttgatgagcatttgt

SEQ ID NO: 5412093 - DNA, 22 bp, Homo sapiens
ctttgatgattgccaacagtgg

SEQ ID NO: 5412094 - DNA, 19 bp, Homo sapiens
ctttgatgcatttccacac

SEQ ID NO: 5412095 - DNA, 17 bp, Homo sapiens
ctttgatgtattttccc

SEQ ID NO: 5412096 - DNA, 11 bp, Homo sapiens
ctttgatgtca

SEQ ID NO: 5412097 - DNA, 23 bp, Homo sapiens
ctttgatgtcaaacgccttgaaa

SEQ ID NO: 5412098 - DNA, 16 bp, Homo sapiens
ctttgatgtcatgtgt

SEQ ID NO: 5412099 - DNA, 23 bp, Homo sapiens
ctttgatgtggatgaaaaaaagg

SEQ ID NO: 5412100 - DNA, 20 bp, Homo sapiens
ctttgatgtgttgttcttgg

SEQ ID NO: 5412101 - DNA, 17 bp, Homo sapiens
ctttgatgtgtttttgt

SEQ ID NO: 5412102 - DNA, 22 bp, Homo sapiens
ctttgatgtgtttttgtatgaa

SEQ ID NO: 5412103 - DNA, 20 bp, Homo sapiens
ctttgatgttaacacatttt

SEQ ID NO: 5412104 - DNA, 16 bp, Homo sapiens
ctttgattaatccaga

SEQ ID NO: 5412105 - DNA, 19 bp, Homo sapiens
ctttgattatttgcatgtt

SEQ ID NO: 5412106 - DNA, 20 bp, Homo sapiens
ctttgattatttgcatgtta

SEQ ID NO: 5412107 - DNA, 22 bp, Homo sapiens
ctttgattatttgcatgttatg

SEQ ID NO: 5412108 - DNA, 20 bp, Homo sapiens
ctttgattcacatgttttca

SEQ ID NO: 5412109 - DNA, 19 bp, Homo sapiens
ctttgattccattttaagt

SEQ ID NO: 5412110 - DNA, 16 bp, Homo sapiens
ctttgattccctctga

SEQ ID NO: 5412111 - DNA, 13 bp, Homo sapiens
ctttgattctcct

SEQ ID NO: 5412112 - DNA, 14 bp, Homo sapiens
ctttgattctcctt

SEQ ID NO: 5412113 - DNA, 16 bp, Homo sapiens
ctttgattctccttca

SEQ ID NO: 5412114 - DNA, 11 bp, Homo sapiens
ctttgattgag

SEQ ID NO: 5412115 - DNA, 14 bp, Homo sapiens
ctttgattgcacat

SEQ ID NO: 5412116 - DNA, 17 bp, Homo sapiens
ctttgatttacagtgcc

SEQ ID NO: 5412117 - DNA, 20 bp, Homo sapiens
ctttgatttccaagtaatat

SEQ ID NO: 5412118 - DNA, 13 bp, Homo sapiens
ctttgatttgtac

SEQ ID NO: 5412119 - DNA, 14 bp, Homo sapiens
ctttgatttgtacc

SEQ ID NO: 5412120 - DNA, 21 bp, Homo sapiens
ctttgatttttatccatttct

SEQ ID NO: 5412121 - DNA, 22 bp, Homo sapiens
ctttgatttttatccatttctt

SEQ ID NO: 5412122 - DNA, 22 bp, Homo sapiens
ctttgcaaaatgagactttcta

SEQ ID NO: 5412123 - DNA, 22 bp, Homo sapiens
ctttgcaaacatcaacctggca

SEQ ID NO: 5412124 - DNA, 12 bp, Homo sapiens
ctttgcaaagac

SEQ ID NO: 5412125 - DNA, 15 bp, Homo sapiens
ctttgcaaaggagct

SEQ ID NO: 5412126 - DNA, 23 bp, Homo sapiens
ctttgcaaattcaagagcctccc

SEQ ID NO: 5412127 - DNA, 21 bp, Homo sapiens
ctttgcaacaataataaatgt

SEQ ID NO: 5412128 - DNA, 18 bp, Homo sapiens
ctttgcaacagcagtgtt

SEQ ID NO: 5412129 - DNA, 23 bp, Homo sapiens
ctttgcaaccttgtactttacaa

SEQ ID NO: 5412130 - DNA, 15 bp, Homo sapiens
ctttgcaagatgctt

SEQ ID NO: 5412131 - DNA, 13 bp, Homo sapiens
ctttgcaagctta

SEQ ID NO: 5412132 - DNA, 14 bp, Homo sapiens
ctttgcaatagcag

SEQ ID NO: 5412133 - DNA, 19 bp, Homo sapiens
ctttgcaatagcagttata

SEQ ID NO: 5412134 - DNA, 15 bp, Homo sapiens
ctttgcaatccaaat

SEQ ID NO: 5412135 - DNA, 16 bp, Homo sapiens
ctttgcaattgctctt

SEQ ID NO: 5412136 - DNA, 23 bp, Homo sapiens
ctttgcaattgctcttctccacg

SEQ ID NO: 5412137 - DNA, 22 bp, Homo sapiens
ctttgcacactttggcccaggg

SEQ ID NO: 5412138 - DNA, 18 bp, Homo sapiens
ctttgcacagctctccgg

SEQ ID NO: 5412139 - DNA, 17 bp, Homo sapiens
ctttgcacaggaaagag

SEQ ID NO: 5412140 - DNA, 16 bp, Homo sapiens
ctttgcacatgtgacc

SEQ ID NO: 5412141 - DNA, 17 bp, Homo sapiens
ctttgcacatgtgacca

SEQ ID NO: 5412142 - DNA, 15 bp, Homo sapiens
ctttgcacattttga

SEQ ID NO: 5412143 - DNA, 14 bp, Homo sapiens
ctttgcaccctgta

SEQ ID NO: 5412144 - DNA, 22 bp, Homo sapiens
ctttgcaccctgtagatgttct

SEQ ID NO: 5412145 - DNA, 18 bp, Homo sapiens
ctttgcacctctgctgat

SEQ ID NO: 5412146 - DNA, 17 bp, Homo sapiens
ctttgcacgacgccctc

SEQ ID NO: 5412147 - DNA, 22 bp, Homo sapiens
ctttgcacgtgctgtttgctgt

SEQ ID NO: 5412148 - DNA, 15 bp, Homo sapiens
ctttgcactgagggc

SEQ ID NO: 5412149 - DNA, 22 bp, Homo sapiens
ctttgcactgtaatgaggaaaa

SEQ ID NO: 5412150 - DNA, 16 bp, Homo sapiens
ctttgcacttttgaaa

SEQ ID NO: 5412151 - DNA, 20 bp, Homo sapiens
ctttgcagacaggcaagcac

SEQ ID NO: 5412152 - DNA, 18 bp, Homo sapiens
ctttgcagacctgggact

SEQ ID NO: 5412153 - DNA, 21 bp, Homo sapiens
ctttgcagacctgggacttta

SEQ ID NO: 5412154 - DNA, 20 bp, Homo sapiens
ctttgcagcaaaataataaa

SEQ ID NO: 5412155 - DNA, 22 bp, Homo sapiens
ctttgcagccggcacagggtct

SEQ ID NO: 5412156 - DNA, 19 bp, Homo sapiens
ctttgcagctgcccagccc

SEQ ID NO: 5412157 - DNA, 21 bp, Homo sapiens
ctttgcagctgcccagcccct

SEQ ID NO: 5412158 - DNA, 14 bp, Homo sapiens
ctttgcagctgctg

SEQ ID NO: 5412159 - DNA, 18 bp, Homo sapiens
ctttgcagctgctgtctg

SEQ ID NO: 5412160 - DNA, 21 bp, Homo sapiens
ctttgcagctgctgtctgagt

SEQ ID NO: 5412161 - DNA, 19 bp, Homo sapiens
ctttgcagctgcttttgca

SEQ ID NO: 5412162 - DNA, 20 bp, Homo sapiens
ctttgcaggcccagcagact

SEQ ID NO: 5412163 - DNA, 20 bp, Homo sapiens
ctttgcaggcggccctcagt

SEQ ID NO: 5412164 - DNA, 21 bp, Homo sapiens
ctttgcaggcggccctcagtg

SEQ ID NO: 5412165 - DNA, 16 bp, Homo sapiens
ctttgcaggctctggg

SEQ ID NO: 5412166 - DNA, 20 bp, Homo sapiens
ctttgcaggctctgggctca

SEQ ID NO: 5412167 - DNA, 21 bp, Homo sapiens
ctttgcagggcacagatgacc

SEQ ID NO: 5412168 - DNA, 13 bp, Homo sapiens
ctttgcagggcag

SEQ ID NO: 5412169 - DNA, 14 bp, Homo sapiens
ctttgcagggcagc

SEQ ID NO: 5412170 - DNA, 17 bp, Homo sapiens
ctttgcagggcagcccc

SEQ ID NO: 5412171 - DNA, 15 bp, Homo sapiens
ctttgcagtgaagat

SEQ ID NO: 5412172 - DNA, 19 bp, Homo sapiens
ctttgcagtgtgcagggtg

SEQ ID NO: 5412173 - DNA, 21 bp, Homo sapiens
ctttgcagttcccatctcctt

SEQ ID NO: 5412174 - DNA, 22 bp, Homo sapiens
ctttgcataacgtataaaagcc

SEQ ID NO: 5412175 - DNA, 18 bp, Homo sapiens
ctttgcatatgagccgtg

SEQ ID NO: 5412176 - DNA, 16 bp, Homo sapiens
ctttgcatctcagtat

SEQ ID NO: 5412177 - DNA, 21 bp, Homo sapiens
ctttgcatggaatttgtaagt

SEQ ID NO: 5412178 - DNA, 20 bp, Homo sapiens
ctttgcatggcagggcctca

SEQ ID NO: 5412179 - DNA, 21 bp, Homo sapiens
ctttgcatggcagggcctcat

SEQ ID NO: 5412180 - DNA, 14 bp, Homo sapiens
ctttgcatgttctt

SEQ ID NO: 5412181 - DNA, 12 bp, Homo sapiens
ctttgcattcat

SEQ ID NO: 5412182 - DNA, 20 bp, Homo sapiens
ctttgcattccttacttgca

SEQ ID NO: 5412183 - DNA, 21 bp, Homo sapiens
ctttgcattccttacttgcac

SEQ ID NO: 5412184 - DNA, 16 bp, Homo sapiens
ctttgcattttgatat

SEQ ID NO: 5412185 - DNA, 14 bp, Homo sapiens
ctttgccaaaaaaa

SEQ ID NO: 5412186 - DNA, 18 bp, Homo sapiens
ctttgccaaaaaaaaaag

SEQ ID NO: 5412187 - DNA, 22 bp, Homo sapiens
ctttgccaaaataccagagcct

SEQ ID NO: 5412188 - DNA, 16 bp, Homo sapiens
ctttgccaagaccttt

SEQ ID NO: 5412189 - DNA, 16 bp, Homo sapiens
ctttgccaaggctctc

SEQ ID NO: 5412190 - DNA, 11 bp, Homo sapiens
ctttgccacaa

SEQ ID NO: 5412191 - DNA, 13 bp, Homo sapiens
ctttgccagagca

SEQ ID NO: 5412192 - DNA, 19 bp, Homo sapiens
ctttgccagagcaggagcc

SEQ ID NO: 5412193 - DNA, 16 bp, Homo sapiens
ctttgccagcagagcc

SEQ ID NO: 5412194 - DNA, 18 bp, Homo sapiens
ctttgccagcagagccag

SEQ ID NO: 5412195 - DNA, 19 bp, Homo sapiens
ctttgccagcagagccagg

SEQ ID NO: 5412196 - DNA, 20 bp, Homo sapiens
ctttgccataactttatgaa

SEQ ID NO: 5412197 - DNA, 18 bp, Homo sapiens
ctttgccatgggcctgct

SEQ ID NO: 5412198 - DNA, 19 bp, Homo sapiens
ctttgccatgggcctgctg

SEQ ID NO: 5412199 - DNA, 20 bp, Homo sapiens
ctttgccatgggcctgctgc

SEQ ID NO: 5412200 - DNA, 14 bp, Homo sapiens
ctttgccatttctt

SEQ ID NO: 5412201 - DNA, 15 bp, Homo sapiens
ctttgcccaacctca

SEQ ID NO: 5412202 - DNA, 18 bp, Homo sapiens
ctttgcccacacacactc

SEQ ID NO: 5412203 - DNA, 22 bp, Homo sapiens
ctttgcccacacacactccttc

SEQ ID NO: 5412204 - DNA, 18 bp, Homo sapiens
ctttgcccacccctcact

SEQ ID NO: 5412205 - DNA, 22 bp, Homo sapiens
ctttgcccagggtcctgtgcct

SEQ ID NO: 5412206 - DNA, 18 bp, Homo sapiens
ctttgcccagttggagac

SEQ ID NO: 5412207 - DNA, 18 bp, Homo sapiens
ctttgccccactgggaga

SEQ ID NO: 5412208 - DNA, 16 bp, Homo sapiens
ctttgccccagttaca

SEQ ID NO: 5412209 - DNA, 16 bp, Homo sapiens
ctttgcccccttgccc

SEQ ID NO: 5412210 - DNA, 17 bp, Homo sapiens
ctttgcccccttgccca

SEQ ID NO: 5412211 - DNA, 19 bp, Homo sapiens
ctttgcccccttgcccatc

SEQ ID NO: 5412212 - DNA, 20 bp, Homo sapiens
ctttgccccggcttgcctgt

SEQ ID NO: 5412213 - DNA, 14 bp, Homo sapiens
ctttgccctgaggc

SEQ ID NO: 5412214 - DNA, 18 bp, Homo sapiens
ctttgccctgctgccctc

SEQ ID NO: 5412215 - DNA, 21 bp, Homo sapiens
ctttgccctggagcagctatt

SEQ ID NO: 5412216 - DNA, 15 bp, Homo sapiens
ctttgcccttcctcc

SEQ ID NO: 5412217 - DNA, 17 bp, Homo sapiens
ctttgcccttctggttt

SEQ ID NO: 5412218 - DNA, 16 bp, Homo sapiens
ctttgccgtgagcatg

SEQ ID NO: 5412219 - DNA, 18 bp, Homo sapiens
ctttgccgtgagcatgca

SEQ ID NO: 5412220 - DNA, 20 bp, Homo sapiens
ctttgcctcaactccaggat

SEQ ID NO: 5412221 - DNA, 21 bp, Homo sapiens
ctttgcctcaactccaggatt

SEQ ID NO: 5412222 - DNA, 15 bp, Homo sapiens
ctttgcctctaccag

SEQ ID NO: 5412223 - DNA, 12 bp, Homo sapiens
ctttgcctctgt

SEQ ID NO: 5412224 - DNA, 14 bp, Homo sapiens
ctttgcctctgtcc

SEQ ID NO: 5412225 - DNA, 19 bp, Homo sapiens
ctttgcctctgtcctccca

SEQ ID NO: 5412226 - DNA, 15 bp, Homo sapiens
ctttgcctcttcagc

SEQ ID NO: 5412227 - DNA, 13 bp, Homo sapiens
ctttgcctgtgtg

SEQ ID NO: 5412228 - DNA, 16 bp, Homo sapiens
ctttgcctgttcagtt

SEQ ID NO: 5412229 - DNA, 19 bp, Homo sapiens
ctttgccttaagtttccct

SEQ ID NO: 5412230 - DNA, 12 bp, Homo sapiens
ctttgccttgca

SEQ ID NO: 5412231 - DNA, 18 bp, Homo sapiens
ctttgccttgcagccaca

SEQ ID NO: 5412232 - DNA, 13 bp, Homo sapiens
ctttgccttgggc

SEQ ID NO: 5412233 - DNA, 19 bp, Homo sapiens
ctttgccttgggctgctcc

SEQ ID NO: 5412234 - DNA, 22 bp, Homo sapiens
ctttgcctttatctctgaggct

SEQ ID NO: 5412235 - DNA, 12 bp, Homo sapiens
ctttgcctttgc

SEQ ID NO: 5412236 - DNA, 20 bp, Homo sapiens
ctttgcgctcctggcccagc

SEQ ID NO: 5412237 - DNA, 21 bp, Homo sapiens
ctttgcgctcctggcccagcc

SEQ ID NO: 5412238 - DNA, 17 bp, Homo sapiens
ctttgcggggcctgtct

SEQ ID NO: 5412239 - DNA, 21 bp, Homo sapiens
ctttgcgtcaggagcagcatc

SEQ ID NO: 5412240 - DNA, 19 bp, Homo sapiens
ctttgcgtggatcaagctt

SEQ ID NO: 5412241 - DNA, 20 bp, Homo sapiens
ctttgctacaaatttatgca

SEQ ID NO: 5412242 - DNA, 16 bp, Homo sapiens
ctttgctacaataaat

SEQ ID NO: 5412243 - DNA, 19 bp, Homo sapiens
ctttgctacaataaatgct

SEQ ID NO: 5412244 - DNA, 14 bp, Homo sapiens
ctttgctacgaaga

SEQ ID NO: 5412245 - DNA, 16 bp, Homo sapiens
ctttgctatgtaaggg

SEQ ID NO: 5412246 - DNA, 11 bp, Homo sapiens
ctttgctattc

SEQ ID NO: 5412247 - DNA, 21 bp, Homo sapiens
ctttgctcagtggatcacaca

SEQ ID NO: 5412248 - DNA, 19 bp, Homo sapiens
ctttgctcagtgtccagct

SEQ ID NO: 5412249 - DNA, 20 bp, Homo sapiens
ctttgctcagtgtccagctt

SEQ ID NO: 5412250 - DNA, 19 bp, Homo sapiens
ctttgctccaccccactca

SEQ ID NO: 5412251 - DNA, 12 bp, Homo sapiens
ctttgctccaga

SEQ ID NO: 5412252 - DNA, 23 bp, Homo sapiens
ctttgctccagacctgcccctcc

SEQ ID NO: 5412253 - DNA, 13 bp, Homo sapiens
ctttgctccagat

SEQ ID NO: 5412254 - DNA, 18 bp, Homo sapiens
ctttgctcccagtttctt

SEQ ID NO: 5412255 - DNA, 13 bp, Homo sapiens
ctttgctccgctc

SEQ ID NO: 5412256 - DNA, 18 bp, Homo sapiens
ctttgctccgctcccacc

SEQ ID NO: 5412257 - DNA, 19 bp, Homo sapiens
ctttgctccgctcccaccg

SEQ ID NO: 5412258 - DNA, 17 bp, Homo sapiens
ctttgctccttcagttc

SEQ ID NO: 5412259 - DNA, 14 bp, Homo sapiens
ctttgctctattaa

SEQ ID NO: 5412260 - DNA, 21 bp, Homo sapiens
ctttgctctcaaggcttggag

SEQ ID NO: 5412261 - DNA, 13 bp, Homo sapiens
ctttgctctggag

SEQ ID NO: 5412262 - DNA, 13 bp, Homo sapiens
ctttgctctggat

SEQ ID NO: 5412263 - DNA, 12 bp, Homo sapiens
ctttgctctggt

SEQ ID NO: 5412264 - DNA, 11 bp, Homo sapiens
ctttgctcttg

SEQ ID NO: 5412265 - DNA, 13 bp, Homo sapiens
ctttgctcttgcc

SEQ ID NO: 5412266 - DNA, 15 bp, Homo sapiens
ctttgctcttggaat

SEQ ID NO: 5412267 - DNA, 23 bp, Homo sapiens
ctttggggccgattgggagaaag

SEQ ID NO: 5412268 - DNA, 15 bp, Homo sapiens
ctttggggcttctgt

SEQ ID NO: 5412269 - DNA, 21 bp, Homo sapiens
ctttggggcttttacaccagt

SEQ ID NO: 5412270 - DNA, 22 bp, Homo sapiens
ctttgggggagtgggcgcagtg

SEQ ID NO: 5412271 - DNA, 23 bp, Homo sapiens
ctttgggggattcaaatgcatga

SEQ ID NO: 5412272 - DNA, 17 bp, Homo sapiens
ctttggggggcactaga

SEQ ID NO: 5412273 - DNA, 22 bp, Homo sapiens
ctttggggtcctagcccagtgc

SEQ ID NO: 5412274 - DNA, 22 bp, Homo sapiens
ctttggggtctacactgcaatc

SEQ ID NO: 5412275 - DNA, 17 bp, Homo sapiens
ctttggggttgcccagc

SEQ ID NO: 5412276 - DNA, 21 bp, Homo sapiens
ctttggggttggttcctagag

SEQ ID NO: 5412277 - DNA, 18 bp, Homo sapiens
ctttgggtacctattttc

SEQ ID NO: 5412278 - DNA, 22 bp, Homo sapiens
ctttgggtacctattttcattg

SEQ ID NO: 5412279 - DNA, 18 bp, Homo sapiens
ctttgggtcctgggcagg

SEQ ID NO: 5412280 - DNA, 23 bp, Homo sapiens
ctttgggtctacaagtatatgtg

SEQ ID NO: 5412281 - DNA, 20 bp, Homo sapiens
ctttgggttggagctgttcc

SEQ ID NO: 5412282 - DNA, 17 bp, Homo sapiens
ctttgggtttcttgttt

SEQ ID NO: 5412283 - DNA, 17 bp, Homo sapiens
ctttgggtttttaactc

SEQ ID NO: 5412284 - DNA, 18 bp, Homo sapiens
ctttgggtttttaactca

SEQ ID NO: 5412285 - DNA, 14 bp, Homo sapiens
ctttggtaaaacag

SEQ ID NO: 5412286 - DNA, 22 bp, Homo sapiens
ctttggtacatggccagtgtga

SEQ ID NO: 5412287 - DNA, 20 bp, Homo sapiens
ctttggtaccagataacttt

SEQ ID NO: 5412288 - DNA, 15 bp, Homo sapiens
ctttggtaggtaaat

SEQ ID NO: 5412289 - DNA, 17 bp, Homo sapiens
ctttggtccccagcatt

SEQ ID NO: 5412290 - DNA, 18 bp, Homo sapiens
ctttggtccccagcattg

SEQ ID NO: 5412291 - DNA, 16 bp, Homo sapiens
ctttggtctacactgt

SEQ ID NO: 5412292 - DNA, 14 bp, Homo sapiens
ctttggtctatttt

SEQ ID NO: 5412293 - DNA, 16 bp, Homo sapiens
ctttggtgaaagggag

SEQ ID NO: 5412294 - DNA, 16 bp, Homo sapiens
ctttggtgaactgttg

SEQ ID NO: 5412295 - DNA, 18 bp, Homo sapiens
ctttggtgcctttcctgt

SEQ ID NO: 5412296 - DNA, 20 bp, Homo sapiens
ctttggtgcctttcctgttc

SEQ ID NO: 5412297 - DNA, 15 bp, Homo sapiens
ctttggtggccaggg

SEQ ID NO: 5412298 - DNA, 20 bp, Homo sapiens
ctttggtgtacaaaatggaa

SEQ ID NO: 5412299 - DNA, 15 bp, Homo sapiens
ctttggttaaaaatg

SEQ ID NO: 5412300 - DNA, 20 bp, Homo sapiens
ctttggttaaaaatggctca

SEQ ID NO: 5412301 - DNA, 19 bp, Homo sapiens
ctttggttaagggctccct

SEQ ID NO: 5412302 - DNA, 19 bp, Homo sapiens
ctttggttaatacatcttt

SEQ ID NO: 5412303 - DNA, 16 bp, Homo sapiens
ctttggttaatctctt

SEQ ID NO: 5412304 - DNA, 14 bp, Homo sapiens
ctttggttatgaaa

SEQ ID NO: 5412305 - DNA, 17 bp, Homo sapiens
ctttggttcctcatggc

SEQ ID NO: 5412306 - DNA, 16 bp, Homo sapiens
ctttggttctctccag

SEQ ID NO: 5412307 - DNA, 19 bp, Homo sapiens
ctttggttctctccaggaa

SEQ ID NO: 5412308 - DNA, 21 bp, Homo sapiens
ctttggttctggccagaatgc

SEQ ID NO: 5412309 - DNA, 21 bp, Homo sapiens
ctttggttctgggttgtttcc

SEQ ID NO: 5412310 - DNA, 17 bp, Homo sapiens
ctttggttcttcagatg

SEQ ID NO: 5412311 - DNA, 16 bp, Homo sapiens
ctttggtttctgtctg

SEQ ID NO: 5412312 - DNA, 13 bp, Homo sapiens
ctttggtttgaca

SEQ ID NO: 5412313 - DNA, 15 bp, Homo sapiens
ctttggtttggcctc

SEQ ID NO: 5412314 - DNA, 13 bp, Homo sapiens
ctttggttttact

SEQ ID NO: 5412315 - DNA, 19 bp, Homo sapiens
ctttggttttgctgagatc

SEQ ID NO: 5412316 - DNA, 17 bp, Homo sapiens
ctttggttttggaggag

SEQ ID NO: 5412317 - DNA, 11 bp, Homo sapiens
ctttggttttt

SEQ ID NO: 5412318 - DNA, 19 bp, Homo sapiens
ctttggtttttttcttctg

SEQ ID NO: 5412319 - DNA, 21 bp, Homo sapiens
ctttgtaaaatatcgtgtgtg

SEQ ID NO: 5412320 - DNA, 14 bp, Homo sapiens
ctttgtaaaggtca

SEQ ID NO: 5412321 - DNA, 12 bp, Homo sapiens
ctttgtaaatag

SEQ ID NO: 5412322 - DNA, 14 bp, Homo sapiens
ctttgtaaattatt

SEQ ID NO: 5412323 - DNA, 15 bp, Homo sapiens
ctttgtaaattctga

SEQ ID NO: 5412324 - DNA, 13 bp, Homo sapiens
ctttgtaaattgt

SEQ ID NO: 5412325 - DNA, 15 bp, Homo sapiens
ctttgtaagaactaa

SEQ ID NO: 5412326 - DNA, 23 bp, Homo sapiens
ctttgtaagacacacagcctttc

SEQ ID NO: 5412327 - DNA, 17 bp, Homo sapiens
ctttgtaagacatttgt

SEQ ID NO: 5412328 - DNA, 19 bp, Homo sapiens
ctttgtaagagtgtagaag

SEQ ID NO: 5412329 - DNA, 21 bp, Homo sapiens
ctttgtaagagtgtagaagca

SEQ ID NO: 5412330 - DNA, 23 bp, Homo sapiens
ctttgtaagagtgtagaagcatt

SEQ ID NO: 5412331 - DNA, 20 bp, Homo sapiens
ctttgtaagatccaccccct

SEQ ID NO: 5412332 - DNA, 14 bp, Homo sapiens
ctttgtaaggactt

SEQ ID NO: 5412333 - DNA, 17 bp, Homo sapiens
ctttgtaagtgaaaaac

SEQ ID NO: 5412334 - DNA, 21 bp, Homo sapiens
ctttgtaagtgaaaaacatga

SEQ ID NO: 5412335 - DNA, 14 bp, Homo sapiens
ctttgtaataaaat

SEQ ID NO: 5412336 - DNA, 20 bp, Homo sapiens
ctttgtaatatgagaatgta

SEQ ID NO: 5412337 - DNA, 22 bp, Homo sapiens
ctttgtaatattctccccaccc

SEQ ID NO: 5412338 - DNA, 13 bp, Homo sapiens
ctttgtaatgaaa

SEQ ID NO: 5412339 - DNA, 16 bp, Homo sapiens
ctttgtaatgaaaacc

SEQ ID NO: 5412340 - DNA, 20 bp, Homo sapiens
ctttgtaatgcttgtacagt

SEQ ID NO: 5412341 - DNA, 22 bp, Homo sapiens
ctttgtaatgtcaccaccttcc

SEQ ID NO: 5412342 - DNA, 20 bp, Homo sapiens
ctttgtaattatttttaata

SEQ ID NO: 5412343 - DNA, 16 bp, Homo sapiens
ctttgtaattcagaaa

SEQ ID NO: 5412344 - DNA, 18 bp, Homo sapiens
ctttgtaatttttgggga

SEQ ID NO: 5412345 - DNA, 19 bp, Homo sapiens
ctttgtacagagtgctttt

SEQ ID NO: 5412346 - DNA, 16 bp, Homo sapiens
ctttgtacagcccaga

SEQ ID NO: 5412347 - DNA, 13 bp, Homo sapiens
ctttgtaccaaaa

SEQ ID NO: 5412348 - DNA, 19 bp, Homo sapiens
ctttgtaccttttgtagtt

SEQ ID NO: 5412349 - DNA, 22 bp, Homo sapiens
ctttgtactcctgctgtctacc

SEQ ID NO: 5412350 - DNA, 22 bp, Homo sapiens
ctttgtactgtagctaaatgta

SEQ ID NO: 5412351 - DNA, 14 bp, Homo sapiens
ctttgtacttgtgt

SEQ ID NO: 5412352 - DNA, 16 bp, Homo sapiens
ctttgtacttgtgttt

SEQ ID NO: 5412353 - DNA, 16 bp, Homo sapiens
ctttgtagaaagcaaa

SEQ ID NO: 5412354 - DNA, 18 bp, Homo sapiens
ctttgtagaataaatggt

SEQ ID NO: 5412355 - DNA, 17 bp, Homo sapiens
ctttgtagactgtttca

SEQ ID NO: 5412356 - DNA, 13 bp, Homo sapiens
ctttgtagatcct

SEQ ID NO: 5412357 - DNA, 18 bp, Homo sapiens
ctttgtagcactcaggct

SEQ ID NO: 5412358 - DNA, 22 bp, Homo sapiens
ctttgtagccatcctgttaaat

SEQ ID NO: 5412359 - DNA, 19 bp, Homo sapiens
ctttgtagctaacagtgaa

SEQ ID NO: 5412360 - DNA, 14 bp, Homo sapiens
ctttgtagttaatg

SEQ ID NO: 5412361 - DNA, 16 bp, Homo sapiens
ctttgtagttactcaa

SEQ ID NO: 5412362 - DNA, 17 bp, Homo sapiens
ctttgtatacaagtact

SEQ ID NO: 5412363 - DNA, 19 bp, Homo sapiens
ctttgtatactttaaataa

SEQ ID NO: 5412364 - DNA, 15 bp, Homo sapiens
ctttgtatagagaat

SEQ ID NO: 5412365 - DNA, 18 bp, Homo sapiens
ctttgtatagttatgtaa

SEQ ID NO: 5412366 - DNA, 21 bp, Homo sapiens
ctttgtatagttatgtaaata

SEQ ID NO: 5412367 - DNA, 13 bp, Homo sapiens
ctttgtatattac

SEQ ID NO: 5412368 - DNA, 15 bp, Homo sapiens
ctttgtatatttaca

SEQ ID NO: 5412369 - DNA, 13 bp, Homo sapiens
ctttgtatcttaa

SEQ ID NO: 5412370 - DNA, 15 bp, Homo sapiens
ctttgtatcttaaat

SEQ ID NO: 5412371 - DNA, 17 bp, Homo sapiens
ctttgtatcttaaatct

SEQ ID NO: 5412372 - DNA, 23 bp, Homo sapiens
ctttgtatcttccatatttggaa

SEQ ID NO: 5412373 - DNA, 18 bp, Homo sapiens
ctttgtatctttctttct

SEQ ID NO: 5412374 - DNA, 22 bp, Homo sapiens
ctttgtatctttctttctctaa

SEQ ID NO: 5412375 - DNA, 20 bp, Homo sapiens
ctttgtatgacagtgaagca

SEQ ID NO: 5412376 - DNA, 14 bp, Homo sapiens
ctttgtatgtggaa

SEQ ID NO: 5412377 - DNA, 22 bp, Homo sapiens
ctttgtatgtggaagtatacct

SEQ ID NO: 5412378 - DNA, 17 bp, Homo sapiens
ctttgtattaccaaagc

SEQ ID NO: 5412379 - DNA, 14 bp, Homo sapiens
ctttgtattataat

SEQ ID NO: 5412380 - DNA, 17 bp, Homo sapiens
ctttgtattctctcctg

SEQ ID NO: 5412381 - DNA, 19 bp, Homo sapiens
ctttgtattctgtcttcat

SEQ ID NO: 5412382 - DNA, 18 bp, Homo sapiens
ctttgtattcttcatgaa

SEQ ID NO: 5412383 - DNA, 20 bp, Homo sapiens
ctttgtattcttcatgaaat

SEQ ID NO: 5412384 - DNA, 20 bp, Homo sapiens
ctttgtatttttacttttaa

SEQ ID NO: 5412385 - DNA, 15 bp, Homo sapiens
ctttgtcaaatggta

SEQ ID NO: 5412386 - DNA, 15 bp, Homo sapiens
ctttgtcacttctgc

SEQ ID NO: 5412387 - DNA, 17 bp, Homo sapiens
ctttgtcacttctgctg

SEQ ID NO: 5412388 - DNA, 12 bp, Homo sapiens
ctttgtcacttg

SEQ ID NO: 5412389 - DNA, 17 bp, Homo sapiens
ctttgtcacttgccaca

SEQ ID NO: 5412390 - DNA, 23 bp, Homo sapiens
ctttgtcagtgttgcctcttgca

SEQ ID NO: 5412391 - DNA, 21 bp, Homo sapiens
ctttgtcatagttatgtgatt

SEQ ID NO: 5412392 - DNA, 10 bp, Homo sapiens
ctttgtcatt

SEQ ID NO: 5412393 - DNA, 14 bp, Homo sapiens
ctttgtcattcagt

SEQ ID NO: 5412394 - DNA, 14 bp, Homo sapiens
ctttgtcattttca

SEQ ID NO: 5412395 - DNA, 17 bp, Homo sapiens
ctttgtccaaaggaaag

SEQ ID NO: 5412396 - DNA, 11 bp, Homo sapiens
ctttgtccagg

SEQ ID NO: 5412397 - DNA, 17 bp, Homo sapiens
ctttgtcccaccaactt

SEQ ID NO: 5412398 - DNA, 20 bp, Homo sapiens
ctttgtccccacacagcctc

SEQ ID NO: 5412399 - DNA, 14 bp, Homo sapiens
ctttgtccccaccg

SEQ ID NO: 5412400 - DNA, 18 bp, Homo sapiens
ctttgtccccaccgcaga

SEQ ID NO: 5412401 - DNA, 17 bp, Homo sapiens
ctttgtcccctcacctc

SEQ ID NO: 5412402 - DNA, 14 bp, Homo sapiens
ctttgtcccctgct

SEQ ID NO: 5412403 - DNA, 20 bp, Homo sapiens
ctttgtcctaagagatttat

SEQ ID NO: 5412404 - DNA, 22 bp, Homo sapiens
ctttgtcctaagagatttatct

SEQ ID NO: 5412405 - DNA, 12 bp, Homo sapiens
ctttgtcctgcg

SEQ ID NO: 5412406 - DNA, 23 bp, Homo sapiens
ctttgtcgtggttcttaaatgtt

SEQ ID NO: 5412407 - DNA, 14 bp, Homo sapiens
ctttgtctaaacaa

SEQ ID NO: 5412408 - DNA, 19 bp, Homo sapiens
ctttgtctaagaaacattg

SEQ ID NO: 5412409 - DNA, 20 bp, Homo sapiens
ctttgtctaagaaacattgg

SEQ ID NO: 5412410 - DNA, 21 bp, Homo sapiens
ctttgtctaagaaacattgga

SEQ ID NO: 5412411 - DNA, 20 bp, Homo sapiens
ctttgtctaattaattacat

SEQ ID NO: 5412412 - DNA, 17 bp, Homo sapiens
ctttgtctccaaagaag

SEQ ID NO: 5412413 - DNA, 19 bp, Homo sapiens
ctttgtctccaaagaagat

SEQ ID NO: 5412414 - DNA, 18 bp, Homo sapiens
ctttgtctcgttcctgtt

SEQ ID NO: 5412415 - DNA, 17 bp, Homo sapiens
ctttgtctctagccggg

SEQ ID NO: 5412416 - DNA, 13 bp, Homo sapiens
ctttgtctctcct

SEQ ID NO: 5412417 - DNA, 14 bp, Homo sapiens
ctttgtctctcctg

SEQ ID NO: 5412418 - DNA, 15 bp, Homo sapiens
ctttgtctctcctgg

SEQ ID NO: 5412419 - DNA, 18 bp, Homo sapiens
ctttgtctctcctggctg

SEQ ID NO: 5412420 - DNA, 18 bp, Homo sapiens
ctttgtctgccttcccaa

SEQ ID NO: 5412421 - DNA, 14 bp, Homo sapiens
ctttgtctggcctc

SEQ ID NO: 5412422 - DNA, 17 bp, Homo sapiens
ctttgtctgtacatact

SEQ ID NO: 5412423 - DNA, 21 bp, Homo sapiens
ctttgtctgtacatactggcc

SEQ ID NO: 5412424 - DNA, 14 bp, Homo sapiens
ctttgtctgtccag

SEQ ID NO: 5412425 - DNA, 14 bp, Homo sapiens
ctttgtcttaatcg

SEQ ID NO: 5412426 - DNA, 13 bp, Homo sapiens
ctttgtcttgaaa

SEQ ID NO: 5412427 - DNA, 14 bp, Homo sapiens
ctttgtcttgtact

SEQ ID NO: 5412428 - DNA, 17 bp, Homo sapiens
ctttgtcttgtacttct

SEQ ID NO: 5412429 - DNA, 18 bp, Homo sapiens
ctttgtcttgtacttctg

SEQ ID NO: 5412430 - DNA, 20 bp, Homo sapiens
ctttgtcttgtacttctgtg

SEQ ID NO: 5412431 - DNA, 13 bp, Homo sapiens
ctttgtctttcaa

SEQ ID NO: 5412432 - DNA, 14 bp, Homo sapiens
ctttgtctttcaaa

SEQ ID NO: 5412433 - DNA, 16 bp, Homo sapiens
ctttgtctttcaaact

SEQ ID NO: 5412434 - DNA, 21 bp, Homo sapiens
ctttgtctttctctcccttct

SEQ ID NO: 5412435 - DNA, 19 bp, Homo sapiens
ctttgtctttctgcagaaa

SEQ ID NO: 5412436 - DNA, 22 bp, Homo sapiens
ctttgtctttctgcagaaaatt

SEQ ID NO: 5412437 - DNA, 14 bp, Homo sapiens
ctttgtctttcttt

SEQ ID NO: 5412438 - DNA, 11 bp, Homo sapiens
ctttgtctttt

SEQ ID NO: 5412439 - DNA, 16 bp, Homo sapiens
ctttgtctttttccta

SEQ ID NO: 5412440 - DNA, 18 bp, Homo sapiens
ctttgtctttttcctact

SEQ ID NO: 5412441 - DNA, 16 bp, Homo sapiens
ctttgtgaacattctg

SEQ ID NO: 5412442 - DNA, 17 bp, Homo sapiens
ctttgtgaacattctgt

SEQ ID NO: 5412443 - DNA, 13 bp, Homo sapiens
ctttgtgaatatt

SEQ ID NO: 5412444 - DNA, 13 bp, Homo sapiens
ctttgtgaatctg

SEQ ID NO: 5412445 - DNA, 12 bp, Homo sapiens
cttttccttttg

SEQ ID NO: 5412446 - DNA, 15 bp, Homo sapiens
cttttccttttgcac

SEQ ID NO: 5412447 - DNA, 23 bp, Homo sapiens
cttttcgagcatgcggagccagc

SEQ ID NO: 5412448 - DNA, 17 bp, Homo sapiens
cttttcgccccctgcct

SEQ ID NO: 5412449 - DNA, 19 bp, Homo sapiens
cttttcgccccctgcctgc

SEQ ID NO: 5412450 - DNA, 23 bp, Homo sapiens
cttttcgccccctgcctgccata

SEQ ID NO: 5412451 - DNA, 21 bp, Homo sapiens
cttttcgcttgcttctgcagc

SEQ ID NO: 5412452 - DNA, 15 bp, Homo sapiens
cttttcgtttagaat

SEQ ID NO: 5412453 - DNA, 21 bp, Homo sapiens
cttttcgtttagaatcagaat

SEQ ID NO: 5412454 - DNA, 19 bp, Homo sapiens
cttttctaaaatctaaaat

SEQ ID NO: 5412455 - DNA, 22 bp, Homo sapiens
cttttctaaactaggctccttc

SEQ ID NO: 5412456 - DNA, 20 bp, Homo sapiens
cttttctaacagaaagcatg

SEQ ID NO: 5412457 - DNA, 20 bp, Homo sapiens
cttttctaaccaagaggctg

SEQ ID NO: 5412458 - DNA, 21 bp, Homo sapiens
cttttctaaccaagaggctgg

SEQ ID NO: 5412459 - DNA, 22 bp, Homo sapiens
cttttctaaccaagaggctggt

SEQ ID NO: 5412460 - DNA, 19 bp, Homo sapiens
cttttctaagaaaagcatt

SEQ ID NO: 5412461 - DNA, 20 bp, Homo sapiens
cttttctaagtggcgtgtgc

SEQ ID NO: 5412462 - DNA, 21 bp, Homo sapiens
cttttctaatcacagtgttgc

SEQ ID NO: 5412463 - DNA, 13 bp, Homo sapiens
cttttctaattaa

SEQ ID NO: 5412464 - DNA, 15 bp, Homo sapiens
cttttctaattaata

SEQ ID NO: 5412465 - DNA, 21 bp, Homo sapiens
cttttctacacactcagccac

SEQ ID NO: 5412466 - DNA, 13 bp, Homo sapiens
cttttctacagca

SEQ ID NO: 5412467 - DNA, 17 bp, Homo sapiens
cttttctaccctagcca

SEQ ID NO: 5412468 - DNA, 18 bp, Homo sapiens
cttttctaccctagccat

SEQ ID NO: 5412469 - DNA, 22 bp, Homo sapiens
cttttctaccctagccattcct

SEQ ID NO: 5412470 - DNA, 21 bp, Homo sapiens
cttttctataagttgtaccaa

SEQ ID NO: 5412471 - DNA, 20 bp, Homo sapiens
cttttctataatgtgcctgg

SEQ ID NO: 5412472 - DNA, 17 bp, Homo sapiens
cttttctatggagcaaa

SEQ ID NO: 5412473 - DNA, 13 bp, Homo sapiens
cttttctattaat

SEQ ID NO: 5412474 - DNA, 14 bp, Homo sapiens
cttttctattttcc

SEQ ID NO: 5412475 - DNA, 20 bp, Homo sapiens
cttttctattttccctcgct

SEQ ID NO: 5412476 - DNA, 13 bp, Homo sapiens
cttttctattttg

SEQ ID NO: 5412477 - DNA, 15 bp, Homo sapiens
cttttctcacaaaaa

SEQ ID NO: 5412478 - DNA, 17 bp, Homo sapiens
cttttctcagtgttggt

SEQ ID NO: 5412479 - DNA, 16 bp, Homo sapiens
cttttctcccacctcc

SEQ ID NO: 5412480 - DNA, 13 bp, Homo sapiens
cttttctcccaga

SEQ ID NO: 5412481 - DNA, 14 bp, Homo sapiens
cttttctcccatat

SEQ ID NO: 5412482 - DNA, 21 bp, Homo sapiens
cttttctccccacgatgatat

SEQ ID NO: 5412483 - DNA, 18 bp, Homo sapiens
cttttctcctatcttcat

SEQ ID NO: 5412484 - DNA, 14 bp, Homo sapiens
cttttctcctcttt

SEQ ID NO: 5412485 - DNA, 18 bp, Homo sapiens
cttttctcctctttgaac

SEQ ID NO: 5412486 - DNA, 15 bp, Homo sapiens
cttttctctacttta

SEQ ID NO: 5412487 - DNA, 13 bp, Homo sapiens
cttttctctccca

SEQ ID NO: 5412488 - DNA, 15 bp, Homo sapiens
cttttctcttctaca

SEQ ID NO: 5412489 - DNA, 23 bp, Homo sapiens
cttttctcttgccccaaatcaca

SEQ ID NO: 5412490 - DNA, 22 bp, Homo sapiens
cttttctctttaattttaactg

SEQ ID NO: 5412491 - DNA, 14 bp, Homo sapiens
cttttctctttctc

SEQ ID NO: 5412492 - DNA, 13 bp, Homo sapiens
cttttctctttgg

SEQ ID NO: 5412493 - DNA, 13 bp, Homo sapiens
cttttctcttttc

SEQ ID NO: 5412494 - DNA, 20 bp, Homo sapiens
cttttctcttttctttctgt

SEQ ID NO: 5412495 - DNA, 19 bp, Homo sapiens
cttttctcttttgctttct

SEQ ID NO: 5412496 - DNA, 16 bp, Homo sapiens
cttttctgaccaaaga

SEQ ID NO: 5412497 - DNA, 14 bp, Homo sapiens
cttttctgaggttt

SEQ ID NO: 5412498 - DNA, 11 bp, Homo sapiens
cttttctgatc

SEQ ID NO: 5412499 - DNA, 17 bp, Homo sapiens
cttttctgattaatata

SEQ ID NO: 5412500 - DNA, 15 bp, Homo sapiens
cttttctgcaatgtt

SEQ ID NO: 5412501 - DNA, 12 bp, Homo sapiens
cttttctgcaga

SEQ ID NO: 5412502 - DNA, 23 bp, Homo sapiens
cttttctgcatcatctgtagata

SEQ ID NO: 5412503 - DNA, 14 bp, Homo sapiens
cttttctgcatttt

SEQ ID NO: 5412504 - DNA, 20 bp, Homo sapiens
cttttctgcattttgctatt

SEQ ID NO: 5412505 - DNA, 17 bp, Homo sapiens
cttttctgccactccat

SEQ ID NO: 5412506 - DNA, 13 bp, Homo sapiens
cttttctgctgag

SEQ ID NO: 5412507 - DNA, 20 bp, Homo sapiens
cttttctgctgttgcctctc

SEQ ID NO: 5412508 - DNA, 19 bp, Homo sapiens
cttttctggggcccaggaa

SEQ ID NO: 5412509 - DNA, 17 bp, Homo sapiens
cttttctgggtatgtgc

SEQ ID NO: 5412510 - DNA, 21 bp, Homo sapiens
cttttctgggtttgaagctgc

SEQ ID NO: 5412511 - DNA, 18 bp, Homo sapiens
cttttctggtaattttgg

SEQ ID NO: 5412512 - DNA, 16 bp, Homo sapiens
cttttctggtccctct

SEQ ID NO: 5412513 - DNA, 19 bp, Homo sapiens
cttttctggtccctcttct

SEQ ID NO: 5412514 - DNA, 20 bp, Homo sapiens
cttttctggtgattctccag

SEQ ID NO: 5412515 - DNA, 18 bp, Homo sapiens
cttttctgtcaccaaatt

SEQ ID NO: 5412516 - DNA, 21 bp, Homo sapiens
cttttctgtcaccaaatttgt

SEQ ID NO: 5412517 - DNA, 23 bp, Homo sapiens
cttttctgtccgagctttgaaaa

SEQ ID NO: 5412518 - DNA, 17 bp, Homo sapiens
cttttctgtcctgggca

SEQ ID NO: 5412519 - DNA, 18 bp, Homo sapiens
cttttctgtctctgcctc

SEQ ID NO: 5412520 - DNA, 21 bp, Homo sapiens
cttttctgtctctgcctccct

SEQ ID NO: 5412521 - DNA, 22 bp, Homo sapiens
cttttctgtgaagccctttgcc

SEQ ID NO: 5412522 - DNA, 13 bp, Homo sapiens
cttttctgtgatt

SEQ ID NO: 5412523 - DNA, 13 bp, Homo sapiens
cttttctgtgttt

SEQ ID NO: 5412524 - DNA, 18 bp, Homo sapiens
cttttctgtgtttacaga

SEQ ID NO: 5412525 - DNA, 22 bp, Homo sapiens
cttttctgtgtttacagagatg

SEQ ID NO: 5412526 - DNA, 17 bp, Homo sapiens
cttttctgttctagttt

SEQ ID NO: 5412527 - DNA, 20 bp, Homo sapiens
cttttctgtttgaaaaacct

SEQ ID NO: 5412528 - DNA, 13 bp, Homo sapiens
cttttcttaacaa

SEQ ID NO: 5412529 - DNA, 18 bp, Homo sapiens
cttttcttaacaacctgg

SEQ ID NO: 5412530 - DNA, 18 bp, Homo sapiens
cttttcttactcctcctc

SEQ ID NO: 5412531 - DNA, 17 bp, Homo sapiens
cttttcttatttttgta

SEQ ID NO: 5412532 - DNA, 13 bp, Homo sapiens
cttttcttcattt

SEQ ID NO: 5412533 - DNA, 16 bp, Homo sapiens
cttttcttcattttgg

SEQ ID NO: 5412534 - DNA, 19 bp, Homo sapiens
cttttcttccccttcctct

SEQ ID NO: 5412535 - DNA, 22 bp, Homo sapiens
cttttcttccccttcctctctc

SEQ ID NO: 5412536 - DNA, 15 bp, Homo sapiens
cttttcttcctggct

SEQ ID NO: 5412537 - DNA, 23 bp, Homo sapiens
cttttcttctattgcctctgaga

SEQ ID NO: 5412538 - DNA, 21 bp, Homo sapiens
cttttcttgactattggagga

SEQ ID NO: 5412539 - DNA, 23 bp, Homo sapiens
cttttcttgcatgaggctagtgt

SEQ ID NO: 5412540 - DNA, 15 bp, Homo sapiens
cttttcttgccagct

SEQ ID NO: 5412541 - DNA, 17 bp, Homo sapiens
cttttcttgccagctca

SEQ ID NO: 5412542 - DNA, 11 bp, Homo sapiens
cttttcttgga

SEQ ID NO: 5412543 - DNA, 13 bp, Homo sapiens
cttttcttggaca

SEQ ID NO: 5412544 - DNA, 14 bp, Homo sapiens
cttttcttggacac

SEQ ID NO: 5412545 - DNA, 12 bp, Homo sapiens
cttttcttggca

SEQ ID NO: 5412546 - DNA, 20 bp, Homo sapiens
cttttcttggcgttcctgcc

SEQ ID NO: 5412547 - DNA, 19 bp, Homo sapiens
cttttcttgtttatcagca

SEQ ID NO: 5412548 - DNA, 15 bp, Homo sapiens
cttttctttaacttt

SEQ ID NO: 5412549 - DNA, 17 bp, Homo sapiens
cttttctttagagaact

SEQ ID NO: 5412550 - DNA, 20 bp, Homo sapiens
cttttctttagagaactgaa

SEQ ID NO: 5412551 - DNA, 22 bp, Homo sapiens
cttttctttagagcattgccat

SEQ ID NO: 5412552 - DNA, 17 bp, Homo sapiens
cttttctttattagctt

SEQ ID NO: 5412553 - DNA, 17 bp, Homo sapiens
cttttctttcagccaag

SEQ ID NO: 5412554 - DNA, 11 bp, Homo sapiens
cttttctttcc

SEQ ID NO: 5412555 - DNA, 14 bp, Homo sapiens
cttttctttccttt

SEQ ID NO: 5412556 - DNA, 16 bp, Homo sapiens
cttttctttctaccaa

SEQ ID NO: 5412557 - DNA, 16 bp, Homo sapiens
cttttctttgaccaga

SEQ ID NO: 5412558 - DNA, 23 bp, Homo sapiens
cttttctttgaccagatctttct

SEQ ID NO: 5412559 - DNA, 17 bp, Homo sapiens
cttttctttgccatctc

SEQ ID NO: 5412560 - DNA, 15 bp, Homo sapiens
cttttctttgttata

SEQ ID NO: 5412561 - DNA, 13 bp, Homo sapiens
cttttcttttctt

SEQ ID NO: 5412562 - DNA, 21 bp, Homo sapiens
cttttcttttgctttcctttc

SEQ ID NO: 5412563 - DNA, 22 bp, Homo sapiens
cttttcttttgttactgttctt

SEQ ID NO: 5412564 - DNA, 14 bp, Homo sapiens
cttttctttttaca

SEQ ID NO: 5412565 - DNA, 15 bp, Homo sapiens
cttttctttttacat

SEQ ID NO: 5412566 - DNA, 23 bp, Homo sapiens
cttttctttttacataactgcct

SEQ ID NO: 5412567 - DNA, 14 bp, Homo sapiens
cttttctttttctc

SEQ ID NO: 5412568 - DNA, 18 bp, Homo sapiens
cttttcttttttaaagta

SEQ ID NO: 5412569 - DNA, 23 bp, Homo sapiens
cttttgaaaaaaaagtttttaat

SEQ ID NO: 5412570 - DNA, 19 bp, Homo sapiens
cttttgaaaagaccaagac

SEQ ID NO: 5412571 - DNA, 14 bp, Homo sapiens
cttttgaaaagctt

SEQ ID NO: 5412572 - DNA, 20 bp, Homo sapiens
cttttgaaacagattccatt

SEQ ID NO: 5412573 - DNA, 17 bp, Homo sapiens
cttttgaaagatgtatg

SEQ ID NO: 5412574 - DNA, 18 bp, Homo sapiens
cttttgaaagatgtatgg

SEQ ID NO: 5412575 - DNA, 18 bp, Homo sapiens
cttttgaaagtagagcta

SEQ ID NO: 5412576 - DNA, 14 bp, Homo sapiens
cttttgaaatctgt

SEQ ID NO: 5412577 - DNA, 14 bp, Homo sapiens
cttttgaacccagg

SEQ ID NO: 5412578 - DNA, 20 bp, Homo sapiens
cttttgaacccaggagttca

SEQ ID NO: 5412579 - DNA, 21 bp, Homo sapiens
cttttgaacgtatgtgctctt

SEQ ID NO: 5412580 - DNA, 20 bp, Homo sapiens
cttttgaactcacgagcctt

SEQ ID NO: 5412581 - DNA, 21 bp, Homo sapiens
cttttgaactgttagatgctg

SEQ ID NO: 5412582 - DNA, 22 bp, Homo sapiens
cttttgaactgttagatgctga

SEQ ID NO: 5412583 - DNA, 11 bp, Homo sapiens
cttttgaagaa

SEQ ID NO: 5412584 - DNA, 17 bp, Homo sapiens
cttttgaagtcttccct

SEQ ID NO: 5412585 - DNA, 20 bp, Homo sapiens
cttttgaagtcttccctcag

SEQ ID NO: 5412586 - DNA, 22 bp, Homo sapiens
cttttgaagtcttccctcagat

SEQ ID NO: 5412587 - DNA, 20 bp, Homo sapiens
cttttgaatacatttgtatt

SEQ ID NO: 5412588 - DNA, 19 bp, Homo sapiens
cttttgaatccatgcttgg

SEQ ID NO: 5412589 - DNA, 20 bp, Homo sapiens
cttttgaatccatgcttggg

SEQ ID NO: 5412590 - DNA, 23 bp, Homo sapiens
cttttgaatccatgcttgggtgt

SEQ ID NO: 5412591 - DNA, 19 bp, Homo sapiens
cttttgaatgatgccttta

SEQ ID NO: 5412592 - DNA, 13 bp, Homo sapiens
cttttgaattaaa

SEQ ID NO: 5412593 - DNA, 17 bp, Homo sapiens
cttttgaattcttgata

SEQ ID NO: 5412594 - DNA, 14 bp, Homo sapiens
cttttgaattgttt

SEQ ID NO: 5412595 - DNA, 17 bp, Homo sapiens
cttttgacaaaggcaag

SEQ ID NO: 5412596 - DNA, 22 bp, Homo sapiens
cttttgacaatcaaagaaaaga

SEQ ID NO: 5412597 - DNA, 18 bp, Homo sapiens
cttttgacactgctctaa

SEQ ID NO: 5412598 - DNA, 23 bp, Homo sapiens
cttttgacacttttaaaaaacaa

SEQ ID NO: 5412599 - DNA, 13 bp, Homo sapiens
cttttgacatgtg

SEQ ID NO: 5412600 - DNA, 14 bp, Homo sapiens
cttttgacatgtgg

SEQ ID NO: 5412601 - DNA, 11 bp, Homo sapiens
cttttgacatt

SEQ ID NO: 5412602 - DNA, 18 bp, Homo sapiens
cttttgaccccttcctgt

SEQ ID NO: 5412603 - DNA, 15 bp, Homo sapiens
cttttgacggccttc

SEQ ID NO: 5412604 - DNA, 16 bp, Homo sapiens
cttttgacggccttct

SEQ ID NO: 5412605 - DNA, 19 bp, Homo sapiens
cttttgactccttttggaa

SEQ ID NO: 5412606 - DNA, 18 bp, Homo sapiens
cttttgacttaaagcaga

SEQ ID NO: 5412607 - DNA, 18 bp, Homo sapiens
cttttgactttcattgga

SEQ ID NO: 5412608 - DNA, 20 bp, Homo sapiens
cttttgagactttttggtgg

SEQ ID NO: 5412609 - DNA, 14 bp, Homo sapiens
cttttgagaggggt

SEQ ID NO: 5412610 - DNA, 15 bp, Homo sapiens
cttttgagcagtaaa

SEQ ID NO: 5412611 - DNA, 13 bp, Homo sapiens
cttttgagcctca

SEQ ID NO: 5412612 - DNA, 14 bp, Homo sapiens
cttttgagcctcag

SEQ ID NO: 5412613 - DNA, 23 bp, Homo sapiens
cttttgagcctcagaccccaggt

SEQ ID NO: 5412614 - DNA, 15 bp, Homo sapiens
cttttgaggagctgg

SEQ ID NO: 5412615 - DNA, 16 bp, Homo sapiens
cttttgaggcatgcac

SEQ ID NO: 5412616 - DNA, 17 bp, Homo sapiens
cttttgaggctctctca

SEQ ID NO: 5412617 - DNA, 20 bp, Homo sapiens
cttttgagggctaaaaaggt

SEQ ID NO: 5412618 - DNA, 17 bp, Homo sapiens
cttttgagtatggctat

SEQ ID NO: 5412619 - DNA, 19 bp, Homo sapiens
cttttgagtgggccctgcc

SEQ ID NO: 5412620 - DNA, 16 bp, Homo sapiens
cttttgataaaatgtt

SEQ ID NO: 5412621 - DNA, 17 bp, Homo sapiens
cttttgataaaatgttc

SEQ ID NO: 5412622 - DNA, 17 bp, Homo sapiens
ctttttgtttgtttgtt

SEQ ID NO: 5412623 - DNA, 21 bp, Homo sapiens
ctttttgtttgtttgttttgg

SEQ ID NO: 5412624 - DNA, 23 bp, Homo sapiens
ctttttgtttgtttgttttggat

SEQ ID NO: 5412625 - DNA, 17 bp, Homo sapiens
ctttttgttttgttctt

SEQ ID NO: 5412626 - DNA, 18 bp, Homo sapiens
cttttttaaaaacaaaca

SEQ ID NO: 5412627 - DNA, 14 bp, Homo sapiens
cttttttaaaataa

SEQ ID NO: 5412628 - DNA, 22 bp, Homo sapiens
cttttttaaaattgtgttctta

SEQ ID NO: 5412629 - DNA, 13 bp, Homo sapiens
cttttttaaagta

SEQ ID NO: 5412630 - DNA, 14 bp, Homo sapiens
cttttttaaataaa

SEQ ID NO: 5412631 - DNA, 17 bp, Homo sapiens
cttttttaaataaactt

SEQ ID NO: 5412632 - DNA, 15 bp, Homo sapiens
cttttttaaataaat

SEQ ID NO: 5412633 - DNA, 22 bp, Homo sapiens
cttttttaaatattttctattt

SEQ ID NO: 5412634 - DNA, 15 bp, Homo sapiens
cttttttaaattttc

SEQ ID NO: 5412635 - DNA, 21 bp, Homo sapiens
cttttttaacatgtgttaaac

SEQ ID NO: 5412636 - DNA, 21 bp, Homo sapiens
cttttttaaggctctgtgcct

SEQ ID NO: 5412637 - DNA, 16 bp, Homo sapiens
cttttttaataaacta

SEQ ID NO: 5412638 - DNA, 15 bp, Homo sapiens
cttttttacacaaat

SEQ ID NO: 5412639 - DNA, 19 bp, Homo sapiens
cttttttacacacctacta

SEQ ID NO: 5412640 - DNA, 13 bp, Homo sapiens
cttttttactcat

SEQ ID NO: 5412641 - DNA, 19 bp, Homo sapiens
cttttttactcattgaaat

SEQ ID NO: 5412642 - DNA, 23 bp, Homo sapiens
cttttttactcattgaaatgtca

SEQ ID NO: 5412643 - DNA, 16 bp, Homo sapiens
cttttttagctctctt

SEQ ID NO: 5412644 - DNA, 19 bp, Homo sapiens
cttttttatacacataatt

SEQ ID NO: 5412645 - DNA, 16 bp, Homo sapiens
cttttttatacataaa

SEQ ID NO: 5412646 - DNA, 17 bp, Homo sapiens
cttttttatacataaac

SEQ ID NO: 5412647 - DNA, 15 bp, Homo sapiens
cttttttatgaagaa

SEQ ID NO: 5412648 - DNA, 23 bp, Homo sapiens
cttttttatgtgccgtgttattg

SEQ ID NO: 5412649 - DNA, 12 bp, Homo sapiens
cttttttatgtt

SEQ ID NO: 5412650 - DNA, 20 bp, Homo sapiens
cttttttattaatcactgtg

SEQ ID NO: 5412651 - DNA, 15 bp, Homo sapiens
cttttttattttaag

SEQ ID NO: 5412652 - DNA, 12 bp, Homo sapiens
cttttttcaaat

SEQ ID NO: 5412653 - DNA, 13 bp, Homo sapiens
cttttttcaaata

SEQ ID NO: 5412654 - DNA, 20 bp, Homo sapiens
cttttttcaaatattgaatg

SEQ ID NO: 5412655 - DNA, 16 bp, Homo sapiens
cttttttcaatatgca

SEQ ID NO: 5412656 - DNA, 12 bp, Homo sapiens
cttttttcaatg

SEQ ID NO: 5412657 - DNA, 14 bp, Homo sapiens
cttttttcaatgta

SEQ ID NO: 5412658 - DNA, 15 bp, Homo sapiens
cttttttcaatgtac

SEQ ID NO: 5412659 - DNA, 19 bp, Homo sapiens
cttttttcaatgtactgta

SEQ ID NO: 5412660 - DNA, 22 bp, Homo sapiens
cttttttcatggacactttgaa

SEQ ID NO: 5412661 - DNA, 22 bp, Homo sapiens
cttttttcccagcccaaattct

SEQ ID NO: 5412662 - DNA, 15 bp, Homo sapiens
cttttttccccagac

SEQ ID NO: 5412663 - DNA, 12 bp, Homo sapiens
cttttttcccct

SEQ ID NO: 5412664 - DNA, 18 bp, Homo sapiens
cttttttcctagtttttc

SEQ ID NO: 5412665 - DNA, 13 bp, Homo sapiens
cttttttcctcct

SEQ ID NO: 5412666 - DNA, 16 bp, Homo sapiens
cttttttcctcctttc

SEQ ID NO: 5412667 - DNA, 12 bp, Homo sapiens
cttttttcctgt

SEQ ID NO: 5412668 - DNA, 19 bp, Homo sapiens
cttttttcctgtcaatata

SEQ ID NO: 5412669 - DNA, 18 bp, Homo sapiens
cttttttcctttccacct

SEQ ID NO: 5412670 - DNA, 17 bp, Homo sapiens
cttttttcggctaaaaa

SEQ ID NO: 5412671 - DNA, 21 bp, Homo sapiens
cttttttctaaacctgtgcct

SEQ ID NO: 5412672 - DNA, 13 bp, Homo sapiens
cttttttctattt

SEQ ID NO: 5412673 - DNA, 18 bp, Homo sapiens
cttttttctcagtcctaa

SEQ ID NO: 5412674 - DNA, 15 bp, Homo sapiens
cttttttctgggtct

SEQ ID NO: 5412675 - DNA, 23 bp, Homo sapiens
cttttttcttaaagcaaagtcac

SEQ ID NO: 5412676 - DNA, 21 bp, Homo sapiens
cttttttcttccccctccatg

SEQ ID NO: 5412677 - DNA, 15 bp, Homo sapiens
cttttttcttgagta

SEQ ID NO: 5412678 - DNA, 16 bp, Homo sapiens
cttttttctttttcct

SEQ ID NO: 5412679 - DNA, 20 bp, Homo sapiens
cttttttgaaataataaatc

SEQ ID NO: 5412680 - DNA, 15 bp, Homo sapiens
cttttttgaaatcag

SEQ ID NO: 5412681 - DNA, 15 bp, Homo sapiens
cttttttgagatttt

SEQ ID NO: 5412682 - DNA, 16 bp, Homo sapiens
cttttttgagtgtgca

SEQ ID NO: 5412683 - DNA, 20 bp, Homo sapiens
cttttttgatatgataataa

SEQ ID NO: 5412684 - DNA, 20 bp, Homo sapiens
cttttttggaaactgttggt

SEQ ID NO: 5412685 - DNA, 14 bp, Homo sapiens
cttttttggctgct

SEQ ID NO: 5412686 - DNA, 20 bp, Homo sapiens
cttttttggctgctgaaggc

SEQ ID NO: 5412687 - DNA, 22 bp, Homo sapiens
cttttttggctgctgaaggctc

SEQ ID NO: 5412688 - DNA, 22 bp, Homo sapiens
cttttttggggggagaaacctc

SEQ ID NO: 5412689 - DNA, 17 bp, Homo sapiens
cttttttgtacagtatt

SEQ ID NO: 5412690 - DNA, 21 bp, Homo sapiens
cttttttgtacataaataaga

SEQ ID NO: 5412691 - DNA, 11 bp, Homo sapiens
cttttttgtct

SEQ ID NO: 5412692 - DNA, 15 bp, Homo sapiens
cttttttgtgtatgt

SEQ ID NO: 5412693 - DNA, 15 bp, Homo sapiens
cttttttgtttgttt

SEQ ID NO: 5412694 - DNA, 16 bp, Homo sapiens
ctttttttaaaattat

SEQ ID NO: 5412695 - DNA, 15 bp, Homo sapiens
ctttttttaaataga

SEQ ID NO: 5412696 - DNA, 19 bp, Homo sapiens
ctttttttaaattttctcc

SEQ ID NO: 5412697 - DNA, 15 bp, Homo sapiens
ctttttttaaccatt

SEQ ID NO: 5412698 - DNA, 16 bp, Homo sapiens
ctttttttaactggtg

SEQ ID NO: 5412699 - DNA, 17 bp, Homo sapiens
ctttttttaactggtga

SEQ ID NO: 5412700 - DNA, 19 bp, Homo sapiens
ctttttttaactggtgaag

SEQ ID NO: 5412701 - DNA, 11 bp, Homo sapiens
ctttttttaag

SEQ ID NO: 5412702 - DNA, 13 bp, Homo sapiens
ctttttttaagtg

SEQ ID NO: 5412703 - DNA, 19 bp, Homo sapiens
ctttttttaagtgcttaca

SEQ ID NO: 5412704 - DNA, 21 bp, Homo sapiens
ctttttttaagtgcttacatt

SEQ ID NO: 5412705 - DNA, 20 bp, Homo sapiens
ctttttttaagtgttctgtg

SEQ ID NO: 5412706 - DNA, 18 bp, Homo sapiens
ctttttttacgtaaacct

SEQ ID NO: 5412707 - DNA, 11 bp, Homo sapiens
ctttttttact

SEQ ID NO: 5412708 - DNA, 12 bp, Homo sapiens
ctttttttactt

SEQ ID NO: 5412709 - DNA, 13 bp, Homo sapiens
ctttttttattac

SEQ ID NO: 5412710 - DNA, 19 bp, Homo sapiens
ctttttttccatctttaca

SEQ ID NO: 5412711 - DNA, 18 bp, Homo sapiens
ctttttttctatattatt

SEQ ID NO: 5412712 - DNA, 19 bp, Homo sapiens
ctttttttctatattattg

SEQ ID NO: 5412713 - DNA, 14 bp, Homo sapiens
ctttttttcttaaa

SEQ ID NO: 5412714 - DNA, 16 bp, Homo sapiens
ctttttttcttgctag

SEQ ID NO: 5412715 - DNA, 22 bp, Homo sapiens
ctttttttgcctaccatttcac

SEQ ID NO: 5412716 - DNA, 13 bp, Homo sapiens
ctttttttgcttt

SEQ ID NO: 5412717 - DNA, 15 bp, Homo sapiens
ctttttttggcccag

SEQ ID NO: 5412718 - DNA, 15 bp, Homo sapiens
ctttttttggtaaat

SEQ ID NO: 5412719 - DNA, 21 bp, Homo sapiens
ctttttttggtgattcaaatg

SEQ ID NO: 5412720 - DNA, 21 bp, Homo sapiens
ctttttttgtgtgtatttgct

SEQ ID NO: 5412721 - DNA, 16 bp, Homo sapiens
cttttttttaaaaaaa

SEQ ID NO: 5412722 - DNA, 22 bp, Homo sapiens
cttttttttaataaggaaaaaa

SEQ ID NO: 5412723 - DNA, 22 bp, Homo sapiens
cttttttttacggaattccaat

SEQ ID NO: 5412724 - DNA, 22 bp, Homo sapiens
cttttttttatggcgtttttct

SEQ ID NO: 5412725 - DNA, 12 bp, Homo sapiens
cttttttttccg

SEQ ID NO: 5412726 - DNA, 16 bp, Homo sapiens
cttttttttcctttga

SEQ ID NO: 5412727 - DNA, 18 bp, Homo sapiens
cttttttttcctttgaac

SEQ ID NO: 5412728 - DNA, 14 bp, Homo sapiens
ctttttttttaagt

SEQ ID NO: 5412729 - DNA, 18 bp, Homo sapiens
ctttttttttaagttctt

SEQ ID NO: 5412730 - DNA, 23 bp, Homo sapiens
ctttttttttatactgcacagtg

SEQ ID NO: 5412731 - DNA, 12 bp, Homo sapiens
ctttttttttcc

SEQ ID NO: 5412732 - DNA, 15 bp, Homo sapiens
ctttttttttccaaa

SEQ ID NO: 5412733 - DNA, 16 bp, Homo sapiens
ctttttttttccaaaa

SEQ ID NO: 5412734 - DNA, 17 bp, Homo sapiens
ctttttttttctctttc

SEQ ID NO: 5412735 - DNA, 18 bp, Homo sapiens
ctttttttttctctttct

SEQ ID NO: 5412736 - DNA, 15 bp, Homo sapiens
cttttttttttcatt

SEQ ID NO: 5412737 - DNA, 16 bp, Homo sapiens
cttttttttttccaaa

SEQ ID NO: 5412738 - DNA, 20 bp, Homo sapiens
cttttttttttccaaattat

SEQ ID NO: 5412739 - DNA, 21 bp, Homo sapiens
cttttttttttccaaattatt

SEQ ID NO: 5412740 - DNA, 14 bp, Homo sapiens
cttttttttttctt

SEQ ID NO: 5412741 - DNA, 16 bp, Homo sapiens
cttttttttttcttgg

SEQ ID NO: 5412742 - DNA, 20 bp, Homo sapiens
ctttttttttttgagacagt

SEQ ID NO: 5412743 - DNA, 20 bp, Homo sapiens
cttttttttttttgagacag

SEQ ID NO: 5412744 - DNA, 21 bp, Homo sapiens
ctttttttttttttataaaag

SEQ ID NO: 5412745 - DNA, 17 bp, Homo sapiens
ctttttttttttttcct

SEQ ID NO: 5412746 - DNA, 19 bp, Homo sapiens
cttttttttttttttggta

SEQ ID NO: 5412747 - DNA, 19 bp, Homo sapiens
ctttttttttttttttgaa

SEQ ID NO: 5412748 - DNA, 22 bp, Homo sapiens
cttttttttttttttttttaaa

SEQ ID NO: 5412749 - DNA, 15 bp, Homo sapiens
gaaaaaaaaaaagaa

SEQ ID NO: 5412750 - DNA, 14 bp, Homo sapiens
gaaaaaaaaaacaa

SEQ ID NO: 5412751 - DNA, 22 bp, Homo sapiens
gaaaaaaaaaactttatttaaa

SEQ ID NO: 5412752 - DNA, 18 bp, Homo sapiens
gaaaaaaaaaagaagaag

SEQ ID NO: 5412753 - DNA, 19 bp, Homo sapiens
gaaaaaaaaaagaagaaga

SEQ ID NO: 5412754 - DNA, 20 bp, Homo sapiens
gaaaaaaaaaaggtgtttat

SEQ ID NO: 5412755 - DNA, 18 bp, Homo sapiens
gaaaaaaaaaatgcattt

SEQ ID NO: 5412756 - DNA, 17 bp, Homo sapiens
gaaaaaaaaagaaaaaa

SEQ ID NO: 5412757 - DNA, 21 bp, Homo sapiens
gaaaaaaaaagcaaatcagaa

SEQ ID NO: 5412758 - DNA, 21 bp, Homo sapiens
gaaaaaaaaagtcagactgct

SEQ ID NO: 5412759 - DNA, 22 bp, Homo sapiens
gaaaaaaaaatgccataataca

SEQ ID NO: 5412760 - DNA, 20 bp, Homo sapiens
gaaaaaaaaattatttgcct

SEQ ID NO: 5412761 - DNA, 16 bp, Homo sapiens
gaaaaaaaaccttgta

SEQ ID NO: 5412762 - DNA, 18 bp, Homo sapiens
gaaaaaaaaccttgtaaa

SEQ ID NO: 5412763 - DNA, 11 bp, Homo sapiens
gaaaaaaaaga

SEQ ID NO: 5412764 - DNA, 19 bp, Homo sapiens
gaaaaaaaagtttcagaga

SEQ ID NO: 5412765 - DNA, 13 bp, Homo sapiens
gaaaaaaaatata

SEQ ID NO: 5412766 - DNA, 16 bp, Homo sapiens
gaaaaaaaatatatat

SEQ ID NO: 5412767 - DNA, 14 bp, Homo sapiens
gaaaaaaaatgtac

SEQ ID NO: 5412768 - DNA, 13 bp, Homo sapiens
gaaaaaaaattat

SEQ ID NO: 5412769 - DNA, 13 bp, Homo sapiens
gaaaaaaaatttg

SEQ ID NO: 5412770 - DNA, 14 bp, Homo sapiens
gaaaaaaaatttgt

SEQ ID NO: 5412771 - DNA, 23 bp, Homo sapiens
gaaaaaaacaaaaacagaatttg

SEQ ID NO: 5412772 - DNA, 13 bp, Homo sapiens
gaaaaaaacagca

SEQ ID NO: 5412773 - DNA, 18 bp, Homo sapiens
gaaaaaaacataaaaagc

SEQ ID NO: 5412774 - DNA, 18 bp, Homo sapiens
gaaaaaaaccacacaaag

SEQ ID NO: 5412775 - DNA, 17 bp, Homo sapiens
gaaaaaaacgaaaacag

SEQ ID NO: 5412776 - DNA, 13 bp, Homo sapiens
gaaaaaaactaaa

SEQ ID NO: 5412777 - DNA, 17 bp, Homo sapiens
gaaaaaaactataaata

SEQ ID NO: 5412778 - DNA, 16 bp, Homo sapiens
gaaaaaaactgggata

SEQ ID NO: 5412779 - DNA, 22 bp, Homo sapiens
gaaaaaaactgggataactgat

SEQ ID NO: 5412780 - DNA, 13 bp, Homo sapiens
gaaaaaaactttt

SEQ ID NO: 5412781 - DNA, 23 bp, Homo sapiens
gaaaaaaacttttataaattaaa

SEQ ID NO: 5412782 - DNA, 12 bp, Homo sapiens
gaaaaaaagact

SEQ ID NO: 5412783 - DNA, 14 bp, Homo sapiens
gaaaaaaagcatgt

SEQ ID NO: 5412784 - DNA, 19 bp, Homo sapiens
gaaaaaaaggttaacagta

SEQ ID NO: 5412785 - DNA, 20 bp, Homo sapiens
gaaaaaaagtttgccagaag

SEQ ID NO: 5412786 - DNA, 17 bp, Homo sapiens
gaaaaaaataaataaaa

SEQ ID NO: 5412787 - DNA, 20 bp, Homo sapiens
gaaaaaaatactatttaaga

SEQ ID NO: 5412788 - DNA, 16 bp, Homo sapiens
gaaaaaaatagtttta

SEQ ID NO: 5412789 - DNA, 20 bp, Homo sapiens
gaaaaaaatagttttacatt

SEQ ID NO: 5412790 - DNA, 19 bp, Homo sapiens
gaaaaaaatataaaatttc

SEQ ID NO: 5412791 - DNA, 15 bp, Homo sapiens
gaaaaaaatatatga

SEQ ID NO: 5412792 - DNA, 15 bp, Homo sapiens
gaaaaaaatatattt

SEQ ID NO: 5412793 - DNA, 13 bp, Homo sapiens
gaaaaaaatcatc

SEQ ID NO: 5412794 - DNA, 13 bp, Homo sapiens
gaaaaaaatgact

SEQ ID NO: 5412795 - DNA, 17 bp, Homo sapiens
gaaaaaaatgagactta

SEQ ID NO: 5412796 - DNA, 21 bp, Homo sapiens
gaaaaaaatgattgttttaga

SEQ ID NO: 5412797 - DNA, 20 bp, Homo sapiens
gaaaaaaatgtacatttatt

SEQ ID NO: 5412798 - DNA, 14 bp, Homo sapiens
gaaaaaaatgtatt

SEQ ID NO: 5412799 - DNA, 15 bp, Homo sapiens
gaaaaaaattacaaa

SEQ ID NO: 5412800 - DNA, 12 bp, Homo sapiens
gaaaaaaattga

SEQ ID NO: 5412801 - DNA, 12 bp, Homo sapiens
gaaaataatcca

SEQ ID NO: 5412802 - DNA, 18 bp, Homo sapiens
gaaaataatgtaattgta

SEQ ID NO: 5412803 - DNA, 16 bp, Homo sapiens
gaaaataatgtttgat

SEQ ID NO: 5412804 - DNA, 15 bp, Homo sapiens
gaaaataattgacag

SEQ ID NO: 5412805 - DNA, 13 bp, Homo sapiens
gaaaataattgtt

SEQ ID NO: 5412806 - DNA, 19 bp, Homo sapiens
gaaaataatttctcttgta

SEQ ID NO: 5412807 - DNA, 21 bp, Homo sapiens
gaaaatacattattagaatat

SEQ ID NO: 5412808 - DNA, 13 bp, Homo sapiens
gaaaatacattgt

SEQ ID NO: 5412809 - DNA, 19 bp, Homo sapiens
gaaaatacctaattgtgga

SEQ ID NO: 5412810 - DNA, 17 bp, Homo sapiens
gaaaataccttagcttc

SEQ ID NO: 5412811 - DNA, 17 bp, Homo sapiens
gaaaatacgctcaggtg

SEQ ID NO: 5412812 - DNA, 17 bp, Homo sapiens
gaaaatagaattgacat

SEQ ID NO: 5412813 - DNA, 19 bp, Homo sapiens
gaaaatagcttttattgag

SEQ ID NO: 5412814 - DNA, 19 bp, Homo sapiens
gaaaataggaacgactcta

SEQ ID NO: 5412815 - DNA, 14 bp, Homo sapiens
gaaaataggatttg

SEQ ID NO: 5412816 - DNA, 17 bp, Homo sapiens
gaaaataggcaggaagc

SEQ ID NO: 5412817 - DNA, 13 bp, Homo sapiens
gaaaataggcttt

SEQ ID NO: 5412818 - DNA, 21 bp, Homo sapiens
gaaaatagggtccttgaaaca

SEQ ID NO: 5412819 - DNA, 19 bp, Homo sapiens
gaaaatagggtggacagaa

SEQ ID NO: 5412820 - DNA, 20 bp, Homo sapiens
gaaaatagtcctccaaaaca

SEQ ID NO: 5412821 - DNA, 16 bp, Homo sapiens
gaaaatagtgtaagaa

SEQ ID NO: 5412822 - DNA, 18 bp, Homo sapiens
gaaaatagtttaggagaa

SEQ ID NO: 5412823 - DNA, 13 bp, Homo sapiens
gaaaatagtttat

SEQ ID NO: 5412824 - DNA, 15 bp, Homo sapiens
gaaaatagtttattt

SEQ ID NO: 5412825 - DNA, 19 bp, Homo sapiens
gaaaatagtttattttaaa

SEQ ID NO: 5412826 - DNA, 20 bp, Homo sapiens
gaaaatagtttattttaaaa

SEQ ID NO: 5412827 - DNA, 21 bp, Homo sapiens
gaaaatataaaacaaataaaa

SEQ ID NO: 5412828 - DNA, 18 bp, Homo sapiens
gaaaatataaatgcatga

SEQ ID NO: 5412829 - DNA, 21 bp, Homo sapiens
gaaaatataaatgcatgattt

SEQ ID NO: 5412830 - DNA, 21 bp, Homo sapiens
gaaaatataaggactttttga

SEQ ID NO: 5412831 - DNA, 18 bp, Homo sapiens
gaaaatataagtggtgct

SEQ ID NO: 5412832 - DNA, 16 bp, Homo sapiens
gaaaatataatattta

SEQ ID NO: 5412833 - DNA, 19 bp, Homo sapiens
gaaaatataatatttactg

SEQ ID NO: 5412834 - DNA, 22 bp, Homo sapiens
gaaaatataatatttactgtta

SEQ ID NO: 5412835 - DNA, 23 bp, Homo sapiens
gaaaatatacaagtaaattctgt

SEQ ID NO: 5412836 - DNA, 12 bp, Homo sapiens
gaaaatatactg

SEQ ID NO: 5412837 - DNA, 13 bp, Homo sapiens
gaaaatatactgt

SEQ ID NO: 5412838 - DNA, 19 bp, Homo sapiens
gaaaatatactgtaaagaa

SEQ ID NO: 5412839 - DNA, 20 bp, Homo sapiens
gaaaatatactgtaaagaaa

SEQ ID NO: 5412840 - DNA, 12 bp, Homo sapiens
gaaaatatactt

SEQ ID NO: 5412841 - DNA, 22 bp, Homo sapiens
gaaaatatagacattctcacat

SEQ ID NO: 5412842 - DNA, 20 bp, Homo sapiens
gaaaatatatattatataca

SEQ ID NO: 5412843 - DNA, 16 bp, Homo sapiens
gaaaatatatgatggc

SEQ ID NO: 5412844 - DNA, 22 bp, Homo sapiens
gaaaatatatttaatacctttg

SEQ ID NO: 5412845 - DNA, 17 bp, Homo sapiens
gaaaatatcactttgta

SEQ ID NO: 5412846 - DNA, 19 bp, Homo sapiens
gaaaatatgatatatatgt

SEQ ID NO: 5412847 - DNA, 22 bp, Homo sapiens
gaaaatatgtactgtataacat

SEQ ID NO: 5412848 - DNA, 17 bp, Homo sapiens
gaaaatatgtcccagaa

SEQ ID NO: 5412849 - DNA, 21 bp, Homo sapiens
gaaaatattatctttgtaatt

SEQ ID NO: 5412850 - DNA, 13 bp, Homo sapiens
gaaaatattctaa

SEQ ID NO: 5412851 - DNA, 19 bp, Homo sapiens
gaaaatattctctatttga

SEQ ID NO: 5412852 - DNA, 20 bp, Homo sapiens
gaaaatattctctatttgaa

SEQ ID NO: 5412853 - DNA, 18 bp, Homo sapiens
gaaaatattgctgtgtct

SEQ ID NO: 5412854 - DNA, 14 bp, Homo sapiens
gaaaatatttaaag

SEQ ID NO: 5412855 - DNA, 22 bp, Homo sapiens
gaaaatatttcctgacttgagt

SEQ ID NO: 5412856 - DNA, 15 bp, Homo sapiens
gaaaatatttctatg

SEQ ID NO: 5412857 - DNA, 17 bp, Homo sapiens
gaaaatattttgatctt

SEQ ID NO: 5412858 - DNA, 20 bp, Homo sapiens
gaaaatattttgatcttcaa

SEQ ID NO: 5412859 - DNA, 17 bp, Homo sapiens
gaaaatattttgtctaa

SEQ ID NO: 5412860 - DNA, 19 bp, Homo sapiens
gaaaatattttgtctaaaa

SEQ ID NO: 5412861 - DNA, 17 bp, Homo sapiens
gaaaatatttttaaatg

SEQ ID NO: 5412862 - DNA, 18 bp, Homo sapiens
gaaaatatttttttctag

SEQ ID NO: 5412863 - DNA, 19 bp, Homo sapiens
gaaaatatttttttctagc

SEQ ID NO: 5412864 - DNA, 14 bp, Homo sapiens
gaaaatcaaataca

SEQ ID NO: 5412865 - DNA, 19 bp, Homo sapiens
gaaaatcaaatacatactt

SEQ ID NO: 5412866 - DNA, 21 bp, Homo sapiens
gaaaatcaatgaaggatttct

SEQ ID NO: 5412867 - DNA, 14 bp, Homo sapiens
gaaaatcaatgctt

SEQ ID NO: 5412868 - DNA, 11 bp, Homo sapiens
gaaaatcagca

SEQ ID NO: 5412869 - DNA, 16 bp, Homo sapiens
gaaaatcagcctgctc

SEQ ID NO: 5412870 - DNA, 20 bp, Homo sapiens
gaaaatcagcctgctccagc

SEQ ID NO: 5412871 - DNA, 11 bp, Homo sapiens
gaaaatcatat

SEQ ID NO: 5412872 - DNA, 22 bp, Homo sapiens
gaaaatcatcaagaagggctgc

SEQ ID NO: 5412873 - DNA, 23 bp, Homo sapiens
gaaaatcatcaagaagggctgca

SEQ ID NO: 5412874 - DNA, 17 bp, Homo sapiens
gaaaatccagcgtgcac

SEQ ID NO: 5412875 - DNA, 15 bp, Homo sapiens
gaaaatccaggtcat

SEQ ID NO: 5412876 - DNA, 19 bp, Homo sapiens
gaaaatcccatgagataaa

SEQ ID NO: 5412877 - DNA, 14 bp, Homo sapiens
gaaaatctaatatt

SEQ ID NO: 5412878 - DNA, 23 bp, Homo sapiens
gaaaatctaatattaaaaatatg

SEQ ID NO: 5412879 - DNA, 22 bp, Homo sapiens
gaaaatctacactccagtgaga

SEQ ID NO: 5412880 - DNA, 22 bp, Homo sapiens
gaaaatctatatttgtcttccg

SEQ ID NO: 5412881 - DNA, 23 bp, Homo sapiens
gaaaatctatatttgtcttccga

SEQ ID NO: 5412882 - DNA, 19 bp, Homo sapiens
gaaaatctgccactcaggg

SEQ ID NO: 5412883 - DNA, 19 bp, Homo sapiens
gaaaatctgtaaaaaagaa

SEQ ID NO: 5412884 - DNA, 21 bp, Homo sapiens
gaaaatctttgttgaagtttg

SEQ ID NO: 5412885 - DNA, 14 bp, Homo sapiens
gaaaatgaaaaaca

SEQ ID NO: 5412886 - DNA, 22 bp, Homo sapiens
gaaaatgaaagtgttaatttta

SEQ ID NO: 5412887 - DNA, 15 bp, Homo sapiens
gaaaatgaagaagga

SEQ ID NO: 5412888 - DNA, 18 bp, Homo sapiens
gaaaatgaatgaatacct

SEQ ID NO: 5412889 - DNA, 16 bp, Homo sapiens
gaaaatgaattttttc

SEQ ID NO: 5412890 - DNA, 15 bp, Homo sapiens
gaaaatgacatttta

SEQ ID NO: 5412891 - DNA, 15 bp, Homo sapiens
gaaaatgacttattt

SEQ ID NO: 5412892 - DNA, 16 bp, Homo sapiens
gaaaatgacttatttc

SEQ ID NO: 5412893 - DNA, 14 bp, Homo sapiens
gaaaatgactttat

SEQ ID NO: 5412894 - DNA, 20 bp, Homo sapiens
gaaaatgagccattttttga

SEQ ID NO: 5412895 - DNA, 13 bp, Homo sapiens
gaaaatgagccct

SEQ ID NO: 5412896 - DNA, 18 bp, Homo sapiens
gaaaatgagccctggctc

SEQ ID NO: 5412897 - DNA, 22 bp, Homo sapiens
gaaaatgagccctggctcccac

SEQ ID NO: 5412898 - DNA, 14 bp, Homo sapiens
gaaaatgatctgag

SEQ ID NO: 5412899 - DNA, 22 bp, Homo sapiens
gaaaatgatctgagtcccagga

SEQ ID NO: 5412900 - DNA, 18 bp, Homo sapiens
gaaaatgatgagttttta

SEQ ID NO: 5412901 - DNA, 23 bp, Homo sapiens
gaaaatgatgtgtacccaaacgt

SEQ ID NO: 5412902 - DNA, 14 bp, Homo sapiens
gaaaatgcaggaga

SEQ ID NO: 5412903 - DNA, 22 bp, Homo sapiens
gaaaatgcaggagagcttcccc

SEQ ID NO: 5412904 - DNA, 22 bp, Homo sapiens
gaaaatgcagtcctgaggagag

SEQ ID NO: 5412905 - DNA, 16 bp, Homo sapiens
gaaaatgcattttctt

SEQ ID NO: 5412906 - DNA, 13 bp, Homo sapiens
gaaaatgccacca

SEQ ID NO: 5412907 - DNA, 18 bp, Homo sapiens
gaaaatgctatcaaataa

SEQ ID NO: 5412908 - DNA, 19 bp, Homo sapiens
gaaaatgctatcaaataac

SEQ ID NO: 5412909 - DNA, 11 bp, Homo sapiens
gaaaatgctga

SEQ ID NO: 5412910 - DNA, 13 bp, Homo sapiens
gaaaatgcttatt

SEQ ID NO: 5412911 - DNA, 14 bp, Homo sapiens
gaaaatgcttctgt

SEQ ID NO: 5412912 - DNA, 16 bp, Homo sapiens
gaaaatggaaaatata

SEQ ID NO: 5412913 - DNA, 22 bp, Homo sapiens
gaaaatggaaaatatacaagta

SEQ ID NO: 5412914 - DNA, 17 bp, Homo sapiens
gaaaatggaaagaagga

SEQ ID NO: 5412915 - DNA, 11 bp, Homo sapiens
gaaaatggaat

SEQ ID NO: 5412916 - DNA, 16 bp, Homo sapiens
gaaaatggaattactc

SEQ ID NO: 5412917 - DNA, 23 bp, Homo sapiens
gaaaatggaattactccaaaaag

SEQ ID NO: 5412918 - DNA, 23 bp, Homo sapiens
gaaaatggacgtgttatgactcc

SEQ ID NO: 5412919 - DNA, 19 bp, Homo sapiens
gaaaatggatatagaaaat

SEQ ID NO: 5412920 - DNA, 20 bp, Homo sapiens
gaaaatggctaataaactgt

SEQ ID NO: 5412921 - DNA, 23 bp, Homo sapiens
gaaaatggctaataaactgtatt

SEQ ID NO: 5412922 - DNA, 17 bp, Homo sapiens
gaaaatggctgaagaaa

SEQ ID NO: 5412923 - DNA, 18 bp, Homo sapiens
gaaaatggctttaatcaa

SEQ ID NO: 5412924 - DNA, 17 bp, Homo sapiens
gaaaatgggaagcatta

SEQ ID NO: 5412925 - DNA, 17 bp, Homo sapiens
gaaaatggggcttgccc

SEQ ID NO: 5412926 - DNA, 14 bp, Homo sapiens
gaaaatggtatttt

SEQ ID NO: 5412927 - DNA, 23 bp, Homo sapiens
gaaaatggtgaagaatggactta

SEQ ID NO: 5412928 - DNA, 20 bp, Homo sapiens
gaaaatggtttattttgtat

SEQ ID NO: 5412929 - DNA, 16 bp, Homo sapiens
gaaaatgtaaaggttt

SEQ ID NO: 5412930 - DNA, 14 bp, Homo sapiens
gaaaatgtaacttt

SEQ ID NO: 5412931 - DNA, 18 bp, Homo sapiens
gaaaatgtaagctgttta

SEQ ID NO: 5412932 - DNA, 19 bp, Homo sapiens
gaaaatgtaagttatgtgt

SEQ ID NO: 5412933 - DNA, 15 bp, Homo sapiens
gaaaatgtacatgtt

SEQ ID NO: 5412934 - DNA, 19 bp, Homo sapiens
gaaaatgtatccagaggaa

SEQ ID NO: 5412935 - DNA, 18 bp, Homo sapiens
gaaaatgtatttcctgaa

SEQ ID NO: 5412936 - DNA, 16 bp, Homo sapiens
gaaaatgtcactgtta

SEQ ID NO: 5412937 - DNA, 20 bp, Homo sapiens
gaaaatgtcactgttataaa

SEQ ID NO: 5412938 - DNA, 21 bp, Homo sapiens
gaaaatgtcactgttataaat

SEQ ID NO: 5412939 - DNA, 23 bp, Homo sapiens
gaaaatgtcagaaaccagttatg

SEQ ID NO: 5412940 - DNA, 15 bp, Homo sapiens
gaaaatgtccaggaa

SEQ ID NO: 5412941 - DNA, 13 bp, Homo sapiens
gaaaatgtcctgt

SEQ ID NO: 5412942 - DNA, 20 bp, Homo sapiens
gaaaatgtgaccctccaaat

SEQ ID NO: 5412943 - DNA, 14 bp, Homo sapiens
gaaaatgtgagggg

SEQ ID NO: 5412944 - DNA, 21 bp, Homo sapiens
gaaaatgtgccatttttttca

SEQ ID NO: 5412945 - DNA, 10 bp, Homo sapiens
gaaaatgtgt

SEQ ID NO: 5412946 - DNA, 18 bp, Homo sapiens
gaaaatgtgtcagcatgc

SEQ ID NO: 5412947 - DNA, 15 bp, Homo sapiens
gaaaatgtgtgtttt

SEQ ID NO: 5412948 - DNA, 15 bp, Homo sapiens
gaaaatgttctgttt

SEQ ID NO: 5412949 - DNA, 21 bp, Homo sapiens
gaaaatgttgagaatcccaaa

SEQ ID NO: 5412950 - DNA, 16 bp, Homo sapiens
gaaaatgtttggaatt

SEQ ID NO: 5412951 - DNA, 18 bp, Homo sapiens
gaaaatgttttgtaagaa

SEQ ID NO: 5412952 - DNA, 22 bp, Homo sapiens
gaaaatgttttgtaagaaacca

SEQ ID NO: 5412953 - DNA, 17 bp, Homo sapiens
gaaaattaaaataggca

SEQ ID NO: 5412954 - DNA, 23 bp, Homo sapiens
gaaaattaaaccaatgaagaaga

SEQ ID NO: 5412955 - DNA, 13 bp, Homo sapiens
gaaaattaacact

SEQ ID NO: 5412956 - DNA, 14 bp, Homo sapiens
gaaaattaacatga

SEQ ID NO: 5412957 - DNA, 15 bp, Homo sapiens
gaaaattaagattat

SEQ ID NO: 5412958 - DNA, 16 bp, Homo sapiens
gaaaattaagattatt

SEQ ID NO: 5412959 - DNA, 17 bp, Homo sapiens
gaaaattaaggaaatgt

SEQ ID NO: 5412960 - DNA, 20 bp, Homo sapiens
gaaaattaagggccgattta

SEQ ID NO: 5412961 - DNA, 19 bp, Homo sapiens
gaaaattaattctaaactt

SEQ ID NO: 5412962 - DNA, 22 bp, Homo sapiens
gaaaattaattctaaacttaga

SEQ ID NO: 5412963 - DNA, 14 bp, Homo sapiens
gaaaattacaaaaa

SEQ ID NO: 5412964 - DNA, 15 bp, Homo sapiens
gaaaattacaacaga

SEQ ID NO: 5412965 - DNA, 23 bp, Homo sapiens
gaaaattacatgttttttcattt

SEQ ID NO: 5412966 - DNA, 18 bp, Homo sapiens
gaaaattaggatttcatg

SEQ ID NO: 5412967 - DNA, 12 bp, Homo sapiens
gaaaattagtaa

SEQ ID NO: 5412968 - DNA, 19 bp, Homo sapiens
gaaaattatgcaaaagcag

SEQ ID NO: 5412969 - DNA, 11 bp, Homo sapiens
gaaaattattt

SEQ ID NO: 5412970 - DNA, 13 bp, Homo sapiens
gaaaattatttaa

SEQ ID NO: 5412971 - DNA, 23 bp, Homo sapiens
gaaaattatttaaaccgctaaaa

SEQ ID NO: 5412972 - DNA, 17 bp, Homo sapiens
gaaaattattttaaaca

SEQ ID NO: 5412973 - DNA, 13 bp, Homo sapiens
gaaaattattttg

SEQ ID NO: 5412974 - DNA, 21 bp, Homo sapiens
gaaaattattttgttcataca

SEQ ID NO: 5412975 - DNA, 20 bp, Homo sapiens
gaaaattcaaaaagtgttta

SEQ ID NO: 5412976 - DNA, 15 bp, Homo sapiens
gaaaattcagctcct

SEQ ID NO: 5412977 - DNA, 14 bp, Homo sapiens
gaaaattcaggtct

SEQ ID NO: 5412978 - DNA, 17 bp, Homo sapiens
gaaacttatttttttct

SEQ ID NO: 5412979 - DNA, 21 bp, Homo sapiens
gaaacttatttttttctgatt

SEQ ID NO: 5412980 - DNA, 21 bp, Homo sapiens
gaaacttcagttgatcttctt

SEQ ID NO: 5412981 - DNA, 21 bp, Homo sapiens
gaaacttcctataccggagct

SEQ ID NO: 5412982 - DNA, 22 bp, Homo sapiens
gaaacttcgctgtcccccaaca

SEQ ID NO: 5412983 - DNA, 13 bp, Homo sapiens
gaaacttgaactc

SEQ ID NO: 5412984 - DNA, 14 bp, Homo sapiens
gaaacttgaactcc

SEQ ID NO: 5412985 - DNA, 17 bp, Homo sapiens
gaaacttggacatttat

SEQ ID NO: 5412986 - DNA, 23 bp, Homo sapiens
gaaacttggctggaatttctgct

SEQ ID NO: 5412987 - DNA, 15 bp, Homo sapiens
gaaacttgtaaatat

SEQ ID NO: 5412988 - DNA, 17 bp, Homo sapiens
gaaacttgtcacttgca

SEQ ID NO: 5412989 - DNA, 21 bp, Homo sapiens
gaaacttgtcacttgcatgtc

SEQ ID NO: 5412990 - DNA, 20 bp, Homo sapiens
gaaacttgttagaaatgcaa

SEQ ID NO: 5412991 - DNA, 16 bp, Homo sapiens
gaaactttatacatta

SEQ ID NO: 5412992 - DNA, 19 bp, Homo sapiens
gaaactttatacattagta

SEQ ID NO: 5412993 - DNA, 20 bp, Homo sapiens
gaaactttctataacctaaa

SEQ ID NO: 5412994 - DNA, 16 bp, Homo sapiens
gaaactttctttctca

SEQ ID NO: 5412995 - DNA, 19 bp, Homo sapiens
gaaactttgagtacagata

SEQ ID NO: 5412996 - DNA, 17 bp, Homo sapiens
gaaactttgctttgggt

SEQ ID NO: 5412997 - DNA, 18 bp, Homo sapiens
gaaactttggaagtttta

SEQ ID NO: 5412998 - DNA, 21 bp, Homo sapiens
gaaactttgggaaaacatgtt

SEQ ID NO: 5412999 - DNA, 14 bp, Homo sapiens
gaaacttttaactg

SEQ ID NO: 5413000 - DNA, 16 bp, Homo sapiens
gaaacttttgaaaaag

SEQ ID NO: 5413001 - DNA, 15 bp, Homo sapiens
gaaacttttggaagg

SEQ ID NO: 5413002 - DNA, 15 bp, Homo sapiens
gaaactttttaattg

SEQ ID NO: 5413003 - DNA, 16 bp, Homo sapiens
gaaactttttaattgt

SEQ ID NO: 5413004 - DNA, 16 bp, Homo sapiens
gaaacttttttatttt

SEQ ID NO: 5413005 - DNA, 11 bp, Homo sapiens
gaaagaaaact

SEQ ID NO: 5413006 - DNA, 22 bp, Homo sapiens
gaaagaaaaggaatgcaagaga

SEQ ID NO: 5413007 - DNA, 21 bp, Homo sapiens
gaaagaaaaggcaaaagactg

SEQ ID NO: 5413008 - DNA, 22 bp, Homo sapiens
gaaagaaaataatggagaatca

SEQ ID NO: 5413009 - DNA, 11 bp, Homo sapiens
gaaagaaaatg

SEQ ID NO: 5413010 - DNA, 15 bp, Homo sapiens
gaaagaaaattatat

SEQ ID NO: 5413011 - DNA, 20 bp, Homo sapiens
gaaagaaacgtacttaactg

SEQ ID NO: 5413012 - DNA, 9 bp, Homo sapiens
gaaagaaag

SEQ ID NO: 5413013 - DNA, 14 bp, Homo sapiens
gaaagaaagagaaa

SEQ ID NO: 5413014 - DNA, 15 bp, Homo sapiens
gaaagaaaggaaaga

SEQ ID NO: 5413015 - DNA, 17 bp, Homo sapiens
gaaagaaaggaaagaag

SEQ ID NO: 5413016 - DNA, 19 bp, Homo sapiens
gaaagaaaggaaagaagga

SEQ ID NO: 5413017 - DNA, 15 bp, Homo sapiens
gaaagaaataattgt

SEQ ID NO: 5413018 - DNA, 11 bp, Homo sapiens
gaaagaaatca

SEQ ID NO: 5413019 - DNA, 15 bp, Homo sapiens
gaaagaaatcatgtt

SEQ ID NO: 5413020 - DNA, 12 bp, Homo sapiens
gaaagaaatgta

SEQ ID NO: 5413021 - DNA, 21 bp, Homo sapiens
gaaagaaattctgaagagagt

SEQ ID NO: 5413022 - DNA, 17 bp, Homo sapiens
gaaagaaatttgaaaaa

SEQ ID NO: 5413023 - DNA, 19 bp, Homo sapiens
gaaagaacatggacttgta

SEQ ID NO: 5413024 - DNA, 23 bp, Homo sapiens
gaaagaacatggacttgtatatt

SEQ ID NO: 5413025 - DNA, 11 bp, Homo sapiens
gaaagaacatt

SEQ ID NO: 5413026 - DNA, 22 bp, Homo sapiens
gaaagaactgtcatgtaaacat

SEQ ID NO: 5413027 - DNA, 21 bp, Homo sapiens
gaaagaacttggacttctaaa

SEQ ID NO: 5413028 - DNA, 15 bp, Homo sapiens
gaaagaagaaggtgg

SEQ ID NO: 5413029 - DNA, 11 bp, Homo sapiens
gaaagaagaga

SEQ ID NO: 5413030 - DNA, 15 bp, Homo sapiens
gaaagaagagaaaag

SEQ ID NO: 5413031 - DNA, 15 bp, Homo sapiens
gaaagaagcaagaca

SEQ ID NO: 5413032 - DNA, 12 bp, Homo sapiens
gaaagaagcagt

SEQ ID NO: 5413033 - DNA, 21 bp, Homo sapiens
gaaagaagcattgaaaacaaa

SEQ ID NO: 5413034 - DNA, 13 bp, Homo sapiens
gaaagaagccata

SEQ ID NO: 5413035 - DNA, 11 bp, Homo sapiens
gaaagaaggaa

SEQ ID NO: 5413036 - DNA, 13 bp, Homo sapiens
gaaagaaggaaaa

SEQ ID NO: 5413037 - DNA, 18 bp, Homo sapiens
gaaagaaggacacttgta

SEQ ID NO: 5413038 - DNA, 21 bp, Homo sapiens
gaaagaaggagatgaatagaa

SEQ ID NO: 5413039 - DNA, 23 bp, Homo sapiens
gaaagaagggggccctgctacct

SEQ ID NO: 5413040 - DNA, 16 bp, Homo sapiens
gaaagaagtattaaaa

SEQ ID NO: 5413041 - DNA, 14 bp, Homo sapiens
gaaagaatagaaag

SEQ ID NO: 5413042 - DNA, 15 bp, Homo sapiens
gaaagaatataaagt

SEQ ID NO: 5413043 - DNA, 15 bp, Homo sapiens
gaaagaatatattta

SEQ ID NO: 5413044 - DNA, 16 bp, Homo sapiens
gaaagaatatatttat

SEQ ID NO: 5413045 - DNA, 21 bp, Homo sapiens
gaaagaatgagaaagaaaagg

SEQ ID NO: 5413046 - DNA, 14 bp, Homo sapiens
gaaagaatgtaaag

SEQ ID NO: 5413047 - DNA, 16 bp, Homo sapiens
gaaagaattagccaac

SEQ ID NO: 5413048 - DNA, 21 bp, Homo sapiens
gaaagaattatttttgtgttt

SEQ ID NO: 5413049 - DNA, 21 bp, Homo sapiens
gaaagaattctattttgctgg

SEQ ID NO: 5413050 - DNA, 20 bp, Homo sapiens
gaaagaattgatcagaatcc

SEQ ID NO: 5413051 - DNA, 13 bp, Homo sapiens
gaaagacaaactg

SEQ ID NO: 5413052 - DNA, 16 bp, Homo sapiens
gaaagacaaagaagga

SEQ ID NO: 5413053 - DNA, 19 bp, Homo sapiens
gaaagacaaagaaggaaaa

SEQ ID NO: 5413054 - DNA, 14 bp, Homo sapiens
gaaagacagagctg

SEQ ID NO: 5413055 - DNA, 14 bp, Homo sapiens
gaaagacaggaaga

SEQ ID NO: 5413056 - DNA, 12 bp, Homo sapiens
gaaagacatcaa

SEQ ID NO: 5413057 - DNA, 13 bp, Homo sapiens
gaaagacatcaat

SEQ ID NO: 5413058 - DNA, 14 bp, Homo sapiens
gaaagacatcaatg

SEQ ID NO: 5413059 - DNA, 17 bp, Homo sapiens
gaaagacatcaatgaaa

SEQ ID NO: 5413060 - DNA, 15 bp, Homo sapiens
gaaagacatctgcct

SEQ ID NO: 5413061 - DNA, 19 bp, Homo sapiens
gaaagacatttcaaatctg

SEQ ID NO: 5413062 - DNA, 22 bp, Homo sapiens
gaaagaccatgcatttaaagta

SEQ ID NO: 5413063 - DNA, 16 bp, Homo sapiens
gaaagaccatttttcc

SEQ ID NO: 5413064 - DNA, 19 bp, Homo sapiens
gaaagaccctaggtgctca

SEQ ID NO: 5413065 - DNA, 18 bp, Homo sapiens
gaaagaccctgatgcagg

SEQ ID NO: 5413066 - DNA, 21 bp, Homo sapiens
gaaagacctacattccctctc

SEQ ID NO: 5413067 - DNA, 20 bp, Homo sapiens
gaaagacgtttttgtgctgt

SEQ ID NO: 5413068 - DNA, 14 bp, Homo sapiens
gaaagactattcaa

SEQ ID NO: 5413069 - DNA, 22 bp, Homo sapiens
gaaagactattcaaacagtctc

SEQ ID NO: 5413070 - DNA, 20 bp, Homo sapiens
gaaagactgggacagcccag

SEQ ID NO: 5413071 - DNA, 17 bp, Homo sapiens
gaaagactgtacaaagt

SEQ ID NO: 5413072 - DNA, 20 bp, Homo sapiens
gaaagacttccaaagaatgt

SEQ ID NO: 5413073 - DNA, 15 bp, Homo sapiens
gaaagacttctcaaa

SEQ ID NO: 5413074 - DNA, 17 bp, Homo sapiens
gaaagactttctaaatc

SEQ ID NO: 5413075 - DNA, 11 bp, Homo sapiens
gaaagagaaaa

SEQ ID NO: 5413076 - DNA, 13 bp, Homo sapiens
gaaagagaaaaag

SEQ ID NO: 5413077 - DNA, 23 bp, Homo sapiens
gaaagagaaaatgctttctcatg

SEQ ID NO: 5413078 - DNA, 14 bp, Homo sapiens
gaaagagaaatgaa

SEQ ID NO: 5413079 - DNA, 15 bp, Homo sapiens
gaaagagaaggtggg

SEQ ID NO: 5413080 - DNA, 15 bp, Homo sapiens
gaaagagaatgaact

SEQ ID NO: 5413081 - DNA, 13 bp, Homo sapiens
gaaagagaatttg

SEQ ID NO: 5413082 - DNA, 19 bp, Homo sapiens
gaaagagacacacacacag

SEQ ID NO: 5413083 - DNA, 18 bp, Homo sapiens
gaaagagacagagtgctg

SEQ ID NO: 5413084 - DNA, 15 bp, Homo sapiens
gaaagagactgtggg

SEQ ID NO: 5413085 - DNA, 20 bp, Homo sapiens
gaaagagactgtggggaggg

SEQ ID NO: 5413086 - DNA, 23 bp, Homo sapiens
gaaagagactgtggggagggtca

SEQ ID NO: 5413087 - DNA, 13 bp, Homo sapiens
gaaagagagaacc

SEQ ID NO: 5413088 - DNA, 14 bp, Homo sapiens
gaaagagagaagcc

SEQ ID NO: 5413089 - DNA, 12 bp, Homo sapiens
gaaagagagaga

SEQ ID NO: 5413090 - DNA, 17 bp, Homo sapiens
gaaagagagagaaacaa

SEQ ID NO: 5413091 - DNA, 15 bp, Homo sapiens
gaaagagagagagag

SEQ ID NO: 5413092 - DNA, 22 bp, Homo sapiens
gaaagagagagagagagagaaa

SEQ ID NO: 5413093 - DNA, 20 bp, Homo sapiens
gaaagagagcaccacgtgat

SEQ ID NO: 5413094 - DNA, 15 bp, Homo sapiens
gaaagagaggactgg

SEQ ID NO: 5413095 - DNA, 13 bp, Homo sapiens
gaaagagagtacc

SEQ ID NO: 5413096 - DNA, 13 bp, Homo sapiens
gaaagagatttaa

SEQ ID NO: 5413097 - DNA, 21 bp, Homo sapiens
gaaagagcacttaagagaata

SEQ ID NO: 5413098 - DNA, 19 bp, Homo sapiens
gaaagagcagtcagagtcc

SEQ ID NO: 5413099 - DNA, 15 bp, Homo sapiens
gaaagaggaaaagaa

SEQ ID NO: 5413100 - DNA, 11 bp, Homo sapiens
gaaagaggaat

SEQ ID NO: 5413101 - DNA, 22 bp, Homo sapiens
gaaagaggaggacccctgcctt

SEQ ID NO: 5413102 - DNA, 14 bp, Homo sapiens
gaaagaggaggcag

SEQ ID NO: 5413103 - DNA, 19 bp, Homo sapiens
gaaagaggagtattttgtc

SEQ ID NO: 5413104 - DNA, 20 bp, Homo sapiens
gaaagaggcagcttgaaact

SEQ ID NO: 5413105 - DNA, 14 bp, Homo sapiens
gaaagaggcaggga

SEQ ID NO: 5413106 - DNA, 14 bp, Homo sapiens
gaaagaggccagac

SEQ ID NO: 5413107 - DNA, 19 bp, Homo sapiens
gaaagagggaaaaagagct

SEQ ID NO: 5413108 - DNA, 13 bp, Homo sapiens
gaaagagggacaa

SEQ ID NO: 5413109 - DNA, 11 bp, Homo sapiens
gaaagagggag

SEQ ID NO: 5413110 - DNA, 21 bp, Homo sapiens
gaaagagggagggaaatcttt

SEQ ID NO: 5413111 - DNA, 16 bp, Homo sapiens
gaaagaggggcctgat

SEQ ID NO: 5413112 - DNA, 22 bp, Homo sapiens
gaaagagggtaataaccagaca

SEQ ID NO: 5413113 - DNA, 19 bp, Homo sapiens
gaaagagggtcccagggct

SEQ ID NO: 5413114 - DNA, 20 bp, Homo sapiens
gaaagagggtcccagggctg

SEQ ID NO: 5413115 - DNA, 21 bp, Homo sapiens
gaaagagggtcccagggctgc

SEQ ID NO: 5413116 - DNA, 18 bp, Homo sapiens
gaaagaggttaggagtag

SEQ ID NO: 5413117 - DNA, 16 bp, Homo sapiens
gaaagaggttctgcac

SEQ ID NO: 5413118 - DNA, 16 bp, Homo sapiens
gaaagagtaaaaccaa

SEQ ID NO: 5413119 - DNA, 15 bp, Homo sapiens
gaaagagtctgggac

SEQ ID NO: 5413120 - DNA, 16 bp, Homo sapiens
gaaagagtctgggacc

SEQ ID NO: 5413121 - DNA, 18 bp, Homo sapiens
gaaagagtgccagtcagc

SEQ ID NO: 5413122 - DNA, 17 bp, Homo sapiens
gaaagagttaagaatgt

SEQ ID NO: 5413123 - DNA, 16 bp, Homo sapiens
gaaagataaatgatga

SEQ ID NO: 5413124 - DNA, 22 bp, Homo sapiens
gaaagataatattgtctgtctc

SEQ ID NO: 5413125 - DNA, 16 bp, Homo sapiens
gaaagatacagacatt

SEQ ID NO: 5413126 - DNA, 19 bp, Homo sapiens
gaaagatatgtatattttt

SEQ ID NO: 5413127 - DNA, 22 bp, Homo sapiens
gaaagatatgtatatttttgat

SEQ ID NO: 5413128 - DNA, 18 bp, Homo sapiens
gaaagatcccaagtcaaa

SEQ ID NO: 5413129 - DNA, 17 bp, Homo sapiens
gaaagatctctgtcaca

SEQ ID NO: 5413130 - DNA, 16 bp, Homo sapiens
gaaagatgaaactgaa

SEQ ID NO: 5413131 - DNA, 22 bp, Homo sapiens
gaaagatgaaactgaaagcaca

SEQ ID NO: 5413132 - DNA, 15 bp, Homo sapiens
gaaagatggagaggc

SEQ ID NO: 5413133 - DNA, 16 bp, Homo sapiens
gaaagatggataaact

SEQ ID NO: 5413134 - DNA, 22 bp, Homo sapiens
gaaagatggataaactgagcct

SEQ ID NO: 5413135 - DNA, 22 bp, Homo sapiens
gaaagatggggagctctggagg

SEQ ID NO: 5413136 - DNA, 19 bp, Homo sapiens
gaaagatggtaatcttttc

SEQ ID NO: 5413137 - DNA, 19 bp, Homo sapiens
gaaagatggttaaacattt

SEQ ID NO: 5413138 - DNA, 13 bp, Homo sapiens
gaaagatgtccca

SEQ ID NO: 5413139 - DNA, 14 bp, Homo sapiens
gaaagatgtcccac

SEQ ID NO: 5413140 - DNA, 21 bp, Homo sapiens
gaaagatgtcccacagggacc

SEQ ID NO: 5413141 - DNA, 23 bp, Homo sapiens
gaaagatgtcccacagggaccac

SEQ ID NO: 5413142 - DNA, 15 bp, Homo sapiens
gaaagatgtgttttt

SEQ ID NO: 5413143 - DNA, 20 bp, Homo sapiens
gaaagattatttaaatgctt

SEQ ID NO: 5413144 - DNA, 22 bp, Homo sapiens
gaaagattatttaaatgctttt

SEQ ID NO: 5413145 - DNA, 23 bp, Homo sapiens
gaaagattccacagagatgttta

SEQ ID NO: 5413146 - DNA, 19 bp, Homo sapiens
gaaagattgtaaactaaag

SEQ ID NO: 5413147 - DNA, 15 bp, Homo sapiens
gaaagattgtgtctg

SEQ ID NO: 5413148 - DNA, 17 bp, Homo sapiens
gaaagatttaaagtatt

SEQ ID NO: 5413149 - DNA, 13 bp, Homo sapiens
gaaagattttctc

SEQ ID NO: 5413150 - DNA, 18 bp, Homo sapiens
gaaagcaaaaaataaaat

SEQ ID NO: 5413151 - DNA, 16 bp, Homo sapiens
gaaagcaaaaatgcta

SEQ ID NO: 5413152 - DNA, 17 bp, Homo sapiens
gaaagcaaaaatgctaa

SEQ ID NO: 5413153 - DNA, 23 bp, Homo sapiens
gaaagcaaaaatgctaatattaa

SEQ ID NO: 5413154 - DNA, 15 bp, Homo sapiens
gaaagcaaaataaca

SEQ ID NO: 5413155 - DNA, 22 bp, Homo sapiens
gaaagcaaacaaaattgttctt

SEQ ID NO: 5413156 - DNA, 18 bp, Homo sapiens
gaaagcaaagcacagaga

SEQ ID NO: 5413157 - DNA, 22 bp, Homo sapiens
gaaataactccttcttgtagta

SEQ ID NO: 5413158 - DNA, 14 bp, Homo sapiens
gaaataagaaaaat

SEQ ID NO: 5413159 - DNA, 18 bp, Homo sapiens
gaaataagaaaaatcatg

SEQ ID NO: 5413160 - DNA, 21 bp, Homo sapiens
gaaataagaaaaatcatgttt

SEQ ID NO: 5413161 - DNA, 13 bp, Homo sapiens
gaaataataaaaa

SEQ ID NO: 5413162 - DNA, 15 bp, Homo sapiens
gaaataataaaaaat

SEQ ID NO: 5413163 - DNA, 20 bp, Homo sapiens
gaaataataaaaaatttcag

SEQ ID NO: 5413164 - DNA, 14 bp, Homo sapiens
gaaataataaaatg

SEQ ID NO: 5413165 - DNA, 18 bp, Homo sapiens
gaaataataaaatgcaaa

SEQ ID NO: 5413166 - DNA, 21 bp, Homo sapiens
gaaataataaaatgcaaatga

SEQ ID NO: 5413167 - DNA, 22 bp, Homo sapiens
gaaataataaaatgcaaatgaa

SEQ ID NO: 5413168 - DNA, 15 bp, Homo sapiens
gaaataataaattaa

SEQ ID NO: 5413169 - DNA, 17 bp, Homo sapiens
gaaataataaattaaca

SEQ ID NO: 5413170 - DNA, 16 bp, Homo sapiens
gaaataatatatttct

SEQ ID NO: 5413171 - DNA, 22 bp, Homo sapiens
gaaataattacttttgaaccat

SEQ ID NO: 5413172 - DNA, 22 bp, Homo sapiens
gaaataattgttgttctgttaa

SEQ ID NO: 5413173 - DNA, 14 bp, Homo sapiens
gaaataatttttct

SEQ ID NO: 5413174 - DNA, 19 bp, Homo sapiens
gaaatacaagatacttttt

SEQ ID NO: 5413175 - DNA, 21 bp, Homo sapiens
gaaatacaaggagggcctctg

SEQ ID NO: 5413176 - DNA, 18 bp, Homo sapiens
gaaatacacaagtaaaca

SEQ ID NO: 5413177 - DNA, 14 bp, Homo sapiens
gaaatacacttttt

SEQ ID NO: 5413178 - DNA, 18 bp, Homo sapiens
gaaatacagaagaaaata

SEQ ID NO: 5413179 - DNA, 16 bp, Homo sapiens
gaaatacagtgcttta

SEQ ID NO: 5413180 - DNA, 12 bp, Homo sapiens
gaaatacatatt

SEQ ID NO: 5413181 - DNA, 21 bp, Homo sapiens
gaaatacatatttccaagaag

SEQ ID NO: 5413182 - DNA, 22 bp, Homo sapiens
gaaatacccttcttttatgagc

SEQ ID NO: 5413183 - DNA, 16 bp, Homo sapiens
gaaatacctcatgttt

SEQ ID NO: 5413184 - DNA, 23 bp, Homo sapiens
gaaatacctcatgtttatgaaaa

SEQ ID NO: 5413185 - DNA, 21 bp, Homo sapiens
gaaatacctttgtagttactc

SEQ ID NO: 5413186 - DNA, 20 bp, Homo sapiens
gaaatacgccagaactgctt

SEQ ID NO: 5413187 - DNA, 16 bp, Homo sapiens
gaaatacgtttgtgtt

SEQ ID NO: 5413188 - DNA, 13 bp, Homo sapiens
gaaatactaaaag

SEQ ID NO: 5413189 - DNA, 16 bp, Homo sapiens
gaaatactaaaagcaa

SEQ ID NO: 5413190 - DNA, 15 bp, Homo sapiens
gaaatactaatgtaa

SEQ ID NO: 5413191 - DNA, 16 bp, Homo sapiens
gaaatactacttacca

SEQ ID NO: 5413192 - DNA, 21 bp, Homo sapiens
gaaatactacttaccatatgt

SEQ ID NO: 5413193 - DNA, 14 bp, Homo sapiens
gaaatactcatgtg

SEQ ID NO: 5413194 - DNA, 23 bp, Homo sapiens
gaaatactgagatgctgggctgt

SEQ ID NO: 5413195 - DNA, 15 bp, Homo sapiens
gaaatactgtttgag

SEQ ID NO: 5413196 - DNA, 20 bp, Homo sapiens
gaaatactttttaacaaaaa

SEQ ID NO: 5413197 - DNA, 20 bp, Homo sapiens
gaaatagaaaaaccctgccc

SEQ ID NO: 5413198 - DNA, 19 bp, Homo sapiens
gaaatagaataggcaaact

SEQ ID NO: 5413199 - DNA, 18 bp, Homo sapiens
gaaatagaatgaaaagtt

SEQ ID NO: 5413200 - DNA, 16 bp, Homo sapiens
gaaatagaattataac

SEQ ID NO: 5413201 - DNA, 13 bp, Homo sapiens
gaaatagacaaaa

SEQ ID NO: 5413202 - DNA, 19 bp, Homo sapiens
gaaatagacagtatattta

SEQ ID NO: 5413203 - DNA, 14 bp, Homo sapiens
gaaatagactttgt

SEQ ID NO: 5413204 - DNA, 16 bp, Homo sapiens
gaaatagagtgaatta

SEQ ID NO: 5413205 - DNA, 22 bp, Homo sapiens
gaaatagatatcctctccccct

SEQ ID NO: 5413206 - DNA, 19 bp, Homo sapiens
gaaatagccaaaaaggcaa

SEQ ID NO: 5413207 - DNA, 21 bp, Homo sapiens
gaaatagccgaactccaggct

SEQ ID NO: 5413208 - DNA, 16 bp, Homo sapiens
gaaatagcggccctgg

SEQ ID NO: 5413209 - DNA, 16 bp, Homo sapiens
gaaatagctacagctg

SEQ ID NO: 5413210 - DNA, 15 bp, Homo sapiens
gaaatagcttatgaa

SEQ ID NO: 5413211 - DNA, 22 bp, Homo sapiens
gaaatagcttcaggatactgta

SEQ ID NO: 5413212 - DNA, 14 bp, Homo sapiens
gaaataggaaacaa

SEQ ID NO: 5413213 - DNA, 18 bp, Homo sapiens
gaaataggaaacaagtga

SEQ ID NO: 5413214 - DNA, 15 bp, Homo sapiens
gaaataggaagatta

SEQ ID NO: 5413215 - DNA, 15 bp, Homo sapiens
gaaataggttagagt

SEQ ID NO: 5413216 - DNA, 16 bp, Homo sapiens
gaaatagtatacattg

SEQ ID NO: 5413217 - DNA, 17 bp, Homo sapiens
gaaatagtctgatttta

SEQ ID NO: 5413218 - DNA, 19 bp, Homo sapiens
gaaatagtctgattttaat

SEQ ID NO: 5413219 - DNA, 21 bp, Homo sapiens
gaaatagtgttctttttaaaa

SEQ ID NO: 5413220 - DNA, 18 bp, Homo sapiens
gaaatagttgtctgtgct

SEQ ID NO: 5413221 - DNA, 15 bp, Homo sapiens
gaaatataaactgtg

SEQ ID NO: 5413222 - DNA, 18 bp, Homo sapiens
gaaatataaattatctga

SEQ ID NO: 5413223 - DNA, 17 bp, Homo sapiens
gaaatataacacatttt

SEQ ID NO: 5413224 - DNA, 15 bp, Homo sapiens
gaaatatacacacag

SEQ ID NO: 5413225 - DNA, 17 bp, Homo sapiens
gaaatatacacacagca

SEQ ID NO: 5413226 - DNA, 14 bp, Homo sapiens
gaaatatacagttt

SEQ ID NO: 5413227 - DNA, 17 bp, Homo sapiens
gaaatatacagtttgac

SEQ ID NO: 5413228 - DNA, 23 bp, Homo sapiens
gaaatatacttttacaagtaaca

SEQ ID NO: 5413229 - DNA, 21 bp, Homo sapiens
gaaatataggatagacactgg

SEQ ID NO: 5413230 - DNA, 19 bp, Homo sapiens
gaaatatagttgaaagtaa

SEQ ID NO: 5413231 - DNA, 12 bp, Homo sapiens
gaaatatataaa

SEQ ID NO: 5413232 - DNA, 19 bp, Homo sapiens
gaaatatatacaaaaagaa

SEQ ID NO: 5413233 - DNA, 18 bp, Homo sapiens
gaaatatatacgaacaaa

SEQ ID NO: 5413234 - DNA, 16 bp, Homo sapiens
gaaatatatatacata

SEQ ID NO: 5413235 - DNA, 18 bp, Homo sapiens
gaaatatatatacatatg

SEQ ID NO: 5413236 - DNA, 23 bp, Homo sapiens
gaaatatatatgtgtgtgtatgt

SEQ ID NO: 5413237 - DNA, 20 bp, Homo sapiens
gaaatatatggtctaatgtt

SEQ ID NO: 5413238 - DNA, 23 bp, Homo sapiens
gaaatatatggtctaatgtttaa

SEQ ID NO: 5413239 - DNA, 20 bp, Homo sapiens
gaaatatattacttaactgt

SEQ ID NO: 5413240 - DNA, 19 bp, Homo sapiens
gaaatatattatgaaaatt

SEQ ID NO: 5413241 - DNA, 22 bp, Homo sapiens
gaaatatattatttcctttatt

SEQ ID NO: 5413242 - DNA, 12 bp, Homo sapiens
gaaatatattca

SEQ ID NO: 5413243 - DNA, 17 bp, Homo sapiens
gaaatatatttgtaaaa

SEQ ID NO: 5413244 - DNA, 18 bp, Homo sapiens
gaaatatatttgtcactt

SEQ ID NO: 5413245 - DNA, 20 bp, Homo sapiens
gaaatatattttaaatgtgg

SEQ ID NO: 5413246 - DNA, 20 bp, Homo sapiens
gaaatatcagttactcagcc

SEQ ID NO: 5413247 - DNA, 23 bp, Homo sapiens
gaaatatcagttactcagccctg

SEQ ID NO: 5413248 - DNA, 23 bp, Homo sapiens
gaaatatccacccagcaggcaga

SEQ ID NO: 5413249 - DNA, 19 bp, Homo sapiens
gaaatatccctcatttcat

SEQ ID NO: 5413250 - DNA, 21 bp, Homo sapiens
gaaatatccctcatttcatta

SEQ ID NO: 5413251 - DNA, 23 bp, Homo sapiens
gaaatatccctcatttcattatt

SEQ ID NO: 5413252 - DNA, 24 bp, Homo sapiens
gaaatatcctttggaacaattatt

SEQ ID NO: 5413253 - DNA, 19 bp, Homo sapiens
gaaatatcgctgatgcaga

SEQ ID NO: 5413254 - DNA, 18 bp, Homo sapiens
gaaatatctgaaaatgta

SEQ ID NO: 5413255 - DNA, 20 bp, Homo sapiens
gaaatatctgaaaatgtatg

SEQ ID NO: 5413256 - DNA, 18 bp, Homo sapiens
gaaatatctgtgaaatat

SEQ ID NO: 5413257 - DNA, 15 bp, Homo sapiens
gaaatatctttctct

SEQ ID NO: 5413258 - DNA, 16 bp, Homo sapiens
gaaatatgaagagcaa

SEQ ID NO: 5413259 - DNA, 14 bp, Homo sapiens
gaaatatgatttta

SEQ ID NO: 5413260 - DNA, 15 bp, Homo sapiens
gaaatatgattttat

SEQ ID NO: 5413261 - DNA, 22 bp, Homo sapiens
gaaatatgattttatttgacaa

SEQ ID NO: 5413262 - DNA, 18 bp, Homo sapiens
gaaatatgcaacctgtgc

SEQ ID NO: 5413263 - DNA, 18 bp, Homo sapiens
gaaatatgcacaatagca

SEQ ID NO: 5413264 - DNA, 19 bp, Homo sapiens
gaaatatgccactgaccga

SEQ ID NO: 5413265 - DNA, 16 bp, Homo sapiens
gaaatatgtgaagccc

SEQ ID NO: 5413266 - DNA, 13 bp, Homo sapiens
gaaatatgttcta

SEQ ID NO: 5413267 - DNA, 15 bp, Homo sapiens
gaaatattaaaagaa

SEQ ID NO: 5413268 - DNA, 13 bp, Homo sapiens
gaaatattaacta

SEQ ID NO: 5413269 - DNA, 19 bp, Homo sapiens
gaaatattaatatgtactt

SEQ ID NO: 5413270 - DNA, 19 bp, Homo sapiens
gaaatattactctgcctgt

SEQ ID NO: 5413271 - DNA, 13 bp, Homo sapiens
gaaatattatgca

SEQ ID NO: 5413272 - DNA, 16 bp, Homo sapiens
gaaatattatgcaaat

SEQ ID NO: 5413273 - DNA, 15 bp, Homo sapiens
gaaatattcagaaat

SEQ ID NO: 5413274 - DNA, 24 bp, Homo sapiens
gaaatattgctctaattcttttca

SEQ ID NO: 5413275 - DNA, 13 bp, Homo sapiens
gaaatattgtaaa

SEQ ID NO: 5413276 - DNA, 15 bp, Homo sapiens
gaaatattgtaaatg

SEQ ID NO: 5413277 - DNA, 15 bp, Homo sapiens
gaaatattgtgctta

SEQ ID NO: 5413278 - DNA, 19 bp, Homo sapiens
gaaatatttaagtatatag

SEQ ID NO: 5413279 - DNA, 15 bp, Homo sapiens
gaaatatttatttta

SEQ ID NO: 5413280 - DNA, 16 bp, Homo sapiens
gaaatatttattttaa

SEQ ID NO: 5413281 - DNA, 17 bp, Homo sapiens
gaaatatttattttaat

SEQ ID NO: 5413282 - DNA, 22 bp, Homo sapiens
gaaatatttattttaataatgt

SEQ ID NO: 5413283 - DNA, 18 bp, Homo sapiens
gaaatatttcttttaaaa

SEQ ID NO: 5413284 - DNA, 15 bp, Homo sapiens
gaaatatttgcgtaa

SEQ ID NO: 5413285 - DNA, 23 bp, Homo sapiens
gaaatatttgcgtaaatggtttt

SEQ ID NO: 5413286 - DNA, 20 bp, Homo sapiens
gaaatatttgcttatttata

SEQ ID NO: 5413287 - DNA, 19 bp, Homo sapiens
gaaatatttgtgacaaaaa

SEQ ID NO: 5413288 - DNA, 13 bp, Homo sapiens
gaaatattttaaa

SEQ ID NO: 5413289 - DNA, 22 bp, Homo sapiens
gaaatattttaatttttaaatg

SEQ ID NO: 5413290 - DNA, 19 bp, Homo sapiens
gaaatattttctactttaa

SEQ ID NO: 5413291 - DNA, 23 bp, Homo sapiens
gaaatattttctactttaaattg

SEQ ID NO: 5413292 - DNA, 17 bp, Homo sapiens
gaaatattttcttcctt

SEQ ID NO: 5413293 - DNA, 20 bp, Homo sapiens
gaaatattttgataataaat

SEQ ID NO: 5413294 - DNA, 13 bp, Homo sapiens
gaaatatttttga

SEQ ID NO: 5413295 - DNA, 19 bp, Homo sapiens
gaaatcaaatatgcaaagc

SEQ ID NO: 5413296 - DNA, 21 bp, Homo sapiens
gaaatcaaatatgcaaagcac

SEQ ID NO: 5413297 - DNA, 17 bp, Homo sapiens
gaaatcaaatgtatgta

SEQ ID NO: 5413298 - DNA, 18 bp, Homo sapiens
gaaatcaaccctctcctg

SEQ ID NO: 5413299 - DNA, 16 bp, Homo sapiens
gaaatcaactctcttc

SEQ ID NO: 5413300 - DNA, 14 bp, Homo sapiens
gaaatcaagagaca

SEQ ID NO: 5413301 - DNA, 15 bp, Homo sapiens
gaaatcaagcataaa

SEQ ID NO: 5413302 - DNA, 19 bp, Homo sapiens
gaaatcaatttaaaggaaa

SEQ ID NO: 5413303 - DNA, 22 bp, Homo sapiens
gaaatcacaattttcctgtgga

SEQ ID NO: 5413304 - DNA, 15 bp, Homo sapiens
gaaatcacagaatca

SEQ ID NO: 5413305 - DNA, 16 bp, Homo sapiens
gaaatcacagaatcat

SEQ ID NO: 5413306 - DNA, 19 bp, Homo sapiens
gaaatcacaggggcggggc

SEQ ID NO: 5413307 - DNA, 18 bp, Homo sapiens
gaaatcacagtcaatgga

SEQ ID NO: 5413308 - DNA, 19 bp, Homo sapiens
gaaatcaccgaaaacgtgg

SEQ ID NO: 5413309 - DNA, 10 bp, Homo sapiens
gaaatcactg

SEQ ID NO: 5413310 - DNA, 11 bp, Homo sapiens
gaaatcactgt

SEQ ID NO: 5413311 - DNA, 13 bp, Homo sapiens
gaaatcactgtga

SEQ ID NO: 5413312 - DNA, 14 bp, Homo sapiens
gaaatcactgtgaa

SEQ ID NO: 5413313 - DNA, 15 bp, Homo sapiens
gaaatcactgtgaaa

SEQ ID NO: 5413314 - DNA, 17 bp, Homo sapiens
gaaatcactgtgaaatt

SEQ ID NO: 5413315 - DNA, 14 bp, Homo sapiens
gaaatcagaaaaat

SEQ ID NO: 5413316 - DNA, 17 bp, Homo sapiens
gaaatcagaaaaattaa

SEQ ID NO: 5413317 - DNA, 18 bp, Homo sapiens
gaaatcagaaaaattaat

SEQ ID NO: 5413318 - DNA, 12 bp, Homo sapiens
gaaatcagcatg

SEQ ID NO: 5413319 - DNA, 15 bp, Homo sapiens
gaaatcagcatgaca

SEQ ID NO: 5413320 - DNA, 17 bp, Homo sapiens
gaaatcagcatgacaaa

SEQ ID NO: 5413321 - DNA, 14 bp, Homo sapiens
gaaatcagccaagt

SEQ ID NO: 5413322 - DNA, 14 bp, Homo sapiens
gaaatcaggcctga

SEQ ID NO: 5413323 - DNA, 20 bp, Homo sapiens
gaaatcaggcctgatgaggg

SEQ ID NO: 5413324 - DNA, 19 bp, Homo sapiens
gaaatcaggtgttttaaga

SEQ ID NO: 5413325 - DNA, 21 bp, Homo sapiens
gaaatcaggtgttttaagact

SEQ ID NO: 5413326 - DNA, 16 bp, Homo sapiens
gaaatcagtaaacact

SEQ ID NO: 5413327 - DNA, 19 bp, Homo sapiens
gaaatcagtagaaagctaa

SEQ ID NO: 5413328 - DNA, 20 bp, Homo sapiens
gaaatcagtagaaagctaaa

SEQ ID NO: 5413329 - DNA, 20 bp, Homo sapiens
gaaatcagtggtgttacatt

SEQ ID NO: 5413330 - DNA, 22 bp, Homo sapiens
gaaatcagtggtgttacatttt

SEQ ID NO: 5413331 - DNA, 15 bp, Homo sapiens
gaaatcataccagtt

SEQ ID NO: 5413332 - DNA, 17 bp, Homo sapiens
gaaatcatactttgcca

SEQ ID NO: 5413333 - DNA, 21 bp, Homo sapiens
gaaatcatatagaaaggctgg

SEQ ID NO: 5413334 - DNA, 19 bp, Homo sapiens
gaaatgtttttaataaaag

SEQ ID NO: 5413335 - DNA, 22 bp, Homo sapiens
gaaatgtttttaataaaagaaa

SEQ ID NO: 5413336 - DNA, 18 bp, Homo sapiens
gaaatgtttttggcaaca

SEQ ID NO: 5413337 - DNA, 20 bp, Homo sapiens
gaaattaaaactattcatgc

SEQ ID NO: 5413338 - DNA, 12 bp, Homo sapiens
gaaattaaaata

SEQ ID NO: 5413339 - DNA, 13 bp, Homo sapiens
gaaattaaaatat

SEQ ID NO: 5413340 - DNA, 16 bp, Homo sapiens
gaaattaaaattgcca

SEQ ID NO: 5413341 - DNA, 18 bp, Homo sapiens
gaaattaaagaaatgaaa

SEQ ID NO: 5413342 - DNA, 22 bp, Homo sapiens
gaaattaaagctgccttttgtt

SEQ ID NO: 5413343 - DNA, 19 bp, Homo sapiens
gaaattaaagtatgcaaaa

SEQ ID NO: 5413344 - DNA, 14 bp, Homo sapiens
gaaattaaataatt

SEQ ID NO: 5413345 - DNA, 14 bp, Homo sapiens
gaaattaacaagaa

SEQ ID NO: 5413346 - DNA, 18 bp, Homo sapiens
gaaattaacaagaactca

SEQ ID NO: 5413347 - DNA, 20 bp, Homo sapiens
gaaattaacttttaaatgtt

SEQ ID NO: 5413348 - DNA, 14 bp, Homo sapiens
gaaattaaggaaca

SEQ ID NO: 5413349 - DNA, 20 bp, Homo sapiens
gaaattaataaaacttatct

SEQ ID NO: 5413350 - DNA, 17 bp, Homo sapiens
gaaattaatttgtgaat

SEQ ID NO: 5413351 - DNA, 21 bp, Homo sapiens
gaaattaatttgtgaatttgc

SEQ ID NO: 5413352 - DNA, 14 bp, Homo sapiens
gaaattacaagttt

SEQ ID NO: 5413353 - DNA, 19 bp, Homo sapiens
gaaattacaagtttcagta

SEQ ID NO: 5413354 - DNA, 20 bp, Homo sapiens
gaaattacaagtttcagtaa

SEQ ID NO: 5413355 - DNA, 17 bp, Homo sapiens
gaaattacacccaaaga

SEQ ID NO: 5413356 - DNA, 15 bp, Homo sapiens
gaaattacctgtgga

SEQ ID NO: 5413357 - DNA, 18 bp, Homo sapiens
gaaattactacaaaattt

SEQ ID NO: 5413358 - DNA, 13 bp, Homo sapiens
gaaattactgtgt

SEQ ID NO: 5413359 - DNA, 21 bp, Homo sapiens
gaaattacttatcatccacat

SEQ ID NO: 5413360 - DNA, 13 bp, Homo sapiens
gaaattacttcta

SEQ ID NO: 5413361 - DNA, 19 bp, Homo sapiens
gaaattactttaacatttt

SEQ ID NO: 5413362 - DNA, 22 bp, Homo sapiens
gaaattactttaacattttgga

SEQ ID NO: 5413363 - DNA, 15 bp, Homo sapiens
gaaattagatttgtg

SEQ ID NO: 5413364 - DNA, 13 bp, Homo sapiens
gaaattagccggg

SEQ ID NO: 5413365 - DNA, 16 bp, Homo sapiens
gaaattagctgtgtga

SEQ ID NO: 5413366 - DNA, 13 bp, Homo sapiens
gaaattagggccc

SEQ ID NO: 5413367 - DNA, 14 bp, Homo sapiens
gaaattagtgtttt

SEQ ID NO: 5413368 - DNA, 21 bp, Homo sapiens
gaaattagtgttttcattctg

SEQ ID NO: 5413369 - DNA, 23 bp, Homo sapiens
gaaattagtgttttcattctggt

SEQ ID NO: 5413370 - DNA, 19 bp, Homo sapiens
gaaattataactattacag

SEQ ID NO: 5413371 - DNA, 21 bp, Homo sapiens
gaaattataagtagatttgta

SEQ ID NO: 5413372 - DNA, 23 bp, Homo sapiens
gaaattatataagtattctaaat

SEQ ID NO: 5413373 - DNA, 15 bp, Homo sapiens
gaaattatatctgtg

SEQ ID NO: 5413374 - DNA, 18 bp, Homo sapiens
gaaattatgtatgtttac

SEQ ID NO: 5413375 - DNA, 21 bp, Homo sapiens
gaaattatgtatgtttacata

SEQ ID NO: 5413376 - DNA, 13 bp, Homo sapiens
gaaattatgtcaa

SEQ ID NO: 5413377 - DNA, 21 bp, Homo sapiens
gaaattattggtatatttgta

SEQ ID NO: 5413378 - DNA, 13 bp, Homo sapiens
gaaattattggtt

SEQ ID NO: 5413379 - DNA, 17 bp, Homo sapiens
gaaattatttaataaaa

SEQ ID NO: 5413380 - DNA, 15 bp, Homo sapiens
gaaattatttaatat

SEQ ID NO: 5413381 - DNA, 19 bp, Homo sapiens
gaaattcaagaagtatttt

SEQ ID NO: 5413382 - DNA, 18 bp, Homo sapiens
gaaattcaattcatagaa

SEQ ID NO: 5413383 - DNA, 19 bp, Homo sapiens
gaaattcaattcatagaat

SEQ ID NO: 5413384 - DNA, 21 bp, Homo sapiens
gaaattcagcccaccagccac

SEQ ID NO: 5413385 - DNA, 20 bp, Homo sapiens
gaaattcagcttttgcagaa

SEQ ID NO: 5413386 - DNA, 13 bp, Homo sapiens
gaaattcaggtac

SEQ ID NO: 5413387 - DNA, 10 bp, Homo sapiens
gaaattcagt

SEQ ID NO: 5413388 - DNA, 14 bp, Homo sapiens
gaaattcatgagag

SEQ ID NO: 5413389 - DNA, 19 bp, Homo sapiens
gaaattcatggctttttct

SEQ ID NO: 5413390 - DNA, 12 bp, Homo sapiens
gaaattccaaag

SEQ ID NO: 5413391 - DNA, 19 bp, Homo sapiens
gaaattccaactcctgatg

SEQ ID NO: 5413392 - DNA, 23 bp, Homo sapiens
gaaattccagcaataagaaatga

SEQ ID NO: 5413393 - DNA, 18 bp, Homo sapiens
gaaattccagtaaatcct

SEQ ID NO: 5413394 - DNA, 18 bp, Homo sapiens
gaaattccagtttaggag

SEQ ID NO: 5413395 - DNA, 21 bp, Homo sapiens
gaaattcccccacttgggagc

SEQ ID NO: 5413396 - DNA, 20 bp, Homo sapiens
gaaattcccgtgttgcttca

SEQ ID NO: 5413397 - DNA, 13 bp, Homo sapiens
gaaattccctgga

SEQ ID NO: 5413398 - DNA, 15 bp, Homo sapiens
gaaattccctggacc

SEQ ID NO: 5413399 - DNA, 22 bp, Homo sapiens
gaaattcccttcatctggaacc

SEQ ID NO: 5413400 - DNA, 14 bp, Homo sapiens
gaaattcctccttc

SEQ ID NO: 5413401 - DNA, 15 bp, Homo sapiens
gaaattcctccttcc

SEQ ID NO: 5413402 - DNA, 15 bp, Homo sapiens
gaaattcctgtagca

SEQ ID NO: 5413403 - DNA, 15 bp, Homo sapiens
gaaattcgtgtgttt

SEQ ID NO: 5413404 - DNA, 16 bp, Homo sapiens
gaaattctaaagagca

SEQ ID NO: 5413405 - DNA, 12 bp, Homo sapiens
gaaattctataa

SEQ ID NO: 5413406 - DNA, 22 bp, Homo sapiens
gaaattctataagagacaaagt

SEQ ID NO: 5413407 - DNA, 13 bp, Homo sapiens
gaaattctcagag

SEQ ID NO: 5413408 - DNA, 14 bp, Homo sapiens
gaaattctcctgga

SEQ ID NO: 5413409 - DNA, 15 bp, Homo sapiens
gaaattctcctggag

SEQ ID NO: 5413410 - DNA, 12 bp, Homo sapiens
gaaattctgaaa

SEQ ID NO: 5413411 - DNA, 15 bp, Homo sapiens
gaaattctgaatttg

SEQ ID NO: 5413412 - DNA, 16 bp, Homo sapiens
gaaattctgctgcttg

SEQ ID NO: 5413413 - DNA, 16 bp, Homo sapiens
gaaattctggcccagc

SEQ ID NO: 5413414 - DNA, 19 bp, Homo sapiens
gaaattctggcccagccaa

SEQ ID NO: 5413415 - DNA, 12 bp, Homo sapiens
gaaattctgttt

SEQ ID NO: 5413416 - DNA, 13 bp, Homo sapiens
gaaattctgtttt

SEQ ID NO: 5413417 - DNA, 20 bp, Homo sapiens
gaaattcttatgttgaatat

SEQ ID NO: 5413418 - DNA, 19 bp, Homo sapiens
gaaattcttcaatttgaaa

SEQ ID NO: 5413419 - DNA, 14 bp, Homo sapiens
gaaattcttcatga

SEQ ID NO: 5413420 - DNA, 17 bp, Homo sapiens
gaaattcttccctgggg

SEQ ID NO: 5413421 - DNA, 18 bp, Homo sapiens
gaaattcttccctggggg

SEQ ID NO: 5413422 - DNA, 13 bp, Homo sapiens
gaaattcttccta

SEQ ID NO: 5413423 - DNA, 18 bp, Homo sapiens
gaaattcttgttatggta

SEQ ID NO: 5413424 - DNA, 16 bp, Homo sapiens
gaaattctttcagcta

SEQ ID NO: 5413425 - DNA, 18 bp, Homo sapiens
gaaattcttttataaata

SEQ ID NO: 5413426 - DNA, 12 bp, Homo sapiens
gaaattgaaagc

SEQ ID NO: 5413427 - DNA, 20 bp, Homo sapiens
gaaattgaatactttgaatg

SEQ ID NO: 5413428 - DNA, 22 bp, Homo sapiens
gaaattgaatactttgaatgtg

SEQ ID NO: 5413429 - DNA, 16 bp, Homo sapiens
gaaattgaatgtacct

SEQ ID NO: 5413430 - DNA, 17 bp, Homo sapiens
gaaattgagctgctttt

SEQ ID NO: 5413431 - DNA, 13 bp, Homo sapiens
gaaattgattttg

SEQ ID NO: 5413432 - DNA, 19 bp, Homo sapiens
gaaattgcagtaacaaaag

SEQ ID NO: 5413433 - DNA, 19 bp, Homo sapiens
gaaattgcatttcctgaca

SEQ ID NO: 5413434 - DNA, 23 bp, Homo sapiens
gaaattgcctccttatttatcaa

SEQ ID NO: 5413435 - DNA, 16 bp, Homo sapiens
gaaattggaagagcac

SEQ ID NO: 5413436 - DNA, 14 bp, Homo sapiens
gaaattggctggat

SEQ ID NO: 5413437 - DNA, 15 bp, Homo sapiens
gaaattggctggatg

SEQ ID NO: 5413438 - DNA, 16 bp, Homo sapiens
gaaattggtaccttgc

SEQ ID NO: 5413439 - DNA, 12 bp, Homo sapiens
gaaattggtttt

SEQ ID NO: 5413440 - DNA, 19 bp, Homo sapiens
gaaattgtaaatcctgtgt

SEQ ID NO: 5413441 - DNA, 17 bp, Homo sapiens
gaaattgtaattatatc

SEQ ID NO: 5413442 - DNA, 13 bp, Homo sapiens
gaaattgtatatt

SEQ ID NO: 5413443 - DNA, 15 bp, Homo sapiens
gaaattgtccttgaa

SEQ ID NO: 5413444 - DNA, 18 bp, Homo sapiens
gaaattgtccttgaagct

SEQ ID NO: 5413445 - DNA, 20 bp, Homo sapiens
gaaattgtctagcagagcag

SEQ ID NO: 5413446 - DNA, 15 bp, Homo sapiens
gaaattgttcctgat

SEQ ID NO: 5413447 - DNA, 22 bp, Homo sapiens
gaaatttaaaaataaagctact

SEQ ID NO: 5413448 - DNA, 14 bp, Homo sapiens
gaaatttaaaagca

SEQ ID NO: 5413449 - DNA, 13 bp, Homo sapiens
gaaatttaaacta

SEQ ID NO: 5413450 - DNA, 14 bp, Homo sapiens
gaaatttaaactat

SEQ ID NO: 5413451 - DNA, 20 bp, Homo sapiens
gaaatttaaactataagcaa

SEQ ID NO: 5413452 - DNA, 14 bp, Homo sapiens
gaaatttaattaca

SEQ ID NO: 5413453 - DNA, 15 bp, Homo sapiens
gaaatttaattacaa

SEQ ID NO: 5413454 - DNA, 19 bp, Homo sapiens
gaaatttaattacaaacaa

SEQ ID NO: 5413455 - DNA, 20 bp, Homo sapiens
gaaatttaattacaaacaat

SEQ ID NO: 5413456 - DNA, 16 bp, Homo sapiens
gaaatttaattcatgt

SEQ ID NO: 5413457 - DNA, 23 bp, Homo sapiens
gaaatttaattcatgtttcttaa

SEQ ID NO: 5413458 - DNA, 22 bp, Homo sapiens
gaaatttactatgtaaatgctt

SEQ ID NO: 5413459 - DNA, 18 bp, Homo sapiens
gaaatttagagtcaattt

SEQ ID NO: 5413460 - DNA, 17 bp, Homo sapiens
gaaatttatacaaagaa

SEQ ID NO: 5413461 - DNA, 11 bp, Homo sapiens
gaaatttattc

SEQ ID NO: 5413462 - DNA, 16 bp, Homo sapiens
gaaatttattcacata

SEQ ID NO: 5413463 - DNA, 22 bp, Homo sapiens
gaaatttatttcctagttctgt

SEQ ID NO: 5413464 - DNA, 15 bp, Homo sapiens
gaaatttcatgattg

SEQ ID NO: 5413465 - DNA, 18 bp, Homo sapiens
gaaatttcatgattggct

SEQ ID NO: 5413466 - DNA, 12 bp, Homo sapiens
gaaatttcattt

SEQ ID NO: 5413467 - DNA, 13 bp, Homo sapiens
gaaatttcatttt

SEQ ID NO: 5413468 - DNA, 16 bp, Homo sapiens
gaaatttcattttcct

SEQ ID NO: 5413469 - DNA, 22 bp, Homo sapiens
gaaatttccggaagtaaataca

SEQ ID NO: 5413470 - DNA, 21 bp, Homo sapiens
gaaatttcctgggagcttttg

SEQ ID NO: 5413471 - DNA, 17 bp, Homo sapiens
gaaatttctcatcacag

SEQ ID NO: 5413472 - DNA, 13 bp, Homo sapiens
gaaatttctgtga

SEQ ID NO: 5413473 - DNA, 17 bp, Homo sapiens
gaaatttgaaaaaactt

SEQ ID NO: 5413474 - DNA, 11 bp, Homo sapiens
gaaatttgaat

SEQ ID NO: 5413475 - DNA, 15 bp, Homo sapiens
gaaatttgataatga

SEQ ID NO: 5413476 - DNA, 14 bp, Homo sapiens
gaaatttgatttct

SEQ ID NO: 5413477 - DNA, 12 bp, Homo sapiens
gaaatttgcaaa

SEQ ID NO: 5413478 - DNA, 14 bp, Homo sapiens
gaaatttgcaaaat

SEQ ID NO: 5413479 - DNA, 16 bp, Homo sapiens
gaaatttgcaactcac

SEQ ID NO: 5413480 - DNA, 18 bp, Homo sapiens
gaaatttgcccctggcaa

SEQ ID NO: 5413481 - DNA, 18 bp, Homo sapiens
gaaatttggatcttcttt

SEQ ID NO: 5413482 - DNA, 13 bp, Homo sapiens
gaaatttggtacc

SEQ ID NO: 5413483 - DNA, 19 bp, Homo sapiens
gaaatttgtggttgcatgt

SEQ ID NO: 5413484 - DNA, 14 bp, Homo sapiens
gaaatttgtgtgct

SEQ ID NO: 5413485 - DNA, 21 bp, Homo sapiens
gaaatttgtgtgcttcacaca

SEQ ID NO: 5413486 - DNA, 17 bp, Homo sapiens
gaaatttgttaatatat

SEQ ID NO: 5413487 - DNA, 18 bp, Homo sapiens
gaaatttgttatacttca

SEQ ID NO: 5413488 - DNA, 20 bp, Homo sapiens
gaaatttgttatacttcaaa

SEQ ID NO: 5413489 - DNA, 17 bp, Homo sapiens
gaaatttgttgtttgtt

SEQ ID NO: 5413490 - DNA, 14 bp, Homo sapiens
gaaatttgtttgta

SEQ ID NO: 5413491 - DNA, 14 bp, Homo sapiens
gaaattttaaaagt

SEQ ID NO: 5413492 - DNA, 19 bp, Homo sapiens
gaaattttaaaggaagaaa

SEQ ID NO: 5413493 - DNA, 13 bp, Homo sapiens
gaaattttaccaa

SEQ ID NO: 5413494 - DNA, 19 bp, Homo sapiens
gaaattttatatgcttact

SEQ ID NO: 5413495 - DNA, 22 bp, Homo sapiens
gaaattttatatgcttactgat

SEQ ID NO: 5413496 - DNA, 19 bp, Homo sapiens
gaaattttatatgtaaatg

SEQ ID NO: 5413497 - DNA, 18 bp, Homo sapiens
gaaattttattagacatt

SEQ ID NO: 5413498 - DNA, 21 bp, Homo sapiens
gaaattttattagacattctc

SEQ ID NO: 5413499 - DNA, 12 bp, Homo sapiens
gaaattttcaac

SEQ ID NO: 5413500 - DNA, 21 bp, Homo sapiens
gaaattttcaagagtctaata

SEQ ID NO: 5413501 - DNA, 17 bp, Homo sapiens
gaaattttccattacat

SEQ ID NO: 5413502 - DNA, 19 bp, Homo sapiens
gaaattttccattacatga

SEQ ID NO: 5413503 - DNA, 14 bp, Homo sapiens
gaaattttctagaa

SEQ ID NO: 5413504 - DNA, 13 bp, Homo sapiens
gaaattttgcaaa

SEQ ID NO: 5413505 - DNA, 19 bp, Homo sapiens
gaaattttgcaaatataaa

SEQ ID NO: 5413506 - DNA, 12 bp, Homo sapiens
gaaattttgtaa

SEQ ID NO: 5413507 - DNA, 13 bp, Homo sapiens
gaaattttgtaag

SEQ ID NO: 5413508 - DNA, 14 bp, Homo sapiens
gaaattttgtaaga

SEQ ID NO: 5413509 - DNA, 13 bp, Homo sapiens
gaaattttgttaa

SEQ ID NO: 5413510 - DNA, 18 bp, Homo sapiens
gaaatttttaaatcattt

SEQ ID NO: 5413511 - DNA, 20 bp, Homo sapiens
gaaatttttcagatgcttct

SEQ ID NO: 5413512 - DNA, 16 bp, Homo sapiens
gaaatttttcatattt

SEQ ID NO: 5413513 - DNA, 14 bp, Homo sapiens
gaaatttttccaca

SEQ ID NO: 5413514 - DNA, 21 bp, Homo sapiens
gaacccctagaaaggagagaa

SEQ ID NO: 5413515 - DNA, 18 bp, Homo sapiens
gaacccctggctccaggc

SEQ ID NO: 5413516 - DNA, 17 bp, Homo sapiens
gaacccctggctccttc

SEQ ID NO: 5413517 - DNA, 17 bp, Homo sapiens
gaaccccttcatcctct

SEQ ID NO: 5413518 - DNA, 17 bp, Homo sapiens
gaacccgggggacagag

SEQ ID NO: 5413519 - DNA, 15 bp, Homo sapiens
gaacccggtcccagg

SEQ ID NO: 5413520 - DNA, 17 bp, Homo sapiens
gaacccggtcccaggcc

SEQ ID NO: 5413521 - DNA, 19 bp, Homo sapiens
gaacccggtcccaggccgc

SEQ ID NO: 5413522 - DNA, 20 bp, Homo sapiens
gaaccctaaataataaaaat

SEQ ID NO: 5413523 - DNA, 17 bp, Homo sapiens
gaaccctctgtcccacc

SEQ ID NO: 5413524 - DNA, 21 bp, Homo sapiens
gaaccctctgtcccaccccta

SEQ ID NO: 5413525 - DNA, 23 bp, Homo sapiens
gaaccctctgtcccacccctagc

SEQ ID NO: 5413526 - DNA, 19 bp, Homo sapiens
gaaccctctgttccttccc

SEQ ID NO: 5413527 - DNA, 14 bp, Homo sapiens
gaaccctcttgcca

SEQ ID NO: 5413528 - DNA, 18 bp, Homo sapiens
gaaccctcttgccatcct

SEQ ID NO: 5413529 - DNA, 11 bp, Homo sapiens
gaaccctgccc

SEQ ID NO: 5413530 - DNA, 18 bp, Homo sapiens
gaaccctgcgtggggaca

SEQ ID NO: 5413531 - DNA, 12 bp, Homo sapiens
gaaccctggaga

SEQ ID NO: 5413532 - DNA, 23 bp, Homo sapiens
gaaccctggtgaggaagctccag

SEQ ID NO: 5413533 - DNA, 23 bp, Homo sapiens
gaacccttaaacagttgcacagc

SEQ ID NO: 5413534 - DNA, 12 bp, Homo sapiens
gaacccttctgc

SEQ ID NO: 5413535 - DNA, 12 bp, Homo sapiens
gaacccttggct

SEQ ID NO: 5413536 - DNA, 16 bp, Homo sapiens
gaacccttggcttgcc

SEQ ID NO: 5413537 - DNA, 21 bp, Homo sapiens
gaacccttggcttgcccacgt

SEQ ID NO: 5413538 - DNA, 23 bp, Homo sapiens
gaaccctttgtttcttgtttatt

SEQ ID NO: 5413539 - DNA, 16 bp, Homo sapiens
gaacccttttcctcca

SEQ ID NO: 5413540 - DNA, 21 bp, Homo sapiens
gaaccgaacatatcatttgtg

SEQ ID NO: 5413541 - DNA, 22 bp, Homo sapiens
gaaccgaacatatcatttgtga

SEQ ID NO: 5413542 - DNA, 20 bp, Homo sapiens
gaaccgactgaccctgagga

SEQ ID NO: 5413543 - DNA, 22 bp, Homo sapiens
gaaccgacttttctaaagctct

SEQ ID NO: 5413544 - DNA, 12 bp, Homo sapiens
gaaccgagaagg

SEQ ID NO: 5413545 - DNA, 18 bp, Homo sapiens
gaaccgaggggctcagga

SEQ ID NO: 5413546 - DNA, 21 bp, Homo sapiens
gaaccgaggggctcaggaaaa

SEQ ID NO: 5413547 - DNA, 21 bp, Homo sapiens
gaaccgagggggctgctccca

SEQ ID NO: 5413548 - DNA, 14 bp, Homo sapiens
gaaccgagtcagaa

SEQ ID NO: 5413549 - DNA, 14 bp, Homo sapiens
gaaccgcacagctc

SEQ ID NO: 5413550 - DNA, 16 bp, Homo sapiens
gaaccgcacagctcag

SEQ ID NO: 5413551 - DNA, 17 bp, Homo sapiens
gaaccgcacagctcagg

SEQ ID NO: 5413552 - DNA, 21 bp, Homo sapiens
gaaccgcacagctcaggaggc

SEQ ID NO: 5413553 - DNA, 14 bp, Homo sapiens
gaaccgcaccccat

SEQ ID NO: 5413554 - DNA, 20 bp, Homo sapiens
gaaccgcaccccatcccacc

SEQ ID NO: 5413555 - DNA, 20 bp, Homo sapiens
gaaccgcagaagcctcccca

SEQ ID NO: 5413556 - DNA, 15 bp, Homo sapiens
gaaccgcaggaagct

SEQ ID NO: 5413557 - DNA, 20 bp, Homo sapiens
gaaccgcaggaagctgctcc

SEQ ID NO: 5413558 - DNA, 14 bp, Homo sapiens
gaaccgccctcctg

SEQ ID NO: 5413559 - DNA, 15 bp, Homo sapiens
gaaccgccctcctga

SEQ ID NO: 5413560 - DNA, 16 bp, Homo sapiens
gaaccgccctcctgat

SEQ ID NO: 5413561 - DNA, 18 bp, Homo sapiens
gaaccgccggttcatttt

SEQ ID NO: 5413562 - DNA, 20 bp, Homo sapiens
gaaccgctcacctagagcca

SEQ ID NO: 5413563 - DNA, 15 bp, Homo sapiens
gaaccgctgaatatg

SEQ ID NO: 5413564 - DNA, 20 bp, Homo sapiens
gaaccggctcccaccctcaa

SEQ ID NO: 5413565 - DNA, 15 bp, Homo sapiens
gaaccgtaggaccca

SEQ ID NO: 5413566 - DNA, 13 bp, Homo sapiens
gaaccgtcaatgt

SEQ ID NO: 5413567 - DNA, 13 bp, Homo sapiens
gaaccgtgacatc

SEQ ID NO: 5413568 - DNA, 16 bp, Homo sapiens
gaaccgtgaggagggg

SEQ ID NO: 5413569 - DNA, 14 bp, Homo sapiens
gaaccgtgtgctcc

SEQ ID NO: 5413570 - DNA, 15 bp, Homo sapiens
gaaccgtttacagtg

SEQ ID NO: 5413571 - DNA, 22 bp, Homo sapiens
gaacctaaagtagcaggactcg

SEQ ID NO: 5413572 - DNA, 20 bp, Homo sapiens
gaacctaactccccacccca

SEQ ID NO: 5413573 - DNA, 16 bp, Homo sapiens
gaacctaactgtatct

SEQ ID NO: 5413574 - DNA, 20 bp, Homo sapiens
gaacctaactgtatcttgag

SEQ ID NO: 5413575 - DNA, 16 bp, Homo sapiens
gaacctacaaaagctt

SEQ ID NO: 5413576 - DNA, 17 bp, Homo sapiens
gaacctacaaaagcttg

SEQ ID NO: 5413577 - DNA, 19 bp, Homo sapiens
gaacctacagactccatct

SEQ ID NO: 5413578 - DNA, 19 bp, Homo sapiens
gaacctacagttttaactg

SEQ ID NO: 5413579 - DNA, 21 bp, Homo sapiens
gaacctacagttttaactgtg

SEQ ID NO: 5413580 - DNA, 20 bp, Homo sapiens
gaacctaccagttggccatg

SEQ ID NO: 5413581 - DNA, 22 bp, Homo sapiens
gaacctaccctcggctcccggg

SEQ ID NO: 5413582 - DNA, 23 bp, Homo sapiens
gaacctaccctcggctcccgggt

SEQ ID NO: 5413583 - DNA, 18 bp, Homo sapiens
gaacctacctgccttgga

SEQ ID NO: 5413584 - DNA, 17 bp, Homo sapiens
gaacctagaagggctag

SEQ ID NO: 5413585 - DNA, 18 bp, Homo sapiens
gaacctatagcatcttct

SEQ ID NO: 5413586 - DNA, 15 bp, Homo sapiens
gaacctatgaagcaa

SEQ ID NO: 5413587 - DNA, 16 bp, Homo sapiens
gaacctatttctcttt

SEQ ID NO: 5413588 - DNA, 17 bp, Homo sapiens
gaacctatttctctttc

SEQ ID NO: 5413589 - DNA, 18 bp, Homo sapiens
gaacctatttctctttct

SEQ ID NO: 5413590 - DNA, 15 bp, Homo sapiens
gaacctattttcatt

SEQ ID NO: 5413591 - DNA, 17 bp, Homo sapiens
gaacctattttcatttg

SEQ ID NO: 5413592 - DNA, 22 bp, Homo sapiens
gaacctattttcatttgtacaa

SEQ ID NO: 5413593 - DNA, 20 bp, Homo sapiens
gaacctcaaactaggaggaa

SEQ ID NO: 5413594 - DNA, 14 bp, Homo sapiens
gaacctcaaactgg

SEQ ID NO: 5413595 - DNA, 22 bp, Homo sapiens
gaacctcaagtctagaaaccag

SEQ ID NO: 5413596 - DNA, 22 bp, Homo sapiens
gaacctcaccccgaggccctgc

SEQ ID NO: 5413597 - DNA, 16 bp, Homo sapiens
gaacctcacgcacctc

SEQ ID NO: 5413598 - DNA, 20 bp, Homo sapiens
gaacctcacgcacctcccat

SEQ ID NO: 5413599 - DNA, 19 bp, Homo sapiens
gaacctcactcttgccaac

SEQ ID NO: 5413600 - DNA, 21 bp, Homo sapiens
gaacctcactcttgccaacct

SEQ ID NO: 5413601 - DNA, 12 bp, Homo sapiens
gaacctcagcct

SEQ ID NO: 5413602 - DNA, 17 bp, Homo sapiens
gaacctcagcctggcca

SEQ ID NO: 5413603 - DNA, 21 bp, Homo sapiens
gaacctcagcctggccagaca

SEQ ID NO: 5413604 - DNA, 14 bp, Homo sapiens
gaacctcagtttcc

SEQ ID NO: 5413605 - DNA, 18 bp, Homo sapiens
gaacctcattgctaccac

SEQ ID NO: 5413606 - DNA, 13 bp, Homo sapiens
gaacctcccaaat

SEQ ID NO: 5413607 - DNA, 17 bp, Homo sapiens
gaacctccccagcctgc

SEQ ID NO: 5413608 - DNA, 18 bp, Homo sapiens
gaacctccccagcctgcg

SEQ ID NO: 5413609 - DNA, 22 bp, Homo sapiens
gaacctccccagcctgcgcctg

SEQ ID NO: 5413610 - DNA, 13 bp, Homo sapiens
gaacctcctctgt

SEQ ID NO: 5413611 - DNA, 16 bp, Homo sapiens
gaacctcctctgtgaa

SEQ ID NO: 5413612 - DNA, 17 bp, Homo sapiens
gaacctcgagtactgtg

SEQ ID NO: 5413613 - DNA, 12 bp, Homo sapiens
gaacctctgtct

SEQ ID NO: 5413614 - DNA, 14 bp, Homo sapiens
gaacctctgtctca

SEQ ID NO: 5413615 - DNA, 13 bp, Homo sapiens
gaacctcttcccc

SEQ ID NO: 5413616 - DNA, 17 bp, Homo sapiens
gaacctcttccccagaa

SEQ ID NO: 5413617 - DNA, 12 bp, Homo sapiens
gaacctgagcta

SEQ ID NO: 5413618 - DNA, 21 bp, Homo sapiens
gaacctgatacctgcctggga

SEQ ID NO: 5413619 - DNA, 15 bp, Homo sapiens
gaacctgatgagcaa

SEQ ID NO: 5413620 - DNA, 17 bp, Homo sapiens
gaacctgatgagcaaga

SEQ ID NO: 5413621 - DNA, 20 bp, Homo sapiens
gaacctgcaagccttctaaa

SEQ ID NO: 5413622 - DNA, 22 bp, Homo sapiens
gaacctgcacacaggacagcgg

SEQ ID NO: 5413623 - DNA, 20 bp, Homo sapiens
gaacctgcatttaagaacag

SEQ ID NO: 5413624 - DNA, 21 bp, Homo sapiens
gaacctgctctcggaggatgc

SEQ ID NO: 5413625 - DNA, 13 bp, Homo sapiens
gaacctgctcttc

SEQ ID NO: 5413626 - DNA, 16 bp, Homo sapiens
gaacctgctcttcatt

SEQ ID NO: 5413627 - DNA, 15 bp, Homo sapiens
gaacctgcttcctgg

SEQ ID NO: 5413628 - DNA, 18 bp, Homo sapiens
gaacctggaccaaagctg

SEQ ID NO: 5413629 - DNA, 12 bp, Homo sapiens
gaacctggagag

SEQ ID NO: 5413630 - DNA, 15 bp, Homo sapiens
gaacctggagagcta

SEQ ID NO: 5413631 - DNA, 15 bp, Homo sapiens
gaacctggagggcta

SEQ ID NO: 5413632 - DNA, 15 bp, Homo sapiens
gaacctggagttcct

SEQ ID NO: 5413633 - DNA, 11 bp, Homo sapiens
gaacctggatc

SEQ ID NO: 5413634 - DNA, 18 bp, Homo sapiens
gaacctggatccagcact

SEQ ID NO: 5413635 - DNA, 11 bp, Homo sapiens
gaacctggcag

SEQ ID NO: 5413636 - DNA, 16 bp, Homo sapiens
gaacctggcaggccct

SEQ ID NO: 5413637 - DNA, 18 bp, Homo sapiens
gaacctggcaggccctgc

SEQ ID NO: 5413638 - DNA, 14 bp, Homo sapiens
gaacctggccttca

SEQ ID NO: 5413639 - DNA, 23 bp, Homo sapiens
gaacctgggaaccatgaagctgg

SEQ ID NO: 5413640 - DNA, 13 bp, Homo sapiens
gaacctgggaagt

SEQ ID NO: 5413641 - DNA, 15 bp, Homo sapiens
gaacctgggaggcag

SEQ ID NO: 5413642 - DNA, 17 bp, Homo sapiens
gaacctggtggctggag

SEQ ID NO: 5413643 - DNA, 20 bp, Homo sapiens
gaacctgtccaacatgtttt

SEQ ID NO: 5413644 - DNA, 22 bp, Homo sapiens
gaacctgtctccattgtgtgat

SEQ ID NO: 5413645 - DNA, 18 bp, Homo sapiens
gaacctgtctcctcccag

SEQ ID NO: 5413646 - DNA, 21 bp, Homo sapiens
gaacctgtcttattaagactg

SEQ ID NO: 5413647 - DNA, 22 bp, Homo sapiens
gaacctgtcttattaagactgg

SEQ ID NO: 5413648 - DNA, 21 bp, Homo sapiens
gaaccttcccgtctgattgtt

SEQ ID NO: 5413649 - DNA, 18 bp, Homo sapiens
gaaccttctggcctccca

SEQ ID NO: 5413650 - DNA, 17 bp, Homo sapiens
gaaccttgaggggctag

SEQ ID NO: 5413651 - DNA, 13 bp, Homo sapiens
gaaccttgctgtc

SEQ ID NO: 5413652 - DNA, 18 bp, Homo sapiens
gaaccttgtcccagccag

SEQ ID NO: 5413653 - DNA, 21 bp, Homo sapiens
gaaccttgtcccagccagtga

SEQ ID NO: 5413654 - DNA, 14 bp, Homo sapiens
gaaccttgtgcctg

SEQ ID NO: 5413655 - DNA, 17 bp, Homo sapiens
gaaccttgtgcctggct

SEQ ID NO: 5413656 - DNA, 19 bp, Homo sapiens
gaaccttgtgcctggctca

SEQ ID NO: 5413657 - DNA, 22 bp, Homo sapiens
gaaccttgttgatgccagctgt

SEQ ID NO: 5413658 - DNA, 13 bp, Homo sapiens
gaacctttcaaaa

SEQ ID NO: 5413659 - DNA, 15 bp, Homo sapiens
gaacctttcccttgt

SEQ ID NO: 5413660 - DNA, 16 bp, Homo sapiens
gaacctttcccttgtg

SEQ ID NO: 5413661 - DNA, 20 bp, Homo sapiens
gaacctttggacaagaggaa

SEQ ID NO: 5413662 - DNA, 13 bp, Homo sapiens
gaacctttgtcaa

SEQ ID NO: 5413663 - DNA, 19 bp, Homo sapiens
gaacgaacacaagaaaaag

SEQ ID NO: 5413664 - DNA, 14 bp, Homo sapiens
gaacgagcagccca

SEQ ID NO: 5413665 - DNA, 22 bp, Homo sapiens
gaacgaggggaaagttctcaga

SEQ ID NO: 5413666 - DNA, 23 bp, Homo sapiens
gaacgcaagaggcatcccaagac

SEQ ID NO: 5413667 - DNA, 15 bp, Homo sapiens
gaacgcaccccactg

SEQ ID NO: 5413668 - DNA, 13 bp, Homo sapiens
gaacgcaggagaa

SEQ ID NO: 5413669 - DNA, 17 bp, Homo sapiens
gaacgcatgcagggccc

SEQ ID NO: 5413670 - DNA, 15 bp, Homo sapiens
gaacgccagtctccc

SEQ ID NO: 5413671 - DNA, 13 bp, Homo sapiens
gaacgccctgtgt

SEQ ID NO: 5413672 - DNA, 20 bp, Homo sapiens
gaacgcgtgtgtacacggga

SEQ ID NO: 5413673 - DNA, 16 bp, Homo sapiens
gaacgcgttgaaattg

SEQ ID NO: 5413674 - DNA, 14 bp, Homo sapiens
gaacgctctaggca

SEQ ID NO: 5413675 - DNA, 17 bp, Homo sapiens
gaacgctctaggcagaa

SEQ ID NO: 5413676 - DNA, 14 bp, Homo sapiens
gaacgctctcctcg

SEQ ID NO: 5413677 - DNA, 12 bp, Homo sapiens
gaacgcttgctc

SEQ ID NO: 5413678 - DNA, 23 bp, Homo sapiens
gaacggacgagataatgtgaact

SEQ ID NO: 5413679 - DNA, 22 bp, Homo sapiens
gaacggagccccaggcctctgt

SEQ ID NO: 5413680 - DNA, 15 bp, Homo sapiens
gaacggaggaggaca

SEQ ID NO: 5413681 - DNA, 22 bp, Homo sapiens
gaacggcatgtgaattctgtga

SEQ ID NO: 5413682 - DNA, 21 bp, Homo sapiens
gaacggccctgcaggagcagg

SEQ ID NO: 5413683 - DNA, 13 bp, Homo sapiens
gaacgggcagcca

SEQ ID NO: 5413684 - DNA, 16 bp, Homo sapiens
gaacgggcatgggcct

SEQ ID NO: 5413685 - DNA, 21 bp, Homo sapiens
gaacgggcatgggcctctctg

SEQ ID NO: 5413686 - DNA, 15 bp, Homo sapiens
gaacggggagaaaag

SEQ ID NO: 5413687 - DNA, 14 bp, Homo sapiens
gaacgtactttctg

SEQ ID NO: 5413688 - DNA, 22 bp, Homo sapiens
gaacgtactttctgttatcaag

SEQ ID NO: 5413689 - DNA, 15 bp, Homo sapiens
gaacgtatttctcca

SEQ ID NO: 5413690 - DNA, 14 bp, Homo sapiens
gaacgtgaataggc

SEQ ID NO: 5413691 - DNA, 22 bp, Homo sapiens
gaacgtgactgccccaactcct

SEQ ID NO: 5413692 - DNA, 15 bp, Homo sapiens
gaacttggaagcaca

SEQ ID NO: 5413693 - DNA, 22 bp, Homo sapiens
gaacttggacttctaaaggcgg

SEQ ID NO: 5413694 - DNA, 22 bp, Homo sapiens
gaacttggatattcaagccttt

SEQ ID NO: 5413695 - DNA, 15 bp, Homo sapiens
gaacttggcgctgcc

SEQ ID NO: 5413696 - DNA, 18 bp, Homo sapiens
gaacttggcgctgcccct

SEQ ID NO: 5413697 - DNA, 21 bp, Homo sapiens
gaacttggctttcctgtttct

SEQ ID NO: 5413698 - DNA, 22 bp, Homo sapiens
gaacttgtaaaggaatttaaaa

SEQ ID NO: 5413699 - DNA, 16 bp, Homo sapiens
gaacttgtagccagaa

SEQ ID NO: 5413700 - DNA, 14 bp, Homo sapiens
gaacttgtagctgt

SEQ ID NO: 5413701 - DNA, 15 bp, Homo sapiens
gaacttgtagctgta

SEQ ID NO: 5413702 - DNA, 15 bp, Homo sapiens
gaacttgtctcttca

SEQ ID NO: 5413703 - DNA, 20 bp, Homo sapiens
gaacttgtgtccctaatgtg

SEQ ID NO: 5413704 - DNA, 17 bp, Homo sapiens
gaacttgttgctgattt

SEQ ID NO: 5413705 - DNA, 15 bp, Homo sapiens
gaacttgttttctgg

SEQ ID NO: 5413706 - DNA, 15 bp, Homo sapiens
gaactttagtgaaac

SEQ ID NO: 5413707 - DNA, 17 bp, Homo sapiens
gaactttccaaaaccta

SEQ ID NO: 5413708 - DNA, 24 bp, Homo sapiens
gaactttccacattcagagcttac

SEQ ID NO: 5413709 - DNA, 12 bp, Homo sapiens
gaactttcctgg

SEQ ID NO: 5413710 - DNA, 19 bp, Homo sapiens
gaactttcggagcctgcct

SEQ ID NO: 5413711 - DNA, 16 bp, Homo sapiens
gaactttctggactcc

SEQ ID NO: 5413712 - DNA, 18 bp, Homo sapiens
gaactttctgttccctat

SEQ ID NO: 5413713 - DNA, 15 bp, Homo sapiens
gaactttgaagaccc

SEQ ID NO: 5413714 - DNA, 16 bp, Homo sapiens
gaactttgacctctgc

SEQ ID NO: 5413715 - DNA, 16 bp, Homo sapiens
gaactttgatacaaat

SEQ ID NO: 5413716 - DNA, 17 bp, Homo sapiens
gaactttgcacacttca

SEQ ID NO: 5413717 - DNA, 14 bp, Homo sapiens
gaactttgggaagc

SEQ ID NO: 5413718 - DNA, 23 bp, Homo sapiens
gaactttgtacagtggagaaata

SEQ ID NO: 5413719 - DNA, 12 bp, Homo sapiens
gaactttgtata

SEQ ID NO: 5413720 - DNA, 21 bp, Homo sapiens
gaactttgtatagttatgtaa

SEQ ID NO: 5413721 - DNA, 22 bp, Homo sapiens
gaactttgtgcttcaaggacat

SEQ ID NO: 5413722 - DNA, 16 bp, Homo sapiens
gaactttgtttccaga

SEQ ID NO: 5413723 - DNA, 17 bp, Homo sapiens
gaactttgtttccagaa

SEQ ID NO: 5413724 - DNA, 20 bp, Homo sapiens
gaacttttaaaagattatct

SEQ ID NO: 5413725 - DNA, 18 bp, Homo sapiens
gaacttttacagaatgca

SEQ ID NO: 5413726 - DNA, 23 bp, Homo sapiens
gaacttttacagaatgcattaaa

SEQ ID NO: 5413727 - DNA, 16 bp, Homo sapiens
gaacttttcaaaataa

SEQ ID NO: 5413728 - DNA, 13 bp, Homo sapiens
gaacttttgtaat

SEQ ID NO: 5413729 - DNA, 15 bp, Homo sapiens
gaacttttgtaattt

SEQ ID NO: 5413730 - DNA, 21 bp, Homo sapiens
gaactttttatttgaggagac

SEQ ID NO: 5413731 - DNA, 14 bp, Homo sapiens
gaactttttcctgg

SEQ ID NO: 5413732 - DNA, 21 bp, Homo sapiens
gaacttttttcaaaattcaaa

SEQ ID NO: 5413733 - DNA, 16 bp, Homo sapiens
gaactttttttccccc

SEQ ID NO: 5413734 - DNA, 10 bp, Homo sapiens
gaagaaaaaa

SEQ ID NO: 5413735 - DNA, 14 bp, Homo sapiens
gaagaaaaaaatct

SEQ ID NO: 5413736 - DNA, 21 bp, Homo sapiens
gaagaaaaaaatcttctccag

SEQ ID NO: 5413737 - DNA, 19 bp, Homo sapiens
gaagaaaaagaagctgagg

SEQ ID NO: 5413738 - DNA, 21 bp, Homo sapiens
gaagaaaaagacctgcatttg

SEQ ID NO: 5413739 - DNA, 14 bp, Homo sapiens
gaagaaaacaaagt

SEQ ID NO: 5413740 - DNA, 16 bp, Homo sapiens
gaagaaaacaaagttc

SEQ ID NO: 5413741 - DNA, 17 bp, Homo sapiens
gaagaaaacactgttat

SEQ ID NO: 5413742 - DNA, 19 bp, Homo sapiens
gaagaaaacatgtctgtga

SEQ ID NO: 5413743 - DNA, 15 bp, Homo sapiens
gaagaaaacattttg

SEQ ID NO: 5413744 - DNA, 19 bp, Homo sapiens
gaagaaaacccgagggaca

SEQ ID NO: 5413745 - DNA, 11 bp, Homo sapiens
gaagaaaagac

SEQ ID NO: 5413746 - DNA, 17 bp, Homo sapiens
gaagaaaagagaagaag

SEQ ID NO: 5413747 - DNA, 15 bp, Homo sapiens
gaagaaaagattctt

SEQ ID NO: 5413748 - DNA, 20 bp, Homo sapiens
gaagaaaagtgggccagtgt

SEQ ID NO: 5413749 - DNA, 13 bp, Homo sapiens
gaagaaaagttat

SEQ ID NO: 5413750 - DNA, 13 bp, Homo sapiens
gaagaaaataacc

SEQ ID NO: 5413751 - DNA, 14 bp, Homo sapiens
gaagaaaataatta

SEQ ID NO: 5413752 - DNA, 21 bp, Homo sapiens
gaagaaaatagaattgacatt

SEQ ID NO: 5413753 - DNA, 19 bp, Homo sapiens
gaagaaaatggaattactc

SEQ ID NO: 5413754 - DNA, 20 bp, Homo sapiens
gaagaaacagctatgagagg

SEQ ID NO: 5413755 - DNA, 20 bp, Homo sapiens
gaagaaacaggggatcaaag

SEQ ID NO: 5413756 - DNA, 23 bp, Homo sapiens
gaagaaacaggggatcaaagttc

SEQ ID NO: 5413757 - DNA, 14 bp, Homo sapiens
gaagaaaccccaag

SEQ ID NO: 5413758 - DNA, 21 bp, Homo sapiens
gaagaaacccttccacgtgta

SEQ ID NO: 5413759 - DNA, 20 bp, Homo sapiens
gaagaaactccgaagaaaag

SEQ ID NO: 5413760 - DNA, 14 bp, Homo sapiens
gaagaaagaaaatg

SEQ ID NO: 5413761 - DNA, 16 bp, Homo sapiens
gaagaaagaaaatgga

SEQ ID NO: 5413762 - DNA, 22 bp, Homo sapiens
gaagaaagaaaatggaaagaag

SEQ ID NO: 5413763 - DNA, 19 bp, Homo sapiens
gaagaaagaacggaagaag

SEQ ID NO: 5413764 - DNA, 20 bp, Homo sapiens
gaagaaagaacggaagaaga

SEQ ID NO: 5413765 - DNA, 18 bp, Homo sapiens
gaagaaagaagcactctg

SEQ ID NO: 5413766 - DNA, 14 bp, Homo sapiens
gaagaaagactcct

SEQ ID NO: 5413767 - DNA, 17 bp, Homo sapiens
gaagaaagagactgtgg

SEQ ID NO: 5413768 - DNA, 12 bp, Homo sapiens
gaagaaagatgt

SEQ ID NO: 5413769 - DNA, 17 bp, Homo sapiens
gaagaaagatttgttac

SEQ ID NO: 5413770 - DNA, 12 bp, Homo sapiens
gaagaaagcaaa

SEQ ID NO: 5413771 - DNA, 18 bp, Homo sapiens
gaagaaagccctgtgctt

SEQ ID NO: 5413772 - DNA, 14 bp, Homo sapiens
gaagaaaggactga

SEQ ID NO: 5413773 - DNA, 22 bp, Homo sapiens
gaagaaaggcaaatctgacttt

SEQ ID NO: 5413774 - DNA, 17 bp, Homo sapiens
gaagaaagtctatgctt

SEQ ID NO: 5413775 - DNA, 13 bp, Homo sapiens
gaagaaagtgaaa

SEQ ID NO: 5413776 - DNA, 23 bp, Homo sapiens
gaagaaagtgttcaaattaaaaa

SEQ ID NO: 5413777 - DNA, 16 bp, Homo sapiens
gaagaaataaatgaaa

SEQ ID NO: 5413778 - DNA, 11 bp, Homo sapiens
gaagaaataca

SEQ ID NO: 5413779 - DNA, 15 bp, Homo sapiens
gaagaaatcacagaa

SEQ ID NO: 5413780 - DNA, 12 bp, Homo sapiens
gaagaaatccat

SEQ ID NO: 5413781 - DNA, 21 bp, Homo sapiens
gaagaaatggctatgaacaga

SEQ ID NO: 5413782 - DNA, 21 bp, Homo sapiens
gaagaaatgtagtttacattt

SEQ ID NO: 5413783 - DNA, 17 bp, Homo sapiens
gaagaaattaaggaaca

SEQ ID NO: 5413784 - DNA, 18 bp, Homo sapiens
gaagaaattaaggaacat

SEQ ID NO: 5413785 - DNA, 21 bp, Homo sapiens
gaagaaattcaggtacagaaa

SEQ ID NO: 5413786 - DNA, 18 bp, Homo sapiens
gaagaaattcctgtagca

SEQ ID NO: 5413787 - DNA, 14 bp, Homo sapiens
gaagaacaaatcta

SEQ ID NO: 5413788 - DNA, 16 bp, Homo sapiens
gaagaacaagaaatgg

SEQ ID NO: 5413789 - DNA, 16 bp, Homo sapiens
gaagaacacagcatgt

SEQ ID NO: 5413790 - DNA, 22 bp, Homo sapiens
gaagaacacagcatgtgccaag

SEQ ID NO: 5413791 - DNA, 23 bp, Homo sapiens
gaagaacacagcatgtgccaaga

SEQ ID NO: 5413792 - DNA, 22 bp, Homo sapiens
gaagaacagccccggggccccc

SEQ ID NO: 5413793 - DNA, 10 bp, Homo sapiens
gaagaacatc

SEQ ID NO: 5413794 - DNA, 13 bp, Homo sapiens
gaagaacatcaag

SEQ ID NO: 5413795 - DNA, 20 bp, Homo sapiens
gaagaacatccaaggagaaa

SEQ ID NO: 5413796 - DNA, 12 bp, Homo sapiens
gaagaacatgaa

SEQ ID NO: 5413797 - DNA, 15 bp, Homo sapiens
gaagaacattattca

SEQ ID NO: 5413798 - DNA, 16 bp, Homo sapiens
gaagaaccaaatacct

SEQ ID NO: 5413799 - DNA, 14 bp, Homo sapiens
gaagaaccagccca

SEQ ID NO: 5413800 - DNA, 16 bp, Homo sapiens
gaagaaccagcccagc

SEQ ID NO: 5413801 - DNA, 20 bp, Homo sapiens
gaagaaccagcccagcctgc

SEQ ID NO: 5413802 - DNA, 22 bp, Homo sapiens
gaagaaccagcccagcctgccc

SEQ ID NO: 5413803 - DNA, 20 bp, Homo sapiens
gaagaaccctatttaaaact

SEQ ID NO: 5413804 - DNA, 14 bp, Homo sapiens
gaagaacccttctc

SEQ ID NO: 5413805 - DNA, 18 bp, Homo sapiens
gaagaaccgacccacccc

SEQ ID NO: 5413806 - DNA, 22 bp, Homo sapiens
gaagaacgaacacaagaaaaag

SEQ ID NO: 5413807 - DNA, 22 bp, Homo sapiens
gaagaacgttttttcctcagtg

SEQ ID NO: 5413808 - DNA, 20 bp, Homo sapiens
gaagaactagtagaagaagc

SEQ ID NO: 5413809 - DNA, 19 bp, Homo sapiens
gaagaactcaccagggttt

SEQ ID NO: 5413810 - DNA, 17 bp, Homo sapiens
gaagaactcatgtgatt

SEQ ID NO: 5413811 - DNA, 22 bp, Homo sapiens
gaagaactctctagttccctca

SEQ ID NO: 5413812 - DNA, 16 bp, Homo sapiens
gaagaactgacttcct

SEQ ID NO: 5413813 - DNA, 14 bp, Homo sapiens
gaagaactgcaggc

SEQ ID NO: 5413814 - DNA, 15 bp, Homo sapiens
gaagaactgcaggcc

SEQ ID NO: 5413815 - DNA, 15 bp, Homo sapiens
gaagaactgcatggg

SEQ ID NO: 5413816 - DNA, 17 bp, Homo sapiens
gaagaactgggtatgag

SEQ ID NO: 5413817 - DNA, 22 bp, Homo sapiens
gaagaactgtgtttcaagttca

SEQ ID NO: 5413818 - DNA, 14 bp, Homo sapiens
gaagaacttgaagt

SEQ ID NO: 5413819 - DNA, 17 bp, Homo sapiens
gaagaacttgaagtgaa

SEQ ID NO: 5413820 - DNA, 23 bp, Homo sapiens
gaagaacttgaagtgaacaaatt

SEQ ID NO: 5413821 - DNA, 16 bp, Homo sapiens
gaagaacttgcatgga

SEQ ID NO: 5413822 - DNA, 23 bp, Homo sapiens
gaagaactttgccttaagtttcc

SEQ ID NO: 5413823 - DNA, 13 bp, Homo sapiens
gaagaagaaaaaa

SEQ ID NO: 5413824 - DNA, 12 bp, Homo sapiens
gaagaagaaaag

SEQ ID NO: 5413825 - DNA, 14 bp, Homo sapiens
gaagaagaaaggac

SEQ ID NO: 5413826 - DNA, 18 bp, Homo sapiens
gaagaagaaccagcccag

SEQ ID NO: 5413827 - DNA, 19 bp, Homo sapiens
gaagaagaaccagcccagc

SEQ ID NO: 5413828 - DNA, 18 bp, Homo sapiens
gaagaagaaccaggcatg

SEQ ID NO: 5413829 - DNA, 13 bp, Homo sapiens
gaagaagaattta

SEQ ID NO: 5413830 - DNA, 18 bp, Homo sapiens
gaagaagacacattccta

SEQ ID NO: 5413831 - DNA, 20 bp, Homo sapiens
gaagaagacctctaggagga

SEQ ID NO: 5413832 - DNA, 14 bp, Homo sapiens
gaagaagagatgca

SEQ ID NO: 5413833 - DNA, 14 bp, Homo sapiens
gaagaagaggagga

SEQ ID NO: 5413834 - DNA, 22 bp, Homo sapiens
gaagaagagggagaggtggagc

SEQ ID NO: 5413835 - DNA, 21 bp, Homo sapiens
gaagaagcaccaatcatgaat

SEQ ID NO: 5413836 - DNA, 14 bp, Homo sapiens
gaagaagcagagag

SEQ ID NO: 5413837 - DNA, 16 bp, Homo sapiens
gaagaagccctgttct

SEQ ID NO: 5413838 - DNA, 12 bp, Homo sapiens
gaagaagcctgt

SEQ ID NO: 5413839 - DNA, 23 bp, Homo sapiens
gaagaagcctttgttcaggtctc

SEQ ID NO: 5413840 - DNA, 20 bp, Homo sapiens
gaagaagcgcggctaactta

SEQ ID NO: 5413841 - DNA, 14 bp, Homo sapiens
gaagaagctcctga

SEQ ID NO: 5413842 - DNA, 14 bp, Homo sapiens
gaagaagctgagga

SEQ ID NO: 5413843 - DNA, 14 bp, Homo sapiens
gaagaagctgggag

SEQ ID NO: 5413844 - DNA, 20 bp, Homo sapiens
gaagaagctgggagggaggg

SEQ ID NO: 5413845 - DNA, 16 bp, Homo sapiens
gaagaagcttaggcag

SEQ ID NO: 5413846 - DNA, 18 bp, Homo sapiens
gaagaagcttaggcaggg

SEQ ID NO: 5413847 - DNA, 18 bp, Homo sapiens
gaagaaggaaacggaagc

SEQ ID NO: 5413848 - DNA, 12 bp, Homo sapiens
gaagaaggaaat

SEQ ID NO: 5413849 - DNA, 21 bp, Homo sapiens
gaagaaggaaatgaatttctc

SEQ ID NO: 5413850 - DNA, 16 bp, Homo sapiens
gaagaaggactgaaga

SEQ ID NO: 5413851 - DNA, 18 bp, Homo sapiens
gaagaaggactgaagaaa

SEQ ID NO: 5413852 - DNA, 21 bp, Homo sapiens
gaagaaggactgaagaaaatc

SEQ ID NO: 5413853 - DNA, 13 bp, Homo sapiens
gaagaaggccaga

SEQ ID NO: 5413854 - DNA, 21 bp, Homo sapiens
gaagaagggaagccttttgca

SEQ ID NO: 5413855 - DNA, 14 bp, Homo sapiens
gaagaagggagaag

SEQ ID NO: 5413856 - DNA, 18 bp, Homo sapiens
gaagaaggggacaatggc

SEQ ID NO: 5413857 - DNA, 23 bp, Homo sapiens
gaagaagtaaactggatactgta

SEQ ID NO: 5413858 - DNA, 13 bp, Homo sapiens
gaagaagtatatt

SEQ ID NO: 5413859 - DNA, 12 bp, Homo sapiens
gaagaagtggga

SEQ ID NO: 5413860 - DNA, 14 bp, Homo sapiens
gaagaagtgggagc

SEQ ID NO: 5413861 - DNA, 15 bp, Homo sapiens
gaagaagtgggagca

SEQ ID NO: 5413862 - DNA, 14 bp, Homo sapiens
gaagaagttcttaa

SEQ ID NO: 5413863 - DNA, 16 bp, Homo sapiens
gaagaataaaaaagaa

SEQ ID NO: 5413864 - DNA, 20 bp, Homo sapiens
gaagaataagtcatggagcc

SEQ ID NO: 5413865 - DNA, 12 bp, Homo sapiens
gaagaataattt

SEQ ID NO: 5413866 - DNA, 15 bp, Homo sapiens
gaagaatacatcaga

SEQ ID NO: 5413867 - DNA, 16 bp, Homo sapiens
gaagaatacccaggaa

SEQ ID NO: 5413868 - DNA, 13 bp, Homo sapiens
gaagaatataaat

SEQ ID NO: 5413869 - DNA, 17 bp, Homo sapiens
gaagaatattcaggact

SEQ ID NO: 5413870 - DNA, 14 bp, Homo sapiens
gaagaatattgtat

SEQ ID NO: 5413871 - DNA, 14 bp, Homo sapiens
gaagattctatgtt

SEQ ID NO: 5413872 - DNA, 17 bp, Homo sapiens
gaagattctatgttaat

SEQ ID NO: 5413873 - DNA, 20 bp, Homo sapiens
gaagattctatgttaatatt

SEQ ID NO: 5413874 - DNA, 12 bp, Homo sapiens
gaagattctatt

SEQ ID NO: 5413875 - DNA, 17 bp, Homo sapiens
gaagattctcctgtgct

SEQ ID NO: 5413876 - DNA, 21 bp, Homo sapiens
gaagattcttcccattctcca

SEQ ID NO: 5413877 - DNA, 19 bp, Homo sapiens
gaagattggggacactcat

SEQ ID NO: 5413878 - DNA, 24 bp, Homo sapiens
gaagattggggacactcatattgc

SEQ ID NO: 5413879 - DNA, 12 bp, Homo sapiens
gaagatttacct

SEQ ID NO: 5413880 - DNA, 21 bp, Homo sapiens
gaagatttatgaacagaaata

SEQ ID NO: 5413881 - DNA, 15 bp, Homo sapiens
gaagatttgaaaaca

SEQ ID NO: 5413882 - DNA, 19 bp, Homo sapiens
gaagatttgacgttgttgt

SEQ ID NO: 5413883 - DNA, 22 bp, Homo sapiens
gaagatttgatgctggagaggt

SEQ ID NO: 5413884 - DNA, 22 bp, Homo sapiens
gaagatttgtctacttgctcca

SEQ ID NO: 5413885 - DNA, 17 bp, Homo sapiens
gaagattttcagtctag

SEQ ID NO: 5413886 - DNA, 20 bp, Homo sapiens
gaagattttcattgaggata

SEQ ID NO: 5413887 - DNA, 23 bp, Homo sapiens
gaagattttgaaatttttattaa

SEQ ID NO: 5413888 - DNA, 20 bp, Homo sapiens
gaagcaaaaacgaaagctgg

SEQ ID NO: 5413889 - DNA, 18 bp, Homo sapiens
gaagcaaaaattcacaaa

SEQ ID NO: 5413890 - DNA, 21 bp, Homo sapiens
gaagcaaacaagcttgatttt

SEQ ID NO: 5413891 - DNA, 22 bp, Homo sapiens
gaagcaaacacacagactctgt

SEQ ID NO: 5413892 - DNA, 13 bp, Homo sapiens
gaagcaaacacat

SEQ ID NO: 5413893 - DNA, 17 bp, Homo sapiens
gaagcaaacacattaag

SEQ ID NO: 5413894 - DNA, 17 bp, Homo sapiens
gaagcaaactaagcccc

SEQ ID NO: 5413895 - DNA, 15 bp, Homo sapiens
gaagcaaagagtgag

SEQ ID NO: 5413896 - DNA, 15 bp, Homo sapiens
gaagcaaagggggga

SEQ ID NO: 5413897 - DNA, 16 bp, Homo sapiens
gaagcaaaggggggag

SEQ ID NO: 5413898 - DNA, 17 bp, Homo sapiens
gaagcaaaggggggagg

SEQ ID NO: 5413899 - DNA, 18 bp, Homo sapiens
gaagcaaaggggggaggt

SEQ ID NO: 5413900 - DNA, 15 bp, Homo sapiens
gaagcaaagttcaac

SEQ ID NO: 5413901 - DNA, 16 bp, Homo sapiens
gaagcaaatatgtttg

SEQ ID NO: 5413902 - DNA, 16 bp, Homo sapiens
gaagcaacagaaaaaa

SEQ ID NO: 5413903 - DNA, 19 bp, Homo sapiens
gaagcaacagatagatgtt

SEQ ID NO: 5413904 - DNA, 15 bp, Homo sapiens
gaagcaacagcttca

SEQ ID NO: 5413905 - DNA, 22 bp, Homo sapiens
gaagcaacattttagctctatt

SEQ ID NO: 5413906 - DNA, 23 bp, Homo sapiens
gaagcaacccaaatgttcatcaa

SEQ ID NO: 5413907 - DNA, 20 bp, Homo sapiens
gaagcaacctcagtaattta

SEQ ID NO: 5413908 - DNA, 22 bp, Homo sapiens
gaagcaacctcagtaatttaga

SEQ ID NO: 5413909 - DNA, 19 bp, Homo sapiens
gaagcaacgtgttaattat

SEQ ID NO: 5413910 - DNA, 23 bp, Homo sapiens
gaagcaactaagttaataataat

SEQ ID NO: 5413911 - DNA, 14 bp, Homo sapiens
gaagcaactgtgaa

SEQ ID NO: 5413912 - DNA, 16 bp, Homo sapiens
gaagcaactgtgaatt

SEQ ID NO: 5413913 - DNA, 18 bp, Homo sapiens
gaagcaagacacgtggcc

SEQ ID NO: 5413914 - DNA, 19 bp, Homo sapiens
gaagcaagacacgtggcct

SEQ ID NO: 5413915 - DNA, 18 bp, Homo sapiens
gaagcaagacgtcctgga

SEQ ID NO: 5413916 - DNA, 23 bp, Homo sapiens
gaagcaagaggcaagctgaaatt

SEQ ID NO: 5413917 - DNA, 14 bp, Homo sapiens
gaagcaagcagggg

SEQ ID NO: 5413918 - DNA, 14 bp, Homo sapiens
gaagcaagccggca

SEQ ID NO: 5413919 - DNA, 14 bp, Homo sapiens
gaagcaagctggat

SEQ ID NO: 5413920 - DNA, 15 bp, Homo sapiens
gaagcaagctgtgtt

SEQ ID NO: 5413921 - DNA, 17 bp, Homo sapiens
gaagcaagctgtgttac

SEQ ID NO: 5413922 - DNA, 18 bp, Homo sapiens
gaagcaagctgtgttact

SEQ ID NO: 5413923 - DNA, 14 bp, Homo sapiens
gaagcaaggcggtg

SEQ ID NO: 5413924 - DNA, 14 bp, Homo sapiens
gaagcaaggctggg

SEQ ID NO: 5413925 - DNA, 13 bp, Homo sapiens
gaagcaagttcac

SEQ ID NO: 5413926 - DNA, 16 bp, Homo sapiens
gaagcaataaagctct

SEQ ID NO: 5413927 - DNA, 20 bp, Homo sapiens
gaagcaataactccaagcag

SEQ ID NO: 5413928 - DNA, 16 bp, Homo sapiens
gaagcaataggtagct

SEQ ID NO: 5413929 - DNA, 17 bp, Homo sapiens
gaagcaatctttgaaat

SEQ ID NO: 5413930 - DNA, 17 bp, Homo sapiens
gaagcaatttatatctt

SEQ ID NO: 5413931 - DNA, 13 bp, Homo sapiens
gaagcaatttgaa

SEQ ID NO: 5413932 - DNA, 15 bp, Homo sapiens
gaagcacaaaagaca

SEQ ID NO: 5413933 - DNA, 22 bp, Homo sapiens
gaagcacaccaatcttactttg

SEQ ID NO: 5413934 - DNA, 18 bp, Homo sapiens
gaagcacagaaaactaga

SEQ ID NO: 5413935 - DNA, 16 bp, Homo sapiens
gaagcacagctcctgc

SEQ ID NO: 5413936 - DNA, 17 bp, Homo sapiens
gaagcacagctcctgcc

SEQ ID NO: 5413937 - DNA, 18 bp, Homo sapiens
gaagcacagctcctgcca

SEQ ID NO: 5413938 - DNA, 20 bp, Homo sapiens
gaagcacagctcctgccagg

SEQ ID NO: 5413939 - DNA, 21 bp, Homo sapiens
gaagcacaggtccaaggctgg

SEQ ID NO: 5413940 - DNA, 19 bp, Homo sapiens
gaagcacatacggcagacc

SEQ ID NO: 5413941 - DNA, 15 bp, Homo sapiens
gaagcacatgcctct

SEQ ID NO: 5413942 - DNA, 17 bp, Homo sapiens
gaagcacatgcctctct

SEQ ID NO: 5413943 - DNA, 22 bp, Homo sapiens
gaagcacatgcctctctcaggc

SEQ ID NO: 5413944 - DNA, 14 bp, Homo sapiens
gaagcaccagcctc

SEQ ID NO: 5413945 - DNA, 16 bp, Homo sapiens
gaagcaccagcctcag

SEQ ID NO: 5413946 - DNA, 17 bp, Homo sapiens
gaagcaccagcctcagt

SEQ ID NO: 5413947 - DNA, 13 bp, Homo sapiens
gaagcaccccacc

SEQ ID NO: 5413948 - DNA, 16 bp, Homo sapiens
gaagcaccccaccaca

SEQ ID NO: 5413949 - DNA, 22 bp, Homo sapiens
gaagcacctactatgtgctggg

SEQ ID NO: 5413950 - DNA, 21 bp, Homo sapiens
gaagcacctatgaaagcaaca

SEQ ID NO: 5413951 - DNA, 18 bp, Homo sapiens
gaagcacgggggagtgag

SEQ ID NO: 5413952 - DNA, 19 bp, Homo sapiens
gaagcacgtggtaaaacac

SEQ ID NO: 5413953 - DNA, 17 bp, Homo sapiens
gaagcactaagactgct

SEQ ID NO: 5413954 - DNA, 16 bp, Homo sapiens
gaagcactctgctggc

SEQ ID NO: 5413955 - DNA, 19 bp, Homo sapiens
gaagcactctgctggcggg

SEQ ID NO: 5413956 - DNA, 16 bp, Homo sapiens
gaagcacttctgctgc

SEQ ID NO: 5413957 - DNA, 17 bp, Homo sapiens
gaagcacttctgctgca

SEQ ID NO: 5413958 - DNA, 19 bp, Homo sapiens
gaagcacttctgctgcatc

SEQ ID NO: 5413959 - DNA, 23 bp, Homo sapiens
gaagcactttgggattctttcca

SEQ ID NO: 5413960 - DNA, 14 bp, Homo sapiens
gaagcagaataaag

SEQ ID NO: 5413961 - DNA, 17 bp, Homo sapiens
gaagcagaataaagcaa

SEQ ID NO: 5413962 - DNA, 18 bp, Homo sapiens
gaagcagaataaagcaat

SEQ ID NO: 5413963 - DNA, 19 bp, Homo sapiens
gaagcagaataaagcaatt

SEQ ID NO: 5413964 - DNA, 23 bp, Homo sapiens
gaagcagaataaagcaattttcc

SEQ ID NO: 5413965 - DNA, 20 bp, Homo sapiens
gaagcagacttttcagaaga

SEQ ID NO: 5413966 - DNA, 22 bp, Homo sapiens
gaagcagagaccggacaagagc

SEQ ID NO: 5413967 - DNA, 14 bp, Homo sapiens
gaagcagagagatg

SEQ ID NO: 5413968 - DNA, 15 bp, Homo sapiens
gaagcagagagatgc

SEQ ID NO: 5413969 - DNA, 12 bp, Homo sapiens
gaagcagagcaa

SEQ ID NO: 5413970 - DNA, 22 bp, Homo sapiens
gaagcagagcaaaatgctcttg

SEQ ID NO: 5413971 - DNA, 13 bp, Homo sapiens
gaagcagagcact

SEQ ID NO: 5413972 - DNA, 13 bp, Homo sapiens
gaagcagagcctg

SEQ ID NO: 5413973 - DNA, 15 bp, Homo sapiens
gaagcagagcctggg

SEQ ID NO: 5413974 - DNA, 17 bp, Homo sapiens
gaagcagagcctggggt

SEQ ID NO: 5413975 - DNA, 22 bp, Homo sapiens
gaagcagaggaaggaaacatag

SEQ ID NO: 5413976 - DNA, 18 bp, Homo sapiens
gaagcagaggccctgccc

SEQ ID NO: 5413977 - DNA, 15 bp, Homo sapiens
gaagcagaggccttt

SEQ ID NO: 5413978 - DNA, 21 bp, Homo sapiens
gaagcagaggtcttcagggct

SEQ ID NO: 5413979 - DNA, 23 bp, Homo sapiens
gaagcagatgcaaagaggcaaga

SEQ ID NO: 5413980 - DNA, 18 bp, Homo sapiens
gaagcagcaacttgtcct

SEQ ID NO: 5413981 - DNA, 23 bp, Homo sapiens
gaagcagcaaggtgggggtcagg

SEQ ID NO: 5413982 - DNA, 13 bp, Homo sapiens
gaagcagcaatta

SEQ ID NO: 5413983 - DNA, 16 bp, Homo sapiens
gaagcagcactgtgag

SEQ ID NO: 5413984 - DNA, 12 bp, Homo sapiens
gaagcagcccct

SEQ ID NO: 5413985 - DNA, 20 bp, Homo sapiens
gaagcagcctcctaatttga

SEQ ID NO: 5413986 - DNA, 9 bp, Homo sapiens
gaagcagct

SEQ ID NO: 5413987 - DNA, 13 bp, Homo sapiens
gaagcagctctgc

SEQ ID NO: 5413988 - DNA, 14 bp, Homo sapiens
gaagcagctctgcc

SEQ ID NO: 5413989 - DNA, 15 bp, Homo sapiens
gaagcagctctgcct

SEQ ID NO: 5413990 - DNA, 16 bp, Homo sapiens
gaagcaggacctagag

SEQ ID NO: 5413991 - DNA, 12 bp, Homo sapiens
gaagcaggaggc

SEQ ID NO: 5413992 - DNA, 11 bp, Homo sapiens
gaagcaggagt

SEQ ID NO: 5413993 - DNA, 13 bp, Homo sapiens
gaagcaggcaggg

SEQ ID NO: 5413994 - DNA, 20 bp, Homo sapiens
gaagcagggaattcctgggg

SEQ ID NO: 5413995 - DNA, 15 bp, Homo sapiens
gaagcaggggtgggg

SEQ ID NO: 5413996 - DNA, 12 bp, Homo sapiens
gaagcaggtgtc

SEQ ID NO: 5413997 - DNA, 21 bp, Homo sapiens
gaagcaggtgtcctttcccct

SEQ ID NO: 5413998 - DNA, 17 bp, Homo sapiens
gaagcaggttaaatgtt

SEQ ID NO: 5413999 - DNA, 22 bp, Homo sapiens
gaagcaggttgaggggctcctg

SEQ ID NO: 5414000 - DNA, 23 bp, Homo sapiens
gaagcaggttgaggggctcctgg

SEQ ID NO: 5414001 - DNA, 13 bp, Homo sapiens
gaagcagtatttt

SEQ ID NO: 5414002 - DNA, 16 bp, Homo sapiens
gaagcagtgagccgca

SEQ ID NO: 5414003 - DNA, 16 bp, Homo sapiens
gaagcagtgcccaggt

SEQ ID NO: 5414004 - DNA, 18 bp, Homo sapiens
gaagcagtgcctcgaggc

SEQ ID NO: 5414005 - DNA, 19 bp, Homo sapiens
gaagcagtgcctcgaggca

SEQ ID NO: 5414006 - DNA, 20 bp, Homo sapiens
gaagcagtgcctcgaggcac

SEQ ID NO: 5414007 - DNA, 17 bp, Homo sapiens
gaagcagtgccttccat

SEQ ID NO: 5414008 - DNA, 23 bp, Homo sapiens
gaagcagtggggtaggctgctgc

SEQ ID NO: 5414009 - DNA, 17 bp, Homo sapiens
gaagcagtgtgtacttc

SEQ ID NO: 5414010 - DNA, 16 bp, Homo sapiens
gaagcagttggggccc

SEQ ID NO: 5414011 - DNA, 17 bp, Homo sapiens
gaagcagttggggccct

SEQ ID NO: 5414012 - DNA, 22 bp, Homo sapiens
gaagcagttgtaccaagtgaaa

SEQ ID NO: 5414013 - DNA, 14 bp, Homo sapiens
gaagcagttgtgtc

SEQ ID NO: 5414014 - DNA, 16 bp, Homo sapiens
gaagcagttgtgtcag

SEQ ID NO: 5414015 - DNA, 18 bp, Homo sapiens
gaagcagtttcagataaa

SEQ ID NO: 5414016 - DNA, 20 bp, Homo sapiens
gaagcatagctacaatttgt

SEQ ID NO: 5414017 - DNA, 17 bp, Homo sapiens
gaagcatagtgaacaca

SEQ ID NO: 5414018 - DNA, 23 bp, Homo sapiens
gaagcatccaaggaacttcatgc

SEQ ID NO: 5414019 - DNA, 15 bp, Homo sapiens
gaagcatcctcccca

SEQ ID NO: 5414020 - DNA, 18 bp, Homo sapiens
gaagcatcctccccacca

SEQ ID NO: 5414021 - DNA, 20 bp, Homo sapiens
gaagcatcctccccaccaga

SEQ ID NO: 5414022 - DNA, 13 bp, Homo sapiens
gaagcatctctga

SEQ ID NO: 5414023 - DNA, 14 bp, Homo sapiens
gaagcatctctgac

SEQ ID NO: 5414024 - DNA, 16 bp, Homo sapiens
gaagcatgaaaaagca

SEQ ID NO: 5414025 - DNA, 20 bp, Homo sapiens
gaagcatgaacgtggattgt

SEQ ID NO: 5414026 - DNA, 15 bp, Homo sapiens
gaagcatggctgtct

SEQ ID NO: 5414027 - DNA, 22 bp, Homo sapiens
gaagcatggctgtctgcacaga

SEQ ID NO: 5414028 - DNA, 14 bp, Homo sapiens
gaagcatgtttcat

SEQ ID NO: 5414029 - DNA, 16 bp, Homo sapiens
gaagcatgtttcatgt

SEQ ID NO: 5414030 - DNA, 18 bp, Homo sapiens
gaagcattaacttctctg

SEQ ID NO: 5414031 - DNA, 16 bp, Homo sapiens
gaagcattcagagagc

SEQ ID NO: 5414032 - DNA, 15 bp, Homo sapiens
gaagcattccttctt

SEQ ID NO: 5414033 - DNA, 18 bp, Homo sapiens
gaagcattccttctttga

SEQ ID NO: 5414034 - DNA, 21 bp, Homo sapiens
gaagcattgaaaacaaagaca

SEQ ID NO: 5414035 - DNA, 17 bp, Homo sapiens
gaagcattgcctggact

SEQ ID NO: 5414036 - DNA, 19 bp, Homo sapiens
gaagcattgcctggactga

SEQ ID NO: 5414037 - DNA, 22 bp, Homo sapiens
gaagcattggtttttttttgat

SEQ ID NO: 5414038 - DNA, 20 bp, Homo sapiens
gaagcattgtaaaataattc

SEQ ID NO: 5414039 - DNA, 15 bp, Homo sapiens
gaagcatttaaaaga

SEQ ID NO: 5414040 - DNA, 22 bp, Homo sapiens
gaagcatttgtattttgtgtga

SEQ ID NO: 5414041 - DNA, 13 bp, Homo sapiens
gaagcatttgttt

SEQ ID NO: 5414042 - DNA, 19 bp, Homo sapiens
gaagcatttgtttctactt

SEQ ID NO: 5414043 - DNA, 15 bp, Homo sapiens
gaagcattttataaa

SEQ ID NO: 5414044 - DNA, 17 bp, Homo sapiens
gaagcattttttataat

SEQ ID NO: 5414045 - DNA, 16 bp, Homo sapiens
gaagccaaagaaaaat

SEQ ID NO: 5414046 - DNA, 20 bp, Homo sapiens
gaagccaaaggcagctaaga

SEQ ID NO: 5414047 - DNA, 13 bp, Homo sapiens
gaagccaaatgaa

SEQ ID NO: 5414048 - DNA, 16 bp, Homo sapiens
gaagccaaatttatca

SEQ ID NO: 5414049 - DNA, 23 bp, Homo sapiens
gaaggaacccggtcccaggccgc

SEQ ID NO: 5414050 - DNA, 20 bp, Homo sapiens
gaaggaactctggcttccag

SEQ ID NO: 5414051 - DNA, 22 bp, Homo sapiens
gaaggaactctggcttccaggt

SEQ ID NO: 5414052 - DNA, 13 bp, Homo sapiens
gaaggaagacttt

SEQ ID NO: 5414053 - DNA, 16 bp, Homo sapiens
gaaggaagagaagaca

SEQ ID NO: 5414054 - DNA, 15 bp, Homo sapiens
gaaggaagagcaagc

SEQ ID NO: 5414055 - DNA, 11 bp, Homo sapiens
gaaggaagagg

SEQ ID NO: 5414056 - DNA, 18 bp, Homo sapiens
gaaggaagcaagccggca

SEQ ID NO: 5414057 - DNA, 18 bp, Homo sapiens
gaaggaagccctctcaga

SEQ ID NO: 5414058 - DNA, 23 bp, Homo sapiens
gaaggaaggagactcacctctgc

SEQ ID NO: 5414059 - DNA, 20 bp, Homo sapiens
gaaggaaggagccagctccc

SEQ ID NO: 5414060 - DNA, 16 bp, Homo sapiens
gaaggaaggaggcaga

SEQ ID NO: 5414061 - DNA, 16 bp, Homo sapiens
gaaggaaggagggcac

SEQ ID NO: 5414062 - DNA, 19 bp, Homo sapiens
gaaggaaggcagggaggag

SEQ ID NO: 5414063 - DNA, 19 bp, Homo sapiens
gaaggaaggcctgagcccc

SEQ ID NO: 5414064 - DNA, 18 bp, Homo sapiens
gaaggaagggacacacac

SEQ ID NO: 5414065 - DNA, 13 bp, Homo sapiens
gaaggaagggcag

SEQ ID NO: 5414066 - DNA, 23 bp, Homo sapiens
gaaggaaggggctatcctgggac

SEQ ID NO: 5414067 - DNA, 16 bp, Homo sapiens
gaaggaagtgaagagg

SEQ ID NO: 5414068 - DNA, 18 bp, Homo sapiens
gaaggaagttatctgctg

SEQ ID NO: 5414069 - DNA, 18 bp, Homo sapiens
gaaggaatgcaataaaga

SEQ ID NO: 5414070 - DNA, 14 bp, Homo sapiens
gaaggaatggtgct

SEQ ID NO: 5414071 - DNA, 18 bp, Homo sapiens
gaaggaatggtgcttggc

SEQ ID NO: 5414072 - DNA, 14 bp, Homo sapiens
gaaggaattacatt

SEQ ID NO: 5414073 - DNA, 15 bp, Homo sapiens
gaaggaattgacttc

SEQ ID NO: 5414074 - DNA, 16 bp, Homo sapiens
gaaggaatttgattgc

SEQ ID NO: 5414075 - DNA, 22 bp, Homo sapiens
gaaggaatttgattgctttgct

SEQ ID NO: 5414076 - DNA, 17 bp, Homo sapiens
gaaggaatttgggagga

SEQ ID NO: 5414077 - DNA, 18 bp, Homo sapiens
gaaggacaatcccaggaa

SEQ ID NO: 5414078 - DNA, 12 bp, Homo sapiens
gaaggacacagc

SEQ ID NO: 5414079 - DNA, 16 bp, Homo sapiens
gaaggacacagcagta

SEQ ID NO: 5414080 - DNA, 13 bp, Homo sapiens
gaaggacacagtg

SEQ ID NO: 5414081 - DNA, 17 bp, Homo sapiens
gaaggacacttcctgcc

SEQ ID NO: 5414082 - DNA, 18 bp, Homo sapiens
gaaggacacttcctgcct

SEQ ID NO: 5414083 - DNA, 15 bp, Homo sapiens
gaaggacagaaagga

SEQ ID NO: 5414084 - DNA, 17 bp, Homo sapiens
gaaggacagaaaggaga

SEQ ID NO: 5414085 - DNA, 16 bp, Homo sapiens
gaaggacaggaagctg

SEQ ID NO: 5414086 - DNA, 14 bp, Homo sapiens
gaaggacaggaccc

SEQ ID NO: 5414087 - DNA, 23 bp, Homo sapiens
gaaggacagtccctgctggggaa

SEQ ID NO: 5414088 - DNA, 21 bp, Homo sapiens
gaaggacatgagatcagggcc

SEQ ID NO: 5414089 - DNA, 19 bp, Homo sapiens
gaaggacattgcggacagc

SEQ ID NO: 5414090 - DNA, 16 bp, Homo sapiens
gaaggaccacatttta

SEQ ID NO: 5414091 - DNA, 15 bp, Homo sapiens
gaaggaccagtgaag

SEQ ID NO: 5414092 - DNA, 14 bp, Homo sapiens
gaaggaccccaggt

SEQ ID NO: 5414093 - DNA, 18 bp, Homo sapiens
gaaggaccctggctcttc

SEQ ID NO: 5414094 - DNA, 17 bp, Homo sapiens
gaaggaccctgtgccct

SEQ ID NO: 5414095 - DNA, 24 bp, Homo sapiens
gaaggaccttcactctaagatgtt

SEQ ID NO: 5414096 - DNA, 21 bp, Homo sapiens
gaaggactatgaaaagctaga

SEQ ID NO: 5414097 - DNA, 15 bp, Homo sapiens
gaaggactgaactcc

SEQ ID NO: 5414098 - DNA, 19 bp, Homo sapiens
gaaggactgaagaccagct

SEQ ID NO: 5414099 - DNA, 15 bp, Homo sapiens
gaaggactgacgaga

SEQ ID NO: 5414100 - DNA, 20 bp, Homo sapiens
gaaggactggccgtggctcc

SEQ ID NO: 5414101 - DNA, 12 bp, Homo sapiens
gaaggactggtg

SEQ ID NO: 5414102 - DNA, 12 bp, Homo sapiens
gaaggacttgac

SEQ ID NO: 5414103 - DNA, 13 bp, Homo sapiens
gaaggactttggc

SEQ ID NO: 5414104 - DNA, 13 bp, Homo sapiens
gaaggagaaagga

SEQ ID NO: 5414105 - DNA, 18 bp, Homo sapiens
gaaggagaaaggagccgg

SEQ ID NO: 5414106 - DNA, 16 bp, Homo sapiens
gaaggagaaggaagga

SEQ ID NO: 5414107 - DNA, 13 bp, Homo sapiens
gaaggagaatggc

SEQ ID NO: 5414108 - DNA, 13 bp, Homo sapiens
gaaggagacacag

SEQ ID NO: 5414109 - DNA, 12 bp, Homo sapiens
gaaggagacaga

SEQ ID NO: 5414110 - DNA, 15 bp, Homo sapiens
gaaggagacagagct

SEQ ID NO: 5414111 - DNA, 18 bp, Homo sapiens
gaaggagacaggcagagc

SEQ ID NO: 5414112 - DNA, 23 bp, Homo sapiens
gaaggagactcacctctgcctca

SEQ ID NO: 5414113 - DNA, 13 bp, Homo sapiens
gaaggagagaaag

SEQ ID NO: 5414114 - DNA, 21 bp, Homo sapiens
gaaggagagaaagtgggtgag

SEQ ID NO: 5414115 - DNA, 15 bp, Homo sapiens
gaaggagagaagggg

SEQ ID NO: 5414116 - DNA, 18 bp, Homo sapiens
gaaggagagaaggggagg

SEQ ID NO: 5414117 - DNA, 20 bp, Homo sapiens
gaaggagagcaagaaggaaa

SEQ ID NO: 5414118 - DNA, 17 bp, Homo sapiens
gaaggagagcccaggcc

SEQ ID NO: 5414119 - DNA, 16 bp, Homo sapiens
gaaggagagcctgctg

SEQ ID NO: 5414120 - DNA, 13 bp, Homo sapiens
gaaggagaggagt

SEQ ID NO: 5414121 - DNA, 15 bp, Homo sapiens
gaaggagaggagtgc

SEQ ID NO: 5414122 - DNA, 22 bp, Homo sapiens
gaaggagaggatttggctcgct

SEQ ID NO: 5414123 - DNA, 12 bp, Homo sapiens
gaaggagaggct

SEQ ID NO: 5414124 - DNA, 17 bp, Homo sapiens
gaaggagatagggaaaa

SEQ ID NO: 5414125 - DNA, 13 bp, Homo sapiens
gaaggagatgaat

SEQ ID NO: 5414126 - DNA, 17 bp, Homo sapiens
gaaggagatgaatagaa

SEQ ID NO: 5414127 - DNA, 19 bp, Homo sapiens
gaaggagatgaatagaaga

SEQ ID NO: 5414128 - DNA, 22 bp, Homo sapiens
gaaggagatgaatagaagaaag

SEQ ID NO: 5414129 - DNA, 23 bp, Homo sapiens
gaaggagatgtaatgacagagag

SEQ ID NO: 5414130 - DNA, 19 bp, Homo sapiens
gaaggagattccacacagg

SEQ ID NO: 5414131 - DNA, 15 bp, Homo sapiens
gaaggagattgtggg

SEQ ID NO: 5414132 - DNA, 16 bp, Homo sapiens
gaaggagattttaagg

SEQ ID NO: 5414133 - DNA, 15 bp, Homo sapiens
gaaggagcagtgtga

SEQ ID NO: 5414134 - DNA, 15 bp, Homo sapiens
gaaggagccagctcc

SEQ ID NO: 5414135 - DNA, 14 bp, Homo sapiens
gaaggagcccctga

SEQ ID NO: 5414136 - DNA, 18 bp, Homo sapiens
gaaggagcccctgagtcc

SEQ ID NO: 5414137 - DNA, 23 bp, Homo sapiens
gaaggagcccctgagtccgcctg

SEQ ID NO: 5414138 - DNA, 23 bp, Homo sapiens
gaaggagcctgcggctgctggca

SEQ ID NO: 5414139 - DNA, 14 bp, Homo sapiens
gaaggagcggcgcc

SEQ ID NO: 5414140 - DNA, 15 bp, Homo sapiens
gaaggagctcccagg

SEQ ID NO: 5414141 - DNA, 18 bp, Homo sapiens
gaaggagctgcctggacc

SEQ ID NO: 5414142 - DNA, 19 bp, Homo sapiens
gaaggaggaagggactggt

SEQ ID NO: 5414143 - DNA, 22 bp, Homo sapiens
gaaggaggaatgctggactgga

SEQ ID NO: 5414144 - DNA, 21 bp, Homo sapiens
gaaggaggaccctgaatttga

SEQ ID NO: 5414145 - DNA, 12 bp, Homo sapiens
gaaggaggagag

SEQ ID NO: 5414146 - DNA, 16 bp, Homo sapiens
gaaggaggagcctgtc

SEQ ID NO: 5414147 - DNA, 15 bp, Homo sapiens
gaaggaggccacctc

SEQ ID NO: 5414148 - DNA, 11 bp, Homo sapiens
gaaggaggcct

SEQ ID NO: 5414149 - DNA, 15 bp, Homo sapiens
gaaggagggacttgg

SEQ ID NO: 5414150 - DNA, 14 bp, Homo sapiens
gaaggagggagctg

SEQ ID NO: 5414151 - DNA, 13 bp, Homo sapiens
gaaggagggcaga

SEQ ID NO: 5414152 - DNA, 14 bp, Homo sapiens
gaaggagggcagag

SEQ ID NO: 5414153 - DNA, 16 bp, Homo sapiens
gaaggagggcagagcc

SEQ ID NO: 5414154 - DNA, 17 bp, Homo sapiens
gaaggagggcagagcca

SEQ ID NO: 5414155 - DNA, 20 bp, Homo sapiens
gaaggagggcagagccatgg

SEQ ID NO: 5414156 - DNA, 14 bp, Homo sapiens
gaaggaggggaagc

SEQ ID NO: 5414157 - DNA, 15 bp, Homo sapiens
gaaggaggggagcct

SEQ ID NO: 5414158 - DNA, 21 bp, Homo sapiens
gaaggaggggagcctttgggg

SEQ ID NO: 5414159 - DNA, 20 bp, Homo sapiens
gaaggagggtacagctgggc

SEQ ID NO: 5414160 - DNA, 19 bp, Homo sapiens
gaaggagggttagggaggg

SEQ ID NO: 5414161 - DNA, 23 bp, Homo sapiens
gaaggaggtcgtttatgtgtgca

SEQ ID NO: 5414162 - DNA, 15 bp, Homo sapiens
gaaggaggtgaggga

SEQ ID NO: 5414163 - DNA, 17 bp, Homo sapiens
gaaggaggtgagggatg

SEQ ID NO: 5414164 - DNA, 18 bp, Homo sapiens
gaaggagtacaaaacaat

SEQ ID NO: 5414165 - DNA, 14 bp, Homo sapiens
gaaggagtttaaaa

SEQ ID NO: 5414166 - DNA, 16 bp, Homo sapiens
gaaggagtttaaaagg

SEQ ID NO: 5414167 - DNA, 19 bp, Homo sapiens
gaaggatagcctcagccac

SEQ ID NO: 5414168 - DNA, 14 bp, Homo sapiens
gaaggatccaggaa

SEQ ID NO: 5414169 - DNA, 23 bp, Homo sapiens
gaaggatccatctttgtatattt

SEQ ID NO: 5414170 - DNA, 19 bp, Homo sapiens
gaaggatcccatgagctcc

SEQ ID NO: 5414171 - DNA, 21 bp, Homo sapiens
gaaggatcccatgagctcctt

SEQ ID NO: 5414172 - DNA, 16 bp, Homo sapiens
gaaggatgcagaagga

SEQ ID NO: 5414173 - DNA, 15 bp, Homo sapiens
gaaggatgctctttc

SEQ ID NO: 5414174 - DNA, 14 bp, Homo sapiens
gaaggatgctgtct

SEQ ID NO: 5414175 - DNA, 20 bp, Homo sapiens
gaaggatggatgagtcagac

SEQ ID NO: 5414176 - DNA, 19 bp, Homo sapiens
gaaggatgggggctcctgg

SEQ ID NO: 5414177 - DNA, 22 bp, Homo sapiens
gaaggatggttgtctcactgtt

SEQ ID NO: 5414178 - DNA, 18 bp, Homo sapiens
gaaggatgtccgttccag

SEQ ID NO: 5414179 - DNA, 23 bp, Homo sapiens
gaaggatgtccgttccaggagca

SEQ ID NO: 5414180 - DNA, 17 bp, Homo sapiens
gaaggattatggaaaaa

SEQ ID NO: 5414181 - DNA, 16 bp, Homo sapiens
gaaggattctgctggc

SEQ ID NO: 5414182 - DNA, 21 bp, Homo sapiens
gaaggattctgctggcctctg

SEQ ID NO: 5414183 - DNA, 13 bp, Homo sapiens
gaaggattgtaaa

SEQ ID NO: 5414184 - DNA, 19 bp, Homo sapiens
gaaggattttaaatgctgt

SEQ ID NO: 5414185 - DNA, 24 bp, Homo sapiens
gaaggattttaaatgctgtatgtc

SEQ ID NO: 5414186 - DNA, 12 bp, Homo sapiens
gaaggcaaaggc

SEQ ID NO: 5414187 - DNA, 15 bp, Homo sapiens
gaaggcaaaggcaga

SEQ ID NO: 5414188 - DNA, 21 bp, Homo sapiens
gaaggcaaaggcagaggaatt

SEQ ID NO: 5414189 - DNA, 18 bp, Homo sapiens
gaaggcaaatataagctg

SEQ ID NO: 5414190 - DNA, 14 bp, Homo sapiens
gaaggcaaatgact

SEQ ID NO: 5414191 - DNA, 18 bp, Homo sapiens
gaaggcaacttgaagaaa

SEQ ID NO: 5414192 - DNA, 16 bp, Homo sapiens
gaaggcaagattggaa

SEQ ID NO: 5414193 - DNA, 21 bp, Homo sapiens
gaaggcaagccaaccttagct

SEQ ID NO: 5414194 - DNA, 18 bp, Homo sapiens
gaaggcaagctggcagga

SEQ ID NO: 5414195 - DNA, 19 bp, Homo sapiens
gaaggcacaggtgtaaata

SEQ ID NO: 5414196 - DNA, 14 bp, Homo sapiens
gaaggcacccgccc

SEQ ID NO: 5414197 - DNA, 13 bp, Homo sapiens
gaaggcacctgct

SEQ ID NO: 5414198 - DNA, 15 bp, Homo sapiens
gaaggcacctgctcc

SEQ ID NO: 5414199 - DNA, 24 bp, Homo sapiens
gaaggcactaaaaagagctgtcct

SEQ ID NO: 5414200 - DNA, 20 bp, Homo sapiens
gaaggcagacagcaggcagc

SEQ ID NO: 5414201 - DNA, 15 bp, Homo sapiens
gaaggcagagaaagg

SEQ ID NO: 5414202 - DNA, 17 bp, Homo sapiens
gaaggcagagaaaggga

SEQ ID NO: 5414203 - DNA, 14 bp, Homo sapiens
gaaggcagagaaat

SEQ ID NO: 5414204 - DNA, 16 bp, Homo sapiens
gaaggcagaggctggc

SEQ ID NO: 5414205 - DNA, 17 bp, Homo sapiens
gaaggcagaggctggca

SEQ ID NO: 5414206 - DNA, 16 bp, Homo sapiens
gaaggcagccaccagc

SEQ ID NO: 5414207 - DNA, 13 bp, Homo sapiens
gaaggcaggaaga

SEQ ID NO: 5414208 - DNA, 20 bp, Homo sapiens
gaaggcaggagtgctgccct

SEQ ID NO: 5414209 - DNA, 13 bp, Homo sapiens
gaaggcaggcagg

SEQ ID NO: 5414210 - DNA, 20 bp, Homo sapiens
gaaggcagggagggcctggg

SEQ ID NO: 5414211 - DNA, 13 bp, Homo sapiens
gaaggcagggctc

SEQ ID NO: 5414212 - DNA, 19 bp, Homo sapiens
gaaggcagggctcctccct

SEQ ID NO: 5414213 - DNA, 22 bp, Homo sapiens
gaaggcagggctcctccctgga

SEQ ID NO: 5414214 - DNA, 22 bp, Homo sapiens
gaaggcagggggaaggtggggt

SEQ ID NO: 5414215 - DNA, 13 bp, Homo sapiens
gaaggcagtggca

SEQ ID NO: 5414216 - DNA, 17 bp, Homo sapiens
gaaggcatatttccaat

SEQ ID NO: 5414217 - DNA, 17 bp, Homo sapiens
gaaggcatcagtcccta

SEQ ID NO: 5414218 - DNA, 13 bp, Homo sapiens
gaaggcatggcgg

SEQ ID NO: 5414219 - DNA, 23 bp, Homo sapiens
gaaggcattggcatctgctttta

SEQ ID NO: 5414220 - DNA, 13 bp, Homo sapiens
gaaggccacatca

SEQ ID NO: 5414221 - DNA, 13 bp, Homo sapiens
gaaggccacatgt

SEQ ID NO: 5414222 - DNA, 13 bp, Homo sapiens
gaaggccacctgc

SEQ ID NO: 5414223 - DNA, 17 bp, Homo sapiens
gaaggccagagagggaa

SEQ ID NO: 5414224 - DNA, 16 bp, Homo sapiens
gaaggccagcccactg

SEQ ID NO: 5414225 - DNA, 16 bp, Homo sapiens
gaaggccatggggcag

SEQ ID NO: 5414226 - DNA, 13 bp, Homo sapiens
gaaggccattggg

SEQ ID NO: 5414227 - DNA, 16 bp, Homo sapiens
gaaggccattgggttt

SEQ ID NO: 5414228 - DNA, 23 bp, Homo sapiens
gaagtgttatttcatccagggaa

SEQ ID NO: 5414229 - DNA, 19 bp, Homo sapiens
gaagtgttcaagaaataaa

SEQ ID NO: 5414230 - DNA, 12 bp, Homo sapiens
gaagtgttcctg

SEQ ID NO: 5414231 - DNA, 18 bp, Homo sapiens
gaagtgttcctgtctcaa

SEQ ID NO: 5414232 - DNA, 15 bp, Homo sapiens
gaagtgttctctaga

SEQ ID NO: 5414233 - DNA, 13 bp, Homo sapiens
gaagtgttgcatg

SEQ ID NO: 5414234 - DNA, 18 bp, Homo sapiens
gaagtgttgcatggatgt

SEQ ID NO: 5414235 - DNA, 21 bp, Homo sapiens
gaagtgttgtggagaaaagag

SEQ ID NO: 5414236 - DNA, 22 bp, Homo sapiens
gaagtgttttcatattgcttct

SEQ ID NO: 5414237 - DNA, 13 bp, Homo sapiens
gaagttaaaatga

SEQ ID NO: 5414238 - DNA, 12 bp, Homo sapiens
gaagttaaaggg

SEQ ID NO: 5414239 - DNA, 15 bp, Homo sapiens
gaagttaaagggaag

SEQ ID NO: 5414240 - DNA, 14 bp, Homo sapiens
gaagttaaagtcaa

SEQ ID NO: 5414241 - DNA, 17 bp, Homo sapiens
gaagttaaagtcaatat

SEQ ID NO: 5414242 - DNA, 18 bp, Homo sapiens
gaagttacatgcataaaa

SEQ ID NO: 5414243 - DNA, 20 bp, Homo sapiens
gaagttacatgcataaaagg

SEQ ID NO: 5414244 - DNA, 13 bp, Homo sapiens
gaagttacctgga

SEQ ID NO: 5414245 - DNA, 15 bp, Homo sapiens
gaagttactttctta

SEQ ID NO: 5414246 - DNA, 16 bp, Homo sapiens
gaagttactttgtaat

SEQ ID NO: 5414247 - DNA, 13 bp, Homo sapiens
gaagttagaattc

SEQ ID NO: 5414248 - DNA, 18 bp, Homo sapiens
gaagttagagataattct

SEQ ID NO: 5414249 - DNA, 18 bp, Homo sapiens
gaagttagcctttatcta

SEQ ID NO: 5414250 - DNA, 17 bp, Homo sapiens
gaagttagctttaactt

SEQ ID NO: 5414251 - DNA, 15 bp, Homo sapiens
gaagttagtttgtat

SEQ ID NO: 5414252 - DNA, 19 bp, Homo sapiens
gaagttcaagtgatctttc

SEQ ID NO: 5414253 - DNA, 24 bp, Homo sapiens
gaagttcaccagccctgagccatg

SEQ ID NO: 5414254 - DNA, 15 bp, Homo sapiens
gaagttcaccattaa

SEQ ID NO: 5414255 - DNA, 20 bp, Homo sapiens
gaagttcatacctaagtact

SEQ ID NO: 5414256 - DNA, 23 bp, Homo sapiens
gaagttcatacctaagtactgta

SEQ ID NO: 5414257 - DNA, 14 bp, Homo sapiens
gaagttcatcttgc

SEQ ID NO: 5414258 - DNA, 13 bp, Homo sapiens
gaagttcatgaat

SEQ ID NO: 5414259 - DNA, 13 bp, Homo sapiens
gaagttcattttt

SEQ ID NO: 5414260 - DNA, 19 bp, Homo sapiens
gaagttccctgaaccttcc

SEQ ID NO: 5414261 - DNA, 17 bp, Homo sapiens
gaagttctccagcttca

SEQ ID NO: 5414262 - DNA, 13 bp, Homo sapiens
gaagttctgagcc

SEQ ID NO: 5414263 - DNA, 16 bp, Homo sapiens
gaagttcttaaagttt

SEQ ID NO: 5414264 - DNA, 14 bp, Homo sapiens
gaagttcttcaaga

SEQ ID NO: 5414265 - DNA, 17 bp, Homo sapiens
gaagttgaagtttagga

SEQ ID NO: 5414266 - DNA, 21 bp, Homo sapiens
gaagttgatatagaacagtgc

SEQ ID NO: 5414267 - DNA, 16 bp, Homo sapiens
gaagttgatctcccca

SEQ ID NO: 5414268 - DNA, 17 bp, Homo sapiens
gaagttgattcatattg

SEQ ID NO: 5414269 - DNA, 17 bp, Homo sapiens
gaagttgcaagactcga

SEQ ID NO: 5414270 - DNA, 18 bp, Homo sapiens
gaagttgccctccaggcc

SEQ ID NO: 5414271 - DNA, 18 bp, Homo sapiens
gaagttgctgagaaatgg

SEQ ID NO: 5414272 - DNA, 21 bp, Homo sapiens
gaagttgctgcttctcccagg

SEQ ID NO: 5414273 - DNA, 20 bp, Homo sapiens
gaagttggaagccattttct

SEQ ID NO: 5414274 - DNA, 16 bp, Homo sapiens
gaagttggacagcaaa

SEQ ID NO: 5414275 - DNA, 22 bp, Homo sapiens
gaagttggagtgagtgtggctc

SEQ ID NO: 5414276 - DNA, 17 bp, Homo sapiens
gaagttggcacatttca

SEQ ID NO: 5414277 - DNA, 15 bp, Homo sapiens
gaagttgggggaaag

SEQ ID NO: 5414278 - DNA, 16 bp, Homo sapiens
gaagttgtcctttctg

SEQ ID NO: 5414279 - DNA, 23 bp, Homo sapiens
gaagttgtgcaacggccagggtt

SEQ ID NO: 5414280 - DNA, 17 bp, Homo sapiens
gaagttgtggaggaggt

SEQ ID NO: 5414281 - DNA, 19 bp, Homo sapiens
gaagttgtggatttcagtt

SEQ ID NO: 5414282 - DNA, 20 bp, Homo sapiens
gaagttgtggatttcagttt

SEQ ID NO: 5414283 - DNA, 12 bp, Homo sapiens
gaagttgttagt

SEQ ID NO: 5414284 - DNA, 17 bp, Homo sapiens
gaagtttattattttca

SEQ ID NO: 5414285 - DNA, 16 bp, Homo sapiens
gaagtttatttgagaa

SEQ ID NO: 5414286 - DNA, 17 bp, Homo sapiens
gaagtttatttgagaaa

SEQ ID NO: 5414287 - DNA, 21 bp, Homo sapiens
gaagtttatttgagaaaatat

SEQ ID NO: 5414288 - DNA, 21 bp, Homo sapiens
gaagtttcaagttttaaagtt

SEQ ID NO: 5414289 - DNA, 22 bp, Homo sapiens
gaagtttcaagttttaaagttc

SEQ ID NO: 5414290 - DNA, 15 bp, Homo sapiens
gaagtttcatttatg

SEQ ID NO: 5414291 - DNA, 19 bp, Homo sapiens
gaagtttccagaaaagaag

SEQ ID NO: 5414292 - DNA, 13 bp, Homo sapiens
gaagtttgaacat

SEQ ID NO: 5414293 - DNA, 12 bp, Homo sapiens
gaagtttgaatg

SEQ ID NO: 5414294 - DNA, 20 bp, Homo sapiens
gaagtttgagatcagcctgg

SEQ ID NO: 5414295 - DNA, 15 bp, Homo sapiens
gaagtttgataaata

SEQ ID NO: 5414296 - DNA, 19 bp, Homo sapiens
gaagtttgatattaaagga

SEQ ID NO: 5414297 - DNA, 13 bp, Homo sapiens
gaagtttgcatct

SEQ ID NO: 5414298 - DNA, 17 bp, Homo sapiens
gaagttttacagcaagg

SEQ ID NO: 5414299 - DNA, 11 bp, Homo sapiens
gaagttttcaa

SEQ ID NO: 5414300 - DNA, 13 bp, Homo sapiens
gaagttttcagga

SEQ ID NO: 5414301 - DNA, 12 bp, Homo sapiens
gaagttttccta

SEQ ID NO: 5414302 - DNA, 14 bp, Homo sapiens
gaagtttttgtact

SEQ ID NO: 5414303 - DNA, 14 bp, Homo sapiens
gaagttttttctac

SEQ ID NO: 5414304 - DNA, 22 bp, Homo sapiens
gaataaaaaataaataaaatgg

SEQ ID NO: 5414305 - DNA, 23 bp, Homo sapiens
gaataaaaaataaataaaatgga

SEQ ID NO: 5414306 - DNA, 15 bp, Homo sapiens
gaataaaaaccctgt

SEQ ID NO: 5414307 - DNA, 19 bp, Homo sapiens
gaataaaaaggttggcctt

SEQ ID NO: 5414308 - DNA, 13 bp, Homo sapiens
gaataaaaagtga

SEQ ID NO: 5414309 - DNA, 16 bp, Homo sapiens
gaataaaaattccaga

SEQ ID NO: 5414310 - DNA, 18 bp, Homo sapiens
gaataaaaattgatgaga

SEQ ID NO: 5414311 - DNA, 18 bp, Homo sapiens
gaataaaacactcatccc

SEQ ID NO: 5414312 - DNA, 17 bp, Homo sapiens
gaataaaagctgtggaa

SEQ ID NO: 5414313 - DNA, 12 bp, Homo sapiens
gaataaaaggat

SEQ ID NO: 5414314 - DNA, 14 bp, Homo sapiens
gaataaaaggctgg

SEQ ID NO: 5414315 - DNA, 23 bp, Homo sapiens
gaataaaagttcctctcccttcc

SEQ ID NO: 5414316 - DNA, 14 bp, Homo sapiens
gaataaaatactct

SEQ ID NO: 5414317 - DNA, 14 bp, Homo sapiens
gaataaaatcctaa

SEQ ID NO: 5414318 - DNA, 20 bp, Homo sapiens
gaataaaatcctaagacaca

SEQ ID NO: 5414319 - DNA, 20 bp, Homo sapiens
gaataaaatctgctgcacct

SEQ ID NO: 5414320 - DNA, 21 bp, Homo sapiens
gaataaaattattttggattt

SEQ ID NO: 5414321 - DNA, 12 bp, Homo sapiens
gaataaacactt

SEQ ID NO: 5414322 - DNA, 18 bp, Homo sapiens
gaataaacagtgagcata

SEQ ID NO: 5414323 - DNA, 12 bp, Homo sapiens
gaataaacatca

SEQ ID NO: 5414324 - DNA, 14 bp, Homo sapiens
gaataaacatctgt

SEQ ID NO: 5414325 - DNA, 17 bp, Homo sapiens
gaataaacatctgtgtc

SEQ ID NO: 5414326 - DNA, 14 bp, Homo sapiens
gaataaacattaat

SEQ ID NO: 5414327 - DNA, 23 bp, Homo sapiens
gaataaacattaattttgtgcat

SEQ ID NO: 5414328 - DNA, 15 bp, Homo sapiens
gaataaaccaagaca

SEQ ID NO: 5414329 - DNA, 20 bp, Homo sapiens
gaataaaccggatcctgttg

SEQ ID NO: 5414330 - DNA, 18 bp, Homo sapiens
gaataaacgcagaagagg

SEQ ID NO: 5414331 - DNA, 20 bp, Homo sapiens
gaataaactccccagcgtat

SEQ ID NO: 5414332 - DNA, 13 bp, Homo sapiens
gaataaactgaat

SEQ ID NO: 5414333 - DNA, 21 bp, Homo sapiens
gaataaactgaatattttgga

SEQ ID NO: 5414334 - DNA, 11 bp, Homo sapiens
gaataaacttc

SEQ ID NO: 5414335 - DNA, 13 bp, Homo sapiens
gaataaacttcag

SEQ ID NO: 5414336 - DNA, 17 bp, Homo sapiens
gaataaacttcagcacc

SEQ ID NO: 5414337 - DNA, 13 bp, Homo sapiens
gaataaagaacat

SEQ ID NO: 5414338 - DNA, 13 bp, Homo sapiens
gaataaagaatac

SEQ ID NO: 5414339 - DNA, 18 bp, Homo sapiens
gaataaagaatacttgaa

SEQ ID NO: 5414340 - DNA, 14 bp, Homo sapiens
gaataaagacacct

SEQ ID NO: 5414341 - DNA, 11 bp, Homo sapiens
gaataaagcaa

SEQ ID NO: 5414342 - DNA, 21 bp, Homo sapiens
gaataaagcaattttccttga

SEQ ID NO: 5414343 - DNA, 16 bp, Homo sapiens
gaataaagcacgtgca

SEQ ID NO: 5414344 - DNA, 17 bp, Homo sapiens
gaataaagcagcctgat

SEQ ID NO: 5414345 - DNA, 16 bp, Homo sapiens
gaataaaggcagtttt

SEQ ID NO: 5414346 - DNA, 20 bp, Homo sapiens
gaataaaggcagttttctaa

SEQ ID NO: 5414347 - DNA, 13 bp, Homo sapiens
gaataaagtctga

SEQ ID NO: 5414348 - DNA, 14 bp, Homo sapiens
gaataaagtctgag

SEQ ID NO: 5414349 - DNA, 19 bp, Homo sapiens
gaataaagtctgagtgggc

SEQ ID NO: 5414350 - DNA, 16 bp, Homo sapiens
gaataaagtgcaaaca

SEQ ID NO: 5414351 - DNA, 17 bp, Homo sapiens
gaataaagttcctgtca

SEQ ID NO: 5414352 - DNA, 14 bp, Homo sapiens
gaataaagttctga

SEQ ID NO: 5414353 - DNA, 20 bp, Homo sapiens
gaataaagttctgttttctg

SEQ ID NO: 5414354 - DNA, 14 bp, Homo sapiens
gaataaagttgaag

SEQ ID NO: 5414355 - DNA, 22 bp, Homo sapiens
gaataaataaatgtatcttatt

SEQ ID NO: 5414356 - DNA, 21 bp, Homo sapiens
gaataaatatgcctctccttt

SEQ ID NO: 5414357 - DNA, 16 bp, Homo sapiens
gaataaatcatgactt

SEQ ID NO: 5414358 - DNA, 12 bp, Homo sapiens
gaataaatgaag

SEQ ID NO: 5414359 - DNA, 11 bp, Homo sapiens
gaataaatgtc

SEQ ID NO: 5414360 - DNA, 14 bp, Homo sapiens
gaataaatgttcaa

SEQ ID NO: 5414361 - DNA, 15 bp, Homo sapiens
gaataaatgttcaaa

SEQ ID NO: 5414362 - DNA, 12 bp, Homo sapiens
gaataaatgttt

SEQ ID NO: 5414363 - DNA, 13 bp, Homo sapiens
gaataaatgtttt

SEQ ID NO: 5414364 - DNA, 14 bp, Homo sapiens
gaataaatgtttta

SEQ ID NO: 5414365 - DNA, 20 bp, Homo sapiens
gaataaattcccaacttctc

SEQ ID NO: 5414366 - DNA, 18 bp, Homo sapiens
gaataaattccttcaacg

SEQ ID NO: 5414367 - DNA, 18 bp, Homo sapiens
gaataaattggattattt

SEQ ID NO: 5414368 - DNA, 20 bp, Homo sapiens
gaataaattgtacagccggc

SEQ ID NO: 5414369 - DNA, 14 bp, Homo sapiens
gaataaattttcaa

SEQ ID NO: 5414370 - DNA, 18 bp, Homo sapiens
gaataaattttcaaatcc

SEQ ID NO: 5414371 - DNA, 16 bp, Homo sapiens
gaataacaacaattta

SEQ ID NO: 5414372 - DNA, 16 bp, Homo sapiens
gaataacactgcagcc

SEQ ID NO: 5414373 - DNA, 16 bp, Homo sapiens
gaataacatttaaatt

SEQ ID NO: 5414374 - DNA, 15 bp, Homo sapiens
gaataacattttcta

SEQ ID NO: 5414375 - DNA, 15 bp, Homo sapiens
gaataacctttctgg

SEQ ID NO: 5414376 - DNA, 21 bp, Homo sapiens
gaataactctgtggcattatt

SEQ ID NO: 5414377 - DNA, 21 bp, Homo sapiens
gaataacttgctactcatggc

SEQ ID NO: 5414378 - DNA, 11 bp, Homo sapiens
gaataagaaaa

SEQ ID NO: 5414379 - DNA, 19 bp, Homo sapiens
gaataagagtgattagagc

SEQ ID NO: 5414380 - DNA, 15 bp, Homo sapiens
gaataagcagaacat

SEQ ID NO: 5414381 - DNA, 23 bp, Homo sapiens
gaataagcagaacatactgttct

SEQ ID NO: 5414382 - DNA, 12 bp, Homo sapiens
gaataaggagga

SEQ ID NO: 5414383 - DNA, 19 bp, Homo sapiens
gaataaggaggaggaggga

SEQ ID NO: 5414384 - DNA, 23 bp, Homo sapiens
gaataaggaggaggagggagaag

SEQ ID NO: 5414385 - DNA, 20 bp, Homo sapiens
gaataaggtacaagaagcat

SEQ ID NO: 5414386 - DNA, 13 bp, Homo sapiens
gaataagtattct

SEQ ID NO: 5414387 - DNA, 20 bp, Homo sapiens
gaataagtgccaggatggaa

SEQ ID NO: 5414388 - DNA, 19 bp, Homo sapiens
gaataagtgctgtttgaga

SEQ ID NO: 5414389 - DNA, 12 bp, Homo sapiens
gaataagttatt

SEQ ID NO: 5414390 - DNA, 19 bp, Homo sapiens
gaataagttattgcagttt

SEQ ID NO: 5414391 - DNA, 22 bp, Homo sapiens
gaataataaaatcaaaaacttt

SEQ ID NO: 5414392 - DNA, 17 bp, Homo sapiens
gaataatacagtatctc

SEQ ID NO: 5414393 - DNA, 18 bp, Homo sapiens
gaataatacatactaatg

SEQ ID NO: 5414394 - DNA, 16 bp, Homo sapiens
gaataatacattgaat

SEQ ID NO: 5414395 - DNA, 15 bp, Homo sapiens
gaataatagaagaac

SEQ ID NO: 5414396 - DNA, 19 bp, Homo sapiens
gaataatatgctgccaaat

SEQ ID NO: 5414397 - DNA, 23 bp, Homo sapiens
gaataatctcatccccccacccg

SEQ ID NO: 5414398 - DNA, 22 bp, Homo sapiens
gaataatctttgggtaacttca

SEQ ID NO: 5414399 - DNA, 14 bp, Homo sapiens
gaataatgaatgga

SEQ ID NO: 5414400 - DNA, 21 bp, Homo sapiens
gaataatgccttgtatggtgt

SEQ ID NO: 5414401 - DNA, 16 bp, Homo sapiens
gaataatgcggacact

SEQ ID NO: 5414402 - DNA, 13 bp, Homo sapiens
gaataatggaaac

SEQ ID NO: 5414403 - DNA, 15 bp, Homo sapiens
gaataatggaaacat

SEQ ID NO: 5414404 - DNA, 16 bp, Homo sapiens
gaataatggaaacatt

SEQ ID NO: 5414405 - DNA, 14 bp, Homo sapiens
gaataatgtagtgc

SEQ ID NO: 5414406 - DNA, 18 bp, Homo sapiens
gaataatgtctagatttt

SEQ ID NO: 5414407 - DNA, 20 bp, Homo sapiens
gaataatgtctagattttga

SEQ ID NO: 5414408 - DNA, 16 bp, Homo sapiens
gaatcatttttgtagg

SEQ ID NO: 5414409 - DNA, 20 bp, Homo sapiens
gaatcatttttgtaggaagc

SEQ ID NO: 5414410 - DNA, 21 bp, Homo sapiens
gaatcatttttgtaggaagca

SEQ ID NO: 5414411 - DNA, 20 bp, Homo sapiens
gaatccaaactcaacaagtg

SEQ ID NO: 5414412 - DNA, 13 bp, Homo sapiens
gaatccaaacttg

SEQ ID NO: 5414413 - DNA, 14 bp, Homo sapiens
gaatccaaagtgga

SEQ ID NO: 5414414 - DNA, 17 bp, Homo sapiens
gaatccaaatctgtcct

SEQ ID NO: 5414415 - DNA, 19 bp, Homo sapiens
gaatccaaatctgtcctct

SEQ ID NO: 5414416 - DNA, 15 bp, Homo sapiens
gaatccaaatgtgaa

SEQ ID NO: 5414417 - DNA, 21 bp, Homo sapiens
gaatccaaatgtgaaagatgc

SEQ ID NO: 5414418 - DNA, 14 bp, Homo sapiens
gaatccaagcctcc

SEQ ID NO: 5414419 - DNA, 17 bp, Homo sapiens
gaatccaagcctccaca

SEQ ID NO: 5414420 - DNA, 20 bp, Homo sapiens
gaatccaagcctccacagcg

SEQ ID NO: 5414421 - DNA, 16 bp, Homo sapiens
gaatccaagcgaggtc

SEQ ID NO: 5414422 - DNA, 15 bp, Homo sapiens
gaatccaagctccct

SEQ ID NO: 5414423 - DNA, 12 bp, Homo sapiens
gaatccacctcg

SEQ ID NO: 5414424 - DNA, 14 bp, Homo sapiens
gaatccacctcgga

SEQ ID NO: 5414425 - DNA, 16 bp, Homo sapiens
gaatccacctcggagc

SEQ ID NO: 5414426 - DNA, 17 bp, Homo sapiens
gaatccacctgcagtta

SEQ ID NO: 5414427 - DNA, 15 bp, Homo sapiens
gaatccagaaggaag

SEQ ID NO: 5414428 - DNA, 16 bp, Homo sapiens
gaatccagaaggaagc

SEQ ID NO: 5414429 - DNA, 18 bp, Homo sapiens
gaatccagacccggctgc

SEQ ID NO: 5414430 - DNA, 13 bp, Homo sapiens
gaatccagctccc

SEQ ID NO: 5414431 - DNA, 19 bp, Homo sapiens
gaatccagtgtggctccca

SEQ ID NO: 5414432 - DNA, 21 bp, Homo sapiens
gaatccagtgtggctcccaca

SEQ ID NO: 5414433 - DNA, 16 bp, Homo sapiens
gaatccataaatgtgt

SEQ ID NO: 5414434 - DNA, 22 bp, Homo sapiens
gaatccatatttcaacagagcc

SEQ ID NO: 5414435 - DNA, 16 bp, Homo sapiens
gaatccatcaggactt

SEQ ID NO: 5414436 - DNA, 14 bp, Homo sapiens
gaatccatgggtct

SEQ ID NO: 5414437 - DNA, 20 bp, Homo sapiens
gaatccatgggtctggctag

SEQ ID NO: 5414438 - DNA, 22 bp, Homo sapiens
gaatcccacccccacttcatgc

SEQ ID NO: 5414439 - DNA, 21 bp, Homo sapiens
gaatcccacttatcaaatcat

SEQ ID NO: 5414440 - DNA, 19 bp, Homo sapiens
gaatcccagcagcagagaa

SEQ ID NO: 5414441 - DNA, 22 bp, Homo sapiens
gaatcccagcagcagagaacca

SEQ ID NO: 5414442 - DNA, 22 bp, Homo sapiens
gaatcccatggatgtttcttct

SEQ ID NO: 5414443 - DNA, 17 bp, Homo sapiens
gaatccccaagtgcctg

SEQ ID NO: 5414444 - DNA, 14 bp, Homo sapiens
gaatcccccttgcc

SEQ ID NO: 5414445 - DNA, 20 bp, Homo sapiens
gaatcccctatcccattctg

SEQ ID NO: 5414446 - DNA, 17 bp, Homo sapiens
gaatcccctccctgtca

SEQ ID NO: 5414447 - DNA, 13 bp, Homo sapiens
gaatcccctgggg

SEQ ID NO: 5414448 - DNA, 20 bp, Homo sapiens
gaatcccggctccagagcag

SEQ ID NO: 5414449 - DNA, 19 bp, Homo sapiens
gaatccctgggagcgcctg

SEQ ID NO: 5414450 - DNA, 17 bp, Homo sapiens
gaatccctgtgttaatt

SEQ ID NO: 5414451 - DNA, 14 bp, Homo sapiens
gaatccctgttcat

SEQ ID NO: 5414452 - DNA, 23 bp, Homo sapiens
gaatccctttctcacttttggaa

SEQ ID NO: 5414453 - DNA, 18 bp, Homo sapiens
gaatccgcctgcagagga

SEQ ID NO: 5414454 - DNA, 19 bp, Homo sapiens
gaatccgggctcccctttc

SEQ ID NO: 5414455 - DNA, 20 bp, Homo sapiens
gaatcctagcacttgtctca

SEQ ID NO: 5414456 - DNA, 15 bp, Homo sapiens
gaatcctagggcctg

SEQ ID NO: 5414457 - DNA, 22 bp, Homo sapiens
gaatcctatatagaatgctgca

SEQ ID NO: 5414458 - DNA, 19 bp, Homo sapiens
gaatcctatggaagagaat

SEQ ID NO: 5414459 - DNA, 14 bp, Homo sapiens
gaatcctcccttcc

SEQ ID NO: 5414460 - DNA, 16 bp, Homo sapiens
gaatcctcccttccca

SEQ ID NO: 5414461 - DNA, 16 bp, Homo sapiens
gaatcctctcctttct

SEQ ID NO: 5414462 - DNA, 19 bp, Homo sapiens
gaatcctgccacacatgct

SEQ ID NO: 5414463 - DNA, 20 bp, Homo sapiens
gaatcctgctcacaaaatca

SEQ ID NO: 5414464 - DNA, 19 bp, Homo sapiens
gaatcctgctgccagagaa

SEQ ID NO: 5414465 - DNA, 12 bp, Homo sapiens
gaatcctggcaa

SEQ ID NO: 5414466 - DNA, 14 bp, Homo sapiens
gaatcctggcagcc

SEQ ID NO: 5414467 - DNA, 17 bp, Homo sapiens
gaatcctggcagcccag

SEQ ID NO: 5414468 - DNA, 13 bp, Homo sapiens
gaatcctggctct

SEQ ID NO: 5414469 - DNA, 17 bp, Homo sapiens
gaatcctggctctgatt

SEQ ID NO: 5414470 - DNA, 17 bp, Homo sapiens
gaatcctgggcccccag

SEQ ID NO: 5414471 - DNA, 22 bp, Homo sapiens
gaatcctgtcgattagactgga

SEQ ID NO: 5414472 - DNA, 16 bp, Homo sapiens
gaatccttactgatat

SEQ ID NO: 5414473 - DNA, 15 bp, Homo sapiens
gaatccttatctata

SEQ ID NO: 5414474 - DNA, 16 bp, Homo sapiens
gaatccttccattcca

SEQ ID NO: 5414475 - DNA, 13 bp, Homo sapiens
gaatcctttgaga

SEQ ID NO: 5414476 - DNA, 14 bp, Homo sapiens
gaatcctttgcctg

SEQ ID NO: 5414477 - DNA, 13 bp, Homo sapiens
gaatccttttgta

SEQ ID NO: 5414478 - DNA, 14 bp, Homo sapiens
gaatcgaagtgttt

SEQ ID NO: 5414479 - DNA, 17 bp, Homo sapiens
gaatcgaagtgtttatg

SEQ ID NO: 5414480 - DNA, 20 bp, Homo sapiens
gaatcgaagtgtttatgtaa

SEQ ID NO: 5414481 - DNA, 16 bp, Homo sapiens
gaatcgaggaaccaga

SEQ ID NO: 5414482 - DNA, 19 bp, Homo sapiens
gaatcgaggaaccagagcc

SEQ ID NO: 5414483 - DNA, 16 bp, Homo sapiens
gaatcgatttcctccc

SEQ ID NO: 5414484 - DNA, 21 bp, Homo sapiens
gaatcgcttgaacccaggtgg

SEQ ID NO: 5414485 - DNA, 17 bp, Homo sapiens
gaatcgctttccttcct

SEQ ID NO: 5414486 - DNA, 18 bp, Homo sapiens
gaatcggctttgcagtgc

SEQ ID NO: 5414487 - DNA, 23 bp, Homo sapiens
gaatcgtccctatatcagggcct

SEQ ID NO: 5414488 - DNA, 13 bp, Homo sapiens
gaatctaaacgtg

SEQ ID NO: 5414489 - DNA, 20 bp, Homo sapiens
gaatctaagctgtttgccaa

SEQ ID NO: 5414490 - DNA, 21 bp, Homo sapiens
gaatctaagctgtttgccaag

SEQ ID NO: 5414491 - DNA, 22 bp, Homo sapiens
gaatctaaggataatgaaataa

SEQ ID NO: 5414492 - DNA, 16 bp, Homo sapiens
gaatctaagtgggaga

SEQ ID NO: 5414493 - DNA, 15 bp, Homo sapiens
gaatctacaagccaa

SEQ ID NO: 5414494 - DNA, 14 bp, Homo sapiens
gaatctacatttgt

SEQ ID NO: 5414495 - DNA, 22 bp, Homo sapiens
gaatctacatttgtttgtattc

SEQ ID NO: 5414496 - DNA, 16 bp, Homo sapiens
gaatctacccaaagga

SEQ ID NO: 5414497 - DNA, 17 bp, Homo sapiens
gaatctacccaaaggat

SEQ ID NO: 5414498 - DNA, 15 bp, Homo sapiens
gaatctactaattcc

SEQ ID NO: 5414499 - DNA, 17 bp, Homo sapiens
gaatctagaagaaatga

SEQ ID NO: 5414500 - DNA, 13 bp, Homo sapiens
gaatctagcccaa

SEQ ID NO: 5414501 - DNA, 20 bp, Homo sapiens
gaatctataagtagtaaatc

SEQ ID NO: 5414502 - DNA, 13 bp, Homo sapiens
gaatctatattta

SEQ ID NO: 5414503 - DNA, 17 bp, Homo sapiens
gaatctatatttaacaa

SEQ ID NO: 5414504 - DNA, 17 bp, Homo sapiens
gaatctatggctttaaa

SEQ ID NO: 5414505 - DNA, 15 bp, Homo sapiens
gaatctattatactg

SEQ ID NO: 5414506 - DNA, 18 bp, Homo sapiens
gaatctatttatcttcat

SEQ ID NO: 5414507 - DNA, 12 bp, Homo sapiens
gaatctattttc

SEQ ID NO: 5414508 - DNA, 15 bp, Homo sapiens
gaatctattttctat

SEQ ID NO: 5414509 - DNA, 18 bp, Homo sapiens
gaatctattttctatgta

SEQ ID NO: 5414510 - DNA, 19 bp, Homo sapiens
gaatctattttctatgtac

SEQ ID NO: 5414511 - DNA, 21 bp, Homo sapiens
gaatctattttctatgtacta

SEQ ID NO: 5414512 - DNA, 21 bp, Homo sapiens
gaatctcaacatgtctcctac

SEQ ID NO: 5414513 - DNA, 19 bp, Homo sapiens
gaatctcaagatgggggca

SEQ ID NO: 5414514 - DNA, 14 bp, Homo sapiens
gaatctcagagaca

SEQ ID NO: 5414515 - DNA, 18 bp, Homo sapiens
gaatctcataatttatac

SEQ ID NO: 5414516 - DNA, 13 bp, Homo sapiens
gaatctcatccct

SEQ ID NO: 5414517 - DNA, 16 bp, Homo sapiens
gaatctcatccctcaa

SEQ ID NO: 5414518 - DNA, 19 bp, Homo sapiens
gaatctcatccctcaactg

SEQ ID NO: 5414519 - DNA, 22 bp, Homo sapiens
gaatctcccaaggagggcacca

SEQ ID NO: 5414520 - DNA, 23 bp, Homo sapiens
gaatctcctttggaaggtgacac

SEQ ID NO: 5414521 - DNA, 17 bp, Homo sapiens
gaatctcgttcccaaag

SEQ ID NO: 5414522 - DNA, 18 bp, Homo sapiens
gaatctcgttgaggccaa

SEQ ID NO: 5414523 - DNA, 20 bp, Homo sapiens
gaatctcgttgaggccaagg

SEQ ID NO: 5414524 - DNA, 12 bp, Homo sapiens
gaatctctgagc

SEQ ID NO: 5414525 - DNA, 23 bp, Homo sapiens
gaatctctgcctagaatctttat

SEQ ID NO: 5414526 - DNA, 22 bp, Homo sapiens
gaatctctgcctctcccaggct

SEQ ID NO: 5414527 - DNA, 12 bp, Homo sapiens
gaatctcttcac

SEQ ID NO: 5414528 - DNA, 18 bp, Homo sapiens
gaatctcttcatgcttga

SEQ ID NO: 5414529 - DNA, 12 bp, Homo sapiens
gaatctctttcc

SEQ ID NO: 5414530 - DNA, 15 bp, Homo sapiens
gaatctcttttctgg

SEQ ID NO: 5414531 - DNA, 18 bp, Homo sapiens
gaatctgaaaagaacaac

SEQ ID NO: 5414532 - DNA, 16 bp, Homo sapiens
gaatctgaactgctct

SEQ ID NO: 5414533 - DNA, 14 bp, Homo sapiens
gaatctgaatgtaa

SEQ ID NO: 5414534 - DNA, 21 bp, Homo sapiens
gaatctgaggcatcctctgac

SEQ ID NO: 5414535 - DNA, 23 bp, Homo sapiens
gaatctgataccaaagagacagg

SEQ ID NO: 5414536 - DNA, 18 bp, Homo sapiens
gaatctgataggaaaaga

SEQ ID NO: 5414537 - DNA, 20 bp, Homo sapiens
gaatctgatcccataaagaa

SEQ ID NO: 5414538 - DNA, 21 bp, Homo sapiens
gaatctgatctttttatacac

SEQ ID NO: 5414539 - DNA, 22 bp, Homo sapiens
gaatctgatctttttatacaca

SEQ ID NO: 5414540 - DNA, 17 bp, Homo sapiens
gaatctgatttttatga

SEQ ID NO: 5414541 - DNA, 15 bp, Homo sapiens
gaatctgcaattcaa

SEQ ID NO: 5414542 - DNA, 21 bp, Homo sapiens
gaatctgcaattcaaaagttc

SEQ ID NO: 5414543 - DNA, 22 bp, Homo sapiens
gaatctgcaattcaaaagttcc

SEQ ID NO: 5414544 - DNA, 17 bp, Homo sapiens
gaatctgcagggagcaa

SEQ ID NO: 5414545 - DNA, 19 bp, Homo sapiens
gaatctgcagggagcaact

SEQ ID NO: 5414546 - DNA, 16 bp, Homo sapiens
gaatctgccttccagc

SEQ ID NO: 5414547 - DNA, 16 bp, Homo sapiens
gaatctgctcacttta

SEQ ID NO: 5414548 - DNA, 20 bp, Homo sapiens
gaatctgctgcatagctcta

SEQ ID NO: 5414549 - DNA, 12 bp, Homo sapiens
gaatctggagac

SEQ ID NO: 5414550 - DNA, 22 bp, Homo sapiens
gaatctggagaccagggagcct

SEQ ID NO: 5414551 - DNA, 12 bp, Homo sapiens
gaatctgggact

SEQ ID NO: 5414552 - DNA, 19 bp, Homo sapiens
gaatctgggactgtgcctg

SEQ ID NO: 5414553 - DNA, 13 bp, Homo sapiens
gaatctgtgcaaa

SEQ ID NO: 5414554 - DNA, 15 bp, Homo sapiens
gaatctgtgcagatg

SEQ ID NO: 5414555 - DNA, 13 bp, Homo sapiens
gaatctgtgcctg

SEQ ID NO: 5414556 - DNA, 19 bp, Homo sapiens
gaatctgtgggtctgggag

SEQ ID NO: 5414557 - DNA, 20 bp, Homo sapiens
gaatctgtgtgcatatttgt

SEQ ID NO: 5414558 - DNA, 16 bp, Homo sapiens
gaatctgttactgaaa

SEQ ID NO: 5414559 - DNA, 23 bp, Homo sapiens
gaatctgttactgaaatgaggag

SEQ ID NO: 5414560 - DNA, 15 bp, Homo sapiens
gaatctgtttctctg

SEQ ID NO: 5414561 - DNA, 21 bp, Homo sapiens
gaatcttaatcgatgaatgta

SEQ ID NO: 5414562 - DNA, 16 bp, Homo sapiens
gaatcttaatttatta

SEQ ID NO: 5414563 - DNA, 18 bp, Homo sapiens
gaatcttatggtggaaga

SEQ ID NO: 5414564 - DNA, 17 bp, Homo sapiens
gaatcttcctggcacaa

SEQ ID NO: 5414565 - DNA, 11 bp, Homo sapiens
gaatcttctca

SEQ ID NO: 5414566 - DNA, 21 bp, Homo sapiens
gaatcttctcatcttttatct

SEQ ID NO: 5414567 - DNA, 16 bp, Homo sapiens
gaatcttgactttctg

SEQ ID NO: 5414568 - DNA, 22 bp, Homo sapiens
gaatcttgctgcaggccctccc

SEQ ID NO: 5414569 - DNA, 22 bp, Homo sapiens
gaatcttgtctcaatgctcata

SEQ ID NO: 5414570 - DNA, 13 bp, Homo sapiens
gaatcttgttcaa

SEQ ID NO: 5414571 - DNA, 16 bp, Homo sapiens
gaatcttgttttgaaa

SEQ ID NO: 5414572 - DNA, 18 bp, Homo sapiens
gaatctttattgagaaag

SEQ ID NO: 5414573 - DNA, 20 bp, Homo sapiens
gaatctttccaataaaccag

SEQ ID NO: 5414574 - DNA, 15 bp, Homo sapiens
gaatctttctcctgg

SEQ ID NO: 5414575 - DNA, 13 bp, Homo sapiens
gaatctttcttct

SEQ ID NO: 5414576 - DNA, 19 bp, Homo sapiens
gaatctttgtaccaaaatt

SEQ ID NO: 5414577 - DNA, 12 bp, Homo sapiens
gaatgaaaaatg

SEQ ID NO: 5414578 - DNA, 13 bp, Homo sapiens
gaatgaaaaatga

SEQ ID NO: 5414579 - DNA, 19 bp, Homo sapiens
gaatgaaaaatttaagcat

SEQ ID NO: 5414580 - DNA, 23 bp, Homo sapiens
gaatgaaaaatttaagcattgtt

SEQ ID NO: 5414581 - DNA, 12 bp, Homo sapiens
gaatgaaaacaa

SEQ ID NO: 5414582 - DNA, 13 bp, Homo sapiens
gaatgaaaagttt

SEQ ID NO: 5414583 - DNA, 12 bp, Homo sapiens
gaatgaaaataa

SEQ ID NO: 5414584 - DNA, 20 bp, Homo sapiens
gaatgaaaataactgaattt

SEQ ID NO: 5414585 - DNA, 21 bp, Homo sapiens
gaatgaaaatacatctttttg

SEQ ID NO: 5414586 - DNA, 20 bp, Homo sapiens
gaattccttggagccactgg

SEQ ID NO: 5414587 - DNA, 20 bp, Homo sapiens
gaattcgtgttatgaatctg

SEQ ID NO: 5414588 - DNA, 21 bp, Homo sapiens
gaattctaattgtcagtgatt

SEQ ID NO: 5414589 - DNA, 23 bp, Homo sapiens
gaattctaattgtcagtgatttt

SEQ ID NO: 5414590 - DNA, 15 bp, Homo sapiens
gaattctaccctgga

SEQ ID NO: 5414591 - DNA, 17 bp, Homo sapiens
gaattctaccctggaaa

SEQ ID NO: 5414592 - DNA, 23 bp, Homo sapiens
gaattctaggcatcccaggggac

SEQ ID NO: 5414593 - DNA, 17 bp, Homo sapiens
gaattctagtgctgctg

SEQ ID NO: 5414594 - DNA, 13 bp, Homo sapiens
gaattctattttg

SEQ ID NO: 5414595 - DNA, 14 bp, Homo sapiens
gaattctattttgc

SEQ ID NO: 5414596 - DNA, 19 bp, Homo sapiens
gaattctctagtttgatta

SEQ ID NO: 5414597 - DNA, 13 bp, Homo sapiens
gaattctgaactt

SEQ ID NO: 5414598 - DNA, 14 bp, Homo sapiens
gaattctgaagttt

SEQ ID NO: 5414599 - DNA, 18 bp, Homo sapiens
gaattctgcaactagcca

SEQ ID NO: 5414600 - DNA, 14 bp, Homo sapiens
gaattctggaggaa

SEQ ID NO: 5414601 - DNA, 15 bp, Homo sapiens
gaattctggtcctgt

SEQ ID NO: 5414602 - DNA, 11 bp, Homo sapiens
gaattctgtat

SEQ ID NO: 5414603 - DNA, 22 bp, Homo sapiens
gaattctgtatagattagaatt

SEQ ID NO: 5414604 - DNA, 13 bp, Homo sapiens
gaattctgtgaag

SEQ ID NO: 5414605 - DNA, 14 bp, Homo sapiens
gaattctgttcatt

SEQ ID NO: 5414606 - DNA, 19 bp, Homo sapiens
gaattctgtttaattttca

SEQ ID NO: 5414607 - DNA, 12 bp, Homo sapiens
gaattcttacag

SEQ ID NO: 5414608 - DNA, 18 bp, Homo sapiens
gaattcttacagccaagt

SEQ ID NO: 5414609 - DNA, 19 bp, Homo sapiens
gaattcttacatgttttct

SEQ ID NO: 5414610 - DNA, 22 bp, Homo sapiens
gaattcttcaacagggaaaaca

SEQ ID NO: 5414611 - DNA, 20 bp, Homo sapiens
gaattcttccgggggaaggg

SEQ ID NO: 5414612 - DNA, 15 bp, Homo sapiens
gaattcttcctcctc

SEQ ID NO: 5414613 - DNA, 15 bp, Homo sapiens
gaattcttcctctcc

SEQ ID NO: 5414614 - DNA, 17 bp, Homo sapiens
gaattcttcctctcctt

SEQ ID NO: 5414615 - DNA, 21 bp, Homo sapiens
gaattcttcctctccttccca

SEQ ID NO: 5414616 - DNA, 14 bp, Homo sapiens
gaattcttctgcaa

SEQ ID NO: 5414617 - DNA, 17 bp, Homo sapiens
gaattcttgatctctaa

SEQ ID NO: 5414618 - DNA, 13 bp, Homo sapiens
gaattctttagat

SEQ ID NO: 5414619 - DNA, 23 bp, Homo sapiens
gaattctttagatttttaaattg

SEQ ID NO: 5414620 - DNA, 21 bp, Homo sapiens
gaattctttgcattccttact

SEQ ID NO: 5414621 - DNA, 13 bp, Homo sapiens
gaattgaaaaaca

SEQ ID NO: 5414622 - DNA, 22 bp, Homo sapiens
gaattgaaaagtttttgtttgg

SEQ ID NO: 5414623 - DNA, 13 bp, Homo sapiens
gaattgaaagaga

SEQ ID NO: 5414624 - DNA, 14 bp, Homo sapiens
gaattgaaatgagg

SEQ ID NO: 5414625 - DNA, 15 bp, Homo sapiens
gaattgaacccagga

SEQ ID NO: 5414626 - DNA, 14 bp, Homo sapiens
gaattgaactctct

SEQ ID NO: 5414627 - DNA, 14 bp, Homo sapiens
gaattgaagcagga

SEQ ID NO: 5414628 - DNA, 20 bp, Homo sapiens
gaattgaaggagaaaatgca

SEQ ID NO: 5414629 - DNA, 18 bp, Homo sapiens
gaattgaaggtttttgat

SEQ ID NO: 5414630 - DNA, 22 bp, Homo sapiens
gaattgaatcgctgcgatactg

SEQ ID NO: 5414631 - DNA, 15 bp, Homo sapiens
gaattgaatgctcta

SEQ ID NO: 5414632 - DNA, 18 bp, Homo sapiens
gaattgacattctctatt

SEQ ID NO: 5414633 - DNA, 13 bp, Homo sapiens
gaattgactgatt

SEQ ID NO: 5414634 - DNA, 20 bp, Homo sapiens
gaattgactgcagttgaaca

SEQ ID NO: 5414635 - DNA, 16 bp, Homo sapiens
gaattgacttcagcag

SEQ ID NO: 5414636 - DNA, 16 bp, Homo sapiens
gaattgagaaaagagt

SEQ ID NO: 5414637 - DNA, 14 bp, Homo sapiens
gaattgagctgcag

SEQ ID NO: 5414638 - DNA, 22 bp, Homo sapiens
gaattgaggggattaatatgaa

SEQ ID NO: 5414639 - DNA, 14 bp, Homo sapiens
gaattgagtaatgg

SEQ ID NO: 5414640 - DNA, 15 bp, Homo sapiens
gaattgagtgtttaa

SEQ ID NO: 5414641 - DNA, 14 bp, Homo sapiens
gaattgataaaaga

SEQ ID NO: 5414642 - DNA, 15 bp, Homo sapiens
gaattgataataaac

SEQ ID NO: 5414643 - DNA, 22 bp, Homo sapiens
gaattgattgggcacatcattt

SEQ ID NO: 5414644 - DNA, 14 bp, Homo sapiens
gaattgatttgcat

SEQ ID NO: 5414645 - DNA, 15 bp, Homo sapiens
gaattgatttgcatt

SEQ ID NO: 5414646 - DNA, 22 bp, Homo sapiens
gaattgatttgcattgaacaca

SEQ ID NO: 5414647 - DNA, 20 bp, Homo sapiens
gaattgcaaaactagacaaa

SEQ ID NO: 5414648 - DNA, 14 bp, Homo sapiens
gaattgcagtcatt

SEQ ID NO: 5414649 - DNA, 23 bp, Homo sapiens
gaattgcattttttaaaacaaga

SEQ ID NO: 5414650 - DNA, 17 bp, Homo sapiens
gaattgcccgtttccat

SEQ ID NO: 5414651 - DNA, 22 bp, Homo sapiens
gaattgcctgcagagagaagcc

SEQ ID NO: 5414652 - DNA, 15 bp, Homo sapiens
gaattgcgctcaggg

SEQ ID NO: 5414653 - DNA, 16 bp, Homo sapiens
gaattgcgctcagggg

SEQ ID NO: 5414654 - DNA, 19 bp, Homo sapiens
gaattgcgctcaggggctc

SEQ ID NO: 5414655 - DNA, 23 bp, Homo sapiens
gaattgctaattctgagggaatt

SEQ ID NO: 5414656 - DNA, 13 bp, Homo sapiens
gaattgctgctct

SEQ ID NO: 5414657 - DNA, 14 bp, Homo sapiens
gaattgctgctctc

SEQ ID NO: 5414658 - DNA, 22 bp, Homo sapiens
gaattgcttgaacccaggaggt

SEQ ID NO: 5414659 - DNA, 19 bp, Homo sapiens
gaattggaaagacttctca

SEQ ID NO: 5414660 - DNA, 19 bp, Homo sapiens
gaattggaatgcactcaga

SEQ ID NO: 5414661 - DNA, 15 bp, Homo sapiens
gaattggagaaaagc

SEQ ID NO: 5414662 - DNA, 16 bp, Homo sapiens
gaattggagctcgtgg

SEQ ID NO: 5414663 - DNA, 19 bp, Homo sapiens
gaattggcctgaacagatg

SEQ ID NO: 5414664 - DNA, 22 bp, Homo sapiens
gaattggcctgaacagatgtaa

SEQ ID NO: 5414665 - DNA, 18 bp, Homo sapiens
gaattggctgccaagagt

SEQ ID NO: 5414666 - DNA, 16 bp, Homo sapiens
gaattgggaagctggg

SEQ ID NO: 5414667 - DNA, 16 bp, Homo sapiens
gaattgggagcttggg

SEQ ID NO: 5414668 - DNA, 20 bp, Homo sapiens
gaattgggcccttagaatgt

SEQ ID NO: 5414669 - DNA, 17 bp, Homo sapiens
gaattgggcggctctga

SEQ ID NO: 5414670 - DNA, 12 bp, Homo sapiens
gaattgggtccc

SEQ ID NO: 5414671 - DNA, 20 bp, Homo sapiens
gaattgggtggggggcttca

SEQ ID NO: 5414672 - DNA, 17 bp, Homo sapiens
gaattggtcttaatgtt

SEQ ID NO: 5414673 - DNA, 20 bp, Homo sapiens
gaattggtcttaatgttgaa

SEQ ID NO: 5414674 - DNA, 23 bp, Homo sapiens
gaattggtcttaatgttgaatgt

SEQ ID NO: 5414675 - DNA, 15 bp, Homo sapiens
gaattggtttaaact

SEQ ID NO: 5414676 - DNA, 20 bp, Homo sapiens
gaattggtttaaacttttat

SEQ ID NO: 5414677 - DNA, 23 bp, Homo sapiens
gaattgtaaaagcaacatcagct

SEQ ID NO: 5414678 - DNA, 22 bp, Homo sapiens
gaattgtaaggaatgattaatt

SEQ ID NO: 5414679 - DNA, 17 bp, Homo sapiens
gaattgtacctatttct

SEQ ID NO: 5414680 - DNA, 16 bp, Homo sapiens
gaattgtagactgatg

SEQ ID NO: 5414681 - DNA, 12 bp, Homo sapiens
gaattgtatttt

SEQ ID NO: 5414682 - DNA, 20 bp, Homo sapiens
gaattgtattttttgttgaa

SEQ ID NO: 5414683 - DNA, 22 bp, Homo sapiens
gaattgtctctgggctgaggaa

SEQ ID NO: 5414684 - DNA, 22 bp, Homo sapiens
gaattgtgcgacttcacaaaat

SEQ ID NO: 5414685 - DNA, 16 bp, Homo sapiens
gaattgtgctcaaaat

SEQ ID NO: 5414686 - DNA, 18 bp, Homo sapiens
gaattgtgtattgatgca

SEQ ID NO: 5414687 - DNA, 22 bp, Homo sapiens
gaattgtgtattgatgcaatat

SEQ ID NO: 5414688 - DNA, 16 bp, Homo sapiens
gaattgtgtgatgttt

SEQ ID NO: 5414689 - DNA, 12 bp, Homo sapiens
gaattgtgtgga

SEQ ID NO: 5414690 - DNA, 18 bp, Homo sapiens
gaattgtgtggagaagtg

SEQ ID NO: 5414691 - DNA, 20 bp, Homo sapiens
gaattgttacctgtcatttt

SEQ ID NO: 5414692 - DNA, 15 bp, Homo sapiens
gaattgttagtttct

SEQ ID NO: 5414693 - DNA, 9 bp, Homo sapiens
gaattgttt

SEQ ID NO: 5414694 - DNA, 22 bp, Homo sapiens
gaattgtttagattttgtgttt

SEQ ID NO: 5414695 - DNA, 20 bp, Homo sapiens
gaattgttttctttaaagat

SEQ ID NO: 5414696 - DNA, 15 bp, Homo sapiens
gaattgtttttataa

SEQ ID NO: 5414697 - DNA, 22 bp, Homo sapiens
gaattgtttttgaatttaaata

SEQ ID NO: 5414698 - DNA, 15 bp, Homo sapiens
gaattgtttttgtac

SEQ ID NO: 5414699 - DNA, 12 bp, Homo sapiens
gaatttaaaaaa

SEQ ID NO: 5414700 - DNA, 14 bp, Homo sapiens
gaatttaaaactgt

SEQ ID NO: 5414701 - DNA, 21 bp, Homo sapiens
gaatttaaaattaagtagaac

SEQ ID NO: 5414702 - DNA, 22 bp, Homo sapiens
gaatttaaagaaaaaaatgtca

SEQ ID NO: 5414703 - DNA, 16 bp, Homo sapiens
gaatttaaataaagtt

SEQ ID NO: 5414704 - DNA, 17 bp, Homo sapiens
gaatttaaatataattc

SEQ ID NO: 5414705 - DNA, 20 bp, Homo sapiens
gaatttaaattctttttcaa

SEQ ID NO: 5414706 - DNA, 11 bp, Homo sapiens
gaatttaacaa

SEQ ID NO: 5414707 - DNA, 12 bp, Homo sapiens
gaatttaacaat

SEQ ID NO: 5414708 - DNA, 18 bp, Homo sapiens
gaatttaacaatgcgaat

SEQ ID NO: 5414709 - DNA, 18 bp, Homo sapiens
gaatttaagaaataactt

SEQ ID NO: 5414710 - DNA, 22 bp, Homo sapiens
gaatttaagcatgagtggcctt

SEQ ID NO: 5414711 - DNA, 22 bp, Homo sapiens
gaatttaagcctcaaatttgaa

SEQ ID NO: 5414712 - DNA, 19 bp, Homo sapiens
gaatttaagctgtaaatta

SEQ ID NO: 5414713 - DNA, 15 bp, Homo sapiens
gaatttaaggcaaaa

SEQ ID NO: 5414714 - DNA, 12 bp, Homo sapiens
gaatttaatata

SEQ ID NO: 5414715 - DNA, 16 bp, Homo sapiens
gaatttaatgctgaat

SEQ ID NO: 5414716 - DNA, 21 bp, Homo sapiens
gaatttaatgcttaaaaatgt

SEQ ID NO: 5414717 - DNA, 15 bp, Homo sapiens
gaatttaatggactg

SEQ ID NO: 5414718 - DNA, 23 bp, Homo sapiens
gaatttaatggactgtgaatttc

SEQ ID NO: 5414719 - DNA, 21 bp, Homo sapiens
gaatttaatttataggcagat

SEQ ID NO: 5414720 - DNA, 14 bp, Homo sapiens
gaatttaatttatg

SEQ ID NO: 5414721 - DNA, 19 bp, Homo sapiens
gaatttaccatcaaacaaa

SEQ ID NO: 5414722 - DNA, 11 bp, Homo sapiens
gaatttaccca

SEQ ID NO: 5414723 - DNA, 16 bp, Homo sapiens
gaatttacttccttgc

SEQ ID NO: 5414724 - DNA, 16 bp, Homo sapiens
gaatttactttcttca

SEQ ID NO: 5414725 - DNA, 21 bp, Homo sapiens
gaatttagaggataaataata

SEQ ID NO: 5414726 - DNA, 22 bp, Homo sapiens
gaatttagccctggtttgaaat

SEQ ID NO: 5414727 - DNA, 19 bp, Homo sapiens
gaatttagcttatacaatt

SEQ ID NO: 5414728 - DNA, 18 bp, Homo sapiens
gaatttaggataaagaat

SEQ ID NO: 5414729 - DNA, 19 bp, Homo sapiens
gaatttagggagaaatgtt

SEQ ID NO: 5414730 - DNA, 23 bp, Homo sapiens
gaatttaggggaaaaaaaagtta

SEQ ID NO: 5414731 - DNA, 19 bp, Homo sapiens
gaatttaggtttttattag

SEQ ID NO: 5414732 - DNA, 22 bp, Homo sapiens
gaatttagtgatactggctcag

SEQ ID NO: 5414733 - DNA, 20 bp, Homo sapiens
gaatttataaaaattaagtt

SEQ ID NO: 5414734 - DNA, 13 bp, Homo sapiens
gaatttataaccc

SEQ ID NO: 5414735 - DNA, 16 bp, Homo sapiens
gaatttataattcagt

SEQ ID NO: 5414736 - DNA, 13 bp, Homo sapiens
gaatttatataaa

SEQ ID NO: 5414737 - DNA, 16 bp, Homo sapiens
gaatttatataaagta

SEQ ID NO: 5414738 - DNA, 23 bp, Homo sapiens
gaatttatccaattttgatcttt

SEQ ID NO: 5414739 - DNA, 16 bp, Homo sapiens
gaatttatctttacca

SEQ ID NO: 5414740 - DNA, 17 bp, Homo sapiens
gaatttatctttaccaa

SEQ ID NO: 5414741 - DNA, 16 bp, Homo sapiens
gaatttatctttgata

SEQ ID NO: 5414742 - DNA, 18 bp, Homo sapiens
gaatttattagtttaaaa

SEQ ID NO: 5414743 - DNA, 17 bp, Homo sapiens
gaatttattcaattcct

SEQ ID NO: 5414744 - DNA, 13 bp, Homo sapiens
gaatttattggca

SEQ ID NO: 5414745 - DNA, 22 bp, Homo sapiens
gaatttattggcagccaaggaa

SEQ ID NO: 5414746 - DNA, 17 bp, Homo sapiens
gaatttcacctgtaaac

SEQ ID NO: 5414747 - DNA, 14 bp, Homo sapiens
gaatttcactgtct

SEQ ID NO: 5414748 - DNA, 21 bp, Homo sapiens
gaatttcaggcattttgttct

SEQ ID NO: 5414749 - DNA, 20 bp, Homo sapiens
gaatttcagtataaagatca

SEQ ID NO: 5414750 - DNA, 17 bp, Homo sapiens
gaatttcccaggaccct

SEQ ID NO: 5414751 - DNA, 20 bp, Homo sapiens
gaatttcccagtgaaataaa

SEQ ID NO: 5414752 - DNA, 14 bp, Homo sapiens
gaatttccctctct

SEQ ID NO: 5414753 - DNA, 17 bp, Homo sapiens
gaatttccctgtgtgga

SEQ ID NO: 5414754 - DNA, 14 bp, Homo sapiens
gaatttcctatctg

SEQ ID NO: 5414755 - DNA, 12 bp, Homo sapiens
gaatttcctgta

SEQ ID NO: 5414756 - DNA, 18 bp, Homo sapiens
gaatttccttactcttga

SEQ ID NO: 5414757 - DNA, 12 bp, Homo sapiens
gaatttctaaag

SEQ ID NO: 5414758 - DNA, 16 bp, Homo sapiens
gaatttctaaatgttg

SEQ ID NO: 5414759 - DNA, 22 bp, Homo sapiens
gaatttctaccagatgtgcttt

SEQ ID NO: 5414760 - DNA, 13 bp, Homo sapiens
gaatttctctaca

SEQ ID NO: 5414761 - DNA, 16 bp, Homo sapiens
gaatttctggaagaaa

SEQ ID NO: 5414762 - DNA, 17 bp, Homo sapiens
gaatttctggaagaaag

SEQ ID NO: 5414763 - DNA, 22 bp, Homo sapiens
gaatttctggaagattcttact

SEQ ID NO: 5414764 - DNA, 20 bp, Homo sapiens
gacaatgcagatgccagagc

SEQ ID NO: 5414765 - DNA, 17 bp, Homo sapiens
gacaatgccctgctggc

SEQ ID NO: 5414766 - DNA, 14 bp, Homo sapiens
gacaatgccttggg

SEQ ID NO: 5414767 - DNA, 18 bp, Homo sapiens
gacaatgcttatggaaag

SEQ ID NO: 5414768 - DNA, 19 bp, Homo sapiens
gacaatgcttatggaaagc

SEQ ID NO: 5414769 - DNA, 21 bp, Homo sapiens
gacaatgcttatggaaagcca

SEQ ID NO: 5414770 - DNA, 24 bp, Homo sapiens
gacaatggacctctcagcagaaac

SEQ ID NO: 5414771 - DNA, 18 bp, Homo sapiens
gacaatggctatattaat

SEQ ID NO: 5414772 - DNA, 20 bp, Homo sapiens
gacaatgtccaaacccactc

SEQ ID NO: 5414773 - DNA, 23 bp, Homo sapiens
gacaatgtggaattacataacag

SEQ ID NO: 5414774 - DNA, 13 bp, Homo sapiens
gacaatgtttaca

SEQ ID NO: 5414775 - DNA, 19 bp, Homo sapiens
gacaattaacatacatcat

SEQ ID NO: 5414776 - DNA, 16 bp, Homo sapiens
gacaattagaaaaaag

SEQ ID NO: 5414777 - DNA, 15 bp, Homo sapiens
gacaattatgaaaaa

SEQ ID NO: 5414778 - DNA, 13 bp, Homo sapiens
gacaattcatgaa

SEQ ID NO: 5414779 - DNA, 18 bp, Homo sapiens
gacaattcctccagagac

SEQ ID NO: 5414780 - DNA, 21 bp, Homo sapiens
gacaattcctccagagacact

SEQ ID NO: 5414781 - DNA, 15 bp, Homo sapiens
gacaattctaatggt

SEQ ID NO: 5414782 - DNA, 14 bp, Homo sapiens
gacaattctgggtg

SEQ ID NO: 5414783 - DNA, 15 bp, Homo sapiens
gacaattctgggtgc

SEQ ID NO: 5414784 - DNA, 22 bp, Homo sapiens
gacaattctttatacaacagtg

SEQ ID NO: 5414785 - DNA, 15 bp, Homo sapiens
gacaattgtcttttt

SEQ ID NO: 5414786 - DNA, 21 bp, Homo sapiens
gacaattgttttaatctgaaa

SEQ ID NO: 5414787 - DNA, 13 bp, Homo sapiens
gacaatttataat

SEQ ID NO: 5414788 - DNA, 18 bp, Homo sapiens
gacaatttcaaaatgcat

SEQ ID NO: 5414789 - DNA, 19 bp, Homo sapiens
gacaatttcaaaatgcatg

SEQ ID NO: 5414790 - DNA, 20 bp, Homo sapiens
gacaatttcaaaatgcatgt

SEQ ID NO: 5414791 - DNA, 16 bp, Homo sapiens
gacaatttgatacata

SEQ ID NO: 5414792 - DNA, 13 bp, Homo sapiens
gacaatttgcctt

SEQ ID NO: 5414793 - DNA, 15 bp, Homo sapiens
gacaattttgtctta

SEQ ID NO: 5414794 - DNA, 22 bp, Homo sapiens
gacaattttgtcttaagtgttt

SEQ ID NO: 5414795 - DNA, 20 bp, Homo sapiens
gacaattttttttcaaatgt

SEQ ID NO: 5414796 - DNA, 12 bp, Homo sapiens
gacacaaaagaa

SEQ ID NO: 5414797 - DNA, 15 bp, Homo sapiens
gacacaaacacacac

SEQ ID NO: 5414798 - DNA, 23 bp, Homo sapiens
gacacaaacaggaatgtctggag

SEQ ID NO: 5414799 - DNA, 18 bp, Homo sapiens
gacacaaacctgcctggg

SEQ ID NO: 5414800 - DNA, 15 bp, Homo sapiens
gacacaaactgccaa

SEQ ID NO: 5414801 - DNA, 18 bp, Homo sapiens
gacacaaataccagagca

SEQ ID NO: 5414802 - DNA, 14 bp, Homo sapiens
gacacaacaactcc

SEQ ID NO: 5414803 - DNA, 16 bp, Homo sapiens
gacacaaccactaatt

SEQ ID NO: 5414804 - DNA, 23 bp, Homo sapiens
gacacaaccactaatttgtcact

SEQ ID NO: 5414805 - DNA, 13 bp, Homo sapiens
gacacaagggtgc

SEQ ID NO: 5414806 - DNA, 22 bp, Homo sapiens
gacacaatatgtatgcttttta

SEQ ID NO: 5414807 - DNA, 16 bp, Homo sapiens
gacacaatccctgggg

SEQ ID NO: 5414808 - DNA, 23 bp, Homo sapiens
gacacaatctcagctcactgtga

SEQ ID NO: 5414809 - DNA, 17 bp, Homo sapiens
gacacaatgctgggtgg

SEQ ID NO: 5414810 - DNA, 18 bp, Homo sapiens
gacacaatggcacctctg

SEQ ID NO: 5414811 - DNA, 14 bp, Homo sapiens
gacacacaaagcag

SEQ ID NO: 5414812 - DNA, 22 bp, Homo sapiens
gacacacacacacacacacata

SEQ ID NO: 5414813 - DNA, 19 bp, Homo sapiens
gacacacacacgcacgcac

SEQ ID NO: 5414814 - DNA, 22 bp, Homo sapiens
gacacacacacgcacgcacaca

SEQ ID NO: 5414815 - DNA, 17 bp, Homo sapiens
gacacacacagactatt

SEQ ID NO: 5414816 - DNA, 13 bp, Homo sapiens
gacacacacagct

SEQ ID NO: 5414817 - DNA, 20 bp, Homo sapiens
gacacacactcaccagtggc

SEQ ID NO: 5414818 - DNA, 16 bp, Homo sapiens
gacacacactggctcc

SEQ ID NO: 5414819 - DNA, 23 bp, Homo sapiens
gacacacactggctcctggacct

SEQ ID NO: 5414820 - DNA, 15 bp, Homo sapiens
gacacacagaaatgt

SEQ ID NO: 5414821 - DNA, 14 bp, Homo sapiens
gacacacagctctg

SEQ ID NO: 5414822 - DNA, 21 bp, Homo sapiens
gacacacaggagtcctttctt

SEQ ID NO: 5414823 - DNA, 13 bp, Homo sapiens
gacacacatacat

SEQ ID NO: 5414824 - DNA, 15 bp, Homo sapiens
gacacacatatacat

SEQ ID NO: 5414825 - DNA, 16 bp, Homo sapiens
gacacacatatacatt

SEQ ID NO: 5414826 - DNA, 20 bp, Homo sapiens
gacacacatatacattattt

SEQ ID NO: 5414827 - DNA, 17 bp, Homo sapiens
gacacacattctgcctt

SEQ ID NO: 5414828 - DNA, 18 bp, Homo sapiens
gacacaccaggcgctaat

SEQ ID NO: 5414829 - DNA, 20 bp, Homo sapiens
gacacaccccacaccccagc

SEQ ID NO: 5414830 - DNA, 17 bp, Homo sapiens
gacacacctcacgcagg

SEQ ID NO: 5414831 - DNA, 21 bp, Homo sapiens
gacacacggggcacccagccc

SEQ ID NO: 5414832 - DNA, 18 bp, Homo sapiens
gacacacggggctcgggc

SEQ ID NO: 5414833 - DNA, 18 bp, Homo sapiens
gacacactaaactctggg

SEQ ID NO: 5414834 - DNA, 16 bp, Homo sapiens
gacacactacaccaca

SEQ ID NO: 5414835 - DNA, 19 bp, Homo sapiens
gacacactacaccacacac

SEQ ID NO: 5414836 - DNA, 22 bp, Homo sapiens
gacacactatcatagttaacat

SEQ ID NO: 5414837 - DNA, 22 bp, Homo sapiens
gacacactgtaaacccctgggt

SEQ ID NO: 5414838 - DNA, 13 bp, Homo sapiens
gacacagaattat

SEQ ID NO: 5414839 - DNA, 23 bp, Homo sapiens
gacacagacattttgtgtgagac

SEQ ID NO: 5414840 - DNA, 10 bp, Homo sapiens
gacacagacc

SEQ ID NO: 5414841 - DNA, 20 bp, Homo sapiens
gacacagacccacacatgtt

SEQ ID NO: 5414842 - DNA, 22 bp, Homo sapiens
gacacagaccggccgcatgtct

SEQ ID NO: 5414843 - DNA, 17 bp, Homo sapiens
gacacagactggcaata

SEQ ID NO: 5414844 - DNA, 19 bp, Homo sapiens
gacacagactggcaataaa

SEQ ID NO: 5414845 - DNA, 20 bp, Homo sapiens
gacacagactggcaataaac

SEQ ID NO: 5414846 - DNA, 21 bp, Homo sapiens
gacacagaggacggcttcccc

SEQ ID NO: 5414847 - DNA, 18 bp, Homo sapiens
gacacagaggctggcact

SEQ ID NO: 5414848 - DNA, 14 bp, Homo sapiens
gacacagagggccc

SEQ ID NO: 5414849 - DNA, 21 bp, Homo sapiens
gacacagatcccactggaaga

SEQ ID NO: 5414850 - DNA, 21 bp, Homo sapiens
gacacagatggcacctgtggc

SEQ ID NO: 5414851 - DNA, 14 bp, Homo sapiens
gacacagattatca

SEQ ID NO: 5414852 - DNA, 23 bp, Homo sapiens
gacacagatttcggtcataaaga

SEQ ID NO: 5414853 - DNA, 11 bp, Homo sapiens
gacacagcagc

SEQ ID NO: 5414854 - DNA, 21 bp, Homo sapiens
gacacagcagcttcaccagag

SEQ ID NO: 5414855 - DNA, 23 bp, Homo sapiens
gacacagcagcttcaccagagca

SEQ ID NO: 5414856 - DNA, 17 bp, Homo sapiens
gacacagcatcagctca

SEQ ID NO: 5414857 - DNA, 18 bp, Homo sapiens
gacacagcccagacaaga

SEQ ID NO: 5414858 - DNA, 15 bp, Homo sapiens
gacacagcctccccc

SEQ ID NO: 5414859 - DNA, 13 bp, Homo sapiens
gacacagcgtccc

SEQ ID NO: 5414860 - DNA, 16 bp, Homo sapiens
gacacagctcttctcc

SEQ ID NO: 5414861 - DNA, 17 bp, Homo sapiens
gacacagcttgtgaatg

SEQ ID NO: 5414862 - DNA, 23 bp, Homo sapiens
gacacagctttatcaccagagag

SEQ ID NO: 5414863 - DNA, 17 bp, Homo sapiens
gacacaggaaaaataaa

SEQ ID NO: 5414864 - DNA, 18 bp, Homo sapiens
gacacaggaaaccaacac

SEQ ID NO: 5414865 - DNA, 13 bp, Homo sapiens
gacacaggaagaa

SEQ ID NO: 5414866 - DNA, 23 bp, Homo sapiens
gacacaggaagaatgggctgcag

SEQ ID NO: 5414867 - DNA, 17 bp, Homo sapiens
gacacaggatgaaggca

SEQ ID NO: 5414868 - DNA, 22 bp, Homo sapiens
gacacaggccagccttggcacg

SEQ ID NO: 5414869 - DNA, 15 bp, Homo sapiens
gacacaggcccggct

SEQ ID NO: 5414870 - DNA, 18 bp, Homo sapiens
gacacaggcccggctcca

SEQ ID NO: 5414871 - DNA, 13 bp, Homo sapiens
gacacaggccctc

SEQ ID NO: 5414872 - DNA, 21 bp, Homo sapiens
gacacaggccgtgggacccag

SEQ ID NO: 5414873 - DNA, 13 bp, Homo sapiens
gacacaggcctgt

SEQ ID NO: 5414874 - DNA, 15 bp, Homo sapiens
gacacaggcctgtgt

SEQ ID NO: 5414875 - DNA, 16 bp, Homo sapiens
gacacaggcctgtgta

SEQ ID NO: 5414876 - DNA, 14 bp, Homo sapiens
gacacaggctgccg

SEQ ID NO: 5414877 - DNA, 16 bp, Homo sapiens
gacacagggacttgaa

SEQ ID NO: 5414878 - DNA, 23 bp, Homo sapiens
gacacagggtgacggtgacaaag

SEQ ID NO: 5414879 - DNA, 14 bp, Homo sapiens
gacacaggtcaggg

SEQ ID NO: 5414880 - DNA, 16 bp, Homo sapiens
gacacaggtctttcct

SEQ ID NO: 5414881 - DNA, 22 bp, Homo sapiens
gacacagtaaaattaactctgt

SEQ ID NO: 5414882 - DNA, 16 bp, Homo sapiens
gacacagtcaggggcc

SEQ ID NO: 5414883 - DNA, 18 bp, Homo sapiens
gacacagtgatgaatgta

SEQ ID NO: 5414884 - DNA, 11 bp, Homo sapiens
gacacagtgtt

SEQ ID NO: 5414885 - DNA, 23 bp, Homo sapiens
gacacagtgttccagctgcctgg

SEQ ID NO: 5414886 - DNA, 18 bp, Homo sapiens
gacacagttatcaaaaag

SEQ ID NO: 5414887 - DNA, 13 bp, Homo sapiens
gacacagttcctg

SEQ ID NO: 5414888 - DNA, 15 bp, Homo sapiens
gacacagttcctggg

SEQ ID NO: 5414889 - DNA, 16 bp, Homo sapiens
gacacagttcctggga

SEQ ID NO: 5414890 - DNA, 15 bp, Homo sapiens
gacacataaatctgt

SEQ ID NO: 5414891 - DNA, 20 bp, Homo sapiens
gacacataaatctgtctgat

SEQ ID NO: 5414892 - DNA, 15 bp, Homo sapiens
gacacataatttgaa

SEQ ID NO: 5414893 - DNA, 15 bp, Homo sapiens
gacacatacagagtg

SEQ ID NO: 5414894 - DNA, 19 bp, Homo sapiens
gacacatactcatttttca

SEQ ID NO: 5414895 - DNA, 16 bp, Homo sapiens
gacacatatgaggggg

SEQ ID NO: 5414896 - DNA, 19 bp, Homo sapiens
gacacatcaagcttttctg

SEQ ID NO: 5414897 - DNA, 13 bp, Homo sapiens
gacacatcagcat

SEQ ID NO: 5414898 - DNA, 20 bp, Homo sapiens
gacacatcagcatgttttct

SEQ ID NO: 5414899 - DNA, 17 bp, Homo sapiens
gacacatcccggcctct

SEQ ID NO: 5414900 - DNA, 21 bp, Homo sapiens
gacacatcccggcctcttcca

SEQ ID NO: 5414901 - DNA, 23 bp, Homo sapiens
gacacatccgccttttgtataca

SEQ ID NO: 5414902 - DNA, 21 bp, Homo sapiens
gacacatctattgcagagact

SEQ ID NO: 5414903 - DNA, 14 bp, Homo sapiens
gacacatgcaaggt

SEQ ID NO: 5414904 - DNA, 19 bp, Homo sapiens
gacacatgcaaggtcattt

SEQ ID NO: 5414905 - DNA, 17 bp, Homo sapiens
gacacatgccagggcca

SEQ ID NO: 5414906 - DNA, 19 bp, Homo sapiens
gacacatgcccctccccca

SEQ ID NO: 5414907 - DNA, 23 bp, Homo sapiens
gacacatgctctcaatatataat

SEQ ID NO: 5414908 - DNA, 21 bp, Homo sapiens
gacacatgctgttggcctcaa

SEQ ID NO: 5414909 - DNA, 15 bp, Homo sapiens
gacacatgtccaaga

SEQ ID NO: 5414910 - DNA, 20 bp, Homo sapiens
gacacatgtccaagaagccc

SEQ ID NO: 5414911 - DNA, 20 bp, Homo sapiens
gacacattcaaccctggaga

SEQ ID NO: 5414912 - DNA, 21 bp, Homo sapiens
gacacattcaaccctggagag

SEQ ID NO: 5414913 - DNA, 16 bp, Homo sapiens
gacacattgactcctt

SEQ ID NO: 5414914 - DNA, 21 bp, Homo sapiens
gacacattgactcctttccaa

SEQ ID NO: 5414915 - DNA, 19 bp, Homo sapiens
gacacattgccccatgaga

SEQ ID NO: 5414916 - DNA, 21 bp, Homo sapiens
gacacattgccttctggagct

SEQ ID NO: 5414917 - DNA, 19 bp, Homo sapiens
gacacattgtcatcagagg

SEQ ID NO: 5414918 - DNA, 18 bp, Homo sapiens
gacacattgttttccaga

SEQ ID NO: 5414919 - DNA, 15 bp, Homo sapiens
gacacatttaaggat

SEQ ID NO: 5414920 - DNA, 17 bp, Homo sapiens
gacacatttaccaaatt

SEQ ID NO: 5414921 - DNA, 16 bp, Homo sapiens
gacaccaaccagacag

SEQ ID NO: 5414922 - DNA, 17 bp, Homo sapiens
gacaccaagctcaccct

SEQ ID NO: 5414923 - DNA, 16 bp, Homo sapiens
gacaccaataaatgtt

SEQ ID NO: 5414924 - DNA, 16 bp, Homo sapiens
gacaccacacccagcc

SEQ ID NO: 5414925 - DNA, 18 bp, Homo sapiens
gacaccacacccagcctc

SEQ ID NO: 5414926 - DNA, 21 bp, Homo sapiens
gacaccacacccagcctcagt

SEQ ID NO: 5414927 - DNA, 19 bp, Homo sapiens
gacaccacacttgttttct

SEQ ID NO: 5414928 - DNA, 14 bp, Homo sapiens
gacaccaccaacag

SEQ ID NO: 5414929 - DNA, 15 bp, Homo sapiens
gacaccacccagagc

SEQ ID NO: 5414930 - DNA, 16 bp, Homo sapiens
gacaccactcctgcca

SEQ ID NO: 5414931 - DNA, 17 bp, Homo sapiens
gacaccactgagctctg

SEQ ID NO: 5414932 - DNA, 12 bp, Homo sapiens
gacaccactggg

SEQ ID NO: 5414933 - DNA, 14 bp, Homo sapiens
gacaccactgggaa

SEQ ID NO: 5414934 - DNA, 22 bp, Homo sapiens
gacaccactgggaaccaagggc

SEQ ID NO: 5414935 - DNA, 18 bp, Homo sapiens
gacaccagaaagccctct

SEQ ID NO: 5414936 - DNA, 12 bp, Homo sapiens
gacaccagagca

SEQ ID NO: 5414937 - DNA, 13 bp, Homo sapiens
gacaccagagcag

SEQ ID NO: 5414938 - DNA, 14 bp, Homo sapiens
gacaccagagcaga

SEQ ID NO: 5414939 - DNA, 13 bp, Homo sapiens
gacaccagagctg

SEQ ID NO: 5414940 - DNA, 23 bp, Homo sapiens
gacaccagccaggctctgtgctg

SEQ ID NO: 5414941 - DNA, 22 bp, Homo sapiens
gacactgtgcaggcccaggcag

SEQ ID NO: 5414942 - DNA, 20 bp, Homo sapiens
gacactgtgcccagcccgga

SEQ ID NO: 5414943 - DNA, 21 bp, Homo sapiens
gacactgtggaaagctttgaa

SEQ ID NO: 5414944 - DNA, 14 bp, Homo sapiens
gacactgtggcagc

SEQ ID NO: 5414945 - DNA, 22 bp, Homo sapiens
gacactgttctcccttcggtgg

SEQ ID NO: 5414946 - DNA, 23 bp, Homo sapiens
gacactgttcttagctcaatgag

SEQ ID NO: 5414947 - DNA, 19 bp, Homo sapiens
gacactgtttggcctttct

SEQ ID NO: 5414948 - DNA, 20 bp, Homo sapiens
gacacttaatactaccttga

SEQ ID NO: 5414949 - DNA, 21 bp, Homo sapiens
gacacttatctcactgtttta

SEQ ID NO: 5414950 - DNA, 19 bp, Homo sapiens
gacacttatggggacagca

SEQ ID NO: 5414951 - DNA, 21 bp, Homo sapiens
gacacttcaaactgcggacac

SEQ ID NO: 5414952 - DNA, 19 bp, Homo sapiens
gacacttcacgcccttggc

SEQ ID NO: 5414953 - DNA, 15 bp, Homo sapiens
gacacttcagagagc

SEQ ID NO: 5414954 - DNA, 18 bp, Homo sapiens
gacacttcagagagctgg

SEQ ID NO: 5414955 - DNA, 19 bp, Homo sapiens
gacacttcagagagctggt

SEQ ID NO: 5414956 - DNA, 20 bp, Homo sapiens
gacacttcagagagctggta

SEQ ID NO: 5414957 - DNA, 18 bp, Homo sapiens
gacacttcagatctgagg

SEQ ID NO: 5414958 - DNA, 21 bp, Homo sapiens
gacacttcatggaccaagaat

SEQ ID NO: 5414959 - DNA, 23 bp, Homo sapiens
gacacttccccttgtctccctgg

SEQ ID NO: 5414960 - DNA, 18 bp, Homo sapiens
gacacttccctctgtttc

SEQ ID NO: 5414961 - DNA, 15 bp, Homo sapiens
gacacttccctgggc

SEQ ID NO: 5414962 - DNA, 12 bp, Homo sapiens
gacacttctcag

SEQ ID NO: 5414963 - DNA, 13 bp, Homo sapiens
gacacttctcagg

SEQ ID NO: 5414964 - DNA, 20 bp, Homo sapiens
gacacttctttatactctct

SEQ ID NO: 5414965 - DNA, 23 bp, Homo sapiens
gacacttctttatactctcttcc

SEQ ID NO: 5414966 - DNA, 17 bp, Homo sapiens
gacacttgatacttgtt

SEQ ID NO: 5414967 - DNA, 16 bp, Homo sapiens
gacacttgctgagtga

SEQ ID NO: 5414968 - DNA, 14 bp, Homo sapiens
gacacttgtacaat

SEQ ID NO: 5414969 - DNA, 14 bp, Homo sapiens
gacacttgtcccca

SEQ ID NO: 5414970 - DNA, 19 bp, Homo sapiens
gacacttgtggtatagtat

SEQ ID NO: 5414971 - DNA, 15 bp, Homo sapiens
gacactttgaaatgt

SEQ ID NO: 5414972 - DNA, 19 bp, Homo sapiens
gacactttgaaatgtgttt

SEQ ID NO: 5414973 - DNA, 20 bp, Homo sapiens
gacactttgccaaggctctc

SEQ ID NO: 5414974 - DNA, 18 bp, Homo sapiens
gacacttttaaaaaacaa

SEQ ID NO: 5414975 - DNA, 21 bp, Homo sapiens
gacacttttaaaaaacaaaaa

SEQ ID NO: 5414976 - DNA, 16 bp, Homo sapiens
gacacttttaaaataa

SEQ ID NO: 5414977 - DNA, 18 bp, Homo sapiens
gacacttttaaaataaat

SEQ ID NO: 5414978 - DNA, 22 bp, Homo sapiens
gacacttttatatttgaaaaaa

SEQ ID NO: 5414979 - DNA, 14 bp, Homo sapiens
gacacttttatgtt

SEQ ID NO: 5414980 - DNA, 17 bp, Homo sapiens
gacacttttcatatcat

SEQ ID NO: 5414981 - DNA, 21 bp, Homo sapiens
gacacttttgccaatgaactc

SEQ ID NO: 5414982 - DNA, 14 bp, Homo sapiens
gacactttttcttt

SEQ ID NO: 5414983 - DNA, 23 bp, Homo sapiens
gacactttttgtattttttcctt

SEQ ID NO: 5414984 - DNA, 19 bp, Homo sapiens
gacacttttttgagtggat

SEQ ID NO: 5414985 - DNA, 14 bp, Homo sapiens
gacagaaaaaaata

SEQ ID NO: 5414986 - DNA, 18 bp, Homo sapiens
gacagaaaacctcaaggg

SEQ ID NO: 5414987 - DNA, 22 bp, Homo sapiens
gacagaaaactaaaaaggaaga

SEQ ID NO: 5414988 - DNA, 21 bp, Homo sapiens
gacagaaaagaaagctgcttt

SEQ ID NO: 5414989 - DNA, 13 bp, Homo sapiens
gacagaaaatatg

SEQ ID NO: 5414990 - DNA, 16 bp, Homo sapiens
gacagaaacagagaga

SEQ ID NO: 5414991 - DNA, 21 bp, Homo sapiens
gacagaaactggattaaaaca

SEQ ID NO: 5414992 - DNA, 20 bp, Homo sapiens
gacagaaagaccctgatgca

SEQ ID NO: 5414993 - DNA, 18 bp, Homo sapiens
gacagaaagagacacaca

SEQ ID NO: 5414994 - DNA, 14 bp, Homo sapiens
gacagaaagcagaa

SEQ ID NO: 5414995 - DNA, 22 bp, Homo sapiens
gacagaaagcctccgctgggct

SEQ ID NO: 5414996 - DNA, 23 bp, Homo sapiens
gacagaaatgacaacaaggccct

SEQ ID NO: 5414997 - DNA, 14 bp, Homo sapiens
gacagaacactgtc

SEQ ID NO: 5414998 - DNA, 13 bp, Homo sapiens
gacagaacattta

SEQ ID NO: 5414999 - DNA, 16 bp, Homo sapiens
gacagaaccagcagaa

SEQ ID NO: 5415000 - DNA, 20 bp, Homo sapiens
gacagaacccctacatgaaa

SEQ ID NO: 5415001 - DNA, 18 bp, Homo sapiens
gacagaacttgaatgtgt

SEQ ID NO: 5415002 - DNA, 15 bp, Homo sapiens
gacagaagcagctct

SEQ ID NO: 5415003 - DNA, 21 bp, Homo sapiens
gacagaagcctggactctgcc

SEQ ID NO: 5415004 - DNA, 19 bp, Homo sapiens
gacagaagctatttcattt

SEQ ID NO: 5415005 - DNA, 15 bp, Homo sapiens
gacagaaggactggt

SEQ ID NO: 5415006 - DNA, 20 bp, Homo sapiens
gacagaaggcccgaggaggc

SEQ ID NO: 5415007 - DNA, 16 bp, Homo sapiens
gacagaatatgtttca

SEQ ID NO: 5415008 - DNA, 20 bp, Homo sapiens
gacagaatgagagagaaaag

SEQ ID NO: 5415009 - DNA, 22 bp, Homo sapiens
gacagaatggctatcaaaagaa

SEQ ID NO: 5415010 - DNA, 15 bp, Homo sapiens
gacagaatgtatctg

SEQ ID NO: 5415011 - DNA, 22 bp, Homo sapiens
gacagaatgtgtctcaggaaaa

SEQ ID NO: 5415012 - DNA, 15 bp, Homo sapiens
gacagaattcactgt

SEQ ID NO: 5415013 - DNA, 13 bp, Homo sapiens
gacagaatttttt

SEQ ID NO: 5415014 - DNA, 18 bp, Homo sapiens
gacagaattttttttgtt

SEQ ID NO: 5415015 - DNA, 15 bp, Homo sapiens
gacagacacaggccc

SEQ ID NO: 5415016 - DNA, 19 bp, Homo sapiens
gacagacaccacagcctcc

SEQ ID NO: 5415017 - DNA, 22 bp, Homo sapiens
gacagacaccacagcctcccct

SEQ ID NO: 5415018 - DNA, 11 bp, Homo sapiens
gacagacacct

SEQ ID NO: 5415019 - DNA, 12 bp, Homo sapiens
gacagacacctc

SEQ ID NO: 5415020 - DNA, 14 bp, Homo sapiens
gacagacagacaga

SEQ ID NO: 5415021 - DNA, 13 bp, Homo sapiens
gacagacagcagc

SEQ ID NO: 5415022 - DNA, 14 bp, Homo sapiens
gacagacagccagg

SEQ ID NO: 5415023 - DNA, 14 bp, Homo sapiens
gacagacaggctct

SEQ ID NO: 5415024 - DNA, 22 bp, Homo sapiens
gacagaccacatctttatctgt

SEQ ID NO: 5415025 - DNA, 16 bp, Homo sapiens
gacagaccacttgcca

SEQ ID NO: 5415026 - DNA, 23 bp, Homo sapiens
gacagaccagcagcaatctgtct

SEQ ID NO: 5415027 - DNA, 20 bp, Homo sapiens
gacagacccacccccagcct

SEQ ID NO: 5415028 - DNA, 14 bp, Homo sapiens
gacagaccctctgc

SEQ ID NO: 5415029 - DNA, 18 bp, Homo sapiens
gacagacgagacaacagc

SEQ ID NO: 5415030 - DNA, 23 bp, Homo sapiens
gacagacgagacaacagcacaca

SEQ ID NO: 5415031 - DNA, 22 bp, Homo sapiens
gacagacgcctgcttttgcaaa

SEQ ID NO: 5415032 - DNA, 14 bp, Homo sapiens
gacagactatttgc

SEQ ID NO: 5415033 - DNA, 23 bp, Homo sapiens
gacagactcacaacctgaaccta

SEQ ID NO: 5415034 - DNA, 12 bp, Homo sapiens
gacagactggcc

SEQ ID NO: 5415035 - DNA, 21 bp, Homo sapiens
gacagactggccgggcaggcg

SEQ ID NO: 5415036 - DNA, 23 bp, Homo sapiens
gacagactggccgggcaggcgtg

SEQ ID NO: 5415037 - DNA, 18 bp, Homo sapiens
gacagagaaatgtgaagg

SEQ ID NO: 5415038 - DNA, 12 bp, Homo sapiens
gacagagaaggg

SEQ ID NO: 5415039 - DNA, 16 bp, Homo sapiens
gacagagacacctgca

SEQ ID NO: 5415040 - DNA, 17 bp, Homo sapiens
gacagagacacctgcac

SEQ ID NO: 5415041 - DNA, 22 bp, Homo sapiens
gacagagacacctgcacctccc

SEQ ID NO: 5415042 - DNA, 18 bp, Homo sapiens
gacagagacgcaggaatg

SEQ ID NO: 5415043 - DNA, 16 bp, Homo sapiens
gacagagactcagatg

SEQ ID NO: 5415044 - DNA, 19 bp, Homo sapiens
gacagagactcagatgagg

SEQ ID NO: 5415045 - DNA, 12 bp, Homo sapiens
gacagagagaga

SEQ ID NO: 5415046 - DNA, 17 bp, Homo sapiens
gacagagagagactgag

SEQ ID NO: 5415047 - DNA, 20 bp, Homo sapiens
gacagagagaggggagagag

SEQ ID NO: 5415048 - DNA, 20 bp, Homo sapiens
gacagagaggagttgccagg

SEQ ID NO: 5415049 - DNA, 17 bp, Homo sapiens
gacagagagttctggtg

SEQ ID NO: 5415050 - DNA, 20 bp, Homo sapiens
gacagagagttctggtgaga

SEQ ID NO: 5415051 - DNA, 16 bp, Homo sapiens
gacagagatggcagag

SEQ ID NO: 5415052 - DNA, 17 bp, Homo sapiens
gacagagatggcagagc

SEQ ID NO: 5415053 - DNA, 14 bp, Homo sapiens
gacagagatttggt

SEQ ID NO: 5415054 - DNA, 12 bp, Homo sapiens
gacagagcaggc

SEQ ID NO: 5415055 - DNA, 14 bp, Homo sapiens
gacagagcaggctt

SEQ ID NO: 5415056 - DNA, 17 bp, Homo sapiens
gacagagcaggctttgt

SEQ ID NO: 5415057 - DNA, 21 bp, Homo sapiens
gacagagcaggctttgtgaga

SEQ ID NO: 5415058 - DNA, 23 bp, Homo sapiens
gacagagcaggctttgtgagaga

SEQ ID NO: 5415059 - DNA, 14 bp, Homo sapiens
gacagagcaggggc

SEQ ID NO: 5415060 - DNA, 19 bp, Homo sapiens
gacagagcaggggctccag

SEQ ID NO: 5415061 - DNA, 12 bp, Homo sapiens
gacagagccaga

SEQ ID NO: 5415062 - DNA, 16 bp, Homo sapiens
gacagagccagaggca

SEQ ID NO: 5415063 - DNA, 13 bp, Homo sapiens
gacagagccatgc

SEQ ID NO: 5415064 - DNA, 16 bp, Homo sapiens
gacagagcccagcatc

SEQ ID NO: 5415065 - DNA, 18 bp, Homo sapiens
gacagagccccacgctgt

SEQ ID NO: 5415066 - DNA, 21 bp, Homo sapiens
gacagagcccccaagcctctg

SEQ ID NO: 5415067 - DNA, 16 bp, Homo sapiens
gacagagcccgggaga

SEQ ID NO: 5415068 - DNA, 15 bp, Homo sapiens
gacagagcgagactt

SEQ ID NO: 5415069 - DNA, 20 bp, Homo sapiens
gacagagcgagactttgtcc

SEQ ID NO: 5415070 - DNA, 17 bp, Homo sapiens
gacagagcgcccctccc

SEQ ID NO: 5415071 - DNA, 22 bp, Homo sapiens
gacagagcggaactatgaaaag

SEQ ID NO: 5415072 - DNA, 20 bp, Homo sapiens
gacagagctacacaggggaa

SEQ ID NO: 5415073 - DNA, 13 bp, Homo sapiens
gacagagctctgg

SEQ ID NO: 5415074 - DNA, 16 bp, Homo sapiens
gacagagctggctgtc

SEQ ID NO: 5415075 - DNA, 21 bp, Homo sapiens
gacagaggaaagggctggctc

SEQ ID NO: 5415076 - DNA, 23 bp, Homo sapiens
gacagaggaaagggctggctccc

SEQ ID NO: 5415077 - DNA, 18 bp, Homo sapiens
gacagaggaccattacaa

SEQ ID NO: 5415078 - DNA, 18 bp, Homo sapiens
gacagaggagcttttctg

SEQ ID NO: 5415079 - DNA, 16 bp, Homo sapiens
gacagaggaggatgta

SEQ ID NO: 5415080 - DNA, 15 bp, Homo sapiens
gacagaggatgagct

SEQ ID NO: 5415081 - DNA, 14 bp, Homo sapiens
gacagaggatgtgg

SEQ ID NO: 5415082 - DNA, 11 bp, Homo sapiens
gacagaggcag

SEQ ID NO: 5415083 - DNA, 15 bp, Homo sapiens
gacagaggcagagat

SEQ ID NO: 5415084 - DNA, 14 bp, Homo sapiens
gacagaggcagccc

SEQ ID NO: 5415085 - DNA, 16 bp, Homo sapiens
gacagaggcagcccca

SEQ ID NO: 5415086 - DNA, 15 bp, Homo sapiens
gacagaggccaagga

SEQ ID NO: 5415087 - DNA, 16 bp, Homo sapiens
gacagaggccggggtc

SEQ ID NO: 5415088 - DNA, 15 bp, Homo sapiens
gacagaggcctgccc

SEQ ID NO: 5415089 - DNA, 14 bp, Homo sapiens
gacagaggcgaggg

SEQ ID NO: 5415090 - DNA, 14 bp, Homo sapiens
gacagaggcggggc

SEQ ID NO: 5415091 - DNA, 13 bp, Homo sapiens
gacagaggctgca

SEQ ID NO: 5415092 - DNA, 13 bp, Homo sapiens
gacagagggaaga

SEQ ID NO: 5415093 - DNA, 15 bp, Homo sapiens
gacagagggaagcca

SEQ ID NO: 5415094 - DNA, 18 bp, Homo sapiens
gacagagggaagccagtc

SEQ ID NO: 5415095 - DNA, 19 bp, Homo sapiens
gacagagggagaagggaga

SEQ ID NO: 5415096 - DNA, 20 bp, Homo sapiens
gacagagggagacagggctg

SEQ ID NO: 5415097 - DNA, 16 bp, Homo sapiens
gacagaggggactctg

SEQ ID NO: 5415098 - DNA, 20 bp, Homo sapiens
gacagaggggactctgggct

SEQ ID NO: 5415099 - DNA, 15 bp, Homo sapiens
gacagagggggtggc

SEQ ID NO: 5415100 - DNA, 19 bp, Homo sapiens
gacagagggggtggcctcc

SEQ ID NO: 5415101 - DNA, 23 bp, Homo sapiens
gacagagggggtggcctcccaac

SEQ ID NO: 5415102 - DNA, 20 bp, Homo sapiens
gacagagggtcacagtgttt

SEQ ID NO: 5415103 - DNA, 21 bp, Homo sapiens
gacagaggttgtagtgagcca

SEQ ID NO: 5415104 - DNA, 20 bp, Homo sapiens
gacagaggtttcattttcat

SEQ ID NO: 5415105 - DNA, 21 bp, Homo sapiens
gacagaggtttcattttcatc

SEQ ID NO: 5415106 - DNA, 20 bp, Homo sapiens
gacagaggtttgaaggagaa

SEQ ID NO: 5415107 - DNA, 22 bp, Homo sapiens
gacagaggtttgaaggagaatg

SEQ ID NO: 5415108 - DNA, 13 bp, Homo sapiens
gacagagtaaaag

SEQ ID NO: 5415109 - DNA, 15 bp, Homo sapiens
gacagagtaaaagta

SEQ ID NO: 5415110 - DNA, 16 bp, Homo sapiens
gacagagtgagactct

SEQ ID NO: 5415111 - DNA, 19 bp, Homo sapiens
gacagagtgagactctgtc

SEQ ID NO: 5415112 - DNA, 22 bp, Homo sapiens
gacagagtgagactctgtctca

SEQ ID NO: 5415113 - DNA, 13 bp, Homo sapiens
gacagagtgccct

SEQ ID NO: 5415114 - DNA, 14 bp, Homo sapiens
gacagagtgccctg

SEQ ID NO: 5415115 - DNA, 18 bp, Homo sapiens
gacagagtgctgaggggc

SEQ ID NO: 5415116 - DNA, 21 bp, Homo sapiens
gacagagttcactataaatgg

SEQ ID NO: 5415117 - DNA, 16 bp, Homo sapiens
gacagagttgattttt

SEQ ID NO: 5415118 - DNA, 23 bp, Homo sapiens
gacatcctgtcatctgagaatga

SEQ ID NO: 5415119 - DNA, 18 bp, Homo sapiens
gacatcggttcaggagga

SEQ ID NO: 5415120 - DNA, 19 bp, Homo sapiens
gacatctacgaagccacag

SEQ ID NO: 5415121 - DNA, 23 bp, Homo sapiens
gacatctacgaagccacaggcct

SEQ ID NO: 5415122 - DNA, 15 bp, Homo sapiens
gacatctcaaataca

SEQ ID NO: 5415123 - DNA, 13 bp, Homo sapiens
gacatctcagggg

SEQ ID NO: 5415124 - DNA, 16 bp, Homo sapiens
gacatctcaggggcca

SEQ ID NO: 5415125 - DNA, 16 bp, Homo sapiens
gacatctccagtgtgc

SEQ ID NO: 5415126 - DNA, 12 bp, Homo sapiens
gacatctcctgg

SEQ ID NO: 5415127 - DNA, 15 bp, Homo sapiens
gacatctcctggcta

SEQ ID NO: 5415128 - DNA, 13 bp, Homo sapiens
gacatctctgcac

SEQ ID NO: 5415129 - DNA, 12 bp, Homo sapiens
gacatctctgga

SEQ ID NO: 5415130 - DNA, 16 bp, Homo sapiens
gacatctctggagcca

SEQ ID NO: 5415131 - DNA, 17 bp, Homo sapiens
gacatctctggagccag

SEQ ID NO: 5415132 - DNA, 13 bp, Homo sapiens
gacatctctgtaa

SEQ ID NO: 5415133 - DNA, 15 bp, Homo sapiens
gacatctgaccccaa

SEQ ID NO: 5415134 - DNA, 13 bp, Homo sapiens
gacatctgaggaa

SEQ ID NO: 5415135 - DNA, 19 bp, Homo sapiens
gacatctgcacccctgagt

SEQ ID NO: 5415136 - DNA, 13 bp, Homo sapiens
gacatctgcctgt

SEQ ID NO: 5415137 - DNA, 17 bp, Homo sapiens
gacatctgcctgtaatt

SEQ ID NO: 5415138 - DNA, 14 bp, Homo sapiens
gacatctgctgtta

SEQ ID NO: 5415139 - DNA, 16 bp, Homo sapiens
gacatctgctgttatc

SEQ ID NO: 5415140 - DNA, 18 bp, Homo sapiens
gacatctggaatctggag

SEQ ID NO: 5415141 - DNA, 19 bp, Homo sapiens
gacatcttagtatttgcat

SEQ ID NO: 5415142 - DNA, 15 bp, Homo sapiens
gacatcttgaatcct

SEQ ID NO: 5415143 - DNA, 22 bp, Homo sapiens
gacatcttgcctacttttcttt

SEQ ID NO: 5415144 - DNA, 13 bp, Homo sapiens
gacatctttctct

SEQ ID NO: 5415145 - DNA, 19 bp, Homo sapiens
gacatctttttaaagctta

SEQ ID NO: 5415146 - DNA, 20 bp, Homo sapiens
gacatgaaaactattttaaa

SEQ ID NO: 5415147 - DNA, 16 bp, Homo sapiens
gacatgaaaagttatt

SEQ ID NO: 5415148 - DNA, 14 bp, Homo sapiens
gacatgaaatgaaa

SEQ ID NO: 5415149 - DNA, 16 bp, Homo sapiens
gacatgaacaatgtgt

SEQ ID NO: 5415150 - DNA, 22 bp, Homo sapiens
gacatgaacgttttctcttcac

SEQ ID NO: 5415151 - DNA, 21 bp, Homo sapiens
gacatgaattttagcttttgt

SEQ ID NO: 5415152 - DNA, 17 bp, Homo sapiens
gacatgaccctctgtcc

SEQ ID NO: 5415153 - DNA, 19 bp, Homo sapiens
gacatgaccctctgtcccc

SEQ ID NO: 5415154 - DNA, 20 bp, Homo sapiens
gacatgacgtggtaaaatgt

SEQ ID NO: 5415155 - DNA, 18 bp, Homo sapiens
gacatgagactaagagaa

SEQ ID NO: 5415156 - DNA, 22 bp, Homo sapiens
gacatgagtccaccctttggag

SEQ ID NO: 5415157 - DNA, 21 bp, Homo sapiens
gacatgatactgatgccatgt

SEQ ID NO: 5415158 - DNA, 14 bp, Homo sapiens
gacatgatcttctt

SEQ ID NO: 5415159 - DNA, 17 bp, Homo sapiens
gacatgatggggaagga

SEQ ID NO: 5415160 - DNA, 21 bp, Homo sapiens
gacatgatttagggaagcagg

SEQ ID NO: 5415161 - DNA, 16 bp, Homo sapiens
gacatgatttccttga

SEQ ID NO: 5415162 - DNA, 19 bp, Homo sapiens
gacatgatttccttgaatg

SEQ ID NO: 5415163 - DNA, 20 bp, Homo sapiens
gacatgatttccttgaatgt

SEQ ID NO: 5415164 - DNA, 24 bp, Homo sapiens
gacatgatttccttgaatgtggct

SEQ ID NO: 5415165 - DNA, 17 bp, Homo sapiens
gacatgcaataaaattt

SEQ ID NO: 5415166 - DNA, 19 bp, Homo sapiens
gacatgcaataaaatttaa

SEQ ID NO: 5415167 - DNA, 12 bp, Homo sapiens
gacatgcacagt

SEQ ID NO: 5415168 - DNA, 21 bp, Homo sapiens
gacatgcacccgcatgtacaa

SEQ ID NO: 5415169 - DNA, 12 bp, Homo sapiens
gacatgcactga

SEQ ID NO: 5415170 - DNA, 14 bp, Homo sapiens
gacatgcactgacc

SEQ ID NO: 5415171 - DNA, 15 bp, Homo sapiens
gacatgcactgaccc

SEQ ID NO: 5415172 - DNA, 16 bp, Homo sapiens
gacatgcactgaccct

SEQ ID NO: 5415173 - DNA, 13 bp, Homo sapiens
gacatgcatgaca

SEQ ID NO: 5415174 - DNA, 22 bp, Homo sapiens
gacatgcattgttggctatttg

SEQ ID NO: 5415175 - DNA, 23 bp, Homo sapiens
gacatgccaactcgggagcattc

SEQ ID NO: 5415176 - DNA, 22 bp, Homo sapiens
gacatgccctcccttctccctg

SEQ ID NO: 5415177 - DNA, 14 bp, Homo sapiens
gacatgccctgtgt

SEQ ID NO: 5415178 - DNA, 13 bp, Homo sapiens
gacatgcctgtcc

SEQ ID NO: 5415179 - DNA, 15 bp, Homo sapiens
gacatgcctgtcctg

SEQ ID NO: 5415180 - DNA, 16 bp, Homo sapiens
gacatgcctgtcctga

SEQ ID NO: 5415181 - DNA, 21 bp, Homo sapiens
gacatgcctgtcctgaaagcg

SEQ ID NO: 5415182 - DNA, 23 bp, Homo sapiens
gacatgcggctgcccacgctcct

SEQ ID NO: 5415183 - DNA, 15 bp, Homo sapiens
gacatgcgggctggg

SEQ ID NO: 5415184 - DNA, 18 bp, Homo sapiens
gacatgcgggctgggcag

SEQ ID NO: 5415185 - DNA, 19 bp, Homo sapiens
gacatgcggtagccagcac

SEQ ID NO: 5415186 - DNA, 22 bp, Homo sapiens
gacatgcggtagccagcacaca

SEQ ID NO: 5415187 - DNA, 23 bp, Homo sapiens
gacatgcggtagccagcacacag

SEQ ID NO: 5415188 - DNA, 15 bp, Homo sapiens
gacatgcgtgtgtca

SEQ ID NO: 5415189 - DNA, 20 bp, Homo sapiens
gacatgcgtgtgtcagggat

SEQ ID NO: 5415190 - DNA, 18 bp, Homo sapiens
gacatgctaaataactat

SEQ ID NO: 5415191 - DNA, 17 bp, Homo sapiens
gacatgctcacctctag

SEQ ID NO: 5415192 - DNA, 19 bp, Homo sapiens
gacatgctgaagccaaagc

SEQ ID NO: 5415193 - DNA, 21 bp, Homo sapiens
gacatgctgactgtcctctcc

SEQ ID NO: 5415194 - DNA, 13 bp, Homo sapiens
gacatgctgccag

SEQ ID NO: 5415195 - DNA, 14 bp, Homo sapiens
gacatgctgccagg

SEQ ID NO: 5415196 - DNA, 15 bp, Homo sapiens
gacatgctgcccacc

SEQ ID NO: 5415197 - DNA, 19 bp, Homo sapiens
gacatgcttactttttaat

SEQ ID NO: 5415198 - DNA, 16 bp, Homo sapiens
gacatgcttttctgcc

SEQ ID NO: 5415199 - DNA, 15 bp, Homo sapiens
gacatggaaatgaag

SEQ ID NO: 5415200 - DNA, 19 bp, Homo sapiens
gacatggaacagtgtaaat

SEQ ID NO: 5415201 - DNA, 18 bp, Homo sapiens
gacatggaagagagagcc

SEQ ID NO: 5415202 - DNA, 18 bp, Homo sapiens
gacatggaagattagagg

SEQ ID NO: 5415203 - DNA, 20 bp, Homo sapiens
gacatggaagattagaggtt

SEQ ID NO: 5415204 - DNA, 13 bp, Homo sapiens
gacatggaaggtt

SEQ ID NO: 5415205 - DNA, 15 bp, Homo sapiens
gacatggaaggttag

SEQ ID NO: 5415206 - DNA, 21 bp, Homo sapiens
gacatggacccactacccttc

SEQ ID NO: 5415207 - DNA, 17 bp, Homo sapiens
gacatggacccggagct

SEQ ID NO: 5415208 - DNA, 19 bp, Homo sapiens
gacatggaccttctctcca

SEQ ID NO: 5415209 - DNA, 22 bp, Homo sapiens
gacatggagactcctgccctgt

SEQ ID NO: 5415210 - DNA, 15 bp, Homo sapiens
gacatggagagagac

SEQ ID NO: 5415211 - DNA, 15 bp, Homo sapiens
gacatggaggttcta

SEQ ID NO: 5415212 - DNA, 16 bp, Homo sapiens
gacatggaggttctaa

SEQ ID NO: 5415213 - DNA, 19 bp, Homo sapiens
gacatggaggttctaaggc

SEQ ID NO: 5415214 - DNA, 20 bp, Homo sapiens
gacatggattggatttcagt

SEQ ID NO: 5415215 - DNA, 19 bp, Homo sapiens
gacatggcaacaaaggatg

SEQ ID NO: 5415216 - DNA, 21 bp, Homo sapiens
gacatggcgtattttgtattt

SEQ ID NO: 5415217 - DNA, 21 bp, Homo sapiens
gacatggcttgccacagctct

SEQ ID NO: 5415218 - DNA, 19 bp, Homo sapiens
gacatggctttcagaaaac

SEQ ID NO: 5415219 - DNA, 12 bp, Homo sapiens
gacatggctttg

SEQ ID NO: 5415220 - DNA, 14 bp, Homo sapiens
gacatgggaaaggg

SEQ ID NO: 5415221 - DNA, 18 bp, Homo sapiens
gacatgggaaaggggaag

SEQ ID NO: 5415222 - DNA, 15 bp, Homo sapiens
gacatgggccccaga

SEQ ID NO: 5415223 - DNA, 16 bp, Homo sapiens
gacatggggaaggcag

SEQ ID NO: 5415224 - DNA, 17 bp, Homo sapiens
gacatggggaaggcaga

SEQ ID NO: 5415225 - DNA, 23 bp, Homo sapiens
gacatggggaggttgtggggcct

SEQ ID NO: 5415226 - DNA, 13 bp, Homo sapiens
gacatggggcaag

SEQ ID NO: 5415227 - DNA, 14 bp, Homo sapiens
gacatggggcaagc

SEQ ID NO: 5415228 - DNA, 16 bp, Homo sapiens
gacatggggcaagcca

SEQ ID NO: 5415229 - DNA, 22 bp, Homo sapiens
gacatggggcaagccagggccc

SEQ ID NO: 5415230 - DNA, 23 bp, Homo sapiens
gacatgggtcgcccatgagagcg

SEQ ID NO: 5415231 - DNA, 13 bp, Homo sapiens
gacatgggtgggg

SEQ ID NO: 5415232 - DNA, 16 bp, Homo sapiens
gacatggtcacagtcc

SEQ ID NO: 5415233 - DNA, 16 bp, Homo sapiens
gacatggtctgtcctg

SEQ ID NO: 5415234 - DNA, 16 bp, Homo sapiens
gacatggtgcctgaga

SEQ ID NO: 5415235 - DNA, 15 bp, Homo sapiens
gacatggtgccttag

SEQ ID NO: 5415236 - DNA, 12 bp, Homo sapiens
gacatggtgggg

SEQ ID NO: 5415237 - DNA, 21 bp, Homo sapiens
gacatggttgggggaatgcac

SEQ ID NO: 5415238 - DNA, 14 bp, Homo sapiens
gacatgtaagaaaa

SEQ ID NO: 5415239 - DNA, 18 bp, Homo sapiens
gacatgtaagaaaatgtt

SEQ ID NO: 5415240 - DNA, 23 bp, Homo sapiens
gacatgtatgcttccagggacaa

SEQ ID NO: 5415241 - DNA, 13 bp, Homo sapiens
gacatgtcaatta

SEQ ID NO: 5415242 - DNA, 21 bp, Homo sapiens
gacatgtcagagcttggccct

SEQ ID NO: 5415243 - DNA, 21 bp, Homo sapiens
gacatgtctttggcttcagaa

SEQ ID NO: 5415244 - DNA, 17 bp, Homo sapiens
gacatgtcttttcttgc

SEQ ID NO: 5415245 - DNA, 21 bp, Homo sapiens
gacatgtcttttcttgcatga

SEQ ID NO: 5415246 - DNA, 18 bp, Homo sapiens
gacatgtgaaaccttttt

SEQ ID NO: 5415247 - DNA, 23 bp, Homo sapiens
gacatgtgaaaccttttttaaga

SEQ ID NO: 5415248 - DNA, 19 bp, Homo sapiens
gacatgtgaagctatttga

SEQ ID NO: 5415249 - DNA, 22 bp, Homo sapiens
gacatgtgaagctatttgatat

SEQ ID NO: 5415250 - DNA, 12 bp, Homo sapiens
gacatgtgacat

SEQ ID NO: 5415251 - DNA, 20 bp, Homo sapiens
gacatgtgacatttatatat

SEQ ID NO: 5415252 - DNA, 20 bp, Homo sapiens
gacatgtgaggaggaaaagg

SEQ ID NO: 5415253 - DNA, 13 bp, Homo sapiens
gacatgtgggtgg

SEQ ID NO: 5415254 - DNA, 16 bp, Homo sapiens
gacatgtgggtggaga

SEQ ID NO: 5415255 - DNA, 18 bp, Homo sapiens
gacatgtgggtggagaag

SEQ ID NO: 5415256 - DNA, 14 bp, Homo sapiens
gacatgtggtggga

SEQ ID NO: 5415257 - DNA, 22 bp, Homo sapiens
gacatgtggtgggacagggacc

SEQ ID NO: 5415258 - DNA, 14 bp, Homo sapiens
gacatgtttcaaga

SEQ ID NO: 5415259 - DNA, 18 bp, Homo sapiens
gacatgtttgtgctctgt

SEQ ID NO: 5415260 - DNA, 19 bp, Homo sapiens
gacatgtttgtgctctgtt

SEQ ID NO: 5415261 - DNA, 23 bp, Homo sapiens
gacatgttttagacaaatactca

SEQ ID NO: 5415262 - DNA, 23 bp, Homo sapiens
gacatgttttgataaagtagtaa

SEQ ID NO: 5415263 - DNA, 14 bp, Homo sapiens
gacattaaaagatt

SEQ ID NO: 5415264 - DNA, 23 bp, Homo sapiens
gacattaaatctatgaagtatat

SEQ ID NO: 5415265 - DNA, 12 bp, Homo sapiens
gacattaacagt

SEQ ID NO: 5415266 - DNA, 17 bp, Homo sapiens
gacattaacagttttcc

SEQ ID NO: 5415267 - DNA, 21 bp, Homo sapiens
gacattaactcattagactgg

SEQ ID NO: 5415268 - DNA, 22 bp, Homo sapiens
gacattaactcattagactgga

SEQ ID NO: 5415269 - DNA, 16 bp, Homo sapiens
gacattaagaatgttg

SEQ ID NO: 5415270 - DNA, 18 bp, Homo sapiens
gacattaagcagccttaa

SEQ ID NO: 5415271 - DNA, 21 bp, Homo sapiens
gacattaagcatcacaaatga

SEQ ID NO: 5415272 - DNA, 18 bp, Homo sapiens
gacattatgtaaaagaaa

SEQ ID NO: 5415273 - DNA, 22 bp, Homo sapiens
gacattatgtaaaagaaaggtt

SEQ ID NO: 5415274 - DNA, 23 bp, Homo sapiens
gacattatgtggttttagatttt

SEQ ID NO: 5415275 - DNA, 20 bp, Homo sapiens
gacattatgtgtgcatgtgt

SEQ ID NO: 5415276 - DNA, 22 bp, Homo sapiens
gacattatgtgtgcatgtgtgt

SEQ ID NO: 5415277 - DNA, 16 bp, Homo sapiens
gacattattaaagttt

SEQ ID NO: 5415278 - DNA, 21 bp, Homo sapiens
gacattattaaagttttcaaa

SEQ ID NO: 5415279 - DNA, 21 bp, Homo sapiens
gacattcaaaacagttactta

SEQ ID NO: 5415280 - DNA, 23 bp, Homo sapiens
gacattcaaaacgtgatgttttg

SEQ ID NO: 5415281 - DNA, 14 bp, Homo sapiens
gacattcacctgcc

SEQ ID NO: 5415282 - DNA, 16 bp, Homo sapiens
gacattcacctgcccc

SEQ ID NO: 5415283 - DNA, 14 bp, Homo sapiens
gacattcactgctg

SEQ ID NO: 5415284 - DNA, 13 bp, Homo sapiens
gacattcacttcc

SEQ ID NO: 5415285 - DNA, 17 bp, Homo sapiens
gacattcagactaaaaa

SEQ ID NO: 5415286 - DNA, 13 bp, Homo sapiens
gacattcagagat

SEQ ID NO: 5415287 - DNA, 23 bp, Homo sapiens
gacattcagtatataaaatatgt

SEQ ID NO: 5415288 - DNA, 16 bp, Homo sapiens
gacattcatgcctggc

SEQ ID NO: 5415289 - DNA, 18 bp, Homo sapiens
gacattcatgcctggctt

SEQ ID NO: 5415290 - DNA, 20 bp, Homo sapiens
gacattcctaaactatcttt

SEQ ID NO: 5415291 - DNA, 22 bp, Homo sapiens
gacattcctaagagtggaggag

SEQ ID NO: 5415292 - DNA, 23 bp, Homo sapiens
gacattcctaagagtggaggagg

SEQ ID NO: 5415293 - DNA, 16 bp, Homo sapiens
gacattcctgggcaca

SEQ ID NO: 5415294 - DNA, 22 bp, Homo sapiens
gacattccttctacatgtaatg

SEQ ID NO: 5415295 - DNA, 15 bp, Homo sapiens
gaccagctggagtga

SEQ ID NO: 5415296 - DNA, 13 bp, Homo sapiens
gaccagctggggc

SEQ ID NO: 5415297 - DNA, 11 bp, Homo sapiens
gaccaggaaag

SEQ ID NO: 5415298 - DNA, 17 bp, Homo sapiens
gaccaggacccagggag

SEQ ID NO: 5415299 - DNA, 20 bp, Homo sapiens
gaccaggacccagggagagg

SEQ ID NO: 5415300 - DNA, 19 bp, Homo sapiens
gaccaggactccctcctca

SEQ ID NO: 5415301 - DNA, 17 bp, Homo sapiens
gaccaggactctgcctt

SEQ ID NO: 5415302 - DNA, 14 bp, Homo sapiens
gaccaggagccagg

SEQ ID NO: 5415303 - DNA, 22 bp, Homo sapiens
gaccaggagctagcccagtccc

SEQ ID NO: 5415304 - DNA, 15 bp, Homo sapiens
gaccaggagggagag

SEQ ID NO: 5415305 - DNA, 21 bp, Homo sapiens
gaccaggagggagagcctctg

SEQ ID NO: 5415306 - DNA, 22 bp, Homo sapiens
gaccaggagggagagcctctgt

SEQ ID NO: 5415307 - DNA, 17 bp, Homo sapiens
gaccaggatccagcctc

SEQ ID NO: 5415308 - DNA, 22 bp, Homo sapiens
gaccaggatcccaagcctcctg

SEQ ID NO: 5415309 - DNA, 17 bp, Homo sapiens
gaccaggatggagcaag

SEQ ID NO: 5415310 - DNA, 24 bp, Homo sapiens
gaccaggatggagcaagctcttcc

SEQ ID NO: 5415311 - DNA, 23 bp, Homo sapiens
gaccaggcatcctccacaatagc

SEQ ID NO: 5415312 - DNA, 15 bp, Homo sapiens
gaccaggcccaagga

SEQ ID NO: 5415313 - DNA, 14 bp, Homo sapiens
gaccaggcctcagc

SEQ ID NO: 5415314 - DNA, 14 bp, Homo sapiens
gaccaggcctggag

SEQ ID NO: 5415315 - DNA, 13 bp, Homo sapiens
gaccaggcctggg

SEQ ID NO: 5415316 - DNA, 18 bp, Homo sapiens
gaccaggctcacaactgt

SEQ ID NO: 5415317 - DNA, 20 bp, Homo sapiens
gaccaggctcacaactgttt

SEQ ID NO: 5415318 - DNA, 19 bp, Homo sapiens
gaccaggctgcagcctcca

SEQ ID NO: 5415319 - DNA, 11 bp, Homo sapiens
gaccaggctgg

SEQ ID NO: 5415320 - DNA, 13 bp, Homo sapiens
gaccaggctggag

SEQ ID NO: 5415321 - DNA, 14 bp, Homo sapiens
gaccaggctgggca

SEQ ID NO: 5415322 - DNA, 15 bp, Homo sapiens
gaccaggctgtgtcc

SEQ ID NO: 5415323 - DNA, 18 bp, Homo sapiens
gaccagggaagtgtgtgt

SEQ ID NO: 5415324 - DNA, 22 bp, Homo sapiens
gaccagggagcctttggttctg

SEQ ID NO: 5415325 - DNA, 20 bp, Homo sapiens
gaccagggatttccatgatg

SEQ ID NO: 5415326 - DNA, 19 bp, Homo sapiens
gaccagggcaaggcccctt

SEQ ID NO: 5415327 - DNA, 15 bp, Homo sapiens
gaccagggcagggcc

SEQ ID NO: 5415328 - DNA, 21 bp, Homo sapiens
gaccagggccaccgcagggga

SEQ ID NO: 5415329 - DNA, 16 bp, Homo sapiens
gaccagggccctgggc

SEQ ID NO: 5415330 - DNA, 17 bp, Homo sapiens
gaccagggccctgggca

SEQ ID NO: 5415331 - DNA, 13 bp, Homo sapiens
gaccagggccgag

SEQ ID NO: 5415332 - DNA, 15 bp, Homo sapiens
gaccagggccgagga

SEQ ID NO: 5415333 - DNA, 19 bp, Homo sapiens
gaccagggccgaggaggtg

SEQ ID NO: 5415334 - DNA, 21 bp, Homo sapiens
gaccagggccgaggaggtgcc

SEQ ID NO: 5415335 - DNA, 14 bp, Homo sapiens
gaccagggcctttt

SEQ ID NO: 5415336 - DNA, 16 bp, Homo sapiens
gaccagggctgctctt

SEQ ID NO: 5415337 - DNA, 19 bp, Homo sapiens
gaccagggctggggcagcc

SEQ ID NO: 5415338 - DNA, 22 bp, Homo sapiens
gaccagggctggggcagcctct

SEQ ID NO: 5415339 - DNA, 16 bp, Homo sapiens
gaccaggggagaggca

SEQ ID NO: 5415340 - DNA, 20 bp, Homo sapiens
gaccaggggccctacctggg

SEQ ID NO: 5415341 - DNA, 19 bp, Homo sapiens
gaccagggtcttacctctc

SEQ ID NO: 5415342 - DNA, 23 bp, Homo sapiens
gaccaggtcttggagctgagcct

SEQ ID NO: 5415343 - DNA, 15 bp, Homo sapiens
gaccaggtgacctta

SEQ ID NO: 5415344 - DNA, 19 bp, Homo sapiens
gaccaggtgctcagcccag

SEQ ID NO: 5415345 - DNA, 15 bp, Homo sapiens
gaccagtaattgtga

SEQ ID NO: 5415346 - DNA, 17 bp, Homo sapiens
gaccagtagtgaccaat

SEQ ID NO: 5415347 - DNA, 15 bp, Homo sapiens
gaccagtcacagcca

SEQ ID NO: 5415348 - DNA, 20 bp, Homo sapiens
gaccagtcacagccatttca

SEQ ID NO: 5415349 - DNA, 14 bp, Homo sapiens
gaccagtctggcca

SEQ ID NO: 5415350 - DNA, 18 bp, Homo sapiens
gaccagtgaccccagaaa

SEQ ID NO: 5415351 - DNA, 23 bp, Homo sapiens
gaccagtgataatgccccaagga

SEQ ID NO: 5415352 - DNA, 12 bp, Homo sapiens
gaccagtgcctg

SEQ ID NO: 5415353 - DNA, 15 bp, Homo sapiens
gaccagtgcctgtga

SEQ ID NO: 5415354 - DNA, 18 bp, Homo sapiens
gaccagtgggatgggctc

SEQ ID NO: 5415355 - DNA, 15 bp, Homo sapiens
gaccagtggtgcctt

SEQ ID NO: 5415356 - DNA, 22 bp, Homo sapiens
gaccagtgtatcaggtcaggga

SEQ ID NO: 5415357 - DNA, 22 bp, Homo sapiens
gaccagttgaataaaagtgcac

SEQ ID NO: 5415358 - DNA, 23 bp, Homo sapiens
gaccagttgaataaaagtgcaca

SEQ ID NO: 5415359 - DNA, 19 bp, Homo sapiens
gaccagttgcagtcactct

SEQ ID NO: 5415360 - DNA, 14 bp, Homo sapiens
gaccagttgggagc

SEQ ID NO: 5415361 - DNA, 11 bp, Homo sapiens
gaccagtttac

SEQ ID NO: 5415362 - DNA, 13 bp, Homo sapiens
gaccagtttgcag

SEQ ID NO: 5415363 - DNA, 14 bp, Homo sapiens
gaccagtttgcatg

SEQ ID NO: 5415364 - DNA, 16 bp, Homo sapiens
gaccataacagccaac

SEQ ID NO: 5415365 - DNA, 18 bp, Homo sapiens
gaccataacagtgccagc

SEQ ID NO: 5415366 - DNA, 13 bp, Homo sapiens
gaccataagagaa

SEQ ID NO: 5415367 - DNA, 15 bp, Homo sapiens
gaccataagagaaac

SEQ ID NO: 5415368 - DNA, 21 bp, Homo sapiens
gaccataagagaaacctgcca

SEQ ID NO: 5415369 - DNA, 13 bp, Homo sapiens
gaccatactaatt

SEQ ID NO: 5415370 - DNA, 23 bp, Homo sapiens
gaccatattctaagttagactct

SEQ ID NO: 5415371 - DNA, 18 bp, Homo sapiens
gaccatatttttaaagaa

SEQ ID NO: 5415372 - DNA, 23 bp, Homo sapiens
gaccatcatttcacctgctgctt

SEQ ID NO: 5415373 - DNA, 23 bp, Homo sapiens
gaccatccactctaccctcccac

SEQ ID NO: 5415374 - DNA, 19 bp, Homo sapiens
gaccatccattctcctcag

SEQ ID NO: 5415375 - DNA, 22 bp, Homo sapiens
gaccatccattctcctcagtgg

SEQ ID NO: 5415376 - DNA, 20 bp, Homo sapiens
gaccatcctggccaacatga

SEQ ID NO: 5415377 - DNA, 18 bp, Homo sapiens
gaccatcctggcccctcc

SEQ ID NO: 5415378 - DNA, 19 bp, Homo sapiens
gaccatcctggcccctcca

SEQ ID NO: 5415379 - DNA, 21 bp, Homo sapiens
gaccatcctggcccctccaga

SEQ ID NO: 5415380 - DNA, 18 bp, Homo sapiens
gaccatctgctgcagtta

SEQ ID NO: 5415381 - DNA, 16 bp, Homo sapiens
gaccatctgtgactat

SEQ ID NO: 5415382 - DNA, 22 bp, Homo sapiens
gaccatctttagcagtttcctc

SEQ ID NO: 5415383 - DNA, 16 bp, Homo sapiens
gaccatgaagagactc

SEQ ID NO: 5415384 - DNA, 22 bp, Homo sapiens
gaccatgcattcagatctgaag

SEQ ID NO: 5415385 - DNA, 13 bp, Homo sapiens
gaccatgccagat

SEQ ID NO: 5415386 - DNA, 14 bp, Homo sapiens
gaccatgccagatt

SEQ ID NO: 5415387 - DNA, 22 bp, Homo sapiens
gaccatgccagattctgcctct

SEQ ID NO: 5415388 - DNA, 23 bp, Homo sapiens
gaccatgccagattctgcctctc

SEQ ID NO: 5415389 - DNA, 18 bp, Homo sapiens
gaccatgcgtcaggggcc

SEQ ID NO: 5415390 - DNA, 21 bp, Homo sapiens
gaccatgctcatctgctggtc

SEQ ID NO: 5415391 - DNA, 22 bp, Homo sapiens
gaccatgctcatctgctggtcc

SEQ ID NO: 5415392 - DNA, 15 bp, Homo sapiens
gaccatgctgagaca

SEQ ID NO: 5415393 - DNA, 23 bp, Homo sapiens
gaccatggacactacacccagca

SEQ ID NO: 5415394 - DNA, 20 bp, Homo sapiens
gaccatggagtggcagccca

SEQ ID NO: 5415395 - DNA, 17 bp, Homo sapiens
gaccatggttttggctc

SEQ ID NO: 5415396 - DNA, 23 bp, Homo sapiens
gaccatggttttggctctcccac

SEQ ID NO: 5415397 - DNA, 20 bp, Homo sapiens
gaccatgtgcggagcagcct

SEQ ID NO: 5415398 - DNA, 12 bp, Homo sapiens
gaccatgtggcc

SEQ ID NO: 5415399 - DNA, 13 bp, Homo sapiens
gaccatgtgtcac

SEQ ID NO: 5415400 - DNA, 20 bp, Homo sapiens
gaccatgtgtcacttgtgct

SEQ ID NO: 5415401 - DNA, 17 bp, Homo sapiens
gaccatgttatattgct

SEQ ID NO: 5415402 - DNA, 16 bp, Homo sapiens
gaccattcctgtccct

SEQ ID NO: 5415403 - DNA, 17 bp, Homo sapiens
gaccattctcaccctgt

SEQ ID NO: 5415404 - DNA, 20 bp, Homo sapiens
gaccattctcaccctgtgaa

SEQ ID NO: 5415405 - DNA, 16 bp, Homo sapiens
gaccattctccacctg

SEQ ID NO: 5415406 - DNA, 15 bp, Homo sapiens
gaccattgaaaaagg

SEQ ID NO: 5415407 - DNA, 15 bp, Homo sapiens
gaccattgaactagg

SEQ ID NO: 5415408 - DNA, 16 bp, Homo sapiens
gaccattggctgcgct

SEQ ID NO: 5415409 - DNA, 19 bp, Homo sapiens
gaccattggggctcccagc

SEQ ID NO: 5415410 - DNA, 18 bp, Homo sapiens
gaccattgtcttccaacc

SEQ ID NO: 5415411 - DNA, 13 bp, Homo sapiens
gaccatttaacat

SEQ ID NO: 5415412 - DNA, 18 bp, Homo sapiens
gaccatttagtcctcacc

SEQ ID NO: 5415413 - DNA, 19 bp, Homo sapiens
gaccatttagtcctcacct

SEQ ID NO: 5415414 - DNA, 20 bp, Homo sapiens
gaccatttctctgcaggcca

SEQ ID NO: 5415415 - DNA, 15 bp, Homo sapiens
gaccatttgtagtga

SEQ ID NO: 5415416 - DNA, 20 bp, Homo sapiens
gaccattttgttaaaatcta

SEQ ID NO: 5415417 - DNA, 14 bp, Homo sapiens
gacccaaaacacag

SEQ ID NO: 5415418 - DNA, 17 bp, Homo sapiens
gacccaaaccccctgca

SEQ ID NO: 5415419 - DNA, 21 bp, Homo sapiens
gacccaaagcaaaacatcaca

SEQ ID NO: 5415420 - DNA, 14 bp, Homo sapiens
gacccaaagcagga

SEQ ID NO: 5415421 - DNA, 21 bp, Homo sapiens
gacccaaatttccctgggggc

SEQ ID NO: 5415422 - DNA, 13 bp, Homo sapiens
gacccaacaatga

SEQ ID NO: 5415423 - DNA, 17 bp, Homo sapiens
gacccaacagcagtgat

SEQ ID NO: 5415424 - DNA, 14 bp, Homo sapiens
gacccaacccatgc

SEQ ID NO: 5415425 - DNA, 22 bp, Homo sapiens
gacccaacccatgcccctgaca

SEQ ID NO: 5415426 - DNA, 19 bp, Homo sapiens
gacccaactgggggcaaag

SEQ ID NO: 5415427 - DNA, 19 bp, Homo sapiens
gacccaagagaactttctt

SEQ ID NO: 5415428 - DNA, 17 bp, Homo sapiens
gacccaagaggtgggga

SEQ ID NO: 5415429 - DNA, 21 bp, Homo sapiens
gacccaagccctgaggcctga

SEQ ID NO: 5415430 - DNA, 16 bp, Homo sapiens
gacccaaggaaaactg

SEQ ID NO: 5415431 - DNA, 14 bp, Homo sapiens
gacccaaggaggaa

SEQ ID NO: 5415432 - DNA, 17 bp, Homo sapiens
gacccaagtcaaagatg

SEQ ID NO: 5415433 - DNA, 22 bp, Homo sapiens
gacccaagtggatattttctta

SEQ ID NO: 5415434 - DNA, 12 bp, Homo sapiens
gacccaataaag

SEQ ID NO: 5415435 - DNA, 13 bp, Homo sapiens
gacccaataaaga

SEQ ID NO: 5415436 - DNA, 19 bp, Homo sapiens
gacccacaaactgcctgtt

SEQ ID NO: 5415437 - DNA, 14 bp, Homo sapiens
gacccacactgcca

SEQ ID NO: 5415438 - DNA, 23 bp, Homo sapiens
gacccacagactggttttgcaac

SEQ ID NO: 5415439 - DNA, 11 bp, Homo sapiens
gacccacagcc

SEQ ID NO: 5415440 - DNA, 14 bp, Homo sapiens
gacccacagccctg

SEQ ID NO: 5415441 - DNA, 15 bp, Homo sapiens
gacccacagccctga

SEQ ID NO: 5415442 - DNA, 15 bp, Homo sapiens
gacccacagcctcca

SEQ ID NO: 5415443 - DNA, 13 bp, Homo sapiens
gacccacagctct

SEQ ID NO: 5415444 - DNA, 16 bp, Homo sapiens
gacccacagctctggg

SEQ ID NO: 5415445 - DNA, 21 bp, Homo sapiens
gacccacagctctgggcctct

SEQ ID NO: 5415446 - DNA, 23 bp, Homo sapiens
gacccacagctctgggcctcttt

SEQ ID NO: 5415447 - DNA, 23 bp, Homo sapiens
gacccacatgccatttgtactga

SEQ ID NO: 5415448 - DNA, 13 bp, Homo sapiens
gacccaccactgg

SEQ ID NO: 5415449 - DNA, 14 bp, Homo sapiens
gacccaccagtgcc

SEQ ID NO: 5415450 - DNA, 14 bp, Homo sapiens
gacccaccatcctt

SEQ ID NO: 5415451 - DNA, 17 bp, Homo sapiens
gacccacccagcccctc

SEQ ID NO: 5415452 - DNA, 23 bp, Homo sapiens
gacccacccatcttcctgctgct

SEQ ID NO: 5415453 - DNA, 14 bp, Homo sapiens
gacccaccccaact

SEQ ID NO: 5415454 - DNA, 15 bp, Homo sapiens
gacccaccccaactc

SEQ ID NO: 5415455 - DNA, 12 bp, Homo sapiens
gacccacccctg

SEQ ID NO: 5415456 - DNA, 22 bp, Homo sapiens
gacccacctgaggctcagccct

SEQ ID NO: 5415457 - DNA, 18 bp, Homo sapiens
gacccacctggagcccgc

SEQ ID NO: 5415458 - DNA, 22 bp, Homo sapiens
gacccacctggtggcctctgcc

SEQ ID NO: 5415459 - DNA, 19 bp, Homo sapiens
gacccacctgtggggcctg

SEQ ID NO: 5415460 - DNA, 23 bp, Homo sapiens
gacccacctgtggggcctgggga

SEQ ID NO: 5415461 - DNA, 23 bp, Homo sapiens
gacccacgcagagaagccccggg

SEQ ID NO: 5415462 - DNA, 18 bp, Homo sapiens
gacccacgggctcatgca

SEQ ID NO: 5415463 - DNA, 14 bp, Homo sapiens
gacccactaaagag

SEQ ID NO: 5415464 - DNA, 16 bp, Homo sapiens
gacccactacccttct

SEQ ID NO: 5415465 - DNA, 23 bp, Homo sapiens
gacccactacccttctcctttcc

SEQ ID NO: 5415466 - DNA, 20 bp, Homo sapiens
gacccactccgactccccct

SEQ ID NO: 5415467 - DNA, 16 bp, Homo sapiens
gacccactgatctcta

SEQ ID NO: 5415468 - DNA, 22 bp, Homo sapiens
gacccactgcgcacagccccag

SEQ ID NO: 5415469 - DNA, 11 bp, Homo sapiens
gacccactgct

SEQ ID NO: 5415470 - DNA, 18 bp, Homo sapiens
gacccacttctcatcaca

SEQ ID NO: 5415471 - DNA, 19 bp, Homo sapiens
gacccacttctcatcacac

SEQ ID NO: 5415472 - DNA, 15 bp, Homo sapiens
gaccctctgtcccca

SEQ ID NO: 5415473 - DNA, 16 bp, Homo sapiens
gaccctctgtccccag

SEQ ID NO: 5415474 - DNA, 21 bp, Homo sapiens
gaccctctgtccccaggcctg

SEQ ID NO: 5415475 - DNA, 23 bp, Homo sapiens
gaccctctgtccccaggcctggc

SEQ ID NO: 5415476 - DNA, 15 bp, Homo sapiens
gaccctcttctctgg

SEQ ID NO: 5415477 - DNA, 13 bp, Homo sapiens
gaccctcttgccc

SEQ ID NO: 5415478 - DNA, 19 bp, Homo sapiens
gaccctcttgcccatcctg

SEQ ID NO: 5415479 - DNA, 18 bp, Homo sapiens
gaccctctttgctgaaga

SEQ ID NO: 5415480 - DNA, 14 bp, Homo sapiens
gaccctgaaatgtg

SEQ ID NO: 5415481 - DNA, 17 bp, Homo sapiens
gaccctgaacccacacc

SEQ ID NO: 5415482 - DNA, 19 bp, Homo sapiens
gaccctgaacccacacctg

SEQ ID NO: 5415483 - DNA, 10 bp, Homo sapiens
gaccctgagg

SEQ ID NO: 5415484 - DNA, 15 bp, Homo sapiens
gaccctgaggaggcc

SEQ ID NO: 5415485 - DNA, 16 bp, Homo sapiens
gaccctgaggcccaga

SEQ ID NO: 5415486 - DNA, 22 bp, Homo sapiens
gaccctgaggcccagagggcct

SEQ ID NO: 5415487 - DNA, 21 bp, Homo sapiens
gaccctgaggccctgggctgg

SEQ ID NO: 5415488 - DNA, 23 bp, Homo sapiens
gaccctgaggccctgggctgggt

SEQ ID NO: 5415489 - DNA, 17 bp, Homo sapiens
gaccctgagggctcctc

SEQ ID NO: 5415490 - DNA, 20 bp, Homo sapiens
gaccctgagggctcctccat

SEQ ID NO: 5415491 - DNA, 15 bp, Homo sapiens
gaccctgcaagacca

SEQ ID NO: 5415492 - DNA, 18 bp, Homo sapiens
gaccctgccaactttcca

SEQ ID NO: 5415493 - DNA, 18 bp, Homo sapiens
gaccctgccacagccaga

SEQ ID NO: 5415494 - DNA, 21 bp, Homo sapiens
gaccctgccacagccagagga

SEQ ID NO: 5415495 - DNA, 12 bp, Homo sapiens
gaccctgccagg

SEQ ID NO: 5415496 - DNA, 13 bp, Homo sapiens
gaccctgccaggc

SEQ ID NO: 5415497 - DNA, 13 bp, Homo sapiens
gaccctgccaggg

SEQ ID NO: 5415498 - DNA, 16 bp, Homo sapiens
gaccctgcccacccca

SEQ ID NO: 5415499 - DNA, 16 bp, Homo sapiens
gaccctgcccataccc

SEQ ID NO: 5415500 - DNA, 21 bp, Homo sapiens
gaccctgcccatacccctgcc

SEQ ID NO: 5415501 - DNA, 18 bp, Homo sapiens
gaccctgccccctgccag

SEQ ID NO: 5415502 - DNA, 16 bp, Homo sapiens
gaccctgccctgtggg

SEQ ID NO: 5415503 - DNA, 13 bp, Homo sapiens
gaccctgcccttg

SEQ ID NO: 5415504 - DNA, 11 bp, Homo sapiens
gaccctgcctc

SEQ ID NO: 5415505 - DNA, 17 bp, Homo sapiens
gaccctgcctcagctga

SEQ ID NO: 5415506 - DNA, 23 bp, Homo sapiens
gaccctgcctcagctgacccggc

SEQ ID NO: 5415507 - DNA, 15 bp, Homo sapiens
gaccctgcctgagcc

SEQ ID NO: 5415508 - DNA, 17 bp, Homo sapiens
gaccctgcctgagccca

SEQ ID NO: 5415509 - DNA, 23 bp, Homo sapiens
gaccctgcctgagcccaggagct

SEQ ID NO: 5415510 - DNA, 20 bp, Homo sapiens
gaccctgcgaaggggccctg

SEQ ID NO: 5415511 - DNA, 12 bp, Homo sapiens
gaccctgcggcc

SEQ ID NO: 5415512 - DNA, 14 bp, Homo sapiens
gaccctgcggcctc

SEQ ID NO: 5415513 - DNA, 12 bp, Homo sapiens
gaccctgctgac

SEQ ID NO: 5415514 - DNA, 16 bp, Homo sapiens
gaccctgctttagagc

SEQ ID NO: 5415515 - DNA, 19 bp, Homo sapiens
gaccctggaattcagcacc

SEQ ID NO: 5415516 - DNA, 19 bp, Homo sapiens
gaccctggagcggctctcc

SEQ ID NO: 5415517 - DNA, 12 bp, Homo sapiens
gaccctggagct

SEQ ID NO: 5415518 - DNA, 15 bp, Homo sapiens
gaccctggctcttct

SEQ ID NO: 5415519 - DNA, 16 bp, Homo sapiens
gaccctgggagagaag

SEQ ID NO: 5415520 - DNA, 20 bp, Homo sapiens
gaccctgggcaaacagagct

SEQ ID NO: 5415521 - DNA, 21 bp, Homo sapiens
gaccctgggcaaacagagcta

SEQ ID NO: 5415522 - DNA, 11 bp, Homo sapiens
gaccctggggc

SEQ ID NO: 5415523 - DNA, 18 bp, Homo sapiens
gaccctggggcaggggtg

SEQ ID NO: 5415524 - DNA, 14 bp, Homo sapiens
gaccctggggctgg

SEQ ID NO: 5415525 - DNA, 23 bp, Homo sapiens
gaccctgggtaggggaagagaag

SEQ ID NO: 5415526 - DNA, 19 bp, Homo sapiens
gaccctgggtgggctctgt

SEQ ID NO: 5415527 - DNA, 18 bp, Homo sapiens
gaccctggtgacctcctg

SEQ ID NO: 5415528 - DNA, 19 bp, Homo sapiens
gaccctggtgacctcctgt

SEQ ID NO: 5415529 - DNA, 21 bp, Homo sapiens
gaccctggtgacctcctgtca

SEQ ID NO: 5415530 - DNA, 20 bp, Homo sapiens
gaccctggtgggctgttcag

SEQ ID NO: 5415531 - DNA, 22 bp, Homo sapiens
gaccctggttactctggtgctg

SEQ ID NO: 5415532 - DNA, 22 bp, Homo sapiens
gaccctgtaaagggtcagggtg

SEQ ID NO: 5415533 - DNA, 11 bp, Homo sapiens
gaccctgtata

SEQ ID NO: 5415534 - DNA, 19 bp, Homo sapiens
gaccctgtatatagcccag

SEQ ID NO: 5415535 - DNA, 14 bp, Homo sapiens
gaccctgtccccta

SEQ ID NO: 5415536 - DNA, 16 bp, Homo sapiens
gaccctgtcctgcagt

SEQ ID NO: 5415537 - DNA, 24 bp, Homo sapiens
gaccctgtcctgcagtcccacact

SEQ ID NO: 5415538 - DNA, 23 bp, Homo sapiens
gaccctgtctcaaaaaaagaaaa

SEQ ID NO: 5415539 - DNA, 20 bp, Homo sapiens
gaccctgtcttctgggcaca

SEQ ID NO: 5415540 - DNA, 21 bp, Homo sapiens
gaccctgtgacatggtgcctg

SEQ ID NO: 5415541 - DNA, 11 bp, Homo sapiens
gaccctgtgcc

SEQ ID NO: 5415542 - DNA, 15 bp, Homo sapiens
gaccctgtgccccag

SEQ ID NO: 5415543 - DNA, 14 bp, Homo sapiens
gaccctgtgccccg

SEQ ID NO: 5415544 - DNA, 15 bp, Homo sapiens
gaccctgtgccccgc

SEQ ID NO: 5415545 - DNA, 20 bp, Homo sapiens
gaccctgtgccccgcctccc

SEQ ID NO: 5415546 - DNA, 22 bp, Homo sapiens
gaccctgtgccctccttcccaa

SEQ ID NO: 5415547 - DNA, 12 bp, Homo sapiens
gaccctgtgcct

SEQ ID NO: 5415548 - DNA, 22 bp, Homo sapiens
gaccctgtgtcctccaccatgc

SEQ ID NO: 5415549 - DNA, 13 bp, Homo sapiens
gaccctgtttctg

SEQ ID NO: 5415550 - DNA, 16 bp, Homo sapiens
gaccctgtttctgtag

SEQ ID NO: 5415551 - DNA, 16 bp, Homo sapiens
gaccctgttttccaca

SEQ ID NO: 5415552 - DNA, 17 bp, Homo sapiens
gaccctgttttccacac

SEQ ID NO: 5415553 - DNA, 20 bp, Homo sapiens
gacccttacagcctctgact

SEQ ID NO: 5415554 - DNA, 21 bp, Homo sapiens
gacccttattacacggaaaac

SEQ ID NO: 5415555 - DNA, 20 bp, Homo sapiens
gacccttattgctgtcctgg

SEQ ID NO: 5415556 - DNA, 15 bp, Homo sapiens
gacccttatttaaaa

SEQ ID NO: 5415557 - DNA, 14 bp, Homo sapiens
gacccttcagggcc

SEQ ID NO: 5415558 - DNA, 15 bp, Homo sapiens
gacccttcagggcca

SEQ ID NO: 5415559 - DNA, 20 bp, Homo sapiens
gacccttccagacatacgaa

SEQ ID NO: 5415560 - DNA, 23 bp, Homo sapiens
gacccttcccaatcagcactgaa

SEQ ID NO: 5415561 - DNA, 13 bp, Homo sapiens
gacccttctactt

SEQ ID NO: 5415562 - DNA, 21 bp, Homo sapiens
gacccttctccaaaggctctg

SEQ ID NO: 5415563 - DNA, 19 bp, Homo sapiens
gacccttctgtctgtaaga

SEQ ID NO: 5415564 - DNA, 21 bp, Homo sapiens
gacccttgacacctgctgaga

SEQ ID NO: 5415565 - DNA, 19 bp, Homo sapiens
gacccttgattcattctga

SEQ ID NO: 5415566 - DNA, 14 bp, Homo sapiens
gacccttgcctgcc

SEQ ID NO: 5415567 - DNA, 24 bp, Homo sapiens
gacccttggcctccatttctgtct

SEQ ID NO: 5415568 - DNA, 20 bp, Homo sapiens
gaccctttcagaatcttttc

SEQ ID NO: 5415569 - DNA, 22 bp, Homo sapiens
gaccctttccttccttccctgg

SEQ ID NO: 5415570 - DNA, 22 bp, Homo sapiens
gaccctttgcctttcttctgcc

SEQ ID NO: 5415571 - DNA, 12 bp, Homo sapiens
gaccctttgggg

SEQ ID NO: 5415572 - DNA, 12 bp, Homo sapiens
gacccttttcat

SEQ ID NO: 5415573 - DNA, 18 bp, Homo sapiens
gacccttttgggtttctg

SEQ ID NO: 5415574 - DNA, 17 bp, Homo sapiens
gacccttttgtgtctat

SEQ ID NO: 5415575 - DNA, 16 bp, Homo sapiens
gaccctttttggacta

SEQ ID NO: 5415576 - DNA, 15 bp, Homo sapiens
gaccgacgcccctcc

SEQ ID NO: 5415577 - DNA, 17 bp, Homo sapiens
gaccgacgcccctccgg

SEQ ID NO: 5415578 - DNA, 22 bp, Homo sapiens
gaccgagatgtgagtcctgttg

SEQ ID NO: 5415579 - DNA, 18 bp, Homo sapiens
gaccgaggacacagtgga

SEQ ID NO: 5415580 - DNA, 16 bp, Homo sapiens
gaccgagtgtggagct

SEQ ID NO: 5415581 - DNA, 22 bp, Homo sapiens
gaccgatgtgtctcccagaact

SEQ ID NO: 5415582 - DNA, 15 bp, Homo sapiens
gaccgattatgcttt

SEQ ID NO: 5415583 - DNA, 21 bp, Homo sapiens
gaccgattatgctttctttgg

SEQ ID NO: 5415584 - DNA, 16 bp, Homo sapiens
gaccgcatcctccagg

SEQ ID NO: 5415585 - DNA, 22 bp, Homo sapiens
gaccgccagatggggcctctgt

SEQ ID NO: 5415586 - DNA, 16 bp, Homo sapiens
gaccgccatggtgctg

SEQ ID NO: 5415587 - DNA, 14 bp, Homo sapiens
gaccgcccagctct

SEQ ID NO: 5415588 - DNA, 13 bp, Homo sapiens
gaccgccccaggg

SEQ ID NO: 5415589 - DNA, 12 bp, Homo sapiens
gaccgccctccg

SEQ ID NO: 5415590 - DNA, 23 bp, Homo sapiens
gaccgcctgcttcacacccctca

SEQ ID NO: 5415591 - DNA, 15 bp, Homo sapiens
gaccgcgcccctggg

SEQ ID NO: 5415592 - DNA, 20 bp, Homo sapiens
gaccgcgtagagagccgggc

SEQ ID NO: 5415593 - DNA, 21 bp, Homo sapiens
gaccgctacaccactctggca

SEQ ID NO: 5415594 - DNA, 23 bp, Homo sapiens
gaccgctacaccactctggcagc

SEQ ID NO: 5415595 - DNA, 18 bp, Homo sapiens
gaccgctgcccaggtggg

SEQ ID NO: 5415596 - DNA, 20 bp, Homo sapiens
gaccgcttgtggggacccag

SEQ ID NO: 5415597 - DNA, 17 bp, Homo sapiens
gaccggaagttgaggct

SEQ ID NO: 5415598 - DNA, 17 bp, Homo sapiens
gaccggaattgagaggt

SEQ ID NO: 5415599 - DNA, 18 bp, Homo sapiens
gaccggagcggctgagga

SEQ ID NO: 5415600 - DNA, 21 bp, Homo sapiens
gaccggaggcaaaaggcagtg

SEQ ID NO: 5415601 - DNA, 13 bp, Homo sapiens
gaccggcagagct

SEQ ID NO: 5415602 - DNA, 23 bp, Homo sapiens
gaccggcagagctctacaggcct

SEQ ID NO: 5415603 - DNA, 11 bp, Homo sapiens
gaccggcccgc

SEQ ID NO: 5415604 - DNA, 15 bp, Homo sapiens
gaccggccctgcccc

SEQ ID NO: 5415605 - DNA, 18 bp, Homo sapiens
gaccggccgcagccccca

SEQ ID NO: 5415606 - DNA, 15 bp, Homo sapiens
gaccggcctgccagg

SEQ ID NO: 5415607 - DNA, 19 bp, Homo sapiens
gaccggcctgccaggagga

SEQ ID NO: 5415608 - DNA, 15 bp, Homo sapiens
gaccggcggctcgga

SEQ ID NO: 5415609 - DNA, 23 bp, Homo sapiens
gaccgggcactcccgggatgggt

SEQ ID NO: 5415610 - DNA, 12 bp, Homo sapiens
gaccgggccagg

SEQ ID NO: 5415611 - DNA, 15 bp, Homo sapiens
gaccgggcccccctg

SEQ ID NO: 5415612 - DNA, 19 bp, Homo sapiens
gaccgggcccctctctagg

SEQ ID NO: 5415613 - DNA, 21 bp, Homo sapiens
gaccgggcctcccctccatgg

SEQ ID NO: 5415614 - DNA, 18 bp, Homo sapiens
gaccgggggctgctgggc

SEQ ID NO: 5415615 - DNA, 18 bp, Homo sapiens
gaccggggtcctgaggct

SEQ ID NO: 5415616 - DNA, 15 bp, Homo sapiens
gaccgggtgggcctg

SEQ ID NO: 5415617 - DNA, 20 bp, Homo sapiens
gaccgggtgggcctggcctg

SEQ ID NO: 5415618 - DNA, 15 bp, Homo sapiens
gaccggtgctgcagg

SEQ ID NO: 5415619 - DNA, 17 bp, Homo sapiens
gaccggtgctgcaggag

SEQ ID NO: 5415620 - DNA, 15 bp, Homo sapiens
gaccggtgcttttat

SEQ ID NO: 5415621 - DNA, 16 bp, Homo sapiens
gaccgtactctcacat

SEQ ID NO: 5415622 - DNA, 22 bp, Homo sapiens
gaccgtatacttaaaatgacaa

SEQ ID NO: 5415623 - DNA, 13 bp, Homo sapiens
gaccgtcctcacc

SEQ ID NO: 5415624 - DNA, 17 bp, Homo sapiens
gaccgtgaggccagaga

SEQ ID NO: 5415625 - DNA, 16 bp, Homo sapiens
gaccgtgcgagctgcc

SEQ ID NO: 5415626 - DNA, 18 bp, Homo sapiens
gaccgtgggcggggcctt

SEQ ID NO: 5415627 - DNA, 17 bp, Homo sapiens
gaccgtgggtcatgcag

SEQ ID NO: 5415628 - DNA, 17 bp, Homo sapiens
gaccgtggtgtcctctg

SEQ ID NO: 5415629 - DNA, 12 bp, Homo sapiens
gaccgtgtacaa

SEQ ID NO: 5415630 - DNA, 13 bp, Homo sapiens
gaccgtgtacaat

SEQ ID NO: 5415631 - DNA, 14 bp, Homo sapiens
gaccgttaaaaaat

SEQ ID NO: 5415632 - DNA, 22 bp, Homo sapiens
gaccgttataaagtgtgccaca

SEQ ID NO: 5415633 - DNA, 18 bp, Homo sapiens
gaccgtttccaagctgcg

SEQ ID NO: 5415634 - DNA, 21 bp, Homo sapiens
gaccgttttcatcctggcctc

SEQ ID NO: 5415635 - DNA, 17 bp, Homo sapiens
gaccgttttgtattgct

SEQ ID NO: 5415636 - DNA, 18 bp, Homo sapiens
gaccgttttgtattgctt

SEQ ID NO: 5415637 - DNA, 17 bp, Homo sapiens
gacctaaagcaagcctg

SEQ ID NO: 5415638 - DNA, 23 bp, Homo sapiens
gacctaaagggtatgagctggag

SEQ ID NO: 5415639 - DNA, 19 bp, Homo sapiens
gacctaaatccattttcta

SEQ ID NO: 5415640 - DNA, 12 bp, Homo sapiens
gacctaaatgac

SEQ ID NO: 5415641 - DNA, 16 bp, Homo sapiens
gacctaaatggcctca

SEQ ID NO: 5415642 - DNA, 13 bp, Homo sapiens
gacctaaattcgt

SEQ ID NO: 5415643 - DNA, 17 bp, Homo sapiens
gacctaacattcgatct

SEQ ID NO: 5415644 - DNA, 18 bp, Homo sapiens
gacctaaccagggccaga

SEQ ID NO: 5415645 - DNA, 22 bp, Homo sapiens
gacctaaccagggccagaagta

SEQ ID NO: 5415646 - DNA, 14 bp, Homo sapiens
gacctaacctagga

SEQ ID NO: 5415647 - DNA, 14 bp, Homo sapiens
gacctaaggcagac

SEQ ID NO: 5415648 - DNA, 19 bp, Homo sapiens
gacctaaggcagacaggaa

SEQ ID NO: 5415649 - DNA, 13 bp, Homo sapiens
gacctaatatcat

SEQ ID NO: 5415650 - DNA, 16 bp, Homo sapiens
gaccttgcaacttcat

SEQ ID NO: 5415651 - DNA, 23 bp, Homo sapiens
gaccttgcaacttcatgtcaact

SEQ ID NO: 5415652 - DNA, 15 bp, Homo sapiens
gaccttgctgccaca

SEQ ID NO: 5415653 - DNA, 18 bp, Homo sapiens
gaccttggaatcgtccct

SEQ ID NO: 5415654 - DNA, 18 bp, Homo sapiens
gaccttggagagacacag

SEQ ID NO: 5415655 - DNA, 19 bp, Homo sapiens
gaccttggcgctctcagct

SEQ ID NO: 5415656 - DNA, 19 bp, Homo sapiens
gaccttgggcaagtccctt

SEQ ID NO: 5415657 - DNA, 17 bp, Homo sapiens
gaccttgggcacatctg

SEQ ID NO: 5415658 - DNA, 19 bp, Homo sapiens
gaccttgtctctacaaaaa

SEQ ID NO: 5415659 - DNA, 15 bp, Homo sapiens
gaccttgttcacact

SEQ ID NO: 5415660 - DNA, 22 bp, Homo sapiens
gacctttaaaaagcaggaaata

SEQ ID NO: 5415661 - DNA, 21 bp, Homo sapiens
gacctttaggtcaaactccct

SEQ ID NO: 5415662 - DNA, 11 bp, Homo sapiens
gacctttattt

SEQ ID NO: 5415663 - DNA, 18 bp, Homo sapiens
gacctttatttttctatc

SEQ ID NO: 5415664 - DNA, 11 bp, Homo sapiens
gacctttcaat

SEQ ID NO: 5415665 - DNA, 19 bp, Homo sapiens
gacctttcaataggaaaaa

SEQ ID NO: 5415666 - DNA, 21 bp, Homo sapiens
gacctttcaataggaaaaact

SEQ ID NO: 5415667 - DNA, 21 bp, Homo sapiens
gacctttcatcgtaaagtgct

SEQ ID NO: 5415668 - DNA, 17 bp, Homo sapiens
gacctttccaccacagc

SEQ ID NO: 5415669 - DNA, 21 bp, Homo sapiens
gacctttccaccacagccagc

SEQ ID NO: 5415670 - DNA, 17 bp, Homo sapiens
gacctttcctgaggaag

SEQ ID NO: 5415671 - DNA, 14 bp, Homo sapiens
gacctttgcccaca

SEQ ID NO: 5415672 - DNA, 19 bp, Homo sapiens
gacctttgtacagcccaga

SEQ ID NO: 5415673 - DNA, 18 bp, Homo sapiens
gacctttgtctgaaggat

SEQ ID NO: 5415674 - DNA, 23 bp, Homo sapiens
gacctttgtctgaaggattttaa

SEQ ID NO: 5415675 - DNA, 22 bp, Homo sapiens
gaccttttaaagtgtttcagct

SEQ ID NO: 5415676 - DNA, 16 bp, Homo sapiens
gaccttttctctccca

SEQ ID NO: 5415677 - DNA, 17 bp, Homo sapiens
gaccttttctctcccat

SEQ ID NO: 5415678 - DNA, 18 bp, Homo sapiens
gaccttttcttcattttg

SEQ ID NO: 5415679 - DNA, 14 bp, Homo sapiens
gaccttttgctgcc

SEQ ID NO: 5415680 - DNA, 21 bp, Homo sapiens
gaccttttggcctttgtaaga

SEQ ID NO: 5415681 - DNA, 15 bp, Homo sapiens
gacctttttaatcca

SEQ ID NO: 5415682 - DNA, 17 bp, Homo sapiens
gacctttttaatccagg

SEQ ID NO: 5415683 - DNA, 15 bp, Homo sapiens
gacctttttctctct

SEQ ID NO: 5415684 - DNA, 16 bp, Homo sapiens
gacgaaaaagaggcat

SEQ ID NO: 5415685 - DNA, 14 bp, Homo sapiens
gacgaaatggaaac

SEQ ID NO: 5415686 - DNA, 20 bp, Homo sapiens
gacgaaatggaaacacacac

SEQ ID NO: 5415687 - DNA, 21 bp, Homo sapiens
gacgaacatccaaccttccca

SEQ ID NO: 5415688 - DNA, 15 bp, Homo sapiens
gacgaagagcaggcc

SEQ ID NO: 5415689 - DNA, 20 bp, Homo sapiens
gacgaagcggagagagccaa

SEQ ID NO: 5415690 - DNA, 16 bp, Homo sapiens
gacgaatgcatattca

SEQ ID NO: 5415691 - DNA, 17 bp, Homo sapiens
gacgaattccactcgtc

SEQ ID NO: 5415692 - DNA, 21 bp, Homo sapiens
gacgacacctggagactgtcc

SEQ ID NO: 5415693 - DNA, 15 bp, Homo sapiens
gacgacctacatctg

SEQ ID NO: 5415694 - DNA, 14 bp, Homo sapiens
gacgacctttacct

SEQ ID NO: 5415695 - DNA, 19 bp, Homo sapiens
gacgacgcgagggccccac

SEQ ID NO: 5415696 - DNA, 18 bp, Homo sapiens
gacgactagcccaggacc

SEQ ID NO: 5415697 - DNA, 20 bp, Homo sapiens
gacgactgttttcccaacac

SEQ ID NO: 5415698 - DNA, 21 bp, Homo sapiens
gacgagacaacagcacacagg

SEQ ID NO: 5415699 - DNA, 22 bp, Homo sapiens
gacgagacccaagggcagagca

SEQ ID NO: 5415700 - DNA, 13 bp, Homo sapiens
gacgagcagagcg

SEQ ID NO: 5415701 - DNA, 20 bp, Homo sapiens
gacgagcatccccctcctct

SEQ ID NO: 5415702 - DNA, 17 bp, Homo sapiens
gacgaggccctcgggcc

SEQ ID NO: 5415703 - DNA, 22 bp, Homo sapiens
gacgagggagtgtctgtaagga

SEQ ID NO: 5415704 - DNA, 21 bp, Homo sapiens
gacgagggatgggatttcatg

SEQ ID NO: 5415705 - DNA, 12 bp, Homo sapiens
gacgaggggcag

SEQ ID NO: 5415706 - DNA, 14 bp, Homo sapiens
gacgaggggcaggg

SEQ ID NO: 5415707 - DNA, 16 bp, Homo sapiens
gacgagttcatgggga

SEQ ID NO: 5415708 - DNA, 21 bp, Homo sapiens
gacgatatactccctgccctt

SEQ ID NO: 5415709 - DNA, 15 bp, Homo sapiens
gacgatcacagaaac

SEQ ID NO: 5415710 - DNA, 13 bp, Homo sapiens
gacgatcgcccag

SEQ ID NO: 5415711 - DNA, 18 bp, Homo sapiens
gacgatcgcccaggctgg

SEQ ID NO: 5415712 - DNA, 18 bp, Homo sapiens
gacgatcttcccccttcc

SEQ ID NO: 5415713 - DNA, 22 bp, Homo sapiens
gacgatcttgctggcagggcct

SEQ ID NO: 5415714 - DNA, 23 bp, Homo sapiens
gacgatgccgtgtgtctcgtctc

SEQ ID NO: 5415715 - DNA, 18 bp, Homo sapiens
gacgattatttatttctg

SEQ ID NO: 5415716 - DNA, 18 bp, Homo sapiens
gacgattccttctctgaa

SEQ ID NO: 5415717 - DNA, 14 bp, Homo sapiens
gacgcaagggagaa

SEQ ID NO: 5415718 - DNA, 15 bp, Homo sapiens
gacgcaaggtgtgct

SEQ ID NO: 5415719 - DNA, 13 bp, Homo sapiens
gacgcacacagct

SEQ ID NO: 5415720 - DNA, 11 bp, Homo sapiens
gacgcacagca

SEQ ID NO: 5415721 - DNA, 12 bp, Homo sapiens
gacgcacagcac

SEQ ID NO: 5415722 - DNA, 22 bp, Homo sapiens
gacgcaccgccgccaccagccc

SEQ ID NO: 5415723 - DNA, 24 bp, Homo sapiens
gacgcaccgcctgaaggcacagct

SEQ ID NO: 5415724 - DNA, 23 bp, Homo sapiens
gacgcaccggcctggctgcagct

SEQ ID NO: 5415725 - DNA, 22 bp, Homo sapiens
gacgcagcagctgggacccctc

SEQ ID NO: 5415726 - DNA, 16 bp, Homo sapiens
gacgcagccacacagt

SEQ ID NO: 5415727 - DNA, 20 bp, Homo sapiens
gacgcagccacacagtggcc

SEQ ID NO: 5415728 - DNA, 20 bp, Homo sapiens
gacgcagccctgggggccag

SEQ ID NO: 5415729 - DNA, 22 bp, Homo sapiens
gacgcagccctgggggccagct

SEQ ID NO: 5415730 - DNA, 15 bp, Homo sapiens
gacgcagcctgagaa

SEQ ID NO: 5415731 - DNA, 16 bp, Homo sapiens
gacgcagcctgagaat

SEQ ID NO: 5415732 - DNA, 23 bp, Homo sapiens
gacgcaggagctgtggaaatggt

SEQ ID NO: 5415733 - DNA, 13 bp, Homo sapiens
gacgcaggccctg

SEQ ID NO: 5415734 - DNA, 14 bp, Homo sapiens
gacgcaggccctgt

SEQ ID NO: 5415735 - DNA, 18 bp, Homo sapiens
gacgcagggagaccctgg

SEQ ID NO: 5415736 - DNA, 20 bp, Homo sapiens
gacgcagggagaccctggga

SEQ ID NO: 5415737 - DNA, 16 bp, Homo sapiens
gacgcagtccgcccag

SEQ ID NO: 5415738 - DNA, 13 bp, Homo sapiens
gacgcatgcaggg

SEQ ID NO: 5415739 - DNA, 16 bp, Homo sapiens
gacgcatgcagggccc

SEQ ID NO: 5415740 - DNA, 22 bp, Homo sapiens
gacgcatgccctcaatcccagc

SEQ ID NO: 5415741 - DNA, 19 bp, Homo sapiens
gacgcatgtaaagatgctg

SEQ ID NO: 5415742 - DNA, 14 bp, Homo sapiens
gacgccaccattcc

SEQ ID NO: 5415743 - DNA, 16 bp, Homo sapiens
gacgccaccattcctg

SEQ ID NO: 5415744 - DNA, 14 bp, Homo sapiens
gacgccacccagca

SEQ ID NO: 5415745 - DNA, 17 bp, Homo sapiens
gacgccacggagggctg

SEQ ID NO: 5415746 - DNA, 16 bp, Homo sapiens
gacgccactcatttca

SEQ ID NO: 5415747 - DNA, 18 bp, Homo sapiens
gacgccactccctgggac

SEQ ID NO: 5415748 - DNA, 12 bp, Homo sapiens
gacgccaggcac

SEQ ID NO: 5415749 - DNA, 11 bp, Homo sapiens
gacgcccaccc

SEQ ID NO: 5415750 - DNA, 15 bp, Homo sapiens
gacgcccagccccat

SEQ ID NO: 5415751 - DNA, 17 bp, Homo sapiens
gacgcccagccccatcc

SEQ ID NO: 5415752 - DNA, 21 bp, Homo sapiens
gacgcccagcccccacccccg

SEQ ID NO: 5415753 - DNA, 22 bp, Homo sapiens
gacgcccagctccgcctgctgg

SEQ ID NO: 5415754 - DNA, 20 bp, Homo sapiens
gacgcccagctgaggctggg

SEQ ID NO: 5415755 - DNA, 22 bp, Homo sapiens
gacgccccggggcgcctagagc

SEQ ID NO: 5415756 - DNA, 23 bp, Homo sapiens
gacgcccctccctcctctggccc

SEQ ID NO: 5415757 - DNA, 15 bp, Homo sapiens
gacgccgtcccacca

SEQ ID NO: 5415758 - DNA, 18 bp, Homo sapiens
gacgcctccggtgagcag

SEQ ID NO: 5415759 - DNA, 18 bp, Homo sapiens
gacgcctctggacctcgg

SEQ ID NO: 5415760 - DNA, 16 bp, Homo sapiens
gacgcctgagacagca

SEQ ID NO: 5415761 - DNA, 17 bp, Homo sapiens
gacgcctgagacagcac

SEQ ID NO: 5415762 - DNA, 23 bp, Homo sapiens
gacgcctgccctccccagagcac

SEQ ID NO: 5415763 - DNA, 13 bp, Homo sapiens
gacgcctggctcc

SEQ ID NO: 5415764 - DNA, 15 bp, Homo sapiens
gacgcctggctccag

SEQ ID NO: 5415765 - DNA, 17 bp, Homo sapiens
gacgcctggctccaggc

SEQ ID NO: 5415766 - DNA, 19 bp, Homo sapiens
gacgcctgggggtgccagg

SEQ ID NO: 5415767 - DNA, 23 bp, Homo sapiens
gacgcctgtctgtgtgcatcatg

SEQ ID NO: 5415768 - DNA, 20 bp, Homo sapiens
gacgcctgtgccaccccttc

SEQ ID NO: 5415769 - DNA, 22 bp, Homo sapiens
gacgccttccaggtcaggatgc

SEQ ID NO: 5415770 - DNA, 19 bp, Homo sapiens
gacgccttcctctctggat

SEQ ID NO: 5415771 - DNA, 22 bp, Homo sapiens
gacgcgaggggaaaggcctgtg

SEQ ID NO: 5415772 - DNA, 17 bp, Homo sapiens
gacgctaataaaaattt

SEQ ID NO: 5415773 - DNA, 23 bp, Homo sapiens
gacgctacccgggaagggggctg

SEQ ID NO: 5415774 - DNA, 14 bp, Homo sapiens
gacgctctctggcc

SEQ ID NO: 5415775 - DNA, 16 bp, Homo sapiens
gacgctctctggcctt

SEQ ID NO: 5415776 - DNA, 14 bp, Homo sapiens
gacgctcttttcta

SEQ ID NO: 5415777 - DNA, 22 bp, Homo sapiens
gacgctgatacataactaaatt

SEQ ID NO: 5415778 - DNA, 19 bp, Homo sapiens
gacgctgcacttgacacca

SEQ ID NO: 5415779 - DNA, 13 bp, Homo sapiens
gacgctgcagagc

SEQ ID NO: 5415780 - DNA, 21 bp, Homo sapiens
gacgctgccgctgccgctgca

SEQ ID NO: 5415781 - DNA, 14 bp, Homo sapiens
gacgctgccgggag

SEQ ID NO: 5415782 - DNA, 14 bp, Homo sapiens
gacgctggagatgc

SEQ ID NO: 5415783 - DNA, 13 bp, Homo sapiens
gacgctggctact

SEQ ID NO: 5415784 - DNA, 14 bp, Homo sapiens
gacgctggtaactg

SEQ ID NO: 5415785 - DNA, 18 bp, Homo sapiens
gacgctggtagagatgga

SEQ ID NO: 5415786 - DNA, 22 bp, Homo sapiens
gacgctgtccattgccacggcc

SEQ ID NO: 5415787 - DNA, 23 bp, Homo sapiens
gacgctgtccattgccacggcca

SEQ ID NO: 5415788 - DNA, 22 bp, Homo sapiens
gacgctgtgattggcaggaggc

SEQ ID NO: 5415789 - DNA, 17 bp, Homo sapiens
gacgctgtgctgccctg

SEQ ID NO: 5415790 - DNA, 18 bp, Homo sapiens
gacgctgtgctgccctgc

SEQ ID NO: 5415791 - DNA, 21 bp, Homo sapiens
gacgctgtgctgccctgccca

SEQ ID NO: 5415792 - DNA, 11 bp, Homo sapiens
gacgcttccag

SEQ ID NO: 5415793 - DNA, 14 bp, Homo sapiens
gacgcttccagacc

SEQ ID NO: 5415794 - DNA, 18 bp, Homo sapiens
gacgcttccagaccacct

SEQ ID NO: 5415795 - DNA, 19 bp, Homo sapiens
gacgcttccagaccacctg

SEQ ID NO: 5415796 - DNA, 12 bp, Homo sapiens
gacgcttccctt

SEQ ID NO: 5415797 - DNA, 13 bp, Homo sapiens
gacgcttctgaat

SEQ ID NO: 5415798 - DNA, 20 bp, Homo sapiens
gacgcttttgagtgggccct

SEQ ID NO: 5415799 - DNA, 21 bp, Homo sapiens
gacggaagtggcctgagaaga

SEQ ID NO: 5415800 - DNA, 14 bp, Homo sapiens
gacggaatctgccg

SEQ ID NO: 5415801 - DNA, 14 bp, Homo sapiens
gacggactcagact

SEQ ID NO: 5415802 - DNA, 21 bp, Homo sapiens
gacggactcagactcctggct

SEQ ID NO: 5415803 - DNA, 22 bp, Homo sapiens
gacggagatgaagaacatctgg

SEQ ID NO: 5415804 - DNA, 22 bp, Homo sapiens
gacggagccactggggtgggag

SEQ ID NO: 5415805 - DNA, 23 bp, Homo sapiens
gacggagccactggggtgggagg

SEQ ID NO: 5415806 - DNA, 18 bp, Homo sapiens
gacggaggcaggaccagg

SEQ ID NO: 5415807 - DNA, 21 bp, Homo sapiens
gacggaggtccccggttgctg

SEQ ID NO: 5415808 - DNA, 14 bp, Homo sapiens
gacggaggtgcctg

SEQ ID NO: 5415809 - DNA, 13 bp, Homo sapiens
gacggagtcccac

SEQ ID NO: 5415810 - DNA, 14 bp, Homo sapiens
gacggagtcccacc

SEQ ID NO: 5415811 - DNA, 19 bp, Homo sapiens
gacggagtctcgctctgtc

SEQ ID NO: 5415812 - DNA, 18 bp, Homo sapiens
gacggagttcagagggtg

SEQ ID NO: 5415813 - DNA, 18 bp, Homo sapiens
gacggatgcccattcctg

SEQ ID NO: 5415814 - DNA, 16 bp, Homo sapiens
gacggatggaaggaga

SEQ ID NO: 5415815 - DNA, 17 bp, Homo sapiens
gacggatggaaggagag

SEQ ID NO: 5415816 - DNA, 11 bp, Homo sapiens
gacggatggca

SEQ ID NO: 5415817 - DNA, 22 bp, Homo sapiens
gacggcactgagagagcgcagc

SEQ ID NO: 5415818 - DNA, 13 bp, Homo sapiens
gacggcagcccca

SEQ ID NO: 5415819 - DNA, 16 bp, Homo sapiens
gacggcagccccatcc

SEQ ID NO: 5415820 - DNA, 11 bp, Homo sapiens
gacggcaggct

SEQ ID NO: 5415821 - DNA, 16 bp, Homo sapiens
gacggcaggctcactg

SEQ ID NO: 5415822 - DNA, 19 bp, Homo sapiens
gacggcaggctcactgcca

SEQ ID NO: 5415823 - DNA, 19 bp, Homo sapiens
gacggccaggctccctgac

SEQ ID NO: 5415824 - DNA, 12 bp, Homo sapiens
gacggccctgca

SEQ ID NO: 5415825 - DNA, 17 bp, Homo sapiens
gacggccctgcctgcct

SEQ ID NO: 5415826 - DNA, 12 bp, Homo sapiens
gacggccctgct

SEQ ID NO: 5415827 - DNA, 14 bp, Homo sapiens
gactctaggttata

SEQ ID NO: 5415828 - DNA, 22 bp, Homo sapiens
gactctaggttatacaataacc

SEQ ID NO: 5415829 - DNA, 18 bp, Homo sapiens
gactctagtactgtgaat

SEQ ID NO: 5415830 - DNA, 19 bp, Homo sapiens
gactctagtactgtgaatc

SEQ ID NO: 5415831 - DNA, 13 bp, Homo sapiens
gactctatgctct

SEQ ID NO: 5415832 - DNA, 14 bp, Homo sapiens
gactctatgctctg

SEQ ID NO: 5415833 - DNA, 22 bp, Homo sapiens
gactctattttaatgtatattt

SEQ ID NO: 5415834 - DNA, 23 bp, Homo sapiens
gactctattttaatgtatatttg

SEQ ID NO: 5415835 - DNA, 20 bp, Homo sapiens
gactctcacactgaatcagc

SEQ ID NO: 5415836 - DNA, 19 bp, Homo sapiens
gactctcagcccagaagaa

SEQ ID NO: 5415837 - DNA, 14 bp, Homo sapiens
gactctcagtctct

SEQ ID NO: 5415838 - DNA, 12 bp, Homo sapiens
gactctccaggg

SEQ ID NO: 5415839 - DNA, 13 bp, Homo sapiens
gactctccaggga

SEQ ID NO: 5415840 - DNA, 15 bp, Homo sapiens
gactctcccaggcct

SEQ ID NO: 5415841 - DNA, 15 bp, Homo sapiens
gactctcctcctccc

SEQ ID NO: 5415842 - DNA, 16 bp, Homo sapiens
gactctcctcctcccc

SEQ ID NO: 5415843 - DNA, 20 bp, Homo sapiens
gactctcctcctcccctcct

SEQ ID NO: 5415844 - DNA, 14 bp, Homo sapiens
gactctctccagga

SEQ ID NO: 5415845 - DNA, 16 bp, Homo sapiens
gactctctccatcaga

SEQ ID NO: 5415846 - DNA, 14 bp, Homo sapiens
gactctctgacaaa

SEQ ID NO: 5415847 - DNA, 17 bp, Homo sapiens
gactctctgacaaagtg

SEQ ID NO: 5415848 - DNA, 19 bp, Homo sapiens
gactctctgtgacctgccc

SEQ ID NO: 5415849 - DNA, 20 bp, Homo sapiens
gactctgaaaaacattccag

SEQ ID NO: 5415850 - DNA, 17 bp, Homo sapiens
gactctgaagcctctgg

SEQ ID NO: 5415851 - DNA, 18 bp, Homo sapiens
gactctgaagcctctggg

SEQ ID NO: 5415852 - DNA, 20 bp, Homo sapiens
gactctgaatctttttcaga

SEQ ID NO: 5415853 - DNA, 17 bp, Homo sapiens
gactctgacctcttggc

SEQ ID NO: 5415854 - DNA, 12 bp, Homo sapiens
gactctgagaaa

SEQ ID NO: 5415855 - DNA, 21 bp, Homo sapiens
gactctgagatgtggagactg

SEQ ID NO: 5415856 - DNA, 19 bp, Homo sapiens
gactctgagcgggaggcag

SEQ ID NO: 5415857 - DNA, 22 bp, Homo sapiens
gactctgagcgggaggcagagt

SEQ ID NO: 5415858 - DNA, 13 bp, Homo sapiens
gactctgagctgc

SEQ ID NO: 5415859 - DNA, 14 bp, Homo sapiens
gactctgagctgct

SEQ ID NO: 5415860 - DNA, 13 bp, Homo sapiens
gactctgaggtgt

SEQ ID NO: 5415861 - DNA, 23 bp, Homo sapiens
gactctgatggaatgtgccacct

SEQ ID NO: 5415862 - DNA, 19 bp, Homo sapiens
gactctgcagagtcactca

SEQ ID NO: 5415863 - DNA, 13 bp, Homo sapiens
gactctgcagcct

SEQ ID NO: 5415864 - DNA, 16 bp, Homo sapiens
gactctgcagcctcag

SEQ ID NO: 5415865 - DNA, 18 bp, Homo sapiens
gactctgcagcctcagag

SEQ ID NO: 5415866 - DNA, 19 bp, Homo sapiens
gactctgcatcccagcacc

SEQ ID NO: 5415867 - DNA, 22 bp, Homo sapiens
gactctgcatcccagcacctgc

SEQ ID NO: 5415868 - DNA, 13 bp, Homo sapiens
gactctgccaggg

SEQ ID NO: 5415869 - DNA, 18 bp, Homo sapiens
gactctgccagggtgggg

SEQ ID NO: 5415870 - DNA, 10 bp, Homo sapiens
gactctgccc

SEQ ID NO: 5415871 - DNA, 15 bp, Homo sapiens
gactctgccccctgc

SEQ ID NO: 5415872 - DNA, 18 bp, Homo sapiens
gactctgccccctgctgg

SEQ ID NO: 5415873 - DNA, 21 bp, Homo sapiens
gactctgcctaaccatgggct

SEQ ID NO: 5415874 - DNA, 22 bp, Homo sapiens
gactctgcctaaccatgggctc

SEQ ID NO: 5415875 - DNA, 16 bp, Homo sapiens
gactctgcctcctctt

SEQ ID NO: 5415876 - DNA, 22 bp, Homo sapiens
gactctgcctcctggtttcctt

SEQ ID NO: 5415877 - DNA, 21 bp, Homo sapiens
gactctgccttttttcacagc

SEQ ID NO: 5415878 - DNA, 15 bp, Homo sapiens
gactctgcgggaggc

SEQ ID NO: 5415879 - DNA, 18 bp, Homo sapiens
gactctgcgggaggctgg

SEQ ID NO: 5415880 - DNA, 15 bp, Homo sapiens
gactctgctctcctc

SEQ ID NO: 5415881 - DNA, 16 bp, Homo sapiens
gactctgctctcctcg

SEQ ID NO: 5415882 - DNA, 19 bp, Homo sapiens
gactctgctctcctcgggc

SEQ ID NO: 5415883 - DNA, 23 bp, Homo sapiens
gactctgctctcctcgggccctg

SEQ ID NO: 5415884 - DNA, 16 bp, Homo sapiens
gactctgctcttgcat

SEQ ID NO: 5415885 - DNA, 13 bp, Homo sapiens
gactctgctgctc

SEQ ID NO: 5415886 - DNA, 20 bp, Homo sapiens
gactctgcttaaacaaagca

SEQ ID NO: 5415887 - DNA, 20 bp, Homo sapiens
gactctggaaccatcctctg

SEQ ID NO: 5415888 - DNA, 22 bp, Homo sapiens
gactctggaaccatcctctgtt

SEQ ID NO: 5415889 - DNA, 14 bp, Homo sapiens
gactctggaagatt

SEQ ID NO: 5415890 - DNA, 20 bp, Homo sapiens
gactctggaagattttcatt

SEQ ID NO: 5415891 - DNA, 22 bp, Homo sapiens
gactctggaagattttcattga

SEQ ID NO: 5415892 - DNA, 19 bp, Homo sapiens
gactctggaagccccccac

SEQ ID NO: 5415893 - DNA, 18 bp, Homo sapiens
gactctggacaatctcac

SEQ ID NO: 5415894 - DNA, 16 bp, Homo sapiens
gactctggaccatgct

SEQ ID NO: 5415895 - DNA, 17 bp, Homo sapiens
gactctggaccatgctg

SEQ ID NO: 5415896 - DNA, 13 bp, Homo sapiens
gactctggactgg

SEQ ID NO: 5415897 - DNA, 14 bp, Homo sapiens
gactctggactggg

SEQ ID NO: 5415898 - DNA, 17 bp, Homo sapiens
gactctggactgggaag

SEQ ID NO: 5415899 - DNA, 17 bp, Homo sapiens
gactctggactttctct

SEQ ID NO: 5415900 - DNA, 18 bp, Homo sapiens
gactctggagccaaggca

SEQ ID NO: 5415901 - DNA, 18 bp, Homo sapiens
gactctggatatttgcac

SEQ ID NO: 5415902 - DNA, 12 bp, Homo sapiens
gactctggccct

SEQ ID NO: 5415903 - DNA, 12 bp, Homo sapiens
gactctggcctc

SEQ ID NO: 5415904 - DNA, 15 bp, Homo sapiens
gactctggcctccac

SEQ ID NO: 5415905 - DNA, 13 bp, Homo sapiens
gactctggcctct

SEQ ID NO: 5415906 - DNA, 15 bp, Homo sapiens
gactctggctgccaa

SEQ ID NO: 5415907 - DNA, 18 bp, Homo sapiens
gactctgggctatggaca

SEQ ID NO: 5415908 - DNA, 19 bp, Homo sapiens
gactctgggctatggacac

SEQ ID NO: 5415909 - DNA, 17 bp, Homo sapiens
gactctgggctgtgcct

SEQ ID NO: 5415910 - DNA, 20 bp, Homo sapiens
gactctgggtccctcggagc

SEQ ID NO: 5415911 - DNA, 18 bp, Homo sapiens
gactctgggtccttcctg

SEQ ID NO: 5415912 - DNA, 17 bp, Homo sapiens
gactctgtaacatcact

SEQ ID NO: 5415913 - DNA, 15 bp, Homo sapiens
gactctgtcacaaag

SEQ ID NO: 5415914 - DNA, 16 bp, Homo sapiens
gactctgtccagctcc

SEQ ID NO: 5415915 - DNA, 18 bp, Homo sapiens
gactctgtgatctaagca

SEQ ID NO: 5415916 - DNA, 14 bp, Homo sapiens
gactctgtgctcac

SEQ ID NO: 5415917 - DNA, 14 bp, Homo sapiens
gactctgtgctggc

SEQ ID NO: 5415918 - DNA, 18 bp, Homo sapiens
gactctgtgctggccagc

SEQ ID NO: 5415919 - DNA, 17 bp, Homo sapiens
gactctgtgtgagcgtg

SEQ ID NO: 5415920 - DNA, 19 bp, Homo sapiens
gactctgttgctggtcttc

SEQ ID NO: 5415921 - DNA, 16 bp, Homo sapiens
gactcttaagaagact

SEQ ID NO: 5415922 - DNA, 18 bp, Homo sapiens
gactcttccaccagagca

SEQ ID NO: 5415923 - DNA, 20 bp, Homo sapiens
gactcttccattcagtttta

SEQ ID NO: 5415924 - DNA, 23 bp, Homo sapiens
gactcttcctttatcccctcctt

SEQ ID NO: 5415925 - DNA, 18 bp, Homo sapiens
gactcttctcggctcagg

SEQ ID NO: 5415926 - DNA, 13 bp, Homo sapiens
gactcttcttatc

SEQ ID NO: 5415927 - DNA, 11 bp, Homo sapiens
gactcttgcct

SEQ ID NO: 5415928 - DNA, 12 bp, Homo sapiens
gactcttgcctt

SEQ ID NO: 5415929 - DNA, 21 bp, Homo sapiens
gactcttgcctttccacctgc

SEQ ID NO: 5415930 - DNA, 19 bp, Homo sapiens
gactcttggagcctctttt

SEQ ID NO: 5415931 - DNA, 19 bp, Homo sapiens
gactcttgggccgtcccca

SEQ ID NO: 5415932 - DNA, 16 bp, Homo sapiens
gactctttagagcagc

SEQ ID NO: 5415933 - DNA, 22 bp, Homo sapiens
gactctttagagcagctttggg

SEQ ID NO: 5415934 - DNA, 22 bp, Homo sapiens
gactctttattgtctgtaaatc

SEQ ID NO: 5415935 - DNA, 13 bp, Homo sapiens
gactctttatttt

SEQ ID NO: 5415936 - DNA, 12 bp, Homo sapiens
gactctttcaaa

SEQ ID NO: 5415937 - DNA, 22 bp, Homo sapiens
gactctttctgaaggaagagaa

SEQ ID NO: 5415938 - DNA, 16 bp, Homo sapiens
gactctttctgagtgc

SEQ ID NO: 5415939 - DNA, 14 bp, Homo sapiens
gactctttgaaatg

SEQ ID NO: 5415940 - DNA, 23 bp, Homo sapiens
gactctttgacgggaggcctcag

SEQ ID NO: 5415941 - DNA, 18 bp, Homo sapiens
gactctttggtggctttg

SEQ ID NO: 5415942 - DNA, 21 bp, Homo sapiens
gactctttggtggctttgcat

SEQ ID NO: 5415943 - DNA, 17 bp, Homo sapiens
gactcttttccttccct

SEQ ID NO: 5415944 - DNA, 22 bp, Homo sapiens
gactctttttggactcagccca

SEQ ID NO: 5415945 - DNA, 16 bp, Homo sapiens
gactgaaaacctctcc

SEQ ID NO: 5415946 - DNA, 20 bp, Homo sapiens
gactgaaaacctctcctcat

SEQ ID NO: 5415947 - DNA, 19 bp, Homo sapiens
gactgaaaatattgtttta

SEQ ID NO: 5415948 - DNA, 20 bp, Homo sapiens
gactgaaagaagaaaacagt

SEQ ID NO: 5415949 - DNA, 21 bp, Homo sapiens
gactgaaagaagaaaacagta

SEQ ID NO: 5415950 - DNA, 17 bp, Homo sapiens
gactgaaagaagaacag

SEQ ID NO: 5415951 - DNA, 21 bp, Homo sapiens
gactgaaagaagaacagctgt

SEQ ID NO: 5415952 - DNA, 12 bp, Homo sapiens
gactgaaagcag

SEQ ID NO: 5415953 - DNA, 17 bp, Homo sapiens
gactgaaagcagcagct

SEQ ID NO: 5415954 - DNA, 21 bp, Homo sapiens
gactgaaagcagcagctagga

SEQ ID NO: 5415955 - DNA, 23 bp, Homo sapiens
gactgaaattaaacgagcgaaga

SEQ ID NO: 5415956 - DNA, 19 bp, Homo sapiens
gactgaaattactttaaca

SEQ ID NO: 5415957 - DNA, 14 bp, Homo sapiens
gactgaacatgttt

SEQ ID NO: 5415958 - DNA, 19 bp, Homo sapiens
gactgaaccagagctggaa

SEQ ID NO: 5415959 - DNA, 12 bp, Homo sapiens
gactgaactcca

SEQ ID NO: 5415960 - DNA, 17 bp, Homo sapiens
gactgaagaaggacatt

SEQ ID NO: 5415961 - DNA, 21 bp, Homo sapiens
gactgaagactgcacaggtga

SEQ ID NO: 5415962 - DNA, 14 bp, Homo sapiens
gactgaagcacagc

SEQ ID NO: 5415963 - DNA, 24 bp, Homo sapiens
gactgaagccgtgcctgtagcctt

SEQ ID NO: 5415964 - DNA, 12 bp, Homo sapiens
gactgaagctgg

SEQ ID NO: 5415965 - DNA, 13 bp, Homo sapiens
gactgaagctggg

SEQ ID NO: 5415966 - DNA, 14 bp, Homo sapiens
gactgaagctgggg

SEQ ID NO: 5415967 - DNA, 15 bp, Homo sapiens
gactgaaggggcaca

SEQ ID NO: 5415968 - DNA, 24 bp, Homo sapiens
gactgaaggggcacaccactgccc

SEQ ID NO: 5415969 - DNA, 16 bp, Homo sapiens
gactgaagtaataact

SEQ ID NO: 5415970 - DNA, 22 bp, Homo sapiens
gactgaagtactggaatttatt

SEQ ID NO: 5415971 - DNA, 20 bp, Homo sapiens
gactgaattatgaaactttt

SEQ ID NO: 5415972 - DNA, 15 bp, Homo sapiens
gactgaattctgcct

SEQ ID NO: 5415973 - DNA, 21 bp, Homo sapiens
gactgacacaggccagcccca

SEQ ID NO: 5415974 - DNA, 20 bp, Homo sapiens
gactgacagcatgtgccctc

SEQ ID NO: 5415975 - DNA, 21 bp, Homo sapiens
gactgacagcatgtgccctcc

SEQ ID NO: 5415976 - DNA, 23 bp, Homo sapiens
gactgacagcatgtgccctcctg

SEQ ID NO: 5415977 - DNA, 15 bp, Homo sapiens
gactgaccaaagact

SEQ ID NO: 5415978 - DNA, 21 bp, Homo sapiens
gactgaccaaagactgcagaa

SEQ ID NO: 5415979 - DNA, 13 bp, Homo sapiens
gactgaccaaatc

SEQ ID NO: 5415980 - DNA, 21 bp, Homo sapiens
gactgaccaatattgtacagt

SEQ ID NO: 5415981 - DNA, 21 bp, Homo sapiens
gactgaccacaccaaccaggc

SEQ ID NO: 5415982 - DNA, 23 bp, Homo sapiens
gactgaccacaccaaccaggcct

SEQ ID NO: 5415983 - DNA, 17 bp, Homo sapiens
gactgaccactggccta

SEQ ID NO: 5415984 - DNA, 14 bp, Homo sapiens
gactgaccagcagc

SEQ ID NO: 5415985 - DNA, 17 bp, Homo sapiens
gactgacccaaaatgtg

SEQ ID NO: 5415986 - DNA, 23 bp, Homo sapiens
gactgacccccatctgagctggg

SEQ ID NO: 5415987 - DNA, 13 bp, Homo sapiens
gactgaccctgag

SEQ ID NO: 5415988 - DNA, 14 bp, Homo sapiens
gactgaccctgagg

SEQ ID NO: 5415989 - DNA, 16 bp, Homo sapiens
gactgaccctgatcag

SEQ ID NO: 5415990 - DNA, 18 bp, Homo sapiens
gactgaccgaagggacgg

SEQ ID NO: 5415991 - DNA, 19 bp, Homo sapiens
gactgacctggtccacagg

SEQ ID NO: 5415992 - DNA, 22 bp, Homo sapiens
gactgaccttcggcagtggctg

SEQ ID NO: 5415993 - DNA, 13 bp, Homo sapiens
gactgactgagac

SEQ ID NO: 5415994 - DNA, 14 bp, Homo sapiens
gactgactgcagcc

SEQ ID NO: 5415995 - DNA, 15 bp, Homo sapiens
gactgacttagcagg

SEQ ID NO: 5415996 - DNA, 22 bp, Homo sapiens
gactgactttttccatttttta

SEQ ID NO: 5415997 - DNA, 15 bp, Homo sapiens
gactgagacccgttc

SEQ ID NO: 5415998 - DNA, 16 bp, Homo sapiens
gactgagactggcact

SEQ ID NO: 5415999 - DNA, 22 bp, Homo sapiens
gactgagactggcacttagccc

SEQ ID NO: 5416000 - DNA, 18 bp, Homo sapiens
gactgagcaccctctgga

SEQ ID NO: 5416001 - DNA, 15 bp, Homo sapiens
gactgagcacctgct

SEQ ID NO: 5416002 - DNA, 13 bp, Homo sapiens
gactgagcagaac

SEQ ID NO: 5416003 - DNA, 14 bp, Homo sapiens
gactgagcagactg

SEQ ID NO: 5416004 - DNA, 15 bp, Homo sapiens
gactgagcagactgg

SEQ ID NO: 5416005 - DNA, 17 bp, Homo sapiens
gactgtgaccaaagcat

SEQ ID NO: 5416006 - DNA, 22 bp, Homo sapiens
gactgtgaccaaagcatttcta

SEQ ID NO: 5416007 - DNA, 18 bp, Homo sapiens
gactgtgactcattccca

SEQ ID NO: 5416008 - DNA, 21 bp, Homo sapiens
gactgtgagactgagagggct

SEQ ID NO: 5416009 - DNA, 23 bp, Homo sapiens
gactgtgagcgagcctggcaggt

SEQ ID NO: 5416010 - DNA, 16 bp, Homo sapiens
gactgtgaggcggcag

SEQ ID NO: 5416011 - DNA, 17 bp, Homo sapiens
gactgtgaggcggcagc

SEQ ID NO: 5416012 - DNA, 20 bp, Homo sapiens
gactgtgaggcggcagctgg

SEQ ID NO: 5416013 - DNA, 23 bp, Homo sapiens
gactgtgatttatttggagtgga

SEQ ID NO: 5416014 - DNA, 16 bp, Homo sapiens
gactgtgcaatactta

SEQ ID NO: 5416015 - DNA, 14 bp, Homo sapiens
gactgtgcagaaga

SEQ ID NO: 5416016 - DNA, 16 bp, Homo sapiens
gactgtgccatctgtg

SEQ ID NO: 5416017 - DNA, 17 bp, Homo sapiens
gactgtgccatggtgag

SEQ ID NO: 5416018 - DNA, 17 bp, Homo sapiens
gactgtgcctcaggcca

SEQ ID NO: 5416019 - DNA, 13 bp, Homo sapiens
gactgtgcctggc

SEQ ID NO: 5416020 - DNA, 17 bp, Homo sapiens
gactgtgcctggctccc

SEQ ID NO: 5416021 - DNA, 19 bp, Homo sapiens
gactgtgcctggctccctg

SEQ ID NO: 5416022 - DNA, 16 bp, Homo sapiens
gactgtggagactgct

SEQ ID NO: 5416023 - DNA, 18 bp, Homo sapiens
gactgtggagactgctcc

SEQ ID NO: 5416024 - DNA, 16 bp, Homo sapiens
gactgtggagctctgg

SEQ ID NO: 5416025 - DNA, 13 bp, Homo sapiens
gactgtggagggg

SEQ ID NO: 5416026 - DNA, 14 bp, Homo sapiens
gactgtggagggga

SEQ ID NO: 5416027 - DNA, 18 bp, Homo sapiens
gactgtggaggggagctg

SEQ ID NO: 5416028 - DNA, 20 bp, Homo sapiens
gactgtggagttccattctt

SEQ ID NO: 5416029 - DNA, 17 bp, Homo sapiens
gactgtggcacttgcct

SEQ ID NO: 5416030 - DNA, 23 bp, Homo sapiens
gactgtggccatatatgctgtat

SEQ ID NO: 5416031 - DNA, 19 bp, Homo sapiens
gactgtggcctcaggaggc

SEQ ID NO: 5416032 - DNA, 13 bp, Homo sapiens
gactgtggctgca

SEQ ID NO: 5416033 - DNA, 15 bp, Homo sapiens
gactgtggctgcagg

SEQ ID NO: 5416034 - DNA, 20 bp, Homo sapiens
gactgtggctgcaggtggga

SEQ ID NO: 5416035 - DNA, 15 bp, Homo sapiens
gactgtggctgctag

SEQ ID NO: 5416036 - DNA, 17 bp, Homo sapiens
gactgtggggagggtca

SEQ ID NO: 5416037 - DNA, 13 bp, Homo sapiens
gactgtgggtggg

SEQ ID NO: 5416038 - DNA, 15 bp, Homo sapiens
gactgtgggtgggga

SEQ ID NO: 5416039 - DNA, 18 bp, Homo sapiens
gactgtgggtggggaggc

SEQ ID NO: 5416040 - DNA, 21 bp, Homo sapiens
gactgtgggtggggaggccct

SEQ ID NO: 5416041 - DNA, 22 bp, Homo sapiens
gactgtgggtggggaggccctg

SEQ ID NO: 5416042 - DNA, 22 bp, Homo sapiens
gactgtggtaggggcagggagg

SEQ ID NO: 5416043 - DNA, 19 bp, Homo sapiens
gactgtggtataattattt

SEQ ID NO: 5416044 - DNA, 21 bp, Homo sapiens
gactgtggtgacttctgctgc

SEQ ID NO: 5416045 - DNA, 14 bp, Homo sapiens
gactgtgtctgaat

SEQ ID NO: 5416046 - DNA, 16 bp, Homo sapiens
gactgtgtgctcagga

SEQ ID NO: 5416047 - DNA, 21 bp, Homo sapiens
gactgtgtgtgccctctgggc

SEQ ID NO: 5416048 - DNA, 13 bp, Homo sapiens
gactgtgtgtgtg

SEQ ID NO: 5416049 - DNA, 21 bp, Homo sapiens
gactgtgttcagtgccttgga

SEQ ID NO: 5416050 - DNA, 14 bp, Homo sapiens
gactgtgtttgcat

SEQ ID NO: 5416051 - DNA, 19 bp, Homo sapiens
gactgtgtttgcattgtct

SEQ ID NO: 5416052 - DNA, 21 bp, Homo sapiens
gactgtgtttgcattgtctaa

SEQ ID NO: 5416053 - DNA, 18 bp, Homo sapiens
gactgttacagactgaaa

SEQ ID NO: 5416054 - DNA, 19 bp, Homo sapiens
gactgttacagactgaaag

SEQ ID NO: 5416055 - DNA, 21 bp, Homo sapiens
gactgttacagactgaaaggt

SEQ ID NO: 5416056 - DNA, 22 bp, Homo sapiens
gactgttactttggcaatttcc

SEQ ID NO: 5416057 - DNA, 18 bp, Homo sapiens
gactgttagttgtccaca

SEQ ID NO: 5416058 - DNA, 23 bp, Homo sapiens
gactgttcatttgaaaccttttt

SEQ ID NO: 5416059 - DNA, 16 bp, Homo sapiens
gactgttccaaagcca

SEQ ID NO: 5416060 - DNA, 23 bp, Homo sapiens
gactgttccaaagccagtgaaat

SEQ ID NO: 5416061 - DNA, 13 bp, Homo sapiens
gactgttccaggc

SEQ ID NO: 5416062 - DNA, 23 bp, Homo sapiens
gactgttccttatttctctctcc

SEQ ID NO: 5416063 - DNA, 19 bp, Homo sapiens
gactgttctcttactgccg

SEQ ID NO: 5416064 - DNA, 17 bp, Homo sapiens
gactgttggctctctga

SEQ ID NO: 5416065 - DNA, 18 bp, Homo sapiens
gactgttgtacaagctca

SEQ ID NO: 5416066 - DNA, 16 bp, Homo sapiens
gactgttgtgctccat

SEQ ID NO: 5416067 - DNA, 11 bp, Homo sapiens
gactgtttatt

SEQ ID NO: 5416068 - DNA, 12 bp, Homo sapiens
gactgtttattt

SEQ ID NO: 5416069 - DNA, 19 bp, Homo sapiens
gactgtttatttaaggatg

SEQ ID NO: 5416070 - DNA, 21 bp, Homo sapiens
gactgtttatttaaggatgga

SEQ ID NO: 5416071 - DNA, 22 bp, Homo sapiens
gactgtttatttaaggatggat

SEQ ID NO: 5416072 - DNA, 15 bp, Homo sapiens
gactgtttcacattg

SEQ ID NO: 5416073 - DNA, 19 bp, Homo sapiens
gactgtttcttttgtaaag

SEQ ID NO: 5416074 - DNA, 18 bp, Homo sapiens
gactgtttgaatgttttc

SEQ ID NO: 5416075 - DNA, 13 bp, Homo sapiens
gactgtttggctt

SEQ ID NO: 5416076 - DNA, 14 bp, Homo sapiens
gactgtttggctta

SEQ ID NO: 5416077 - DNA, 22 bp, Homo sapiens
gactgtttggcttataaacaca

SEQ ID NO: 5416078 - DNA, 14 bp, Homo sapiens
gactgttttactgt

SEQ ID NO: 5416079 - DNA, 16 bp, Homo sapiens
gactgttttactgttt

SEQ ID NO: 5416080 - DNA, 19 bp, Homo sapiens
gactgttttctctcggctc

SEQ ID NO: 5416081 - DNA, 21 bp, Homo sapiens
gactgttttctctcggctccc

SEQ ID NO: 5416082 - DNA, 18 bp, Homo sapiens
gactgttttctcttgaga

SEQ ID NO: 5416083 - DNA, 19 bp, Homo sapiens
gactgtttttcggacagtt

SEQ ID NO: 5416084 - DNA, 20 bp, Homo sapiens
gacttaaaattagtcttttg

SEQ ID NO: 5416085 - DNA, 17 bp, Homo sapiens
gacttaacatagccaaa

SEQ ID NO: 5416086 - DNA, 21 bp, Homo sapiens
gacttaacatagccaaaatgt

SEQ ID NO: 5416087 - DNA, 23 bp, Homo sapiens
gacttaacatagccaaaatgtga

SEQ ID NO: 5416088 - DNA, 16 bp, Homo sapiens
gacttaacggctccag

SEQ ID NO: 5416089 - DNA, 19 bp, Homo sapiens
gacttaacggctccaggat

SEQ ID NO: 5416090 - DNA, 20 bp, Homo sapiens
gacttaactgcatttttaga

SEQ ID NO: 5416091 - DNA, 19 bp, Homo sapiens
gacttaactggcccagaag

SEQ ID NO: 5416092 - DNA, 14 bp, Homo sapiens
gacttaacttttta

SEQ ID NO: 5416093 - DNA, 15 bp, Homo sapiens
gacttaactttttaa

SEQ ID NO: 5416094 - DNA, 16 bp, Homo sapiens
gacttaagacaaatgg

SEQ ID NO: 5416095 - DNA, 22 bp, Homo sapiens
gacttaagacaaatgggactga

SEQ ID NO: 5416096 - DNA, 20 bp, Homo sapiens
gacttaagcatctggctcta

SEQ ID NO: 5416097 - DNA, 21 bp, Homo sapiens
gacttaaggggctgggatgct

SEQ ID NO: 5416098 - DNA, 18 bp, Homo sapiens
gacttaatagacattttt

SEQ ID NO: 5416099 - DNA, 15 bp, Homo sapiens
gacttaatctttgct

SEQ ID NO: 5416100 - DNA, 17 bp, Homo sapiens
gacttaatctttgctga

SEQ ID NO: 5416101 - DNA, 14 bp, Homo sapiens
gacttaatgtgatt

SEQ ID NO: 5416102 - DNA, 15 bp, Homo sapiens
gacttaatgtgatta

SEQ ID NO: 5416103 - DNA, 19 bp, Homo sapiens
gacttaattttagaaagaa

SEQ ID NO: 5416104 - DNA, 14 bp, Homo sapiens
gacttacaaaatgc

SEQ ID NO: 5416105 - DNA, 15 bp, Homo sapiens
gacttacatgattca

SEQ ID NO: 5416106 - DNA, 16 bp, Homo sapiens
gacttacatgattcat

SEQ ID NO: 5416107 - DNA, 19 bp, Homo sapiens
gacttacatgattcatttt

SEQ ID NO: 5416108 - DNA, 14 bp, Homo sapiens
gacttaccaggaag

SEQ ID NO: 5416109 - DNA, 14 bp, Homo sapiens
gacttactgcctga

SEQ ID NO: 5416110 - DNA, 21 bp, Homo sapiens
gacttactttaattactggaa

SEQ ID NO: 5416111 - DNA, 21 bp, Homo sapiens
gacttagaaaaccagctcagc

SEQ ID NO: 5416112 - DNA, 16 bp, Homo sapiens
gacttagaaagcaggg

SEQ ID NO: 5416113 - DNA, 19 bp, Homo sapiens
gacttagaaagcaggggct

SEQ ID NO: 5416114 - DNA, 16 bp, Homo sapiens
gacttagatattaaaa

SEQ ID NO: 5416115 - DNA, 14 bp, Homo sapiens
gacttagatctgag

SEQ ID NO: 5416116 - DNA, 16 bp, Homo sapiens
gacttagatctgagcc

SEQ ID NO: 5416117 - DNA, 12 bp, Homo sapiens
gacttaggccag

SEQ ID NO: 5416118 - DNA, 15 bp, Homo sapiens
gacttaggccagagg

SEQ ID NO: 5416119 - DNA, 23 bp, Homo sapiens
gacttaggggagttcagtattta

SEQ ID NO: 5416120 - DNA, 16 bp, Homo sapiens
gacttaggttctagat

SEQ ID NO: 5416121 - DNA, 17 bp, Homo sapiens
gacttagtatattttct

SEQ ID NO: 5416122 - DNA, 16 bp, Homo sapiens
gacttatagtacatga

SEQ ID NO: 5416123 - DNA, 19 bp, Homo sapiens
gacttatatatttgaaaga

SEQ ID NO: 5416124 - DNA, 18 bp, Homo sapiens
gacttatcaacactataa

SEQ ID NO: 5416125 - DNA, 20 bp, Homo sapiens
gacttattgattaagtatat

SEQ ID NO: 5416126 - DNA, 12 bp, Homo sapiens
gacttatttctg

SEQ ID NO: 5416127 - DNA, 15 bp, Homo sapiens
gacttatttctgctc

SEQ ID NO: 5416128 - DNA, 15 bp, Homo sapiens
gacttatttcttaaa

SEQ ID NO: 5416129 - DNA, 18 bp, Homo sapiens
gacttattttgtcttatt

SEQ ID NO: 5416130 - DNA, 22 bp, Homo sapiens
gacttattttgtcttattctta

SEQ ID NO: 5416131 - DNA, 17 bp, Homo sapiens
gacttcaaagcaagctg

SEQ ID NO: 5416132 - DNA, 22 bp, Homo sapiens
gacttcaaagtgtgtctgggat

SEQ ID NO: 5416133 - DNA, 16 bp, Homo sapiens
gacttcaactgcccag

SEQ ID NO: 5416134 - DNA, 14 bp, Homo sapiens
gacttcaatttccc

SEQ ID NO: 5416135 - DNA, 19 bp, Homo sapiens
gacttcaatttcccaccca

SEQ ID NO: 5416136 - DNA, 12 bp, Homo sapiens
gacttcacaaaa

SEQ ID NO: 5416137 - DNA, 15 bp, Homo sapiens
gacttcacaaaatgc

SEQ ID NO: 5416138 - DNA, 17 bp, Homo sapiens
gacttcacaaaatgcaa

SEQ ID NO: 5416139 - DNA, 18 bp, Homo sapiens
gacttcacaaaatgcaag

SEQ ID NO: 5416140 - DNA, 17 bp, Homo sapiens
gacttcacacagcacct

SEQ ID NO: 5416141 - DNA, 16 bp, Homo sapiens
gacttcacactgcaag

SEQ ID NO: 5416142 - DNA, 13 bp, Homo sapiens
gacttcacagcag

SEQ ID NO: 5416143 - DNA, 14 bp, Homo sapiens
gacttcaccaaata

SEQ ID NO: 5416144 - DNA, 19 bp, Homo sapiens
gacttcactgcagcctttc

SEQ ID NO: 5416145 - DNA, 13 bp, Homo sapiens
gacttcactgtat

SEQ ID NO: 5416146 - DNA, 16 bp, Homo sapiens
gacttcactgtatata

SEQ ID NO: 5416147 - DNA, 19 bp, Homo sapiens
gacttcactgtatataaac

SEQ ID NO: 5416148 - DNA, 17 bp, Homo sapiens
gacttcagaaacttttt

SEQ ID NO: 5416149 - DNA, 20 bp, Homo sapiens
gacttcagaacagtgtttga

SEQ ID NO: 5416150 - DNA, 17 bp, Homo sapiens
gacttcagaacatgctg

SEQ ID NO: 5416151 - DNA, 20 bp, Homo sapiens
gacttcagactctctcctct

SEQ ID NO: 5416152 - DNA, 23 bp, Homo sapiens
gacttcagactctctcctctctc

SEQ ID NO: 5416153 - DNA, 12 bp, Homo sapiens
gacttcagattg

SEQ ID NO: 5416154 - DNA, 18 bp, Homo sapiens
gacttcagatttcaaatt

SEQ ID NO: 5416155 - DNA, 21 bp, Homo sapiens
gacttcaggaacaagtaatgt

SEQ ID NO: 5416156 - DNA, 24 bp, Homo sapiens
gacttcaggagctgacagagccag

SEQ ID NO: 5416157 - DNA, 22 bp, Homo sapiens
gacttcagggaaggtgaaacag

SEQ ID NO: 5416158 - DNA, 22 bp, Homo sapiens
gacttcagggcagggctctgat

SEQ ID NO: 5416159 - DNA, 18 bp, Homo sapiens
gacttcaggggctgcccg

SEQ ID NO: 5416160 - DNA, 23 bp, Homo sapiens
gacttcaggggctgcccgctccc

SEQ ID NO: 5416161 - DNA, 24 bp, Homo sapiens
gacttcaggtggagagcactagaa

SEQ ID NO: 5416162 - DNA, 18 bp, Homo sapiens
gacttcagtgaatatttt

SEQ ID NO: 5416163 - DNA, 23 bp, Homo sapiens
gacttcagtgtgtgtatttgtgt

SEQ ID NO: 5416164 - DNA, 15 bp, Homo sapiens
gacttcattaataat

SEQ ID NO: 5416165 - DNA, 19 bp, Homo sapiens
gacttcatttaacactgag

SEQ ID NO: 5416166 - DNA, 22 bp, Homo sapiens
gacttcatttaacactgagtga

SEQ ID NO: 5416167 - DNA, 18 bp, Homo sapiens
gacttcatttgtgccaca

SEQ ID NO: 5416168 - DNA, 19 bp, Homo sapiens
gacttcatttgtgccacac

SEQ ID NO: 5416169 - DNA, 20 bp, Homo sapiens
gacttcattttatatttaaa

SEQ ID NO: 5416170 - DNA, 19 bp, Homo sapiens
gacttccaaatcctggaag

SEQ ID NO: 5416171 - DNA, 12 bp, Homo sapiens
gacttccacaaa

SEQ ID NO: 5416172 - DNA, 17 bp, Homo sapiens
gacttccacaaacctgg

SEQ ID NO: 5416173 - DNA, 14 bp, Homo sapiens
gacttccacatttt

SEQ ID NO: 5416174 - DNA, 23 bp, Homo sapiens
gacttccacatttttgcacagat

SEQ ID NO: 5416175 - DNA, 15 bp, Homo sapiens
gacttccagctttct

SEQ ID NO: 5416176 - DNA, 16 bp, Homo sapiens
gacttccagctttctc

SEQ ID NO: 5416177 - DNA, 15 bp, Homo sapiens
gacttccatgcctta

SEQ ID NO: 5416178 - DNA, 15 bp, Homo sapiens
gacttcccaactgca

SEQ ID NO: 5416179 - DNA, 13 bp, Homo sapiens
gacttcccagctg

SEQ ID NO: 5416180 - DNA, 23 bp, Homo sapiens
gacttcccagctggcagcgcctc

SEQ ID NO: 5416181 - DNA, 12 bp, Homo sapiens
gagaagccttca

SEQ ID NO: 5416182 - DNA, 16 bp, Homo sapiens
gagaagccttcaagct

SEQ ID NO: 5416183 - DNA, 20 bp, Homo sapiens
gagaagccttcaagctctga

SEQ ID NO: 5416184 - DNA, 21 bp, Homo sapiens
gagaagccttcaagctctgag

SEQ ID NO: 5416185 - DNA, 16 bp, Homo sapiens
gagaagcgctgccctg

SEQ ID NO: 5416186 - DNA, 21 bp, Homo sapiens
gagaagcgctgccctgtgaga

SEQ ID NO: 5416187 - DNA, 13 bp, Homo sapiens
gagaagcggctgg

SEQ ID NO: 5416188 - DNA, 15 bp, Homo sapiens
gagaagcggctggca

SEQ ID NO: 5416189 - DNA, 19 bp, Homo sapiens
gagaagctagatgcccctg

SEQ ID NO: 5416190 - DNA, 20 bp, Homo sapiens
gagaagctagatgcccctgc

SEQ ID NO: 5416191 - DNA, 16 bp, Homo sapiens
gagaagctcagctgcc

SEQ ID NO: 5416192 - DNA, 13 bp, Homo sapiens
gagaagctcttca

SEQ ID NO: 5416193 - DNA, 12 bp, Homo sapiens
gagaagctgaaa

SEQ ID NO: 5416194 - DNA, 13 bp, Homo sapiens
gagaagctgaagc

SEQ ID NO: 5416195 - DNA, 13 bp, Homo sapiens
gagaagctgagaa

SEQ ID NO: 5416196 - DNA, 14 bp, Homo sapiens
gagaagctgaggcc

SEQ ID NO: 5416197 - DNA, 16 bp, Homo sapiens
gagaagctgatccagt

SEQ ID NO: 5416198 - DNA, 11 bp, Homo sapiens
gagaagctgct

SEQ ID NO: 5416199 - DNA, 12 bp, Homo sapiens
gagaagctgctc

SEQ ID NO: 5416200 - DNA, 13 bp, Homo sapiens
gagaagctgctca

SEQ ID NO: 5416201 - DNA, 19 bp, Homo sapiens
gagaagctgctccaggcct

SEQ ID NO: 5416202 - DNA, 18 bp, Homo sapiens
gagaagctgctgaccaat

SEQ ID NO: 5416203 - DNA, 14 bp, Homo sapiens
gagaagctggactt

SEQ ID NO: 5416204 - DNA, 15 bp, Homo sapiens
gagaagctggggagg

SEQ ID NO: 5416205 - DNA, 13 bp, Homo sapiens
gagaagctgtgtc

SEQ ID NO: 5416206 - DNA, 22 bp, Homo sapiens
gagaagcttgtggtgttcctga

SEQ ID NO: 5416207 - DNA, 21 bp, Homo sapiens
gagaagcttttgaataaaaac

SEQ ID NO: 5416208 - DNA, 16 bp, Homo sapiens
gagaaggaaaaagaaa

SEQ ID NO: 5416209 - DNA, 13 bp, Homo sapiens
gagaaggaaaagg

SEQ ID NO: 5416210 - DNA, 22 bp, Homo sapiens
gagaaggaaaaggctggcaagg

SEQ ID NO: 5416211 - DNA, 18 bp, Homo sapiens
gagaaggaaaattttagc

SEQ ID NO: 5416212 - DNA, 14 bp, Homo sapiens
gagaaggaaataaa

SEQ ID NO: 5416213 - DNA, 16 bp, Homo sapiens
gagaaggaaataaaat

SEQ ID NO: 5416214 - DNA, 19 bp, Homo sapiens
gagaaggaaataaaatcag

SEQ ID NO: 5416215 - DNA, 14 bp, Homo sapiens
gagaaggaaatgca

SEQ ID NO: 5416216 - DNA, 15 bp, Homo sapiens
gagaaggaaatgcag

SEQ ID NO: 5416217 - DNA, 14 bp, Homo sapiens
gagaaggaactgat

SEQ ID NO: 5416218 - DNA, 15 bp, Homo sapiens
gagaaggaagatagg

SEQ ID NO: 5416219 - DNA, 16 bp, Homo sapiens
gagaaggaagatagga

SEQ ID NO: 5416220 - DNA, 17 bp, Homo sapiens
gagaaggaagggcagag

SEQ ID NO: 5416221 - DNA, 15 bp, Homo sapiens
gagaaggagagaaag

SEQ ID NO: 5416222 - DNA, 12 bp, Homo sapiens
gagaaggagagg

SEQ ID NO: 5416223 - DNA, 18 bp, Homo sapiens
gagaaggagaggctctga

SEQ ID NO: 5416224 - DNA, 20 bp, Homo sapiens
gagaaggaggccgccagact

SEQ ID NO: 5416225 - DNA, 21 bp, Homo sapiens
gagaaggagggttgtgcccac

SEQ ID NO: 5416226 - DNA, 19 bp, Homo sapiens
gagaaggagtgccatacct

SEQ ID NO: 5416227 - DNA, 22 bp, Homo sapiens
gagaaggataggccttcattaa

SEQ ID NO: 5416228 - DNA, 17 bp, Homo sapiens
gagaaggatctagaatg

SEQ ID NO: 5416229 - DNA, 17 bp, Homo sapiens
gagaaggcaagctggca

SEQ ID NO: 5416230 - DNA, 11 bp, Homo sapiens
gagaaggcagc

SEQ ID NO: 5416231 - DNA, 13 bp, Homo sapiens
gagaaggcaggaa

SEQ ID NO: 5416232 - DNA, 14 bp, Homo sapiens
gagaaggccgctgc

SEQ ID NO: 5416233 - DNA, 14 bp, Homo sapiens
gagaaggcctgccc

SEQ ID NO: 5416234 - DNA, 23 bp, Homo sapiens
gagaaggcctgccccccttccca

SEQ ID NO: 5416235 - DNA, 12 bp, Homo sapiens
gagaaggcctgg

SEQ ID NO: 5416236 - DNA, 21 bp, Homo sapiens
gagaaggcctggtcagcagag

SEQ ID NO: 5416237 - DNA, 20 bp, Homo sapiens
gagaaggccttacagaaaat

SEQ ID NO: 5416238 - DNA, 14 bp, Homo sapiens
gagaaggcgaggag

SEQ ID NO: 5416239 - DNA, 23 bp, Homo sapiens
gagaaggctcacgaagggcatcc

SEQ ID NO: 5416240 - DNA, 16 bp, Homo sapiens
gagaaggctggagaag

SEQ ID NO: 5416241 - DNA, 19 bp, Homo sapiens
gagaagggaagaaggggcc

SEQ ID NO: 5416242 - DNA, 20 bp, Homo sapiens
gagaagggaatcctcctcca

SEQ ID NO: 5416243 - DNA, 20 bp, Homo sapiens
gagaagggagaacaggggtc

SEQ ID NO: 5416244 - DNA, 15 bp, Homo sapiens
gagaagggagggtgg

SEQ ID NO: 5416245 - DNA, 21 bp, Homo sapiens
gagaagggcagagttacttga

SEQ ID NO: 5416246 - DNA, 15 bp, Homo sapiens
gagaagggccagccc

SEQ ID NO: 5416247 - DNA, 20 bp, Homo sapiens
gagaagggccagccctacat

SEQ ID NO: 5416248 - DNA, 18 bp, Homo sapiens
gagaagggcctgctctgc

SEQ ID NO: 5416249 - DNA, 18 bp, Homo sapiens
gagaagggctcagagagg

SEQ ID NO: 5416250 - DNA, 21 bp, Homo sapiens
gagaagggctcagagaggaca

SEQ ID NO: 5416251 - DNA, 16 bp, Homo sapiens
gagaagggctggggcc

SEQ ID NO: 5416252 - DNA, 15 bp, Homo sapiens
gagaagggcttttct

SEQ ID NO: 5416253 - DNA, 17 bp, Homo sapiens
gagaaggggacttctct

SEQ ID NO: 5416254 - DNA, 22 bp, Homo sapiens
gagaaggggaggacctctgggc

SEQ ID NO: 5416255 - DNA, 20 bp, Homo sapiens
gagaaggggcccaagagaga

SEQ ID NO: 5416256 - DNA, 21 bp, Homo sapiens
gagaaggggcccaagagagac

SEQ ID NO: 5416257 - DNA, 22 bp, Homo sapiens
gagaaggggcccaagagagaca

SEQ ID NO: 5416258 - DNA, 19 bp, Homo sapiens
gagaagggggctctgcccc

SEQ ID NO: 5416259 - DNA, 17 bp, Homo sapiens
gagaagggggtctctgt

SEQ ID NO: 5416260 - DNA, 19 bp, Homo sapiens
gagaagggggtctctgtta

SEQ ID NO: 5416261 - DNA, 16 bp, Homo sapiens
gagaaggggtgtgcat

SEQ ID NO: 5416262 - DNA, 22 bp, Homo sapiens
gagaagggttagacaagcctgg

SEQ ID NO: 5416263 - DNA, 19 bp, Homo sapiens
gagaaggtaaggtgtgaac

SEQ ID NO: 5416264 - DNA, 23 bp, Homo sapiens
gagaaggtactgaaataatgatc

SEQ ID NO: 5416265 - DNA, 19 bp, Homo sapiens
gagaaggtattagcaaagc

SEQ ID NO: 5416266 - DNA, 18 bp, Homo sapiens
gagaaggtgcctgccata

SEQ ID NO: 5416267 - DNA, 17 bp, Homo sapiens
gagaaggtggacctggc

SEQ ID NO: 5416268 - DNA, 23 bp, Homo sapiens
gagaaggttggaggtggggaagg

SEQ ID NO: 5416269 - DNA, 16 bp, Homo sapiens
gagaaggtttattgtt

SEQ ID NO: 5416270 - DNA, 17 bp, Homo sapiens
gagaaggtttattgtta

SEQ ID NO: 5416271 - DNA, 15 bp, Homo sapiens
gagaagtaaattatt

SEQ ID NO: 5416272 - DNA, 19 bp, Homo sapiens
gagaagtaaattattttat

SEQ ID NO: 5416273 - DNA, 14 bp, Homo sapiens
gagaagtacttggt

SEQ ID NO: 5416274 - DNA, 14 bp, Homo sapiens
gagaagtacttttg

SEQ ID NO: 5416275 - DNA, 22 bp, Homo sapiens
gagaagtagctagtagcaatgt

SEQ ID NO: 5416276 - DNA, 16 bp, Homo sapiens
gagaagtatacataag

SEQ ID NO: 5416277 - DNA, 18 bp, Homo sapiens
gagaagtcaaacatttca

SEQ ID NO: 5416278 - DNA, 22 bp, Homo sapiens
gagaagtcacagggcagtacct

SEQ ID NO: 5416279 - DNA, 23 bp, Homo sapiens
gagaagtcactcacactggccac

SEQ ID NO: 5416280 - DNA, 17 bp, Homo sapiens
gagaagtcggccaggta

SEQ ID NO: 5416281 - DNA, 21 bp, Homo sapiens
gagaagtctcagctaagctca

SEQ ID NO: 5416282 - DNA, 19 bp, Homo sapiens
gagaagtctggtcagagcc

SEQ ID NO: 5416283 - DNA, 23 bp, Homo sapiens
gagaagtctggtcagagccacag

SEQ ID NO: 5416284 - DNA, 20 bp, Homo sapiens
gagaagtgaatgctgggact

SEQ ID NO: 5416285 - DNA, 17 bp, Homo sapiens
gagaagtgacagggaag

SEQ ID NO: 5416286 - DNA, 21 bp, Homo sapiens
gagaagtgacagggaagctac

SEQ ID NO: 5416287 - DNA, 23 bp, Homo sapiens
gagaagtgcccctgctgcctccc

SEQ ID NO: 5416288 - DNA, 19 bp, Homo sapiens
gagaagtgccttctccttc

SEQ ID NO: 5416289 - DNA, 13 bp, Homo sapiens
gagaagtgctccc

SEQ ID NO: 5416290 - DNA, 16 bp, Homo sapiens
gagaagtgctccctgg

SEQ ID NO: 5416291 - DNA, 20 bp, Homo sapiens
gagaagtgctccctggaggc

SEQ ID NO: 5416292 - DNA, 17 bp, Homo sapiens
gagaagtggccagggct

SEQ ID NO: 5416293 - DNA, 13 bp, Homo sapiens
gagaagtggcccc

SEQ ID NO: 5416294 - DNA, 20 bp, Homo sapiens
gagaagtggggaccccaccc

SEQ ID NO: 5416295 - DNA, 21 bp, Homo sapiens
gagaagtgggggcagcccagg

SEQ ID NO: 5416296 - DNA, 16 bp, Homo sapiens
gagaagtgggtgggga

SEQ ID NO: 5416297 - DNA, 24 bp, Homo sapiens
gagaagtgggtggggacagaccag

SEQ ID NO: 5416298 - DNA, 17 bp, Homo sapiens
gagaagtgtgccttctc

SEQ ID NO: 5416299 - DNA, 15 bp, Homo sapiens
gagaagtgtgttctg

SEQ ID NO: 5416300 - DNA, 15 bp, Homo sapiens
gagaagttaagcagc

SEQ ID NO: 5416301 - DNA, 16 bp, Homo sapiens
gagaagttgacatgga

SEQ ID NO: 5416302 - DNA, 15 bp, Homo sapiens
gagaagttgagcagg

SEQ ID NO: 5416303 - DNA, 21 bp, Homo sapiens
gagaagttgctgcttgtgatc

SEQ ID NO: 5416304 - DNA, 16 bp, Homo sapiens
gagaagttgtaaagta

SEQ ID NO: 5416305 - DNA, 21 bp, Homo sapiens
gagaagtttaacaagtattta

SEQ ID NO: 5416306 - DNA, 21 bp, Homo sapiens
gagaagtttcgaggggtcctc

SEQ ID NO: 5416307 - DNA, 17 bp, Homo sapiens
gagaagtttctggccct

SEQ ID NO: 5416308 - DNA, 16 bp, Homo sapiens
gagaagttttgttttt

SEQ ID NO: 5416309 - DNA, 20 bp, Homo sapiens
gagaataaattggattattt

SEQ ID NO: 5416310 - DNA, 23 bp, Homo sapiens
gagaataaattggattattttct

SEQ ID NO: 5416311 - DNA, 16 bp, Homo sapiens
gagaataaatttggga

SEQ ID NO: 5416312 - DNA, 18 bp, Homo sapiens
gagaataagagaaagaaa

SEQ ID NO: 5416313 - DNA, 18 bp, Homo sapiens
gagaataattatttcaga

SEQ ID NO: 5416314 - DNA, 17 bp, Homo sapiens
gagaataattgtgtaca

SEQ ID NO: 5416315 - DNA, 19 bp, Homo sapiens
gagaataattgtgtacaaa

SEQ ID NO: 5416316 - DNA, 21 bp, Homo sapiens
gagaatacatcttgtttctga

SEQ ID NO: 5416317 - DNA, 23 bp, Homo sapiens
gagaatacatcttgtttctgagt

SEQ ID NO: 5416318 - DNA, 23 bp, Homo sapiens
gagaataccttggtctcacctat

SEQ ID NO: 5416319 - DNA, 11 bp, Homo sapiens
gagaatagaaa

SEQ ID NO: 5416320 - DNA, 13 bp, Homo sapiens
gagaatagaaatt

SEQ ID NO: 5416321 - DNA, 14 bp, Homo sapiens
gagaatagaaattt

SEQ ID NO: 5416322 - DNA, 23 bp, Homo sapiens
gagaatagaaatttgcccctggc

SEQ ID NO: 5416323 - DNA, 14 bp, Homo sapiens
gagaatagaaggaa

SEQ ID NO: 5416324 - DNA, 16 bp, Homo sapiens
gagaatagaaggaaac

SEQ ID NO: 5416325 - DNA, 16 bp, Homo sapiens
gagaatagcagagagc

SEQ ID NO: 5416326 - DNA, 23 bp, Homo sapiens
gagaatagcagagagccaaatct

SEQ ID NO: 5416327 - DNA, 21 bp, Homo sapiens
gagaatataccttatttattt

SEQ ID NO: 5416328 - DNA, 14 bp, Homo sapiens
gagaatatatacat

SEQ ID NO: 5416329 - DNA, 15 bp, Homo sapiens
gagaatattaattgt

SEQ ID NO: 5416330 - DNA, 19 bp, Homo sapiens
gagaatattttaagtattg

SEQ ID NO: 5416331 - DNA, 23 bp, Homo sapiens
gagaatatttttggcattcctct

SEQ ID NO: 5416332 - DNA, 13 bp, Homo sapiens
gagaatcactgca

SEQ ID NO: 5416333 - DNA, 18 bp, Homo sapiens
gagaatcactgcagccca

SEQ ID NO: 5416334 - DNA, 20 bp, Homo sapiens
gagaatcactgcagcccagg

SEQ ID NO: 5416335 - DNA, 13 bp, Homo sapiens
gagaatcacttga

SEQ ID NO: 5416336 - DNA, 15 bp, Homo sapiens
gagaatcacttgaac

SEQ ID NO: 5416337 - DNA, 23 bp, Homo sapiens
gagaatcacttgaccgggagaca

SEQ ID NO: 5416338 - DNA, 13 bp, Homo sapiens
gagaatcagacct

SEQ ID NO: 5416339 - DNA, 18 bp, Homo sapiens
gagaatcagacctgggtg

SEQ ID NO: 5416340 - DNA, 14 bp, Homo sapiens
gagaatcagactga

SEQ ID NO: 5416341 - DNA, 14 bp, Homo sapiens
gagaatcagggcag

SEQ ID NO: 5416342 - DNA, 21 bp, Homo sapiens
gagaatcatacttagcaaagt

SEQ ID NO: 5416343 - DNA, 19 bp, Homo sapiens
gagaatcatgtttctttga

SEQ ID NO: 5416344 - DNA, 20 bp, Homo sapiens
gagaatcccactttctatag

SEQ ID NO: 5416345 - DNA, 17 bp, Homo sapiens
gagaatcccttaaaatt

SEQ ID NO: 5416346 - DNA, 18 bp, Homo sapiens
gagaatcccttaaaatta

SEQ ID NO: 5416347 - DNA, 14 bp, Homo sapiens
gagaatcctccctt

SEQ ID NO: 5416348 - DNA, 18 bp, Homo sapiens
gagaatcctctcctttct

SEQ ID NO: 5416349 - DNA, 21 bp, Homo sapiens
gagaatcctctcctttcttat

SEQ ID NO: 5416350 - DNA, 14 bp, Homo sapiens
gagaatcctgcctc

SEQ ID NO: 5416351 - DNA, 14 bp, Homo sapiens
gagaatcgcttgaa

SEQ ID NO: 5416352 - DNA, 15 bp, Homo sapiens
gagaatctatattta

SEQ ID NO: 5416353 - DNA, 15 bp, Homo sapiens
gagaatctcttggga

SEQ ID NO: 5416354 - DNA, 17 bp, Homo sapiens
gagaatctgagacatct

SEQ ID NO: 5416355 - DNA, 19 bp, Homo sapiens
gagaatctgggggtgagga

SEQ ID NO: 5416356 - DNA, 22 bp, Homo sapiens
gagaatctgggggtgaggagga

SEQ ID NO: 5416357 - DNA, 19 bp, Homo sapiens
gagaatcttaaggtctaac

SEQ ID NO: 5416358 - DNA, 14 bp, Homo sapiens
gagactgcagagga

SEQ ID NO: 5416359 - DNA, 16 bp, Homo sapiens
gagactgcaggtgggc

SEQ ID NO: 5416360 - DNA, 19 bp, Homo sapiens
gagactgcaggtgggctgg

SEQ ID NO: 5416361 - DNA, 22 bp, Homo sapiens
gagactgcaggtgggctgggcc

SEQ ID NO: 5416362 - DNA, 14 bp, Homo sapiens
gagactgcccaccc

SEQ ID NO: 5416363 - DNA, 15 bp, Homo sapiens
gagactgcccaccct

SEQ ID NO: 5416364 - DNA, 21 bp, Homo sapiens
gagactgccccacggccctgt

SEQ ID NO: 5416365 - DNA, 13 bp, Homo sapiens
gagactgcccttc

SEQ ID NO: 5416366 - DNA, 19 bp, Homo sapiens
gagactgcgggatggtcct

SEQ ID NO: 5416367 - DNA, 23 bp, Homo sapiens
gagactgcgttctgcaagcatca

SEQ ID NO: 5416368 - DNA, 17 bp, Homo sapiens
gagactgctcctgagcc

SEQ ID NO: 5416369 - DNA, 20 bp, Homo sapiens
gagactgcttcccatcctac

SEQ ID NO: 5416370 - DNA, 23 bp, Homo sapiens
gagactgcttcccatcctaccct

SEQ ID NO: 5416371 - DNA, 16 bp, Homo sapiens
gagactgcttgacaaa

SEQ ID NO: 5416372 - DNA, 16 bp, Homo sapiens
gagactggagcatctg

SEQ ID NO: 5416373 - DNA, 20 bp, Homo sapiens
gagactggagcatctgactc

SEQ ID NO: 5416374 - DNA, 16 bp, Homo sapiens
gagactggcaagagct

SEQ ID NO: 5416375 - DNA, 17 bp, Homo sapiens
gagactggcacttagcc

SEQ ID NO: 5416376 - DNA, 13 bp, Homo sapiens
gagactggcagcc

SEQ ID NO: 5416377 - DNA, 16 bp, Homo sapiens
gagactggcagccagg

SEQ ID NO: 5416378 - DNA, 19 bp, Homo sapiens
gagactggcagccagggag

SEQ ID NO: 5416379 - DNA, 18 bp, Homo sapiens
gagactggccagaggcag

SEQ ID NO: 5416380 - DNA, 19 bp, Homo sapiens
gagactggcgtgaacccag

SEQ ID NO: 5416381 - DNA, 19 bp, Homo sapiens
gagactgggcacccctgcc

SEQ ID NO: 5416382 - DNA, 14 bp, Homo sapiens
gagactgggctgag

SEQ ID NO: 5416383 - DNA, 17 bp, Homo sapiens
gagactgggctgaggga

SEQ ID NO: 5416384 - DNA, 16 bp, Homo sapiens
gagactggggggcttg

SEQ ID NO: 5416385 - DNA, 13 bp, Homo sapiens
gagactggggtgg

SEQ ID NO: 5416386 - DNA, 15 bp, Homo sapiens
gagactggggtggcc

SEQ ID NO: 5416387 - DNA, 20 bp, Homo sapiens
gagactggggtggcctcaag

SEQ ID NO: 5416388 - DNA, 16 bp, Homo sapiens
gagactggtcctgtgt

SEQ ID NO: 5416389 - DNA, 23 bp, Homo sapiens
gagactggtcctgtgtgcagtga

SEQ ID NO: 5416390 - DNA, 21 bp, Homo sapiens
gagactggttagtgatgcagt

SEQ ID NO: 5416391 - DNA, 16 bp, Homo sapiens
gagactggttttttcc

SEQ ID NO: 5416392 - DNA, 19 bp, Homo sapiens
gagactgtccacttctagc

SEQ ID NO: 5416393 - DNA, 22 bp, Homo sapiens
gagactgtctcaagagggcact

SEQ ID NO: 5416394 - DNA, 21 bp, Homo sapiens
gagactgtctggcccccctgg

SEQ ID NO: 5416395 - DNA, 22 bp, Homo sapiens
gagactgtctggcccccctggt

SEQ ID NO: 5416396 - DNA, 17 bp, Homo sapiens
gagactgtgaggcggca

SEQ ID NO: 5416397 - DNA, 22 bp, Homo sapiens
gagactgtgaggcggcagctgg

SEQ ID NO: 5416398 - DNA, 23 bp, Homo sapiens
gagactgtgaggcggcagctggg

SEQ ID NO: 5416399 - DNA, 13 bp, Homo sapiens
gagactgtgccat

SEQ ID NO: 5416400 - DNA, 16 bp, Homo sapiens
gagactgtggggaggg

SEQ ID NO: 5416401 - DNA, 17 bp, Homo sapiens
gagactgtggggagggt

SEQ ID NO: 5416402 - DNA, 21 bp, Homo sapiens
gagactgtgtgtgccctctgg

SEQ ID NO: 5416403 - DNA, 22 bp, Homo sapiens
gagactgtttattaccagattc

SEQ ID NO: 5416404 - DNA, 17 bp, Homo sapiens
gagactgttttgaattt

SEQ ID NO: 5416405 - DNA, 13 bp, Homo sapiens
gagacttaaaaca

SEQ ID NO: 5416406 - DNA, 18 bp, Homo sapiens
gagacttacgccctgttc

SEQ ID NO: 5416407 - DNA, 19 bp, Homo sapiens
gagacttacgccctgttcc

SEQ ID NO: 5416408 - DNA, 16 bp, Homo sapiens
gagacttacggcaaga

SEQ ID NO: 5416409 - DNA, 14 bp, Homo sapiens
gagacttactgggt

SEQ ID NO: 5416410 - DNA, 18 bp, Homo sapiens
gagacttaggccagaggt

SEQ ID NO: 5416411 - DNA, 20 bp, Homo sapiens
gagacttaggccagaggtga

SEQ ID NO: 5416412 - DNA, 23 bp, Homo sapiens
gagacttcccagaccccggaggc

SEQ ID NO: 5416413 - DNA, 15 bp, Homo sapiens
gagacttcctctggt

SEQ ID NO: 5416414 - DNA, 22 bp, Homo sapiens
gagacttccttgtgtcagggca

SEQ ID NO: 5416415 - DNA, 21 bp, Homo sapiens
gagacttctaggaggatgctg

SEQ ID NO: 5416416 - DNA, 12 bp, Homo sapiens
gagacttctctg

SEQ ID NO: 5416417 - DNA, 11 bp, Homo sapiens
gagacttctgt

SEQ ID NO: 5416418 - DNA, 18 bp, Homo sapiens
gagacttgagcttgacct

SEQ ID NO: 5416419 - DNA, 12 bp, Homo sapiens
gagacttgcctt

SEQ ID NO: 5416420 - DNA, 19 bp, Homo sapiens
gagacttggaagaggagga

SEQ ID NO: 5416421 - DNA, 15 bp, Homo sapiens
gagacttggatgagg

SEQ ID NO: 5416422 - DNA, 23 bp, Homo sapiens
gagacttgtacagttgactggct

SEQ ID NO: 5416423 - DNA, 14 bp, Homo sapiens
gagacttgtagttt

SEQ ID NO: 5416424 - DNA, 16 bp, Homo sapiens
gagacttgttctagag

SEQ ID NO: 5416425 - DNA, 21 bp, Homo sapiens
gagacttgttcttggttcctg

SEQ ID NO: 5416426 - DNA, 22 bp, Homo sapiens
gagacttgttcttggttcctgt

SEQ ID NO: 5416427 - DNA, 17 bp, Homo sapiens
gagactttcccctctcg

SEQ ID NO: 5416428 - DNA, 14 bp, Homo sapiens
gagactttctcctg

SEQ ID NO: 5416429 - DNA, 17 bp, Homo sapiens
gagactttctcctggcc

SEQ ID NO: 5416430 - DNA, 20 bp, Homo sapiens
gagactttctttctgtaggt

SEQ ID NO: 5416431 - DNA, 10 bp, Homo sapiens
gagactttga

SEQ ID NO: 5416432 - DNA, 11 bp, Homo sapiens
gagactttgat

SEQ ID NO: 5416433 - DNA, 19 bp, Homo sapiens
gagactttgatactaccag

SEQ ID NO: 5416434 - DNA, 22 bp, Homo sapiens
gagactttgatactaccagggt

SEQ ID NO: 5416435 - DNA, 13 bp, Homo sapiens
gagactttgatgt

SEQ ID NO: 5416436 - DNA, 14 bp, Homo sapiens
gagactttgcccag

SEQ ID NO: 5416437 - DNA, 15 bp, Homo sapiens
gagactttgtcactt

SEQ ID NO: 5416438 - DNA, 19 bp, Homo sapiens
gagactttgtcacttattt

SEQ ID NO: 5416439 - DNA, 20 bp, Homo sapiens
gagactttgtcacttatttc

SEQ ID NO: 5416440 - DNA, 19 bp, Homo sapiens
gagactttttggtggatgt

SEQ ID NO: 5416441 - DNA, 23 bp, Homo sapiens
gagagaaaacagacctaatgctc

SEQ ID NO: 5416442 - DNA, 20 bp, Homo sapiens
gagagaaaacttatttgagt

SEQ ID NO: 5416443 - DNA, 16 bp, Homo sapiens
gagagaaaagaaaaat

SEQ ID NO: 5416444 - DNA, 18 bp, Homo sapiens
gagagaaaagaaaaatat

SEQ ID NO: 5416445 - DNA, 15 bp, Homo sapiens
gagagaaaagctgga

SEQ ID NO: 5416446 - DNA, 11 bp, Homo sapiens
gagagaaaata

SEQ ID NO: 5416447 - DNA, 12 bp, Homo sapiens
gagagaaaataa

SEQ ID NO: 5416448 - DNA, 11 bp, Homo sapiens
gagagaaagaa

SEQ ID NO: 5416449 - DNA, 12 bp, Homo sapiens
gagagaaagaga

SEQ ID NO: 5416450 - DNA, 15 bp, Homo sapiens
gagagaaagagagaa

SEQ ID NO: 5416451 - DNA, 18 bp, Homo sapiens
gagagaaagagagaagcc

SEQ ID NO: 5416452 - DNA, 20 bp, Homo sapiens
gagagaaagagagaagccag

SEQ ID NO: 5416453 - DNA, 21 bp, Homo sapiens
gagagaaagagagaagccagc

SEQ ID NO: 5416454 - DNA, 16 bp, Homo sapiens
gagagaaagccaggca

SEQ ID NO: 5416455 - DNA, 18 bp, Homo sapiens
gagagaaagccaggcagg

SEQ ID NO: 5416456 - DNA, 19 bp, Homo sapiens
gagagaaagccaggcaggt

SEQ ID NO: 5416457 - DNA, 14 bp, Homo sapiens
gagagaaaggactc

SEQ ID NO: 5416458 - DNA, 16 bp, Homo sapiens
gagagaaaggactcct

SEQ ID NO: 5416459 - DNA, 22 bp, Homo sapiens
gagagaaagtgggacctggtgg

SEQ ID NO: 5416460 - DNA, 22 bp, Homo sapiens
gagagaaagtgtgagcaaacta

SEQ ID NO: 5416461 - DNA, 13 bp, Homo sapiens
gagagaaatattt

SEQ ID NO: 5416462 - DNA, 18 bp, Homo sapiens
gagagaaatcaggcctga

SEQ ID NO: 5416463 - DNA, 19 bp, Homo sapiens
gagagaaatcttaagtcat

SEQ ID NO: 5416464 - DNA, 14 bp, Homo sapiens
gagagaaattctgt

SEQ ID NO: 5416465 - DNA, 23 bp, Homo sapiens
gagagaaattctgttaaaatcta

SEQ ID NO: 5416466 - DNA, 16 bp, Homo sapiens
gagagaacctaactgt

SEQ ID NO: 5416467 - DNA, 17 bp, Homo sapiens
gagagaacctaactgta

SEQ ID NO: 5416468 - DNA, 11 bp, Homo sapiens
gagagaactta

SEQ ID NO: 5416469 - DNA, 17 bp, Homo sapiens
gagagaagagaatgcac

SEQ ID NO: 5416470 - DNA, 14 bp, Homo sapiens
gagagaagagcccc

SEQ ID NO: 5416471 - DNA, 16 bp, Homo sapiens
gagagaagagccccac

SEQ ID NO: 5416472 - DNA, 17 bp, Homo sapiens
gagagaagagtccagga

SEQ ID NO: 5416473 - DNA, 17 bp, Homo sapiens
gagagaagcaagccagc

SEQ ID NO: 5416474 - DNA, 15 bp, Homo sapiens
gagagaagcacccca

SEQ ID NO: 5416475 - DNA, 13 bp, Homo sapiens
gagagaagcaggc

SEQ ID NO: 5416476 - DNA, 15 bp, Homo sapiens
gagagaagcaggcag

SEQ ID NO: 5416477 - DNA, 16 bp, Homo sapiens
gagagaagccacgctg

SEQ ID NO: 5416478 - DNA, 14 bp, Homo sapiens
gagagaagccagcc

SEQ ID NO: 5416479 - DNA, 18 bp, Homo sapiens
gagagaagccagccacag

SEQ ID NO: 5416480 - DNA, 13 bp, Homo sapiens
gagagaagctctt

SEQ ID NO: 5416481 - DNA, 17 bp, Homo sapiens
gagagaaggggaggagg

SEQ ID NO: 5416482 - DNA, 21 bp, Homo sapiens
gagagaaggtggtctgcaccc

SEQ ID NO: 5416483 - DNA, 18 bp, Homo sapiens
gagagaagtgcccctgct

SEQ ID NO: 5416484 - DNA, 15 bp, Homo sapiens
gagagaagtggccag

SEQ ID NO: 5416485 - DNA, 23 bp, Homo sapiens
gagagaataaattggattatttt

SEQ ID NO: 5416486 - DNA, 17 bp, Homo sapiens
gagagaatagagctgcc

SEQ ID NO: 5416487 - DNA, 19 bp, Homo sapiens
gagagaatagagctgccac

SEQ ID NO: 5416488 - DNA, 21 bp, Homo sapiens
gagagaatagagctgccactg

SEQ ID NO: 5416489 - DNA, 21 bp, Homo sapiens
gagagaatgagagagtgtgga

SEQ ID NO: 5416490 - DNA, 15 bp, Homo sapiens
gagagaatgtggaaa

SEQ ID NO: 5416491 - DNA, 22 bp, Homo sapiens
gagagaatgtgtgtgtgtggca

SEQ ID NO: 5416492 - DNA, 17 bp, Homo sapiens
gagagaattaaaactca

SEQ ID NO: 5416493 - DNA, 18 bp, Homo sapiens
gagagaattctgttctaa

SEQ ID NO: 5416494 - DNA, 13 bp, Homo sapiens
gagagacacagat

SEQ ID NO: 5416495 - DNA, 21 bp, Homo sapiens
gagagacaggcagcccagcag

SEQ ID NO: 5416496 - DNA, 15 bp, Homo sapiens
gagagacccaaggag

SEQ ID NO: 5416497 - DNA, 19 bp, Homo sapiens
gagagacccaaggaggaaa

SEQ ID NO: 5416498 - DNA, 11 bp, Homo sapiens
gagagacccca

SEQ ID NO: 5416499 - DNA, 15 bp, Homo sapiens
gagagaccctgccaa

SEQ ID NO: 5416500 - DNA, 15 bp, Homo sapiens
gagagaccctggcct

SEQ ID NO: 5416501 - DNA, 17 bp, Homo sapiens
gagagaccgaggaggga

SEQ ID NO: 5416502 - DNA, 15 bp, Homo sapiens
gagagacctcatcag

SEQ ID NO: 5416503 - DNA, 19 bp, Homo sapiens
gagagactgaaagcagcag

SEQ ID NO: 5416504 - DNA, 17 bp, Homo sapiens
gagagactgagggagag

SEQ ID NO: 5416505 - DNA, 13 bp, Homo sapiens
gagagactgccat

SEQ ID NO: 5416506 - DNA, 14 bp, Homo sapiens
gagagactggccag

SEQ ID NO: 5416507 - DNA, 20 bp, Homo sapiens
gagagacttgtgctcaagga

SEQ ID NO: 5416508 - DNA, 13 bp, Homo sapiens
gagagagaaaaaa

SEQ ID NO: 5416509 - DNA, 11 bp, Homo sapiens
gagagagaaag

SEQ ID NO: 5416510 - DNA, 13 bp, Homo sapiens
gagagagaaagag

SEQ ID NO: 5416511 - DNA, 14 bp, Homo sapiens
gagagagaaagaga

SEQ ID NO: 5416512 - DNA, 11 bp, Homo sapiens
gagagagaagg

SEQ ID NO: 5416513 - DNA, 20 bp, Homo sapiens
gagagagaatagagctgcca

SEQ ID NO: 5416514 - DNA, 11 bp, Homo sapiens
gagagagactg

SEQ ID NO: 5416515 - DNA, 18 bp, Homo sapiens
gagagagacttggaagag

SEQ ID NO: 5416516 - DNA, 10 bp, Homo sapiens
gagagagaga

SEQ ID NO: 5416517 - DNA, 15 bp, Homo sapiens
gagagagagaaagag

SEQ ID NO: 5416518 - DNA, 14 bp, Homo sapiens
gagagagagagaaa

SEQ ID NO: 5416519 - DNA, 13 bp, Homo sapiens
gagagagagagag

SEQ ID NO: 5416520 - DNA, 13 bp, Homo sapiens
gagagagaggaca

SEQ ID NO: 5416521 - DNA, 15 bp, Homo sapiens
gagagagaggcagaa

SEQ ID NO: 5416522 - DNA, 19 bp, Homo sapiens
gagagagcagcttctgcca

SEQ ID NO: 5416523 - DNA, 14 bp, Homo sapiens
gagagagccatgaa

SEQ ID NO: 5416524 - DNA, 18 bp, Homo sapiens
gagagagccatgaagcat

SEQ ID NO: 5416525 - DNA, 23 bp, Homo sapiens
gagagagcccttcccagggcacc

SEQ ID NO: 5416526 - DNA, 18 bp, Homo sapiens
gagagagcgcgggagaga

SEQ ID NO: 5416527 - DNA, 19 bp, Homo sapiens
gagagagcgcgggagagag

SEQ ID NO: 5416528 - DNA, 16 bp, Homo sapiens
gagagagctgtattaa

SEQ ID NO: 5416529 - DNA, 22 bp, Homo sapiens
gagagagcttctgttgctgcct

SEQ ID NO: 5416530 - DNA, 21 bp, Homo sapiens
gagagaggaaggagattccac

SEQ ID NO: 5416531 - DNA, 13 bp, Homo sapiens
gagagaggacagc

SEQ ID NO: 5416532 - DNA, 15 bp, Homo sapiens
gagagaggacctcca

SEQ ID NO: 5416533 - DNA, 22 bp, Homo sapiens
gagagaggacctccatgccccc

SEQ ID NO: 5416534 - DNA, 15 bp, Homo sapiens
gagagaggaggcctg

SEQ ID NO: 5416535 - DNA, 18 bp, Homo sapiens
gagagaggaggcctggac

SEQ ID NO: 5416536 - DNA, 13 bp, Homo sapiens
gagagaggccatt

SEQ ID NO: 5416537 - DNA, 12 bp, Homo sapiens
gagaggatttga

SEQ ID NO: 5416538 - DNA, 18 bp, Homo sapiens
gagaggcaccagtccagc

SEQ ID NO: 5416539 - DNA, 13 bp, Homo sapiens
gagaggcactcag

SEQ ID NO: 5416540 - DNA, 18 bp, Homo sapiens
gagaggcactcagtgagc

SEQ ID NO: 5416541 - DNA, 11 bp, Homo sapiens
gagaggcagaa

SEQ ID NO: 5416542 - DNA, 22 bp, Homo sapiens
gagaggcagacttccctgaatg

SEQ ID NO: 5416543 - DNA, 16 bp, Homo sapiens
gagaggcagagagcgg

SEQ ID NO: 5416544 - DNA, 15 bp, Homo sapiens
gagaggcagagtgcc

SEQ ID NO: 5416545 - DNA, 13 bp, Homo sapiens
gagaggcagccag

SEQ ID NO: 5416546 - DNA, 21 bp, Homo sapiens
gagaggcagcccaggaagtct

SEQ ID NO: 5416547 - DNA, 11 bp, Homo sapiens
gagaggcagct

SEQ ID NO: 5416548 - DNA, 14 bp, Homo sapiens
gagaggcaggaatg

SEQ ID NO: 5416549 - DNA, 16 bp, Homo sapiens
gagaggcaggaatggg

SEQ ID NO: 5416550 - DNA, 21 bp, Homo sapiens
gagaggcaggcatagaggctt

SEQ ID NO: 5416551 - DNA, 14 bp, Homo sapiens
gagaggcatggctg

SEQ ID NO: 5416552 - DNA, 23 bp, Homo sapiens
gagaggcatgggggcccaaaggg

SEQ ID NO: 5416553 - DNA, 14 bp, Homo sapiens
gagaggccagttga

SEQ ID NO: 5416554 - DNA, 11 bp, Homo sapiens
gagaggccccc

SEQ ID NO: 5416555 - DNA, 23 bp, Homo sapiens
gagaggccctctggagtggccac

SEQ ID NO: 5416556 - DNA, 13 bp, Homo sapiens
gagaggccgggac

SEQ ID NO: 5416557 - DNA, 20 bp, Homo sapiens
gagaggcctcggctgtctcc

SEQ ID NO: 5416558 - DNA, 23 bp, Homo sapiens
gagaggcctcggctgtctcctgt

SEQ ID NO: 5416559 - DNA, 20 bp, Homo sapiens
gagaggcctggggtgggaca

SEQ ID NO: 5416560 - DNA, 21 bp, Homo sapiens
gagaggcctggggtgggacag

SEQ ID NO: 5416561 - DNA, 23 bp, Homo sapiens
gagaggcgcgtctgccccaccct

SEQ ID NO: 5416562 - DNA, 12 bp, Homo sapiens
gagaggcggcct

SEQ ID NO: 5416563 - DNA, 15 bp, Homo sapiens
gagaggcggcctcgt

SEQ ID NO: 5416564 - DNA, 15 bp, Homo sapiens
gagaggcgtcctggt

SEQ ID NO: 5416565 - DNA, 19 bp, Homo sapiens
gagaggcgtcctggtgagg

SEQ ID NO: 5416566 - DNA, 20 bp, Homo sapiens
gagaggcgttagtgggcagg

SEQ ID NO: 5416567 - DNA, 21 bp, Homo sapiens
gagaggctctgaaagctgctt

SEQ ID NO: 5416568 - DNA, 16 bp, Homo sapiens
gagaggctctggggca

SEQ ID NO: 5416569 - DNA, 22 bp, Homo sapiens
gagaggctgagtacggatggga

SEQ ID NO: 5416570 - DNA, 15 bp, Homo sapiens
gagaggctgcctcag

SEQ ID NO: 5416571 - DNA, 15 bp, Homo sapiens
gagaggctggatgac

SEQ ID NO: 5416572 - DNA, 20 bp, Homo sapiens
gagaggctgggctgggtggc

SEQ ID NO: 5416573 - DNA, 12 bp, Homo sapiens
gagaggctggtg

SEQ ID NO: 5416574 - DNA, 18 bp, Homo sapiens
gagaggctgtctggggcc

SEQ ID NO: 5416575 - DNA, 23 bp, Homo sapiens
gagaggctgtggtggctgtctct

SEQ ID NO: 5416576 - DNA, 18 bp, Homo sapiens
gagagggaagagggagac

SEQ ID NO: 5416577 - DNA, 15 bp, Homo sapiens
gagagggaagctgag

SEQ ID NO: 5416578 - DNA, 17 bp, Homo sapiens
gagagggaagctgaggc

SEQ ID NO: 5416579 - DNA, 14 bp, Homo sapiens
gagagggaatgtga

SEQ ID NO: 5416580 - DNA, 15 bp, Homo sapiens
gagagggaatgtgaa

SEQ ID NO: 5416581 - DNA, 19 bp, Homo sapiens
gagagggagagcagagaaa

SEQ ID NO: 5416582 - DNA, 18 bp, Homo sapiens
gagagggagcaagccttc

SEQ ID NO: 5416583 - DNA, 19 bp, Homo sapiens
gagagggaggcaagccctg

SEQ ID NO: 5416584 - DNA, 23 bp, Homo sapiens
gagagggaggtcactggaaaggg

SEQ ID NO: 5416585 - DNA, 12 bp, Homo sapiens
gagagggatgga

SEQ ID NO: 5416586 - DNA, 14 bp, Homo sapiens
gagagggcagaggg

SEQ ID NO: 5416587 - DNA, 16 bp, Homo sapiens
gagagggcccagctgt

SEQ ID NO: 5416588 - DNA, 17 bp, Homo sapiens
gagagggcccagctgta

SEQ ID NO: 5416589 - DNA, 21 bp, Homo sapiens
gagagggcccagctgtagcca

SEQ ID NO: 5416590 - DNA, 23 bp, Homo sapiens
gagagggccgggcagaggggcag

SEQ ID NO: 5416591 - DNA, 18 bp, Homo sapiens
gagagggcctctgcctgg

SEQ ID NO: 5416592 - DNA, 15 bp, Homo sapiens
gagagggcgcaggcc

SEQ ID NO: 5416593 - DNA, 17 bp, Homo sapiens
gagagggcgcaggccgt

SEQ ID NO: 5416594 - DNA, 14 bp, Homo sapiens
gagagggcgcccag

SEQ ID NO: 5416595 - DNA, 18 bp, Homo sapiens
gagagggcgcccagccca

SEQ ID NO: 5416596 - DNA, 17 bp, Homo sapiens
gagagggctagccctga

SEQ ID NO: 5416597 - DNA, 21 bp, Homo sapiens
gagagggctagccctgagccc

SEQ ID NO: 5416598 - DNA, 20 bp, Homo sapiens
gagagggctcgaggggtggg

SEQ ID NO: 5416599 - DNA, 11 bp, Homo sapiens
gagagggctga

SEQ ID NO: 5416600 - DNA, 13 bp, Homo sapiens
gagagggctgagc

SEQ ID NO: 5416601 - DNA, 22 bp, Homo sapiens
gagagggctgagccatgggggt

SEQ ID NO: 5416602 - DNA, 15 bp, Homo sapiens
gagagggctgagccc

SEQ ID NO: 5416603 - DNA, 23 bp, Homo sapiens
gagagggctgttggacagctgct

SEQ ID NO: 5416604 - DNA, 14 bp, Homo sapiens
gagagggcttgaaa

SEQ ID NO: 5416605 - DNA, 11 bp, Homo sapiens
gagagggcttt

SEQ ID NO: 5416606 - DNA, 15 bp, Homo sapiens
gagaggggacatttc

SEQ ID NO: 5416607 - DNA, 16 bp, Homo sapiens
gagaggggacgcaggc

SEQ ID NO: 5416608 - DNA, 14 bp, Homo sapiens
gagaggggagagag

SEQ ID NO: 5416609 - DNA, 13 bp, Homo sapiens
gagaggggaggga

SEQ ID NO: 5416610 - DNA, 16 bp, Homo sapiens
gagaggggagggaggg

SEQ ID NO: 5416611 - DNA, 16 bp, Homo sapiens
gagaggggagggctcc

SEQ ID NO: 5416612 - DNA, 13 bp, Homo sapiens
gagaggggcacag

SEQ ID NO: 5416613 - DNA, 18 bp, Homo sapiens
gagaggggcctctggctg

SEQ ID NO: 5416614 - DNA, 12 bp, Homo sapiens
gagaggggcctg

SEQ ID NO: 5416615 - DNA, 15 bp, Homo sapiens
gagaggggcctggga

SEQ ID NO: 5416616 - DNA, 20 bp, Homo sapiens
gagaggggcctgggaaagga

SEQ ID NO: 5416617 - DNA, 15 bp, Homo sapiens
gagaggggctgctct

SEQ ID NO: 5416618 - DNA, 20 bp, Homo sapiens
gagaggggctgctctccaga

SEQ ID NO: 5416619 - DNA, 18 bp, Homo sapiens
gagagggggatgcccctg

SEQ ID NO: 5416620 - DNA, 21 bp, Homo sapiens
gagagggggatgcccctggcc

SEQ ID NO: 5416621 - DNA, 23 bp, Homo sapiens
gagagggggatgcccctggccct

SEQ ID NO: 5416622 - DNA, 19 bp, Homo sapiens
gagagggggcactgtggtc

SEQ ID NO: 5416623 - DNA, 22 bp, Homo sapiens
gagagggggcactgtggtcagg

SEQ ID NO: 5416624 - DNA, 18 bp, Homo sapiens
gagagggggccacctccc

SEQ ID NO: 5416625 - DNA, 23 bp, Homo sapiens
gagagggggcctgggacttccat

SEQ ID NO: 5416626 - DNA, 18 bp, Homo sapiens
gagagggggtaatggagg

SEQ ID NO: 5416627 - DNA, 17 bp, Homo sapiens
gagaggggtggaggctg

SEQ ID NO: 5416628 - DNA, 14 bp, Homo sapiens
gagaggggtttggg

SEQ ID NO: 5416629 - DNA, 16 bp, Homo sapiens
gagagggtgaaggagg

SEQ ID NO: 5416630 - DNA, 13 bp, Homo sapiens
gagagggtgacaa

SEQ ID NO: 5416631 - DNA, 22 bp, Homo sapiens
gagagggtgccgcgggcgagaa

SEQ ID NO: 5416632 - DNA, 15 bp, Homo sapiens
gagagggtggcatca

SEQ ID NO: 5416633 - DNA, 20 bp, Homo sapiens
gagagggtgggagtgggccc

SEQ ID NO: 5416634 - DNA, 14 bp, Homo sapiens
gagaggtaaagggt

SEQ ID NO: 5416635 - DNA, 20 bp, Homo sapiens
gagaggtagcactctcagag

SEQ ID NO: 5416636 - DNA, 18 bp, Homo sapiens
gagaggtagcgagctgct

SEQ ID NO: 5416637 - DNA, 18 bp, Homo sapiens
gagaggtcaagcccagga

SEQ ID NO: 5416638 - DNA, 24 bp, Homo sapiens
gagaggtcaagcccaggaggactg

SEQ ID NO: 5416639 - DNA, 23 bp, Homo sapiens
gagaggtccctgcttacctgacg

SEQ ID NO: 5416640 - DNA, 15 bp, Homo sapiens
gagaggtctcaggtt

SEQ ID NO: 5416641 - DNA, 17 bp, Homo sapiens
gagaggtcttttttaaa

SEQ ID NO: 5416642 - DNA, 17 bp, Homo sapiens
gagaggtgaaagcataa

SEQ ID NO: 5416643 - DNA, 13 bp, Homo sapiens
gagaggtgccagc

SEQ ID NO: 5416644 - DNA, 16 bp, Homo sapiens
gagaggtggagaactg

SEQ ID NO: 5416645 - DNA, 21 bp, Homo sapiens
gagaggtggagaactgggatt

SEQ ID NO: 5416646 - DNA, 14 bp, Homo sapiens
gagaggtggcagga

SEQ ID NO: 5416647 - DNA, 23 bp, Homo sapiens
gagaggtgggaggaactccttgc

SEQ ID NO: 5416648 - DNA, 14 bp, Homo sapiens
gagaggtgggcagc

SEQ ID NO: 5416649 - DNA, 16 bp, Homo sapiens
gagaggtgggcagcag

SEQ ID NO: 5416650 - DNA, 22 bp, Homo sapiens
gagaggtggggagggagacaga

SEQ ID NO: 5416651 - DNA, 14 bp, Homo sapiens
gagaggttaaagca

SEQ ID NO: 5416652 - DNA, 21 bp, Homo sapiens
gagaggttaaagcaaaccagc

SEQ ID NO: 5416653 - DNA, 22 bp, Homo sapiens
gagaggttaaagcaaaccagcc

SEQ ID NO: 5416654 - DNA, 16 bp, Homo sapiens
gagaggttaaggtgca

SEQ ID NO: 5416655 - DNA, 18 bp, Homo sapiens
gagaggttctggggagga

SEQ ID NO: 5416656 - DNA, 22 bp, Homo sapiens
gagaggttctggggaggaaggg

SEQ ID NO: 5416657 - DNA, 20 bp, Homo sapiens
gagaggtttgcagtcccaag

SEQ ID NO: 5416658 - DNA, 22 bp, Homo sapiens
gagaggtttgtcaacacaaaga

SEQ ID NO: 5416659 - DNA, 15 bp, Homo sapiens
gagagtaaaaattca

SEQ ID NO: 5416660 - DNA, 13 bp, Homo sapiens
gagagtaaacaga

SEQ ID NO: 5416661 - DNA, 20 bp, Homo sapiens
gagagtaatttgggaaaaga

SEQ ID NO: 5416662 - DNA, 14 bp, Homo sapiens
gagagtacactgtg

SEQ ID NO: 5416663 - DNA, 19 bp, Homo sapiens
gagagtacagtgagccaag

SEQ ID NO: 5416664 - DNA, 19 bp, Homo sapiens
gagagtacatttgctttaa

SEQ ID NO: 5416665 - DNA, 17 bp, Homo sapiens
gagagtaccatgctggc

SEQ ID NO: 5416666 - DNA, 14 bp, Homo sapiens
gagagtacctgtgt

SEQ ID NO: 5416667 - DNA, 21 bp, Homo sapiens
gagagtagccgagagcctgct

SEQ ID NO: 5416668 - DNA, 15 bp, Homo sapiens
gagagtatattatgt

SEQ ID NO: 5416669 - DNA, 17 bp, Homo sapiens
gagagtattaaatattt

SEQ ID NO: 5416670 - DNA, 16 bp, Homo sapiens
gagagtcaaagctgac

SEQ ID NO: 5416671 - DNA, 14 bp, Homo sapiens
gagagtcaaatggg

SEQ ID NO: 5416672 - DNA, 20 bp, Homo sapiens
gagagtcagctctctgccct

SEQ ID NO: 5416673 - DNA, 23 bp, Homo sapiens
gagagtcagctctctgccctgtg

SEQ ID NO: 5416674 - DNA, 13 bp, Homo sapiens
gagagtcaggagt

SEQ ID NO: 5416675 - DNA, 23 bp, Homo sapiens
gagagtcaggagttttactgcct

SEQ ID NO: 5416676 - DNA, 20 bp, Homo sapiens
gagagtcatatacattagtt

SEQ ID NO: 5416677 - DNA, 15 bp, Homo sapiens
gagagtccaggcctg

SEQ ID NO: 5416678 - DNA, 21 bp, Homo sapiens
gagagtcccactgcctcaggt

SEQ ID NO: 5416679 - DNA, 16 bp, Homo sapiens
gagagtcctgggagcc

SEQ ID NO: 5416680 - DNA, 20 bp, Homo sapiens
gagagtcggtctgctttgga

SEQ ID NO: 5416681 - DNA, 23 bp, Homo sapiens
gagagtctagcactcattttcta

SEQ ID NO: 5416682 - DNA, 16 bp, Homo sapiens
gagagtctcccaggga

SEQ ID NO: 5416683 - DNA, 13 bp, Homo sapiens
gagagtctggccc

SEQ ID NO: 5416684 - DNA, 18 bp, Homo sapiens
gagagtctggccctagac

SEQ ID NO: 5416685 - DNA, 14 bp, Homo sapiens
gagagtctgtctca

SEQ ID NO: 5416686 - DNA, 15 bp, Homo sapiens
gagagtcttgcagtg

SEQ ID NO: 5416687 - DNA, 17 bp, Homo sapiens
gagagtcttgcagtgat

SEQ ID NO: 5416688 - DNA, 17 bp, Homo sapiens
gagagtcttgggcctgg

SEQ ID NO: 5416689 - DNA, 19 bp, Homo sapiens
gagagtcttgggcctggcc

SEQ ID NO: 5416690 - DNA, 15 bp, Homo sapiens
gagagtgaacaaatt

SEQ ID NO: 5416691 - DNA, 15 bp, Homo sapiens
gagagtgagagagag

SEQ ID NO: 5416692 - DNA, 20 bp, Homo sapiens
gagagtgagagcacaaagat

SEQ ID NO: 5416693 - DNA, 17 bp, Homo sapiens
gagagtgagcatgagct

SEQ ID NO: 5416694 - DNA, 23 bp, Homo sapiens
gagagtgcggcgtgggggcactg

SEQ ID NO: 5416695 - DNA, 18 bp, Homo sapiens
gagagtggacctgtgctg

SEQ ID NO: 5416696 - DNA, 22 bp, Homo sapiens
gagagtggcaggtgggctgcct

SEQ ID NO: 5416697 - DNA, 17 bp, Homo sapiens
gagagtggcctgggtcc

SEQ ID NO: 5416698 - DNA, 22 bp, Homo sapiens
gagagtggcctgggtcccaggg

SEQ ID NO: 5416699 - DNA, 21 bp, Homo sapiens
gagagtggctcctcccggtgc

SEQ ID NO: 5416700 - DNA, 19 bp, Homo sapiens
gagagtggggcctgccctc

SEQ ID NO: 5416701 - DNA, 19 bp, Homo sapiens
gagagtgggggagaatggc

SEQ ID NO: 5416702 - DNA, 15 bp, Homo sapiens
gagagtgggttttgt

SEQ ID NO: 5416703 - DNA, 16 bp, Homo sapiens
gagagtggtaaaaaag

SEQ ID NO: 5416704 - DNA, 14 bp, Homo sapiens
gagagtggtgccct

SEQ ID NO: 5416705 - DNA, 18 bp, Homo sapiens
gagagtgtcaaccagaca

SEQ ID NO: 5416706 - DNA, 20 bp, Homo sapiens
gagagtgtcaaccagacaga

SEQ ID NO: 5416707 - DNA, 22 bp, Homo sapiens
gagagtgtcaaccagacagagg

SEQ ID NO: 5416708 - DNA, 16 bp, Homo sapiens
gagagtgtgtgggcag

SEQ ID NO: 5416709 - DNA, 17 bp, Homo sapiens
gagagtgtgtgggcagg

SEQ ID NO: 5416710 - DNA, 20 bp, Homo sapiens
gagagttagtcgccctacag

SEQ ID NO: 5416711 - DNA, 16 bp, Homo sapiens
gagagttcaagcctgt

SEQ ID NO: 5416712 - DNA, 20 bp, Homo sapiens
gagagttcaagcctgtggga

SEQ ID NO: 5416713 - DNA, 20 bp, Homo sapiens
gagagttcaatggctgctga

SEQ ID NO: 5416714 - DNA, 20 bp, Homo sapiens
gagcaatcttgctgtgaaac

SEQ ID NO: 5416715 - DNA, 22 bp, Homo sapiens
gagcaatgcttttaatgaattt

SEQ ID NO: 5416716 - DNA, 15 bp, Homo sapiens
gagcaatggcgcctg

SEQ ID NO: 5416717 - DNA, 13 bp, Homo sapiens
gagcaatgggact

SEQ ID NO: 5416718 - DNA, 13 bp, Homo sapiens
gagcaatgggagg

SEQ ID NO: 5416719 - DNA, 21 bp, Homo sapiens
gagcaatgggagggggctcca

SEQ ID NO: 5416720 - DNA, 15 bp, Homo sapiens
gagcaatgtctgtgc

SEQ ID NO: 5416721 - DNA, 17 bp, Homo sapiens
gagcaatgtctgtgcta

SEQ ID NO: 5416722 - DNA, 17 bp, Homo sapiens
gagcaattccaggctga

SEQ ID NO: 5416723 - DNA, 15 bp, Homo sapiens
gagcacaaacatttt

SEQ ID NO: 5416724 - DNA, 18 bp, Homo sapiens
gagcacaaacatttttca

SEQ ID NO: 5416725 - DNA, 22 bp, Homo sapiens
gagcacaaagaagaaagctgat

SEQ ID NO: 5416726 - DNA, 17 bp, Homo sapiens
gagcacaacataatttt

SEQ ID NO: 5416727 - DNA, 17 bp, Homo sapiens
gagcacaagaaggccag

SEQ ID NO: 5416728 - DNA, 19 bp, Homo sapiens
gagcacaagaaggccagcc

SEQ ID NO: 5416729 - DNA, 21 bp, Homo sapiens
gagcacaagaaggccagccca

SEQ ID NO: 5416730 - DNA, 23 bp, Homo sapiens
gagcacaagaaggccagcccact

SEQ ID NO: 5416731 - DNA, 22 bp, Homo sapiens
gagcacaagaggagatccaggg

SEQ ID NO: 5416732 - DNA, 20 bp, Homo sapiens
gagcacaataaatggctgta

SEQ ID NO: 5416733 - DNA, 15 bp, Homo sapiens
gagcacaataatttg

SEQ ID NO: 5416734 - DNA, 21 bp, Homo sapiens
gagcacacaggtacagcaaca

SEQ ID NO: 5416735 - DNA, 13 bp, Homo sapiens
gagcacacccagc

SEQ ID NO: 5416736 - DNA, 17 bp, Homo sapiens
gagcacacccgtgtgca

SEQ ID NO: 5416737 - DNA, 17 bp, Homo sapiens
gagcacacggccctgcc

SEQ ID NO: 5416738 - DNA, 13 bp, Homo sapiens
gagcacactgtag

SEQ ID NO: 5416739 - DNA, 22 bp, Homo sapiens
gagcacacttatttatgaattg

SEQ ID NO: 5416740 - DNA, 23 bp, Homo sapiens
gagcacacttatttatgaattgt

SEQ ID NO: 5416741 - DNA, 14 bp, Homo sapiens
gagcacagagccct

SEQ ID NO: 5416742 - DNA, 17 bp, Homo sapiens
gagcacagatctgtttc

SEQ ID NO: 5416743 - DNA, 13 bp, Homo sapiens
gagcacagccaat

SEQ ID NO: 5416744 - DNA, 15 bp, Homo sapiens
gagcacagccctccc

SEQ ID NO: 5416745 - DNA, 20 bp, Homo sapiens
gagcacagccctcccgcccc

SEQ ID NO: 5416746 - DNA, 13 bp, Homo sapiens
gagcacaggcagc

SEQ ID NO: 5416747 - DNA, 14 bp, Homo sapiens
gagcacaggcagct

SEQ ID NO: 5416748 - DNA, 15 bp, Homo sapiens
gagcacaggcagctg

SEQ ID NO: 5416749 - DNA, 22 bp, Homo sapiens
gagcacaggtgtctgcctagat

SEQ ID NO: 5416750 - DNA, 22 bp, Homo sapiens
gagcacagtcaggggctgggca

SEQ ID NO: 5416751 - DNA, 20 bp, Homo sapiens
gagcacatagtgtcctgccc

SEQ ID NO: 5416752 - DNA, 15 bp, Homo sapiens
gagcacatctctctg

SEQ ID NO: 5416753 - DNA, 18 bp, Homo sapiens
gagcacatctctctgccc

SEQ ID NO: 5416754 - DNA, 14 bp, Homo sapiens
gagcacatgttcat

SEQ ID NO: 5416755 - DNA, 15 bp, Homo sapiens
gagcacatgttcata

SEQ ID NO: 5416756 - DNA, 15 bp, Homo sapiens
gagcaccaccagggc

SEQ ID NO: 5416757 - DNA, 14 bp, Homo sapiens
gagcaccacggcca

SEQ ID NO: 5416758 - DNA, 22 bp, Homo sapiens
gagcaccacggggtcgggggag

SEQ ID NO: 5416759 - DNA, 13 bp, Homo sapiens
gagcaccaggcac

SEQ ID NO: 5416760 - DNA, 15 bp, Homo sapiens
gagcaccaggcacga

SEQ ID NO: 5416761 - DNA, 23 bp, Homo sapiens
gagcaccaggcacgaacccacct

SEQ ID NO: 5416762 - DNA, 13 bp, Homo sapiens
gagcaccagggga

SEQ ID NO: 5416763 - DNA, 17 bp, Homo sapiens
gagcacccacagccgca

SEQ ID NO: 5416764 - DNA, 20 bp, Homo sapiens
gagcacccagatcagactct

SEQ ID NO: 5416765 - DNA, 19 bp, Homo sapiens
gagcacccccaagcctggg

SEQ ID NO: 5416766 - DNA, 14 bp, Homo sapiens
gagcacccccagcc

SEQ ID NO: 5416767 - DNA, 15 bp, Homo sapiens
gagcacccccagcct

SEQ ID NO: 5416768 - DNA, 21 bp, Homo sapiens
gagcacccccagcctccccca

SEQ ID NO: 5416769 - DNA, 22 bp, Homo sapiens
gagcaccccctgctccaccagc

SEQ ID NO: 5416770 - DNA, 16 bp, Homo sapiens
gagcacccctctctgc

SEQ ID NO: 5416771 - DNA, 17 bp, Homo sapiens
gagcacccctctctgca

SEQ ID NO: 5416772 - DNA, 18 bp, Homo sapiens
gagcaccgtgtcaagctg

SEQ ID NO: 5416773 - DNA, 13 bp, Homo sapiens
gagcacctcagga

SEQ ID NO: 5416774 - DNA, 19 bp, Homo sapiens
gagcacctccacatcctcc

SEQ ID NO: 5416775 - DNA, 17 bp, Homo sapiens
gagcacctccagcctga

SEQ ID NO: 5416776 - DNA, 12 bp, Homo sapiens
gagcacctctca

SEQ ID NO: 5416777 - DNA, 14 bp, Homo sapiens
gagcacctctcaga

SEQ ID NO: 5416778 - DNA, 21 bp, Homo sapiens
gagcacctgcaggcgtgacct

SEQ ID NO: 5416779 - DNA, 16 bp, Homo sapiens
gagcacctgctgtctg

SEQ ID NO: 5416780 - DNA, 17 bp, Homo sapiens
gagcacctgctgtctgg

SEQ ID NO: 5416781 - DNA, 13 bp, Homo sapiens
gagcacctggacc

SEQ ID NO: 5416782 - DNA, 15 bp, Homo sapiens
gagcacctggacccc

SEQ ID NO: 5416783 - DNA, 16 bp, Homo sapiens
gagcacctggaccccc

SEQ ID NO: 5416784 - DNA, 20 bp, Homo sapiens
gagcacctgggccccactgg

SEQ ID NO: 5416785 - DNA, 22 bp, Homo sapiens
gagcacctgggccccactggac

SEQ ID NO: 5416786 - DNA, 13 bp, Homo sapiens
gagcacctggtgg

SEQ ID NO: 5416787 - DNA, 14 bp, Homo sapiens
gagcacctggtggg

SEQ ID NO: 5416788 - DNA, 22 bp, Homo sapiens
gagcaccttaatattattgggg

SEQ ID NO: 5416789 - DNA, 21 bp, Homo sapiens
gagcaccttagacagtccctg

SEQ ID NO: 5416790 - DNA, 17 bp, Homo sapiens
gagcaccttcctcactt

SEQ ID NO: 5416791 - DNA, 19 bp, Homo sapiens
gagcaccttcctcacttcc

SEQ ID NO: 5416792 - DNA, 23 bp, Homo sapiens
gagcaccttttaaacccctccct

SEQ ID NO: 5416793 - DNA, 13 bp, Homo sapiens
gagcacgcctgcc

SEQ ID NO: 5416794 - DNA, 14 bp, Homo sapiens
gagcacgcctgcca

SEQ ID NO: 5416795 - DNA, 22 bp, Homo sapiens
gagcacggctctgtccccagcc

SEQ ID NO: 5416796 - DNA, 20 bp, Homo sapiens
gagcacggtcccccaggagg

SEQ ID NO: 5416797 - DNA, 21 bp, Homo sapiens
gagcacgtggagatagtgcca

SEQ ID NO: 5416798 - DNA, 23 bp, Homo sapiens
gagcacgtggagatagtgccagg

SEQ ID NO: 5416799 - DNA, 21 bp, Homo sapiens
gagcactaaggtgtgctctga

SEQ ID NO: 5416800 - DNA, 20 bp, Homo sapiens
gagcactagaatgagaaatc

SEQ ID NO: 5416801 - DNA, 21 bp, Homo sapiens
gagcactagaatgagaaatca

SEQ ID NO: 5416802 - DNA, 20 bp, Homo sapiens
gagcactcccaagtctacag

SEQ ID NO: 5416803 - DNA, 21 bp, Homo sapiens
gagcactctaattagagaact

SEQ ID NO: 5416804 - DNA, 20 bp, Homo sapiens
gagcactctggggtgggagg

SEQ ID NO: 5416805 - DNA, 17 bp, Homo sapiens
gagcactgaaccacatt

SEQ ID NO: 5416806 - DNA, 16 bp, Homo sapiens
gagcactgccaggagg

SEQ ID NO: 5416807 - DNA, 18 bp, Homo sapiens
gagcactgccaggaggga

SEQ ID NO: 5416808 - DNA, 18 bp, Homo sapiens
gagcactgcctctatgcc

SEQ ID NO: 5416809 - DNA, 23 bp, Homo sapiens
gagcactgcctctatgccctgca

SEQ ID NO: 5416810 - DNA, 13 bp, Homo sapiens
gagcactggaggc

SEQ ID NO: 5416811 - DNA, 21 bp, Homo sapiens
gagcactggaggcctctgcaa

SEQ ID NO: 5416812 - DNA, 13 bp, Homo sapiens
gagcactgggttg

SEQ ID NO: 5416813 - DNA, 23 bp, Homo sapiens
gagcactggtgtgaactcaccct

SEQ ID NO: 5416814 - DNA, 14 bp, Homo sapiens
gagcactgtgttca

SEQ ID NO: 5416815 - DNA, 20 bp, Homo sapiens
gagcactgtgttcacacttt

SEQ ID NO: 5416816 - DNA, 22 bp, Homo sapiens
gagcactgttttctagtgtatc

SEQ ID NO: 5416817 - DNA, 16 bp, Homo sapiens
gagcacttaagagaat

SEQ ID NO: 5416818 - DNA, 18 bp, Homo sapiens
gagcacttaagagaatat

SEQ ID NO: 5416819 - DNA, 19 bp, Homo sapiens
gagcagaaagccagggtcc

SEQ ID NO: 5416820 - DNA, 13 bp, Homo sapiens
gagcagaaataaa

SEQ ID NO: 5416821 - DNA, 22 bp, Homo sapiens
gagcagaaatttatctttcaaa

SEQ ID NO: 5416822 - DNA, 12 bp, Homo sapiens
gagcagaagcag

SEQ ID NO: 5416823 - DNA, 16 bp, Homo sapiens
gagcagaaggaaggat

SEQ ID NO: 5416824 - DNA, 23 bp, Homo sapiens
gagcagaaggaaggatgccactt

SEQ ID NO: 5416825 - DNA, 17 bp, Homo sapiens
gagcagaaggggagatg

SEQ ID NO: 5416826 - DNA, 18 bp, Homo sapiens
gagcagaaggggagatgg

SEQ ID NO: 5416827 - DNA, 17 bp, Homo sapiens
gagcagaagtggagctg

SEQ ID NO: 5416828 - DNA, 13 bp, Homo sapiens
gagcagaataaat

SEQ ID NO: 5416829 - DNA, 16 bp, Homo sapiens
gagcagaataaatgtt

SEQ ID NO: 5416830 - DNA, 18 bp, Homo sapiens
gagcagaatactggtctc

SEQ ID NO: 5416831 - DNA, 22 bp, Homo sapiens
gagcagaatgttgtacttgaaa

SEQ ID NO: 5416832 - DNA, 17 bp, Homo sapiens
gagcagacagagaaatg

SEQ ID NO: 5416833 - DNA, 14 bp, Homo sapiens
gagcagacaggaca

SEQ ID NO: 5416834 - DNA, 13 bp, Homo sapiens
gagcagacagggc

SEQ ID NO: 5416835 - DNA, 22 bp, Homo sapiens
gagcagaccaccccgcctgccc

SEQ ID NO: 5416836 - DNA, 14 bp, Homo sapiens
gagcagactacagc

SEQ ID NO: 5416837 - DNA, 23 bp, Homo sapiens
gagcagactggcggggggcccat

SEQ ID NO: 5416838 - DNA, 19 bp, Homo sapiens
gagcagactggtgagcaga

SEQ ID NO: 5416839 - DNA, 20 bp, Homo sapiens
gagcagactggtgagcagac

SEQ ID NO: 5416840 - DNA, 17 bp, Homo sapiens
gagcagagaacctgctc

SEQ ID NO: 5416841 - DNA, 12 bp, Homo sapiens
gagcagagaagg

SEQ ID NO: 5416842 - DNA, 12 bp, Homo sapiens
gagcagagacca

SEQ ID NO: 5416843 - DNA, 20 bp, Homo sapiens
gagcagagacggcagcccca

SEQ ID NO: 5416844 - DNA, 24 bp, Homo sapiens
gagcagagacggcagccccatcct

SEQ ID NO: 5416845 - DNA, 17 bp, Homo sapiens
gagcagagagagccaga

SEQ ID NO: 5416846 - DNA, 16 bp, Homo sapiens
gagcagagagcaaagg

SEQ ID NO: 5416847 - DNA, 21 bp, Homo sapiens
gagcagagagcttagcctgga

SEQ ID NO: 5416848 - DNA, 20 bp, Homo sapiens
gagcagagatcacaccactg

SEQ ID NO: 5416849 - DNA, 18 bp, Homo sapiens
gagcagagcgatggagca

SEQ ID NO: 5416850 - DNA, 16 bp, Homo sapiens
gagcagagcgcagccc

SEQ ID NO: 5416851 - DNA, 17 bp, Homo sapiens
gagcagagcgcagcccc

SEQ ID NO: 5416852 - DNA, 23 bp, Homo sapiens
gagcagagctgatggagaaggaa

SEQ ID NO: 5416853 - DNA, 13 bp, Homo sapiens
gagcagaggaggg

SEQ ID NO: 5416854 - DNA, 19 bp, Homo sapiens
gagcagaggaggggaaagt

SEQ ID NO: 5416855 - DNA, 17 bp, Homo sapiens
gagcagagggaggaaga

SEQ ID NO: 5416856 - DNA, 14 bp, Homo sapiens
gagcagaggtctcc

SEQ ID NO: 5416857 - DNA, 20 bp, Homo sapiens
gagcagagtctgggcctctg

SEQ ID NO: 5416858 - DNA, 20 bp, Homo sapiens
gagcagagtcttgctacctc

SEQ ID NO: 5416859 - DNA, 22 bp, Homo sapiens
gagcagatcgtgccgtggagct

SEQ ID NO: 5416860 - DNA, 23 bp, Homo sapiens
gagcagatcgtgccgtggagctt

SEQ ID NO: 5416861 - DNA, 22 bp, Homo sapiens
gagcagatgaggtgaaaaggcc

SEQ ID NO: 5416862 - DNA, 21 bp, Homo sapiens
gagcagatgcagagagccatt

SEQ ID NO: 5416863 - DNA, 15 bp, Homo sapiens
gagcagatggacagc

SEQ ID NO: 5416864 - DNA, 21 bp, Homo sapiens
gagcagcaagaagcagcctgt

SEQ ID NO: 5416865 - DNA, 19 bp, Homo sapiens
gagcagcaagttcatacaa

SEQ ID NO: 5416866 - DNA, 20 bp, Homo sapiens
gagcagcacctcctcagcct

SEQ ID NO: 5416867 - DNA, 22 bp, Homo sapiens
gagcagcacctcctcagcctga

SEQ ID NO: 5416868 - DNA, 14 bp, Homo sapiens
gagcagcagcacca

SEQ ID NO: 5416869 - DNA, 22 bp, Homo sapiens
gagcagcagcaccaaccacagc

SEQ ID NO: 5416870 - DNA, 11 bp, Homo sapiens
gagcagcagcc

SEQ ID NO: 5416871 - DNA, 12 bp, Homo sapiens
gagcagcagcca

SEQ ID NO: 5416872 - DNA, 22 bp, Homo sapiens
gagcagcagcgctcggcccgga

SEQ ID NO: 5416873 - DNA, 15 bp, Homo sapiens
gagcagcagcttggg

SEQ ID NO: 5416874 - DNA, 13 bp, Homo sapiens
gagcagcaggaag

SEQ ID NO: 5416875 - DNA, 18 bp, Homo sapiens
gagcagcaggagggggga

SEQ ID NO: 5416876 - DNA, 21 bp, Homo sapiens
gagcagcaggaggggggaggg

SEQ ID NO: 5416877 - DNA, 12 bp, Homo sapiens
gagcagcaggcc

SEQ ID NO: 5416878 - DNA, 13 bp, Homo sapiens
gagcagcaggcct

SEQ ID NO: 5416879 - DNA, 15 bp, Homo sapiens
gagcagcaggtgctg

SEQ ID NO: 5416880 - DNA, 11 bp, Homo sapiens
gagcagccaga

SEQ ID NO: 5416881 - DNA, 18 bp, Homo sapiens
gagcagccagcacccacc

SEQ ID NO: 5416882 - DNA, 12 bp, Homo sapiens
gagcagccagga

SEQ ID NO: 5416883 - DNA, 15 bp, Homo sapiens
gagcagcccacctgc

SEQ ID NO: 5416884 - DNA, 20 bp, Homo sapiens
gagcagcccacctgctgccc

SEQ ID NO: 5416885 - DNA, 13 bp, Homo sapiens
gagcagcccagca

SEQ ID NO: 5416886 - DNA, 16 bp, Homo sapiens
gagcagcccagggcct

SEQ ID NO: 5416887 - DNA, 15 bp, Homo sapiens
gagcagcccctccca

SEQ ID NO: 5416888 - DNA, 16 bp, Homo sapiens
gagcagccctggagtc

SEQ ID NO: 5416889 - DNA, 15 bp, Homo sapiens
gagcagccctggccc

SEQ ID NO: 5416890 - DNA, 16 bp, Homo sapiens
gagcagccctggcccc

SEQ ID NO: 5416891 - DNA, 12 bp, Homo sapiens
gagcccccacca

SEQ ID NO: 5416892 - DNA, 17 bp, Homo sapiens
gagcccccagcagaggc

SEQ ID NO: 5416893 - DNA, 18 bp, Homo sapiens
gagcccccagcagaggca

SEQ ID NO: 5416894 - DNA, 14 bp, Homo sapiens
gagcccccagccct

SEQ ID NO: 5416895 - DNA, 17 bp, Homo sapiens
gagcccccagccctggg

SEQ ID NO: 5416896 - DNA, 13 bp, Homo sapiens
gagcccccagcct

SEQ ID NO: 5416897 - DNA, 12 bp, Homo sapiens
gagccccccact

SEQ ID NO: 5416898 - DNA, 18 bp, Homo sapiens
gagccccccatgcccctc

SEQ ID NO: 5416899 - DNA, 13 bp, Homo sapiens
gagcccccccctt

SEQ ID NO: 5416900 - DNA, 21 bp, Homo sapiens
gagcccccgccccgccccaca

SEQ ID NO: 5416901 - DNA, 22 bp, Homo sapiens
gagcccccgccccgccccacat

SEQ ID NO: 5416902 - DNA, 13 bp, Homo sapiens
gagccccctgcac

SEQ ID NO: 5416903 - DNA, 19 bp, Homo sapiens
gagccccctgcacccaccc

SEQ ID NO: 5416904 - DNA, 12 bp, Homo sapiens
gagccccctgga

SEQ ID NO: 5416905 - DNA, 14 bp, Homo sapiens
gagccccctggcgg

SEQ ID NO: 5416906 - DNA, 17 bp, Homo sapiens
gagccccctgtgcccac

SEQ ID NO: 5416907 - DNA, 22 bp, Homo sapiens
gagccccctgtgcccacccagg

SEQ ID NO: 5416908 - DNA, 22 bp, Homo sapiens
gagcccccttcctgtccccagg

SEQ ID NO: 5416909 - DNA, 13 bp, Homo sapiens
gagccccgaggcc

SEQ ID NO: 5416910 - DNA, 17 bp, Homo sapiens
gagccccgaggccttct

SEQ ID NO: 5416911 - DNA, 13 bp, Homo sapiens
gagccccgcagac

SEQ ID NO: 5416912 - DNA, 18 bp, Homo sapiens
gagccccgccccaccccg

SEQ ID NO: 5416913 - DNA, 22 bp, Homo sapiens
gagccccgccccaccccgtcct

SEQ ID NO: 5416914 - DNA, 14 bp, Homo sapiens
gagccccgccctct

SEQ ID NO: 5416915 - DNA, 16 bp, Homo sapiens
gagccccgccctcttc

SEQ ID NO: 5416916 - DNA, 19 bp, Homo sapiens
gagccccgccctcttcctg

SEQ ID NO: 5416917 - DNA, 12 bp, Homo sapiens
gagccccggagc

SEQ ID NO: 5416918 - DNA, 22 bp, Homo sapiens
gagcccctactgtgggcaaagt

SEQ ID NO: 5416919 - DNA, 18 bp, Homo sapiens
gagcccctatcctgcacc

SEQ ID NO: 5416920 - DNA, 21 bp, Homo sapiens
gagcccctcagacagccccct

SEQ ID NO: 5416921 - DNA, 19 bp, Homo sapiens
gagcccctcatgccacagt

SEQ ID NO: 5416922 - DNA, 13 bp, Homo sapiens
gagcccctcccca

SEQ ID NO: 5416923 - DNA, 18 bp, Homo sapiens
gagcccctccccagccag

SEQ ID NO: 5416924 - DNA, 20 bp, Homo sapiens
gagcccctccctcctgtgtt

SEQ ID NO: 5416925 - DNA, 15 bp, Homo sapiens
gagcccctcctccag

SEQ ID NO: 5416926 - DNA, 21 bp, Homo sapiens
gagcccctcctccagcccctg

SEQ ID NO: 5416927 - DNA, 19 bp, Homo sapiens
gagcccctcctctgagcag

SEQ ID NO: 5416928 - DNA, 20 bp, Homo sapiens
gagcccctccttctcccctg

SEQ ID NO: 5416929 - DNA, 13 bp, Homo sapiens
gagcccctgaaag

SEQ ID NO: 5416930 - DNA, 22 bp, Homo sapiens
gagcccctgaaagcctcacgta

SEQ ID NO: 5416931 - DNA, 14 bp, Homo sapiens
gagcccctggacat

SEQ ID NO: 5416932 - DNA, 16 bp, Homo sapiens
gagcccctggacatgc

SEQ ID NO: 5416933 - DNA, 23 bp, Homo sapiens
gagcccctggacatgcctgtcct

SEQ ID NO: 5416934 - DNA, 19 bp, Homo sapiens
gagcccctgggtgggtggt

SEQ ID NO: 5416935 - DNA, 14 bp, Homo sapiens
gagcccctggtcct

SEQ ID NO: 5416936 - DNA, 14 bp, Homo sapiens
gagcccctggtctt

SEQ ID NO: 5416937 - DNA, 21 bp, Homo sapiens
gagcccctgtctagagaggga

SEQ ID NO: 5416938 - DNA, 22 bp, Homo sapiens
gagcccctgtctagagagggag

SEQ ID NO: 5416939 - DNA, 20 bp, Homo sapiens
gagcccctgtttctcctcca

SEQ ID NO: 5416940 - DNA, 23 bp, Homo sapiens
gagccccttcatccgcctgtggg

SEQ ID NO: 5416941 - DNA, 21 bp, Homo sapiens
gagccccttccttgctctgca

SEQ ID NO: 5416942 - DNA, 18 bp, Homo sapiens
gagccccttcgggagcag

SEQ ID NO: 5416943 - DNA, 20 bp, Homo sapiens
gagccccttctgctcagctc

SEQ ID NO: 5416944 - DNA, 21 bp, Homo sapiens
gagcccctttgcctgtcaagt

SEQ ID NO: 5416945 - DNA, 22 bp, Homo sapiens
gagcccgaggaggtgtctcagg

SEQ ID NO: 5416946 - DNA, 20 bp, Homo sapiens
gagcccgagggcctgacagg

SEQ ID NO: 5416947 - DNA, 16 bp, Homo sapiens
gagcccgcccacctgg

SEQ ID NO: 5416948 - DNA, 21 bp, Homo sapiens
gagcccgccgtctgcaggggc

SEQ ID NO: 5416949 - DNA, 21 bp, Homo sapiens
gagcccgcttcaagctctctg

SEQ ID NO: 5416950 - DNA, 21 bp, Homo sapiens
gagcccggccccacctccctg

SEQ ID NO: 5416951 - DNA, 20 bp, Homo sapiens
gagcccggccctcccccagc

SEQ ID NO: 5416952 - DNA, 23 bp, Homo sapiens
gagcccggccctcccccagctcc

SEQ ID NO: 5416953 - DNA, 14 bp, Homo sapiens
gagcccgggagctg

SEQ ID NO: 5416954 - DNA, 17 bp, Homo sapiens
gagcccgggctgcctgg

SEQ ID NO: 5416955 - DNA, 21 bp, Homo sapiens
gagcccggggcagagctcaga

SEQ ID NO: 5416956 - DNA, 22 bp, Homo sapiens
gagcccggggcagagctcagag

SEQ ID NO: 5416957 - DNA, 19 bp, Homo sapiens
gagccctaaccccttccag

SEQ ID NO: 5416958 - DNA, 16 bp, Homo sapiens
gagccctacttccagg

SEQ ID NO: 5416959 - DNA, 23 bp, Homo sapiens
gagccctagccctgctccaactc

SEQ ID NO: 5416960 - DNA, 13 bp, Homo sapiens
gagccctcagaac

SEQ ID NO: 5416961 - DNA, 11 bp, Homo sapiens
gagccctcagg

SEQ ID NO: 5416962 - DNA, 14 bp, Homo sapiens
gagccctcaggctc

SEQ ID NO: 5416963 - DNA, 22 bp, Homo sapiens
gagccctcaggctccccagaac

SEQ ID NO: 5416964 - DNA, 22 bp, Homo sapiens
gagccctcagtcggggcaggcc

SEQ ID NO: 5416965 - DNA, 15 bp, Homo sapiens
gagccctccaggcct

SEQ ID NO: 5416966 - DNA, 20 bp, Homo sapiens
gagccctccaggcctgcagg

SEQ ID NO: 5416967 - DNA, 13 bp, Homo sapiens
gagccctccccca

SEQ ID NO: 5416968 - DNA, 14 bp, Homo sapiens
gagccctcccccaa

SEQ ID NO: 5416969 - DNA, 12 bp, Homo sapiens
gagccctcccta

SEQ ID NO: 5416970 - DNA, 15 bp, Homo sapiens
gagccctccctcttc

SEQ ID NO: 5416971 - DNA, 19 bp, Homo sapiens
gagccctcctgagggccgg

SEQ ID NO: 5416972 - DNA, 15 bp, Homo sapiens
gagccctcctggaat

SEQ ID NO: 5416973 - DNA, 23 bp, Homo sapiens
gagccctcctggaatggagctgt

SEQ ID NO: 5416974 - DNA, 23 bp, Homo sapiens
gagccctccttcttgccctgagc

SEQ ID NO: 5416975 - DNA, 16 bp, Homo sapiens
gagccctctcactcca

SEQ ID NO: 5416976 - DNA, 19 bp, Homo sapiens
gagccctctcactccagcc

SEQ ID NO: 5416977 - DNA, 22 bp, Homo sapiens
gagccctctcactccagccaaa

SEQ ID NO: 5416978 - DNA, 11 bp, Homo sapiens
gagccctctcc

SEQ ID NO: 5416979 - DNA, 14 bp, Homo sapiens
gagccctctcctcc

SEQ ID NO: 5416980 - DNA, 15 bp, Homo sapiens
gagccctctcctccc

SEQ ID NO: 5416981 - DNA, 14 bp, Homo sapiens
gagccctcttgccc

SEQ ID NO: 5416982 - DNA, 19 bp, Homo sapiens
gagccctcttgcccagcac

SEQ ID NO: 5416983 - DNA, 18 bp, Homo sapiens
gagccctgaccttggctg

SEQ ID NO: 5416984 - DNA, 22 bp, Homo sapiens
gagccctgaccttggctgactg

SEQ ID NO: 5416985 - DNA, 16 bp, Homo sapiens
gagccctgactcctgg

SEQ ID NO: 5416986 - DNA, 10 bp, Homo sapiens
gagccctgag

SEQ ID NO: 5416987 - DNA, 16 bp, Homo sapiens
gagccctgagcccaga

SEQ ID NO: 5416988 - DNA, 12 bp, Homo sapiens
gagccctgagct

SEQ ID NO: 5416989 - DNA, 16 bp, Homo sapiens
gagccctgagctcagg

SEQ ID NO: 5416990 - DNA, 19 bp, Homo sapiens
gagccctgaggacctctca

SEQ ID NO: 5416991 - DNA, 22 bp, Homo sapiens
gagccctgaggacctctcagca

SEQ ID NO: 5416992 - DNA, 17 bp, Homo sapiens
gagccctgaggcctaga

SEQ ID NO: 5416993 - DNA, 19 bp, Homo sapiens
gagccctgaggggctgggc

SEQ ID NO: 5416994 - DNA, 21 bp, Homo sapiens
gagccctgaggggctgggctg

SEQ ID NO: 5416995 - DNA, 23 bp, Homo sapiens
gagccctgcagccaaacagagcc

SEQ ID NO: 5416996 - DNA, 12 bp, Homo sapiens
gagccctgcagt

SEQ ID NO: 5416997 - DNA, 23 bp, Homo sapiens
gagccctgctatgaaaggaataa

SEQ ID NO: 5416998 - DNA, 14 bp, Homo sapiens
gagccctgctccct

SEQ ID NO: 5416999 - DNA, 22 bp, Homo sapiens
gagccctgctcttctctcccca

SEQ ID NO: 5417000 - DNA, 18 bp, Homo sapiens
gagccctggaccccaggc

SEQ ID NO: 5417001 - DNA, 22 bp, Homo sapiens
gagccctggaccttgggcctag

SEQ ID NO: 5417002 - DNA, 12 bp, Homo sapiens
gagccctggaga

SEQ ID NO: 5417003 - DNA, 14 bp, Homo sapiens
gagccctggagagc

SEQ ID NO: 5417004 - DNA, 19 bp, Homo sapiens
gagccctggagagccccat

SEQ ID NO: 5417005 - DNA, 16 bp, Homo sapiens
gagccctggccagccc

SEQ ID NO: 5417006 - DNA, 17 bp, Homo sapiens
gagccctggctctgccc

SEQ ID NO: 5417007 - DNA, 19 bp, Homo sapiens
gagccctggctctgcccct

SEQ ID NO: 5417008 - DNA, 22 bp, Homo sapiens
gagccctggctctgcccctcag

SEQ ID NO: 5417009 - DNA, 18 bp, Homo sapiens
gagccctggctgggttca

SEQ ID NO: 5417010 - DNA, 16 bp, Homo sapiens
gagccctgggaggctc

SEQ ID NO: 5417011 - DNA, 20 bp, Homo sapiens
gagccctgggaggctctgga

SEQ ID NO: 5417012 - DNA, 13 bp, Homo sapiens
gagccctgggcgg

SEQ ID NO: 5417013 - DNA, 11 bp, Homo sapiens
gagccctgggg

SEQ ID NO: 5417014 - DNA, 22 bp, Homo sapiens
gagccctggggactgttccaaa

SEQ ID NO: 5417015 - DNA, 23 bp, Homo sapiens
gagccctggggactgttccaaag

SEQ ID NO: 5417016 - DNA, 13 bp, Homo sapiens
gagccctggggtt

SEQ ID NO: 5417017 - DNA, 22 bp, Homo sapiens
gagccctggggtttccacacag

SEQ ID NO: 5417018 - DNA, 12 bp, Homo sapiens
gagccctggtcc

SEQ ID NO: 5417019 - DNA, 16 bp, Homo sapiens
gagccctgtacccacc

SEQ ID NO: 5417020 - DNA, 12 bp, Homo sapiens
gagccctgtccc

SEQ ID NO: 5417021 - DNA, 14 bp, Homo sapiens
gagccctgtccctg

SEQ ID NO: 5417022 - DNA, 22 bp, Homo sapiens
gagccctgtcctgcctaaggct

SEQ ID NO: 5417023 - DNA, 18 bp, Homo sapiens
gagccctgtggatgagcc

SEQ ID NO: 5417024 - DNA, 22 bp, Homo sapiens
gagccctgtggatgagccctca

SEQ ID NO: 5417025 - DNA, 19 bp, Homo sapiens
gagccctgtggccgccacc

SEQ ID NO: 5417026 - DNA, 21 bp, Homo sapiens
gagccctgtggccgccacctg

SEQ ID NO: 5417027 - DNA, 19 bp, Homo sapiens
gagccctgttggcagctct

SEQ ID NO: 5417028 - DNA, 12 bp, Homo sapiens
gagcccttagcc

SEQ ID NO: 5417029 - DNA, 14 bp, Homo sapiens
gagcccttagcctt

SEQ ID NO: 5417030 - DNA, 18 bp, Homo sapiens
gagcccttatctgtgctc

SEQ ID NO: 5417031 - DNA, 12 bp, Homo sapiens
gagcccttcact

SEQ ID NO: 5417032 - DNA, 19 bp, Homo sapiens
gagcccttccaggagtggg

SEQ ID NO: 5417033 - DNA, 18 bp, Homo sapiens
gagcccttcccagggcac

SEQ ID NO: 5417034 - DNA, 23 bp, Homo sapiens
gagcccttcccagggcacccagg

SEQ ID NO: 5417035 - DNA, 12 bp, Homo sapiens
gagcccttctct

SEQ ID NO: 5417036 - DNA, 13 bp, Homo sapiens
gagcccttctctt

SEQ ID NO: 5417037 - DNA, 22 bp, Homo sapiens
gagcccttgactgtacagagac

SEQ ID NO: 5417038 - DNA, 20 bp, Homo sapiens
gagcccttgcacaggccact

SEQ ID NO: 5417039 - DNA, 15 bp, Homo sapiens
gagcccttggcccct

SEQ ID NO: 5417040 - DNA, 15 bp, Homo sapiens
gagccgaagcccagg

SEQ ID NO: 5417041 - DNA, 19 bp, Homo sapiens
gagccgagatcacgccact

SEQ ID NO: 5417042 - DNA, 20 bp, Homo sapiens
gagccgagatcgcgccactg

SEQ ID NO: 5417043 - DNA, 22 bp, Homo sapiens
gagccgagattgcgccactgca

SEQ ID NO: 5417044 - DNA, 20 bp, Homo sapiens
gagccgaggggagagaggga

SEQ ID NO: 5417045 - DNA, 23 bp, Homo sapiens
gagccgaggggagagagggactc

SEQ ID NO: 5417046 - DNA, 12 bp, Homo sapiens
gagccgcagagc

SEQ ID NO: 5417047 - DNA, 15 bp, Homo sapiens
gagccgcagagcctg

SEQ ID NO: 5417048 - DNA, 13 bp, Homo sapiens
gagccgcagaggc

SEQ ID NO: 5417049 - DNA, 16 bp, Homo sapiens
gagccgcccaaggcct

SEQ ID NO: 5417050 - DNA, 21 bp, Homo sapiens
gagccgcggggaagctggctt

SEQ ID NO: 5417051 - DNA, 14 bp, Homo sapiens
gagccgctggcaga

SEQ ID NO: 5417052 - DNA, 18 bp, Homo sapiens
gagccgcttccccagctc

SEQ ID NO: 5417053 - DNA, 23 bp, Homo sapiens
gagccggcacctacatccccagg

SEQ ID NO: 5417054 - DNA, 14 bp, Homo sapiens
gagccggcatcctt

SEQ ID NO: 5417055 - DNA, 19 bp, Homo sapiens
gagccggcatccttgcctg

SEQ ID NO: 5417056 - DNA, 22 bp, Homo sapiens
gagccggcatccttgcctgtct

SEQ ID NO: 5417057 - DNA, 16 bp, Homo sapiens
gagccggcggcctctc

SEQ ID NO: 5417058 - DNA, 17 bp, Homo sapiens
gagccggcggcctctcg

SEQ ID NO: 5417059 - DNA, 18 bp, Homo sapiens
gagccgggaccctcaggt

SEQ ID NO: 5417060 - DNA, 20 bp, Homo sapiens
gagccgggcaaactggccgc

SEQ ID NO: 5417061 - DNA, 21 bp, Homo sapiens
gagccgggcacattgagctgt

SEQ ID NO: 5417062 - DNA, 13 bp, Homo sapiens
gagccgggcctgg

SEQ ID NO: 5417063 - DNA, 18 bp, Homo sapiens
gagccggggagtttcttt

SEQ ID NO: 5417064 - DNA, 19 bp, Homo sapiens
gagccggggagtttctttc

SEQ ID NO: 5417065 - DNA, 23 bp, Homo sapiens
gagccgggtccggcctctccctg

SEQ ID NO: 5417066 - DNA, 21 bp, Homo sapiens
gagccgggtctgcctcttctg

SEQ ID NO: 5417067 - DNA, 19 bp, Homo sapiens
gagccgggtgtccccaaca

SEQ ID NO: 5417068 - DNA, 22 bp, Homo sapiens
gagctcagcacagcctcacccc

SEQ ID NO: 5417069 - DNA, 12 bp, Homo sapiens
gagctcagctca

SEQ ID NO: 5417070 - DNA, 21 bp, Homo sapiens
gagctcaggaaccgaggcagg

SEQ ID NO: 5417071 - DNA, 18 bp, Homo sapiens
gagctcaggagaaggcct

SEQ ID NO: 5417072 - DNA, 13 bp, Homo sapiens
gagctcaggagag

SEQ ID NO: 5417073 - DNA, 23 bp, Homo sapiens
gagctcaggagtttgagaccagg

SEQ ID NO: 5417074 - DNA, 21 bp, Homo sapiens
gagctcaggctgagcccagcc

SEQ ID NO: 5417075 - DNA, 12 bp, Homo sapiens
gagctcagggca

SEQ ID NO: 5417076 - DNA, 14 bp, Homo sapiens
gagctcagggctgg

SEQ ID NO: 5417077 - DNA, 16 bp, Homo sapiens
gagctcaggtttctgg

SEQ ID NO: 5417078 - DNA, 19 bp, Homo sapiens
gagctcaggtttctggaca

SEQ ID NO: 5417079 - DNA, 22 bp, Homo sapiens
gagctcagttgagaaacagttc

SEQ ID NO: 5417080 - DNA, 18 bp, Homo sapiens
gagctcatcccccctgct

SEQ ID NO: 5417081 - DNA, 21 bp, Homo sapiens
gagctcatccctctcacccag

SEQ ID NO: 5417082 - DNA, 14 bp, Homo sapiens
gagctcattctgtc

SEQ ID NO: 5417083 - DNA, 17 bp, Homo sapiens
gagctcatttggggacc

SEQ ID NO: 5417084 - DNA, 20 bp, Homo sapiens
gagctccacagaagacacgt

SEQ ID NO: 5417085 - DNA, 22 bp, Homo sapiens
gagctccaccctcccctcttct

SEQ ID NO: 5417086 - DNA, 11 bp, Homo sapiens
gagctccacct

SEQ ID NO: 5417087 - DNA, 12 bp, Homo sapiens
gagctccactct

SEQ ID NO: 5417088 - DNA, 16 bp, Homo sapiens
gagctccactctgctt

SEQ ID NO: 5417089 - DNA, 18 bp, Homo sapiens
gagctccactctgcttct

SEQ ID NO: 5417090 - DNA, 21 bp, Homo sapiens
gagctccactctgcttctctg

SEQ ID NO: 5417091 - DNA, 13 bp, Homo sapiens
gagctccactgcc

SEQ ID NO: 5417092 - DNA, 22 bp, Homo sapiens
gagctccactgccatgtaccca

SEQ ID NO: 5417093 - DNA, 15 bp, Homo sapiens
gagctccagaccccc

SEQ ID NO: 5417094 - DNA, 22 bp, Homo sapiens
gagctccagacccccagcaacc

SEQ ID NO: 5417095 - DNA, 22 bp, Homo sapiens
gagctccagagcaacgaccagg

SEQ ID NO: 5417096 - DNA, 13 bp, Homo sapiens
gagctccagccac

SEQ ID NO: 5417097 - DNA, 14 bp, Homo sapiens
gagctccagccacc

SEQ ID NO: 5417098 - DNA, 19 bp, Homo sapiens
gagctccaggatggggagg

SEQ ID NO: 5417099 - DNA, 14 bp, Homo sapiens
gagctccagtgtcc

SEQ ID NO: 5417100 - DNA, 19 bp, Homo sapiens
gagctccagtgtcctgagc

SEQ ID NO: 5417101 - DNA, 23 bp, Homo sapiens
gagctccagtgtcctgagctcag

SEQ ID NO: 5417102 - DNA, 19 bp, Homo sapiens
gagctccatgttgcttcac

SEQ ID NO: 5417103 - DNA, 16 bp, Homo sapiens
gagctcccacctccct

SEQ ID NO: 5417104 - DNA, 21 bp, Homo sapiens
gagctcccacctcccttccca

SEQ ID NO: 5417105 - DNA, 13 bp, Homo sapiens
gagctcccaggag

SEQ ID NO: 5417106 - DNA, 16 bp, Homo sapiens
gagctccccagatctc

SEQ ID NO: 5417107 - DNA, 17 bp, Homo sapiens
gagctccccagatctcc

SEQ ID NO: 5417108 - DNA, 20 bp, Homo sapiens
gagctccccagatctcccac

SEQ ID NO: 5417109 - DNA, 19 bp, Homo sapiens
gagctcccctacggaccag

SEQ ID NO: 5417110 - DNA, 20 bp, Homo sapiens
gagctcccctacggaccagg

SEQ ID NO: 5417111 - DNA, 17 bp, Homo sapiens
gagctcccctccacagc

SEQ ID NO: 5417112 - DNA, 19 bp, Homo sapiens
gagctcccctccccaactg

SEQ ID NO: 5417113 - DNA, 21 bp, Homo sapiens
gagctcccctggagccagcag

SEQ ID NO: 5417114 - DNA, 16 bp, Homo sapiens
gagctcccctgtttgc

SEQ ID NO: 5417115 - DNA, 19 bp, Homo sapiens
gagctccctttttgaattg

SEQ ID NO: 5417116 - DNA, 22 bp, Homo sapiens
gagctccctttttgaattgtgt

SEQ ID NO: 5417117 - DNA, 14 bp, Homo sapiens
gagctcctaagctg

SEQ ID NO: 5417118 - DNA, 12 bp, Homo sapiens
gagctcctccct

SEQ ID NO: 5417119 - DNA, 14 bp, Homo sapiens
gagctcctccctcc

SEQ ID NO: 5417120 - DNA, 15 bp, Homo sapiens
gagctcctccctcca

SEQ ID NO: 5417121 - DNA, 16 bp, Homo sapiens
gagctcctccctccag

SEQ ID NO: 5417122 - DNA, 22 bp, Homo sapiens
gagctcctccctccagctgcga

SEQ ID NO: 5417123 - DNA, 14 bp, Homo sapiens
gagctcctccgcag

SEQ ID NO: 5417124 - DNA, 13 bp, Homo sapiens
gagctcctcttcc

SEQ ID NO: 5417125 - DNA, 19 bp, Homo sapiens
gagctcctgatcagaggca

SEQ ID NO: 5417126 - DNA, 14 bp, Homo sapiens
gagctcctggaagc

SEQ ID NO: 5417127 - DNA, 12 bp, Homo sapiens
gagctcctggcc

SEQ ID NO: 5417128 - DNA, 13 bp, Homo sapiens
gagctcctgggaa

SEQ ID NO: 5417129 - DNA, 13 bp, Homo sapiens
gagctcctgggga

SEQ ID NO: 5417130 - DNA, 18 bp, Homo sapiens
gagctcctggggagctcc

SEQ ID NO: 5417131 - DNA, 22 bp, Homo sapiens
gagctcctgtccctacccactc

SEQ ID NO: 5417132 - DNA, 20 bp, Homo sapiens
gagctcgcagcccccgcgcc

SEQ ID NO: 5417133 - DNA, 14 bp, Homo sapiens
gagctcgcccctcc

SEQ ID NO: 5417134 - DNA, 15 bp, Homo sapiens
gagctcggggacagg

SEQ ID NO: 5417135 - DNA, 16 bp, Homo sapiens
gagctcggggacaggt

SEQ ID NO: 5417136 - DNA, 12 bp, Homo sapiens
gagctcggggct

SEQ ID NO: 5417137 - DNA, 19 bp, Homo sapiens
gagctcggggggctctgcc

SEQ ID NO: 5417138 - DNA, 15 bp, Homo sapiens
gagctcggggtccac

SEQ ID NO: 5417139 - DNA, 19 bp, Homo sapiens
gagctcgtgtatcctgggg

SEQ ID NO: 5417140 - DNA, 23 bp, Homo sapiens
gagctcgtgtatcctggggctcc

SEQ ID NO: 5417141 - DNA, 16 bp, Homo sapiens
gagctctacaggcctg

SEQ ID NO: 5417142 - DNA, 20 bp, Homo sapiens
gagctctacaggcctgcagc

SEQ ID NO: 5417143 - DNA, 14 bp, Homo sapiens
gagctctacccagg

SEQ ID NO: 5417144 - DNA, 21 bp, Homo sapiens
gagctctacccagggcctgca

SEQ ID NO: 5417145 - DNA, 23 bp, Homo sapiens
gagctctacccagggcctgcagg

SEQ ID NO: 5417146 - DNA, 19 bp, Homo sapiens
gagctctatgggcagatct

SEQ ID NO: 5417147 - DNA, 23 bp, Homo sapiens
gagctctcaaatccctctccaac

SEQ ID NO: 5417148 - DNA, 12 bp, Homo sapiens
gagctctccagg

SEQ ID NO: 5417149 - DNA, 14 bp, Homo sapiens
gagctctccaggcc

SEQ ID NO: 5417150 - DNA, 18 bp, Homo sapiens
gagctctccaggccaggt

SEQ ID NO: 5417151 - DNA, 15 bp, Homo sapiens
gagctctcccccttg

SEQ ID NO: 5417152 - DNA, 17 bp, Homo sapiens
gagctctctcagaccct

SEQ ID NO: 5417153 - DNA, 14 bp, Homo sapiens
gagctctctctaca

SEQ ID NO: 5417154 - DNA, 17 bp, Homo sapiens
gagctctctgctgagca

SEQ ID NO: 5417155 - DNA, 16 bp, Homo sapiens
gagctctgaaatcttc

SEQ ID NO: 5417156 - DNA, 23 bp, Homo sapiens
gagctctgacccttgggcctggg

SEQ ID NO: 5417157 - DNA, 17 bp, Homo sapiens
gagctctgacctgcccc

SEQ ID NO: 5417158 - DNA, 19 bp, Homo sapiens
gagctctgagaggccctgg

SEQ ID NO: 5417159 - DNA, 20 bp, Homo sapiens
gagctctgagaggccctgga

SEQ ID NO: 5417160 - DNA, 21 bp, Homo sapiens
gagctctgagaggccctggat

SEQ ID NO: 5417161 - DNA, 22 bp, Homo sapiens
gagctctgagaggccctggatc

SEQ ID NO: 5417162 - DNA, 20 bp, Homo sapiens
gagctctgcctcaactccac

SEQ ID NO: 5417163 - DNA, 18 bp, Homo sapiens
gagctctgcgccaggcag

SEQ ID NO: 5417164 - DNA, 20 bp, Homo sapiens
gagctctgcgccaggcagag

SEQ ID NO: 5417165 - DNA, 20 bp, Homo sapiens
gagctctggagcaagccctg

SEQ ID NO: 5417166 - DNA, 16 bp, Homo sapiens
gagctctggccccgct

SEQ ID NO: 5417167 - DNA, 19 bp, Homo sapiens
gagctctggccccgctagc

SEQ ID NO: 5417168 - DNA, 15 bp, Homo sapiens
gagctctggggacag

SEQ ID NO: 5417169 - DNA, 21 bp, Homo sapiens
gagctctggggacagcttcct

SEQ ID NO: 5417170 - DNA, 23 bp, Homo sapiens
gagctctggggacagcttcctca

SEQ ID NO: 5417171 - DNA, 13 bp, Homo sapiens
gagctctgggggg

SEQ ID NO: 5417172 - DNA, 17 bp, Homo sapiens
gagctctggtgctttag

SEQ ID NO: 5417173 - DNA, 22 bp, Homo sapiens
gagctctgtaacttacacctgg

SEQ ID NO: 5417174 - DNA, 15 bp, Homo sapiens
gagctctgtagcctg

SEQ ID NO: 5417175 - DNA, 18 bp, Homo sapiens
gagctctgtagcctggtc

SEQ ID NO: 5417176 - DNA, 14 bp, Homo sapiens
gagctcttagtttt

SEQ ID NO: 5417177 - DNA, 17 bp, Homo sapiens
gagctcttagtttttaa

SEQ ID NO: 5417178 - DNA, 22 bp, Homo sapiens
gagctcttcaagctgtcccctc

SEQ ID NO: 5417179 - DNA, 22 bp, Homo sapiens
gagctcttcccttattcctaat

SEQ ID NO: 5417180 - DNA, 21 bp, Homo sapiens
gagctcttcctatccctctcc

SEQ ID NO: 5417181 - DNA, 18 bp, Homo sapiens
gagctcttgacagaaagc

SEQ ID NO: 5417182 - DNA, 19 bp, Homo sapiens
gagctcttgacagaaagca

SEQ ID NO: 5417183 - DNA, 20 bp, Homo sapiens
gagctcttgacagaaagcag

SEQ ID NO: 5417184 - DNA, 14 bp, Homo sapiens
gagctcttgctatc

SEQ ID NO: 5417185 - DNA, 12 bp, Homo sapiens
gagctcttggaa

SEQ ID NO: 5417186 - DNA, 15 bp, Homo sapiens
gagctcttggcagga

SEQ ID NO: 5417187 - DNA, 15 bp, Homo sapiens
gagctcttggccttt

SEQ ID NO: 5417188 - DNA, 16 bp, Homo sapiens
gagctcttggcctttg

SEQ ID NO: 5417189 - DNA, 15 bp, Homo sapiens
gagctcttgggtcag

SEQ ID NO: 5417190 - DNA, 19 bp, Homo sapiens
gagctcttgggtcagagaa

SEQ ID NO: 5417191 - DNA, 21 bp, Homo sapiens
gagctcttgggtcagagaaaa

SEQ ID NO: 5417192 - DNA, 21 bp, Homo sapiens
gagctcttgtgttcagaagaa

SEQ ID NO: 5417193 - DNA, 19 bp, Homo sapiens
gagctctttgtctcaccag

SEQ ID NO: 5417194 - DNA, 23 bp, Homo sapiens
gagctctttgtctcaccagctca

SEQ ID NO: 5417195 - DNA, 22 bp, Homo sapiens
gagctgaaaaggatcgaggcat

SEQ ID NO: 5417196 - DNA, 23 bp, Homo sapiens
gagctgaaaaggatcgaggcatg

SEQ ID NO: 5417197 - DNA, 19 bp, Homo sapiens
gagctgaacccattttgag

SEQ ID NO: 5417198 - DNA, 23 bp, Homo sapiens
gagctgaacccattttgagtgac

SEQ ID NO: 5417199 - DNA, 13 bp, Homo sapiens
gagctgaagacct

SEQ ID NO: 5417200 - DNA, 13 bp, Homo sapiens
gagctgacaaaat

SEQ ID NO: 5417201 - DNA, 18 bp, Homo sapiens
gagctgacacaaacctgc

SEQ ID NO: 5417202 - DNA, 17 bp, Homo sapiens
gagctgacagagccaga

SEQ ID NO: 5417203 - DNA, 20 bp, Homo sapiens
gagctgacagagccagaggc

SEQ ID NO: 5417204 - DNA, 14 bp, Homo sapiens
gagctgaccagccg

SEQ ID NO: 5417205 - DNA, 15 bp, Homo sapiens
gagctgacgggaggc

SEQ ID NO: 5417206 - DNA, 22 bp, Homo sapiens
gagctgacgggaggccccagct

SEQ ID NO: 5417207 - DNA, 17 bp, Homo sapiens
gagctgagaagaggagg

SEQ ID NO: 5417208 - DNA, 18 bp, Homo sapiens
gagctgagaagaggagga

SEQ ID NO: 5417209 - DNA, 22 bp, Homo sapiens
gagctgagaagaggaggaggtg

SEQ ID NO: 5417210 - DNA, 22 bp, Homo sapiens
gagctgagatcacaccactgca

SEQ ID NO: 5417211 - DNA, 18 bp, Homo sapiens
gagctgagcagcctctgg

SEQ ID NO: 5417212 - DNA, 22 bp, Homo sapiens
gagctgagccaggctagctgga

SEQ ID NO: 5417213 - DNA, 23 bp, Homo sapiens
gagctgagccaggctagctggag

SEQ ID NO: 5417214 - DNA, 17 bp, Homo sapiens
gagctgagctacctggg

SEQ ID NO: 5417215 - DNA, 19 bp, Homo sapiens
gagctgaggatttcctgga

SEQ ID NO: 5417216 - DNA, 17 bp, Homo sapiens
gagctgaggcaattcta

SEQ ID NO: 5417217 - DNA, 17 bp, Homo sapiens
gagctgaggccacactc

SEQ ID NO: 5417218 - DNA, 16 bp, Homo sapiens
gagctgaggcctccct

SEQ ID NO: 5417219 - DNA, 12 bp, Homo sapiens
gagctgagggag

SEQ ID NO: 5417220 - DNA, 23 bp, Homo sapiens
gagctgagggagggagccatgga

SEQ ID NO: 5417221 - DNA, 15 bp, Homo sapiens
gagctgaggggcagg

SEQ ID NO: 5417222 - DNA, 19 bp, Homo sapiens
gagctgaggggcagggccg

SEQ ID NO: 5417223 - DNA, 15 bp, Homo sapiens
gagctgagtggccag

SEQ ID NO: 5417224 - DNA, 16 bp, Homo sapiens
gagctgatataaattc

SEQ ID NO: 5417225 - DNA, 16 bp, Homo sapiens
gagctgatccagagca

SEQ ID NO: 5417226 - DNA, 19 bp, Homo sapiens
gagctgatggagaaggaag

SEQ ID NO: 5417227 - DNA, 14 bp, Homo sapiens
gagctgatggcagc

SEQ ID NO: 5417228 - DNA, 15 bp, Homo sapiens
gagctgatggcagct

SEQ ID NO: 5417229 - DNA, 18 bp, Homo sapiens
gagctgattgcagaaagg

SEQ ID NO: 5417230 - DNA, 17 bp, Homo sapiens
gagctgatttccaggcc

SEQ ID NO: 5417231 - DNA, 13 bp, Homo sapiens
gagctgcacagca

SEQ ID NO: 5417232 - DNA, 22 bp, Homo sapiens
gagctgcacagggtttggccca

SEQ ID NO: 5417233 - DNA, 23 bp, Homo sapiens
gagctgcacagggtttggcccaa

SEQ ID NO: 5417234 - DNA, 17 bp, Homo sapiens
gagctgcactgatcacc

SEQ ID NO: 5417235 - DNA, 14 bp, Homo sapiens
gagctgcagagcag

SEQ ID NO: 5417236 - DNA, 15 bp, Homo sapiens
gagctgcagccagtc

SEQ ID NO: 5417237 - DNA, 14 bp, Homo sapiens
gagctgcagccccc

SEQ ID NO: 5417238 - DNA, 17 bp, Homo sapiens
gagctgcagcctggctg

SEQ ID NO: 5417239 - DNA, 19 bp, Homo sapiens
gagctgcaggggcatggga

SEQ ID NO: 5417240 - DNA, 17 bp, Homo sapiens
gagctgcagttcttgtg

SEQ ID NO: 5417241 - DNA, 17 bp, Homo sapiens
gagctgcagttgtgaaa

SEQ ID NO: 5417242 - DNA, 20 bp, Homo sapiens
gagctgcatggacgcctggc

SEQ ID NO: 5417243 - DNA, 12 bp, Homo sapiens
gagctgccactg

SEQ ID NO: 5417244 - DNA, 13 bp, Homo sapiens
gagctgccactgg

SEQ ID NO: 5417245 - DNA, 19 bp, Homo sapiens
gaggaagggactggtccag

SEQ ID NO: 5417246 - DNA, 16 bp, Homo sapiens
gaggaagggaggcctg

SEQ ID NO: 5417247 - DNA, 19 bp, Homo sapiens
gaggaagggaggcctgagg

SEQ ID NO: 5417248 - DNA, 20 bp, Homo sapiens
gaggaagggaggcctgaggg

SEQ ID NO: 5417249 - DNA, 21 bp, Homo sapiens
gaggaagggaggcctgagggg

SEQ ID NO: 5417250 - DNA, 14 bp, Homo sapiens
gaggaagggatggg

SEQ ID NO: 5417251 - DNA, 12 bp, Homo sapiens
gaggaagggcca

SEQ ID NO: 5417252 - DNA, 17 bp, Homo sapiens
gaggaagggccaggaga

SEQ ID NO: 5417253 - DNA, 21 bp, Homo sapiens
gaggaagggccaggagagaga

SEQ ID NO: 5417254 - DNA, 15 bp, Homo sapiens
gaggaagggcccccg

SEQ ID NO: 5417255 - DNA, 14 bp, Homo sapiens
gaggaagggctggg

SEQ ID NO: 5417256 - DNA, 15 bp, Homo sapiens
gaggaagggctgggc

SEQ ID NO: 5417257 - DNA, 21 bp, Homo sapiens
gaggaaggggggccgccgctg

SEQ ID NO: 5417258 - DNA, 19 bp, Homo sapiens
gaggaaggtcccatggcct

SEQ ID NO: 5417259 - DNA, 19 bp, Homo sapiens
gaggaaggtgactgtgtgt

SEQ ID NO: 5417260 - DNA, 19 bp, Homo sapiens
gaggaagtatgagtgctga

SEQ ID NO: 5417261 - DNA, 18 bp, Homo sapiens
gaggaagtcttatcttct

SEQ ID NO: 5417262 - DNA, 17 bp, Homo sapiens
gaggaagtgagccagca

SEQ ID NO: 5417263 - DNA, 18 bp, Homo sapiens
gaggaagtggctgtccct

SEQ ID NO: 5417264 - DNA, 21 bp, Homo sapiens
gaggaagtgtggaaaaatagc

SEQ ID NO: 5417265 - DNA, 13 bp, Homo sapiens
gaggaagttcaga

SEQ ID NO: 5417266 - DNA, 17 bp, Homo sapiens
gaggaagttcagatctt

SEQ ID NO: 5417267 - DNA, 17 bp, Homo sapiens
gaggaagttggctgagc

SEQ ID NO: 5417268 - DNA, 19 bp, Homo sapiens
gaggaataaagctgtgagc

SEQ ID NO: 5417269 - DNA, 23 bp, Homo sapiens
gaggaataaagcttctctctgag

SEQ ID NO: 5417270 - DNA, 17 bp, Homo sapiens
gaggaataaatgccttt

SEQ ID NO: 5417271 - DNA, 21 bp, Homo sapiens
gaggaataagctcccagggcc

SEQ ID NO: 5417272 - DNA, 21 bp, Homo sapiens
gaggaataattatttatttaa

SEQ ID NO: 5417273 - DNA, 18 bp, Homo sapiens
gaggaatagtgcttgctg

SEQ ID NO: 5417274 - DNA, 19 bp, Homo sapiens
gaggaatagttgagcccca

SEQ ID NO: 5417275 - DNA, 13 bp, Homo sapiens
gaggaatatcaat

SEQ ID NO: 5417276 - DNA, 23 bp, Homo sapiens
gaggaatatgacggaagaacata

SEQ ID NO: 5417277 - DNA, 18 bp, Homo sapiens
gaggaatatgactgtttt

SEQ ID NO: 5417278 - DNA, 19 bp, Homo sapiens
gaggaatatgactgttttt

SEQ ID NO: 5417279 - DNA, 14 bp, Homo sapiens
gaggaatcacccca

SEQ ID NO: 5417280 - DNA, 19 bp, Homo sapiens
gaggaatcactcttgtgga

SEQ ID NO: 5417281 - DNA, 20 bp, Homo sapiens
gaggaatcatgtcaggcctg

SEQ ID NO: 5417282 - DNA, 13 bp, Homo sapiens
gaggaatcctgga

SEQ ID NO: 5417283 - DNA, 16 bp, Homo sapiens
gaggaatcctggcagc

SEQ ID NO: 5417284 - DNA, 19 bp, Homo sapiens
gaggaatctgtgggtctgg

SEQ ID NO: 5417285 - DNA, 15 bp, Homo sapiens
gaggaatctgtttct

SEQ ID NO: 5417286 - DNA, 19 bp, Homo sapiens
gaggaatctgtttctctgc

SEQ ID NO: 5417287 - DNA, 15 bp, Homo sapiens
gaggaatcttttact

SEQ ID NO: 5417288 - DNA, 21 bp, Homo sapiens
gaggaatgctcccccatcctc

SEQ ID NO: 5417289 - DNA, 20 bp, Homo sapiens
gaggaatgctctgtgccaga

SEQ ID NO: 5417290 - DNA, 18 bp, Homo sapiens
gaggaatgctggactgga

SEQ ID NO: 5417291 - DNA, 14 bp, Homo sapiens
gaggaatggacaga

SEQ ID NO: 5417292 - DNA, 16 bp, Homo sapiens
gaggaatgtagggcct

SEQ ID NO: 5417293 - DNA, 13 bp, Homo sapiens
gaggaatgtatat

SEQ ID NO: 5417294 - DNA, 14 bp, Homo sapiens
gaggaatgtatatg

SEQ ID NO: 5417295 - DNA, 16 bp, Homo sapiens
gaggaattgggacctg

SEQ ID NO: 5417296 - DNA, 13 bp, Homo sapiens
gaggaatttctga

SEQ ID NO: 5417297 - DNA, 16 bp, Homo sapiens
gaggaatttgaagctc

SEQ ID NO: 5417298 - DNA, 15 bp, Homo sapiens
gaggaattttctaaa

SEQ ID NO: 5417299 - DNA, 22 bp, Homo sapiens
gaggaattttctttgtgtagct

SEQ ID NO: 5417300 - DNA, 17 bp, Homo sapiens
gaggacaaaacttcttg

SEQ ID NO: 5417301 - DNA, 23 bp, Homo sapiens
gaggacaaaacttcttgtcagac

SEQ ID NO: 5417302 - DNA, 15 bp, Homo sapiens
gaggacaaaaggaat

SEQ ID NO: 5417303 - DNA, 14 bp, Homo sapiens
gaggacaaaataaa

SEQ ID NO: 5417304 - DNA, 15 bp, Homo sapiens
gaggacaaaataaag

SEQ ID NO: 5417305 - DNA, 16 bp, Homo sapiens
gaggacaaaataaagt

SEQ ID NO: 5417306 - DNA, 21 bp, Homo sapiens
gaggacaaaataaagtgtgtg

SEQ ID NO: 5417307 - DNA, 23 bp, Homo sapiens
gaggacaaaataaagtgtgtgtg

SEQ ID NO: 5417308 - DNA, 20 bp, Homo sapiens
gaggacaaagagaataaaga

SEQ ID NO: 5417309 - DNA, 13 bp, Homo sapiens
gaggacaaggaaa

SEQ ID NO: 5417310 - DNA, 19 bp, Homo sapiens
gaggacaattcatgaactt

SEQ ID NO: 5417311 - DNA, 15 bp, Homo sapiens
gaggacacagcacaa

SEQ ID NO: 5417312 - DNA, 13 bp, Homo sapiens
gaggacacaggca

SEQ ID NO: 5417313 - DNA, 11 bp, Homo sapiens
gaggacacatg

SEQ ID NO: 5417314 - DNA, 13 bp, Homo sapiens
gaggacacatgtc

SEQ ID NO: 5417315 - DNA, 15 bp, Homo sapiens
gaggacacctaatgt

SEQ ID NO: 5417316 - DNA, 20 bp, Homo sapiens
gaggacacctgtactggaga

SEQ ID NO: 5417317 - DNA, 18 bp, Homo sapiens
gaggacacgtggcctgca

SEQ ID NO: 5417318 - DNA, 14 bp, Homo sapiens
gaggacagagccgg

SEQ ID NO: 5417319 - DNA, 14 bp, Homo sapiens
gaggacagagctgg

SEQ ID NO: 5417320 - DNA, 16 bp, Homo sapiens
gaggacagagggcaca

SEQ ID NO: 5417321 - DNA, 19 bp, Homo sapiens
gaggacagagtgccctggg

SEQ ID NO: 5417322 - DNA, 17 bp, Homo sapiens
gaggacagatgcctcct

SEQ ID NO: 5417323 - DNA, 21 bp, Homo sapiens
gaggacagcctgcctctgcca

SEQ ID NO: 5417324 - DNA, 22 bp, Homo sapiens
gaggacagcctgcctctgccac

SEQ ID NO: 5417325 - DNA, 14 bp, Homo sapiens
gaggacagctctgg

SEQ ID NO: 5417326 - DNA, 13 bp, Homo sapiens
gaggacaggcagg

SEQ ID NO: 5417327 - DNA, 15 bp, Homo sapiens
gaggacaggcaggcc

SEQ ID NO: 5417328 - DNA, 14 bp, Homo sapiens
gaggacaggcggga

SEQ ID NO: 5417329 - DNA, 20 bp, Homo sapiens
gaggacaggcgggaggaggt

SEQ ID NO: 5417330 - DNA, 18 bp, Homo sapiens
gaggacaggctctagaga

SEQ ID NO: 5417331 - DNA, 14 bp, Homo sapiens
gaggacagggaggg

SEQ ID NO: 5417332 - DNA, 19 bp, Homo sapiens
gaggacagggcccccacag

SEQ ID NO: 5417333 - DNA, 21 bp, Homo sapiens
gaggacaggtggaggcgagcc

SEQ ID NO: 5417334 - DNA, 13 bp, Homo sapiens
gaggacagtgctg

SEQ ID NO: 5417335 - DNA, 12 bp, Homo sapiens
gaggacagtggg

SEQ ID NO: 5417336 - DNA, 16 bp, Homo sapiens
gaggacatggcttctg

SEQ ID NO: 5417337 - DNA, 21 bp, Homo sapiens
gaggacatgtttttgttttct

SEQ ID NO: 5417338 - DNA, 23 bp, Homo sapiens
gaggacatttgtgggcaagcaga

SEQ ID NO: 5417339 - DNA, 15 bp, Homo sapiens
gaggaccaatgcttg

SEQ ID NO: 5417340 - DNA, 16 bp, Homo sapiens
gaggaccaatgcttgc

SEQ ID NO: 5417341 - DNA, 22 bp, Homo sapiens
gaggaccacactttgagaacct

SEQ ID NO: 5417342 - DNA, 14 bp, Homo sapiens
gaggaccaccagca

SEQ ID NO: 5417343 - DNA, 13 bp, Homo sapiens
gaggaccactcct

SEQ ID NO: 5417344 - DNA, 13 bp, Homo sapiens
gaggaccagagga

SEQ ID NO: 5417345 - DNA, 18 bp, Homo sapiens
gaggaccagaggagcaga

SEQ ID NO: 5417346 - DNA, 14 bp, Homo sapiens
gaggaccagcacac

SEQ ID NO: 5417347 - DNA, 21 bp, Homo sapiens
gaggaccaggaaacagcctca

SEQ ID NO: 5417348 - DNA, 13 bp, Homo sapiens
gaggaccagggcc

SEQ ID NO: 5417349 - DNA, 15 bp, Homo sapiens
gaggaccagggccct

SEQ ID NO: 5417350 - DNA, 15 bp, Homo sapiens
gaggaccagggtgga

SEQ ID NO: 5417351 - DNA, 18 bp, Homo sapiens
gaggaccagtcaggatga

SEQ ID NO: 5417352 - DNA, 22 bp, Homo sapiens
gaggaccagtcaggatgaggcc

SEQ ID NO: 5417353 - DNA, 15 bp, Homo sapiens
gaggaccatgaaaca

SEQ ID NO: 5417354 - DNA, 11 bp, Homo sapiens
gaggacccagg

SEQ ID NO: 5417355 - DNA, 15 bp, Homo sapiens
gaggacccagggctc

SEQ ID NO: 5417356 - DNA, 20 bp, Homo sapiens
gaggacccatgaaacagcag

SEQ ID NO: 5417357 - DNA, 22 bp, Homo sapiens
gaggacccatgaaacagcagct

SEQ ID NO: 5417358 - DNA, 16 bp, Homo sapiens
gaggaccccagggtgg

SEQ ID NO: 5417359 - DNA, 18 bp, Homo sapiens
gaggaccccattctggga

SEQ ID NO: 5417360 - DNA, 19 bp, Homo sapiens
gaggaccccattctgggac

SEQ ID NO: 5417361 - DNA, 21 bp, Homo sapiens
gaggaccccattctgggactg

SEQ ID NO: 5417362 - DNA, 21 bp, Homo sapiens
gaggaccccgagggctgagga

SEQ ID NO: 5417363 - DNA, 11 bp, Homo sapiens
gaggacccctg

SEQ ID NO: 5417364 - DNA, 21 bp, Homo sapiens
gaggacccctgccctcggcca

SEQ ID NO: 5417365 - DNA, 20 bp, Homo sapiens
gaggacccctgccttcctct

SEQ ID NO: 5417366 - DNA, 22 bp, Homo sapiens
gaggacccctgccttcctctga

SEQ ID NO: 5417367 - DNA, 23 bp, Homo sapiens
gaggacccctgccttcctctgag

SEQ ID NO: 5417368 - DNA, 14 bp, Homo sapiens
gaggaccccttaat

SEQ ID NO: 5417369 - DNA, 19 bp, Homo sapiens
gaggacccgccggatgaca

SEQ ID NO: 5417370 - DNA, 23 bp, Homo sapiens
gaggacccgggaccacagctgct

SEQ ID NO: 5417371 - DNA, 17 bp, Homo sapiens
gaggaccctcagcccca

SEQ ID NO: 5417372 - DNA, 15 bp, Homo sapiens
gaggaccctcccagg

SEQ ID NO: 5417373 - DNA, 16 bp, Homo sapiens
gaggaccctcccaggt

SEQ ID NO: 5417374 - DNA, 11 bp, Homo sapiens
gaggaccctgg

SEQ ID NO: 5417375 - DNA, 20 bp, Homo sapiens
gaggaccctggaaatggact

SEQ ID NO: 5417376 - DNA, 16 bp, Homo sapiens
gaggacctccatgccc

SEQ ID NO: 5417377 - DNA, 13 bp, Homo sapiens
gaggacctctggg

SEQ ID NO: 5417378 - DNA, 16 bp, Homo sapiens
gaggacctgaccctac

SEQ ID NO: 5417379 - DNA, 16 bp, Homo sapiens
gaggacctgagcctgc

SEQ ID NO: 5417380 - DNA, 17 bp, Homo sapiens
gaggacctgagcctgcc

SEQ ID NO: 5417381 - DNA, 21 bp, Homo sapiens
gaggacctgagcctgccgagc

SEQ ID NO: 5417382 - DNA, 13 bp, Homo sapiens
gaggacctgcccg

SEQ ID NO: 5417383 - DNA, 14 bp, Homo sapiens
gaggacctgcggcc

SEQ ID NO: 5417384 - DNA, 16 bp, Homo sapiens
gaggacctgtatttaa

SEQ ID NO: 5417385 - DNA, 22 bp, Homo sapiens
gaggacctgtatttaagcaaat

SEQ ID NO: 5417386 - DNA, 15 bp, Homo sapiens
gaggaccttatctgt

SEQ ID NO: 5417387 - DNA, 17 bp, Homo sapiens
gaggacgagacccccat

SEQ ID NO: 5417388 - DNA, 15 bp, Homo sapiens
gaggacgctctctgg

SEQ ID NO: 5417389 - DNA, 16 bp, Homo sapiens
gaggacggagttcaga

SEQ ID NO: 5417390 - DNA, 21 bp, Homo sapiens
gaggacggagttcagagggtg

SEQ ID NO: 5417391 - DNA, 15 bp, Homo sapiens
gaggacggggagata

SEQ ID NO: 5417392 - DNA, 18 bp, Homo sapiens
gaggacgtgggcggcaga

SEQ ID NO: 5417393 - DNA, 18 bp, Homo sapiens
gaggactagaacctggag

SEQ ID NO: 5417394 - DNA, 18 bp, Homo sapiens
gaggactccaggcagcag

SEQ ID NO: 5417395 - DNA, 13 bp, Homo sapiens
gaggactccaggg

SEQ ID NO: 5417396 - DNA, 14 bp, Homo sapiens
gaggactccagggg

SEQ ID NO: 5417397 - DNA, 15 bp, Homo sapiens
gaggactccaggggc

SEQ ID NO: 5417398 - DNA, 13 bp, Homo sapiens
gaggactccctcc

SEQ ID NO: 5417399 - DNA, 21 bp, Homo sapiens
gaggactccctccatgtggcc

SEQ ID NO: 5417400 - DNA, 21 bp, Homo sapiens
gaggactcgcttgtaaatacc

SEQ ID NO: 5417401 - DNA, 22 bp, Homo sapiens
gaggactcgcttgtaaatacca

SEQ ID NO: 5417402 - DNA, 15 bp, Homo sapiens
gaggactcggccact

SEQ ID NO: 5417403 - DNA, 21 bp, Homo sapiens
gaggactcggccactgtgtct

SEQ ID NO: 5417404 - DNA, 21 bp, Homo sapiens
gaggactctagaagctcaggt

SEQ ID NO: 5417405 - DNA, 12 bp, Homo sapiens
gaggactctcct

SEQ ID NO: 5417406 - DNA, 13 bp, Homo sapiens
gaggactctcctc

SEQ ID NO: 5417407 - DNA, 21 bp, Homo sapiens
gaggactctttccgactgccc

SEQ ID NO: 5417408 - DNA, 15 bp, Homo sapiens
gaggactgaagctgg

SEQ ID NO: 5417409 - DNA, 13 bp, Homo sapiens
gaggactgagact

SEQ ID NO: 5417410 - DNA, 17 bp, Homo sapiens
gaggactgagcccccac

SEQ ID NO: 5417411 - DNA, 13 bp, Homo sapiens
gaggactggactg

SEQ ID NO: 5417412 - DNA, 22 bp, Homo sapiens
gaggactggttctgaggccaga

SEQ ID NO: 5417413 - DNA, 13 bp, Homo sapiens
gaggactgtattt

SEQ ID NO: 5417414 - DNA, 18 bp, Homo sapiens
gaggactgtatttgtgac

SEQ ID NO: 5417415 - DNA, 15 bp, Homo sapiens
gaggactgtcctccc

SEQ ID NO: 5417416 - DNA, 15 bp, Homo sapiens
gaggactgtgacaga

SEQ ID NO: 5417417 - DNA, 23 bp, Homo sapiens
gaggactgttgacatccaagctt

SEQ ID NO: 5417418 - DNA, 17 bp, Homo sapiens
gaggacttggagggtct

SEQ ID NO: 5417419 - DNA, 23 bp, Homo sapiens
gaggacttggagggtctgggggc

SEQ ID NO: 5417420 - DNA, 21 bp, Homo sapiens
gaggacttggttgatgtttaa

SEQ ID NO: 5417421 - DNA, 18 bp, Homo sapiens
gaggacttgtgtctctgt

SEQ ID NO: 5417422 - DNA, 23 bp, Homo sapiens
gaggactttgattgcacattgtt

SEQ ID NO: 5417423 - DNA, 17 bp, Homo sapiens
gaggactttgcccagga

SEQ ID NO: 5417424 - DNA, 17 bp, Homo sapiens
gaggcagggccctgggg

SEQ ID NO: 5417425 - DNA, 15 bp, Homo sapiens
gaggcagggccttgc

SEQ ID NO: 5417426 - DNA, 23 bp, Homo sapiens
gaggcagggccttgcccagagat

SEQ ID NO: 5417427 - DNA, 15 bp, Homo sapiens
gaggcagggctctcc

SEQ ID NO: 5417428 - DNA, 16 bp, Homo sapiens
gaggcagggctctccc

SEQ ID NO: 5417429 - DNA, 17 bp, Homo sapiens
gaggcagggctctcccg

SEQ ID NO: 5417430 - DNA, 22 bp, Homo sapiens
gaggcagggctggaatgggaga

SEQ ID NO: 5417431 - DNA, 11 bp, Homo sapiens
gaggcagggga

SEQ ID NO: 5417432 - DNA, 16 bp, Homo sapiens
gaggcaggggctgggc

SEQ ID NO: 5417433 - DNA, 19 bp, Homo sapiens
gaggcaggggctgggcaga

SEQ ID NO: 5417434 - DNA, 20 bp, Homo sapiens
gaggcaggggctgggcagag

SEQ ID NO: 5417435 - DNA, 17 bp, Homo sapiens
gaggcaggggcttcctg

SEQ ID NO: 5417436 - DNA, 20 bp, Homo sapiens
gaggcaggggcttcctggtg

SEQ ID NO: 5417437 - DNA, 13 bp, Homo sapiens
gaggcagggtctc

SEQ ID NO: 5417438 - DNA, 19 bp, Homo sapiens
gaggcagggtctcactctg

SEQ ID NO: 5417439 - DNA, 23 bp, Homo sapiens
gaggcagggtctcactctgttga

SEQ ID NO: 5417440 - DNA, 17 bp, Homo sapiens
gaggcaggtcgggctgc

SEQ ID NO: 5417441 - DNA, 22 bp, Homo sapiens
gaggcaggtcgggctgccagcc

SEQ ID NO: 5417442 - DNA, 18 bp, Homo sapiens
gaggcaggtctgggccag

SEQ ID NO: 5417443 - DNA, 19 bp, Homo sapiens
gaggcaggtggatcacctg

SEQ ID NO: 5417444 - DNA, 22 bp, Homo sapiens
gaggcaggtggatcacgaggtc

SEQ ID NO: 5417445 - DNA, 19 bp, Homo sapiens
gaggcaggtgggtggtaag

SEQ ID NO: 5417446 - DNA, 14 bp, Homo sapiens
gaggcagtccatct

SEQ ID NO: 5417447 - DNA, 22 bp, Homo sapiens
gaggcagtgagactgcaggtgg

SEQ ID NO: 5417448 - DNA, 20 bp, Homo sapiens
gaggcagtgctgatccggct

SEQ ID NO: 5417449 - DNA, 21 bp, Homo sapiens
gaggcagtgctgatccggctg

SEQ ID NO: 5417450 - DNA, 16 bp, Homo sapiens
gaggcagtggcagcaa

SEQ ID NO: 5417451 - DNA, 16 bp, Homo sapiens
gaggcagtggcttgga

SEQ ID NO: 5417452 - DNA, 21 bp, Homo sapiens
gaggcagtggcttggagcaga

SEQ ID NO: 5417453 - DNA, 19 bp, Homo sapiens
gaggcagtgggtcccactt

SEQ ID NO: 5417454 - DNA, 21 bp, Homo sapiens
gaggcagttcgaccagccagg

SEQ ID NO: 5417455 - DNA, 15 bp, Homo sapiens
gaggcagttgcccag

SEQ ID NO: 5417456 - DNA, 18 bp, Homo sapiens
gaggcagttgcccagcct

SEQ ID NO: 5417457 - DNA, 20 bp, Homo sapiens
gaggcagttgcccagcctct

SEQ ID NO: 5417458 - DNA, 19 bp, Homo sapiens
gaggcagtttttgttcctt

SEQ ID NO: 5417459 - DNA, 15 bp, Homo sapiens
gaggcatagagggag

SEQ ID NO: 5417460 - DNA, 22 bp, Homo sapiens
gaggcatcatggaaagactggg

SEQ ID NO: 5417461 - DNA, 23 bp, Homo sapiens
gaggcatcccaagacctcatctg

SEQ ID NO: 5417462 - DNA, 14 bp, Homo sapiens
gaggcatcctctga

SEQ ID NO: 5417463 - DNA, 15 bp, Homo sapiens
gaggcatcctctgac

SEQ ID NO: 5417464 - DNA, 21 bp, Homo sapiens
gaggcatcctctgactccact

SEQ ID NO: 5417465 - DNA, 21 bp, Homo sapiens
gaggcatcctgcctgggtggg

SEQ ID NO: 5417466 - DNA, 14 bp, Homo sapiens
gaggcatcttttct

SEQ ID NO: 5417467 - DNA, 17 bp, Homo sapiens
gaggcatggcaattctg

SEQ ID NO: 5417468 - DNA, 23 bp, Homo sapiens
gaggcatggcaattctggaagct

SEQ ID NO: 5417469 - DNA, 14 bp, Homo sapiens
gaggcatggccctg

SEQ ID NO: 5417470 - DNA, 16 bp, Homo sapiens
gaggcatgggggccca

SEQ ID NO: 5417471 - DNA, 18 bp, Homo sapiens
gaggcatgggggcccaaa

SEQ ID NO: 5417472 - DNA, 13 bp, Homo sapiens
gaggcatggtgtg

SEQ ID NO: 5417473 - DNA, 22 bp, Homo sapiens
gaggcatgtgatgagaggaaat

SEQ ID NO: 5417474 - DNA, 15 bp, Homo sapiens
gaggcattcccagag

SEQ ID NO: 5417475 - DNA, 18 bp, Homo sapiens
gaggcattcggggaagct

SEQ ID NO: 5417476 - DNA, 16 bp, Homo sapiens
gaggcatttgagcagc

SEQ ID NO: 5417477 - DNA, 14 bp, Homo sapiens
gaggcatttgtctt

SEQ ID NO: 5417478 - DNA, 22 bp, Homo sapiens
gaggcatttgtcttagagagag

SEQ ID NO: 5417479 - DNA, 19 bp, Homo sapiens
gaggccaaacacccaagca

SEQ ID NO: 5417480 - DNA, 21 bp, Homo sapiens
gaggccaaacacccaagcaca

SEQ ID NO: 5417481 - DNA, 23 bp, Homo sapiens
gaggccaaacacccaagcacaaa

SEQ ID NO: 5417482 - DNA, 17 bp, Homo sapiens
gaggccaaacaggccct

SEQ ID NO: 5417483 - DNA, 18 bp, Homo sapiens
gaggccaaaggctggtgg

SEQ ID NO: 5417484 - DNA, 20 bp, Homo sapiens
gaggccaaatattgatctgt

SEQ ID NO: 5417485 - DNA, 18 bp, Homo sapiens
gaggccaagaatattgca

SEQ ID NO: 5417486 - DNA, 22 bp, Homo sapiens
gaggccaagaatattgcaaaat

SEQ ID NO: 5417487 - DNA, 21 bp, Homo sapiens
gaggccaagagtggccccacc

SEQ ID NO: 5417488 - DNA, 15 bp, Homo sapiens
gaggccaagatggct

SEQ ID NO: 5417489 - DNA, 12 bp, Homo sapiens
gaggccaaggca

SEQ ID NO: 5417490 - DNA, 15 bp, Homo sapiens
gaggccaaggcaggt

SEQ ID NO: 5417491 - DNA, 12 bp, Homo sapiens
gaggccaaggtg

SEQ ID NO: 5417492 - DNA, 17 bp, Homo sapiens
gaggccaaggtgggagg

SEQ ID NO: 5417493 - DNA, 15 bp, Homo sapiens
gaggccaagtgcagg

SEQ ID NO: 5417494 - DNA, 16 bp, Homo sapiens
gaggccaataaaaagt

SEQ ID NO: 5417495 - DNA, 19 bp, Homo sapiens
gaggccaataaaaagttca

SEQ ID NO: 5417496 - DNA, 19 bp, Homo sapiens
gaggccacactttctggga

SEQ ID NO: 5417497 - DNA, 23 bp, Homo sapiens
gaggccacatgagtcccagtggg

SEQ ID NO: 5417498 - DNA, 20 bp, Homo sapiens
gaggccacattgctggctgc

SEQ ID NO: 5417499 - DNA, 21 bp, Homo sapiens
gaggccacattgctggctgcc

SEQ ID NO: 5417500 - DNA, 22 bp, Homo sapiens
gaggccacattgctggctgccc

SEQ ID NO: 5417501 - DNA, 11 bp, Homo sapiens
gaggccaccca

SEQ ID NO: 5417502 - DNA, 13 bp, Homo sapiens
gaggccaccccaa

SEQ ID NO: 5417503 - DNA, 13 bp, Homo sapiens
gaggccacctcct

SEQ ID NO: 5417504 - DNA, 17 bp, Homo sapiens
gaggccacgtcccaccc

SEQ ID NO: 5417505 - DNA, 19 bp, Homo sapiens
gaggccacgtcccacccca

SEQ ID NO: 5417506 - DNA, 15 bp, Homo sapiens
gaggccactcagagg

SEQ ID NO: 5417507 - DNA, 21 bp, Homo sapiens
gaggccactcagaggccccca

SEQ ID NO: 5417508 - DNA, 16 bp, Homo sapiens
gaggccactgaagagg

SEQ ID NO: 5417509 - DNA, 18 bp, Homo sapiens
gaggccacttgcttgctg

SEQ ID NO: 5417510 - DNA, 15 bp, Homo sapiens
gaggccactttgaga

SEQ ID NO: 5417511 - DNA, 14 bp, Homo sapiens
gaggccagaaaggt

SEQ ID NO: 5417512 - DNA, 20 bp, Homo sapiens
gaggccagacacaggccgtg

SEQ ID NO: 5417513 - DNA, 18 bp, Homo sapiens
gaggccagagtctcccag

SEQ ID NO: 5417514 - DNA, 14 bp, Homo sapiens
gaggccagccccac

SEQ ID NO: 5417515 - DNA, 18 bp, Homo sapiens
gaggccagccccacccag

SEQ ID NO: 5417516 - DNA, 12 bp, Homo sapiens
gaggccagcctg

SEQ ID NO: 5417517 - DNA, 15 bp, Homo sapiens
gaggccagcctggcc

SEQ ID NO: 5417518 - DNA, 16 bp, Homo sapiens
gaggccagcctggcct

SEQ ID NO: 5417519 - DNA, 18 bp, Homo sapiens
gaggccagcctggcctcc

SEQ ID NO: 5417520 - DNA, 22 bp, Homo sapiens
gaggccagcctggcctcctgcc

SEQ ID NO: 5417521 - DNA, 10 bp, Homo sapiens
gaggccagct

SEQ ID NO: 5417522 - DNA, 19 bp, Homo sapiens
gaggccagctatctgcctg

SEQ ID NO: 5417523 - DNA, 20 bp, Homo sapiens
gaggccagctatctgcctga

SEQ ID NO: 5417524 - DNA, 19 bp, Homo sapiens
gaggccaggaatctgccat

SEQ ID NO: 5417525 - DNA, 12 bp, Homo sapiens
gaggccaggagt

SEQ ID NO: 5417526 - DNA, 13 bp, Homo sapiens
gaggccagggcag

SEQ ID NO: 5417527 - DNA, 20 bp, Homo sapiens
gaggccagggcagcaaggga

SEQ ID NO: 5417528 - DNA, 14 bp, Homo sapiens
gaggccagggccgc

SEQ ID NO: 5417529 - DNA, 17 bp, Homo sapiens
gaggccagggtggccag

SEQ ID NO: 5417530 - DNA, 14 bp, Homo sapiens
gaggccaggtgcag

SEQ ID NO: 5417531 - DNA, 13 bp, Homo sapiens
gaggccagtggcc

SEQ ID NO: 5417532 - DNA, 14 bp, Homo sapiens
gaggccagtgttgt

SEQ ID NO: 5417533 - DNA, 16 bp, Homo sapiens
gaggccatacttgtga

SEQ ID NO: 5417534 - DNA, 19 bp, Homo sapiens
gaggccatcagggccctgc

SEQ ID NO: 5417535 - DNA, 21 bp, Homo sapiens
gaggccatcagggccctgccc

SEQ ID NO: 5417536 - DNA, 17 bp, Homo sapiens
gaggccatccaagatgg

SEQ ID NO: 5417537 - DNA, 17 bp, Homo sapiens
gaggccatctcaggaga

SEQ ID NO: 5417538 - DNA, 14 bp, Homo sapiens
gaggccatctggag

SEQ ID NO: 5417539 - DNA, 18 bp, Homo sapiens
gaggccatctggagagcc

SEQ ID NO: 5417540 - DNA, 22 bp, Homo sapiens
gaggccatctggagagcccaga

SEQ ID NO: 5417541 - DNA, 23 bp, Homo sapiens
gaggccatgattcgcccaaagcc

SEQ ID NO: 5417542 - DNA, 20 bp, Homo sapiens
gaggccatggactctgtcct

SEQ ID NO: 5417543 - DNA, 14 bp, Homo sapiens
gaggccatgggcct

SEQ ID NO: 5417544 - DNA, 18 bp, Homo sapiens
gaggccatgggcctcctg

SEQ ID NO: 5417545 - DNA, 21 bp, Homo sapiens
gaggccatgggcctcctgtgt

SEQ ID NO: 5417546 - DNA, 23 bp, Homo sapiens
gaggccatgggcctcctgtgtgt

SEQ ID NO: 5417547 - DNA, 23 bp, Homo sapiens
gaggccatgggggcccctcggca

SEQ ID NO: 5417548 - DNA, 14 bp, Homo sapiens
gaggccatgtgcat

SEQ ID NO: 5417549 - DNA, 19 bp, Homo sapiens
gaggccattccctgtagga

SEQ ID NO: 5417550 - DNA, 19 bp, Homo sapiens
gaggccatttgctgccctg

SEQ ID NO: 5417551 - DNA, 21 bp, Homo sapiens
gaggccatttgctgccctggg

SEQ ID NO: 5417552 - DNA, 22 bp, Homo sapiens
gaggccatttgctgccctgggg

SEQ ID NO: 5417553 - DNA, 12 bp, Homo sapiens
gaggcccaagga

SEQ ID NO: 5417554 - DNA, 19 bp, Homo sapiens
gaggcccaatgaggtggct

SEQ ID NO: 5417555 - DNA, 21 bp, Homo sapiens
gaggcccaatgaggtggctca

SEQ ID NO: 5417556 - DNA, 23 bp, Homo sapiens
gaggcccactagagggcccatca

SEQ ID NO: 5417557 - DNA, 11 bp, Homo sapiens
gaggcccagag

SEQ ID NO: 5417558 - DNA, 14 bp, Homo sapiens
gaggcccagagagc

SEQ ID NO: 5417559 - DNA, 16 bp, Homo sapiens
gaggcccagagggcct

SEQ ID NO: 5417560 - DNA, 17 bp, Homo sapiens
gaggcccagcagagccg

SEQ ID NO: 5417561 - DNA, 11 bp, Homo sapiens
gaggcccagcc

SEQ ID NO: 5417562 - DNA, 16 bp, Homo sapiens
gaggcccagccctcag

SEQ ID NO: 5417563 - DNA, 16 bp, Homo sapiens
gaggcccagcctgtcc

SEQ ID NO: 5417564 - DNA, 16 bp, Homo sapiens
gaggcccagcgggcag

SEQ ID NO: 5417565 - DNA, 18 bp, Homo sapiens
gaggcccaggcaccacca

SEQ ID NO: 5417566 - DNA, 24 bp, Homo sapiens
gaggcccaggcaccaccaggagca

SEQ ID NO: 5417567 - DNA, 14 bp, Homo sapiens
gaggcccaggctgc

SEQ ID NO: 5417568 - DNA, 16 bp, Homo sapiens
gaggcccaggctgccg

SEQ ID NO: 5417569 - DNA, 17 bp, Homo sapiens
gaggcccaggctgccgt

SEQ ID NO: 5417570 - DNA, 14 bp, Homo sapiens
gaggcccagggagc

SEQ ID NO: 5417571 - DNA, 15 bp, Homo sapiens
gaggcccagggagca

SEQ ID NO: 5417572 - DNA, 13 bp, Homo sapiens
gaggcccagttca

SEQ ID NO: 5417573 - DNA, 13 bp, Homo sapiens
gaggcccatggcc

SEQ ID NO: 5417574 - DNA, 15 bp, Homo sapiens
gaggcccatggccac

SEQ ID NO: 5417575 - DNA, 19 bp, Homo sapiens
gaggccccaataccccatg

SEQ ID NO: 5417576 - DNA, 13 bp, Homo sapiens
gaggccccacctg

SEQ ID NO: 5417577 - DNA, 22 bp, Homo sapiens
gaggccccacctgaagggtgga

SEQ ID NO: 5417578 - DNA, 14 bp, Homo sapiens
gaggccccactggg

SEQ ID NO: 5417579 - DNA, 13 bp, Homo sapiens
gaggccccagcct

SEQ ID NO: 5417580 - DNA, 22 bp, Homo sapiens
gaggccccagcctccctgaagc

SEQ ID NO: 5417581 - DNA, 23 bp, Homo sapiens
gaggccccagcctccctgaagcc

SEQ ID NO: 5417582 - DNA, 16 bp, Homo sapiens
gaggccccaggcccta

SEQ ID NO: 5417583 - DNA, 12 bp, Homo sapiens
gaggccccaggg

SEQ ID NO: 5417584 - DNA, 16 bp, Homo sapiens
gaggcccccagcccag

SEQ ID NO: 5417585 - DNA, 17 bp, Homo sapiens
gaggcccccagcccagg

SEQ ID NO: 5417586 - DNA, 20 bp, Homo sapiens
gaggcccccagcccagggct

SEQ ID NO: 5417587 - DNA, 14 bp, Homo sapiens
gaggcccccagtgg

SEQ ID NO: 5417588 - DNA, 11 bp, Homo sapiens
gaggcccccct

SEQ ID NO: 5417589 - DNA, 16 bp, Homo sapiens
gaggcccccctctgcc

SEQ ID NO: 5417590 - DNA, 21 bp, Homo sapiens
gaggcccccctctgcctttga

SEQ ID NO: 5417591 - DNA, 22 bp, Homo sapiens
gaggcccccgcacgcaagcctc

SEQ ID NO: 5417592 - DNA, 17 bp, Homo sapiens
gaggccccgaggctcga

SEQ ID NO: 5417593 - DNA, 13 bp, Homo sapiens
gaggcccctaggt

SEQ ID NO: 5417594 - DNA, 20 bp, Homo sapiens
gaggcccctaggtgcccagg

SEQ ID NO: 5417595 - DNA, 21 bp, Homo sapiens
gaggcccctaggtgcccaggg

SEQ ID NO: 5417596 - DNA, 24 bp, Homo sapiens
gaggcccctatgtagtccgtgctg

SEQ ID NO: 5417597 - DNA, 14 bp, Homo sapiens
gaggcccctcccag

SEQ ID NO: 5417598 - DNA, 21 bp, Homo sapiens
gaggcccctgaggcagcccag

SEQ ID NO: 5417599 - DNA, 13 bp, Homo sapiens
gaggcccctggac

SEQ ID NO: 5417600 - DNA, 18 bp, Homo sapiens
gaggcccctggagccaga

SEQ ID NO: 5417601 - DNA, 18 bp, Homo sapiens
gagggatgaggtgctggg

SEQ ID NO: 5417602 - DNA, 22 bp, Homo sapiens
gagggatgaggtgctgggaggg

SEQ ID NO: 5417603 - DNA, 16 bp, Homo sapiens
gagggatgatgaagag

SEQ ID NO: 5417604 - DNA, 17 bp, Homo sapiens
gagggatgatgccacac

SEQ ID NO: 5417605 - DNA, 23 bp, Homo sapiens
gagggatgcagtgcctttcccca

SEQ ID NO: 5417606 - DNA, 14 bp, Homo sapiens
gagggatgccccca

SEQ ID NO: 5417607 - DNA, 14 bp, Homo sapiens
gagggatgcccgct

SEQ ID NO: 5417608 - DNA, 15 bp, Homo sapiens
gagggatgctgcctg

SEQ ID NO: 5417609 - DNA, 18 bp, Homo sapiens
gagggatggagaaagaag

SEQ ID NO: 5417610 - DNA, 13 bp, Homo sapiens
gagggatggagag

SEQ ID NO: 5417611 - DNA, 21 bp, Homo sapiens
gagggatggagaggcggcctc

SEQ ID NO: 5417612 - DNA, 12 bp, Homo sapiens
gagggatgggag

SEQ ID NO: 5417613 - DNA, 14 bp, Homo sapiens
gagggatgggagag

SEQ ID NO: 5417614 - DNA, 18 bp, Homo sapiens
gagggatgggatttcatg

SEQ ID NO: 5417615 - DNA, 13 bp, Homo sapiens
gagggatgggcct

SEQ ID NO: 5417616 - DNA, 15 bp, Homo sapiens
gagggatgggcctgg

SEQ ID NO: 5417617 - DNA, 17 bp, Homo sapiens
gagggatgtaactattg

SEQ ID NO: 5417618 - DNA, 15 bp, Homo sapiens
gagggatgtggagca

SEQ ID NO: 5417619 - DNA, 21 bp, Homo sapiens
gagggatgtgggtaagaggag

SEQ ID NO: 5417620 - DNA, 24 bp, Homo sapiens
gagggatgtgggtaagaggagcag

SEQ ID NO: 5417621 - DNA, 14 bp, Homo sapiens
gagggatgttccag

SEQ ID NO: 5417622 - DNA, 23 bp, Homo sapiens
gagggatgttctagccctccctg

SEQ ID NO: 5417623 - DNA, 18 bp, Homo sapiens
gagggattctggttccag

SEQ ID NO: 5417624 - DNA, 18 bp, Homo sapiens
gagggattgaacacaggc

SEQ ID NO: 5417625 - DNA, 19 bp, Homo sapiens
gagggattgaacacaggca

SEQ ID NO: 5417626 - DNA, 19 bp, Homo sapiens
gagggattttagcctcttc

SEQ ID NO: 5417627 - DNA, 20 bp, Homo sapiens
gagggattttagcctcttcc

SEQ ID NO: 5417628 - DNA, 21 bp, Homo sapiens
gagggattttagcctcttccc

SEQ ID NO: 5417629 - DNA, 22 bp, Homo sapiens
gagggattttagcctcttccct

SEQ ID NO: 5417630 - DNA, 17 bp, Homo sapiens
gagggcaacagggagca

SEQ ID NO: 5417631 - DNA, 22 bp, Homo sapiens
gagggcaagaggtgcctgggag

SEQ ID NO: 5417632 - DNA, 22 bp, Homo sapiens
gagggcaagccctgcccacaga

SEQ ID NO: 5417633 - DNA, 12 bp, Homo sapiens
gagggcacacac

SEQ ID NO: 5417634 - DNA, 14 bp, Homo sapiens
gagggcacagcagg

SEQ ID NO: 5417635 - DNA, 15 bp, Homo sapiens
gagggcacagccctc

SEQ ID NO: 5417636 - DNA, 18 bp, Homo sapiens
gagggcacatctccagaa

SEQ ID NO: 5417637 - DNA, 17 bp, Homo sapiens
gagggcacatgaacagc

SEQ ID NO: 5417638 - DNA, 20 bp, Homo sapiens
gagggcacattccttgcctg

SEQ ID NO: 5417639 - DNA, 15 bp, Homo sapiens
gagggcaccaccaag

SEQ ID NO: 5417640 - DNA, 17 bp, Homo sapiens
gagggcaccagggactc

SEQ ID NO: 5417641 - DNA, 23 bp, Homo sapiens
gagggcacccccaaattcaaaga

SEQ ID NO: 5417642 - DNA, 15 bp, Homo sapiens
gagggcactggagct

SEQ ID NO: 5417643 - DNA, 14 bp, Homo sapiens
gagggcacttcagg

SEQ ID NO: 5417644 - DNA, 15 bp, Homo sapiens
gagggcacttcaggt

SEQ ID NO: 5417645 - DNA, 16 bp, Homo sapiens
gagggcacttcaggtc

SEQ ID NO: 5417646 - DNA, 17 bp, Homo sapiens
gagggcacttcaggtcc

SEQ ID NO: 5417647 - DNA, 17 bp, Homo sapiens
gagggcagactggggca

SEQ ID NO: 5417648 - DNA, 17 bp, Homo sapiens
gagggcagagccatggg

SEQ ID NO: 5417649 - DNA, 16 bp, Homo sapiens
gagggcagagctggtg

SEQ ID NO: 5417650 - DNA, 21 bp, Homo sapiens
gagggcagagtgggctgcctg

SEQ ID NO: 5417651 - DNA, 21 bp, Homo sapiens
gagggcagcactgggaagctg

SEQ ID NO: 5417652 - DNA, 13 bp, Homo sapiens
gagggcagcagcc

SEQ ID NO: 5417653 - DNA, 16 bp, Homo sapiens
gagggcagcagccagc

SEQ ID NO: 5417654 - DNA, 17 bp, Homo sapiens
gagggcagcagccagcc

SEQ ID NO: 5417655 - DNA, 21 bp, Homo sapiens
gagggcagcagccagccctgc

SEQ ID NO: 5417656 - DNA, 12 bp, Homo sapiens
gagggcagcagg

SEQ ID NO: 5417657 - DNA, 15 bp, Homo sapiens
gagggcagcagggct

SEQ ID NO: 5417658 - DNA, 19 bp, Homo sapiens
gagggcagcagggctaccc

SEQ ID NO: 5417659 - DNA, 15 bp, Homo sapiens
gagggcagccccctc

SEQ ID NO: 5417660 - DNA, 16 bp, Homo sapiens
gagggcaggaccctca

SEQ ID NO: 5417661 - DNA, 14 bp, Homo sapiens
gagggcaggcttgg

SEQ ID NO: 5417662 - DNA, 16 bp, Homo sapiens
gagggcaggcttgggg

SEQ ID NO: 5417663 - DNA, 21 bp, Homo sapiens
gagggcaggtccagctctgtg

SEQ ID NO: 5417664 - DNA, 16 bp, Homo sapiens
gagggcagtacctggg

SEQ ID NO: 5417665 - DNA, 15 bp, Homo sapiens
gagggcagtgccctt

SEQ ID NO: 5417666 - DNA, 16 bp, Homo sapiens
gagggcagtgtttcct

SEQ ID NO: 5417667 - DNA, 20 bp, Homo sapiens
gagggcagttcgcagccacc

SEQ ID NO: 5417668 - DNA, 15 bp, Homo sapiens
gagggcatctctgag

SEQ ID NO: 5417669 - DNA, 16 bp, Homo sapiens
gagggcatctctgagt

SEQ ID NO: 5417670 - DNA, 18 bp, Homo sapiens
gagggcatgggagggagg

SEQ ID NO: 5417671 - DNA, 23 bp, Homo sapiens
gagggcatgtgatattttcacat

SEQ ID NO: 5417672 - DNA, 21 bp, Homo sapiens
gagggcatttggcttcctctg

SEQ ID NO: 5417673 - DNA, 20 bp, Homo sapiens
gagggccaacaactgtccct

SEQ ID NO: 5417674 - DNA, 18 bp, Homo sapiens
gagggccaagagatctgt

SEQ ID NO: 5417675 - DNA, 19 bp, Homo sapiens
gagggccaccggtgggcag

SEQ ID NO: 5417676 - DNA, 15 bp, Homo sapiens
gagggccacggggag

SEQ ID NO: 5417677 - DNA, 22 bp, Homo sapiens
gagggccaggcagaatggctgc

SEQ ID NO: 5417678 - DNA, 14 bp, Homo sapiens
gagggccagggacc

SEQ ID NO: 5417679 - DNA, 19 bp, Homo sapiens
gagggccagggaggcagag

SEQ ID NO: 5417680 - DNA, 16 bp, Homo sapiens
gagggccagtgatgat

SEQ ID NO: 5417681 - DNA, 13 bp, Homo sapiens
gagggcccagagc

SEQ ID NO: 5417682 - DNA, 14 bp, Homo sapiens
gagggcccagccag

SEQ ID NO: 5417683 - DNA, 15 bp, Homo sapiens
gagggcccagcccag

SEQ ID NO: 5417684 - DNA, 21 bp, Homo sapiens
gagggcccagcccagagccac

SEQ ID NO: 5417685 - DNA, 13 bp, Homo sapiens
gagggcccaggca

SEQ ID NO: 5417686 - DNA, 15 bp, Homo sapiens
gagggccccacgtcc

SEQ ID NO: 5417687 - DNA, 11 bp, Homo sapiens
gagggcccctc

SEQ ID NO: 5417688 - DNA, 22 bp, Homo sapiens
gagggcccctcactggctggac

SEQ ID NO: 5417689 - DNA, 18 bp, Homo sapiens
gagggcccctctgcccag

SEQ ID NO: 5417690 - DNA, 19 bp, Homo sapiens
gagggcccctgcgtggggg

SEQ ID NO: 5417691 - DNA, 20 bp, Homo sapiens
gagggcccctgcgtgggggc

SEQ ID NO: 5417692 - DNA, 14 bp, Homo sapiens
gagggccctgagga

SEQ ID NO: 5417693 - DNA, 15 bp, Homo sapiens
gagggccctgaggaa

SEQ ID NO: 5417694 - DNA, 17 bp, Homo sapiens
gagggccctgaggaata

SEQ ID NO: 5417695 - DNA, 19 bp, Homo sapiens
gagggccctgaggaataaa

SEQ ID NO: 5417696 - DNA, 23 bp, Homo sapiens
gagggccctgaggaataaagctt

SEQ ID NO: 5417697 - DNA, 12 bp, Homo sapiens
gagggccctggt

SEQ ID NO: 5417698 - DNA, 16 bp, Homo sapiens
gagggccgcctgcctt

SEQ ID NO: 5417699 - DNA, 20 bp, Homo sapiens
gagggccggttctaaggctc

SEQ ID NO: 5417700 - DNA, 20 bp, Homo sapiens
gagggcctcagagcctgacc

SEQ ID NO: 5417701 - DNA, 13 bp, Homo sapiens
gagggcctctgga

SEQ ID NO: 5417702 - DNA, 15 bp, Homo sapiens
gagggcctgaggtct

SEQ ID NO: 5417703 - DNA, 22 bp, Homo sapiens
gagggcctgaggtctggctgct

SEQ ID NO: 5417704 - DNA, 14 bp, Homo sapiens
gagggcctgcaagg

SEQ ID NO: 5417705 - DNA, 14 bp, Homo sapiens
gagggcctgctgga

SEQ ID NO: 5417706 - DNA, 13 bp, Homo sapiens
gagggcctgggcc

SEQ ID NO: 5417707 - DNA, 17 bp, Homo sapiens
gagggcctgggcctggc

SEQ ID NO: 5417708 - DNA, 22 bp, Homo sapiens
gagggccttcccctcccagccc

SEQ ID NO: 5417709 - DNA, 17 bp, Homo sapiens
gagggccttcttaagat

SEQ ID NO: 5417710 - DNA, 23 bp, Homo sapiens
gagggcgaccccgtcacagcctc

SEQ ID NO: 5417711 - DNA, 15 bp, Homo sapiens
gagggcgcaggccgt

SEQ ID NO: 5417712 - DNA, 12 bp, Homo sapiens
gagggcgcccag

SEQ ID NO: 5417713 - DNA, 13 bp, Homo sapiens
gagggcgcccagc

SEQ ID NO: 5417714 - DNA, 15 bp, Homo sapiens
gagggcgcccagcag

SEQ ID NO: 5417715 - DNA, 19 bp, Homo sapiens
gagggcgcccagcagcctg

SEQ ID NO: 5417716 - DNA, 14 bp, Homo sapiens
gagggcgcccagcc

SEQ ID NO: 5417717 - DNA, 18 bp, Homo sapiens
gagggcgcccattcgtct

SEQ ID NO: 5417718 - DNA, 13 bp, Homo sapiens
gagggcgcctggg

SEQ ID NO: 5417719 - DNA, 15 bp, Homo sapiens
gagggcgcttttgta

SEQ ID NO: 5417720 - DNA, 21 bp, Homo sapiens
gagggcggcccctctgttctg

SEQ ID NO: 5417721 - DNA, 14 bp, Homo sapiens
gagggcgtcaggca

SEQ ID NO: 5417722 - DNA, 15 bp, Homo sapiens
gagggcgtcaggcag

SEQ ID NO: 5417723 - DNA, 17 bp, Homo sapiens
gagggcgtcaggcagag

SEQ ID NO: 5417724 - DNA, 14 bp, Homo sapiens
gagggcgtgggagc

SEQ ID NO: 5417725 - DNA, 20 bp, Homo sapiens
gagggctactcagcagtaag

SEQ ID NO: 5417726 - DNA, 22 bp, Homo sapiens
gagggctactcagcagtaagca

SEQ ID NO: 5417727 - DNA, 17 bp, Homo sapiens
gagggctagaacctaga

SEQ ID NO: 5417728 - DNA, 20 bp, Homo sapiens
gagggctagaacctggaagg

SEQ ID NO: 5417729 - DNA, 21 bp, Homo sapiens
gagggctagaacctggagagc

SEQ ID NO: 5417730 - DNA, 18 bp, Homo sapiens
gagggctagaactggaga

SEQ ID NO: 5417731 - DNA, 19 bp, Homo sapiens
gagggctagaatctggaga

SEQ ID NO: 5417732 - DNA, 17 bp, Homo sapiens
gagggctagccctgagc

SEQ ID NO: 5417733 - DNA, 14 bp, Homo sapiens
gagggctcactcag

SEQ ID NO: 5417734 - DNA, 11 bp, Homo sapiens
gagggctcaga

SEQ ID NO: 5417735 - DNA, 19 bp, Homo sapiens
gagggctcagaagagcagc

SEQ ID NO: 5417736 - DNA, 13 bp, Homo sapiens
gagggctcctcca

SEQ ID NO: 5417737 - DNA, 20 bp, Homo sapiens
gagggctcctggggcagaga

SEQ ID NO: 5417738 - DNA, 11 bp, Homo sapiens
gagggctctga

SEQ ID NO: 5417739 - DNA, 13 bp, Homo sapiens
gagggctctgagg

SEQ ID NO: 5417740 - DNA, 14 bp, Homo sapiens
gagggctctgaggc

SEQ ID NO: 5417741 - DNA, 15 bp, Homo sapiens
gagggctctgaggcg

SEQ ID NO: 5417742 - DNA, 20 bp, Homo sapiens
gagggctctgatctaacaaa

SEQ ID NO: 5417743 - DNA, 14 bp, Homo sapiens
gagggctctgtgct

SEQ ID NO: 5417744 - DNA, 15 bp, Homo sapiens
gagggctgacaaggc

SEQ ID NO: 5417745 - DNA, 12 bp, Homo sapiens
gagggctgagcc

SEQ ID NO: 5417746 - DNA, 13 bp, Homo sapiens
gagggctgagccc

SEQ ID NO: 5417747 - DNA, 20 bp, Homo sapiens
gagggctgagcccctcctct

SEQ ID NO: 5417748 - DNA, 20 bp, Homo sapiens
gagggctgagcctggtccca

SEQ ID NO: 5417749 - DNA, 19 bp, Homo sapiens
gagggctgaggagcagcca

SEQ ID NO: 5417750 - DNA, 18 bp, Homo sapiens
gagggctgatggaggaaa

SEQ ID NO: 5417751 - DNA, 16 bp, Homo sapiens
gagggctgcagtcaca

SEQ ID NO: 5417752 - DNA, 13 bp, Homo sapiens
gagggctgccagc

SEQ ID NO: 5417753 - DNA, 16 bp, Homo sapiens
gagggctgccagcagc

SEQ ID NO: 5417754 - DNA, 19 bp, Homo sapiens
gagggctggaatctggaga

SEQ ID NO: 5417755 - DNA, 20 bp, Homo sapiens
gagggctggaatctggagag

SEQ ID NO: 5417756 - DNA, 17 bp, Homo sapiens
gagggctggagaccaga

SEQ ID NO: 5417757 - DNA, 20 bp, Homo sapiens
gagggctggaggcccaggct

SEQ ID NO: 5417758 - DNA, 14 bp, Homo sapiens
gagggctggctggc

SEQ ID NO: 5417759 - DNA, 16 bp, Homo sapiens
gagggctgggcagggc

SEQ ID NO: 5417760 - DNA, 21 bp, Homo sapiens
gagggctgggcagggccctgt

SEQ ID NO: 5417761 - DNA, 13 bp, Homo sapiens
gagggctgggccc

SEQ ID NO: 5417762 - DNA, 14 bp, Homo sapiens
gagggctgtggctg

SEQ ID NO: 5417763 - DNA, 16 bp, Homo sapiens
gagggctttcagcgcc

SEQ ID NO: 5417764 - DNA, 15 bp, Homo sapiens
gaggggaacactgcc

SEQ ID NO: 5417765 - DNA, 17 bp, Homo sapiens
gaggggaacactgccct

SEQ ID NO: 5417766 - DNA, 12 bp, Homo sapiens
gaggggaagaaa

SEQ ID NO: 5417767 - DNA, 16 bp, Homo sapiens
gaggggaagagagagg

SEQ ID NO: 5417768 - DNA, 16 bp, Homo sapiens
gaggggaagctgcagc

SEQ ID NO: 5417769 - DNA, 13 bp, Homo sapiens
gaggggaagctgg

SEQ ID NO: 5417770 - DNA, 15 bp, Homo sapiens
gaggggaagctgggc

SEQ ID NO: 5417771 - DNA, 12 bp, Homo sapiens
gaggggaaggcc

SEQ ID NO: 5417772 - DNA, 16 bp, Homo sapiens
gaggggaaggggcggt

SEQ ID NO: 5417773 - DNA, 14 bp, Homo sapiens
gaggggaagtccct

SEQ ID NO: 5417774 - DNA, 19 bp, Homo sapiens
gaggggaataatagaagaa

SEQ ID NO: 5417775 - DNA, 14 bp, Homo sapiens
gaggggacagagct

SEQ ID NO: 5417776 - DNA, 18 bp, Homo sapiens
gaggggacagagctgagg

SEQ ID NO: 5417777 - DNA, 21 bp, Homo sapiens
gaggggaccaattctggacag

SEQ ID NO: 5417778 - DNA, 14 bp, Homo sapiens
gaggggaccaggag

SEQ ID NO: 5417779 - DNA, 15 bp, Homo sapiens
gaggggaccaggagt

SEQ ID NO: 5417780 - DNA, 16 bp, Homo sapiens
gaggggaccaggagtg

SEQ ID NO: 5417781 - DNA, 16 bp, Homo sapiens
gaggttttctccccca

SEQ ID NO: 5417782 - DNA, 20 bp, Homo sapiens
gaggtttttcttgggaaaga

SEQ ID NO: 5417783 - DNA, 15 bp, Homo sapiens
gaggtttttttgctt

SEQ ID NO: 5417784 - DNA, 15 bp, Homo sapiens
gagtaaaaactagaa

SEQ ID NO: 5417785 - DNA, 17 bp, Homo sapiens
gagtaaaacattttatt

SEQ ID NO: 5417786 - DNA, 20 bp, Homo sapiens
gagtaaaacttgtattggaa

SEQ ID NO: 5417787 - DNA, 15 bp, Homo sapiens
gagtaaaatcacaga

SEQ ID NO: 5417788 - DNA, 15 bp, Homo sapiens
gagtaaaccatgtat

SEQ ID NO: 5417789 - DNA, 17 bp, Homo sapiens
gagtaaacggcccaggc

SEQ ID NO: 5417790 - DNA, 14 bp, Homo sapiens
gagtaaacttgaaa

SEQ ID NO: 5417791 - DNA, 15 bp, Homo sapiens
gagtaaacttgaaaa

SEQ ID NO: 5417792 - DNA, 18 bp, Homo sapiens
gagtaaagaattattttg

SEQ ID NO: 5417793 - DNA, 14 bp, Homo sapiens
gagtaaagataaaa

SEQ ID NO: 5417794 - DNA, 19 bp, Homo sapiens
gagtaaagataaaaggata

SEQ ID NO: 5417795 - DNA, 17 bp, Homo sapiens
gagtaaagctcctatct

SEQ ID NO: 5417796 - DNA, 16 bp, Homo sapiens
gagtaaataaactctt

SEQ ID NO: 5417797 - DNA, 18 bp, Homo sapiens
gagtaaataattggaaaa

SEQ ID NO: 5417798 - DNA, 16 bp, Homo sapiens
gagtaaatacaggtag

SEQ ID NO: 5417799 - DNA, 15 bp, Homo sapiens
gagtaaatattgagg

SEQ ID NO: 5417800 - DNA, 16 bp, Homo sapiens
gagtaaatcagatgtt

SEQ ID NO: 5417801 - DNA, 17 bp, Homo sapiens
gagtaaattgctctgtt

SEQ ID NO: 5417802 - DNA, 19 bp, Homo sapiens
gagtaacaatacaaatgga

SEQ ID NO: 5417803 - DNA, 13 bp, Homo sapiens
gagtaacactgag

SEQ ID NO: 5417804 - DNA, 15 bp, Homo sapiens
gagtaacacttgaaa

SEQ ID NO: 5417805 - DNA, 20 bp, Homo sapiens
gagtaacacttgaaaagtgt

SEQ ID NO: 5417806 - DNA, 13 bp, Homo sapiens
gagtaacagggca

SEQ ID NO: 5417807 - DNA, 17 bp, Homo sapiens
gagtaacagtcatcatt

SEQ ID NO: 5417808 - DNA, 18 bp, Homo sapiens
gagtaacagtcatcattt

SEQ ID NO: 5417809 - DNA, 20 bp, Homo sapiens
gagtaacagtcatcatttat

SEQ ID NO: 5417810 - DNA, 13 bp, Homo sapiens
gagtaacatttgc

SEQ ID NO: 5417811 - DNA, 15 bp, Homo sapiens
gagtaacatttgctg

SEQ ID NO: 5417812 - DNA, 21 bp, Homo sapiens
gagtaactatcgaaatgacgg

SEQ ID NO: 5417813 - DNA, 15 bp, Homo sapiens
gagtaagaaacttca

SEQ ID NO: 5417814 - DNA, 20 bp, Homo sapiens
gagtaagaaatttcaggttg

SEQ ID NO: 5417815 - DNA, 17 bp, Homo sapiens
gagtaagacaagtggga

SEQ ID NO: 5417816 - DNA, 13 bp, Homo sapiens
gagtaagacattg

SEQ ID NO: 5417817 - DNA, 12 bp, Homo sapiens
gagtaagcccaa

SEQ ID NO: 5417818 - DNA, 21 bp, Homo sapiens
gagtaagggtaaaaaagataa

SEQ ID NO: 5417819 - DNA, 14 bp, Homo sapiens
gagtaataggacca

SEQ ID NO: 5417820 - DNA, 18 bp, Homo sapiens
gagtaatattacatttca

SEQ ID NO: 5417821 - DNA, 13 bp, Homo sapiens
gagtaatcaatct

SEQ ID NO: 5417822 - DNA, 14 bp, Homo sapiens
gagtaatcaggcag

SEQ ID NO: 5417823 - DNA, 17 bp, Homo sapiens
gagtaatcaggcagcct

SEQ ID NO: 5417824 - DNA, 14 bp, Homo sapiens
gagtaatggtgtag

SEQ ID NO: 5417825 - DNA, 15 bp, Homo sapiens
gagtaatgtttaaga

SEQ ID NO: 5417826 - DNA, 19 bp, Homo sapiens
gagtaattcatctgtgaat

SEQ ID NO: 5417827 - DNA, 23 bp, Homo sapiens
gagtaattcttttctgtttctgt

SEQ ID NO: 5417828 - DNA, 18 bp, Homo sapiens
gagtaattgaggaaaaac

SEQ ID NO: 5417829 - DNA, 13 bp, Homo sapiens
gagtaatttaaat

SEQ ID NO: 5417830 - DNA, 13 bp, Homo sapiens
gagtaatttcatt

SEQ ID NO: 5417831 - DNA, 17 bp, Homo sapiens
gagtaattttggatttt

SEQ ID NO: 5417832 - DNA, 21 bp, Homo sapiens
gagtacaaaacaatctctcaa

SEQ ID NO: 5417833 - DNA, 13 bp, Homo sapiens
gagtacaaatgcc

SEQ ID NO: 5417834 - DNA, 20 bp, Homo sapiens
gagtacaagctcttgtttct

SEQ ID NO: 5417835 - DNA, 23 bp, Homo sapiens
gagtacactcagccactgtcaca

SEQ ID NO: 5417836 - DNA, 20 bp, Homo sapiens
gagtacagatactgtgagct

SEQ ID NO: 5417837 - DNA, 16 bp, Homo sapiens
gagtacaggtgaagca

SEQ ID NO: 5417838 - DNA, 20 bp, Homo sapiens
gagtacatggaagaagtata

SEQ ID NO: 5417839 - DNA, 21 bp, Homo sapiens
gagtacattcatctggaggct

SEQ ID NO: 5417840 - DNA, 12 bp, Homo sapiens
gagtacattgtg

SEQ ID NO: 5417841 - DNA, 21 bp, Homo sapiens
gagtaccaaatccacaagcca

SEQ ID NO: 5417842 - DNA, 13 bp, Homo sapiens
gagtaccaggggc

SEQ ID NO: 5417843 - DNA, 16 bp, Homo sapiens
gagtaccaggggctgg

SEQ ID NO: 5417844 - DNA, 13 bp, Homo sapiens
gagtacccagcct

SEQ ID NO: 5417845 - DNA, 22 bp, Homo sapiens
gagtacccccctgagagcatgt

SEQ ID NO: 5417846 - DNA, 22 bp, Homo sapiens
gagtacccctgctttgggcttg

SEQ ID NO: 5417847 - DNA, 15 bp, Homo sapiens
gagtacctcaaagga

SEQ ID NO: 5417848 - DNA, 16 bp, Homo sapiens
gagtacctgctgcccc

SEQ ID NO: 5417849 - DNA, 22 bp, Homo sapiens
gagtacctgctgccccagctga

SEQ ID NO: 5417850 - DNA, 12 bp, Homo sapiens
gagtacctgtgt

SEQ ID NO: 5417851 - DNA, 14 bp, Homo sapiens
gagtacctgtgtgt

SEQ ID NO: 5417852 - DNA, 19 bp, Homo sapiens
gagtaccttctacaggccc

SEQ ID NO: 5417853 - DNA, 15 bp, Homo sapiens
gagtacgtcctgcct

SEQ ID NO: 5417854 - DNA, 14 bp, Homo sapiens
gagtacgttaaaag

SEQ ID NO: 5417855 - DNA, 19 bp, Homo sapiens
gagtactacagtcctccca

SEQ ID NO: 5417856 - DNA, 21 bp, Homo sapiens
gagtactacagtcctcccatc

SEQ ID NO: 5417857 - DNA, 14 bp, Homo sapiens
gagtactatattta

SEQ ID NO: 5417858 - DNA, 20 bp, Homo sapiens
gagtactcataaaggacact

SEQ ID NO: 5417859 - DNA, 20 bp, Homo sapiens
gagtactccacactgcacaa

SEQ ID NO: 5417860 - DNA, 15 bp, Homo sapiens
gagtactctttctct

SEQ ID NO: 5417861 - DNA, 19 bp, Homo sapiens
gagtactggaataaacagt

SEQ ID NO: 5417862 - DNA, 18 bp, Homo sapiens
gagtactgtgggcaattt

SEQ ID NO: 5417863 - DNA, 15 bp, Homo sapiens
gagtagaaaatgtga

SEQ ID NO: 5417864 - DNA, 20 bp, Homo sapiens
gagtagaaagacagagctgg

SEQ ID NO: 5417865 - DNA, 15 bp, Homo sapiens
gagtagaaaggcctt

SEQ ID NO: 5417866 - DNA, 14 bp, Homo sapiens
gagtagaaattgtt

SEQ ID NO: 5417867 - DNA, 21 bp, Homo sapiens
gagtagagaggcccgcccgcc

SEQ ID NO: 5417868 - DNA, 17 bp, Homo sapiens
gagtagaggtttaaaga

SEQ ID NO: 5417869 - DNA, 21 bp, Homo sapiens
gagtagataagtgctcagtat

SEQ ID NO: 5417870 - DNA, 17 bp, Homo sapiens
gagtagatgcgcagccc

SEQ ID NO: 5417871 - DNA, 13 bp, Homo sapiens
gagtagatgcttg

SEQ ID NO: 5417872 - DNA, 23 bp, Homo sapiens
gagtagatgcttgctcttgggaa

SEQ ID NO: 5417873 - DNA, 19 bp, Homo sapiens
gagtagcaaggaaggacac

SEQ ID NO: 5417874 - DNA, 18 bp, Homo sapiens
gagtagcacccccagcca

SEQ ID NO: 5417875 - DNA, 17 bp, Homo sapiens
gagtagccgagagcctg

SEQ ID NO: 5417876 - DNA, 21 bp, Homo sapiens
gagtagccgagagcctgctcc

SEQ ID NO: 5417877 - DNA, 21 bp, Homo sapiens
gagtagcctaaaattactatt

SEQ ID NO: 5417878 - DNA, 16 bp, Homo sapiens
gagtagctcgtcctca

SEQ ID NO: 5417879 - DNA, 19 bp, Homo sapiens
gagtagctcgtcctcactg

SEQ ID NO: 5417880 - DNA, 20 bp, Homo sapiens
gagtagctgagactacaggt

SEQ ID NO: 5417881 - DNA, 14 bp, Homo sapiens
gagtagctgagagg

SEQ ID NO: 5417882 - DNA, 16 bp, Homo sapiens
gagtagctgagaggaa

SEQ ID NO: 5417883 - DNA, 19 bp, Homo sapiens
gagtagctgagaggaagat

SEQ ID NO: 5417884 - DNA, 13 bp, Homo sapiens
gagtagctgagct

SEQ ID NO: 5417885 - DNA, 22 bp, Homo sapiens
gagtagctgggactacaggcac

SEQ ID NO: 5417886 - DNA, 13 bp, Homo sapiens
gagtagctgggcc

SEQ ID NO: 5417887 - DNA, 14 bp, Homo sapiens
gagtagctgggcct

SEQ ID NO: 5417888 - DNA, 17 bp, Homo sapiens
gagtaggaagactttgg

SEQ ID NO: 5417889 - DNA, 18 bp, Homo sapiens
gagtaggaagactttgga

SEQ ID NO: 5417890 - DNA, 23 bp, Homo sapiens
gagtaggagcactggggtggggg

SEQ ID NO: 5417891 - DNA, 11 bp, Homo sapiens
gagtaggccct

SEQ ID NO: 5417892 - DNA, 16 bp, Homo sapiens
gagtagggccctgaca

SEQ ID NO: 5417893 - DNA, 17 bp, Homo sapiens
gagtagggccctgacag

SEQ ID NO: 5417894 - DNA, 18 bp, Homo sapiens
gagtagggccctgacagg

SEQ ID NO: 5417895 - DNA, 17 bp, Homo sapiens
gagtagggttgccagtc

SEQ ID NO: 5417896 - DNA, 19 bp, Homo sapiens
gagtagggttgccagtcct

SEQ ID NO: 5417897 - DNA, 16 bp, Homo sapiens
gagtaggtctgggatg

SEQ ID NO: 5417898 - DNA, 24 bp, Homo sapiens
gagtaggtgggtaggagcccttct

SEQ ID NO: 5417899 - DNA, 22 bp, Homo sapiens
gagtagtcagaactataacatt

SEQ ID NO: 5417900 - DNA, 14 bp, Homo sapiens
gagtagtcagaagt

SEQ ID NO: 5417901 - DNA, 21 bp, Homo sapiens
gagtagtgaagactccagaaa

SEQ ID NO: 5417902 - DNA, 15 bp, Homo sapiens
gagtagtggccactg

SEQ ID NO: 5417903 - DNA, 24 bp, Homo sapiens
gagtagttgggattacaggtgact

SEQ ID NO: 5417904 - DNA, 22 bp, Homo sapiens
gagtagttgttggtctgtagca

SEQ ID NO: 5417905 - DNA, 17 bp, Homo sapiens
gagtagtttttcagcta

SEQ ID NO: 5417906 - DNA, 17 bp, Homo sapiens
gagtataagaaatgcat

SEQ ID NO: 5417907 - DNA, 18 bp, Homo sapiens
gagtatacaatatataaa

SEQ ID NO: 5417908 - DNA, 19 bp, Homo sapiens
gagtatacaatatataaaa

SEQ ID NO: 5417909 - DNA, 19 bp, Homo sapiens
gagtatacctcctatatgt

SEQ ID NO: 5417910 - DNA, 11 bp, Homo sapiens
gagtatatatg

SEQ ID NO: 5417911 - DNA, 17 bp, Homo sapiens
gagtatatatgtacagt

SEQ ID NO: 5417912 - DNA, 18 bp, Homo sapiens
gagtatatgtaacagttt

SEQ ID NO: 5417913 - DNA, 20 bp, Homo sapiens
gagtatatttccattcagac

SEQ ID NO: 5417914 - DNA, 17 bp, Homo sapiens
gagtatcaaaggcagaa

SEQ ID NO: 5417915 - DNA, 22 bp, Homo sapiens
gagtatcaaaggcagaaaggag

SEQ ID NO: 5417916 - DNA, 11 bp, Homo sapiens
gagtatcactt

SEQ ID NO: 5417917 - DNA, 14 bp, Homo sapiens
gagtatcactttaa

SEQ ID NO: 5417918 - DNA, 17 bp, Homo sapiens
gagtatcaggtctccca

SEQ ID NO: 5417919 - DNA, 23 bp, Homo sapiens
gagtatctcctcgcaagctgggt

SEQ ID NO: 5417920 - DNA, 21 bp, Homo sapiens
gagtatctgaagggaattgtt

SEQ ID NO: 5417921 - DNA, 12 bp, Homo sapiens
gagtatctgtaa

SEQ ID NO: 5417922 - DNA, 19 bp, Homo sapiens
gagtatctgtaacccttga

SEQ ID NO: 5417923 - DNA, 12 bp, Homo sapiens
gagtatctttac

SEQ ID NO: 5417924 - DNA, 15 bp, Homo sapiens
gagtatgagtgcaag

SEQ ID NO: 5417925 - DNA, 19 bp, Homo sapiens
gagtatgcaagaagaatat

SEQ ID NO: 5417926 - DNA, 24 bp, Homo sapiens
gagtatgccactgcactccagcct

SEQ ID NO: 5417927 - DNA, 20 bp, Homo sapiens
gagtatgcttgggccctgca

SEQ ID NO: 5417928 - DNA, 16 bp, Homo sapiens
gagtatgtagtggctt

SEQ ID NO: 5417929 - DNA, 18 bp, Homo sapiens
gagtatgtggcaaaacat

SEQ ID NO: 5417930 - DNA, 22 bp, Homo sapiens
gagtatgttaagctctttatga

SEQ ID NO: 5417931 - DNA, 14 bp, Homo sapiens
gagtatgttgtcat

SEQ ID NO: 5417932 - DNA, 19 bp, Homo sapiens
gagtatgttgtcataacat

SEQ ID NO: 5417933 - DNA, 22 bp, Homo sapiens
gagtattaaaatgtatgcatgt

SEQ ID NO: 5417934 - DNA, 23 bp, Homo sapiens
gagtattaaaatgtatgcatgtt

SEQ ID NO: 5417935 - DNA, 17 bp, Homo sapiens
gagtattaagaatgcag

SEQ ID NO: 5417936 - DNA, 11 bp, Homo sapiens
gagtattcagt

SEQ ID NO: 5417937 - DNA, 12 bp, Homo sapiens
gagtattctaat

SEQ ID NO: 5417938 - DNA, 20 bp, Homo sapiens
gagtattctaataagctagt

SEQ ID NO: 5417939 - DNA, 19 bp, Homo sapiens
gagtattctatgtaaaaat

SEQ ID NO: 5417940 - DNA, 21 bp, Homo sapiens
gagtattctcggatagttgct

SEQ ID NO: 5417941 - DNA, 21 bp, Homo sapiens
gagtattgtttaaaatgtaat

SEQ ID NO: 5417942 - DNA, 18 bp, Homo sapiens
gagtatttacaataaaga

SEQ ID NO: 5417943 - DNA, 13 bp, Homo sapiens
gagtatttggtaa

SEQ ID NO: 5417944 - DNA, 17 bp, Homo sapiens
gagtatttttaacactt

SEQ ID NO: 5417945 - DNA, 21 bp, Homo sapiens
gagtatttttataattttatc

SEQ ID NO: 5417946 - DNA, 18 bp, Homo sapiens
gagtatttttgacagaat

SEQ ID NO: 5417947 - DNA, 13 bp, Homo sapiens
gagtcaaaacaaa

SEQ ID NO: 5417948 - DNA, 19 bp, Homo sapiens
gagtcaaaactacaaatca

SEQ ID NO: 5417949 - DNA, 16 bp, Homo sapiens
gagtcaaaagcctggg

SEQ ID NO: 5417950 - DNA, 14 bp, Homo sapiens
gagtcaaagctgac

SEQ ID NO: 5417951 - DNA, 20 bp, Homo sapiens
gagtcaaaggcatctccctt

SEQ ID NO: 5417952 - DNA, 11 bp, Homo sapiens
gagtcaaatcc

SEQ ID NO: 5417953 - DNA, 14 bp, Homo sapiens
gagtcaaatccagt

SEQ ID NO: 5417954 - DNA, 15 bp, Homo sapiens
gagtcaaatccagtg

SEQ ID NO: 5417955 - DNA, 16 bp, Homo sapiens
gagtcaaatccagtgg

SEQ ID NO: 5417956 - DNA, 18 bp, Homo sapiens
gagtcaaatccagtggtg

SEQ ID NO: 5417957 - DNA, 15 bp, Homo sapiens
gagtcaactggctgg

SEQ ID NO: 5417958 - DNA, 18 bp, Homo sapiens
gagtcaagctgatgaagt

SEQ ID NO: 5417959 - DNA, 12 bp, Homo sapiens
gagtgcagcctt

SEQ ID NO: 5417960 - DNA, 15 bp, Homo sapiens
gagtgcagccttctc

SEQ ID NO: 5417961 - DNA, 13 bp, Homo sapiens
gagtgcaggccca

SEQ ID NO: 5417962 - DNA, 17 bp, Homo sapiens
gagtgcagtcctgatca

SEQ ID NO: 5417963 - DNA, 11 bp, Homo sapiens
gagtgcagtga

SEQ ID NO: 5417964 - DNA, 12 bp, Homo sapiens
gagtgcagtgag

SEQ ID NO: 5417965 - DNA, 19 bp, Homo sapiens
gagtgcatggccacagcca

SEQ ID NO: 5417966 - DNA, 19 bp, Homo sapiens
gagtgccacatggccgctg

SEQ ID NO: 5417967 - DNA, 14 bp, Homo sapiens
gagtgccaggacca

SEQ ID NO: 5417968 - DNA, 17 bp, Homo sapiens
gagtgccaggaccagcc

SEQ ID NO: 5417969 - DNA, 19 bp, Homo sapiens
gagtgccaggactccccag

SEQ ID NO: 5417970 - DNA, 20 bp, Homo sapiens
gagtgccaggactccccagg

SEQ ID NO: 5417971 - DNA, 16 bp, Homo sapiens
gagtgccatccctgag

SEQ ID NO: 5417972 - DNA, 14 bp, Homo sapiens
gagtgccatggctg

SEQ ID NO: 5417973 - DNA, 16 bp, Homo sapiens
gagtgcccagcagagg

SEQ ID NO: 5417974 - DNA, 19 bp, Homo sapiens
gagtgcccatggggtagaa

SEQ ID NO: 5417975 - DNA, 15 bp, Homo sapiens
gagtgccccacctgc

SEQ ID NO: 5417976 - DNA, 23 bp, Homo sapiens
gagtgccccattcttttgtaatt

SEQ ID NO: 5417977 - DNA, 22 bp, Homo sapiens
gagtgccctgcaggcacagagg

SEQ ID NO: 5417978 - DNA, 13 bp, Homo sapiens
gagtgccctgctt

SEQ ID NO: 5417979 - DNA, 19 bp, Homo sapiens
gagtgccctgctttgcaaa

SEQ ID NO: 5417980 - DNA, 22 bp, Homo sapiens
gagtgcctgcattcccaggaaa

SEQ ID NO: 5417981 - DNA, 16 bp, Homo sapiens
gagtgcctggagtcag

SEQ ID NO: 5417982 - DNA, 14 bp, Homo sapiens
gagtgccttctgtg

SEQ ID NO: 5417983 - DNA, 15 bp, Homo sapiens
gagtgccttctgtgg

SEQ ID NO: 5417984 - DNA, 18 bp, Homo sapiens
gagtgccttttgcagaag

SEQ ID NO: 5417985 - DNA, 23 bp, Homo sapiens
gagtgcgcagatctgtgcctggg

SEQ ID NO: 5417986 - DNA, 23 bp, Homo sapiens
gagtgcgctcttggtccctggtc

SEQ ID NO: 5417987 - DNA, 14 bp, Homo sapiens
gagtgcggcgtgga

SEQ ID NO: 5417988 - DNA, 16 bp, Homo sapiens
gagtgcggcgtggaga

SEQ ID NO: 5417989 - DNA, 18 bp, Homo sapiens
gagtgcggcgtggagact

SEQ ID NO: 5417990 - DNA, 19 bp, Homo sapiens
gagtgcgtctgaggggaca

SEQ ID NO: 5417991 - DNA, 14 bp, Homo sapiens
gagtgctaaatttt

SEQ ID NO: 5417992 - DNA, 19 bp, Homo sapiens
gagtgctaagcattagctt

SEQ ID NO: 5417993 - DNA, 14 bp, Homo sapiens
gagtgctctcactg

SEQ ID NO: 5417994 - DNA, 18 bp, Homo sapiens
gagtgctgaggccagggc

SEQ ID NO: 5417995 - DNA, 15 bp, Homo sapiens
gagtgctgcagcttt

SEQ ID NO: 5417996 - DNA, 23 bp, Homo sapiens
gagtgctgcagctttgggaaagc

SEQ ID NO: 5417997 - DNA, 18 bp, Homo sapiens
gagtgctgcttgtgcctc

SEQ ID NO: 5417998 - DNA, 23 bp, Homo sapiens
gagtgctggaatggggacctggg

SEQ ID NO: 5417999 - DNA, 13 bp, Homo sapiens
gagtgctggctcc

SEQ ID NO: 5418000 - DNA, 14 bp, Homo sapiens
gagtgctggctcca

SEQ ID NO: 5418001 - DNA, 19 bp, Homo sapiens
gagtgctgggcactgctcc

SEQ ID NO: 5418002 - DNA, 17 bp, Homo sapiens
gagtgctgtcgggacca

SEQ ID NO: 5418003 - DNA, 21 bp, Homo sapiens
gagtgctgtcgggaccacatc

SEQ ID NO: 5418004 - DNA, 19 bp, Homo sapiens
gagtgcttgcttttcatgc

SEQ ID NO: 5418005 - DNA, 19 bp, Homo sapiens
gagtggaagaagggaagcc

SEQ ID NO: 5418006 - DNA, 21 bp, Homo sapiens
gagtggaagggaggagcagca

SEQ ID NO: 5418007 - DNA, 21 bp, Homo sapiens
gagtggaatgcagggaagagg

SEQ ID NO: 5418008 - DNA, 17 bp, Homo sapiens
gagtggacaagtcatgg

SEQ ID NO: 5418009 - DNA, 16 bp, Homo sapiens
gagtggacaccgctca

SEQ ID NO: 5418010 - DNA, 12 bp, Homo sapiens
gagtggacagca

SEQ ID NO: 5418011 - DNA, 18 bp, Homo sapiens
gagtggacagcagctgga

SEQ ID NO: 5418012 - DNA, 20 bp, Homo sapiens
gagtggacagcagctggact

SEQ ID NO: 5418013 - DNA, 22 bp, Homo sapiens
gagtggaccacgacctcgtcca

SEQ ID NO: 5418014 - DNA, 17 bp, Homo sapiens
gagtggacctgtgctgt

SEQ ID NO: 5418015 - DNA, 13 bp, Homo sapiens
gagtggactcttc

SEQ ID NO: 5418016 - DNA, 15 bp, Homo sapiens
gagtggagagagcag

SEQ ID NO: 5418017 - DNA, 19 bp, Homo sapiens
gagtggagcaaatgcttaa

SEQ ID NO: 5418018 - DNA, 14 bp, Homo sapiens
gagtggagcccagg

SEQ ID NO: 5418019 - DNA, 16 bp, Homo sapiens
gagtggagcccagggt

SEQ ID NO: 5418020 - DNA, 13 bp, Homo sapiens
gagtggaggagga

SEQ ID NO: 5418021 - DNA, 18 bp, Homo sapiens
gagtggaggaggcctggg

SEQ ID NO: 5418022 - DNA, 13 bp, Homo sapiens
gagtggaggcatt

SEQ ID NO: 5418023 - DNA, 20 bp, Homo sapiens
gagtggaggtgggctgggcc

SEQ ID NO: 5418024 - DNA, 19 bp, Homo sapiens
gagtggaggttaaggctga

SEQ ID NO: 5418025 - DNA, 12 bp, Homo sapiens
gagtggagtctg

SEQ ID NO: 5418026 - DNA, 15 bp, Homo sapiens
gagtggagtctgagt

SEQ ID NO: 5418027 - DNA, 21 bp, Homo sapiens
gagtggagtctgccacccagg

SEQ ID NO: 5418028 - DNA, 14 bp, Homo sapiens
gagtggagttgaaa

SEQ ID NO: 5418029 - DNA, 16 bp, Homo sapiens
gagtggatagatgccc

SEQ ID NO: 5418030 - DNA, 16 bp, Homo sapiens
gagtggatgcctcaga

SEQ ID NO: 5418031 - DNA, 15 bp, Homo sapiens
gagtggattcctccc

SEQ ID NO: 5418032 - DNA, 17 bp, Homo sapiens
gagtggattcctcccca

SEQ ID NO: 5418033 - DNA, 17 bp, Homo sapiens
gagtggcacttctgcct

SEQ ID NO: 5418034 - DNA, 18 bp, Homo sapiens
gagtggcagccaagagcc

SEQ ID NO: 5418035 - DNA, 16 bp, Homo sapiens
gagtggcagccatgcc

SEQ ID NO: 5418036 - DNA, 24 bp, Homo sapiens
gagtggcagccatgcctcatgcca

SEQ ID NO: 5418037 - DNA, 16 bp, Homo sapiens
gagtggcagcccagcc

SEQ ID NO: 5418038 - DNA, 21 bp, Homo sapiens
gagtggcagcccagccagcgt

SEQ ID NO: 5418039 - DNA, 11 bp, Homo sapiens
gagtggcatgt

SEQ ID NO: 5418040 - DNA, 18 bp, Homo sapiens
gagtggcattggcagcag

SEQ ID NO: 5418041 - DNA, 20 bp, Homo sapiens
gagtggccaatccctgtgtg

SEQ ID NO: 5418042 - DNA, 13 bp, Homo sapiens
gagtggccacggc

SEQ ID NO: 5418043 - DNA, 21 bp, Homo sapiens
gagtggccacggcccagggag

SEQ ID NO: 5418044 - DNA, 11 bp, Homo sapiens
gagtggccagc

SEQ ID NO: 5418045 - DNA, 15 bp, Homo sapiens
gagtggccagcgcca

SEQ ID NO: 5418046 - DNA, 17 bp, Homo sapiens
gagtggccatttggggt

SEQ ID NO: 5418047 - DNA, 11 bp, Homo sapiens
gagtggcccac

SEQ ID NO: 5418048 - DNA, 21 bp, Homo sapiens
gagtggccccacctggccctc

SEQ ID NO: 5418049 - DNA, 13 bp, Homo sapiens
gagtggccctgat

SEQ ID NO: 5418050 - DNA, 15 bp, Homo sapiens
gagtggccggggaag

SEQ ID NO: 5418051 - DNA, 15 bp, Homo sapiens
gagtggcctagagca

SEQ ID NO: 5418052 - DNA, 16 bp, Homo sapiens
gagtggcctagagcac

SEQ ID NO: 5418053 - DNA, 16 bp, Homo sapiens
gagtggcctccctgct

SEQ ID NO: 5418054 - DNA, 10 bp, Homo sapiens
gagtggcctg

SEQ ID NO: 5418055 - DNA, 12 bp, Homo sapiens
gagtggcctggc

SEQ ID NO: 5418056 - DNA, 14 bp, Homo sapiens
gagtggcctggcca

SEQ ID NO: 5418057 - DNA, 15 bp, Homo sapiens
gagtggcctggccag

SEQ ID NO: 5418058 - DNA, 14 bp, Homo sapiens
gagtggcctgggtc

SEQ ID NO: 5418059 - DNA, 14 bp, Homo sapiens
gagtggcctgtgag

SEQ ID NO: 5418060 - DNA, 17 bp, Homo sapiens
gagtggcgagtccagac

SEQ ID NO: 5418061 - DNA, 19 bp, Homo sapiens
gagtggcgagtccagacac

SEQ ID NO: 5418062 - DNA, 22 bp, Homo sapiens
gagtggcggggcccctgctccg

SEQ ID NO: 5418063 - DNA, 14 bp, Homo sapiens
gagtggctcccgtg

SEQ ID NO: 5418064 - DNA, 13 bp, Homo sapiens
gagtggctcctcc

SEQ ID NO: 5418065 - DNA, 20 bp, Homo sapiens
gagtggctgaccaggccctg

SEQ ID NO: 5418066 - DNA, 14 bp, Homo sapiens
gagtggctgccgga

SEQ ID NO: 5418067 - DNA, 16 bp, Homo sapiens
gagtggctgccggagg

SEQ ID NO: 5418068 - DNA, 14 bp, Homo sapiens
gagtggctggggca

SEQ ID NO: 5418069 - DNA, 15 bp, Homo sapiens
gagtggcttcactcc

SEQ ID NO: 5418070 - DNA, 19 bp, Homo sapiens
gagtggcttcactcctgct

SEQ ID NO: 5418071 - DNA, 20 bp, Homo sapiens
gagtggcttcactcctgctg

SEQ ID NO: 5418072 - DNA, 21 bp, Homo sapiens
gagtggcttgtgattctggga

SEQ ID NO: 5418073 - DNA, 13 bp, Homo sapiens
gagtggctttcta

SEQ ID NO: 5418074 - DNA, 17 bp, Homo sapiens
gagtgggaaataaatca

SEQ ID NO: 5418075 - DNA, 13 bp, Homo sapiens
gagtgggaagccc

SEQ ID NO: 5418076 - DNA, 17 bp, Homo sapiens
gagtgggaaggacttgg

SEQ ID NO: 5418077 - DNA, 14 bp, Homo sapiens
gagtgggacagaca

SEQ ID NO: 5418078 - DNA, 16 bp, Homo sapiens
gagtgggacagacagc

SEQ ID NO: 5418079 - DNA, 18 bp, Homo sapiens
gagtgggacagagtctgg

SEQ ID NO: 5418080 - DNA, 11 bp, Homo sapiens
gagtgggagag

SEQ ID NO: 5418081 - DNA, 14 bp, Homo sapiens
gagtgggagaggaa

SEQ ID NO: 5418082 - DNA, 16 bp, Homo sapiens
gagtgggcacctcaga

SEQ ID NO: 5418083 - DNA, 13 bp, Homo sapiens
gagtgggcagagc

SEQ ID NO: 5418084 - DNA, 22 bp, Homo sapiens
gagtgggccctgcccggggagc

SEQ ID NO: 5418085 - DNA, 15 bp, Homo sapiens
gagtgggctctgagc

SEQ ID NO: 5418086 - DNA, 15 bp, Homo sapiens
gagtgggctgcctgg

SEQ ID NO: 5418087 - DNA, 22 bp, Homo sapiens
gagtgggctgggccctctgtcc

SEQ ID NO: 5418088 - DNA, 21 bp, Homo sapiens
gagtgggcttcggagtgaatg

SEQ ID NO: 5418089 - DNA, 19 bp, Homo sapiens
gagtggggagcggagcttg

SEQ ID NO: 5418090 - DNA, 22 bp, Homo sapiens
gagtggggcctgccctctgccc

SEQ ID NO: 5418091 - DNA, 23 bp, Homo sapiens
gagtggggcctgccctctgcccc

SEQ ID NO: 5418092 - DNA, 15 bp, Homo sapiens
gagtggggcctttgc

SEQ ID NO: 5418093 - DNA, 18 bp, Homo sapiens
gagtggggcctttgccag

SEQ ID NO: 5418094 - DNA, 23 bp, Homo sapiens
gagtggggctagactgggctggc

SEQ ID NO: 5418095 - DNA, 19 bp, Homo sapiens
gagtggggctggggaaagg

SEQ ID NO: 5418096 - DNA, 19 bp, Homo sapiens
gagtgggggagagcaggct

SEQ ID NO: 5418097 - DNA, 21 bp, Homo sapiens
gagtgggggctgtgccgtgaa

SEQ ID NO: 5418098 - DNA, 13 bp, Homo sapiens
gagtgggggtggg

SEQ ID NO: 5418099 - DNA, 13 bp, Homo sapiens
gagtgggtgaata

SEQ ID NO: 5418100 - DNA, 21 bp, Homo sapiens
gagtgggtgggacacagagac

SEQ ID NO: 5418101 - DNA, 14 bp, Homo sapiens
gagtgggtggggag

SEQ ID NO: 5418102 - DNA, 14 bp, Homo sapiens
gagtgggttggctt

SEQ ID NO: 5418103 - DNA, 16 bp, Homo sapiens
gagtggtaacagctct

SEQ ID NO: 5418104 - DNA, 17 bp, Homo sapiens
gagtggtcactggtcag

SEQ ID NO: 5418105 - DNA, 18 bp, Homo sapiens
gagtggtcactggtcagg

SEQ ID NO: 5418106 - DNA, 22 bp, Homo sapiens
gagtggtcactggtcagggcag

SEQ ID NO: 5418107 - DNA, 17 bp, Homo sapiens
gagtggtccacattctg

SEQ ID NO: 5418108 - DNA, 21 bp, Homo sapiens
gagtggtctttctggagaggt

SEQ ID NO: 5418109 - DNA, 14 bp, Homo sapiens
gagtggtgccctgg

SEQ ID NO: 5418110 - DNA, 13 bp, Homo sapiens
gagtggtggcagc

SEQ ID NO: 5418111 - DNA, 16 bp, Homo sapiens
gagtggttaggcagca

SEQ ID NO: 5418112 - DNA, 14 bp, Homo sapiens
gagtggttcctgtg

SEQ ID NO: 5418113 - DNA, 16 bp, Homo sapiens
gagtggttctcatttg

SEQ ID NO: 5418114 - DNA, 20 bp, Homo sapiens
gagtggttgggctgtgcctg

SEQ ID NO: 5418115 - DNA, 15 bp, Homo sapiens
gagtggttgttgcca

SEQ ID NO: 5418116 - DNA, 18 bp, Homo sapiens
gagtggtttcggaaaaaa

SEQ ID NO: 5418117 - DNA, 19 bp, Homo sapiens
gagtggtttcggaaaaaaa

SEQ ID NO: 5418118 - DNA, 14 bp, Homo sapiens
gagtgtaacaagaa

SEQ ID NO: 5418119 - DNA, 17 bp, Homo sapiens
gagtgtaatgtttgtta

SEQ ID NO: 5418120 - DNA, 19 bp, Homo sapiens
gagtgtacagacccctgcc

SEQ ID NO: 5418121 - DNA, 15 bp, Homo sapiens
gagtgtactcccagg

SEQ ID NO: 5418122 - DNA, 12 bp, Homo sapiens
gagtgtactgtg

SEQ ID NO: 5418123 - DNA, 13 bp, Homo sapiens
gagtgtactgtgc

SEQ ID NO: 5418124 - DNA, 15 bp, Homo sapiens
gagtgtagaagcatt

SEQ ID NO: 5418125 - DNA, 19 bp, Homo sapiens
gagtgtagcctaaagggca

SEQ ID NO: 5418126 - DNA, 21 bp, Homo sapiens
gagtgtagcctaaagggcagg

SEQ ID NO: 5418127 - DNA, 23 bp, Homo sapiens
gagtgtagcctaaagggcagggc

SEQ ID NO: 5418128 - DNA, 15 bp, Homo sapiens
gagtgtaggtgactt

SEQ ID NO: 5418129 - DNA, 17 bp, Homo sapiens
gagtgtagtcccggagg

SEQ ID NO: 5418130 - DNA, 13 bp, Homo sapiens
gagtgtatgtata

SEQ ID NO: 5418131 - DNA, 18 bp, Homo sapiens
gagtgtatgtatacacac

SEQ ID NO: 5418132 - DNA, 20 bp, Homo sapiens
gagtgtatgtatacacacac

SEQ ID NO: 5418133 - DNA, 12 bp, Homo sapiens
gagtgtatttta

SEQ ID NO: 5418134 - DNA, 22 bp, Homo sapiens
gagtgtattttttaaaattgat

SEQ ID NO: 5418135 - DNA, 18 bp, Homo sapiens
gagtgtcaaccagacaga

SEQ ID NO: 5418136 - DNA, 14 bp, Homo sapiens
gagtgtcccaagcc

SEQ ID NO: 5418137 - DNA, 20 bp, Homo sapiens
gagtgtccctttttgcaggg

SEQ ID NO: 5418138 - DNA, 14 bp, Homo sapiens
gagtgtcctgtctg

SEQ ID NO: 5418139 - DNA, 11 bp, Homo sapiens
gataacaaaga

SEQ ID NO: 5418140 - DNA, 18 bp, Homo sapiens
gataacaaagatatcttt

SEQ ID NO: 5418141 - DNA, 18 bp, Homo sapiens
gataacaagcaaggatat

SEQ ID NO: 5418142 - DNA, 22 bp, Homo sapiens
gataacaagtttaatataaagt

SEQ ID NO: 5418143 - DNA, 21 bp, Homo sapiens
gataacaccaccattcacaag

SEQ ID NO: 5418144 - DNA, 17 bp, Homo sapiens
gataacactggagtggt

SEQ ID NO: 5418145 - DNA, 15 bp, Homo sapiens
gataacagcctcttg

SEQ ID NO: 5418146 - DNA, 20 bp, Homo sapiens
gataacagctaccatgacaa

SEQ ID NO: 5418147 - DNA, 20 bp, Homo sapiens
gataacagggattgatttta

SEQ ID NO: 5418148 - DNA, 22 bp, Homo sapiens
gataacagggattgattttaaa

SEQ ID NO: 5418149 - DNA, 14 bp, Homo sapiens
gataacataaataa

SEQ ID NO: 5418150 - DNA, 15 bp, Homo sapiens
gataaccagctgtaa

SEQ ID NO: 5418151 - DNA, 15 bp, Homo sapiens
gataaccccaagaca

SEQ ID NO: 5418152 - DNA, 18 bp, Homo sapiens
gataaccccaggcactgt

SEQ ID NO: 5418153 - DNA, 21 bp, Homo sapiens
gataaccccaggcactgtttg

SEQ ID NO: 5418154 - DNA, 18 bp, Homo sapiens
gataacctaataattgta

SEQ ID NO: 5418155 - DNA, 17 bp, Homo sapiens
gataacctatatgattt

SEQ ID NO: 5418156 - DNA, 22 bp, Homo sapiens
gataacctgtacttcaagttaa

SEQ ID NO: 5418157 - DNA, 17 bp, Homo sapiens
gataacctgtttaagat

SEQ ID NO: 5418158 - DNA, 19 bp, Homo sapiens
gataaccttgtttattagc

SEQ ID NO: 5418159 - DNA, 17 bp, Homo sapiens
gataacgcaggagagag

SEQ ID NO: 5418160 - DNA, 21 bp, Homo sapiens
gataactaaggtgaagaatct

SEQ ID NO: 5418161 - DNA, 22 bp, Homo sapiens
gataactactgacgaaagagtc

SEQ ID NO: 5418162 - DNA, 20 bp, Homo sapiens
gataactagatggtgctgag

SEQ ID NO: 5418163 - DNA, 14 bp, Homo sapiens
gataactagccaga

SEQ ID NO: 5418164 - DNA, 18 bp, Homo sapiens
gataactatttacatata

SEQ ID NO: 5418165 - DNA, 17 bp, Homo sapiens
gataactctctttcctt

SEQ ID NO: 5418166 - DNA, 15 bp, Homo sapiens
gataactgctttgca

SEQ ID NO: 5418167 - DNA, 20 bp, Homo sapiens
gataacttccttgcccctgc

SEQ ID NO: 5418168 - DNA, 22 bp, Homo sapiens
gataacttccttgcccctgctc

SEQ ID NO: 5418169 - DNA, 15 bp, Homo sapiens
gataacttcttgaaa

SEQ ID NO: 5418170 - DNA, 19 bp, Homo sapiens
gataactttacagaaatgg

SEQ ID NO: 5418171 - DNA, 11 bp, Homo sapiens
gataagaaaag

SEQ ID NO: 5418172 - DNA, 14 bp, Homo sapiens
gataagaaataaga

SEQ ID NO: 5418173 - DNA, 22 bp, Homo sapiens
gataagaaccttttgagtgcct

SEQ ID NO: 5418174 - DNA, 23 bp, Homo sapiens
gataagaactttgcacacttcaa

SEQ ID NO: 5418175 - DNA, 21 bp, Homo sapiens
gataagaataaacgaggaaaa

SEQ ID NO: 5418176 - DNA, 19 bp, Homo sapiens
gataagaataggtcatttt

SEQ ID NO: 5418177 - DNA, 16 bp, Homo sapiens
gataagacattttgtt

SEQ ID NO: 5418178 - DNA, 21 bp, Homo sapiens
gataagacattttgtttttac

SEQ ID NO: 5418179 - DNA, 15 bp, Homo sapiens
gataagactggaaaa

SEQ ID NO: 5418180 - DNA, 21 bp, Homo sapiens
gataagacttgtttctttctg

SEQ ID NO: 5418181 - DNA, 16 bp, Homo sapiens
gataagagttggctgg

SEQ ID NO: 5418182 - DNA, 20 bp, Homo sapiens
gataagatcttttattttgc

SEQ ID NO: 5418183 - DNA, 21 bp, Homo sapiens
gataagattgaaattccagtt

SEQ ID NO: 5418184 - DNA, 13 bp, Homo sapiens
gataagcctgagc

SEQ ID NO: 5418185 - DNA, 15 bp, Homo sapiens
gataagcctgagcct

SEQ ID NO: 5418186 - DNA, 16 bp, Homo sapiens
gataagcttcaaagct

SEQ ID NO: 5418187 - DNA, 17 bp, Homo sapiens
gataaggaaactttatt

SEQ ID NO: 5418188 - DNA, 13 bp, Homo sapiens
gataaggaaatca

SEQ ID NO: 5418189 - DNA, 17 bp, Homo sapiens
gataaggaattatagac

SEQ ID NO: 5418190 - DNA, 16 bp, Homo sapiens
gataaggcaagccagt

SEQ ID NO: 5418191 - DNA, 14 bp, Homo sapiens
gataaggccgagcc

SEQ ID NO: 5418192 - DNA, 15 bp, Homo sapiens
gataaggcctgtggg

SEQ ID NO: 5418193 - DNA, 18 bp, Homo sapiens
gataagggagagggaaat

SEQ ID NO: 5418194 - DNA, 15 bp, Homo sapiens
gataaggggccttgc

SEQ ID NO: 5418195 - DNA, 23 bp, Homo sapiens
gataaggtacctttcacatagag

SEQ ID NO: 5418196 - DNA, 15 bp, Homo sapiens
gataaggtggcttct

SEQ ID NO: 5418197 - DNA, 16 bp, Homo sapiens
gataaggtggcttctc

SEQ ID NO: 5418198 - DNA, 12 bp, Homo sapiens
gataagtaatga

SEQ ID NO: 5418199 - DNA, 14 bp, Homo sapiens
gataagtggaaaaa

SEQ ID NO: 5418200 - DNA, 19 bp, Homo sapiens
gataagtggctgtttcatc

SEQ ID NO: 5418201 - DNA, 13 bp, Homo sapiens
gataagtgtaaat

SEQ ID NO: 5418202 - DNA, 14 bp, Homo sapiens
gataagtgttcttc

SEQ ID NO: 5418203 - DNA, 12 bp, Homo sapiens
gataagttcata

SEQ ID NO: 5418204 - DNA, 17 bp, Homo sapiens
gataagttggaaacact

SEQ ID NO: 5418205 - DNA, 18 bp, Homo sapiens
gataagttggagcagggg

SEQ ID NO: 5418206 - DNA, 22 bp, Homo sapiens
gataagtttctattctgtcagt

SEQ ID NO: 5418207 - DNA, 16 bp, Homo sapiens
gataagttttgtttca

SEQ ID NO: 5418208 - DNA, 13 bp, Homo sapiens
gataataaaaatt

SEQ ID NO: 5418209 - DNA, 14 bp, Homo sapiens
gataataaaattca

SEQ ID NO: 5418210 - DNA, 12 bp, Homo sapiens
gataataaagga

SEQ ID NO: 5418211 - DNA, 21 bp, Homo sapiens
gataataaatgcttcttaaag

SEQ ID NO: 5418212 - DNA, 19 bp, Homo sapiens
gataataacagcaccccat

SEQ ID NO: 5418213 - DNA, 21 bp, Homo sapiens
gataataaggaaaagtttaat

SEQ ID NO: 5418214 - DNA, 17 bp, Homo sapiens
gataataatattgtttt

SEQ ID NO: 5418215 - DNA, 20 bp, Homo sapiens
gataataatattgtttttct

SEQ ID NO: 5418216 - DNA, 19 bp, Homo sapiens
gataataatcatgatcaca

SEQ ID NO: 5418217 - DNA, 14 bp, Homo sapiens
gataatacaccact

SEQ ID NO: 5418218 - DNA, 20 bp, Homo sapiens
gataatacaggtaacattat

SEQ ID NO: 5418219 - DNA, 12 bp, Homo sapiens
gataatagattc

SEQ ID NO: 5418220 - DNA, 17 bp, Homo sapiens
gataatagcatttttgt

SEQ ID NO: 5418221 - DNA, 17 bp, Homo sapiens
gataatagggttttcag

SEQ ID NO: 5418222 - DNA, 19 bp, Homo sapiens
gataataggtagcctgctg

SEQ ID NO: 5418223 - DNA, 22 bp, Homo sapiens
gataataggtagcctgctgtgg

SEQ ID NO: 5418224 - DNA, 13 bp, Homo sapiens
gataataggtcat

SEQ ID NO: 5418225 - DNA, 19 bp, Homo sapiens
gataatagtaatggttcta

SEQ ID NO: 5418226 - DNA, 16 bp, Homo sapiens
gataatataaaaagca

SEQ ID NO: 5418227 - DNA, 17 bp, Homo sapiens
gataatatataaacaat

SEQ ID NO: 5418228 - DNA, 19 bp, Homo sapiens
gataatatataaacaataa

SEQ ID NO: 5418229 - DNA, 19 bp, Homo sapiens
gataatatatacaaacctt

SEQ ID NO: 5418230 - DNA, 14 bp, Homo sapiens
gataatatctgtga

SEQ ID NO: 5418231 - DNA, 14 bp, Homo sapiens
gataatatgtttag

SEQ ID NO: 5418232 - DNA, 13 bp, Homo sapiens
gataatatgtttg

SEQ ID NO: 5418233 - DNA, 23 bp, Homo sapiens
gataatattactgtttatttctg

SEQ ID NO: 5418234 - DNA, 19 bp, Homo sapiens
gataatattcattggttaa

SEQ ID NO: 5418235 - DNA, 21 bp, Homo sapiens
gataatattttacatacactg

SEQ ID NO: 5418236 - DNA, 17 bp, Homo sapiens
gataatcaactgggctg

SEQ ID NO: 5418237 - DNA, 21 bp, Homo sapiens
gataatcaactgggctgaaca

SEQ ID NO: 5418238 - DNA, 16 bp, Homo sapiens
gataatcagcctctta

SEQ ID NO: 5418239 - DNA, 17 bp, Homo sapiens
gataatctaaatataaa

SEQ ID NO: 5418240 - DNA, 19 bp, Homo sapiens
gataatctcagtgctttcc

SEQ ID NO: 5418241 - DNA, 22 bp, Homo sapiens
gataatcttcaggtgaacactt

SEQ ID NO: 5418242 - DNA, 15 bp, Homo sapiens
gataatcttcggcca

SEQ ID NO: 5418243 - DNA, 22 bp, Homo sapiens
gataatgataggtaatttagat

SEQ ID NO: 5418244 - DNA, 20 bp, Homo sapiens
gataatgcagataaatacat

SEQ ID NO: 5418245 - DNA, 13 bp, Homo sapiens
gataatgcatgaa

SEQ ID NO: 5418246 - DNA, 16 bp, Homo sapiens
gataatgcatgaagca

SEQ ID NO: 5418247 - DNA, 16 bp, Homo sapiens
gataatgccccaagga

SEQ ID NO: 5418248 - DNA, 18 bp, Homo sapiens
gataatgccccaaggaca

SEQ ID NO: 5418249 - DNA, 19 bp, Homo sapiens
gataatgctgttgcctcat

SEQ ID NO: 5418250 - DNA, 14 bp, Homo sapiens
gataatggagaatg

SEQ ID NO: 5418251 - DNA, 18 bp, Homo sapiens
gataatggataatcttcg

SEQ ID NO: 5418252 - DNA, 19 bp, Homo sapiens
gataatggtgaacatttta

SEQ ID NO: 5418253 - DNA, 21 bp, Homo sapiens
gataatgtgatattatacata

SEQ ID NO: 5418254 - DNA, 20 bp, Homo sapiens
gataatgtggattaaaacct

SEQ ID NO: 5418255 - DNA, 14 bp, Homo sapiens
gataatgttaaatt

SEQ ID NO: 5418256 - DNA, 21 bp, Homo sapiens
gataatgttaaatttgtaagt

SEQ ID NO: 5418257 - DNA, 17 bp, Homo sapiens
gataattaaatgaaata

SEQ ID NO: 5418258 - DNA, 18 bp, Homo sapiens
gataattaaatgaaatac

SEQ ID NO: 5418259 - DNA, 19 bp, Homo sapiens
gataattaaatgaaatact

SEQ ID NO: 5418260 - DNA, 14 bp, Homo sapiens
gataattaaccaag

SEQ ID NO: 5418261 - DNA, 23 bp, Homo sapiens
gataattaaccaaggtagaatga

SEQ ID NO: 5418262 - DNA, 20 bp, Homo sapiens
gataattaaggccagaggcc

SEQ ID NO: 5418263 - DNA, 15 bp, Homo sapiens
gataattacaataca

SEQ ID NO: 5418264 - DNA, 19 bp, Homo sapiens
gataattagatgattatat

SEQ ID NO: 5418265 - DNA, 21 bp, Homo sapiens
gataattagatgattatatat

SEQ ID NO: 5418266 - DNA, 13 bp, Homo sapiens
gataattatatca

SEQ ID NO: 5418267 - DNA, 15 bp, Homo sapiens
gataattcaacattt

SEQ ID NO: 5418268 - DNA, 13 bp, Homo sapiens
gataattcatttg

SEQ ID NO: 5418269 - DNA, 16 bp, Homo sapiens
gataattcatttgtat

SEQ ID NO: 5418270 - DNA, 13 bp, Homo sapiens
gataattccagtg

SEQ ID NO: 5418271 - DNA, 18 bp, Homo sapiens
gataattcgagcaaacaa

SEQ ID NO: 5418272 - DNA, 18 bp, Homo sapiens
gataattctagctttgag

SEQ ID NO: 5418273 - DNA, 18 bp, Homo sapiens
gataattgcattcatctt

SEQ ID NO: 5418274 - DNA, 14 bp, Homo sapiens
gataattgctattt

SEQ ID NO: 5418275 - DNA, 17 bp, Homo sapiens
gataattgtactttgaa

SEQ ID NO: 5418276 - DNA, 19 bp, Homo sapiens
gataattgtgtattttctt

SEQ ID NO: 5418277 - DNA, 22 bp, Homo sapiens
gataattgtgtattttctttgg

SEQ ID NO: 5418278 - DNA, 22 bp, Homo sapiens
gataatttagtggattaaccag

SEQ ID NO: 5418279 - DNA, 15 bp, Homo sapiens
gataatttatttcaa

SEQ ID NO: 5418280 - DNA, 16 bp, Homo sapiens
gataatttattttgta

SEQ ID NO: 5418281 - DNA, 12 bp, Homo sapiens
gataatttcagg

SEQ ID NO: 5418282 - DNA, 13 bp, Homo sapiens
gataatttgaaaa

SEQ ID NO: 5418283 - DNA, 12 bp, Homo sapiens
gataatttgcat

SEQ ID NO: 5418284 - DNA, 13 bp, Homo sapiens
gataatttgcata

SEQ ID NO: 5418285 - DNA, 22 bp, Homo sapiens
gataatttgcatattctattgt

SEQ ID NO: 5418286 - DNA, 12 bp, Homo sapiens
gataattttaaa

SEQ ID NO: 5418287 - DNA, 22 bp, Homo sapiens
gataattttatttataaactag

SEQ ID NO: 5418288 - DNA, 20 bp, Homo sapiens
gataattttcagctgcaagg

SEQ ID NO: 5418289 - DNA, 12 bp, Homo sapiens
gataattttgaa

SEQ ID NO: 5418290 - DNA, 18 bp, Homo sapiens
gataatttttaaaagagg

SEQ ID NO: 5418291 - DNA, 21 bp, Homo sapiens
gataatttttaaaagaggaaa

SEQ ID NO: 5418292 - DNA, 11 bp, Homo sapiens
gataatttttc

SEQ ID NO: 5418293 - DNA, 17 bp, Homo sapiens
gatacaaaagcatgtga

SEQ ID NO: 5418294 - DNA, 17 bp, Homo sapiens
gatacaaaagcttttta

SEQ ID NO: 5418295 - DNA, 16 bp, Homo sapiens
gatacaaatgtctatc

SEQ ID NO: 5418296 - DNA, 17 bp, Homo sapiens
gatacaaatgtctatca

SEQ ID NO: 5418297 - DNA, 19 bp, Homo sapiens
gatacaacctccctcttgt

SEQ ID NO: 5418298 - DNA, 21 bp, Homo sapiens
gatacaagaaaaagtagaaaa

SEQ ID NO: 5418299 - DNA, 15 bp, Homo sapiens
gatacaataaaacaa

SEQ ID NO: 5418300 - DNA, 16 bp, Homo sapiens
gatacaatcagctgct

SEQ ID NO: 5418301 - DNA, 13 bp, Homo sapiens
gatacaatgctgt

SEQ ID NO: 5418302 - DNA, 20 bp, Homo sapiens
gatacacaaagctttctttt

SEQ ID NO: 5418303 - DNA, 13 bp, Homo sapiens
gatacacacacac

SEQ ID NO: 5418304 - DNA, 22 bp, Homo sapiens
gatacacacatagtttcttttt

SEQ ID NO: 5418305 - DNA, 23 bp, Homo sapiens
gatacaccattatgtttaagata

SEQ ID NO: 5418306 - DNA, 20 bp, Homo sapiens
gatacactgaagttaacaga

SEQ ID NO: 5418307 - DNA, 14 bp, Homo sapiens
gatacactgcactt

SEQ ID NO: 5418308 - DNA, 13 bp, Homo sapiens
gatacactgcagc

SEQ ID NO: 5418309 - DNA, 22 bp, Homo sapiens
gatacagaagcccatgtcttct

SEQ ID NO: 5418310 - DNA, 23 bp, Homo sapiens
gatacagaagcccatgtcttctg

SEQ ID NO: 5418311 - DNA, 16 bp, Homo sapiens
gatacagacattcaat

SEQ ID NO: 5418312 - DNA, 16 bp, Homo sapiens
gatacagagtatattt

SEQ ID NO: 5418313 - DNA, 19 bp, Homo sapiens
gatacagccccaaaccagg

SEQ ID NO: 5418314 - DNA, 19 bp, Homo sapiens
gatacagctgagtgggaac

SEQ ID NO: 5418315 - DNA, 19 bp, Homo sapiens
gatacaggaaaagctgctg

SEQ ID NO: 5418316 - DNA, 20 bp, Homo sapiens
gatacaggaaaagctgctga

SEQ ID NO: 5418317 - DNA, 15 bp, Homo sapiens
gatatctgcatgtgt

SEQ ID NO: 5418318 - DNA, 21 bp, Homo sapiens
gatatctggcctaaaatcttg

SEQ ID NO: 5418319 - DNA, 20 bp, Homo sapiens
gatatctgtttgcttctaaa

SEQ ID NO: 5418320 - DNA, 16 bp, Homo sapiens
gatatcttcagaaaac

SEQ ID NO: 5418321 - DNA, 14 bp, Homo sapiens
gatatgaaaaatat

SEQ ID NO: 5418322 - DNA, 21 bp, Homo sapiens
gatatgaaactctacatttaa

SEQ ID NO: 5418323 - DNA, 23 bp, Homo sapiens
gatatgaaagagaaaatgctttc

SEQ ID NO: 5418324 - DNA, 15 bp, Homo sapiens
gatatgaaagctgat

SEQ ID NO: 5418325 - DNA, 23 bp, Homo sapiens
gatatgaacagggcccaggcctg

SEQ ID NO: 5418326 - DNA, 21 bp, Homo sapiens
gatatgaagaactattatatt

SEQ ID NO: 5418327 - DNA, 17 bp, Homo sapiens
gatatgaatatatggca

SEQ ID NO: 5418328 - DNA, 22 bp, Homo sapiens
gatatgagaaatataaaaataa

SEQ ID NO: 5418329 - DNA, 21 bp, Homo sapiens
gatatgagagggatgcagtgc

SEQ ID NO: 5418330 - DNA, 22 bp, Homo sapiens
gatatgagtatacaatatataa

SEQ ID NO: 5418331 - DNA, 14 bp, Homo sapiens
gatatgattcaaat

SEQ ID NO: 5418332 - DNA, 22 bp, Homo sapiens
gatatgattcaaatgtctataa

SEQ ID NO: 5418333 - DNA, 14 bp, Homo sapiens
gatatgattggcaa

SEQ ID NO: 5418334 - DNA, 15 bp, Homo sapiens
gatatgcaaaagctg

SEQ ID NO: 5418335 - DNA, 20 bp, Homo sapiens
gatatgcatgtagcatataa

SEQ ID NO: 5418336 - DNA, 23 bp, Homo sapiens
gatatgcatgtagcatataaatg

SEQ ID NO: 5418337 - DNA, 19 bp, Homo sapiens
gatatgccactaacttcta

SEQ ID NO: 5418338 - DNA, 14 bp, Homo sapiens
gatatgcgtattat

SEQ ID NO: 5418339 - DNA, 15 bp, Homo sapiens
gatatgctgagaaat

SEQ ID NO: 5418340 - DNA, 11 bp, Homo sapiens
gatatgctgct

SEQ ID NO: 5418341 - DNA, 12 bp, Homo sapiens
gatatgcttgta

SEQ ID NO: 5418342 - DNA, 19 bp, Homo sapiens
gatatggaaacagaagaca

SEQ ID NO: 5418343 - DNA, 22 bp, Homo sapiens
gatatggaaacagaagacaaaa

SEQ ID NO: 5418344 - DNA, 18 bp, Homo sapiens
gatatggaccatcagtga

SEQ ID NO: 5418345 - DNA, 13 bp, Homo sapiens
gatatggagaatt

SEQ ID NO: 5418346 - DNA, 15 bp, Homo sapiens
gatatggagccctgt

SEQ ID NO: 5418347 - DNA, 12 bp, Homo sapiens
gatatggcagga

SEQ ID NO: 5418348 - DNA, 19 bp, Homo sapiens
gatatggcaggactcctgg

SEQ ID NO: 5418349 - DNA, 21 bp, Homo sapiens
gatatggcattgcactgctta

SEQ ID NO: 5418350 - DNA, 12 bp, Homo sapiens
gatatggctgcc

SEQ ID NO: 5418351 - DNA, 15 bp, Homo sapiens
gatatggctgcccag

SEQ ID NO: 5418352 - DNA, 18 bp, Homo sapiens
gatatggctgcccaggag

SEQ ID NO: 5418353 - DNA, 19 bp, Homo sapiens
gatatggctgcccaggaga

SEQ ID NO: 5418354 - DNA, 20 bp, Homo sapiens
gatatggctgcccaggagac

SEQ ID NO: 5418355 - DNA, 13 bp, Homo sapiens
gatatgggactga

SEQ ID NO: 5418356 - DNA, 15 bp, Homo sapiens
gatatgggctttctc

SEQ ID NO: 5418357 - DNA, 16 bp, Homo sapiens
gatatgggtcctctgg

SEQ ID NO: 5418358 - DNA, 18 bp, Homo sapiens
gatatggtgaagggaagt

SEQ ID NO: 5418359 - DNA, 16 bp, Homo sapiens
gatatgtaaaacattt

SEQ ID NO: 5418360 - DNA, 18 bp, Homo sapiens
gatatgtaaaacatttat

SEQ ID NO: 5418361 - DNA, 19 bp, Homo sapiens
gatatgtaaaacatttatt

SEQ ID NO: 5418362 - DNA, 16 bp, Homo sapiens
gatatgtatatataca

SEQ ID NO: 5418363 - DNA, 18 bp, Homo sapiens
gatatgtatattttaata

SEQ ID NO: 5418364 - DNA, 23 bp, Homo sapiens
gatatgtatcataaaaataaaat

SEQ ID NO: 5418365 - DNA, 22 bp, Homo sapiens
gatatgtccagtcatcctgccc

SEQ ID NO: 5418366 - DNA, 15 bp, Homo sapiens
gatatgtctgctgag

SEQ ID NO: 5418367 - DNA, 15 bp, Homo sapiens
gatatgtgaaacaat

SEQ ID NO: 5418368 - DNA, 14 bp, Homo sapiens
gatatgtgaacagt

SEQ ID NO: 5418369 - DNA, 22 bp, Homo sapiens
gatatgtgccaaagtccattta

SEQ ID NO: 5418370 - DNA, 13 bp, Homo sapiens
gatatgtgtaata

SEQ ID NO: 5418371 - DNA, 16 bp, Homo sapiens
gatatgttatactgaa

SEQ ID NO: 5418372 - DNA, 17 bp, Homo sapiens
gatatgttgtattaact

SEQ ID NO: 5418373 - DNA, 13 bp, Homo sapiens
gatatgttttaaa

SEQ ID NO: 5418374 - DNA, 16 bp, Homo sapiens
gatattaaaaattgaa

SEQ ID NO: 5418375 - DNA, 13 bp, Homo sapiens
gatattaaaacac

SEQ ID NO: 5418376 - DNA, 13 bp, Homo sapiens
gatattaaaattt

SEQ ID NO: 5418377 - DNA, 19 bp, Homo sapiens
gatattaaaatttggtgct

SEQ ID NO: 5418378 - DNA, 20 bp, Homo sapiens
gatattaaaatttggtgctt

SEQ ID NO: 5418379 - DNA, 19 bp, Homo sapiens
gatattaaacgtgtaaatt

SEQ ID NO: 5418380 - DNA, 22 bp, Homo sapiens
gatattaaagattggaatgtgt

SEQ ID NO: 5418381 - DNA, 12 bp, Homo sapiens
gatattaaattc

SEQ ID NO: 5418382 - DNA, 19 bp, Homo sapiens
gatattaaattttttaaaa

SEQ ID NO: 5418383 - DNA, 22 bp, Homo sapiens
gatattaatttatcagattgct

SEQ ID NO: 5418384 - DNA, 19 bp, Homo sapiens
gatattacaatggccagcc

SEQ ID NO: 5418385 - DNA, 12 bp, Homo sapiens
gatattacttta

SEQ ID NO: 5418386 - DNA, 15 bp, Homo sapiens
gatattactttatca

SEQ ID NO: 5418387 - DNA, 22 bp, Homo sapiens
gatattactttatcactttttg

SEQ ID NO: 5418388 - DNA, 20 bp, Homo sapiens
gatattagttaatgagccat

SEQ ID NO: 5418389 - DNA, 18 bp, Homo sapiens
gatattataagggagagc

SEQ ID NO: 5418390 - DNA, 16 bp, Homo sapiens
gatattatattaaaca

SEQ ID NO: 5418391 - DNA, 18 bp, Homo sapiens
gatattatattaaacata

SEQ ID NO: 5418392 - DNA, 12 bp, Homo sapiens
gatattatctac

SEQ ID NO: 5418393 - DNA, 16 bp, Homo sapiens
gatattatgtataaaa

SEQ ID NO: 5418394 - DNA, 19 bp, Homo sapiens
gatattatgtatagaaaat

SEQ ID NO: 5418395 - DNA, 23 bp, Homo sapiens
gatattattagaaattagaaaaa

SEQ ID NO: 5418396 - DNA, 14 bp, Homo sapiens
gatattattttaaa

SEQ ID NO: 5418397 - DNA, 18 bp, Homo sapiens
gatattcaagcctttgga

SEQ ID NO: 5418398 - DNA, 15 bp, Homo sapiens
gatattcagatgtat

SEQ ID NO: 5418399 - DNA, 18 bp, Homo sapiens
gatattcatactttccaa

SEQ ID NO: 5418400 - DNA, 21 bp, Homo sapiens
gatattccaaaataaaaggac

SEQ ID NO: 5418401 - DNA, 21 bp, Homo sapiens
gatattccatagtatattaaa

SEQ ID NO: 5418402 - DNA, 18 bp, Homo sapiens
gatattccatgaatgtat

SEQ ID NO: 5418403 - DNA, 20 bp, Homo sapiens
gatattctactgtacttttt

SEQ ID NO: 5418404 - DNA, 18 bp, Homo sapiens
gatattctccctgacctt

SEQ ID NO: 5418405 - DNA, 16 bp, Homo sapiens
gatattctgttgcttt

SEQ ID NO: 5418406 - DNA, 20 bp, Homo sapiens
gatattcttatttcactaaa

SEQ ID NO: 5418407 - DNA, 20 bp, Homo sapiens
gatattcttctcttgcttta

SEQ ID NO: 5418408 - DNA, 18 bp, Homo sapiens
gatattctttgttaattt

SEQ ID NO: 5418409 - DNA, 15 bp, Homo sapiens
gatattgaaggaatt

SEQ ID NO: 5418410 - DNA, 23 bp, Homo sapiens
gatattgaggccaagaatattgc

SEQ ID NO: 5418411 - DNA, 17 bp, Homo sapiens
gatattgctaattgtgt

SEQ ID NO: 5418412 - DNA, 21 bp, Homo sapiens
gatattgctactataatcaaa

SEQ ID NO: 5418413 - DNA, 17 bp, Homo sapiens
gatattgggacacacat

SEQ ID NO: 5418414 - DNA, 19 bp, Homo sapiens
gatattggttctatttatt

SEQ ID NO: 5418415 - DNA, 16 bp, Homo sapiens
gatattggttcttccc

SEQ ID NO: 5418416 - DNA, 15 bp, Homo sapiens
gatattgtacataaa

SEQ ID NO: 5418417 - DNA, 16 bp, Homo sapiens
gatattgtatgtacct

SEQ ID NO: 5418418 - DNA, 13 bp, Homo sapiens
gatattgtgaaca

SEQ ID NO: 5418419 - DNA, 21 bp, Homo sapiens
gatattgtgaacatttgtgat

SEQ ID NO: 5418420 - DNA, 16 bp, Homo sapiens
gatattgtgaagtaca

SEQ ID NO: 5418421 - DNA, 17 bp, Homo sapiens
gatattgtgaagtacat

SEQ ID NO: 5418422 - DNA, 12 bp, Homo sapiens
gatattgtgcat

SEQ ID NO: 5418423 - DNA, 17 bp, Homo sapiens
gatattgttataaataa

SEQ ID NO: 5418424 - DNA, 18 bp, Homo sapiens
gatattgttataaataaa

SEQ ID NO: 5418425 - DNA, 21 bp, Homo sapiens
gatattgttataaataaaatt

SEQ ID NO: 5418426 - DNA, 18 bp, Homo sapiens
gatattgtttaaaattca

SEQ ID NO: 5418427 - DNA, 19 bp, Homo sapiens
gatattgtttaaaattcag

SEQ ID NO: 5418428 - DNA, 22 bp, Homo sapiens
gatattgttttctgtaaataac

SEQ ID NO: 5418429 - DNA, 13 bp, Homo sapiens
gatatttaaaaga

SEQ ID NO: 5418430 - DNA, 16 bp, Homo sapiens
gatatttaagaaaata

SEQ ID NO: 5418431 - DNA, 13 bp, Homo sapiens
gatatttaattat

SEQ ID NO: 5418432 - DNA, 22 bp, Homo sapiens
gatatttaattcacctcagcct

SEQ ID NO: 5418433 - DNA, 14 bp, Homo sapiens
gatatttatagaac

SEQ ID NO: 5418434 - DNA, 16 bp, Homo sapiens
gatatttatatatatt

SEQ ID NO: 5418435 - DNA, 19 bp, Homo sapiens
gatatttatatgttattaa

SEQ ID NO: 5418436 - DNA, 20 bp, Homo sapiens
gatatttatatgttattaaa

SEQ ID NO: 5418437 - DNA, 19 bp, Homo sapiens
gatatttattgagtgccca

SEQ ID NO: 5418438 - DNA, 15 bp, Homo sapiens
gatatttatttcctg

SEQ ID NO: 5418439 - DNA, 21 bp, Homo sapiens
gatatttcaaatgattatgat

SEQ ID NO: 5418440 - DNA, 12 bp, Homo sapiens
gatatttcaatc

SEQ ID NO: 5418441 - DNA, 11 bp, Homo sapiens
gatatttcatg

SEQ ID NO: 5418442 - DNA, 22 bp, Homo sapiens
gatatttccctcccctggggac

SEQ ID NO: 5418443 - DNA, 19 bp, Homo sapiens
gatatttcgaccctggggc

SEQ ID NO: 5418444 - DNA, 21 bp, Homo sapiens
gatatttctacaaggtgttca

SEQ ID NO: 5418445 - DNA, 23 bp, Homo sapiens
gatatttctatttcctggaatgg

SEQ ID NO: 5418446 - DNA, 17 bp, Homo sapiens
gatatttctctagtagt

SEQ ID NO: 5418447 - DNA, 21 bp, Homo sapiens
gatatttctgtgtagtattta

SEQ ID NO: 5418448 - DNA, 13 bp, Homo sapiens
gatatttcttgct

SEQ ID NO: 5418449 - DNA, 13 bp, Homo sapiens
gatatttgcacta

SEQ ID NO: 5418450 - DNA, 20 bp, Homo sapiens
gatatttgcagtttttcatt

SEQ ID NO: 5418451 - DNA, 14 bp, Homo sapiens
gatatttgcattga

SEQ ID NO: 5418452 - DNA, 21 bp, Homo sapiens
gatatttgctggagtgctggc

SEQ ID NO: 5418453 - DNA, 14 bp, Homo sapiens
gatatttggcttaa

SEQ ID NO: 5418454 - DNA, 18 bp, Homo sapiens
gatatttggcttaaatat

SEQ ID NO: 5418455 - DNA, 20 bp, Homo sapiens
gatatttgtatttattcttt

SEQ ID NO: 5418456 - DNA, 21 bp, Homo sapiens
gatatttgtatttatttccag

SEQ ID NO: 5418457 - DNA, 22 bp, Homo sapiens
gatatttgtcatgctgggattt

SEQ ID NO: 5418458 - DNA, 15 bp, Homo sapiens
gatattttatatgta

SEQ ID NO: 5418459 - DNA, 19 bp, Homo sapiens
gatattttcaacgcagccc

SEQ ID NO: 5418460 - DNA, 13 bp, Homo sapiens
gatattttcacag

SEQ ID NO: 5418461 - DNA, 13 bp, Homo sapiens
gatattttccata

SEQ ID NO: 5418462 - DNA, 14 bp, Homo sapiens
gatattttccatat

SEQ ID NO: 5418463 - DNA, 14 bp, Homo sapiens
gatattttcttaaa

SEQ ID NO: 5418464 - DNA, 14 bp, Homo sapiens
gatattttgcacga

SEQ ID NO: 5418465 - DNA, 15 bp, Homo sapiens
gatattttgctttgt

SEQ ID NO: 5418466 - DNA, 16 bp, Homo sapiens
gatattttgctttgtg

SEQ ID NO: 5418467 - DNA, 20 bp, Homo sapiens
gatattttgggtatattttc

SEQ ID NO: 5418468 - DNA, 22 bp, Homo sapiens
gatatttttaaagatctgtaag

SEQ ID NO: 5418469 - DNA, 11 bp, Homo sapiens
gatatttttat

SEQ ID NO: 5418470 - DNA, 16 bp, Homo sapiens
gatatttttatgtgca

SEQ ID NO: 5418471 - DNA, 17 bp, Homo sapiens
gatatttttatgtgcag

SEQ ID NO: 5418472 - DNA, 14 bp, Homo sapiens
gatatttttattca

SEQ ID NO: 5418473 - DNA, 20 bp, Homo sapiens
gatatttttattcaaactac

SEQ ID NO: 5418474 - DNA, 15 bp, Homo sapiens
gatatttttccattt

SEQ ID NO: 5418475 - DNA, 18 bp, Homo sapiens
gatatttttccatttttt

SEQ ID NO: 5418476 - DNA, 12 bp, Homo sapiens
gatatttttgta

SEQ ID NO: 5418477 - DNA, 17 bp, Homo sapiens
gatatttttgtacttga

SEQ ID NO: 5418478 - DNA, 16 bp, Homo sapiens
gatcaaaaactatttg

SEQ ID NO: 5418479 - DNA, 14 bp, Homo sapiens
gatcaaaaaggctt

SEQ ID NO: 5418480 - DNA, 15 bp, Homo sapiens
gatcaaaaataaact

SEQ ID NO: 5418481 - DNA, 16 bp, Homo sapiens
gatcaaaaccttcctt

SEQ ID NO: 5418482 - DNA, 23 bp, Homo sapiens
gatcaaaaggttaataaagtaat

SEQ ID NO: 5418483 - DNA, 22 bp, Homo sapiens
gatcaaaataaaaagtgacaca

SEQ ID NO: 5418484 - DNA, 20 bp, Homo sapiens
gatcaaaatgcatacgtatt

SEQ ID NO: 5418485 - DNA, 17 bp, Homo sapiens
gatcaaacctttctggc

SEQ ID NO: 5418486 - DNA, 16 bp, Homo sapiens
gatcaaagacacacag

SEQ ID NO: 5418487 - DNA, 16 bp, Homo sapiens
gatcaaagcaccttga

SEQ ID NO: 5418488 - DNA, 17 bp, Homo sapiens
gatcaaagctaggaaag

SEQ ID NO: 5418489 - DNA, 23 bp, Homo sapiens
gatcaaagctaggaaaggcagaa

SEQ ID NO: 5418490 - DNA, 14 bp, Homo sapiens
gatcaaagttcctg

SEQ ID NO: 5418491 - DNA, 16 bp, Homo sapiens
gatcaaagttcctgtt

SEQ ID NO: 5418492 - DNA, 14 bp, Homo sapiens
gatcaaataactta

SEQ ID NO: 5418493 - DNA, 23 bp, Homo sapiens
gatcaaataacttagggccaagt

SEQ ID NO: 5418494 - DNA, 16 bp, Homo sapiens
gatcaaatactttaaa

SEQ ID NO: 5418495 - DNA, 18 bp, Homo sapiens
gatgtctacagaaaatgc

SEQ ID NO: 5418496 - DNA, 21 bp, Homo sapiens
gatgtctagataacattcatg

SEQ ID NO: 5418497 - DNA, 15 bp, Homo sapiens
gatgtctcagagcct

SEQ ID NO: 5418498 - DNA, 20 bp, Homo sapiens
gatgtctcagagccttccat

SEQ ID NO: 5418499 - DNA, 14 bp, Homo sapiens
gatgtctccagatt

SEQ ID NO: 5418500 - DNA, 17 bp, Homo sapiens
gatgtctcccctgccac

SEQ ID NO: 5418501 - DNA, 15 bp, Homo sapiens
gatgtctcctaagca

SEQ ID NO: 5418502 - DNA, 19 bp, Homo sapiens
gatgtctcctaagcacctg

SEQ ID NO: 5418503 - DNA, 23 bp, Homo sapiens
gatgtctcctcaagcctgtgggc

SEQ ID NO: 5418504 - DNA, 21 bp, Homo sapiens
gatgtctctggggcagatccc

SEQ ID NO: 5418505 - DNA, 15 bp, Homo sapiens
gatgtctcttggaaa

SEQ ID NO: 5418506 - DNA, 16 bp, Homo sapiens
gatgtctcttgtagaa

SEQ ID NO: 5418507 - DNA, 17 bp, Homo sapiens
gatgtctcttgtagaag

SEQ ID NO: 5418508 - DNA, 22 bp, Homo sapiens
gatgtctgagagaccatctcct

SEQ ID NO: 5418509 - DNA, 15 bp, Homo sapiens
gatgtctgcaaagga

SEQ ID NO: 5418510 - DNA, 21 bp, Homo sapiens
gatgtctgcaaaggagggcct

SEQ ID NO: 5418511 - DNA, 15 bp, Homo sapiens
gatgtctgtgtatac

SEQ ID NO: 5418512 - DNA, 18 bp, Homo sapiens
gatgtctgtgtatacata

SEQ ID NO: 5418513 - DNA, 14 bp, Homo sapiens
gatgtctgttgaaa

SEQ ID NO: 5418514 - DNA, 18 bp, Homo sapiens
gatgtcttatttttagat

SEQ ID NO: 5418515 - DNA, 12 bp, Homo sapiens
gatgtcttcatc

SEQ ID NO: 5418516 - DNA, 20 bp, Homo sapiens
gatgtcttcgtacagttctt

SEQ ID NO: 5418517 - DNA, 13 bp, Homo sapiens
gatgtcttctgcc

SEQ ID NO: 5418518 - DNA, 15 bp, Homo sapiens
gatgtcttctggtgt

SEQ ID NO: 5418519 - DNA, 19 bp, Homo sapiens
gatgtcttctggtgtcatg

SEQ ID NO: 5418520 - DNA, 12 bp, Homo sapiens
gatgtctttgtt

SEQ ID NO: 5418521 - DNA, 18 bp, Homo sapiens
gatgtcttttatagtgga

SEQ ID NO: 5418522 - DNA, 14 bp, Homo sapiens
gatgtcttttcttg

SEQ ID NO: 5418523 - DNA, 22 bp, Homo sapiens
gatgtgaaaataaagcagaagc

SEQ ID NO: 5418524 - DNA, 19 bp, Homo sapiens
gatgtgaaagataaatgat

SEQ ID NO: 5418525 - DNA, 14 bp, Homo sapiens
gatgtgaacacatc

SEQ ID NO: 5418526 - DNA, 13 bp, Homo sapiens
gatgtgaagaaat

SEQ ID NO: 5418527 - DNA, 15 bp, Homo sapiens
gatgtgaagataatt

SEQ ID NO: 5418528 - DNA, 21 bp, Homo sapiens
gatgtgaagataatttgcata

SEQ ID NO: 5418529 - DNA, 21 bp, Homo sapiens
gatgtgaagctcacactgatg

SEQ ID NO: 5418530 - DNA, 15 bp, Homo sapiens
gatgtgaaggacatg

SEQ ID NO: 5418531 - DNA, 21 bp, Homo sapiens
gatgtgaatactcttcccaca

SEQ ID NO: 5418532 - DNA, 23 bp, Homo sapiens
gatgtgaataggttatatgcaag

SEQ ID NO: 5418533 - DNA, 20 bp, Homo sapiens
gatgtgaattattgacactg

SEQ ID NO: 5418534 - DNA, 22 bp, Homo sapiens
gatgtgaattgcctgcagagag

SEQ ID NO: 5418535 - DNA, 16 bp, Homo sapiens
gatgtgagccccaggg

SEQ ID NO: 5418536 - DNA, 17 bp, Homo sapiens
gatgtgagccccagggg

SEQ ID NO: 5418537 - DNA, 16 bp, Homo sapiens
gatgtgatcaggcccc

SEQ ID NO: 5418538 - DNA, 20 bp, Homo sapiens
gatgtgatggaacacacaca

SEQ ID NO: 5418539 - DNA, 13 bp, Homo sapiens
gatgtgattattt

SEQ ID NO: 5418540 - DNA, 17 bp, Homo sapiens
gatgtgattcctgcatt

SEQ ID NO: 5418541 - DNA, 16 bp, Homo sapiens
gatgtgattgtggaat

SEQ ID NO: 5418542 - DNA, 16 bp, Homo sapiens
gatgtgcaaaatcact

SEQ ID NO: 5418543 - DNA, 12 bp, Homo sapiens
gatgtgcaagcg

SEQ ID NO: 5418544 - DNA, 17 bp, Homo sapiens
gatgtgcaatacatttt

SEQ ID NO: 5418545 - DNA, 14 bp, Homo sapiens
gatgtgcaattgat

SEQ ID NO: 5418546 - DNA, 14 bp, Homo sapiens
gatgtgcacccatg

SEQ ID NO: 5418547 - DNA, 19 bp, Homo sapiens
gatgtgcacgtaaagtact

SEQ ID NO: 5418548 - DNA, 15 bp, Homo sapiens
gatgtgcagcagatt

SEQ ID NO: 5418549 - DNA, 19 bp, Homo sapiens
gatgtgcaggaagaaaagc

SEQ ID NO: 5418550 - DNA, 15 bp, Homo sapiens
gatgtgcatctggcc

SEQ ID NO: 5418551 - DNA, 22 bp, Homo sapiens
gatgtgcatttcacctgtgaca

SEQ ID NO: 5418552 - DNA, 21 bp, Homo sapiens
gatgtgcatttttgtgaaatg

SEQ ID NO: 5418553 - DNA, 23 bp, Homo sapiens
gatgtgcatttttgtgaaatgaa

SEQ ID NO: 5418554 - DNA, 14 bp, Homo sapiens
gatgtgcccacagg

SEQ ID NO: 5418555 - DNA, 16 bp, Homo sapiens
gatgtgcccacaggga

SEQ ID NO: 5418556 - DNA, 19 bp, Homo sapiens
gatgtgcccacagggacca

SEQ ID NO: 5418557 - DNA, 14 bp, Homo sapiens
gatgtgcccagagt

SEQ ID NO: 5418558 - DNA, 15 bp, Homo sapiens
gatgtgcccagagta

SEQ ID NO: 5418559 - DNA, 17 bp, Homo sapiens
gatgtgcccagagtagc

SEQ ID NO: 5418560 - DNA, 20 bp, Homo sapiens
gatgtgcccagagtagccca

SEQ ID NO: 5418561 - DNA, 15 bp, Homo sapiens
gatgtgctcagccaa

SEQ ID NO: 5418562 - DNA, 21 bp, Homo sapiens
gatgtgctcccaccaggcagc

SEQ ID NO: 5418563 - DNA, 21 bp, Homo sapiens
gatgtgctgctgggaatggat

SEQ ID NO: 5418564 - DNA, 14 bp, Homo sapiens
gatgtgctggaggg

SEQ ID NO: 5418565 - DNA, 15 bp, Homo sapiens
gatgtgctggagggg

SEQ ID NO: 5418566 - DNA, 22 bp, Homo sapiens
gatgtgctggaggggtggccca

SEQ ID NO: 5418567 - DNA, 13 bp, Homo sapiens
gatgtgcttaaca

SEQ ID NO: 5418568 - DNA, 14 bp, Homo sapiens
gatgtgcttaacag

SEQ ID NO: 5418569 - DNA, 20 bp, Homo sapiens
gatgtgcttgttaactgagt

SEQ ID NO: 5418570 - DNA, 21 bp, Homo sapiens
gatgtgctttgcattcctaca

SEQ ID NO: 5418571 - DNA, 16 bp, Homo sapiens
gatgtgcttttctcca

SEQ ID NO: 5418572 - DNA, 23 bp, Homo sapiens
gatgtggaaaagccaagaggctg

SEQ ID NO: 5418573 - DNA, 14 bp, Homo sapiens
gatgtggaaagcac

SEQ ID NO: 5418574 - DNA, 17 bp, Homo sapiens
gatgtggaaatgaggtt

SEQ ID NO: 5418575 - DNA, 18 bp, Homo sapiens
gatgtggaatgcagtcct

SEQ ID NO: 5418576 - DNA, 20 bp, Homo sapiens
gatgtggacatgcacccgca

SEQ ID NO: 5418577 - DNA, 19 bp, Homo sapiens
gatgtggacgtcacgctcc

SEQ ID NO: 5418578 - DNA, 12 bp, Homo sapiens
gatgtggagcca

SEQ ID NO: 5418579 - DNA, 14 bp, Homo sapiens
gatgtggagccagg

SEQ ID NO: 5418580 - DNA, 18 bp, Homo sapiens
gatgtggagccaggcgtg

SEQ ID NO: 5418581 - DNA, 17 bp, Homo sapiens
gatgtggagctcctgct

SEQ ID NO: 5418582 - DNA, 14 bp, Homo sapiens
gatgtggaggaaga

SEQ ID NO: 5418583 - DNA, 18 bp, Homo sapiens
gatgtggaggaagagcca

SEQ ID NO: 5418584 - DNA, 23 bp, Homo sapiens
gatgtggagtgagaacagcattt

SEQ ID NO: 5418585 - DNA, 17 bp, Homo sapiens
gatgtggagtggggcag

SEQ ID NO: 5418586 - DNA, 13 bp, Homo sapiens
gatgtggatgaaa

SEQ ID NO: 5418587 - DNA, 19 bp, Homo sapiens
gatgtggatggaggtgatg

SEQ ID NO: 5418588 - DNA, 17 bp, Homo sapiens
gatgtggcactgcttga

SEQ ID NO: 5418589 - DNA, 14 bp, Homo sapiens
gatgtggcaggagg

SEQ ID NO: 5418590 - DNA, 15 bp, Homo sapiens
gatgtggcaggggca

SEQ ID NO: 5418591 - DNA, 16 bp, Homo sapiens
gatgtggcaggggcag

SEQ ID NO: 5418592 - DNA, 12 bp, Homo sapiens
gatgtggccctg

SEQ ID NO: 5418593 - DNA, 21 bp, Homo sapiens
gatgtggcttctggctcctcg

SEQ ID NO: 5418594 - DNA, 14 bp, Homo sapiens
gatgtgggaagaag

SEQ ID NO: 5418595 - DNA, 12 bp, Homo sapiens
gatgtgggcagc

SEQ ID NO: 5418596 - DNA, 14 bp, Homo sapiens
gatgtgggcagctt

SEQ ID NO: 5418597 - DNA, 13 bp, Homo sapiens
gatgtggggctga

SEQ ID NO: 5418598 - DNA, 19 bp, Homo sapiens
gatgtggggctgagctggg

SEQ ID NO: 5418599 - DNA, 21 bp, Homo sapiens
gatgtgggtaagaggagcaga

SEQ ID NO: 5418600 - DNA, 23 bp, Homo sapiens
gatgtgggtctttttctcttctg

SEQ ID NO: 5418601 - DNA, 14 bp, Homo sapiens
gatgtgggtgtcct

SEQ ID NO: 5418602 - DNA, 16 bp, Homo sapiens
gatgtggtcacagctg

SEQ ID NO: 5418603 - DNA, 15 bp, Homo sapiens
gatgtggtgaggcag

SEQ ID NO: 5418604 - DNA, 22 bp, Homo sapiens
gatgtggtgatactgagattgt

SEQ ID NO: 5418605 - DNA, 15 bp, Homo sapiens
gatgtggtgcctgag

SEQ ID NO: 5418606 - DNA, 16 bp, Homo sapiens
gatgtggttttcttaa

SEQ ID NO: 5418607 - DNA, 17 bp, Homo sapiens
gatgtgtaatttttctg

SEQ ID NO: 5418608 - DNA, 20 bp, Homo sapiens
gatgtgtaatttttctgtat

SEQ ID NO: 5418609 - DNA, 22 bp, Homo sapiens
gatgtgtacatcccatgtaaca

SEQ ID NO: 5418610 - DNA, 15 bp, Homo sapiens
gatgtgtatcagtgt

SEQ ID NO: 5418611 - DNA, 21 bp, Homo sapiens
gatgtgtcccccccaggcctt

SEQ ID NO: 5418612 - DNA, 19 bp, Homo sapiens
gatgtgtctgggagagcct

SEQ ID NO: 5418613 - DNA, 19 bp, Homo sapiens
gatgtgtgagcatcctgca

SEQ ID NO: 5418614 - DNA, 16 bp, Homo sapiens
gatgtgtgatttttag

SEQ ID NO: 5418615 - DNA, 13 bp, Homo sapiens
gatgtgtgcatgt

SEQ ID NO: 5418616 - DNA, 13 bp, Homo sapiens
gatgtgtgcccag

SEQ ID NO: 5418617 - DNA, 15 bp, Homo sapiens
gatgtgtgtgtgtgc

SEQ ID NO: 5418618 - DNA, 12 bp, Homo sapiens
gatgtgtgttga

SEQ ID NO: 5418619 - DNA, 14 bp, Homo sapiens
gatgtgtgttgata

SEQ ID NO: 5418620 - DNA, 18 bp, Homo sapiens
gatgtgtgttgcttctct

SEQ ID NO: 5418621 - DNA, 18 bp, Homo sapiens
gatgtgtgttgtcagcct

SEQ ID NO: 5418622 - DNA, 21 bp, Homo sapiens
gatgtgttcctccattttctt

SEQ ID NO: 5418623 - DNA, 15 bp, Homo sapiens
gatgtgttcctcctg

SEQ ID NO: 5418624 - DNA, 14 bp, Homo sapiens
gatgtgttcggttt

SEQ ID NO: 5418625 - DNA, 21 bp, Homo sapiens
gatgtgttcggttttgttgtt

SEQ ID NO: 5418626 - DNA, 16 bp, Homo sapiens
gatgtgttgcaaaggt

SEQ ID NO: 5418627 - DNA, 18 bp, Homo sapiens
gatgtgtttgctttctga

SEQ ID NO: 5418628 - DNA, 17 bp, Homo sapiens
gatgtgttttgttttgg

SEQ ID NO: 5418629 - DNA, 20 bp, Homo sapiens
gatgttaaagcatttccctg

SEQ ID NO: 5418630 - DNA, 22 bp, Homo sapiens
gatgttaacagtattttaagaa

SEQ ID NO: 5418631 - DNA, 14 bp, Homo sapiens
gatgttaaccagaa

SEQ ID NO: 5418632 - DNA, 21 bp, Homo sapiens
gatgttacaaggtgttgttaa

SEQ ID NO: 5418633 - DNA, 22 bp, Homo sapiens
gatgttacaaggtgttgttaaa

SEQ ID NO: 5418634 - DNA, 18 bp, Homo sapiens
gatgttacattaggaaga

SEQ ID NO: 5418635 - DNA, 21 bp, Homo sapiens
gatgttagcagacccagctta

SEQ ID NO: 5418636 - DNA, 16 bp, Homo sapiens
gatgttaggctgggcc

SEQ ID NO: 5418637 - DNA, 18 bp, Homo sapiens
gatgttagttttagaatt

SEQ ID NO: 5418638 - DNA, 16 bp, Homo sapiens
gatgttatatttttct

SEQ ID NO: 5418639 - DNA, 20 bp, Homo sapiens
gatgttatcttaacactgaa

SEQ ID NO: 5418640 - DNA, 17 bp, Homo sapiens
gatgttatttttgtatt

SEQ ID NO: 5418641 - DNA, 14 bp, Homo sapiens
gatgttcaaatatt

SEQ ID NO: 5418642 - DNA, 18 bp, Homo sapiens
gatgttcaatagaacatg

SEQ ID NO: 5418643 - DNA, 14 bp, Homo sapiens
gatgttcagagtgg

SEQ ID NO: 5418644 - DNA, 17 bp, Homo sapiens
gatgttcagcactgtcc

SEQ ID NO: 5418645 - DNA, 19 bp, Homo sapiens
gatgttcagcactgtccct

SEQ ID NO: 5418646 - DNA, 20 bp, Homo sapiens
gatgttccggcgtttatttc

SEQ ID NO: 5418647 - DNA, 14 bp, Homo sapiens
gatgttcctgggat

SEQ ID NO: 5418648 - DNA, 22 bp, Homo sapiens
gatgttccttaccaaggatttt

SEQ ID NO: 5418649 - DNA, 18 bp, Homo sapiens
gatgttctaaggctctga

SEQ ID NO: 5418650 - DNA, 19 bp, Homo sapiens
gatgttctaaggctctgag

SEQ ID NO: 5418651 - DNA, 20 bp, Homo sapiens
gatgttctaaggctctgaga

SEQ ID NO: 5418652 - DNA, 19 bp, Homo sapiens
gatgttctaagtctttcca

SEQ ID NO: 5418653 - DNA, 23 bp, Homo sapiens
gatgttctaggatagttgatgca

SEQ ID NO: 5418654 - DNA, 18 bp, Homo sapiens
gatgttgaaatatgcata

SEQ ID NO: 5418655 - DNA, 16 bp, Homo sapiens
gatgttgaggggagga

SEQ ID NO: 5418656 - DNA, 16 bp, Homo sapiens
gatgttgataatttca

SEQ ID NO: 5418657 - DNA, 23 bp, Homo sapiens
gatgttgatgcaatccttacaaa

SEQ ID NO: 5418658 - DNA, 15 bp, Homo sapiens
gatgttgccatgtgt

SEQ ID NO: 5418659 - DNA, 16 bp, Homo sapiens
gatgttgctaacagca

SEQ ID NO: 5418660 - DNA, 17 bp, Homo sapiens
gatgttgctgttcacag

SEQ ID NO: 5418661 - DNA, 19 bp, Homo sapiens
gatgttgcttctgaatcac

SEQ ID NO: 5418662 - DNA, 20 bp, Homo sapiens
gatgttgcttctgaatcact

SEQ ID NO: 5418663 - DNA, 16 bp, Homo sapiens
gatgttgcttttgaaa

SEQ ID NO: 5418664 - DNA, 19 bp, Homo sapiens
gatgttgcttttgaaaagt

SEQ ID NO: 5418665 - DNA, 15 bp, Homo sapiens
gatgttgtagaataa

SEQ ID NO: 5418666 - DNA, 19 bp, Homo sapiens
gatgttgtcattatgtaca

SEQ ID NO: 5418667 - DNA, 20 bp, Homo sapiens
gatgttgtgtattgtggttt

SEQ ID NO: 5418668 - DNA, 21 bp, Homo sapiens
gatgttgtgttagttaagaat

SEQ ID NO: 5418669 - DNA, 20 bp, Homo sapiens
gatgttgtttaacataaatt

SEQ ID NO: 5418670 - DNA, 17 bp, Homo sapiens
gatgttgtttgggagag

SEQ ID NO: 5418671 - DNA, 14 bp, Homo sapiens
gatgtttaaaacac

SEQ ID NO: 5418672 - DNA, 22 bp, Homo sapiens
gatgtttaaaacaccttctata

SEQ ID NO: 5418673 - DNA, 20 bp, Homo sapiens
gattccagttgcgtgtctgt

SEQ ID NO: 5418674 - DNA, 9 bp, Homo sapiens
gattccatc

SEQ ID NO: 5418675 - DNA, 16 bp, Homo sapiens
gattccatcaaagaga

SEQ ID NO: 5418676 - DNA, 14 bp, Homo sapiens
gattccatctcctt

SEQ ID NO: 5418677 - DNA, 15 bp, Homo sapiens
gattccatgctaagc

SEQ ID NO: 5418678 - DNA, 20 bp, Homo sapiens
gattccatgctaagcaagct

SEQ ID NO: 5418679 - DNA, 21 bp, Homo sapiens
gattccattccatggaaataa

SEQ ID NO: 5418680 - DNA, 20 bp, Homo sapiens
gattccattttatacaagaa

SEQ ID NO: 5418681 - DNA, 15 bp, Homo sapiens
gattcccaagctctg

SEQ ID NO: 5418682 - DNA, 17 bp, Homo sapiens
gattcccaagctctgct

SEQ ID NO: 5418683 - DNA, 18 bp, Homo sapiens
gattcccaagctctgctc

SEQ ID NO: 5418684 - DNA, 20 bp, Homo sapiens
gattcccaagctctgctcct

SEQ ID NO: 5418685 - DNA, 16 bp, Homo sapiens
gattcccaccaaggtc

SEQ ID NO: 5418686 - DNA, 21 bp, Homo sapiens
gattcccagagacaggaaaat

SEQ ID NO: 5418687 - DNA, 13 bp, Homo sapiens
gattcccagagag

SEQ ID NO: 5418688 - DNA, 13 bp, Homo sapiens
gattcccagagca

SEQ ID NO: 5418689 - DNA, 13 bp, Homo sapiens
gattcccaggagt

SEQ ID NO: 5418690 - DNA, 17 bp, Homo sapiens
gattcccaggatgagca

SEQ ID NO: 5418691 - DNA, 12 bp, Homo sapiens
gattcccaggcc

SEQ ID NO: 5418692 - DNA, 15 bp, Homo sapiens
gattcccaggccagg

SEQ ID NO: 5418693 - DNA, 18 bp, Homo sapiens
gattcccaggccaggctc

SEQ ID NO: 5418694 - DNA, 16 bp, Homo sapiens
gattcccaggccaggg

SEQ ID NO: 5418695 - DNA, 18 bp, Homo sapiens
gattcccaggccagggct

SEQ ID NO: 5418696 - DNA, 21 bp, Homo sapiens
gattcccataacataaaagtg

SEQ ID NO: 5418697 - DNA, 13 bp, Homo sapiens
gattcccattgaa

SEQ ID NO: 5418698 - DNA, 23 bp, Homo sapiens
gattcccattgaaaatgtaagta

SEQ ID NO: 5418699 - DNA, 19 bp, Homo sapiens
gattccccactcagccttt

SEQ ID NO: 5418700 - DNA, 17 bp, Homo sapiens
gattccccatctcaggc

SEQ ID NO: 5418701 - DNA, 20 bp, Homo sapiens
gattccccatctcaggccag

SEQ ID NO: 5418702 - DNA, 13 bp, Homo sapiens
gattcccccagcc

SEQ ID NO: 5418703 - DNA, 18 bp, Homo sapiens
gattccccctgccctgtg

SEQ ID NO: 5418704 - DNA, 19 bp, Homo sapiens
gattccccctgccctgtgc

SEQ ID NO: 5418705 - DNA, 15 bp, Homo sapiens
gattccccggagctg

SEQ ID NO: 5418706 - DNA, 21 bp, Homo sapiens
gattcccctggaccacacctc

SEQ ID NO: 5418707 - DNA, 14 bp, Homo sapiens
gattcccctgtgtc

SEQ ID NO: 5418708 - DNA, 15 bp, Homo sapiens
gattcccgcatggtt

SEQ ID NO: 5418709 - DNA, 19 bp, Homo sapiens
gattcccgtggctttgtgc

SEQ ID NO: 5418710 - DNA, 23 bp, Homo sapiens
gattccctctcccacccaaggag

SEQ ID NO: 5418711 - DNA, 19 bp, Homo sapiens
gattccctctcccaggccc

SEQ ID NO: 5418712 - DNA, 20 bp, Homo sapiens
gattccctctcccaggcccc

SEQ ID NO: 5418713 - DNA, 15 bp, Homo sapiens
gattccctgatttaa

SEQ ID NO: 5418714 - DNA, 16 bp, Homo sapiens
gattcccttccttctg

SEQ ID NO: 5418715 - DNA, 13 bp, Homo sapiens
gattcccttgtta

SEQ ID NO: 5418716 - DNA, 19 bp, Homo sapiens
gattcccttgttattcaac

SEQ ID NO: 5418717 - DNA, 21 bp, Homo sapiens
gattcctaaggcccagctgcc

SEQ ID NO: 5418718 - DNA, 22 bp, Homo sapiens
gattcctaatcactcagagcag

SEQ ID NO: 5418719 - DNA, 19 bp, Homo sapiens
gattcctacccctcttcca

SEQ ID NO: 5418720 - DNA, 20 bp, Homo sapiens
gattcctcacagccttggct

SEQ ID NO: 5418721 - DNA, 14 bp, Homo sapiens
gattcctccccacc

SEQ ID NO: 5418722 - DNA, 16 bp, Homo sapiens
gattcctccccaccct

SEQ ID NO: 5418723 - DNA, 17 bp, Homo sapiens
gattcctccccaccctg

SEQ ID NO: 5418724 - DNA, 14 bp, Homo sapiens
gattcctctaagat

SEQ ID NO: 5418725 - DNA, 22 bp, Homo sapiens
gattcctctcatttccagcttc

SEQ ID NO: 5418726 - DNA, 16 bp, Homo sapiens
gattcctctgctgcca

SEQ ID NO: 5418727 - DNA, 23 bp, Homo sapiens
gattcctctgtattgtgctgatt

SEQ ID NO: 5418728 - DNA, 20 bp, Homo sapiens
gattcctcttgcctctctca

SEQ ID NO: 5418729 - DNA, 12 bp, Homo sapiens
gattcctgaccc

SEQ ID NO: 5418730 - DNA, 15 bp, Homo sapiens
gattcctgagccagt

SEQ ID NO: 5418731 - DNA, 19 bp, Homo sapiens
gattcctgagctggcctgt

SEQ ID NO: 5418732 - DNA, 22 bp, Homo sapiens
gattcctgcatttttttacctt

SEQ ID NO: 5418733 - DNA, 12 bp, Homo sapiens
gattcctggctc

SEQ ID NO: 5418734 - DNA, 17 bp, Homo sapiens
gattcctgtaaatgtga

SEQ ID NO: 5418735 - DNA, 16 bp, Homo sapiens
gattccttcaattcaa

SEQ ID NO: 5418736 - DNA, 13 bp, Homo sapiens
gattccttcctgt

SEQ ID NO: 5418737 - DNA, 15 bp, Homo sapiens
gattccttcctgttc

SEQ ID NO: 5418738 - DNA, 15 bp, Homo sapiens
gattccttctctgaa

SEQ ID NO: 5418739 - DNA, 14 bp, Homo sapiens
gattccttcttgct

SEQ ID NO: 5418740 - DNA, 21 bp, Homo sapiens
gattcctttaacaacatgttt

SEQ ID NO: 5418741 - DNA, 15 bp, Homo sapiens
gattcctttcctgtg

SEQ ID NO: 5418742 - DNA, 16 bp, Homo sapiens
gattccttttcttgtt

SEQ ID NO: 5418743 - DNA, 20 bp, Homo sapiens
gattccttttgatggggaga

SEQ ID NO: 5418744 - DNA, 21 bp, Homo sapiens
gattcgagctatatttaagta

SEQ ID NO: 5418745 - DNA, 21 bp, Homo sapiens
gattcgaggtcctcctggcct

SEQ ID NO: 5418746 - DNA, 16 bp, Homo sapiens
gattcgatcttttcct

SEQ ID NO: 5418747 - DNA, 18 bp, Homo sapiens
gattcgcccaaagccaga

SEQ ID NO: 5418748 - DNA, 15 bp, Homo sapiens
gattcgcttttggta

SEQ ID NO: 5418749 - DNA, 16 bp, Homo sapiens
gattcggtatcccccc

SEQ ID NO: 5418750 - DNA, 16 bp, Homo sapiens
gattctaaaacattct

SEQ ID NO: 5418751 - DNA, 20 bp, Homo sapiens
gattctaaaacattctttaa

SEQ ID NO: 5418752 - DNA, 12 bp, Homo sapiens
gattctaaaatg

SEQ ID NO: 5418753 - DNA, 16 bp, Homo sapiens
gattctaaaatgtctc

SEQ ID NO: 5418754 - DNA, 17 bp, Homo sapiens
gattctaaacagatgtc

SEQ ID NO: 5418755 - DNA, 16 bp, Homo sapiens
gattctaaagattcta

SEQ ID NO: 5418756 - DNA, 17 bp, Homo sapiens
gattctaaaggggacag

SEQ ID NO: 5418757 - DNA, 24 bp, Homo sapiens
gattctaaaggggacagatcttga

SEQ ID NO: 5418758 - DNA, 16 bp, Homo sapiens
gattctaaattatgtg

SEQ ID NO: 5418759 - DNA, 15 bp, Homo sapiens
gattctaatgatgat

SEQ ID NO: 5418760 - DNA, 20 bp, Homo sapiens
gattctaccgtaattgcttt

SEQ ID NO: 5418761 - DNA, 14 bp, Homo sapiens
gattctactttaag

SEQ ID NO: 5418762 - DNA, 21 bp, Homo sapiens
gattctatattattatatata

SEQ ID NO: 5418763 - DNA, 21 bp, Homo sapiens
gattctatctacataagtcct

SEQ ID NO: 5418764 - DNA, 21 bp, Homo sapiens
gattctatgcctgtatttcca

SEQ ID NO: 5418765 - DNA, 20 bp, Homo sapiens
gattctatgttaatatttta

SEQ ID NO: 5418766 - DNA, 21 bp, Homo sapiens
gattctatgttaatattttat

SEQ ID NO: 5418767 - DNA, 21 bp, Homo sapiens
gattctatttaattgaaactc

SEQ ID NO: 5418768 - DNA, 21 bp, Homo sapiens
gattctatttatatgtacatg

SEQ ID NO: 5418769 - DNA, 17 bp, Homo sapiens
gattctcacctgccttc

SEQ ID NO: 5418770 - DNA, 22 bp, Homo sapiens
gattctcagggctggagcctgg

SEQ ID NO: 5418771 - DNA, 23 bp, Homo sapiens
gattctcagggctggagcctggg

SEQ ID NO: 5418772 - DNA, 12 bp, Homo sapiens
gattctcagggt

SEQ ID NO: 5418773 - DNA, 13 bp, Homo sapiens
gattctcataact

SEQ ID NO: 5418774 - DNA, 16 bp, Homo sapiens
gattctcatgcctcag

SEQ ID NO: 5418775 - DNA, 23 bp, Homo sapiens
gattctcatgtctcagcctcctc

SEQ ID NO: 5418776 - DNA, 17 bp, Homo sapiens
gattctcccgcctcagc

SEQ ID NO: 5418777 - DNA, 15 bp, Homo sapiens
gattctcctctccca

SEQ ID NO: 5418778 - DNA, 13 bp, Homo sapiens
gattctcctgcct

SEQ ID NO: 5418779 - DNA, 18 bp, Homo sapiens
gattctcctgcctcagcc

SEQ ID NO: 5418780 - DNA, 21 bp, Homo sapiens
gattctcgccccttccctctc

SEQ ID NO: 5418781 - DNA, 23 bp, Homo sapiens
gattctcgccccttccctctctc

SEQ ID NO: 5418782 - DNA, 22 bp, Homo sapiens
gattctctccattttggtgtct

SEQ ID NO: 5418783 - DNA, 21 bp, Homo sapiens
gattctctctccatttggaat

SEQ ID NO: 5418784 - DNA, 22 bp, Homo sapiens
gattctctggctgtaaggctct

SEQ ID NO: 5418785 - DNA, 12 bp, Homo sapiens
gattctctgtgg

SEQ ID NO: 5418786 - DNA, 13 bp, Homo sapiens
gattctcttaaat

SEQ ID NO: 5418787 - DNA, 13 bp, Homo sapiens
gattctcttctca

SEQ ID NO: 5418788 - DNA, 23 bp, Homo sapiens
gattctcttgcctcagcttcccc

SEQ ID NO: 5418789 - DNA, 22 bp, Homo sapiens
gattctctttaactgtgtgacc

SEQ ID NO: 5418790 - DNA, 23 bp, Homo sapiens
gattctgaaatttttttcctaag

SEQ ID NO: 5418791 - DNA, 21 bp, Homo sapiens
gattctgaagcttatgtttct

SEQ ID NO: 5418792 - DNA, 19 bp, Homo sapiens
gattctgacatttatattt

SEQ ID NO: 5418793 - DNA, 23 bp, Homo sapiens
gattctgaccttaaatgcaacca

SEQ ID NO: 5418794 - DNA, 14 bp, Homo sapiens
gattctgagagctg

SEQ ID NO: 5418795 - DNA, 20 bp, Homo sapiens
gattctgagcaaaggccctg

SEQ ID NO: 5418796 - DNA, 23 bp, Homo sapiens
gattctgagcaaaggccctgggt

SEQ ID NO: 5418797 - DNA, 17 bp, Homo sapiens
gattctgagcagtgcct

SEQ ID NO: 5418798 - DNA, 18 bp, Homo sapiens
gattctgagcagtgcctc

SEQ ID NO: 5418799 - DNA, 20 bp, Homo sapiens
gattctgagcagtgcctctt

SEQ ID NO: 5418800 - DNA, 19 bp, Homo sapiens
gattctgatttcagttttt

SEQ ID NO: 5418801 - DNA, 22 bp, Homo sapiens
gattctgatttcagtttttcat

SEQ ID NO: 5418802 - DNA, 23 bp, Homo sapiens
gattctgatttcagtttttcatt

SEQ ID NO: 5418803 - DNA, 15 bp, Homo sapiens
gattctgcagctgct

SEQ ID NO: 5418804 - DNA, 15 bp, Homo sapiens
gattctgcagtaaat

SEQ ID NO: 5418805 - DNA, 16 bp, Homo sapiens
gattctgcagtaaatc

SEQ ID NO: 5418806 - DNA, 13 bp, Homo sapiens
gattctgcctctc

SEQ ID NO: 5418807 - DNA, 12 bp, Homo sapiens
gattctgccttt

SEQ ID NO: 5418808 - DNA, 15 bp, Homo sapiens
gattctggaagcaaa

SEQ ID NO: 5418809 - DNA, 19 bp, Homo sapiens
gattctggataaagccact

SEQ ID NO: 5418810 - DNA, 22 bp, Homo sapiens
gattctggataaagccactgaa

SEQ ID NO: 5418811 - DNA, 23 bp, Homo sapiens
gattctggatggccgggctgctg

SEQ ID NO: 5418812 - DNA, 16 bp, Homo sapiens
gattctggctttaagc

SEQ ID NO: 5418813 - DNA, 20 bp, Homo sapiens
gattctggctttaagccttc

SEQ ID NO: 5418814 - DNA, 11 bp, Homo sapiens
gattctgggaa

SEQ ID NO: 5418815 - DNA, 16 bp, Homo sapiens
gattctgggaaaggtg

SEQ ID NO: 5418816 - DNA, 18 bp, Homo sapiens
gattctgggaaaggtgct

SEQ ID NO: 5418817 - DNA, 19 bp, Homo sapiens
gattctgggaaaggtgctc

SEQ ID NO: 5418818 - DNA, 21 bp, Homo sapiens
gattctgggaaaggtgctcaa

SEQ ID NO: 5418819 - DNA, 22 bp, Homo sapiens
gattctgggaaaggtgctcaaa

SEQ ID NO: 5418820 - DNA, 12 bp, Homo sapiens
gattctgggaag

SEQ ID NO: 5418821 - DNA, 22 bp, Homo sapiens
gattctgggaggcaagaaaagg

SEQ ID NO: 5418822 - DNA, 17 bp, Homo sapiens
gattctggttccagggt

SEQ ID NO: 5418823 - DNA, 12 bp, Homo sapiens
gattctgtacat

SEQ ID NO: 5418824 - DNA, 15 bp, Homo sapiens
gattctgtggaacaa

SEQ ID NO: 5418825 - DNA, 12 bp, Homo sapiens
gattctgtggct

SEQ ID NO: 5418826 - DNA, 14 bp, Homo sapiens
gattctgtgggcag

SEQ ID NO: 5418827 - DNA, 18 bp, Homo sapiens
gattctgtgggcagctgg

SEQ ID NO: 5418828 - DNA, 22 bp, Homo sapiens
gattctgtgggcagctggctct

SEQ ID NO: 5418829 - DNA, 16 bp, Homo sapiens
gattctgtgtattaac

SEQ ID NO: 5418830 - DNA, 18 bp, Homo sapiens
gattctgtgtcagagccc

SEQ ID NO: 5418831 - DNA, 22 bp, Homo sapiens
gattctgtgtcagagcccagcc

SEQ ID NO: 5418832 - DNA, 22 bp, Homo sapiens
gattctgtgtgttttcataata

SEQ ID NO: 5418833 - DNA, 19 bp, Homo sapiens
gattctgttaaaaaaataa

SEQ ID NO: 5418834 - DNA, 18 bp, Homo sapiens
gattctgttctacttgat

SEQ ID NO: 5418835 - DNA, 23 bp, Homo sapiens
gattctgtttattcttccagaat

SEQ ID NO: 5418836 - DNA, 21 bp, Homo sapiens
gattcttaacacagccttcct

SEQ ID NO: 5418837 - DNA, 23 bp, Homo sapiens
gattcttaacacagccttccttc

SEQ ID NO: 5418838 - DNA, 17 bp, Homo sapiens
gattcttaccctttctt

SEQ ID NO: 5418839 - DNA, 18 bp, Homo sapiens
gattcttatttgatggtg

SEQ ID NO: 5418840 - DNA, 19 bp, Homo sapiens
gattcttcccattctccat

SEQ ID NO: 5418841 - DNA, 18 bp, Homo sapiens
gattcttcccgctcccca

SEQ ID NO: 5418842 - DNA, 19 bp, Homo sapiens
gattcttcccgctccccac

SEQ ID NO: 5418843 - DNA, 21 bp, Homo sapiens
gattcttctgcttcagcctcc

SEQ ID NO: 5418844 - DNA, 18 bp, Homo sapiens
gattcttgattcctggct

SEQ ID NO: 5418845 - DNA, 15 bp, Homo sapiens
gattcttgtatttat

SEQ ID NO: 5418846 - DNA, 21 bp, Homo sapiens
gattcttgtatttattacaac

SEQ ID NO: 5418847 - DNA, 15 bp, Homo sapiens
gattcttgtgattga

SEQ ID NO: 5418848 - DNA, 17 bp, Homo sapiens
gattcttgtgcctcagc

SEQ ID NO: 5418849 - DNA, 19 bp, Homo sapiens
gatttccatattttatttt

SEQ ID NO: 5418850 - DNA, 17 bp, Homo sapiens
gatttccatcttaatgt

SEQ ID NO: 5418851 - DNA, 22 bp, Homo sapiens
gatttccatgggccccaccatt

SEQ ID NO: 5418852 - DNA, 19 bp, Homo sapiens
gatttccattgtgtggcct

SEQ ID NO: 5418853 - DNA, 20 bp, Homo sapiens
gatttcccactcagggctgg

SEQ ID NO: 5418854 - DNA, 20 bp, Homo sapiens
gatttcccatcccctgtggg

SEQ ID NO: 5418855 - DNA, 18 bp, Homo sapiens
gatttcccgtggccccag

SEQ ID NO: 5418856 - DNA, 15 bp, Homo sapiens
gatttccctaaaaat

SEQ ID NO: 5418857 - DNA, 23 bp, Homo sapiens
gatttccctccagagaaagcaca

SEQ ID NO: 5418858 - DNA, 16 bp, Homo sapiens
gatttccctgaagcta

SEQ ID NO: 5418859 - DNA, 14 bp, Homo sapiens
gatttcctaagctg

SEQ ID NO: 5418860 - DNA, 15 bp, Homo sapiens
gatttcctaagctgt

SEQ ID NO: 5418861 - DNA, 13 bp, Homo sapiens
gatttcctaatac

SEQ ID NO: 5418862 - DNA, 18 bp, Homo sapiens
gatttcctacagaaatac

SEQ ID NO: 5418863 - DNA, 16 bp, Homo sapiens
gatttcctagtggagt

SEQ ID NO: 5418864 - DNA, 17 bp, Homo sapiens
gatttcctattttaaaa

SEQ ID NO: 5418865 - DNA, 22 bp, Homo sapiens
gatttcctattttaaaaccatg

SEQ ID NO: 5418866 - DNA, 14 bp, Homo sapiens
gatttcctcttgaa

SEQ ID NO: 5418867 - DNA, 22 bp, Homo sapiens
gatttcctgctttgggaagccg

SEQ ID NO: 5418868 - DNA, 15 bp, Homo sapiens
gatttccttcaatgt

SEQ ID NO: 5418869 - DNA, 12 bp, Homo sapiens
gatttccttctt

SEQ ID NO: 5418870 - DNA, 15 bp, Homo sapiens
gatttccttgtgcaa

SEQ ID NO: 5418871 - DNA, 19 bp, Homo sapiens
gatttcctttatactgtga

SEQ ID NO: 5418872 - DNA, 20 bp, Homo sapiens
gatttcctttatactgtgaa

SEQ ID NO: 5418873 - DNA, 20 bp, Homo sapiens
gatttcctttctgtggtgag

SEQ ID NO: 5418874 - DNA, 14 bp, Homo sapiens
gatttcgtgtgccg

SEQ ID NO: 5418875 - DNA, 17 bp, Homo sapiens
gatttcgtgtgccgctg

SEQ ID NO: 5418876 - DNA, 16 bp, Homo sapiens
gatttctaacagtcct

SEQ ID NO: 5418877 - DNA, 15 bp, Homo sapiens
gatttctaagttaaa

SEQ ID NO: 5418878 - DNA, 12 bp, Homo sapiens
gatttctacaac

SEQ ID NO: 5418879 - DNA, 16 bp, Homo sapiens
gatttctacaactgat

SEQ ID NO: 5418880 - DNA, 15 bp, Homo sapiens
gatttctacctcagc

SEQ ID NO: 5418881 - DNA, 18 bp, Homo sapiens
gatttctacctcagcagc

SEQ ID NO: 5418882 - DNA, 23 bp, Homo sapiens
gatttctagaaagcctgttcccc

SEQ ID NO: 5418883 - DNA, 12 bp, Homo sapiens
gatttctagaat

SEQ ID NO: 5418884 - DNA, 18 bp, Homo sapiens
gatttctagcaggcagga

SEQ ID NO: 5418885 - DNA, 22 bp, Homo sapiens
gatttctagcagtatgtgtgct

SEQ ID NO: 5418886 - DNA, 15 bp, Homo sapiens
gatttctatggcttt

SEQ ID NO: 5418887 - DNA, 21 bp, Homo sapiens
gatttctcacactctaactgt

SEQ ID NO: 5418888 - DNA, 23 bp, Homo sapiens
gatttctcactatatatatttct

SEQ ID NO: 5418889 - DNA, 20 bp, Homo sapiens
gatttctcagtgatttccta

SEQ ID NO: 5418890 - DNA, 22 bp, Homo sapiens
gatttctcattgacttttataa

SEQ ID NO: 5418891 - DNA, 11 bp, Homo sapiens
gatttctccca

SEQ ID NO: 5418892 - DNA, 21 bp, Homo sapiens
gatttctctagaggctggcaa

SEQ ID NO: 5418893 - DNA, 10 bp, Homo sapiens
gatttctctg

SEQ ID NO: 5418894 - DNA, 11 bp, Homo sapiens
gatttctctga

SEQ ID NO: 5418895 - DNA, 20 bp, Homo sapiens
gatttctctgctcacagaag

SEQ ID NO: 5418896 - DNA, 16 bp, Homo sapiens
gatttctcttgggcag

SEQ ID NO: 5418897 - DNA, 16 bp, Homo sapiens
gatttctctttctctc

SEQ ID NO: 5418898 - DNA, 20 bp, Homo sapiens
gatttctgacatcaaaactt

SEQ ID NO: 5418899 - DNA, 11 bp, Homo sapiens
gatttctgatt

SEQ ID NO: 5418900 - DNA, 12 bp, Homo sapiens
gatttctgattt

SEQ ID NO: 5418901 - DNA, 13 bp, Homo sapiens
gatttctgctaag

SEQ ID NO: 5418902 - DNA, 12 bp, Homo sapiens
gatttctgggat

SEQ ID NO: 5418903 - DNA, 12 bp, Homo sapiens
gatttctggtct

SEQ ID NO: 5418904 - DNA, 18 bp, Homo sapiens
gatttctggttctgatgc

SEQ ID NO: 5418905 - DNA, 17 bp, Homo sapiens
gatttctgtaaactctg

SEQ ID NO: 5418906 - DNA, 14 bp, Homo sapiens
gatttctgttcagc

SEQ ID NO: 5418907 - DNA, 16 bp, Homo sapiens
gatttctgttgttatt

SEQ ID NO: 5418908 - DNA, 19 bp, Homo sapiens
gatttctgtttagataata

SEQ ID NO: 5418909 - DNA, 22 bp, Homo sapiens
gatttcttaatgtctgtcagaa

SEQ ID NO: 5418910 - DNA, 15 bp, Homo sapiens
gatttcttcagaatt

SEQ ID NO: 5418911 - DNA, 17 bp, Homo sapiens
gatttcttcgctgctct

SEQ ID NO: 5418912 - DNA, 21 bp, Homo sapiens
gatttcttgctaagctccagc

SEQ ID NO: 5418913 - DNA, 20 bp, Homo sapiens
gatttcttgtgatgtattct

SEQ ID NO: 5418914 - DNA, 17 bp, Homo sapiens
gatttctttagtgtcat

SEQ ID NO: 5418915 - DNA, 23 bp, Homo sapiens
gatttctttctttgcaccaaaga

SEQ ID NO: 5418916 - DNA, 15 bp, Homo sapiens
gatttctttgaatgt

SEQ ID NO: 5418917 - DNA, 16 bp, Homo sapiens
gatttcttttaaagaa

SEQ ID NO: 5418918 - DNA, 15 bp, Homo sapiens
gatttgaaaaacttt

SEQ ID NO: 5418919 - DNA, 16 bp, Homo sapiens
gatttgaaaaatataa

SEQ ID NO: 5418920 - DNA, 20 bp, Homo sapiens
gatttgaaaacaaacttctc

SEQ ID NO: 5418921 - DNA, 14 bp, Homo sapiens
gatttgaaaacacc

SEQ ID NO: 5418922 - DNA, 14 bp, Homo sapiens
gatttgaaaattgt

SEQ ID NO: 5418923 - DNA, 21 bp, Homo sapiens
gatttgaacaaattttctggt

SEQ ID NO: 5418924 - DNA, 13 bp, Homo sapiens
gatttgaacactt

SEQ ID NO: 5418925 - DNA, 18 bp, Homo sapiens
gatttgaaccatgaagtc

SEQ ID NO: 5418926 - DNA, 16 bp, Homo sapiens
gatttgaactcagatc

SEQ ID NO: 5418927 - DNA, 18 bp, Homo sapiens
gatttgaagaacatgtga

SEQ ID NO: 5418928 - DNA, 18 bp, Homo sapiens
gatttgaagatctgattt

SEQ ID NO: 5418929 - DNA, 20 bp, Homo sapiens
gatttgaagtggaaaaagaa

SEQ ID NO: 5418930 - DNA, 14 bp, Homo sapiens
gatttgaccaaatc

SEQ ID NO: 5418931 - DNA, 13 bp, Homo sapiens
gatttgacctcct

SEQ ID NO: 5418932 - DNA, 17 bp, Homo sapiens
gatttgacctcctccct

SEQ ID NO: 5418933 - DNA, 13 bp, Homo sapiens
gatttgactgttt

SEQ ID NO: 5418934 - DNA, 18 bp, Homo sapiens
gatttgactgtttttacc

SEQ ID NO: 5418935 - DNA, 14 bp, Homo sapiens
gatttgagaaattt

SEQ ID NO: 5418936 - DNA, 14 bp, Homo sapiens
gatttgagtttcct

SEQ ID NO: 5418937 - DNA, 17 bp, Homo sapiens
gatttgataacaagttt

SEQ ID NO: 5418938 - DNA, 21 bp, Homo sapiens
gatttgatgagttaactgtga

SEQ ID NO: 5418939 - DNA, 15 bp, Homo sapiens
gatttgatgctggag

SEQ ID NO: 5418940 - DNA, 15 bp, Homo sapiens
gatttgatgtaagtt

SEQ ID NO: 5418941 - DNA, 19 bp, Homo sapiens
gatttgatgtgactttttt

SEQ ID NO: 5418942 - DNA, 15 bp, Homo sapiens
gatttgattcatttt

SEQ ID NO: 5418943 - DNA, 21 bp, Homo sapiens
gatttgcaaatgcacatttgt

SEQ ID NO: 5418944 - DNA, 14 bp, Homo sapiens
gatttgcaacagca

SEQ ID NO: 5418945 - DNA, 16 bp, Homo sapiens
gatttgcaactttaga

SEQ ID NO: 5418946 - DNA, 14 bp, Homo sapiens
gatttgcaggattt

SEQ ID NO: 5418947 - DNA, 13 bp, Homo sapiens
gatttgcatggat

SEQ ID NO: 5418948 - DNA, 15 bp, Homo sapiens
gatttgcatggattt

SEQ ID NO: 5418949 - DNA, 18 bp, Homo sapiens
gatttgcatggattttgg

SEQ ID NO: 5418950 - DNA, 11 bp, Homo sapiens
gatttgcatgt

SEQ ID NO: 5418951 - DNA, 14 bp, Homo sapiens
gatttgccattcaa

SEQ ID NO: 5418952 - DNA, 22 bp, Homo sapiens
gatttgccattgtccaggaaag

SEQ ID NO: 5418953 - DNA, 17 bp, Homo sapiens
gatttgcccatttacac

SEQ ID NO: 5418954 - DNA, 12 bp, Homo sapiens
gatttgcctcac

SEQ ID NO: 5418955 - DNA, 14 bp, Homo sapiens
gatttgcctgcctg

SEQ ID NO: 5418956 - DNA, 15 bp, Homo sapiens
gatttgcctgtgcca

SEQ ID NO: 5418957 - DNA, 18 bp, Homo sapiens
gatttgcgtggaaatctc

SEQ ID NO: 5418958 - DNA, 23 bp, Homo sapiens
gatttgctcaatacctggcctca

SEQ ID NO: 5418959 - DNA, 15 bp, Homo sapiens
gatttgctgctcttc

SEQ ID NO: 5418960 - DNA, 11 bp, Homo sapiens
gatttgctgtt

SEQ ID NO: 5418961 - DNA, 12 bp, Homo sapiens
gatttggaaaaa

SEQ ID NO: 5418962 - DNA, 19 bp, Homo sapiens
gatttggaagagaggcacc

SEQ ID NO: 5418963 - DNA, 15 bp, Homo sapiens
gatttggaagggaaa

SEQ ID NO: 5418964 - DNA, 16 bp, Homo sapiens
gatttggaatacacat

SEQ ID NO: 5418965 - DNA, 22 bp, Homo sapiens
gatttggagatgtctctgtgtg

SEQ ID NO: 5418966 - DNA, 20 bp, Homo sapiens
gatttggcatgggacagacg

SEQ ID NO: 5418967 - DNA, 21 bp, Homo sapiens
gatttggccacactggggctg

SEQ ID NO: 5418968 - DNA, 14 bp, Homo sapiens
gatttggccaggcc

SEQ ID NO: 5418969 - DNA, 14 bp, Homo sapiens
gatttggctcgctg

SEQ ID NO: 5418970 - DNA, 17 bp, Homo sapiens
gatttggctcgctgtgg

SEQ ID NO: 5418971 - DNA, 15 bp, Homo sapiens
gatttgggaaccaag

SEQ ID NO: 5418972 - DNA, 18 bp, Homo sapiens
gatttggggcctcaagaa

SEQ ID NO: 5418973 - DNA, 20 bp, Homo sapiens
gatttggggctcagagtggg

SEQ ID NO: 5418974 - DNA, 13 bp, Homo sapiens
gatttggggtgga

SEQ ID NO: 5418975 - DNA, 18 bp, Homo sapiens
gatttggttgcactttag

SEQ ID NO: 5418976 - DNA, 24 bp, Homo sapiens
gatttggttgcactttagacattt

SEQ ID NO: 5418977 - DNA, 19 bp, Homo sapiens
gatttgtaacccactgaga

SEQ ID NO: 5418978 - DNA, 16 bp, Homo sapiens
gatttgtaatgagcac

SEQ ID NO: 5418979 - DNA, 16 bp, Homo sapiens
gatttgtaattacagg

SEQ ID NO: 5418980 - DNA, 17 bp, Homo sapiens
gatttgtacatattatc

SEQ ID NO: 5418981 - DNA, 11 bp, Homo sapiens
gatttgtacca

SEQ ID NO: 5418982 - DNA, 24 bp, Homo sapiens
gatttgtagagtcaatcatgtgtt

SEQ ID NO: 5418983 - DNA, 17 bp, Homo sapiens
gatttgtagcactgagg

SEQ ID NO: 5418984 - DNA, 19 bp, Homo sapiens
gatttgtagcactgagggt

SEQ ID NO: 5418985 - DNA, 23 bp, Homo sapiens
gatttgtaggaaggtctcattct

SEQ ID NO: 5418986 - DNA, 21 bp, Homo sapiens
gatttgtagtttgtcccattt

SEQ ID NO: 5418987 - DNA, 13 bp, Homo sapiens
gatttgtatattt

SEQ ID NO: 5418988 - DNA, 14 bp, Homo sapiens
gatttgtattaaaa

SEQ ID NO: 5418989 - DNA, 13 bp, Homo sapiens
gatttgtatttat

SEQ ID NO: 5418990 - DNA, 20 bp, Homo sapiens
gatttgtatttatattagag

SEQ ID NO: 5418991 - DNA, 17 bp, Homo sapiens
gatttgtcactgcttca

SEQ ID NO: 5418992 - DNA, 14 bp, Homo sapiens
gatttgtccaaaca

SEQ ID NO: 5418993 - DNA, 18 bp, Homo sapiens
gatttgtccttttatttc

SEQ ID NO: 5418994 - DNA, 13 bp, Homo sapiens
gatttgtctctga

SEQ ID NO: 5418995 - DNA, 15 bp, Homo sapiens
gatttgtcttccctt

SEQ ID NO: 5418996 - DNA, 16 bp, Homo sapiens
gatttgtcttcccttc

SEQ ID NO: 5418997 - DNA, 22 bp, Homo sapiens
gatttgtctttggtgaacattg

SEQ ID NO: 5418998 - DNA, 22 bp, Homo sapiens
gatttgtggggacctcagcctg

SEQ ID NO: 5418999 - DNA, 18 bp, Homo sapiens
gatttgttatggttacat

SEQ ID NO: 5419000 - DNA, 17 bp, Homo sapiens
gatttgttgattctctc

SEQ ID NO: 5419001 - DNA, 22 bp, Homo sapiens
gatttgttgccatgtgcacctt

SEQ ID NO: 5419002 - DNA, 16 bp, Homo sapiens
gatttgtttatttgca

SEQ ID NO: 5419003 - DNA, 18 bp, Homo sapiens
gatttgtttcttaatggg

SEQ ID NO: 5419004 - DNA, 17 bp, Homo sapiens
gatttgttttagaatga

SEQ ID NO: 5419005 - DNA, 14 bp, Homo sapiens
gatttgttttgaat

SEQ ID NO: 5419006 - DNA, 18 bp, Homo sapiens
gatttgtttttaaactgt

SEQ ID NO: 5419007 - DNA, 15 bp, Homo sapiens
gatttgtttttctct

SEQ ID NO: 5419008 - DNA, 17 bp, Homo sapiens
gattttaaaaaatcaat

SEQ ID NO: 5419009 - DNA, 17 bp, Homo sapiens
gattttaaaaatacatt

SEQ ID NO: 5419010 - DNA, 21 bp, Homo sapiens
gattttaaaatgtacatgtat

SEQ ID NO: 5419011 - DNA, 15 bp, Homo sapiens
gattttaaactagat

SEQ ID NO: 5419012 - DNA, 14 bp, Homo sapiens
gattttaaaggcag

SEQ ID NO: 5419013 - DNA, 13 bp, Homo sapiens
gattttaaatgct

SEQ ID NO: 5419014 - DNA, 14 bp, Homo sapiens
gattttaaatgtgt

SEQ ID NO: 5419015 - DNA, 16 bp, Homo sapiens
gattttaaatgtgtga

SEQ ID NO: 5419016 - DNA, 12 bp, Homo sapiens
gattttaacaat

SEQ ID NO: 5419017 - DNA, 14 bp, Homo sapiens
gattttaacaataa

SEQ ID NO: 5419018 - DNA, 17 bp, Homo sapiens
gattttaacaataacta

SEQ ID NO: 5419019 - DNA, 15 bp, Homo sapiens
gattttaacttaact

SEQ ID NO: 5419020 - DNA, 20 bp, Homo sapiens
gattttaacttaactgaaat

SEQ ID NO: 5419021 - DNA, 18 bp, Homo sapiens
gattttaagaatggtctc

SEQ ID NO: 5419022 - DNA, 19 bp, Homo sapiens
gattttaagtattgtttcc

SEQ ID NO: 5419023 - DNA, 21 bp, Homo sapiens
gattttaagtttctctgcaga

SEQ ID NO: 5419024 - DNA, 16 bp, Homo sapiens
gattttaatacattga

SEQ ID NO: 5419025 - DNA, 22 bp, Homo sapiens
gattttaatagggaatatatct

SEQ ID NO: 5419026 - DNA, 15 bp, Homo sapiens
gattttaattgtcat

SEQ ID NO: 5419027 - DNA, 19 bp, Homo sapiens
gattttaatttcaggaaaa

SEQ ID NO: 5419028 - DNA, 22 bp, Homo sapiens
gattttaattttatattcagtg

SEQ ID NO: 5419029 - DNA, 14 bp, Homo sapiens
gcaaagatcaaaat

SEQ ID NO: 5419030 - DNA, 15 bp, Homo sapiens
gcaaagatcaaaata

SEQ ID NO: 5419031 - DNA, 18 bp, Homo sapiens
gcaaagatcaaaataaaa

SEQ ID NO: 5419032 - DNA, 19 bp, Homo sapiens
gcaaagatctgtcctcagc

SEQ ID NO: 5419033 - DNA, 11 bp, Homo sapiens
gcaaagatgca

SEQ ID NO: 5419034 - DNA, 21 bp, Homo sapiens
gcaaagcaagggggaaggctg

SEQ ID NO: 5419035 - DNA, 21 bp, Homo sapiens
gcaaagcacccatttcaatgt

SEQ ID NO: 5419036 - DNA, 23 bp, Homo sapiens
gcaaagcactgacttctaagtaa

SEQ ID NO: 5419037 - DNA, 20 bp, Homo sapiens
gcaaagcatcggtcatgtgt

SEQ ID NO: 5419038 - DNA, 22 bp, Homo sapiens
gcaaagcatcggtcatgtgtgt

SEQ ID NO: 5419039 - DNA, 21 bp, Homo sapiens
gcaaagccacaaggctggcca

SEQ ID NO: 5419040 - DNA, 23 bp, Homo sapiens
gcaaagccacaaggctggccagc

SEQ ID NO: 5419041 - DNA, 11 bp, Homo sapiens
gcaaagccata

SEQ ID NO: 5419042 - DNA, 16 bp, Homo sapiens
gcaaagccatattcta

SEQ ID NO: 5419043 - DNA, 13 bp, Homo sapiens
gcaaagcccagct

SEQ ID NO: 5419044 - DNA, 18 bp, Homo sapiens
gcaaagccccatgctgga

SEQ ID NO: 5419045 - DNA, 19 bp, Homo sapiens
gcaaagcccccagagccca

SEQ ID NO: 5419046 - DNA, 23 bp, Homo sapiens
gcaaagcccccagagcccaggct

SEQ ID NO: 5419047 - DNA, 22 bp, Homo sapiens
gcaaagcccttggaacaccctg

SEQ ID NO: 5419048 - DNA, 14 bp, Homo sapiens
gcaaagcctccagc

SEQ ID NO: 5419049 - DNA, 16 bp, Homo sapiens
gcaaagcctccagcat

SEQ ID NO: 5419050 - DNA, 11 bp, Homo sapiens
gcaaagcctgt

SEQ ID NO: 5419051 - DNA, 12 bp, Homo sapiens
gcaaagcctgtt

SEQ ID NO: 5419052 - DNA, 17 bp, Homo sapiens
gcaaagctgctgggcca

SEQ ID NO: 5419053 - DNA, 18 bp, Homo sapiens
gcaaagctgttcttcctg

SEQ ID NO: 5419054 - DNA, 21 bp, Homo sapiens
gcaaagcttttgcctgcaaga

SEQ ID NO: 5419055 - DNA, 17 bp, Homo sapiens
gcaaaggaaaccaaagg

SEQ ID NO: 5419056 - DNA, 19 bp, Homo sapiens
gcaaaggaaaggggcaaaa

SEQ ID NO: 5419057 - DNA, 14 bp, Homo sapiens
gcaaaggaaatacc

SEQ ID NO: 5419058 - DNA, 23 bp, Homo sapiens
gcaaaggactgttttttcctgag

SEQ ID NO: 5419059 - DNA, 16 bp, Homo sapiens
gcaaaggagaaatctg

SEQ ID NO: 5419060 - DNA, 21 bp, Homo sapiens
gcaaaggagacaaagcaggag

SEQ ID NO: 5419061 - DNA, 14 bp, Homo sapiens
gcaaaggagggcaa

SEQ ID NO: 5419062 - DNA, 20 bp, Homo sapiens
gcaaaggaggggaaacaatg

SEQ ID NO: 5419063 - DNA, 17 bp, Homo sapiens
gcaaaggagtagaaaga

SEQ ID NO: 5419064 - DNA, 23 bp, Homo sapiens
gcaaaggatgtgttttcagtctt

SEQ ID NO: 5419065 - DNA, 13 bp, Homo sapiens
gcaaaggcagggc

SEQ ID NO: 5419066 - DNA, 15 bp, Homo sapiens
gcaaaggcagtcccg

SEQ ID NO: 5419067 - DNA, 20 bp, Homo sapiens
gcaaaggcccatgccccctt

SEQ ID NO: 5419068 - DNA, 13 bp, Homo sapiens
gcaaaggccctgg

SEQ ID NO: 5419069 - DNA, 15 bp, Homo sapiens
gcaaaggccctgggt

SEQ ID NO: 5419070 - DNA, 12 bp, Homo sapiens
gcaaaggccctt

SEQ ID NO: 5419071 - DNA, 14 bp, Homo sapiens
gcaaaggcccttgt

SEQ ID NO: 5419072 - DNA, 18 bp, Homo sapiens
gcaaaggcccttgtcatt

SEQ ID NO: 5419073 - DNA, 22 bp, Homo sapiens
gcaaaggcccttgtcattgcct

SEQ ID NO: 5419074 - DNA, 12 bp, Homo sapiens
gcaaaggcctgg

SEQ ID NO: 5419075 - DNA, 14 bp, Homo sapiens
gcaaaggcctgggc

SEQ ID NO: 5419076 - DNA, 16 bp, Homo sapiens
gcaaagggaaatcaag

SEQ ID NO: 5419077 - DNA, 16 bp, Homo sapiens
gcaaagggacattgaa

SEQ ID NO: 5419078 - DNA, 17 bp, Homo sapiens
gcaaagggacattgaag

SEQ ID NO: 5419079 - DNA, 15 bp, Homo sapiens
gcaaagggcatgggt

SEQ ID NO: 5419080 - DNA, 16 bp, Homo sapiens
gcaaagggccaggaag

SEQ ID NO: 5419081 - DNA, 16 bp, Homo sapiens
gcaaagggcgggcctg

SEQ ID NO: 5419082 - DNA, 19 bp, Homo sapiens
gcaaagggctgaaagccat

SEQ ID NO: 5419083 - DNA, 22 bp, Homo sapiens
gcaaagggctgaaagccatttg

SEQ ID NO: 5419084 - DNA, 13 bp, Homo sapiens
gcaaaggggacag

SEQ ID NO: 5419085 - DNA, 20 bp, Homo sapiens
gcaaaggggctgaaagaaca

SEQ ID NO: 5419086 - DNA, 16 bp, Homo sapiens
gcaaagggtgggtttg

SEQ ID NO: 5419087 - DNA, 19 bp, Homo sapiens
gcaaaggtgcactccagac

SEQ ID NO: 5419088 - DNA, 15 bp, Homo sapiens
gcaaaggtgcctcat

SEQ ID NO: 5419089 - DNA, 15 bp, Homo sapiens
gcaaaggttgggtct

SEQ ID NO: 5419090 - DNA, 16 bp, Homo sapiens
gcaaagtaaaattaga

SEQ ID NO: 5419091 - DNA, 16 bp, Homo sapiens
gcaaagtacaatgtgt

SEQ ID NO: 5419092 - DNA, 12 bp, Homo sapiens
gcaaagtactgt

SEQ ID NO: 5419093 - DNA, 22 bp, Homo sapiens
gcaaagtatcaaagaaaaacaa

SEQ ID NO: 5419094 - DNA, 16 bp, Homo sapiens
gcaaagtatccctact

SEQ ID NO: 5419095 - DNA, 19 bp, Homo sapiens
gcaaagtattgtgaaagta

SEQ ID NO: 5419096 - DNA, 21 bp, Homo sapiens
gcaaagtcatgcaaaggctgg

SEQ ID NO: 5419097 - DNA, 14 bp, Homo sapiens
gcaaagtctaaagt

SEQ ID NO: 5419098 - DNA, 22 bp, Homo sapiens
gcaaagtctaaagtttacagta

SEQ ID NO: 5419099 - DNA, 21 bp, Homo sapiens
gcaaagtctccagaagaaaat

SEQ ID NO: 5419100 - DNA, 13 bp, Homo sapiens
gcaaagtgcaaat

SEQ ID NO: 5419101 - DNA, 16 bp, Homo sapiens
gcaaagtgcaaatact

SEQ ID NO: 5419102 - DNA, 15 bp, Homo sapiens
gcaaagtgccctcat

SEQ ID NO: 5419103 - DNA, 21 bp, Homo sapiens
gcaaagtgctagccactggaa

SEQ ID NO: 5419104 - DNA, 12 bp, Homo sapiens
gcaaagtgctgg

SEQ ID NO: 5419105 - DNA, 13 bp, Homo sapiens
gcaaagtggcagg

SEQ ID NO: 5419106 - DNA, 18 bp, Homo sapiens
gcaaagtggcagggaccg

SEQ ID NO: 5419107 - DNA, 15 bp, Homo sapiens
gcaaagtggttccct

SEQ ID NO: 5419108 - DNA, 14 bp, Homo sapiens
gcaaagttatattt

SEQ ID NO: 5419109 - DNA, 13 bp, Homo sapiens
gcaaagttatctt

SEQ ID NO: 5419110 - DNA, 14 bp, Homo sapiens
gcaaagttatctta

SEQ ID NO: 5419111 - DNA, 20 bp, Homo sapiens
gcaaagtttaaatgtatttt

SEQ ID NO: 5419112 - DNA, 17 bp, Homo sapiens
gcaaagtttacagatgt

SEQ ID NO: 5419113 - DNA, 19 bp, Homo sapiens
gcaaagtttacagatgttt

SEQ ID NO: 5419114 - DNA, 14 bp, Homo sapiens
gcaaataaagcctt

SEQ ID NO: 5419115 - DNA, 20 bp, Homo sapiens
gcaaataaaggctctggaag

SEQ ID NO: 5419116 - DNA, 20 bp, Homo sapiens
gcaaataaatacgtgtcaaa

SEQ ID NO: 5419117 - DNA, 16 bp, Homo sapiens
gcaaataaggacagca

SEQ ID NO: 5419118 - DNA, 18 bp, Homo sapiens
gcaaataaggacagcagc

SEQ ID NO: 5419119 - DNA, 16 bp, Homo sapiens
gcaaataatggaaaaa

SEQ ID NO: 5419120 - DNA, 18 bp, Homo sapiens
gcaaataatggaaaaata

SEQ ID NO: 5419121 - DNA, 21 bp, Homo sapiens
gcaaataatggaaaaatagta

SEQ ID NO: 5419122 - DNA, 18 bp, Homo sapiens
gcaaatactgattttcaa

SEQ ID NO: 5419123 - DNA, 22 bp, Homo sapiens
gcaaatactgattttcaaaaaa

SEQ ID NO: 5419124 - DNA, 18 bp, Homo sapiens
gcaaatacttagcaaaaa

SEQ ID NO: 5419125 - DNA, 17 bp, Homo sapiens
gcaaatagaaaacagga

SEQ ID NO: 5419126 - DNA, 21 bp, Homo sapiens
gcaaatagattcagagaaatt

SEQ ID NO: 5419127 - DNA, 21 bp, Homo sapiens
gcaaatagccacaattatata

SEQ ID NO: 5419128 - DNA, 13 bp, Homo sapiens
gcaaatatatgat

SEQ ID NO: 5419129 - DNA, 15 bp, Homo sapiens
gcaaatatgtttgca

SEQ ID NO: 5419130 - DNA, 19 bp, Homo sapiens
gcaaatattatccagcaag

SEQ ID NO: 5419131 - DNA, 15 bp, Homo sapiens
gcaaatattgaagtt

SEQ ID NO: 5419132 - DNA, 18 bp, Homo sapiens
gcaaatattgaagttgtt

SEQ ID NO: 5419133 - DNA, 13 bp, Homo sapiens
gcaaatcagaaac

SEQ ID NO: 5419134 - DNA, 20 bp, Homo sapiens
gcaaatcagaaacttgtgaa

SEQ ID NO: 5419135 - DNA, 22 bp, Homo sapiens
gcaaatcagaaacttgtgaagt

SEQ ID NO: 5419136 - DNA, 15 bp, Homo sapiens
gcaaatcagacacaa

SEQ ID NO: 5419137 - DNA, 23 bp, Homo sapiens
gcaaatcagacacaattagagaa

SEQ ID NO: 5419138 - DNA, 15 bp, Homo sapiens
gcaaatcaggggcca

SEQ ID NO: 5419139 - DNA, 17 bp, Homo sapiens
gcaaatcaggtaaaata

SEQ ID NO: 5419140 - DNA, 17 bp, Homo sapiens
gcaaatcagtatatttt

SEQ ID NO: 5419141 - DNA, 19 bp, Homo sapiens
gcaaatcagtatattttct

SEQ ID NO: 5419142 - DNA, 18 bp, Homo sapiens
gcaaatcatttgtttaaa

SEQ ID NO: 5419143 - DNA, 15 bp, Homo sapiens
gcaaatcccatttct

SEQ ID NO: 5419144 - DNA, 15 bp, Homo sapiens
gcaaatcctcttcta

SEQ ID NO: 5419145 - DNA, 17 bp, Homo sapiens
gcaaatcctttgtgaaa

SEQ ID NO: 5419146 - DNA, 22 bp, Homo sapiens
gcaaatcgaatgaaattaactg

SEQ ID NO: 5419147 - DNA, 19 bp, Homo sapiens
gcaaatcgtacattgtgcc

SEQ ID NO: 5419148 - DNA, 12 bp, Homo sapiens
gcaaatctaaag

SEQ ID NO: 5419149 - DNA, 19 bp, Homo sapiens
gcaaatctcctttgtccat

SEQ ID NO: 5419150 - DNA, 12 bp, Homo sapiens
gcaaatgaatca

SEQ ID NO: 5419151 - DNA, 13 bp, Homo sapiens
gcaaatgaatcat

SEQ ID NO: 5419152 - DNA, 14 bp, Homo sapiens
gcaaatgaatcatt

SEQ ID NO: 5419153 - DNA, 14 bp, Homo sapiens
gcaaatgaatgcct

SEQ ID NO: 5419154 - DNA, 19 bp, Homo sapiens
gcaaatgaatgcctttcaa

SEQ ID NO: 5419155 - DNA, 16 bp, Homo sapiens
gcaaatgacagatttc

SEQ ID NO: 5419156 - DNA, 19 bp, Homo sapiens
gcaaatgacagatttctgt

SEQ ID NO: 5419157 - DNA, 21 bp, Homo sapiens
gcaaatgacagatttctgtaa

SEQ ID NO: 5419158 - DNA, 19 bp, Homo sapiens
gcaaatgacatgcactgac

SEQ ID NO: 5419159 - DNA, 12 bp, Homo sapiens
gcaaatgacttt

SEQ ID NO: 5419160 - DNA, 14 bp, Homo sapiens
gcaaatgagatttc

SEQ ID NO: 5419161 - DNA, 15 bp, Homo sapiens
gcaaatgcaaaaata

SEQ ID NO: 5419162 - DNA, 23 bp, Homo sapiens
gcaaatgcacacacctcatgcta

SEQ ID NO: 5419163 - DNA, 18 bp, Homo sapiens
gcaaatgcacatttgtca

SEQ ID NO: 5419164 - DNA, 15 bp, Homo sapiens
gcaaatgcattctat

SEQ ID NO: 5419165 - DNA, 22 bp, Homo sapiens
gcaaatgcattctatcgttatt

SEQ ID NO: 5419166 - DNA, 20 bp, Homo sapiens
gcaaatgccaggacagctgc

SEQ ID NO: 5419167 - DNA, 14 bp, Homo sapiens
gcaaatgcccaagg

SEQ ID NO: 5419168 - DNA, 15 bp, Homo sapiens
gcaaatgcctgccaa

SEQ ID NO: 5419169 - DNA, 23 bp, Homo sapiens
gcaaatgctaatgtcaaacttga

SEQ ID NO: 5419170 - DNA, 23 bp, Homo sapiens
gcaaatggagataaaagcaattc

SEQ ID NO: 5419171 - DNA, 19 bp, Homo sapiens
gcaaatggaggcttttcac

SEQ ID NO: 5419172 - DNA, 22 bp, Homo sapiens
gcaaatggaggcttttcactgc

SEQ ID NO: 5419173 - DNA, 21 bp, Homo sapiens
gcaaatggatggggataagaa

SEQ ID NO: 5419174 - DNA, 14 bp, Homo sapiens
gcaaatggcctcat

SEQ ID NO: 5419175 - DNA, 19 bp, Homo sapiens
gcaaatggctgagatggag

SEQ ID NO: 5419176 - DNA, 12 bp, Homo sapiens
gcaaatgggagc

SEQ ID NO: 5419177 - DNA, 23 bp, Homo sapiens
gcaaatggtggttgtttcttcca

SEQ ID NO: 5419178 - DNA, 15 bp, Homo sapiens
gcaaatgtaaagtct

SEQ ID NO: 5419179 - DNA, 18 bp, Homo sapiens
gcaaatgtcatcagaact

SEQ ID NO: 5419180 - DNA, 19 bp, Homo sapiens
gcaaatgtcatgctgcctt

SEQ ID NO: 5419181 - DNA, 20 bp, Homo sapiens
gcaaatgtcatgctgcctta

SEQ ID NO: 5419182 - DNA, 21 bp, Homo sapiens
gcaaatgtccccttgatgggg

SEQ ID NO: 5419183 - DNA, 15 bp, Homo sapiens
gcaaatgtctaattg

SEQ ID NO: 5419184 - DNA, 16 bp, Homo sapiens
gcaaatgtgacctgtg

SEQ ID NO: 5419185 - DNA, 12 bp, Homo sapiens
gcaaatgttaaa

SEQ ID NO: 5419186 - DNA, 15 bp, Homo sapiens
gcaaatgttacatag

SEQ ID NO: 5419187 - DNA, 12 bp, Homo sapiens
gcaaatgttgta

SEQ ID NO: 5419188 - DNA, 16 bp, Homo sapiens
gcaaatgtttaaacat

SEQ ID NO: 5419189 - DNA, 17 bp, Homo sapiens
gcaaatgtttaaacatt

SEQ ID NO: 5419190 - DNA, 12 bp, Homo sapiens
gcaaatgtttac

SEQ ID NO: 5419191 - DNA, 18 bp, Homo sapiens
gcaaatgtttacattttg

SEQ ID NO: 5419192 - DNA, 19 bp, Homo sapiens
gcaaatgtttatttaaaag

SEQ ID NO: 5419193 - DNA, 11 bp, Homo sapiens
gcaaattaaaa

SEQ ID NO: 5419194 - DNA, 20 bp, Homo sapiens
gcaaattaaaacatatttca

SEQ ID NO: 5419195 - DNA, 21 bp, Homo sapiens
gcaaattaaaacatatttcat

SEQ ID NO: 5419196 - DNA, 16 bp, Homo sapiens
gcaaattactccaagg

SEQ ID NO: 5419197 - DNA, 23 bp, Homo sapiens
gcaaattattctagtcaactgct

SEQ ID NO: 5419198 - DNA, 14 bp, Homo sapiens
gcaaattattttaa

SEQ ID NO: 5419199 - DNA, 18 bp, Homo sapiens
gcaaattcaagagcctcc

SEQ ID NO: 5419200 - DNA, 17 bp, Homo sapiens
gcaaattccagatttgt

SEQ ID NO: 5419201 - DNA, 17 bp, Homo sapiens
gcaaattccatagctca

SEQ ID NO: 5419202 - DNA, 23 bp, Homo sapiens
gcaaattccatagctcaataaaa

SEQ ID NO: 5419203 - DNA, 12 bp, Homo sapiens
gcaaattctcaa

SEQ ID NO: 5419204 - DNA, 22 bp, Homo sapiens
gcaaattctgaggtaagtgtat

SEQ ID NO: 5419205 - DNA, 12 bp, Homo sapiens
gcaaattctttt

SEQ ID NO: 5419206 - DNA, 20 bp, Homo sapiens
gcaaattcttttgaattgtt

SEQ ID NO: 5419207 - DNA, 21 bp, Homo sapiens
gcaagtgaaggtttacaattt

SEQ ID NO: 5419208 - DNA, 20 bp, Homo sapiens
gcaagtgaatttttctctaa

SEQ ID NO: 5419209 - DNA, 18 bp, Homo sapiens
gcaagtgaccgacaaaat

SEQ ID NO: 5419210 - DNA, 22 bp, Homo sapiens
gcaagtgaccgacaaaattcca

SEQ ID NO: 5419211 - DNA, 14 bp, Homo sapiens
gcaagtgagaaaga

SEQ ID NO: 5419212 - DNA, 17 bp, Homo sapiens
gcaagtgagagagatgg

SEQ ID NO: 5419213 - DNA, 16 bp, Homo sapiens
gcaagtgagagctggg

SEQ ID NO: 5419214 - DNA, 19 bp, Homo sapiens
gcaagtgagagctgggtgt

SEQ ID NO: 5419215 - DNA, 15 bp, Homo sapiens
gcaagtgagagggga

SEQ ID NO: 5419216 - DNA, 20 bp, Homo sapiens
gcaagtgagaggggagggag

SEQ ID NO: 5419217 - DNA, 22 bp, Homo sapiens
gcaagtgagcaaacctgcccca

SEQ ID NO: 5419218 - DNA, 14 bp, Homo sapiens
gcaagtgaggcaag

SEQ ID NO: 5419219 - DNA, 12 bp, Homo sapiens
gcaagtgaggcc

SEQ ID NO: 5419220 - DNA, 16 bp, Homo sapiens
gcaagtgaggccggag

SEQ ID NO: 5419221 - DNA, 20 bp, Homo sapiens
gcaagtgagtctggtggagg

SEQ ID NO: 5419222 - DNA, 16 bp, Homo sapiens
gcaagtgcccgccctg

SEQ ID NO: 5419223 - DNA, 19 bp, Homo sapiens
gcaagtgcccgccctgccc

SEQ ID NO: 5419224 - DNA, 13 bp, Homo sapiens
gcaagtgcctggg

SEQ ID NO: 5419225 - DNA, 22 bp, Homo sapiens
gcaagtgctatgccaagccatg

SEQ ID NO: 5419226 - DNA, 12 bp, Homo sapiens
gcaagtgctcag

SEQ ID NO: 5419227 - DNA, 15 bp, Homo sapiens
gcaagtgctcaggga

SEQ ID NO: 5419228 - DNA, 15 bp, Homo sapiens
gcaagtgctggagtc

SEQ ID NO: 5419229 - DNA, 21 bp, Homo sapiens
gcaagtgctggagtctcctga

SEQ ID NO: 5419230 - DNA, 14 bp, Homo sapiens
gcaagtgctgtttg

SEQ ID NO: 5419231 - DNA, 20 bp, Homo sapiens
gcaagtgctgtttgggcagg

SEQ ID NO: 5419232 - DNA, 23 bp, Homo sapiens
gcaagtgctgtttgggcaggagt

SEQ ID NO: 5419233 - DNA, 20 bp, Homo sapiens
gcaagtggatggcccagcag

SEQ ID NO: 5419234 - DNA, 22 bp, Homo sapiens
gcaagtggatggcccagcaggc

SEQ ID NO: 5419235 - DNA, 15 bp, Homo sapiens
gcaagtggttgtttt

SEQ ID NO: 5419236 - DNA, 13 bp, Homo sapiens
gcaagtgtacagt

SEQ ID NO: 5419237 - DNA, 15 bp, Homo sapiens
gcaagtgtctggagc

SEQ ID NO: 5419238 - DNA, 22 bp, Homo sapiens
gcaagtgtctggagcggctgct

SEQ ID NO: 5419239 - DNA, 16 bp, Homo sapiens
gcaagtgtgaatactg

SEQ ID NO: 5419240 - DNA, 12 bp, Homo sapiens
gcaagtgtgtgc

SEQ ID NO: 5419241 - DNA, 13 bp, Homo sapiens
gcaagtgtgtgca

SEQ ID NO: 5419242 - DNA, 22 bp, Homo sapiens
gcaagtgtgtgcatgtgtgcga

SEQ ID NO: 5419243 - DNA, 21 bp, Homo sapiens
gcaagtgttaataataactta

SEQ ID NO: 5419244 - DNA, 17 bp, Homo sapiens
gcaagtgttcactgctc

SEQ ID NO: 5419245 - DNA, 12 bp, Homo sapiens
gcaagtgtttct

SEQ ID NO: 5419246 - DNA, 15 bp, Homo sapiens
gcaagtgtttctgtt

SEQ ID NO: 5419247 - DNA, 14 bp, Homo sapiens
gcaagttaagagaa

SEQ ID NO: 5419248 - DNA, 19 bp, Homo sapiens
gcaagttaagagaaacttt

SEQ ID NO: 5419249 - DNA, 20 bp, Homo sapiens
gcaagttaagagaaacttta

SEQ ID NO: 5419250 - DNA, 17 bp, Homo sapiens
gcaagttattttatttg

SEQ ID NO: 5419251 - DNA, 20 bp, Homo sapiens
gcaagttcagggaagcaggc

SEQ ID NO: 5419252 - DNA, 23 bp, Homo sapiens
gcaagttcagggaagcaggcaga

SEQ ID NO: 5419253 - DNA, 15 bp, Homo sapiens
gcaagttcccagttg

SEQ ID NO: 5419254 - DNA, 17 bp, Homo sapiens
gcaagttctagagaaga

SEQ ID NO: 5419255 - DNA, 13 bp, Homo sapiens
gcaagttgcagtc

SEQ ID NO: 5419256 - DNA, 23 bp, Homo sapiens
gcaagtttctgtttcaaagcaca

SEQ ID NO: 5419257 - DNA, 22 bp, Homo sapiens
gcaagttttaaacccaaaatat

SEQ ID NO: 5419258 - DNA, 16 bp, Homo sapiens
gcaagtttttggtaat

SEQ ID NO: 5419259 - DNA, 13 bp, Homo sapiens
gcaataaaaaaat

SEQ ID NO: 5419260 - DNA, 16 bp, Homo sapiens
gcaataaaagcccagg

SEQ ID NO: 5419261 - DNA, 14 bp, Homo sapiens
gcaataaaatagta

SEQ ID NO: 5419262 - DNA, 12 bp, Homo sapiens
gcaataaaattt

SEQ ID NO: 5419263 - DNA, 17 bp, Homo sapiens
gcaataaactcagtcaa

SEQ ID NO: 5419264 - DNA, 11 bp, Homo sapiens
gcaataaagca

SEQ ID NO: 5419265 - DNA, 18 bp, Homo sapiens
gcaataaaggagaagaga

SEQ ID NO: 5419266 - DNA, 15 bp, Homo sapiens
gcaataaataaagct

SEQ ID NO: 5419267 - DNA, 18 bp, Homo sapiens
gcaataaataacacttgt

SEQ ID NO: 5419268 - DNA, 13 bp, Homo sapiens
gcaataaatatta

SEQ ID NO: 5419269 - DNA, 18 bp, Homo sapiens
gcaataaatattatttga

SEQ ID NO: 5419270 - DNA, 21 bp, Homo sapiens
gcaataaatctgacccagtgc

SEQ ID NO: 5419271 - DNA, 19 bp, Homo sapiens
gcaataaatgccctctctg

SEQ ID NO: 5419272 - DNA, 21 bp, Homo sapiens
gcaataaatggctcgtgggct

SEQ ID NO: 5419273 - DNA, 15 bp, Homo sapiens
gcaataaattttgaa

SEQ ID NO: 5419274 - DNA, 18 bp, Homo sapiens
gcaataacactatattta

SEQ ID NO: 5419275 - DNA, 21 bp, Homo sapiens
gcaataaccagcataataaaa

SEQ ID NO: 5419276 - DNA, 12 bp, Homo sapiens
gcaataactatt

SEQ ID NO: 5419277 - DNA, 17 bp, Homo sapiens
gcaataactgaaaatga

SEQ ID NO: 5419278 - DNA, 21 bp, Homo sapiens
gcaataacttctatattttaa

SEQ ID NO: 5419279 - DNA, 15 bp, Homo sapiens
gcaataagaaatgaa

SEQ ID NO: 5419280 - DNA, 20 bp, Homo sapiens
gcaataagaaatgaacaaaa

SEQ ID NO: 5419281 - DNA, 12 bp, Homo sapiens
gcaataaggaaa

SEQ ID NO: 5419282 - DNA, 17 bp, Homo sapiens
gcaataaggatttattc

SEQ ID NO: 5419283 - DNA, 20 bp, Homo sapiens
gcaataaggatttattctca

SEQ ID NO: 5419284 - DNA, 14 bp, Homo sapiens
gcaataagttcatt

SEQ ID NO: 5419285 - DNA, 21 bp, Homo sapiens
gcaataatatgtgagaggaca

SEQ ID NO: 5419286 - DNA, 20 bp, Homo sapiens
gcaataatggtcccatccag

SEQ ID NO: 5419287 - DNA, 14 bp, Homo sapiens
gcaataatgtgcaa

SEQ ID NO: 5419288 - DNA, 23 bp, Homo sapiens
gcaataattaggatctatgcaat

SEQ ID NO: 5419289 - DNA, 13 bp, Homo sapiens
gcaataattgttt

SEQ ID NO: 5419290 - DNA, 19 bp, Homo sapiens
gcaatacaactttaccata

SEQ ID NO: 5419291 - DNA, 17 bp, Homo sapiens
gcaatacaagtttcatc

SEQ ID NO: 5419292 - DNA, 18 bp, Homo sapiens
gcaataccaacctgaaag

SEQ ID NO: 5419293 - DNA, 17 bp, Homo sapiens
gcaatacggaacactgt

SEQ ID NO: 5419294 - DNA, 20 bp, Homo sapiens
gcaatactaattgagaaaca

SEQ ID NO: 5419295 - DNA, 15 bp, Homo sapiens
gcaatactcatcaga

SEQ ID NO: 5419296 - DNA, 22 bp, Homo sapiens
gcaatactcatcagagcagcta

SEQ ID NO: 5419297 - DNA, 14 bp, Homo sapiens
gcaatactgcttaa

SEQ ID NO: 5419298 - DNA, 22 bp, Homo sapiens
gcaatactgtccagttttcttg

SEQ ID NO: 5419299 - DNA, 19 bp, Homo sapiens
gcaatacttaggaggctta

SEQ ID NO: 5419300 - DNA, 10 bp, Homo sapiens
gcaatagaaa

SEQ ID NO: 5419301 - DNA, 19 bp, Homo sapiens
gcaatagaagtgctcccct

SEQ ID NO: 5419302 - DNA, 11 bp, Homo sapiens
gcaatagagac

SEQ ID NO: 5419303 - DNA, 14 bp, Homo sapiens
gcaatagagactgt

SEQ ID NO: 5419304 - DNA, 19 bp, Homo sapiens
gcaatagattactgatgtg

SEQ ID NO: 5419305 - DNA, 17 bp, Homo sapiens
gcaatagcagttataac

SEQ ID NO: 5419306 - DNA, 20 bp, Homo sapiens
gcaatagcagttataacaga

SEQ ID NO: 5419307 - DNA, 12 bp, Homo sapiens
gcaatagcattg

SEQ ID NO: 5419308 - DNA, 23 bp, Homo sapiens
gcaataggtagctggggagccct

SEQ ID NO: 5419309 - DNA, 22 bp, Homo sapiens
gcaataggtttgggggacgccc

SEQ ID NO: 5419310 - DNA, 22 bp, Homo sapiens
gcaatagtgcaacatctctgaa

SEQ ID NO: 5419311 - DNA, 17 bp, Homo sapiens
gcaatagtgtgttctga

SEQ ID NO: 5419312 - DNA, 21 bp, Homo sapiens
gcaatagttttttacttctct

SEQ ID NO: 5419313 - DNA, 14 bp, Homo sapiens
gcaatataaccaat

SEQ ID NO: 5419314 - DNA, 17 bp, Homo sapiens
gcaatataaccaatgtt

SEQ ID NO: 5419315 - DNA, 17 bp, Homo sapiens
gcaatatagaaacacga

SEQ ID NO: 5419316 - DNA, 14 bp, Homo sapiens
gcaatatattttgt

SEQ ID NO: 5419317 - DNA, 19 bp, Homo sapiens
gcaatatattttgtatgca

SEQ ID NO: 5419318 - DNA, 20 bp, Homo sapiens
gcaatatcttcgttagtaat

SEQ ID NO: 5419319 - DNA, 20 bp, Homo sapiens
gcaatatgaggggactgcat

SEQ ID NO: 5419320 - DNA, 21 bp, Homo sapiens
gcaatattaatgcctttaaag

SEQ ID NO: 5419321 - DNA, 17 bp, Homo sapiens
gcaatattctctgtaca

SEQ ID NO: 5419322 - DNA, 19 bp, Homo sapiens
gcaatattctctgtacata

SEQ ID NO: 5419323 - DNA, 17 bp, Homo sapiens
gcaatatttaaggagat

SEQ ID NO: 5419324 - DNA, 21 bp, Homo sapiens
gcaatatttatggatgcaaca

SEQ ID NO: 5419325 - DNA, 15 bp, Homo sapiens
gcaatcaaatctgct

SEQ ID NO: 5419326 - DNA, 16 bp, Homo sapiens
gcaatcaagagcttcc

SEQ ID NO: 5419327 - DNA, 19 bp, Homo sapiens
gcaatcaaggttataattt

SEQ ID NO: 5419328 - DNA, 16 bp, Homo sapiens
gcaatcactgggccca

SEQ ID NO: 5419329 - DNA, 21 bp, Homo sapiens
gcaatcactgggcccagagga

SEQ ID NO: 5419330 - DNA, 14 bp, Homo sapiens
gcaatcagaagaaa

SEQ ID NO: 5419331 - DNA, 14 bp, Homo sapiens
gcaatcatttcccc

SEQ ID NO: 5419332 - DNA, 17 bp, Homo sapiens
gcaatcatttcccctcc

SEQ ID NO: 5419333 - DNA, 16 bp, Homo sapiens
gcaatcattttatgct

SEQ ID NO: 5419334 - DNA, 18 bp, Homo sapiens
gcaatccacaatctgaca

SEQ ID NO: 5419335 - DNA, 20 bp, Homo sapiens
gcaatccacctgccttggcc

SEQ ID NO: 5419336 - DNA, 20 bp, Homo sapiens
gcaatccatgttagttttta

SEQ ID NO: 5419337 - DNA, 19 bp, Homo sapiens
gcaatcccaccaaatcatc

SEQ ID NO: 5419338 - DNA, 19 bp, Homo sapiens
gcaatccgagccagctctg

SEQ ID NO: 5419339 - DNA, 14 bp, Homo sapiens
gcaatcctcctgcc

SEQ ID NO: 5419340 - DNA, 17 bp, Homo sapiens
gcaatcctcctgcctca

SEQ ID NO: 5419341 - DNA, 17 bp, Homo sapiens
gcaatcctctcacctca

SEQ ID NO: 5419342 - DNA, 20 bp, Homo sapiens
gcaatccttaaaaagaccat

SEQ ID NO: 5419343 - DNA, 21 bp, Homo sapiens
gcaatcgtaatgtacagatgg

SEQ ID NO: 5419344 - DNA, 15 bp, Homo sapiens
gcaatcgttctgctg

SEQ ID NO: 5419345 - DNA, 12 bp, Homo sapiens
gcaatctcagct

SEQ ID NO: 5419346 - DNA, 22 bp, Homo sapiens
gcaatctccttactgtgtttca

SEQ ID NO: 5419347 - DNA, 19 bp, Homo sapiens
gcaatctcggctcactgca

SEQ ID NO: 5419348 - DNA, 21 bp, Homo sapiens
gcaatctctctctgtgtcttt

SEQ ID NO: 5419349 - DNA, 16 bp, Homo sapiens
gcaatctctgcctccc

SEQ ID NO: 5419350 - DNA, 22 bp, Homo sapiens
gcaatctgaccctatgggtcta

SEQ ID NO: 5419351 - DNA, 16 bp, Homo sapiens
gcaatctggaagaaag

SEQ ID NO: 5419352 - DNA, 22 bp, Homo sapiens
gcaatctggaagaaagccctgt

SEQ ID NO: 5419353 - DNA, 18 bp, Homo sapiens
gcaatctggctcctcctg

SEQ ID NO: 5419354 - DNA, 17 bp, Homo sapiens
gcaatcttggctcactg

SEQ ID NO: 5419355 - DNA, 16 bp, Homo sapiens
gcaatgaaaaatactt

SEQ ID NO: 5419356 - DNA, 16 bp, Homo sapiens
gcaatgaaaaattctc

SEQ ID NO: 5419357 - DNA, 23 bp, Homo sapiens
gcaatgaaaagtcgttttccaaa

SEQ ID NO: 5419358 - DNA, 14 bp, Homo sapiens
gcaatgaaaatttt

SEQ ID NO: 5419359 - DNA, 18 bp, Homo sapiens
gcaatgaaaattttaaga

SEQ ID NO: 5419360 - DNA, 13 bp, Homo sapiens
gcaatgaaacaga

SEQ ID NO: 5419361 - DNA, 15 bp, Homo sapiens
gcaatgaaaccaaag

SEQ ID NO: 5419362 - DNA, 16 bp, Homo sapiens
gcaatgaaaccaaagc

SEQ ID NO: 5419363 - DNA, 20 bp, Homo sapiens
gcaatgaaaccaaagccagg

SEQ ID NO: 5419364 - DNA, 16 bp, Homo sapiens
gcaatgaaaggtacta

SEQ ID NO: 5419365 - DNA, 18 bp, Homo sapiens
gcaatgaaaggtactata

SEQ ID NO: 5419366 - DNA, 23 bp, Homo sapiens
gcaatgaaaggtactatatttgc

SEQ ID NO: 5419367 - DNA, 14 bp, Homo sapiens
gcaatgaaagtcaa

SEQ ID NO: 5419368 - DNA, 14 bp, Homo sapiens
gcaatgaagaatat

SEQ ID NO: 5419369 - DNA, 17 bp, Homo sapiens
gcaatgaagtctctgaa

SEQ ID NO: 5419370 - DNA, 18 bp, Homo sapiens
gcaatgacaggtaaatta

SEQ ID NO: 5419371 - DNA, 13 bp, Homo sapiens
gcaatgacctttc

SEQ ID NO: 5419372 - DNA, 22 bp, Homo sapiens
gcaatgacctttcaataggaaa

SEQ ID NO: 5419373 - DNA, 17 bp, Homo sapiens
gcaatgagtgtgccaga

SEQ ID NO: 5419374 - DNA, 17 bp, Homo sapiens
gcaatgataatgagcag

SEQ ID NO: 5419375 - DNA, 17 bp, Homo sapiens
gcaatgatgaatgagaa

SEQ ID NO: 5419376 - DNA, 20 bp, Homo sapiens
gcaatgatgacccactaaag

SEQ ID NO: 5419377 - DNA, 19 bp, Homo sapiens
gcaatgcatctgaaagttt

SEQ ID NO: 5419378 - DNA, 17 bp, Homo sapiens
gcaatgccacagccctg

SEQ ID NO: 5419379 - DNA, 21 bp, Homo sapiens
gcaatgccacagccctgtcag

SEQ ID NO: 5419380 - DNA, 22 bp, Homo sapiens
gcaatgccacagccctgtcagc

SEQ ID NO: 5419381 - DNA, 15 bp, Homo sapiens
gcaatgccatcagcc

SEQ ID NO: 5419382 - DNA, 17 bp, Homo sapiens
gcaatgccatcagcccc

SEQ ID NO: 5419383 - DNA, 12 bp, Homo sapiens
gcaatgccccct

SEQ ID NO: 5419384 - DNA, 19 bp, Homo sapiens
gcaatgcctgtgaaaaaga

SEQ ID NO: 5419385 - DNA, 14 bp, Homo sapiens
gcacagaatatttt

SEQ ID NO: 5419386 - DNA, 13 bp, Homo sapiens
gcacagaatgagt

SEQ ID NO: 5419387 - DNA, 19 bp, Homo sapiens
gcacagacaagcagccctt

SEQ ID NO: 5419388 - DNA, 23 bp, Homo sapiens
gcacagacaattctaatggtaac

SEQ ID NO: 5419389 - DNA, 11 bp, Homo sapiens
gcacagacagg

SEQ ID NO: 5419390 - DNA, 16 bp, Homo sapiens
gcacagaccctgccct

SEQ ID NO: 5419391 - DNA, 21 bp, Homo sapiens
gcacagaccctgccctgtggg

SEQ ID NO: 5419392 - DNA, 19 bp, Homo sapiens
gcacagacctctcccaccc

SEQ ID NO: 5419393 - DNA, 10 bp, Homo sapiens
gcacagactg

SEQ ID NO: 5419394 - DNA, 15 bp, Homo sapiens
gcacagactgttccc

SEQ ID NO: 5419395 - DNA, 23 bp, Homo sapiens
gcacagacttccaccatgtgcat

SEQ ID NO: 5419396 - DNA, 14 bp, Homo sapiens
gcacagacttctgg

SEQ ID NO: 5419397 - DNA, 22 bp, Homo sapiens
gcacagacttctggaaggctgg

SEQ ID NO: 5419398 - DNA, 13 bp, Homo sapiens
gcacagagaggga

SEQ ID NO: 5419399 - DNA, 23 bp, Homo sapiens
gcacagagagggacacatgcccc

SEQ ID NO: 5419400 - DNA, 23 bp, Homo sapiens
gcacagagagggggccacctccc

SEQ ID NO: 5419401 - DNA, 16 bp, Homo sapiens
gcacagagcacactta

SEQ ID NO: 5419402 - DNA, 19 bp, Homo sapiens
gcacagagcatccgtctcc

SEQ ID NO: 5419403 - DNA, 22 bp, Homo sapiens
gcacagagcatccgtctcccct

SEQ ID NO: 5419404 - DNA, 14 bp, Homo sapiens
gcacagagcccaat

SEQ ID NO: 5419405 - DNA, 13 bp, Homo sapiens
gcacagagccctg

SEQ ID NO: 5419406 - DNA, 20 bp, Homo sapiens
gcacagagcctggccccagg

SEQ ID NO: 5419407 - DNA, 19 bp, Homo sapiens
gcacagagctctccagctc

SEQ ID NO: 5419408 - DNA, 12 bp, Homo sapiens
gcacagaggcct

SEQ ID NO: 5419409 - DNA, 17 bp, Homo sapiens
gcacagaggcctgactg

SEQ ID NO: 5419410 - DNA, 20 bp, Homo sapiens
gcacagaggcctgactgact

SEQ ID NO: 5419411 - DNA, 16 bp, Homo sapiens
gcacagagggaagcca

SEQ ID NO: 5419412 - DNA, 18 bp, Homo sapiens
gcacagagggaagccatg

SEQ ID NO: 5419413 - DNA, 19 bp, Homo sapiens
gcacagagggcgctcctgt

SEQ ID NO: 5419414 - DNA, 18 bp, Homo sapiens
gcacagagtcgatgctca

SEQ ID NO: 5419415 - DNA, 18 bp, Homo sapiens
gcacagagttgttacatt

SEQ ID NO: 5419416 - DNA, 20 bp, Homo sapiens
gcacagataaaaagtggaat

SEQ ID NO: 5419417 - DNA, 17 bp, Homo sapiens
gcacagatatttccatt

SEQ ID NO: 5419418 - DNA, 17 bp, Homo sapiens
gcacagatgaccaaagt

SEQ ID NO: 5419419 - DNA, 20 bp, Homo sapiens
gcacagatgccatggcctgt

SEQ ID NO: 5419420 - DNA, 17 bp, Homo sapiens
gcacagatgctccaggg

SEQ ID NO: 5419421 - DNA, 20 bp, Homo sapiens
gcacagattacttcagggct

SEQ ID NO: 5419422 - DNA, 14 bp, Homo sapiens
gcacagattcccag

SEQ ID NO: 5419423 - DNA, 15 bp, Homo sapiens
gcacagattcccagg

SEQ ID NO: 5419424 - DNA, 18 bp, Homo sapiens
gcacagattcccaggcca

SEQ ID NO: 5419425 - DNA, 13 bp, Homo sapiens
gcacagattgaag

SEQ ID NO: 5419426 - DNA, 14 bp, Homo sapiens
gcacagattgaaga

SEQ ID NO: 5419427 - DNA, 14 bp, Homo sapiens
gcacagatttgcat

SEQ ID NO: 5419428 - DNA, 13 bp, Homo sapiens
gcacagattttaa

SEQ ID NO: 5419429 - DNA, 14 bp, Homo sapiens
gcacagattttaat

SEQ ID NO: 5419430 - DNA, 17 bp, Homo sapiens
gcacagattttaattgt

SEQ ID NO: 5419431 - DNA, 12 bp, Homo sapiens
gcacagcaaaag

SEQ ID NO: 5419432 - DNA, 14 bp, Homo sapiens
gcacagcaaggagg

SEQ ID NO: 5419433 - DNA, 23 bp, Homo sapiens
gcacagcaccgggggagagggac

SEQ ID NO: 5419434 - DNA, 13 bp, Homo sapiens
gcacagcactgcc

SEQ ID NO: 5419435 - DNA, 16 bp, Homo sapiens
gcacagcactgcctgc

SEQ ID NO: 5419436 - DNA, 19 bp, Homo sapiens
gcacagcactgcctgccaa

SEQ ID NO: 5419437 - DNA, 21 bp, Homo sapiens
gcacagcactgcctgccaagc

SEQ ID NO: 5419438 - DNA, 23 bp, Homo sapiens
gcacagcactttggttttgctga

SEQ ID NO: 5419439 - DNA, 13 bp, Homo sapiens
gcacagcagcatc

SEQ ID NO: 5419440 - DNA, 13 bp, Homo sapiens
gcacagcagcctg

SEQ ID NO: 5419441 - DNA, 20 bp, Homo sapiens
gcacagcagcctgcttccca

SEQ ID NO: 5419442 - DNA, 14 bp, Homo sapiens
gcacagcaggacct

SEQ ID NO: 5419443 - DNA, 23 bp, Homo sapiens
gcacagcaggctgccagtgcctg

SEQ ID NO: 5419444 - DNA, 14 bp, Homo sapiens
gcacagcaggggag

SEQ ID NO: 5419445 - DNA, 13 bp, Homo sapiens
gcacagcatctca

SEQ ID NO: 5419446 - DNA, 17 bp, Homo sapiens
gcacagccaaatttaaa

SEQ ID NO: 5419447 - DNA, 22 bp, Homo sapiens
gcacagccaacacgcacctgcc

SEQ ID NO: 5419448 - DNA, 18 bp, Homo sapiens
gcacagccaacgagacac

SEQ ID NO: 5419449 - DNA, 15 bp, Homo sapiens
gcacagccaaggact

SEQ ID NO: 5419450 - DNA, 16 bp, Homo sapiens
gcacagccacccgtgg

SEQ ID NO: 5419451 - DNA, 23 bp, Homo sapiens
gcacagccacccgtggggtgctg

SEQ ID NO: 5419452 - DNA, 23 bp, Homo sapiens
gcacagccacctccgccagaccc

SEQ ID NO: 5419453 - DNA, 12 bp, Homo sapiens
gcacagccagaa

SEQ ID NO: 5419454 - DNA, 22 bp, Homo sapiens
gcacagccagcccaaaccttgg

SEQ ID NO: 5419455 - DNA, 14 bp, Homo sapiens
gcacagcccctgga

SEQ ID NO: 5419456 - DNA, 18 bp, Homo sapiens
gcacagccctcccgcccc

SEQ ID NO: 5419457 - DNA, 21 bp, Homo sapiens
gcacagccctcccgccccttc

SEQ ID NO: 5419458 - DNA, 22 bp, Homo sapiens
gcacagccctcccgccccttcc

SEQ ID NO: 5419459 - DNA, 11 bp, Homo sapiens
gcacagccctg

SEQ ID NO: 5419460 - DNA, 16 bp, Homo sapiens
gcacagccctgagtgt

SEQ ID NO: 5419461 - DNA, 12 bp, Homo sapiens
gcacagccctgg

SEQ ID NO: 5419462 - DNA, 23 bp, Homo sapiens
gcacagcctagggtcttgggggt

SEQ ID NO: 5419463 - DNA, 20 bp, Homo sapiens
gcacagcctcacccctgcag

SEQ ID NO: 5419464 - DNA, 21 bp, Homo sapiens
gcacagcctcacccctgcagg

SEQ ID NO: 5419465 - DNA, 15 bp, Homo sapiens
gcacagcctcttaga

SEQ ID NO: 5419466 - DNA, 18 bp, Homo sapiens
gcacagcctcttagatgc

SEQ ID NO: 5419467 - DNA, 20 bp, Homo sapiens
gcacagcctcttagatgcag

SEQ ID NO: 5419468 - DNA, 19 bp, Homo sapiens
gcacagcctggctgtggcc

SEQ ID NO: 5419469 - DNA, 14 bp, Homo sapiens
gcacagccttctcc

SEQ ID NO: 5419470 - DNA, 16 bp, Homo sapiens
gcacagcgcgggcgga

SEQ ID NO: 5419471 - DNA, 17 bp, Homo sapiens
gcacagcgcgggcggag

SEQ ID NO: 5419472 - DNA, 15 bp, Homo sapiens
gcacagcgctgagca

SEQ ID NO: 5419473 - DNA, 16 bp, Homo sapiens
gcacagcgctgagcat

SEQ ID NO: 5419474 - DNA, 21 bp, Homo sapiens
gcacagcgtttacatatttac

SEQ ID NO: 5419475 - DNA, 14 bp, Homo sapiens
gcacagctactcag

SEQ ID NO: 5419476 - DNA, 17 bp, Homo sapiens
gcacagctcctcccctg

SEQ ID NO: 5419477 - DNA, 20 bp, Homo sapiens
gcacagctcctcccctgccg

SEQ ID NO: 5419478 - DNA, 24 bp, Homo sapiens
gcacagctcctcccctgccgcctc

SEQ ID NO: 5419479 - DNA, 20 bp, Homo sapiens
gcacagctctcctcctccat

SEQ ID NO: 5419480 - DNA, 19 bp, Homo sapiens
gcacagctcttcacaccat

SEQ ID NO: 5419481 - DNA, 22 bp, Homo sapiens
gcacagctgaggaccctcagcc

SEQ ID NO: 5419482 - DNA, 15 bp, Homo sapiens
gcacagctgctgtgc

SEQ ID NO: 5419483 - DNA, 16 bp, Homo sapiens
gcacagctggagaaat

SEQ ID NO: 5419484 - DNA, 19 bp, Homo sapiens
gcacagctgggagcctggt

SEQ ID NO: 5419485 - DNA, 14 bp, Homo sapiens
gcacagctgggcat

SEQ ID NO: 5419486 - DNA, 14 bp, Homo sapiens
gcacagctgtctgc

SEQ ID NO: 5419487 - DNA, 16 bp, Homo sapiens
gcacagctgtctgcca

SEQ ID NO: 5419488 - DNA, 20 bp, Homo sapiens
gcacagctgtctgccaggca

SEQ ID NO: 5419489 - DNA, 15 bp, Homo sapiens
gcacagcttcttctg

SEQ ID NO: 5419490 - DNA, 22 bp, Homo sapiens
gcacagcttgacctgaggctgt

SEQ ID NO: 5419491 - DNA, 18 bp, Homo sapiens
gcacagctttcctgggtc

SEQ ID NO: 5419492 - DNA, 19 bp, Homo sapiens
gcacagcttttccaaaata

SEQ ID NO: 5419493 - DNA, 15 bp, Homo sapiens
gcacaggaaaaggta

SEQ ID NO: 5419494 - DNA, 15 bp, Homo sapiens
gcacaggacacctgg

SEQ ID NO: 5419495 - DNA, 19 bp, Homo sapiens
gcacaggacacctggccgc

SEQ ID NO: 5419496 - DNA, 16 bp, Homo sapiens
gcacaggactgattct

SEQ ID NO: 5419497 - DNA, 16 bp, Homo sapiens
gcacaggagactccaa

SEQ ID NO: 5419498 - DNA, 21 bp, Homo sapiens
gcacaggagactccaaggagc

SEQ ID NO: 5419499 - DNA, 23 bp, Homo sapiens
gcacaggagagcacccacagccg

SEQ ID NO: 5419500 - DNA, 15 bp, Homo sapiens
gcacaggagctacct

SEQ ID NO: 5419501 - DNA, 15 bp, Homo sapiens
gcacaggaggctccg

SEQ ID NO: 5419502 - DNA, 20 bp, Homo sapiens
gcacaggagtgtcctcttcc

SEQ ID NO: 5419503 - DNA, 18 bp, Homo sapiens
gcacaggcaacattacaa

SEQ ID NO: 5419504 - DNA, 18 bp, Homo sapiens
gcacaggcactgaacagg

SEQ ID NO: 5419505 - DNA, 12 bp, Homo sapiens
gcacaggcagct

SEQ ID NO: 5419506 - DNA, 15 bp, Homo sapiens
gcacaggcaggaaga

SEQ ID NO: 5419507 - DNA, 13 bp, Homo sapiens
gcacaggcagggc

SEQ ID NO: 5419508 - DNA, 14 bp, Homo sapiens
gcacaggcagggca

SEQ ID NO: 5419509 - DNA, 21 bp, Homo sapiens
gcacaggcagggcaggaccag

SEQ ID NO: 5419510 - DNA, 17 bp, Homo sapiens
gcacaggccacttgctc

SEQ ID NO: 5419511 - DNA, 18 bp, Homo sapiens
gcacaggccacttgctca

SEQ ID NO: 5419512 - DNA, 22 bp, Homo sapiens
gcacaggcccgccctctgcctc

SEQ ID NO: 5419513 - DNA, 14 bp, Homo sapiens
gcacaggccctagc

SEQ ID NO: 5419514 - DNA, 17 bp, Homo sapiens
gcacaggcctctgcctg

SEQ ID NO: 5419515 - DNA, 18 bp, Homo sapiens
gcacaggctcagtgtagg

SEQ ID NO: 5419516 - DNA, 13 bp, Homo sapiens
gcacaggctcctg

SEQ ID NO: 5419517 - DNA, 19 bp, Homo sapiens
gcacaggctgagtgcaggc

SEQ ID NO: 5419518 - DNA, 20 bp, Homo sapiens
gcacaggctgagtgcaggcc

SEQ ID NO: 5419519 - DNA, 21 bp, Homo sapiens
gcacaggctgagtgcaggccc

SEQ ID NO: 5419520 - DNA, 18 bp, Homo sapiens
gcacaggctgccccaccc

SEQ ID NO: 5419521 - DNA, 19 bp, Homo sapiens
gcacaggctgccccacccc

SEQ ID NO: 5419522 - DNA, 16 bp, Homo sapiens
gcacagggaagggctt

SEQ ID NO: 5419523 - DNA, 12 bp, Homo sapiens
gcacagggagaa

SEQ ID NO: 5419524 - DNA, 16 bp, Homo sapiens
gcacagggagaggccg

SEQ ID NO: 5419525 - DNA, 13 bp, Homo sapiens
gcacagggcacca

SEQ ID NO: 5419526 - DNA, 17 bp, Homo sapiens
gcacagggcaccagagg

SEQ ID NO: 5419527 - DNA, 20 bp, Homo sapiens
gcacagggcaccagaggccg

SEQ ID NO: 5419528 - DNA, 15 bp, Homo sapiens
gcacagggcagctgg

SEQ ID NO: 5419529 - DNA, 18 bp, Homo sapiens
gcacagggcaggggtggt

SEQ ID NO: 5419530 - DNA, 23 bp, Homo sapiens
gcacagggcatgaaatgaacaca

SEQ ID NO: 5419531 - DNA, 17 bp, Homo sapiens
gcacagggcatgcctgg

SEQ ID NO: 5419532 - DNA, 20 bp, Homo sapiens
gcacagggcatgcctggcct

SEQ ID NO: 5419533 - DNA, 21 bp, Homo sapiens
gcacagggcatgcctggcctg

SEQ ID NO: 5419534 - DNA, 23 bp, Homo sapiens
gcacagggcatgcctggcctgag

SEQ ID NO: 5419535 - DNA, 15 bp, Homo sapiens
gcacagggcccgcag

SEQ ID NO: 5419536 - DNA, 20 bp, Homo sapiens
gcacagggcccgcagtgctg

SEQ ID NO: 5419537 - DNA, 14 bp, Homo sapiens
gcacagggcctggc

SEQ ID NO: 5419538 - DNA, 16 bp, Homo sapiens
gcacaggggccccaga

SEQ ID NO: 5419539 - DNA, 18 bp, Homo sapiens
gcacagggtctgctcttt

SEQ ID NO: 5419540 - DNA, 23 bp, Homo sapiens
gcacagggtctgctctttctctg

SEQ ID NO: 5419541 - DNA, 19 bp, Homo sapiens
gcacaggtccaaggctggt

SEQ ID NO: 5419542 - DNA, 15 bp, Homo sapiens
gcacaggtcccacct

SEQ ID NO: 5419543 - DNA, 19 bp, Homo sapiens
gcacaggtcgggcgcagga

SEQ ID NO: 5419544 - DNA, 20 bp, Homo sapiens
gcacaggtcgggcgcaggat

SEQ ID NO: 5419545 - DNA, 14 bp, Homo sapiens
gcacaggtgacaga

SEQ ID NO: 5419546 - DNA, 13 bp, Homo sapiens
gcacaggtgggag

SEQ ID NO: 5419547 - DNA, 14 bp, Homo sapiens
gcacaggtgggagg

SEQ ID NO: 5419548 - DNA, 21 bp, Homo sapiens
gcacaggtttgttttttcaag

SEQ ID NO: 5419549 - DNA, 21 bp, Homo sapiens
gcacagtaatatgaaagccac

SEQ ID NO: 5419550 - DNA, 14 bp, Homo sapiens
gcacagtaatgtag

SEQ ID NO: 5419551 - DNA, 19 bp, Homo sapiens
gcacagtaatgtagaaatg

SEQ ID NO: 5419552 - DNA, 17 bp, Homo sapiens
gcacagtaggtcccggc

SEQ ID NO: 5419553 - DNA, 20 bp, Homo sapiens
gcacagtaggtcccggccag

SEQ ID NO: 5419554 - DNA, 21 bp, Homo sapiens
gcacagtaggtcccggccagc

SEQ ID NO: 5419555 - DNA, 16 bp, Homo sapiens
gcacagtagtgttggg

SEQ ID NO: 5419556 - DNA, 20 bp, Homo sapiens
gcacagtagtgttgggtgga

SEQ ID NO: 5419557 - DNA, 17 bp, Homo sapiens
gcacagtatctgctgtt

SEQ ID NO: 5419558 - DNA, 18 bp, Homo sapiens
gcacagtatctgctgttc

SEQ ID NO: 5419559 - DNA, 19 bp, Homo sapiens
gcacagtatctgctgttct

SEQ ID NO: 5419560 - DNA, 23 bp, Homo sapiens
gcacagtatctgctgttcttcag

SEQ ID NO: 5419561 - DNA, 16 bp, Homo sapiens
gcacagtcactgctct

SEQ ID NO: 5419562 - DNA, 15 bp, Homo sapiens
gcacagtcagaagga

SEQ ID NO: 5419563 - DNA, 11 bp, Homo sapiens
gcacctgctgg

SEQ ID NO: 5419564 - DNA, 15 bp, Homo sapiens
gcacctgctggaaac

SEQ ID NO: 5419565 - DNA, 19 bp, Homo sapiens
gcacctgctgtcagcctgg

SEQ ID NO: 5419566 - DNA, 18 bp, Homo sapiens
gcacctggaatatataac

SEQ ID NO: 5419567 - DNA, 21 bp, Homo sapiens
gcacctggaatatataaccag

SEQ ID NO: 5419568 - DNA, 16 bp, Homo sapiens
gcacctggaccccctg

SEQ ID NO: 5419569 - DNA, 20 bp, Homo sapiens
gcacctggaccccctgcccg

SEQ ID NO: 5419570 - DNA, 17 bp, Homo sapiens
gcacctggagcccacag

SEQ ID NO: 5419571 - DNA, 18 bp, Homo sapiens
gcacctggcatcgcacca

SEQ ID NO: 5419572 - DNA, 14 bp, Homo sapiens
gcacctggcctgct

SEQ ID NO: 5419573 - DNA, 20 bp, Homo sapiens
gcacctggcctgggccacac

SEQ ID NO: 5419574 - DNA, 16 bp, Homo sapiens
gcacctgggcagctcc

SEQ ID NO: 5419575 - DNA, 20 bp, Homo sapiens
gcacctgggccccactggac

SEQ ID NO: 5419576 - DNA, 22 bp, Homo sapiens
gcacctgggccccactggacaa

SEQ ID NO: 5419577 - DNA, 22 bp, Homo sapiens
gcacctgggctgaggaggcagt

SEQ ID NO: 5419578 - DNA, 16 bp, Homo sapiens
gcacctgggctttctg

SEQ ID NO: 5419579 - DNA, 20 bp, Homo sapiens
gcacctgggtgtgctccagg

SEQ ID NO: 5419580 - DNA, 12 bp, Homo sapiens
gcacctgggttg

SEQ ID NO: 5419581 - DNA, 22 bp, Homo sapiens
gcacctggtttctgttctgttg

SEQ ID NO: 5419582 - DNA, 21 bp, Homo sapiens
gcacctgtaatcccagctact

SEQ ID NO: 5419583 - DNA, 18 bp, Homo sapiens
gcacctgtaatgtgcgag

SEQ ID NO: 5419584 - DNA, 12 bp, Homo sapiens
gcacctgtacag

SEQ ID NO: 5419585 - DNA, 15 bp, Homo sapiens
gcacctgtagtccca

SEQ ID NO: 5419586 - DNA, 15 bp, Homo sapiens
gcacctgtccccacc

SEQ ID NO: 5419587 - DNA, 20 bp, Homo sapiens
gcacctgtccccaccctcca

SEQ ID NO: 5419588 - DNA, 21 bp, Homo sapiens
gcacctgtccccaccctccac

SEQ ID NO: 5419589 - DNA, 19 bp, Homo sapiens
gcacctgtcgcccagtgcc

SEQ ID NO: 5419590 - DNA, 20 bp, Homo sapiens
gcacctgtcggtggctgcct

SEQ ID NO: 5419591 - DNA, 11 bp, Homo sapiens
gcacctgtctg

SEQ ID NO: 5419592 - DNA, 14 bp, Homo sapiens
gcacctgtctgctc

SEQ ID NO: 5419593 - DNA, 18 bp, Homo sapiens
gcacctgtctgctccagc

SEQ ID NO: 5419594 - DNA, 22 bp, Homo sapiens
gcacctgtctggattgttttta

SEQ ID NO: 5419595 - DNA, 19 bp, Homo sapiens
gcacctgtggcctctcagt

SEQ ID NO: 5419596 - DNA, 19 bp, Homo sapiens
gcaccttaatattattggg

SEQ ID NO: 5419597 - DNA, 17 bp, Homo sapiens
gcaccttacattcctag

SEQ ID NO: 5419598 - DNA, 17 bp, Homo sapiens
gcaccttagacagtccc

SEQ ID NO: 5419599 - DNA, 19 bp, Homo sapiens
gcaccttagacagtccctg

SEQ ID NO: 5419600 - DNA, 20 bp, Homo sapiens
gcaccttagacagtccctgc

SEQ ID NO: 5419601 - DNA, 16 bp, Homo sapiens
gcaccttagtggcttt

SEQ ID NO: 5419602 - DNA, 20 bp, Homo sapiens
gcaccttcaagcgctccagg

SEQ ID NO: 5419603 - DNA, 16 bp, Homo sapiens
gcaccttcagggctga

SEQ ID NO: 5419604 - DNA, 20 bp, Homo sapiens
gcaccttcagggctgagttc

SEQ ID NO: 5419605 - DNA, 12 bp, Homo sapiens
gcaccttccccc

SEQ ID NO: 5419606 - DNA, 14 bp, Homo sapiens
gcaccttccccctc

SEQ ID NO: 5419607 - DNA, 14 bp, Homo sapiens
gcaccttcctcctc

SEQ ID NO: 5419608 - DNA, 18 bp, Homo sapiens
gcaccttcctcctccccg

SEQ ID NO: 5419609 - DNA, 21 bp, Homo sapiens
gcaccttcctcctccccgctc

SEQ ID NO: 5419610 - DNA, 22 bp, Homo sapiens
gcaccttctgacgcagcctgag

SEQ ID NO: 5419611 - DNA, 15 bp, Homo sapiens
gcaccttctttctgg

SEQ ID NO: 5419612 - DNA, 18 bp, Homo sapiens
gcaccttctttctggact

SEQ ID NO: 5419613 - DNA, 14 bp, Homo sapiens
gcaccttgctgcag

SEQ ID NO: 5419614 - DNA, 23 bp, Homo sapiens
gcaccttgggcacgggagagcgc

SEQ ID NO: 5419615 - DNA, 23 bp, Homo sapiens
gcaccttgtgaaggaaaaacatg

SEQ ID NO: 5419616 - DNA, 14 bp, Homo sapiens
gcaccttgtgcctg

SEQ ID NO: 5419617 - DNA, 15 bp, Homo sapiens
gcaccttgtgcctgg

SEQ ID NO: 5419618 - DNA, 13 bp, Homo sapiens
gcacctttcctga

SEQ ID NO: 5419619 - DNA, 18 bp, Homo sapiens
gcacctttctagttgaaa

SEQ ID NO: 5419620 - DNA, 16 bp, Homo sapiens
gcacctttgcacagga

SEQ ID NO: 5419621 - DNA, 19 bp, Homo sapiens
gcacctttgcacaggatgc

SEQ ID NO: 5419622 - DNA, 22 bp, Homo sapiens
gcacctttggaaacaacattta

SEQ ID NO: 5419623 - DNA, 14 bp, Homo sapiens
gcaccttttactgt

SEQ ID NO: 5419624 - DNA, 15 bp, Homo sapiens
gcaccttttactgtg

SEQ ID NO: 5419625 - DNA, 19 bp, Homo sapiens
gcaccttttcatgtacagc

SEQ ID NO: 5419626 - DNA, 20 bp, Homo sapiens
gcaccttttcatgtacagca

SEQ ID NO: 5419627 - DNA, 16 bp, Homo sapiens
gcacgaacccacctgc

SEQ ID NO: 5419628 - DNA, 19 bp, Homo sapiens
gcacgaacccacctgctga

SEQ ID NO: 5419629 - DNA, 17 bp, Homo sapiens
gcacgacgtcagcctct

SEQ ID NO: 5419630 - DNA, 16 bp, Homo sapiens
gcacgactgcgggagc

SEQ ID NO: 5419631 - DNA, 19 bp, Homo sapiens
gcacgactgcgggagccag

SEQ ID NO: 5419632 - DNA, 22 bp, Homo sapiens
gcacgagacccatttccttgtg

SEQ ID NO: 5419633 - DNA, 16 bp, Homo sapiens
gcacgaggtctggcca

SEQ ID NO: 5419634 - DNA, 20 bp, Homo sapiens
gcacgagtgggaaggacttg

SEQ ID NO: 5419635 - DNA, 17 bp, Homo sapiens
gcacgatctcagctcac

SEQ ID NO: 5419636 - DNA, 21 bp, Homo sapiens
gcacgatctcagctcactgca

SEQ ID NO: 5419637 - DNA, 21 bp, Homo sapiens
gcacgatcttggctcactgca

SEQ ID NO: 5419638 - DNA, 13 bp, Homo sapiens
gcacgatttctgt

SEQ ID NO: 5419639 - DNA, 16 bp, Homo sapiens
gcacgattttgcacaa

SEQ ID NO: 5419640 - DNA, 18 bp, Homo sapiens
gcacgcaacccttgctgc

SEQ ID NO: 5419641 - DNA, 21 bp, Homo sapiens
gcacgcaacccttgctgctgc

SEQ ID NO: 5419642 - DNA, 13 bp, Homo sapiens
gcacgcaagcctc

SEQ ID NO: 5419643 - DNA, 22 bp, Homo sapiens
gcacgcaagcctcagccactcc

SEQ ID NO: 5419644 - DNA, 14 bp, Homo sapiens
gcacgcacacacac

SEQ ID NO: 5419645 - DNA, 16 bp, Homo sapiens
gcacgcacacacacaa

SEQ ID NO: 5419646 - DNA, 20 bp, Homo sapiens
gcacgcacacacacatacag

SEQ ID NO: 5419647 - DNA, 16 bp, Homo sapiens
gcacgcacactgtctg

SEQ ID NO: 5419648 - DNA, 13 bp, Homo sapiens
gcacgcacatgcc

SEQ ID NO: 5419649 - DNA, 13 bp, Homo sapiens
gcacgcacccaca

SEQ ID NO: 5419650 - DNA, 20 bp, Homo sapiens
gcacgcaccccgcccctgca

SEQ ID NO: 5419651 - DNA, 13 bp, Homo sapiens
gcacgcacctgta

SEQ ID NO: 5419652 - DNA, 14 bp, Homo sapiens
gcacgcacctgtag

SEQ ID NO: 5419653 - DNA, 16 bp, Homo sapiens
gcacgcacttgcctgt

SEQ ID NO: 5419654 - DNA, 14 bp, Homo sapiens
gcacgcaggaccag

SEQ ID NO: 5419655 - DNA, 17 bp, Homo sapiens
gcacgcaggcggggcag

SEQ ID NO: 5419656 - DNA, 14 bp, Homo sapiens
gcacgccaacccca

SEQ ID NO: 5419657 - DNA, 17 bp, Homo sapiens
gcacgccaaccccagca

SEQ ID NO: 5419658 - DNA, 18 bp, Homo sapiens
gcacgccaccacacctgg

SEQ ID NO: 5419659 - DNA, 17 bp, Homo sapiens
gcacgcccatgtgtgag

SEQ ID NO: 5419660 - DNA, 13 bp, Homo sapiens
gcacgccctactc

SEQ ID NO: 5419661 - DNA, 14 bp, Homo sapiens
gcacgccctactcc

SEQ ID NO: 5419662 - DNA, 16 bp, Homo sapiens
gcacgccgtggagcat

SEQ ID NO: 5419663 - DNA, 13 bp, Homo sapiens
gcacgcctctccc

SEQ ID NO: 5419664 - DNA, 15 bp, Homo sapiens
gcacgcctctcccca

SEQ ID NO: 5419665 - DNA, 17 bp, Homo sapiens
gcacgcctctccccacc

SEQ ID NO: 5419666 - DNA, 14 bp, Homo sapiens
gcacgcctgcaggc

SEQ ID NO: 5419667 - DNA, 12 bp, Homo sapiens
gcacgcctgccc

SEQ ID NO: 5419668 - DNA, 15 bp, Homo sapiens
gcacgcctgccttct

SEQ ID NO: 5419669 - DNA, 14 bp, Homo sapiens
gcacgcctgctggc

SEQ ID NO: 5419670 - DNA, 16 bp, Homo sapiens
gcacgcgacttctcag

SEQ ID NO: 5419671 - DNA, 18 bp, Homo sapiens
gcacgcgacttctcagga

SEQ ID NO: 5419672 - DNA, 20 bp, Homo sapiens
gcacgcggagtgagtttttt

SEQ ID NO: 5419673 - DNA, 21 bp, Homo sapiens
gcacgcggcagcacctctgag

SEQ ID NO: 5419674 - DNA, 18 bp, Homo sapiens
gcacgcggccgctctccg

SEQ ID NO: 5419675 - DNA, 17 bp, Homo sapiens
gcacgctcaatgcccag

SEQ ID NO: 5419676 - DNA, 23 bp, Homo sapiens
gcacgctcaatgcccagtaaaat

SEQ ID NO: 5419677 - DNA, 18 bp, Homo sapiens
gcacgctcccctccatcc

SEQ ID NO: 5419678 - DNA, 18 bp, Homo sapiens
gcacgctgcccaggggct

SEQ ID NO: 5419679 - DNA, 18 bp, Homo sapiens
gcacgctgcctgccaaag

SEQ ID NO: 5419680 - DNA, 19 bp, Homo sapiens
gcacgctgcctgccaaagt

SEQ ID NO: 5419681 - DNA, 22 bp, Homo sapiens
gcacgctggacagcactctgcc

SEQ ID NO: 5419682 - DNA, 16 bp, Homo sapiens
gcacggacaataaacc

SEQ ID NO: 5419683 - DNA, 17 bp, Homo sapiens
gcacggacaataaacct

SEQ ID NO: 5419684 - DNA, 19 bp, Homo sapiens
gcacggacatggtctgtcc

SEQ ID NO: 5419685 - DNA, 16 bp, Homo sapiens
gcacggcagcttgagc

SEQ ID NO: 5419686 - DNA, 20 bp, Homo sapiens
gcacggcaggcgtgtggcag

SEQ ID NO: 5419687 - DNA, 17 bp, Homo sapiens
gcacggcccggcccctc

SEQ ID NO: 5419688 - DNA, 18 bp, Homo sapiens
gcacggcccggcccctca

SEQ ID NO: 5419689 - DNA, 22 bp, Homo sapiens
gcacggcccggcccctcaccct

SEQ ID NO: 5419690 - DNA, 18 bp, Homo sapiens
gcacggcctcgcgtctgt

SEQ ID NO: 5419691 - DNA, 14 bp, Homo sapiens
gcacggcggcaggg

SEQ ID NO: 5419692 - DNA, 19 bp, Homo sapiens
gcacggcgggatcctccac

SEQ ID NO: 5419693 - DNA, 14 bp, Homo sapiens
gcacggctccgagg

SEQ ID NO: 5419694 - DNA, 22 bp, Homo sapiens
gcacgggagagcgccacccgcc

SEQ ID NO: 5419695 - DNA, 22 bp, Homo sapiens
gcacgggatgcgtgggaggcag

SEQ ID NO: 5419696 - DNA, 19 bp, Homo sapiens
gcacgggattcatgcagtg

SEQ ID NO: 5419697 - DNA, 20 bp, Homo sapiens
gcacgggccctccctcccag

SEQ ID NO: 5419698 - DNA, 14 bp, Homo sapiens
gcacgggtgtcacg

SEQ ID NO: 5419699 - DNA, 21 bp, Homo sapiens
gcacgggtgtcacggccaggc

SEQ ID NO: 5419700 - DNA, 22 bp, Homo sapiens
gcacgggttaagatctgaaagt

SEQ ID NO: 5419701 - DNA, 19 bp, Homo sapiens
gcacggtcccccaggaggc

SEQ ID NO: 5419702 - DNA, 21 bp, Homo sapiens
gcacggtcccccaggaggcag

SEQ ID NO: 5419703 - DNA, 24 bp, Homo sapiens
gcacggtctggggaagaggatgag

SEQ ID NO: 5419704 - DNA, 18 bp, Homo sapiens
gcacggtgaatggctttg

SEQ ID NO: 5419705 - DNA, 20 bp, Homo sapiens
gcacggtgggccttgctggg

SEQ ID NO: 5419706 - DNA, 14 bp, Homo sapiens
gcacggtttctgtt

SEQ ID NO: 5419707 - DNA, 18 bp, Homo sapiens
gcacgtaaagtacttgta

SEQ ID NO: 5419708 - DNA, 22 bp, Homo sapiens
gcacgtaggttccccagagagc

SEQ ID NO: 5419709 - DNA, 22 bp, Homo sapiens
gcacgtatttatttataagttt

SEQ ID NO: 5419710 - DNA, 15 bp, Homo sapiens
gcacgtccttgggcg

SEQ ID NO: 5419711 - DNA, 14 bp, Homo sapiens
gcacgtcgccatcc

SEQ ID NO: 5419712 - DNA, 13 bp, Homo sapiens
gcacgtctcctgc

SEQ ID NO: 5419713 - DNA, 19 bp, Homo sapiens
gcacgtctcctgctgcgtg

SEQ ID NO: 5419714 - DNA, 14 bp, Homo sapiens
gcacgtgcacacac

SEQ ID NO: 5419715 - DNA, 16 bp, Homo sapiens
gcacgtggagagctgg

SEQ ID NO: 5419716 - DNA, 21 bp, Homo sapiens
gcacgtggagatagtgccagg

SEQ ID NO: 5419717 - DNA, 18 bp, Homo sapiens
gcacgtggcatgtggcct

SEQ ID NO: 5419718 - DNA, 12 bp, Homo sapiens
gcacgtggccag

SEQ ID NO: 5419719 - DNA, 18 bp, Homo sapiens
gcacgtggccaggagcca

SEQ ID NO: 5419720 - DNA, 13 bp, Homo sapiens
gcacgtggcctct

SEQ ID NO: 5419721 - DNA, 17 bp, Homo sapiens
gcacgtggcctcttgag

SEQ ID NO: 5419722 - DNA, 19 bp, Homo sapiens
gcacgtggcctcttgagca

SEQ ID NO: 5419723 - DNA, 17 bp, Homo sapiens
gcacgtggggcccactg

SEQ ID NO: 5419724 - DNA, 14 bp, Homo sapiens
gcacgtgtgttttt

SEQ ID NO: 5419725 - DNA, 18 bp, Homo sapiens
gcacgtgtgtttttctat

SEQ ID NO: 5419726 - DNA, 14 bp, Homo sapiens
gcacgttgacccaa

SEQ ID NO: 5419727 - DNA, 15 bp, Homo sapiens
gcacgtttaaagttc

SEQ ID NO: 5419728 - DNA, 17 bp, Homo sapiens
gcacgtttaaagttctg

SEQ ID NO: 5419729 - DNA, 20 bp, Homo sapiens
gcacgtttggcatttctctt

SEQ ID NO: 5419730 - DNA, 20 bp, Homo sapiens
gcactaaaaagttgaaccat

SEQ ID NO: 5419731 - DNA, 15 bp, Homo sapiens
gcactaaaagtgatg

SEQ ID NO: 5419732 - DNA, 14 bp, Homo sapiens
gcactaaaatgttt

SEQ ID NO: 5419733 - DNA, 18 bp, Homo sapiens
gcactaaactcagattga

SEQ ID NO: 5419734 - DNA, 20 bp, Homo sapiens
gcactaaagtatgtaaagta

SEQ ID NO: 5419735 - DNA, 15 bp, Homo sapiens
gcactaaatatgaac

SEQ ID NO: 5419736 - DNA, 23 bp, Homo sapiens
gcactaaccccagctgccggcag

SEQ ID NO: 5419737 - DNA, 14 bp, Homo sapiens
gcactaaggccgtg

SEQ ID NO: 5419738 - DNA, 20 bp, Homo sapiens
gcactaaggccgtgtctctg

SEQ ID NO: 5419739 - DNA, 23 bp, Homo sapiens
gcactaaggggcccggccagcca

SEQ ID NO: 5419740 - DNA, 18 bp, Homo sapiens
gcacttctggggccagcc

SEQ ID NO: 5419741 - DNA, 13 bp, Homo sapiens
gcacttgaagaat

SEQ ID NO: 5419742 - DNA, 15 bp, Homo sapiens
gcacttgaagaatat

SEQ ID NO: 5419743 - DNA, 15 bp, Homo sapiens
gcacttgagctgtct

SEQ ID NO: 5419744 - DNA, 16 bp, Homo sapiens
gcacttgagctgtctg

SEQ ID NO: 5419745 - DNA, 22 bp, Homo sapiens
gcacttgatgtgatgtggcagg

SEQ ID NO: 5419746 - DNA, 17 bp, Homo sapiens
gcacttgattcaggagg

SEQ ID NO: 5419747 - DNA, 20 bp, Homo sapiens
gcacttgcagaggagcccag

SEQ ID NO: 5419748 - DNA, 14 bp, Homo sapiens
gcacttgcatctgt

SEQ ID NO: 5419749 - DNA, 13 bp, Homo sapiens
gcacttgcctgct

SEQ ID NO: 5419750 - DNA, 13 bp, Homo sapiens
gcacttgcctgga

SEQ ID NO: 5419751 - DNA, 18 bp, Homo sapiens
gcacttgcctgggtcaca

SEQ ID NO: 5419752 - DNA, 18 bp, Homo sapiens
gcacttgcctgttggctg

SEQ ID NO: 5419753 - DNA, 22 bp, Homo sapiens
gcacttgcggttccggcatgga

SEQ ID NO: 5419754 - DNA, 16 bp, Homo sapiens
gcacttggagccaagg

SEQ ID NO: 5419755 - DNA, 12 bp, Homo sapiens
gcacttggcctc

SEQ ID NO: 5419756 - DNA, 18 bp, Homo sapiens
gcacttggcctcagctgg

SEQ ID NO: 5419757 - DNA, 13 bp, Homo sapiens
gcacttggctcct

SEQ ID NO: 5419758 - DNA, 15 bp, Homo sapiens
gcacttggctgcata

SEQ ID NO: 5419759 - DNA, 21 bp, Homo sapiens
gcacttggggcaccttgctcc

SEQ ID NO: 5419760 - DNA, 22 bp, Homo sapiens
gcacttgggggctcagcaaggc

SEQ ID NO: 5419761 - DNA, 15 bp, Homo sapiens
gcacttggtgctgct

SEQ ID NO: 5419762 - DNA, 15 bp, Homo sapiens
gcacttgtatatacg

SEQ ID NO: 5419763 - DNA, 17 bp, Homo sapiens
gcacttgtatttaattc

SEQ ID NO: 5419764 - DNA, 13 bp, Homo sapiens
gcacttgtcacta

SEQ ID NO: 5419765 - DNA, 21 bp, Homo sapiens
gcacttgtctcattttaatgt

SEQ ID NO: 5419766 - DNA, 23 bp, Homo sapiens
gcacttgtctcattttaatgtaa

SEQ ID NO: 5419767 - DNA, 17 bp, Homo sapiens
gcacttgtgatcctaaa

SEQ ID NO: 5419768 - DNA, 21 bp, Homo sapiens
gcacttgtgattatttattat

SEQ ID NO: 5419769 - DNA, 23 bp, Homo sapiens
gcacttgtgattatttattattt

SEQ ID NO: 5419770 - DNA, 18 bp, Homo sapiens
gcacttgtggaatatgtt

SEQ ID NO: 5419771 - DNA, 19 bp, Homo sapiens
gcacttgttccttctgctt

SEQ ID NO: 5419772 - DNA, 22 bp, Homo sapiens
gcactttaaagaggctgtgtgg

SEQ ID NO: 5419773 - DNA, 18 bp, Homo sapiens
gcactttaacacagtgtc

SEQ ID NO: 5419774 - DNA, 18 bp, Homo sapiens
gcactttaaccctctctt

SEQ ID NO: 5419775 - DNA, 17 bp, Homo sapiens
gcactttaatgataaaa

SEQ ID NO: 5419776 - DNA, 14 bp, Homo sapiens
gcactttaattgaa

SEQ ID NO: 5419777 - DNA, 18 bp, Homo sapiens
gcactttaattgaagaac

SEQ ID NO: 5419778 - DNA, 21 bp, Homo sapiens
gcactttaattgaagaactgc

SEQ ID NO: 5419779 - DNA, 19 bp, Homo sapiens
gcactttacgctgtctgta

SEQ ID NO: 5419780 - DNA, 15 bp, Homo sapiens
gcactttagaaatat

SEQ ID NO: 5419781 - DNA, 20 bp, Homo sapiens
gcactttagtgattgctttt

SEQ ID NO: 5419782 - DNA, 19 bp, Homo sapiens
gcactttagtgtattttct

SEQ ID NO: 5419783 - DNA, 15 bp, Homo sapiens
gcactttataaaagc

SEQ ID NO: 5419784 - DNA, 12 bp, Homo sapiens
gcactttatcct

SEQ ID NO: 5419785 - DNA, 18 bp, Homo sapiens
gcactttatgtggagact

SEQ ID NO: 5419786 - DNA, 13 bp, Homo sapiens
gcactttcattgc

SEQ ID NO: 5419787 - DNA, 20 bp, Homo sapiens
gcactttccacttcttcctt

SEQ ID NO: 5419788 - DNA, 18 bp, Homo sapiens
gcactttcccccttcccg

SEQ ID NO: 5419789 - DNA, 16 bp, Homo sapiens
gcactttcctcctggc

SEQ ID NO: 5419790 - DNA, 18 bp, Homo sapiens
gcactttcctttcaataa

SEQ ID NO: 5419791 - DNA, 21 bp, Homo sapiens
gcactttctacaatgtgaact

SEQ ID NO: 5419792 - DNA, 20 bp, Homo sapiens
gcactttctatcctctgtaa

SEQ ID NO: 5419793 - DNA, 12 bp, Homo sapiens
gcactttgaaaa

SEQ ID NO: 5419794 - DNA, 17 bp, Homo sapiens
gcactttgaaatacctc

SEQ ID NO: 5419795 - DNA, 23 bp, Homo sapiens
gcactttgaaatacctcatgttt

SEQ ID NO: 5419796 - DNA, 15 bp, Homo sapiens
gcactttgatgtcat

SEQ ID NO: 5419797 - DNA, 12 bp, Homo sapiens
gcactttgcact

SEQ ID NO: 5419798 - DNA, 13 bp, Homo sapiens
gcactttgcactt

SEQ ID NO: 5419799 - DNA, 13 bp, Homo sapiens
gcactttgcagga

SEQ ID NO: 5419800 - DNA, 20 bp, Homo sapiens
gcactttgctttaatataaa

SEQ ID NO: 5419801 - DNA, 21 bp, Homo sapiens
gcactttgctttaatataaat

SEQ ID NO: 5419802 - DNA, 17 bp, Homo sapiens
gcactttggcttataat

SEQ ID NO: 5419803 - DNA, 20 bp, Homo sapiens
gcactttggcttataattct

SEQ ID NO: 5419804 - DNA, 19 bp, Homo sapiens
gcactttgggaagctgagg

SEQ ID NO: 5419805 - DNA, 16 bp, Homo sapiens
gcactttgggaggcag

SEQ ID NO: 5419806 - DNA, 23 bp, Homo sapiens
gcactttgggaggccgaggcagg

SEQ ID NO: 5419807 - DNA, 16 bp, Homo sapiens
gcactttgggaggctg

SEQ ID NO: 5419808 - DNA, 18 bp, Homo sapiens
gcactttgggaggctgag

SEQ ID NO: 5419809 - DNA, 11 bp, Homo sapiens
gcactttgggg

SEQ ID NO: 5419810 - DNA, 13 bp, Homo sapiens
gcactttgggttt

SEQ ID NO: 5419811 - DNA, 20 bp, Homo sapiens
gcactttgggtttttaactc

SEQ ID NO: 5419812 - DNA, 14 bp, Homo sapiens
gcactttgtaaatt

SEQ ID NO: 5419813 - DNA, 15 bp, Homo sapiens
gcactttgtaaattc

SEQ ID NO: 5419814 - DNA, 13 bp, Homo sapiens
gcacttttaacaa

SEQ ID NO: 5419815 - DNA, 15 bp, Homo sapiens
gcacttttaacaaaa

SEQ ID NO: 5419816 - DNA, 14 bp, Homo sapiens
gcacttttagaaat

SEQ ID NO: 5419817 - DNA, 13 bp, Homo sapiens
gcacttttcatta

SEQ ID NO: 5419818 - DNA, 16 bp, Homo sapiens
gcacttttgagctcct

SEQ ID NO: 5419819 - DNA, 17 bp, Homo sapiens
gcacttttgagctccta

SEQ ID NO: 5419820 - DNA, 23 bp, Homo sapiens
gcacttttgagctcctaagctgc

SEQ ID NO: 5419821 - DNA, 15 bp, Homo sapiens
gcacttttgggcctt

SEQ ID NO: 5419822 - DNA, 15 bp, Homo sapiens
gcacttttgttattc

SEQ ID NO: 5419823 - DNA, 18 bp, Homo sapiens
gcactttttaaaaagtac

SEQ ID NO: 5419824 - DNA, 21 bp, Homo sapiens
gcactttttaacattctcaat

SEQ ID NO: 5419825 - DNA, 15 bp, Homo sapiens
gcactttttcacata

SEQ ID NO: 5419826 - DNA, 17 bp, Homo sapiens
gcactttttcacataag

SEQ ID NO: 5419827 - DNA, 20 bp, Homo sapiens
gcactttttccttactgtgc

SEQ ID NO: 5419828 - DNA, 21 bp, Homo sapiens
gcactttttccttactgtgca

SEQ ID NO: 5419829 - DNA, 20 bp, Homo sapiens
gcactttttcgtgtggatct

SEQ ID NO: 5419830 - DNA, 22 bp, Homo sapiens
gcactttttcttaatcattttt

SEQ ID NO: 5419831 - DNA, 14 bp, Homo sapiens
gcagaaaaattaaa

SEQ ID NO: 5419832 - DNA, 12 bp, Homo sapiens
gcagaaaacaga

SEQ ID NO: 5419833 - DNA, 22 bp, Homo sapiens
gcagaaaacagagcctgcctaa

SEQ ID NO: 5419834 - DNA, 17 bp, Homo sapiens
gcagaaaacccttgggc

SEQ ID NO: 5419835 - DNA, 22 bp, Homo sapiens
gcagaaaacggagagtgcttgg

SEQ ID NO: 5419836 - DNA, 21 bp, Homo sapiens
gcagaaaagaggagaccctgg

SEQ ID NO: 5419837 - DNA, 17 bp, Homo sapiens
gcagaaaagcacctgcc

SEQ ID NO: 5419838 - DNA, 18 bp, Homo sapiens
gcagaaaagcacctgccg

SEQ ID NO: 5419839 - DNA, 13 bp, Homo sapiens
gcagaaaagtgct

SEQ ID NO: 5419840 - DNA, 14 bp, Homo sapiens
gcagaaaagtgctt

SEQ ID NO: 5419841 - DNA, 16 bp, Homo sapiens
gcagaaaagtgcttag

SEQ ID NO: 5419842 - DNA, 18 bp, Homo sapiens
gcagaaaagtgcttagaa

SEQ ID NO: 5419843 - DNA, 23 bp, Homo sapiens
gcagaaaagtgcttagaaagtta

SEQ ID NO: 5419844 - DNA, 16 bp, Homo sapiens
gcagaaaattgcctaa

SEQ ID NO: 5419845 - DNA, 20 bp, Homo sapiens
gcagaaacaaaatgaaaaaa

SEQ ID NO: 5419846 - DNA, 21 bp, Homo sapiens
gcagaaacaaaatgaaaaaaa

SEQ ID NO: 5419847 - DNA, 10 bp, Homo sapiens
gcagaaacag

SEQ ID NO: 5419848 - DNA, 14 bp, Homo sapiens
gcagaaacagccat

SEQ ID NO: 5419849 - DNA, 15 bp, Homo sapiens
gcagaaacagccatt

SEQ ID NO: 5419850 - DNA, 22 bp, Homo sapiens
gcagaaacccccaggaggagag

SEQ ID NO: 5419851 - DNA, 19 bp, Homo sapiens
gcagaaacctatctcaggg

SEQ ID NO: 5419852 - DNA, 23 bp, Homo sapiens
gcagaaacctatctcagggaggg

SEQ ID NO: 5419853 - DNA, 21 bp, Homo sapiens
gcagaaaccttgtttgtttta

SEQ ID NO: 5419854 - DNA, 16 bp, Homo sapiens
gcagaaacttggatgt

SEQ ID NO: 5419855 - DNA, 13 bp, Homo sapiens
gcagaaagatgga

SEQ ID NO: 5419856 - DNA, 19 bp, Homo sapiens
gcagaaagatggagaggca

SEQ ID NO: 5419857 - DNA, 20 bp, Homo sapiens
gcagaaagatggagaggcat

SEQ ID NO: 5419858 - DNA, 18 bp, Homo sapiens
gcagaaagcagaggctgg

SEQ ID NO: 5419859 - DNA, 20 bp, Homo sapiens
gcagaaagcatccctcaccc

SEQ ID NO: 5419860 - DNA, 21 bp, Homo sapiens
gcagaaagctgtgaacaggct

SEQ ID NO: 5419861 - DNA, 12 bp, Homo sapiens
gcagaaaggctg

SEQ ID NO: 5419862 - DNA, 13 bp, Homo sapiens
gcagaaaggctgc

SEQ ID NO: 5419863 - DNA, 16 bp, Homo sapiens
gcagaaagggccaccc

SEQ ID NO: 5419864 - DNA, 12 bp, Homo sapiens
gcagaaataaaa

SEQ ID NO: 5419865 - DNA, 16 bp, Homo sapiens
gcagaaatacagtctt

SEQ ID NO: 5419866 - DNA, 12 bp, Homo sapiens
gcagaaatagtt

SEQ ID NO: 5419867 - DNA, 19 bp, Homo sapiens
gcagaaatcctgcaatgaa

SEQ ID NO: 5419868 - DNA, 23 bp, Homo sapiens
gcagaaatcgagagtgtgctctc

SEQ ID NO: 5419869 - DNA, 13 bp, Homo sapiens
gcagaaatgaaat

SEQ ID NO: 5419870 - DNA, 16 bp, Homo sapiens
gcagaaatgtgctgca

SEQ ID NO: 5419871 - DNA, 14 bp, Homo sapiens
gcagaaattctgtt

SEQ ID NO: 5419872 - DNA, 15 bp, Homo sapiens
gcagaaattctgttt

SEQ ID NO: 5419873 - DNA, 22 bp, Homo sapiens
gcagaaatttgatttgaaaagt

SEQ ID NO: 5419874 - DNA, 21 bp, Homo sapiens
gcagaacaaatgtgtttttct

SEQ ID NO: 5419875 - DNA, 13 bp, Homo sapiens
gcagaacacctgg

SEQ ID NO: 5419876 - DNA, 14 bp, Homo sapiens
gcagaacagccatt

SEQ ID NO: 5419877 - DNA, 23 bp, Homo sapiens
gcagaacagccgctcctgtctgc

SEQ ID NO: 5419878 - DNA, 21 bp, Homo sapiens
gcagaacatgtgggaggaaga

SEQ ID NO: 5419879 - DNA, 13 bp, Homo sapiens
gcagaaccagtcc

SEQ ID NO: 5419880 - DNA, 17 bp, Homo sapiens
gcagaacccccaggtgg

SEQ ID NO: 5419881 - DNA, 18 bp, Homo sapiens
gcagaacccccaggtggc

SEQ ID NO: 5419882 - DNA, 16 bp, Homo sapiens
gcagaaccggtcccag

SEQ ID NO: 5419883 - DNA, 18 bp, Homo sapiens
gcagaaccggtcccagcc

SEQ ID NO: 5419884 - DNA, 21 bp, Homo sapiens
gcagaaccggtcccagcctgg

SEQ ID NO: 5419885 - DNA, 15 bp, Homo sapiens
gcagaacctggtggc

SEQ ID NO: 5419886 - DNA, 15 bp, Homo sapiens
gcagaacggaggagg

SEQ ID NO: 5419887 - DNA, 19 bp, Homo sapiens
gcagaactaccaggtggca

SEQ ID NO: 5419888 - DNA, 14 bp, Homo sapiens
gcagaactcctacc

SEQ ID NO: 5419889 - DNA, 14 bp, Homo sapiens
gcagaactctctgt

SEQ ID NO: 5419890 - DNA, 20 bp, Homo sapiens
gcagaactgaagccacttgg

SEQ ID NO: 5419891 - DNA, 16 bp, Homo sapiens
gcagaactgagctcct

SEQ ID NO: 5419892 - DNA, 21 bp, Homo sapiens
gcagaactgccattattttct

SEQ ID NO: 5419893 - DNA, 23 bp, Homo sapiens
gcagaactgccattattttctgt

SEQ ID NO: 5419894 - DNA, 16 bp, Homo sapiens
gcagaactgctggggc

SEQ ID NO: 5419895 - DNA, 17 bp, Homo sapiens
gcagaactgctggggct

SEQ ID NO: 5419896 - DNA, 13 bp, Homo sapiens
gcagaagaaagga

SEQ ID NO: 5419897 - DNA, 13 bp, Homo sapiens
gcagaagaagctg

SEQ ID NO: 5419898 - DNA, 16 bp, Homo sapiens
gcagaagaagctggga

SEQ ID NO: 5419899 - DNA, 20 bp, Homo sapiens
gcagaagaagctgggaggga

SEQ ID NO: 5419900 - DNA, 13 bp, Homo sapiens
gcagaagaatctt

SEQ ID NO: 5419901 - DNA, 23 bp, Homo sapiens
gcagaagaattgaacccaggagg

SEQ ID NO: 5419902 - DNA, 15 bp, Homo sapiens
gcagaagacaccaga

SEQ ID NO: 5419903 - DNA, 16 bp, Homo sapiens
gcagaagacaccagag

SEQ ID NO: 5419904 - DNA, 18 bp, Homo sapiens
gcagaagacaccagagca

SEQ ID NO: 5419905 - DNA, 14 bp, Homo sapiens
gcagaagaccagat

SEQ ID NO: 5419906 - DNA, 19 bp, Homo sapiens
gcagaagacgggaggggag

SEQ ID NO: 5419907 - DNA, 13 bp, Homo sapiens
gcagaagacgtct

SEQ ID NO: 5419908 - DNA, 20 bp, Homo sapiens
gcagaagactagaggccagg

SEQ ID NO: 5419909 - DNA, 23 bp, Homo sapiens
gcagaagagagtggggcctgccc

SEQ ID NO: 5419910 - DNA, 14 bp, Homo sapiens
gcagaagagggtgt

SEQ ID NO: 5419911 - DNA, 13 bp, Homo sapiens
gcagaagcagcaa

SEQ ID NO: 5419912 - DNA, 18 bp, Homo sapiens
gcagaagcattgcctgga

SEQ ID NO: 5419913 - DNA, 20 bp, Homo sapiens
gcagaagcattgcctggact

SEQ ID NO: 5419914 - DNA, 22 bp, Homo sapiens
gcagaagcattgcctggactga

SEQ ID NO: 5419915 - DNA, 15 bp, Homo sapiens
gcagaagcatttgaa

SEQ ID NO: 5419916 - DNA, 13 bp, Homo sapiens
gcagaagccaagg

SEQ ID NO: 5419917 - DNA, 22 bp, Homo sapiens
gcagaagccaagggaagacagt

SEQ ID NO: 5419918 - DNA, 12 bp, Homo sapiens
gcagaagccaga

SEQ ID NO: 5419919 - DNA, 21 bp, Homo sapiens
gcagaggggccaggcccaggc

SEQ ID NO: 5419920 - DNA, 21 bp, Homo sapiens
gcagaggggctttctggagag

SEQ ID NO: 5419921 - DNA, 13 bp, Homo sapiens
gcagaggtaaaag

SEQ ID NO: 5419922 - DNA, 18 bp, Homo sapiens
gcagaggtaccctgggtg

SEQ ID NO: 5419923 - DNA, 14 bp, Homo sapiens
gcagaggtcagact

SEQ ID NO: 5419924 - DNA, 15 bp, Homo sapiens
gcagaggtcccagcc

SEQ ID NO: 5419925 - DNA, 20 bp, Homo sapiens
gcagaggtcccagccccagg

SEQ ID NO: 5419926 - DNA, 21 bp, Homo sapiens
gcagaggtcccagccccaggc

SEQ ID NO: 5419927 - DNA, 18 bp, Homo sapiens
gcagaggtcccctgaggt

SEQ ID NO: 5419928 - DNA, 19 bp, Homo sapiens
gcagaggtcccctgaggtc

SEQ ID NO: 5419929 - DNA, 14 bp, Homo sapiens
gcagaggtctccaa

SEQ ID NO: 5419930 - DNA, 19 bp, Homo sapiens
gcagaggtctccaaactga

SEQ ID NO: 5419931 - DNA, 13 bp, Homo sapiens
gcagaggtggggt

SEQ ID NO: 5419932 - DNA, 20 bp, Homo sapiens
gcagaggtggggtgctgggg

SEQ ID NO: 5419933 - DNA, 18 bp, Homo sapiens
gcagaggtggtctggtgc

SEQ ID NO: 5419934 - DNA, 18 bp, Homo sapiens
gcagaggttgcagtgagc

SEQ ID NO: 5419935 - DNA, 21 bp, Homo sapiens
gcagaggttgcagtgagctga

SEQ ID NO: 5419936 - DNA, 22 bp, Homo sapiens
gcagagtaaaattacagaagaa

SEQ ID NO: 5419937 - DNA, 19 bp, Homo sapiens
gcagagtaaattgctctgt

SEQ ID NO: 5419938 - DNA, 17 bp, Homo sapiens
gcagagtaattcaggca

SEQ ID NO: 5419939 - DNA, 15 bp, Homo sapiens
gcagagtagctgctt

SEQ ID NO: 5419940 - DNA, 17 bp, Homo sapiens
gcagagtagctgcttcc

SEQ ID NO: 5419941 - DNA, 15 bp, Homo sapiens
gcagagtcaagctga

SEQ ID NO: 5419942 - DNA, 16 bp, Homo sapiens
gcagagtcctgccttc

SEQ ID NO: 5419943 - DNA, 19 bp, Homo sapiens
gcagagtcctgccttcttc

SEQ ID NO: 5419944 - DNA, 18 bp, Homo sapiens
gcagagtctgggcctctg

SEQ ID NO: 5419945 - DNA, 14 bp, Homo sapiens
gcagagtctgtctc

SEQ ID NO: 5419946 - DNA, 14 bp, Homo sapiens
gcagagtgaaattc

SEQ ID NO: 5419947 - DNA, 15 bp, Homo sapiens
gcagagtgcacagct

SEQ ID NO: 5419948 - DNA, 20 bp, Homo sapiens
gcagagtggaaactcagccg

SEQ ID NO: 5419949 - DNA, 19 bp, Homo sapiens
gcagagtggactgcattta

SEQ ID NO: 5419950 - DNA, 17 bp, Homo sapiens
gcagagtggagcccagg

SEQ ID NO: 5419951 - DNA, 18 bp, Homo sapiens
gcagagtggagcccaggg

SEQ ID NO: 5419952 - DNA, 19 bp, Homo sapiens
gcagagtggagcccagggt

SEQ ID NO: 5419953 - DNA, 22 bp, Homo sapiens
gcagagtggcagtcttcagttt

SEQ ID NO: 5419954 - DNA, 17 bp, Homo sapiens
gcagagtggcctgtgag

SEQ ID NO: 5419955 - DNA, 21 bp, Homo sapiens
gcagagtggcgtggcctcccc

SEQ ID NO: 5419956 - DNA, 22 bp, Homo sapiens
gcagagtggcgtggcctcccca

SEQ ID NO: 5419957 - DNA, 13 bp, Homo sapiens
gcagagtgggact

SEQ ID NO: 5419958 - DNA, 18 bp, Homo sapiens
gcagagtgggacttggag

SEQ ID NO: 5419959 - DNA, 19 bp, Homo sapiens
gcagagtgggacttggaga

SEQ ID NO: 5419960 - DNA, 16 bp, Homo sapiens
gcagagtgggctgcct

SEQ ID NO: 5419961 - DNA, 18 bp, Homo sapiens
gcagagtgggctgcctgg

SEQ ID NO: 5419962 - DNA, 13 bp, Homo sapiens
gcagagttaaatc

SEQ ID NO: 5419963 - DNA, 18 bp, Homo sapiens
gcagagttacagttctgt

SEQ ID NO: 5419964 - DNA, 18 bp, Homo sapiens
gcagagttctcctggagg

SEQ ID NO: 5419965 - DNA, 19 bp, Homo sapiens
gcagagttctttgcaagct

SEQ ID NO: 5419966 - DNA, 15 bp, Homo sapiens
gcagagttgaagaca

SEQ ID NO: 5419967 - DNA, 16 bp, Homo sapiens
gcagagttgtaaatat

SEQ ID NO: 5419968 - DNA, 21 bp, Homo sapiens
gcagagttgtaaatatataaa

SEQ ID NO: 5419969 - DNA, 23 bp, Homo sapiens
gcagagttgtaaatatataaata

SEQ ID NO: 5419970 - DNA, 18 bp, Homo sapiens
gcagagtttccaaaacca

SEQ ID NO: 5419971 - DNA, 13 bp, Homo sapiens
gcagagtttgcct

SEQ ID NO: 5419972 - DNA, 20 bp, Homo sapiens
gcagagtttgtgtgttgtct

SEQ ID NO: 5419973 - DNA, 24 bp, Homo sapiens
gcagagtttgtgtgttgtcttgaa

SEQ ID NO: 5419974 - DNA, 16 bp, Homo sapiens
gcagataaagacagct

SEQ ID NO: 5419975 - DNA, 21 bp, Homo sapiens
gcagataaagacagctgacag

SEQ ID NO: 5419976 - DNA, 14 bp, Homo sapiens
gcagataaatacat

SEQ ID NO: 5419977 - DNA, 21 bp, Homo sapiens
gcagataacatttgtgtgtta

SEQ ID NO: 5419978 - DNA, 15 bp, Homo sapiens
gcagataaggccgag

SEQ ID NO: 5419979 - DNA, 21 bp, Homo sapiens
gcagataaggccgagcccaca

SEQ ID NO: 5419980 - DNA, 22 bp, Homo sapiens
gcagataagttggagcaggggt

SEQ ID NO: 5419981 - DNA, 18 bp, Homo sapiens
gcagataatcagcctctt

SEQ ID NO: 5419982 - DNA, 19 bp, Homo sapiens
gcagataattctggaccag

SEQ ID NO: 5419983 - DNA, 22 bp, Homo sapiens
gcagataattctggaccagaga

SEQ ID NO: 5419984 - DNA, 14 bp, Homo sapiens
gcagatactttgaa

SEQ ID NO: 5419985 - DNA, 17 bp, Homo sapiens
gcagatagcccaggagc

SEQ ID NO: 5419986 - DNA, 15 bp, Homo sapiens
gcagatagtgcctct

SEQ ID NO: 5419987 - DNA, 17 bp, Homo sapiens
gcagatcacctgaggtc

SEQ ID NO: 5419988 - DNA, 14 bp, Homo sapiens
gcagatcacttgag

SEQ ID NO: 5419989 - DNA, 14 bp, Homo sapiens
gcagatcatctggg

SEQ ID NO: 5419990 - DNA, 14 bp, Homo sapiens
gcagatccaggact

SEQ ID NO: 5419991 - DNA, 15 bp, Homo sapiens
gcagatcccagctca

SEQ ID NO: 5419992 - DNA, 18 bp, Homo sapiens
gcagatccccactgtcct

SEQ ID NO: 5419993 - DNA, 20 bp, Homo sapiens
gcagatcgtgccgtggagct

SEQ ID NO: 5419994 - DNA, 16 bp, Homo sapiens
gcagatctagccaggc

SEQ ID NO: 5419995 - DNA, 19 bp, Homo sapiens
gcagatctagccaggcctc

SEQ ID NO: 5419996 - DNA, 22 bp, Homo sapiens
gcagatctcccacatgccaggg

SEQ ID NO: 5419997 - DNA, 20 bp, Homo sapiens
gcagatctgtgccccatgcc

SEQ ID NO: 5419998 - DNA, 14 bp, Homo sapiens
gcagatctgtgcct

SEQ ID NO: 5419999 - DNA, 17 bp, Homo sapiens
gcagatctgtgcctggg

SEQ ID NO: 5420000 - DNA, 13 bp, Homo sapiens
gcagatcttttct

SEQ ID NO: 5420001 - DNA, 13 bp, Homo sapiens
gcagatgacaaaa

SEQ ID NO: 5420002 - DNA, 13 bp, Homo sapiens
gcagatgactgag

SEQ ID NO: 5420003 - DNA, 14 bp, Homo sapiens
gcagatgagggctg

SEQ ID NO: 5420004 - DNA, 18 bp, Homo sapiens
gcagatgaggggccactg

SEQ ID NO: 5420005 - DNA, 17 bp, Homo sapiens
gcagatgataaaaggaa

SEQ ID NO: 5420006 - DNA, 14 bp, Homo sapiens
gcagatgatccatg

SEQ ID NO: 5420007 - DNA, 18 bp, Homo sapiens
gcagatgcaaagaggcaa

SEQ ID NO: 5420008 - DNA, 13 bp, Homo sapiens
gcagatgccagag

SEQ ID NO: 5420009 - DNA, 13 bp, Homo sapiens
gcagatgcccttg

SEQ ID NO: 5420010 - DNA, 23 bp, Homo sapiens
gcagatgcccttgctgggcctgg

SEQ ID NO: 5420011 - DNA, 20 bp, Homo sapiens
gcagatgctagcacatgccc

SEQ ID NO: 5420012 - DNA, 23 bp, Homo sapiens
gcagatgctagcgcgttgcctgt

SEQ ID NO: 5420013 - DNA, 23 bp, Homo sapiens
gcagatgctttgcccaggcttct

SEQ ID NO: 5420014 - DNA, 18 bp, Homo sapiens
gcagatggaatgctgtgt

SEQ ID NO: 5420015 - DNA, 18 bp, Homo sapiens
gcagatggagaccccttg

SEQ ID NO: 5420016 - DNA, 20 bp, Homo sapiens
gcagatggatccacgtgctc

SEQ ID NO: 5420017 - DNA, 21 bp, Homo sapiens
gcagatgggcctgtgtgcacc

SEQ ID NO: 5420018 - DNA, 17 bp, Homo sapiens
gcagatgggcggacggc

SEQ ID NO: 5420019 - DNA, 16 bp, Homo sapiens
gcagatgggggcctct

SEQ ID NO: 5420020 - DNA, 14 bp, Homo sapiens
gcagatgggtgcta

SEQ ID NO: 5420021 - DNA, 23 bp, Homo sapiens
gcagatggtctgagttcttgtgt

SEQ ID NO: 5420022 - DNA, 20 bp, Homo sapiens
gcagatgtaaagttattctt

SEQ ID NO: 5420023 - DNA, 22 bp, Homo sapiens
gcagatgtaaagttattcttga

SEQ ID NO: 5420024 - DNA, 17 bp, Homo sapiens
gcagatgtaggagggac

SEQ ID NO: 5420025 - DNA, 17 bp, Homo sapiens
gcagatgtcccccactg

SEQ ID NO: 5420026 - DNA, 18 bp, Homo sapiens
gcagatgtcccccactgc

SEQ ID NO: 5420027 - DNA, 15 bp, Homo sapiens
gcagatgtgagccac

SEQ ID NO: 5420028 - DNA, 16 bp, Homo sapiens
gcagatgtgcagcaga

SEQ ID NO: 5420029 - DNA, 16 bp, Homo sapiens
gcagatgttcaaatat

SEQ ID NO: 5420030 - DNA, 17 bp, Homo sapiens
gcagatgtttaatgaag

SEQ ID NO: 5420031 - DNA, 20 bp, Homo sapiens
gcagattaataacagaaata

SEQ ID NO: 5420032 - DNA, 16 bp, Homo sapiens
gcagattacaataaat

SEQ ID NO: 5420033 - DNA, 19 bp, Homo sapiens
gcagattacaataaatcct

SEQ ID NO: 5420034 - DNA, 15 bp, Homo sapiens
gcagattacactgat

SEQ ID NO: 5420035 - DNA, 20 bp, Homo sapiens
gcagattagtaactgttcct

SEQ ID NO: 5420036 - DNA, 18 bp, Homo sapiens
gcagattattcactgatt

SEQ ID NO: 5420037 - DNA, 15 bp, Homo sapiens
gcagattatttgccc

SEQ ID NO: 5420038 - DNA, 23 bp, Homo sapiens
gcagattattttagtctgtcatc

SEQ ID NO: 5420039 - DNA, 17 bp, Homo sapiens
gcagattcctgggcctg

SEQ ID NO: 5420040 - DNA, 23 bp, Homo sapiens
gcagattgagacctacaggctga

SEQ ID NO: 5420041 - DNA, 19 bp, Homo sapiens
gcagattggagaaaccctt

SEQ ID NO: 5420042 - DNA, 17 bp, Homo sapiens
gcagattgggctggctc

SEQ ID NO: 5420043 - DNA, 21 bp, Homo sapiens
gcagattggttcatgcctggg

SEQ ID NO: 5420044 - DNA, 20 bp, Homo sapiens
gcagattgtgtaacaatttt

SEQ ID NO: 5420045 - DNA, 18 bp, Homo sapiens
gcagatttactgtcccag

SEQ ID NO: 5420046 - DNA, 19 bp, Homo sapiens
gcagatttactgtcccagg

SEQ ID NO: 5420047 - DNA, 22 bp, Homo sapiens
gcagatttactgtcccaggagc

SEQ ID NO: 5420048 - DNA, 22 bp, Homo sapiens
gcagatttatttttgaaacaaa

SEQ ID NO: 5420049 - DNA, 17 bp, Homo sapiens
gcagatttctgccttga

SEQ ID NO: 5420050 - DNA, 17 bp, Homo sapiens
gcagatttgatatttgc

SEQ ID NO: 5420051 - DNA, 17 bp, Homo sapiens
gcagattttacaaaaga

SEQ ID NO: 5420052 - DNA, 17 bp, Homo sapiens
gcagattttagttttat

SEQ ID NO: 5420053 - DNA, 18 bp, Homo sapiens
gcagattttcttaaggaa

SEQ ID NO: 5420054 - DNA, 22 bp, Homo sapiens
gcagattttcttaaggaatttt

SEQ ID NO: 5420055 - DNA, 19 bp, Homo sapiens
gcagattttgcccttgaca

SEQ ID NO: 5420056 - DNA, 21 bp, Homo sapiens
gcagatttttatgttttgaaa

SEQ ID NO: 5420057 - DNA, 16 bp, Homo sapiens
gcagcaaacactccac

SEQ ID NO: 5420058 - DNA, 14 bp, Homo sapiens
gcagcaaagagggg

SEQ ID NO: 5420059 - DNA, 18 bp, Homo sapiens
gcagcaaagaggggcgct

SEQ ID NO: 5420060 - DNA, 13 bp, Homo sapiens
gcagcaaaggaag

SEQ ID NO: 5420061 - DNA, 15 bp, Homo sapiens
gcagcaaaggaagac

SEQ ID NO: 5420062 - DNA, 18 bp, Homo sapiens
gcagcaaataaacaacta

SEQ ID NO: 5420063 - DNA, 20 bp, Homo sapiens
gcagcaaatagcaaatgaaa

SEQ ID NO: 5420064 - DNA, 19 bp, Homo sapiens
gcagcaaatgccactctgg

SEQ ID NO: 5420065 - DNA, 14 bp, Homo sapiens
gcagcaacaactgt

SEQ ID NO: 5420066 - DNA, 11 bp, Homo sapiens
gcagcaacaat

SEQ ID NO: 5420067 - DNA, 19 bp, Homo sapiens
gcagcaacacaatgttatt

SEQ ID NO: 5420068 - DNA, 20 bp, Homo sapiens
gcagcaacacccaagtccac

SEQ ID NO: 5420069 - DNA, 14 bp, Homo sapiens
gcagcaacaggacc

SEQ ID NO: 5420070 - DNA, 19 bp, Homo sapiens
gcagcaacaggaccaggag

SEQ ID NO: 5420071 - DNA, 21 bp, Homo sapiens
gcagcaacaggaccaggagcc

SEQ ID NO: 5420072 - DNA, 17 bp, Homo sapiens
gcagcaaccagagcact

SEQ ID NO: 5420073 - DNA, 18 bp, Homo sapiens
gcagcaaccagagcactg

SEQ ID NO: 5420074 - DNA, 20 bp, Homo sapiens
gcagcaaccagagcactgta

SEQ ID NO: 5420075 - DNA, 15 bp, Homo sapiens
gcagcaaccattcat

SEQ ID NO: 5420076 - DNA, 15 bp, Homo sapiens
gcagcaactcccacg

SEQ ID NO: 5420077 - DNA, 16 bp, Homo sapiens
gcagcaacttgtccta

SEQ ID NO: 5420078 - DNA, 22 bp, Homo sapiens
gcagcaacttgtcctagcacag

SEQ ID NO: 5420079 - DNA, 14 bp, Homo sapiens
gcagcaagcctggc

SEQ ID NO: 5420080 - DNA, 11 bp, Homo sapiens
gcagcaaggcc

SEQ ID NO: 5420081 - DNA, 17 bp, Homo sapiens
gcagcaaggcccgagca

SEQ ID NO: 5420082 - DNA, 16 bp, Homo sapiens
gcagcaaggccctgct

SEQ ID NO: 5420083 - DNA, 13 bp, Homo sapiens
gcagcaaggtggg

SEQ ID NO: 5420084 - DNA, 23 bp, Homo sapiens
gcagcaatatattaccagcaaga

SEQ ID NO: 5420085 - DNA, 20 bp, Homo sapiens
gcagcaatattttgtatatt

SEQ ID NO: 5420086 - DNA, 15 bp, Homo sapiens
gcagcaatcacaaag

SEQ ID NO: 5420087 - DNA, 14 bp, Homo sapiens
gcagcaatctgtct

SEQ ID NO: 5420088 - DNA, 14 bp, Homo sapiens
gcagcaatctttga

SEQ ID NO: 5420089 - DNA, 22 bp, Homo sapiens
gcagcaattcacgctgtctctt

SEQ ID NO: 5420090 - DNA, 21 bp, Homo sapiens
gcagcacaaagaaacagcctt

SEQ ID NO: 5420091 - DNA, 14 bp, Homo sapiens
gcagcacaaggaat

SEQ ID NO: 5420092 - DNA, 15 bp, Homo sapiens
gcagcacacctcagc

SEQ ID NO: 5420093 - DNA, 22 bp, Homo sapiens
gcagcacacctcagccccactg

SEQ ID NO: 5420094 - DNA, 22 bp, Homo sapiens
gcagcacagagtcgctggcatg

SEQ ID NO: 5420095 - DNA, 12 bp, Homo sapiens
gcagcacagcaa

SEQ ID NO: 5420096 - DNA, 22 bp, Homo sapiens
gcagcctagcctatgtctggca

SEQ ID NO: 5420097 - DNA, 15 bp, Homo sapiens
gcagcctcacagtcc

SEQ ID NO: 5420098 - DNA, 11 bp, Homo sapiens
gcagcctcaga

SEQ ID NO: 5420099 - DNA, 23 bp, Homo sapiens
gcagcctcagaggccccttgctg

SEQ ID NO: 5420100 - DNA, 18 bp, Homo sapiens
gcagcctcagggcttcct

SEQ ID NO: 5420101 - DNA, 12 bp, Homo sapiens
gcagcctccact

SEQ ID NO: 5420102 - DNA, 16 bp, Homo sapiens
gcagcctccacttccc

SEQ ID NO: 5420103 - DNA, 17 bp, Homo sapiens
gcagcctccagagccag

SEQ ID NO: 5420104 - DNA, 19 bp, Homo sapiens
gcagcctccagagccagcc

SEQ ID NO: 5420105 - DNA, 23 bp, Homo sapiens
gcagcctccagtctgctctcagc

SEQ ID NO: 5420106 - DNA, 21 bp, Homo sapiens
gcagcctccagtgctggctgc

SEQ ID NO: 5420107 - DNA, 22 bp, Homo sapiens
gcagcctccagtgctggctgct

SEQ ID NO: 5420108 - DNA, 22 bp, Homo sapiens
gcagcctccagttgtagcaggt

SEQ ID NO: 5420109 - DNA, 23 bp, Homo sapiens
gcagcctccctgtcactcagctg

SEQ ID NO: 5420110 - DNA, 13 bp, Homo sapiens
gcagcctcccttc

SEQ ID NO: 5420111 - DNA, 14 bp, Homo sapiens
gcagcctccggggt

SEQ ID NO: 5420112 - DNA, 21 bp, Homo sapiens
gcagcctccggggttcagcct

SEQ ID NO: 5420113 - DNA, 14 bp, Homo sapiens
gcagcctcctcctg

SEQ ID NO: 5420114 - DNA, 15 bp, Homo sapiens
gcagcctcctcctga

SEQ ID NO: 5420115 - DNA, 13 bp, Homo sapiens
gcagcctcctggg

SEQ ID NO: 5420116 - DNA, 14 bp, Homo sapiens
gcagcctcctgggc

SEQ ID NO: 5420117 - DNA, 16 bp, Homo sapiens
gcagcctcctgggcag

SEQ ID NO: 5420118 - DNA, 19 bp, Homo sapiens
gcagcctcgaactcctggg

SEQ ID NO: 5420119 - DNA, 21 bp, Homo sapiens
gcagcctcgaactcctgggct

SEQ ID NO: 5420120 - DNA, 23 bp, Homo sapiens
gcagcctcgacctccctggcttg

SEQ ID NO: 5420121 - DNA, 23 bp, Homo sapiens
gcagcctcgagtgcccctgtccc

SEQ ID NO: 5420122 - DNA, 23 bp, Homo sapiens
gcagcctcgcacaggccctagct

SEQ ID NO: 5420123 - DNA, 13 bp, Homo sapiens
gcagcctcgtgga

SEQ ID NO: 5420124 - DNA, 22 bp, Homo sapiens
gcagcctctcagtgccctccag

SEQ ID NO: 5420125 - DNA, 20 bp, Homo sapiens
gcagcctctccgactctgca

SEQ ID NO: 5420126 - DNA, 17 bp, Homo sapiens
gcagcctctctggctgg

SEQ ID NO: 5420127 - DNA, 23 bp, Homo sapiens
gcagcctctcttcactgctacat

SEQ ID NO: 5420128 - DNA, 14 bp, Homo sapiens
gcagcctctgaagt

SEQ ID NO: 5420129 - DNA, 22 bp, Homo sapiens
gcagcctctgaagttggacagc

SEQ ID NO: 5420130 - DNA, 19 bp, Homo sapiens
gcagcctctgatctgtgca

SEQ ID NO: 5420131 - DNA, 18 bp, Homo sapiens
gcagcctctgccaggcct

SEQ ID NO: 5420132 - DNA, 12 bp, Homo sapiens
gcagcctctgga

SEQ ID NO: 5420133 - DNA, 22 bp, Homo sapiens
gcagcctctggggggtggccag

SEQ ID NO: 5420134 - DNA, 14 bp, Homo sapiens
gcagcctgaacact

SEQ ID NO: 5420135 - DNA, 13 bp, Homo sapiens
gcagcctgaagcc

SEQ ID NO: 5420136 - DNA, 20 bp, Homo sapiens
gcagcctgaccccaggcagc

SEQ ID NO: 5420137 - DNA, 13 bp, Homo sapiens
gcagcctgagaat

SEQ ID NO: 5420138 - DNA, 14 bp, Homo sapiens
gcagcctgagaatg

SEQ ID NO: 5420139 - DNA, 17 bp, Homo sapiens
gcagcctgagctccacc

SEQ ID NO: 5420140 - DNA, 22 bp, Homo sapiens
gcagcctgagctccaccctccc

SEQ ID NO: 5420141 - DNA, 12 bp, Homo sapiens
gcagcctgatgg

SEQ ID NO: 5420142 - DNA, 14 bp, Homo sapiens
gcagcctgatggcc

SEQ ID NO: 5420143 - DNA, 18 bp, Homo sapiens
gcagcctgatggccaagg

SEQ ID NO: 5420144 - DNA, 21 bp, Homo sapiens
gcagcctgatggccaaggggg

SEQ ID NO: 5420145 - DNA, 12 bp, Homo sapiens
gcagcctgcacc

SEQ ID NO: 5420146 - DNA, 16 bp, Homo sapiens
gcagcctgcacctgcc

SEQ ID NO: 5420147 - DNA, 17 bp, Homo sapiens
gcagcctgcacctgccc

SEQ ID NO: 5420148 - DNA, 19 bp, Homo sapiens
gcagcctgcacctgccccg

SEQ ID NO: 5420149 - DNA, 13 bp, Homo sapiens
gcagcctgccagc

SEQ ID NO: 5420150 - DNA, 16 bp, Homo sapiens
gcagcctgcccctaga

SEQ ID NO: 5420151 - DNA, 13 bp, Homo sapiens
gcagcctgcctgg

SEQ ID NO: 5420152 - DNA, 23 bp, Homo sapiens
gcagcctgcgccaccgcccagag

SEQ ID NO: 5420153 - DNA, 19 bp, Homo sapiens
gcagcctgcgctcggcagg

SEQ ID NO: 5420154 - DNA, 21 bp, Homo sapiens
gcagcctgcgctcggcaggaa

SEQ ID NO: 5420155 - DNA, 22 bp, Homo sapiens
gcagcctgcgctcggcaggaag

SEQ ID NO: 5420156 - DNA, 23 bp, Homo sapiens
gcagcctgcgctcggcaggaagg

SEQ ID NO: 5420157 - DNA, 19 bp, Homo sapiens
gcagcctgcgtggctgacc

SEQ ID NO: 5420158 - DNA, 15 bp, Homo sapiens
gcagcctgctggggc

SEQ ID NO: 5420159 - DNA, 19 bp, Homo sapiens
gcagcctgctttggccttt

SEQ ID NO: 5420160 - DNA, 22 bp, Homo sapiens
gcagcctgctttggcctttcct

SEQ ID NO: 5420161 - DNA, 13 bp, Homo sapiens
gcagcctggagac

SEQ ID NO: 5420162 - DNA, 12 bp, Homo sapiens
gcagcctggagc

SEQ ID NO: 5420163 - DNA, 13 bp, Homo sapiens
gcagcctggagcc

SEQ ID NO: 5420164 - DNA, 19 bp, Homo sapiens
gcagcctggagccctggag

SEQ ID NO: 5420165 - DNA, 17 bp, Homo sapiens
gcagcctggcatctgtg

SEQ ID NO: 5420166 - DNA, 11 bp, Homo sapiens
gcagcctggcg

SEQ ID NO: 5420167 - DNA, 21 bp, Homo sapiens
gcagcctggcggggcaggagg

SEQ ID NO: 5420168 - DNA, 22 bp, Homo sapiens
gcagcctggcggggcaggaggc

SEQ ID NO: 5420169 - DNA, 14 bp, Homo sapiens
gcagcctggctccc

SEQ ID NO: 5420170 - DNA, 21 bp, Homo sapiens
gcagcctggctcccaggacac

SEQ ID NO: 5420171 - DNA, 20 bp, Homo sapiens
gcagcctggctcccctgggg

SEQ ID NO: 5420172 - DNA, 20 bp, Homo sapiens
gcagcctggctggtcctccc

SEQ ID NO: 5420173 - DNA, 21 bp, Homo sapiens
gcagcctggctggtcctccca

SEQ ID NO: 5420174 - DNA, 22 bp, Homo sapiens
gcagcctgggctccctcttgtg

SEQ ID NO: 5420175 - DNA, 17 bp, Homo sapiens
gcagcctggggcggtgt

SEQ ID NO: 5420176 - DNA, 19 bp, Homo sapiens
gcagcctgggtctggatgg

SEQ ID NO: 5420177 - DNA, 23 bp, Homo sapiens
gcagcctggttccctctttcctg

SEQ ID NO: 5420178 - DNA, 17 bp, Homo sapiens
gcagcctggttggcagc

SEQ ID NO: 5420179 - DNA, 14 bp, Homo sapiens
gcagcctgtatgtg

SEQ ID NO: 5420180 - DNA, 17 bp, Homo sapiens
gcagcctgtatgtggtg

SEQ ID NO: 5420181 - DNA, 21 bp, Homo sapiens
gcagcctgtatgtggtgtggg

SEQ ID NO: 5420182 - DNA, 21 bp, Homo sapiens
gcagcctgttttcactcagct

SEQ ID NO: 5420183 - DNA, 19 bp, Homo sapiens
gcagccttcatcagaactc

SEQ ID NO: 5420184 - DNA, 12 bp, Homo sapiens
gcagccttccag

SEQ ID NO: 5420185 - DNA, 20 bp, Homo sapiens
gcagccttccagtggcttct

SEQ ID NO: 5420186 - DNA, 23 bp, Homo sapiens
gcagccttccagtggcttctccc

SEQ ID NO: 5420187 - DNA, 16 bp, Homo sapiens
gcagccttcccctccc

SEQ ID NO: 5420188 - DNA, 18 bp, Homo sapiens
gcagccttcccctccctg

SEQ ID NO: 5420189 - DNA, 19 bp, Homo sapiens
gcagccttcccctccctgt

SEQ ID NO: 5420190 - DNA, 21 bp, Homo sapiens
gcagccttcccctccctgtat

SEQ ID NO: 5420191 - DNA, 18 bp, Homo sapiens
gcagccttgcgctgtccc

SEQ ID NO: 5420192 - DNA, 22 bp, Homo sapiens
gcagccttgcgctgtcccaggc

SEQ ID NO: 5420193 - DNA, 15 bp, Homo sapiens
gcagccttggcaaac

SEQ ID NO: 5420194 - DNA, 22 bp, Homo sapiens
gcagccttggggaaccccgagc

SEQ ID NO: 5420195 - DNA, 15 bp, Homo sapiens
gcagccttggggcat

SEQ ID NO: 5420196 - DNA, 23 bp, Homo sapiens
gcagccttgggggggctgccttt

SEQ ID NO: 5420197 - DNA, 12 bp, Homo sapiens
gcagccttgtga

SEQ ID NO: 5420198 - DNA, 23 bp, Homo sapiens
gcagcctttctgtggagagtgag

SEQ ID NO: 5420199 - DNA, 22 bp, Homo sapiens
gcagcctttttctggccttgac

SEQ ID NO: 5420200 - DNA, 16 bp, Homo sapiens
gcagcgaccacccctg

SEQ ID NO: 5420201 - DNA, 20 bp, Homo sapiens
gcagcgaccacccctgcctc

SEQ ID NO: 5420202 - DNA, 12 bp, Homo sapiens
gcagcgagcctg

SEQ ID NO: 5420203 - DNA, 16 bp, Homo sapiens
gcagcgaggctgggct

SEQ ID NO: 5420204 - DNA, 23 bp, Homo sapiens
gcagcgcacggtctggggaagag

SEQ ID NO: 5420205 - DNA, 16 bp, Homo sapiens
gcagcgcagccgagcc

SEQ ID NO: 5420206 - DNA, 17 bp, Homo sapiens
gcagcgcagccgagccc

SEQ ID NO: 5420207 - DNA, 14 bp, Homo sapiens
gcagcgcagggctg

SEQ ID NO: 5420208 - DNA, 15 bp, Homo sapiens
gcagcgcattgtttt

SEQ ID NO: 5420209 - DNA, 19 bp, Homo sapiens
gcagcgccacccagtggaa

SEQ ID NO: 5420210 - DNA, 17 bp, Homo sapiens
gcagcgcccagcctggc

SEQ ID NO: 5420211 - DNA, 15 bp, Homo sapiens
gcagcgcccaggcct

SEQ ID NO: 5420212 - DNA, 20 bp, Homo sapiens
gcagcgcccaggcctgctgg

SEQ ID NO: 5420213 - DNA, 14 bp, Homo sapiens
gcagcgccccacca

SEQ ID NO: 5420214 - DNA, 23 bp, Homo sapiens
gcagcgcccccatctgtcttcag

SEQ ID NO: 5420215 - DNA, 16 bp, Homo sapiens
gcagcgcccctctgca

SEQ ID NO: 5420216 - DNA, 21 bp, Homo sapiens
gcagcgcccgaggccagggcc

SEQ ID NO: 5420217 - DNA, 15 bp, Homo sapiens
gcagcgcctccaccc

SEQ ID NO: 5420218 - DNA, 17 bp, Homo sapiens
gcagcgcctcccgccgc

SEQ ID NO: 5420219 - DNA, 15 bp, Homo sapiens
gcagcgcctcctgga

SEQ ID NO: 5420220 - DNA, 13 bp, Homo sapiens
gcagcgcctgtcc

SEQ ID NO: 5420221 - DNA, 16 bp, Homo sapiens
gcagcgcctgtcccct

SEQ ID NO: 5420222 - DNA, 20 bp, Homo sapiens
gcagcgcctgtcccctcaca

SEQ ID NO: 5420223 - DNA, 13 bp, Homo sapiens
gcagcgcctttcc

SEQ ID NO: 5420224 - DNA, 17 bp, Homo sapiens
gcagcgctagtggaggg

SEQ ID NO: 5420225 - DNA, 21 bp, Homo sapiens
gcagcggaagggactctgggc

SEQ ID NO: 5420226 - DNA, 22 bp, Homo sapiens
gcagcggaagggactctgggct

SEQ ID NO: 5420227 - DNA, 13 bp, Homo sapiens
gcagcggcagagc

SEQ ID NO: 5420228 - DNA, 13 bp, Homo sapiens
gcagcggcccaga

SEQ ID NO: 5420229 - DNA, 22 bp, Homo sapiens
gcagcggctctggtcctcggag

SEQ ID NO: 5420230 - DNA, 22 bp, Homo sapiens
gcagcggctgccctctggggcc

SEQ ID NO: 5420231 - DNA, 22 bp, Homo sapiens
gcagcgggagcctccctgcctc

SEQ ID NO: 5420232 - DNA, 13 bp, Homo sapiens
gcagcgggccagg

SEQ ID NO: 5420233 - DNA, 16 bp, Homo sapiens
gcagcgggccaggcag

SEQ ID NO: 5420234 - DNA, 17 bp, Homo sapiens
gcagcgggccaggcccg

SEQ ID NO: 5420235 - DNA, 15 bp, Homo sapiens
gcagcgggcggaggg

SEQ ID NO: 5420236 - DNA, 14 bp, Homo sapiens
gcagcggggctggc

SEQ ID NO: 5420237 - DNA, 15 bp, Homo sapiens
gcagcggggctggcc

SEQ ID NO: 5420238 - DNA, 21 bp, Homo sapiens
gcagcggtggaaggagcctgc

SEQ ID NO: 5420239 - DNA, 22 bp, Homo sapiens
gcagcggtggaaggagcctgcg

SEQ ID NO: 5420240 - DNA, 19 bp, Homo sapiens
gcagcggtgggaaggaaag

SEQ ID NO: 5420241 - DNA, 13 bp, Homo sapiens
gcagcgtcccccg

SEQ ID NO: 5420242 - DNA, 15 bp, Homo sapiens
gcagcgtcccccgcc

SEQ ID NO: 5420243 - DNA, 17 bp, Homo sapiens
gcagcgtcccccgccgc

SEQ ID NO: 5420244 - DNA, 16 bp, Homo sapiens
gcagcgtctgagcggc

SEQ ID NO: 5420245 - DNA, 21 bp, Homo sapiens
gcagcgtctgagcggccgcct

SEQ ID NO: 5420246 - DNA, 22 bp, Homo sapiens
gcagcgtctgagcggccgcctg

SEQ ID NO: 5420247 - DNA, 19 bp, Homo sapiens
gcagcgtgccgagccagca

SEQ ID NO: 5420248 - DNA, 15 bp, Homo sapiens
gcagcgtgggctctg

SEQ ID NO: 5420249 - DNA, 21 bp, Homo sapiens
gcagcgtgggctctgccaatg

SEQ ID NO: 5420250 - DNA, 18 bp, Homo sapiens
gcagcgtgtgggtcccgc

SEQ ID NO: 5420251 - DNA, 18 bp, Homo sapiens
gcagcgttagggctgctt

SEQ ID NO: 5420252 - DNA, 21 bp, Homo sapiens
gcagcgtttatggtgcttcct

SEQ ID NO: 5420253 - DNA, 17 bp, Homo sapiens
gcagctaacaatgtctg

SEQ ID NO: 5420254 - DNA, 22 bp, Homo sapiens
gcagctaagatagaaagctgga

SEQ ID NO: 5420255 - DNA, 19 bp, Homo sapiens
gcagctaagctcaaatgta

SEQ ID NO: 5420256 - DNA, 17 bp, Homo sapiens
gcagctaatttgtgaaa

SEQ ID NO: 5420257 - DNA, 14 bp, Homo sapiens
gcagctaccctcag

SEQ ID NO: 5420258 - DNA, 15 bp, Homo sapiens
gcagctaccctcagc

SEQ ID NO: 5420259 - DNA, 16 bp, Homo sapiens
gcagctaccctcagcc

SEQ ID NO: 5420260 - DNA, 17 bp, Homo sapiens
gcagctactgtaacttt

SEQ ID NO: 5420261 - DNA, 19 bp, Homo sapiens
gcagctactgtaacttttt

SEQ ID NO: 5420262 - DNA, 13 bp, Homo sapiens
gcagctagctgct

SEQ ID NO: 5420263 - DNA, 16 bp, Homo sapiens
gcagctagctgctttt

SEQ ID NO: 5420264 - DNA, 16 bp, Homo sapiens
gcagctaggactgagg

SEQ ID NO: 5420265 - DNA, 20 bp, Homo sapiens
gcagctaggactgaggagtg

SEQ ID NO: 5420266 - DNA, 22 bp, Homo sapiens
gcagctaggcagggagggggct

SEQ ID NO: 5420267 - DNA, 21 bp, Homo sapiens
gcagctagtcctagtgaacct

SEQ ID NO: 5420268 - DNA, 15 bp, Homo sapiens
gcagctcaaaggcac

SEQ ID NO: 5420269 - DNA, 17 bp, Homo sapiens
gcagctcaacctaccct

SEQ ID NO: 5420270 - DNA, 16 bp, Homo sapiens
gcagctcacaccctac

SEQ ID NO: 5420271 - DNA, 19 bp, Homo sapiens
gcagctcacaccctacctt

SEQ ID NO: 5420272 - DNA, 18 bp, Homo sapiens
gcaggagtgccaggacca

SEQ ID NO: 5420273 - DNA, 20 bp, Homo sapiens
gcaggagtgccaggaccagc

SEQ ID NO: 5420274 - DNA, 15 bp, Homo sapiens
gcaggagtgctgccc

SEQ ID NO: 5420275 - DNA, 21 bp, Homo sapiens
gcaggagtgctgccctctccc

SEQ ID NO: 5420276 - DNA, 13 bp, Homo sapiens
gcaggagtggaag

SEQ ID NO: 5420277 - DNA, 19 bp, Homo sapiens
gcaggagtggccggggaag

SEQ ID NO: 5420278 - DNA, 19 bp, Homo sapiens
gcaggagtgggctctgagc

SEQ ID NO: 5420279 - DNA, 18 bp, Homo sapiens
gcaggagtggtgcagaca

SEQ ID NO: 5420280 - DNA, 21 bp, Homo sapiens
gcaggagtgtcctgcccatgc

SEQ ID NO: 5420281 - DNA, 20 bp, Homo sapiens
gcaggagtgtcctggctgtg

SEQ ID NO: 5420282 - DNA, 16 bp, Homo sapiens
gcaggagttcctttcc

SEQ ID NO: 5420283 - DNA, 19 bp, Homo sapiens
gcaggagttgggggcaggt

SEQ ID NO: 5420284 - DNA, 22 bp, Homo sapiens
gcaggatagttgctccgcctct

SEQ ID NO: 5420285 - DNA, 21 bp, Homo sapiens
gcaggatcaaagacacacagg

SEQ ID NO: 5420286 - DNA, 23 bp, Homo sapiens
gcaggatcagatgactctctcca

SEQ ID NO: 5420287 - DNA, 15 bp, Homo sapiens
gcaggatccctcctg

SEQ ID NO: 5420288 - DNA, 17 bp, Homo sapiens
gcaggatctcaagccag

SEQ ID NO: 5420289 - DNA, 22 bp, Homo sapiens
gcaggatctcaccaggcagcct

SEQ ID NO: 5420290 - DNA, 12 bp, Homo sapiens
gcaggatctcag

SEQ ID NO: 5420291 - DNA, 14 bp, Homo sapiens
gcaggatctgtctg

SEQ ID NO: 5420292 - DNA, 21 bp, Homo sapiens
gcaggatgaattttctgcagc

SEQ ID NO: 5420293 - DNA, 20 bp, Homo sapiens
gcaggatgaccacgcacctc

SEQ ID NO: 5420294 - DNA, 23 bp, Homo sapiens
gcaggatgaccacgcacctccac

SEQ ID NO: 5420295 - DNA, 14 bp, Homo sapiens
gcaggatggaacta

SEQ ID NO: 5420296 - DNA, 17 bp, Homo sapiens
gcaggatggcctttcct

SEQ ID NO: 5420297 - DNA, 18 bp, Homo sapiens
gcaggattcagccggagg

SEQ ID NO: 5420298 - DNA, 17 bp, Homo sapiens
gcaggattcccttctgg

SEQ ID NO: 5420299 - DNA, 18 bp, Homo sapiens
gcaggattcccttctggg

SEQ ID NO: 5420300 - DNA, 21 bp, Homo sapiens
gcaggattcccttctgggctt

SEQ ID NO: 5420301 - DNA, 15 bp, Homo sapiens
gcaggattctagcct

SEQ ID NO: 5420302 - DNA, 14 bp, Homo sapiens
gcaggattgaaaat

SEQ ID NO: 5420303 - DNA, 22 bp, Homo sapiens
gcaggattgaaaatgtccagga

SEQ ID NO: 5420304 - DNA, 21 bp, Homo sapiens
gcaggattggggaagagagcc

SEQ ID NO: 5420305 - DNA, 21 bp, Homo sapiens
gcaggatttttagagcattaa

SEQ ID NO: 5420306 - DNA, 22 bp, Homo sapiens
gcaggatttttagagcattaaa

SEQ ID NO: 5420307 - DNA, 23 bp, Homo sapiens
gcaggatttttagagcattaaaa

SEQ ID NO: 5420308 - DNA, 19 bp, Homo sapiens
gcaggcaaaaaagggacag

SEQ ID NO: 5420309 - DNA, 21 bp, Homo sapiens
gcaggcaagacaccttcccag

SEQ ID NO: 5420310 - DNA, 14 bp, Homo sapiens
gcaggcaagccctt

SEQ ID NO: 5420311 - DNA, 15 bp, Homo sapiens
gcaggcaagggctct

SEQ ID NO: 5420312 - DNA, 19 bp, Homo sapiens
gcaggcaatgctgtacttt

SEQ ID NO: 5420313 - DNA, 17 bp, Homo sapiens
gcaggcacacacgcctt

SEQ ID NO: 5420314 - DNA, 21 bp, Homo sapiens
gcaggcacacacgccttcatg

SEQ ID NO: 5420315 - DNA, 17 bp, Homo sapiens
gcaggcacacagcagcc

SEQ ID NO: 5420316 - DNA, 12 bp, Homo sapiens
gcaggcacagca

SEQ ID NO: 5420317 - DNA, 13 bp, Homo sapiens
gcaggcacagcac

SEQ ID NO: 5420318 - DNA, 14 bp, Homo sapiens
gcaggcacaggaca

SEQ ID NO: 5420319 - DNA, 22 bp, Homo sapiens
gcaggcaccgctgggttctgac

SEQ ID NO: 5420320 - DNA, 14 bp, Homo sapiens
gcaggcaccgggct

SEQ ID NO: 5420321 - DNA, 15 bp, Homo sapiens
gcaggcaccgggctg

SEQ ID NO: 5420322 - DNA, 16 bp, Homo sapiens
gcaggcacctgggctt

SEQ ID NO: 5420323 - DNA, 12 bp, Homo sapiens
gcaggcacctgt

SEQ ID NO: 5420324 - DNA, 18 bp, Homo sapiens
gcaggcacgggtggtccc

SEQ ID NO: 5420325 - DNA, 20 bp, Homo sapiens
gcaggcacgggtggtccccg

SEQ ID NO: 5420326 - DNA, 10 bp, Homo sapiens
gcaggcagac

SEQ ID NO: 5420327 - DNA, 11 bp, Homo sapiens
gcaggcagaca

SEQ ID NO: 5420328 - DNA, 11 bp, Homo sapiens
gcaggcagaga

SEQ ID NO: 5420329 - DNA, 23 bp, Homo sapiens
gcaggcagagcggggaggtgcct

SEQ ID NO: 5420330 - DNA, 24 bp, Homo sapiens
gcaggcagagcggggaggtgcctg

SEQ ID NO: 5420331 - DNA, 13 bp, Homo sapiens
gcaggcagagctc

SEQ ID NO: 5420332 - DNA, 18 bp, Homo sapiens
gcaggcagagctcagcac

SEQ ID NO: 5420333 - DNA, 21 bp, Homo sapiens
gcaggcagagctcagcacagc

SEQ ID NO: 5420334 - DNA, 24 bp, Homo sapiens
gcaggcagagctcagcacagcctc

SEQ ID NO: 5420335 - DNA, 20 bp, Homo sapiens
gcaggcagaggcccaggctg

SEQ ID NO: 5420336 - DNA, 21 bp, Homo sapiens
gcaggcagaggcccaggctgc

SEQ ID NO: 5420337 - DNA, 12 bp, Homo sapiens
gcaggcagccag

SEQ ID NO: 5420338 - DNA, 19 bp, Homo sapiens
gcaggcagccagcatctgg

SEQ ID NO: 5420339 - DNA, 13 bp, Homo sapiens
gcaggcagccagg

SEQ ID NO: 5420340 - DNA, 20 bp, Homo sapiens
gcaggcagcctgagagctgg

SEQ ID NO: 5420341 - DNA, 22 bp, Homo sapiens
gcaggcagcctgagagctggcc

SEQ ID NO: 5420342 - DNA, 18 bp, Homo sapiens
gcaggcagcgccaagcaa

SEQ ID NO: 5420343 - DNA, 23 bp, Homo sapiens
gcaggcagctaggcagggagggg

SEQ ID NO: 5420344 - DNA, 18 bp, Homo sapiens
gcaggcaggaacaaacag

SEQ ID NO: 5420345 - DNA, 22 bp, Homo sapiens
gcaggcaggaacaaacagggct

SEQ ID NO: 5420346 - DNA, 12 bp, Homo sapiens
gcaggcaggcac

SEQ ID NO: 5420347 - DNA, 14 bp, Homo sapiens
gcaggcaggcactg

SEQ ID NO: 5420348 - DNA, 16 bp, Homo sapiens
gcaggcaggcagacca

SEQ ID NO: 5420349 - DNA, 14 bp, Homo sapiens
gcaggcaggctggg

SEQ ID NO: 5420350 - DNA, 15 bp, Homo sapiens
gcaggcaggctgggg

SEQ ID NO: 5420351 - DNA, 14 bp, Homo sapiens
gcaggcagggagaa

SEQ ID NO: 5420352 - DNA, 13 bp, Homo sapiens
gcaggcagggctc

SEQ ID NO: 5420353 - DNA, 16 bp, Homo sapiens
gcaggcagggctctcc

SEQ ID NO: 5420354 - DNA, 16 bp, Homo sapiens
gcaggcagggctgggc

SEQ ID NO: 5420355 - DNA, 17 bp, Homo sapiens
gcaggcagggctgggcc

SEQ ID NO: 5420356 - DNA, 18 bp, Homo sapiens
gcaggcagggctgggcca

SEQ ID NO: 5420357 - DNA, 12 bp, Homo sapiens
gcaggcaggggc

SEQ ID NO: 5420358 - DNA, 19 bp, Homo sapiens
gcaggcaggtggactgact

SEQ ID NO: 5420359 - DNA, 9 bp, Homo sapiens
gcaggcagt

SEQ ID NO: 5420360 - DNA, 23 bp, Homo sapiens
gcaggcagtggggctggaagcag

SEQ ID NO: 5420361 - DNA, 21 bp, Homo sapiens
gcaggcatcggggagccggga

SEQ ID NO: 5420362 - DNA, 13 bp, Homo sapiens
gcaggcatggccc

SEQ ID NO: 5420363 - DNA, 22 bp, Homo sapiens
gcaggcatggctggtgcctgaa

SEQ ID NO: 5420364 - DNA, 21 bp, Homo sapiens
gcaggccaaacatggccagac

SEQ ID NO: 5420365 - DNA, 19 bp, Homo sapiens
gcaggccaaggccttctcc

SEQ ID NO: 5420366 - DNA, 21 bp, Homo sapiens
gcaggccaaggccttctcctc

SEQ ID NO: 5420367 - DNA, 22 bp, Homo sapiens
gcaggccaaggtctgagccaca

SEQ ID NO: 5420368 - DNA, 17 bp, Homo sapiens
gcaggccacccgggctg

SEQ ID NO: 5420369 - DNA, 20 bp, Homo sapiens
gcaggccacccgggctgcct

SEQ ID NO: 5420370 - DNA, 21 bp, Homo sapiens
gcaggccacctggctctcacc

SEQ ID NO: 5420371 - DNA, 12 bp, Homo sapiens
gcaggccagaga

SEQ ID NO: 5420372 - DNA, 17 bp, Homo sapiens
gcaggccagatggcccc

SEQ ID NO: 5420373 - DNA, 19 bp, Homo sapiens
gcaggccagatggcccctc

SEQ ID NO: 5420374 - DNA, 19 bp, Homo sapiens
gcaggccagcttcgtgctg

SEQ ID NO: 5420375 - DNA, 17 bp, Homo sapiens
gcaggccaggccagctg

SEQ ID NO: 5420376 - DNA, 20 bp, Homo sapiens
gcaggccaggttatgcctca

SEQ ID NO: 5420377 - DNA, 23 bp, Homo sapiens
gcaggccagtcccacggctctgt

SEQ ID NO: 5420378 - DNA, 13 bp, Homo sapiens
gcaggccagtgtc

SEQ ID NO: 5420379 - DNA, 23 bp, Homo sapiens
gcaggcccaatgctgcttttggg

SEQ ID NO: 5420380 - DNA, 16 bp, Homo sapiens
gcaggcccaccctgct

SEQ ID NO: 5420381 - DNA, 18 bp, Homo sapiens
gcaggcccactccccagc

SEQ ID NO: 5420382 - DNA, 20 bp, Homo sapiens
gcaggcccactccccagccc

SEQ ID NO: 5420383 - DNA, 15 bp, Homo sapiens
gcaggcccagcatgc

SEQ ID NO: 5420384 - DNA, 18 bp, Homo sapiens
gcaggcccagcctctgcc

SEQ ID NO: 5420385 - DNA, 14 bp, Homo sapiens
gcaggcccatggga

SEQ ID NO: 5420386 - DNA, 23 bp, Homo sapiens
gcaggccccagccaagtgccttc

SEQ ID NO: 5420387 - DNA, 16 bp, Homo sapiens
gcaggcccctctcctc

SEQ ID NO: 5420388 - DNA, 18 bp, Homo sapiens
gcaggcccctttggacct

SEQ ID NO: 5420389 - DNA, 17 bp, Homo sapiens
gcaggcccgacagagag

SEQ ID NO: 5420390 - DNA, 23 bp, Homo sapiens
gcaggcccgacagagagatgaag

SEQ ID NO: 5420391 - DNA, 11 bp, Homo sapiens
gcaggccctcc

SEQ ID NO: 5420392 - DNA, 22 bp, Homo sapiens
gcaggccctccgcgggggacag

SEQ ID NO: 5420393 - DNA, 11 bp, Homo sapiens
gcaggccctgc

SEQ ID NO: 5420394 - DNA, 12 bp, Homo sapiens
gcaggccctgca

SEQ ID NO: 5420395 - DNA, 15 bp, Homo sapiens
gcaggccctgcactg

SEQ ID NO: 5420396 - DNA, 18 bp, Homo sapiens
gcaggccctgcactgtcc

SEQ ID NO: 5420397 - DNA, 14 bp, Homo sapiens
gcaggccctgcagt

SEQ ID NO: 5420398 - DNA, 15 bp, Homo sapiens
gcaggccctgcccag

SEQ ID NO: 5420399 - DNA, 17 bp, Homo sapiens
gcaggccctgcccagcc

SEQ ID NO: 5420400 - DNA, 18 bp, Homo sapiens
gcaggccctgcccagcca

SEQ ID NO: 5420401 - DNA, 19 bp, Homo sapiens
gcaggccctgcccagccag

SEQ ID NO: 5420402 - DNA, 22 bp, Homo sapiens
gcaggccctgcccagccagcca

SEQ ID NO: 5420403 - DNA, 18 bp, Homo sapiens
gcaggccctgggcctcca

SEQ ID NO: 5420404 - DNA, 19 bp, Homo sapiens
gcaggccctgggcctccac

SEQ ID NO: 5420405 - DNA, 20 bp, Homo sapiens
gcaggccctgggcctccacc

SEQ ID NO: 5420406 - DNA, 23 bp, Homo sapiens
gcaggccctgggcctccacctct

SEQ ID NO: 5420407 - DNA, 21 bp, Homo sapiens
gcaggccctggtggagaggcc

SEQ ID NO: 5420408 - DNA, 13 bp, Homo sapiens
gcaggccctgtcc

SEQ ID NO: 5420409 - DNA, 17 bp, Homo sapiens
gcaggccctgtccagcc

SEQ ID NO: 5420410 - DNA, 18 bp, Homo sapiens
gcaggccctgtccagccc

SEQ ID NO: 5420411 - DNA, 19 bp, Homo sapiens
gcaggccctgtccagcccc

SEQ ID NO: 5420412 - DNA, 23 bp, Homo sapiens
gcaggcccttcccattctgcccc

SEQ ID NO: 5420413 - DNA, 19 bp, Homo sapiens
gcaggccgggcctgctgtc

SEQ ID NO: 5420414 - DNA, 20 bp, Homo sapiens
gcaggccgtgacgtctgggt

SEQ ID NO: 5420415 - DNA, 15 bp, Homo sapiens
gcaggcctaagacat

SEQ ID NO: 5420416 - DNA, 21 bp, Homo sapiens
gcaggcctaggacctcaggcg

SEQ ID NO: 5420417 - DNA, 20 bp, Homo sapiens
gcaggcctccaacgcccctg

SEQ ID NO: 5420418 - DNA, 21 bp, Homo sapiens
gcaggcctccaacgcccctgt

SEQ ID NO: 5420419 - DNA, 18 bp, Homo sapiens
gcaggcctccctgccagt

SEQ ID NO: 5420420 - DNA, 21 bp, Homo sapiens
gcaggcctctgggacccacag

SEQ ID NO: 5420421 - DNA, 13 bp, Homo sapiens
gcaggcctgaccc

SEQ ID NO: 5420422 - DNA, 15 bp, Homo sapiens
gcaggcctgacccac

SEQ ID NO: 5420423 - DNA, 14 bp, Homo sapiens
gcaggcctgagaat

SEQ ID NO: 5420424 - DNA, 14 bp, Homo sapiens
gcaggcctgccttc

SEQ ID NO: 5420425 - DNA, 18 bp, Homo sapiens
gcaggcctgccttctcag

SEQ ID NO: 5420426 - DNA, 21 bp, Homo sapiens
gcaggcctgccttctcaggga

SEQ ID NO: 5420427 - DNA, 12 bp, Homo sapiens
gcaggcctggga

SEQ ID NO: 5420428 - DNA, 18 bp, Homo sapiens
gcaggcctgggacccagc

SEQ ID NO: 5420429 - DNA, 19 bp, Homo sapiens
gcaggcctgggacccagct

SEQ ID NO: 5420430 - DNA, 13 bp, Homo sapiens
gcaggcctgttcc

SEQ ID NO: 5420431 - DNA, 19 bp, Homo sapiens
gcaggcctgttccctgagg

SEQ ID NO: 5420432 - DNA, 21 bp, Homo sapiens
gcaggcctgttccctgaggac

SEQ ID NO: 5420433 - DNA, 22 bp, Homo sapiens
gcaggccttagtacggctgctg

SEQ ID NO: 5420434 - DNA, 16 bp, Homo sapiens
gcaggccttgctgggg

SEQ ID NO: 5420435 - DNA, 20 bp, Homo sapiens
gcaggccttgctggggtcca

SEQ ID NO: 5420436 - DNA, 13 bp, Homo sapiens
gcaggcctttcct

SEQ ID NO: 5420437 - DNA, 14 bp, Homo sapiens
gcaggcctttccta

SEQ ID NO: 5420438 - DNA, 23 bp, Homo sapiens
gcaggcgacaaaatctcctggct

SEQ ID NO: 5420439 - DNA, 17 bp, Homo sapiens
gcaggcgaccgggcctc

SEQ ID NO: 5420440 - DNA, 18 bp, Homo sapiens
gcaggcggctcctcctca

SEQ ID NO: 5420441 - DNA, 16 bp, Homo sapiens
gcaggcggggctcctc

SEQ ID NO: 5420442 - DNA, 21 bp, Homo sapiens
gcaggcggggctcctcctgaa

SEQ ID NO: 5420443 - DNA, 20 bp, Homo sapiens
gcaggcgggggctgctcagc

SEQ ID NO: 5420444 - DNA, 23 bp, Homo sapiens
gcaggcggggggggcgcctggag

SEQ ID NO: 5420445 - DNA, 15 bp, Homo sapiens
gcaggcggtatccag

SEQ ID NO: 5420446 - DNA, 19 bp, Homo sapiens
gcaggcggtatccagaggt

SEQ ID NO: 5420447 - DNA, 14 bp, Homo sapiens
gcaggcggtcccca

SEQ ID NO: 5420448 - DNA, 13 bp, Homo sapiens
gcaggtgctgctg

SEQ ID NO: 5420449 - DNA, 19 bp, Homo sapiens
gcaggtgctggagcactgg

SEQ ID NO: 5420450 - DNA, 20 bp, Homo sapiens
gcaggtgctggagcactggg

SEQ ID NO: 5420451 - DNA, 17 bp, Homo sapiens
gcaggtgctgtgcgcct

SEQ ID NO: 5420452 - DNA, 15 bp, Homo sapiens
gcaggtgcttttggc

SEQ ID NO: 5420453 - DNA, 18 bp, Homo sapiens
gcaggtggactgactgtg

SEQ ID NO: 5420454 - DNA, 19 bp, Homo sapiens
gcaggtggactgactgtgt

SEQ ID NO: 5420455 - DNA, 20 bp, Homo sapiens
gcaggtggactgactgtgtt

SEQ ID NO: 5420456 - DNA, 22 bp, Homo sapiens
gcaggtggactgactgtgttgg

SEQ ID NO: 5420457 - DNA, 15 bp, Homo sapiens
gcaggtggccacagc

SEQ ID NO: 5420458 - DNA, 22 bp, Homo sapiens
gcaggtggccacagcaggactg

SEQ ID NO: 5420459 - DNA, 16 bp, Homo sapiens
gcaggtggccagggct

SEQ ID NO: 5420460 - DNA, 22 bp, Homo sapiens
gcaggtggccgcccctgaggct

SEQ ID NO: 5420461 - DNA, 15 bp, Homo sapiens
gcaggtggcctccct

SEQ ID NO: 5420462 - DNA, 16 bp, Homo sapiens
gcaggtggcctccctc

SEQ ID NO: 5420463 - DNA, 15 bp, Homo sapiens
gcaggtgggagctga

SEQ ID NO: 5420464 - DNA, 15 bp, Homo sapiens
gcaggtgggcactgg

SEQ ID NO: 5420465 - DNA, 16 bp, Homo sapiens
gcaggtgggctgggcc

SEQ ID NO: 5420466 - DNA, 14 bp, Homo sapiens
gcaggtgggtgctg

SEQ ID NO: 5420467 - DNA, 15 bp, Homo sapiens
gcaggtggtcctgag

SEQ ID NO: 5420468 - DNA, 21 bp, Homo sapiens
gcaggtggtcctgagacctga

SEQ ID NO: 5420469 - DNA, 15 bp, Homo sapiens
gcaggtggtggaggg

SEQ ID NO: 5420470 - DNA, 17 bp, Homo sapiens
gcaggtggtggaggggc

SEQ ID NO: 5420471 - DNA, 14 bp, Homo sapiens
gcaggtggtggcac

SEQ ID NO: 5420472 - DNA, 21 bp, Homo sapiens
gcaggtggtggcactgagccc

SEQ ID NO: 5420473 - DNA, 20 bp, Homo sapiens
gcaggtggtgtcgggccctt

SEQ ID NO: 5420474 - DNA, 22 bp, Homo sapiens
gcaggtgtcatatatggggggc

SEQ ID NO: 5420475 - DNA, 15 bp, Homo sapiens
gcaggtgtcctgagc

SEQ ID NO: 5420476 - DNA, 23 bp, Homo sapiens
gcaggtgtcctttcccctctctg

SEQ ID NO: 5420477 - DNA, 14 bp, Homo sapiens
gcaggtgtgaccct

SEQ ID NO: 5420478 - DNA, 16 bp, Homo sapiens
gcaggtgtgaccctga

SEQ ID NO: 5420479 - DNA, 18 bp, Homo sapiens
gcaggtgtgaccctgagg

SEQ ID NO: 5420480 - DNA, 20 bp, Homo sapiens
gcaggtgtgaccctgagggc

SEQ ID NO: 5420481 - DNA, 18 bp, Homo sapiens
gcaggtgtgagggcagtg

SEQ ID NO: 5420482 - DNA, 21 bp, Homo sapiens
gcaggtgtgggatctggggag

SEQ ID NO: 5420483 - DNA, 15 bp, Homo sapiens
gcaggtgtgggctcc

SEQ ID NO: 5420484 - DNA, 16 bp, Homo sapiens
gcaggtgtgggctccc

SEQ ID NO: 5420485 - DNA, 23 bp, Homo sapiens
gcaggtgtgggctcccacgccct

SEQ ID NO: 5420486 - DNA, 13 bp, Homo sapiens
gcaggtgtggtgg

SEQ ID NO: 5420487 - DNA, 16 bp, Homo sapiens
gcaggtgttctgctga

SEQ ID NO: 5420488 - DNA, 23 bp, Homo sapiens
gcaggttaaatgttttgtaaact

SEQ ID NO: 5420489 - DNA, 14 bp, Homo sapiens
gcaggttaccttgg

SEQ ID NO: 5420490 - DNA, 16 bp, Homo sapiens
gcaggttagaacctag

SEQ ID NO: 5420491 - DNA, 14 bp, Homo sapiens
gcaggttagaagaa

SEQ ID NO: 5420492 - DNA, 15 bp, Homo sapiens
gcaggttagagaaaa

SEQ ID NO: 5420493 - DNA, 19 bp, Homo sapiens
gcaggttatgtcagcagct

SEQ ID NO: 5420494 - DNA, 13 bp, Homo sapiens
gcaggttcagttt

SEQ ID NO: 5420495 - DNA, 16 bp, Homo sapiens
gcaggttcccaagctc

SEQ ID NO: 5420496 - DNA, 19 bp, Homo sapiens
gcaggttcccaagctcaga

SEQ ID NO: 5420497 - DNA, 19 bp, Homo sapiens
gcaggttccccaagggccc

SEQ ID NO: 5420498 - DNA, 20 bp, Homo sapiens
gcaggttccccaagggccct

SEQ ID NO: 5420499 - DNA, 21 bp, Homo sapiens
gcaggttccccaagggccctg

SEQ ID NO: 5420500 - DNA, 13 bp, Homo sapiens
gcaggttcctggg

SEQ ID NO: 5420501 - DNA, 14 bp, Homo sapiens
gcaggttcctgggg

SEQ ID NO: 5420502 - DNA, 21 bp, Homo sapiens
gcaggttcctggggccgcctg

SEQ ID NO: 5420503 - DNA, 13 bp, Homo sapiens
gcaggttctcttt

SEQ ID NO: 5420504 - DNA, 16 bp, Homo sapiens
gcaggttcttgatgtc

SEQ ID NO: 5420505 - DNA, 23 bp, Homo sapiens
gcaggttcttgatgtcatgtact

SEQ ID NO: 5420506 - DNA, 21 bp, Homo sapiens
gcaggttgaggggctcctgga

SEQ ID NO: 5420507 - DNA, 22 bp, Homo sapiens
gcaggttggaaggggccttgct

SEQ ID NO: 5420508 - DNA, 13 bp, Homo sapiens
gcaggttggatgg

SEQ ID NO: 5420509 - DNA, 23 bp, Homo sapiens
gcaggttggatgggagtgggcac

SEQ ID NO: 5420510 - DNA, 21 bp, Homo sapiens
gcaggttggcaaacgggcttg

SEQ ID NO: 5420511 - DNA, 22 bp, Homo sapiens
gcaggttggcaaacgggcttga

SEQ ID NO: 5420512 - DNA, 22 bp, Homo sapiens
gcaggttgtgtgtgtgtgcagt

SEQ ID NO: 5420513 - DNA, 15 bp, Homo sapiens
gcaggtttcatttct

SEQ ID NO: 5420514 - DNA, 21 bp, Homo sapiens
gcaggtttctccttgaagcaa

SEQ ID NO: 5420515 - DNA, 12 bp, Homo sapiens
gcagtaaaataa

SEQ ID NO: 5420516 - DNA, 16 bp, Homo sapiens
gcagtaaaataaaaaa

SEQ ID NO: 5420517 - DNA, 15 bp, Homo sapiens
gcagtaaagagaaac

SEQ ID NO: 5420518 - DNA, 18 bp, Homo sapiens
gcagtaaagagaaacttt

SEQ ID NO: 5420519 - DNA, 13 bp, Homo sapiens
gcagtaaatactt

SEQ ID NO: 5420520 - DNA, 19 bp, Homo sapiens
gcagtaaatccacagccaa

SEQ ID NO: 5420521 - DNA, 23 bp, Homo sapiens
gcagtaactgtccctgctttctg

SEQ ID NO: 5420522 - DNA, 22 bp, Homo sapiens
gcagtaatattttaagatggac

SEQ ID NO: 5420523 - DNA, 23 bp, Homo sapiens
gcagtaattaatatctcctggaa

SEQ ID NO: 5420524 - DNA, 13 bp, Homo sapiens
gcagtacaaatgt

SEQ ID NO: 5420525 - DNA, 16 bp, Homo sapiens
gcagtacaataaaagt

SEQ ID NO: 5420526 - DNA, 17 bp, Homo sapiens
gcagtacaataaaagta

SEQ ID NO: 5420527 - DNA, 16 bp, Homo sapiens
gcagtacagtgtgtgt

SEQ ID NO: 5420528 - DNA, 17 bp, Homo sapiens
gcagtacatcttgtgca

SEQ ID NO: 5420529 - DNA, 22 bp, Homo sapiens
gcagtacatcttgtgcatgcaa

SEQ ID NO: 5420530 - DNA, 23 bp, Homo sapiens
gcagtaccctccattgggcacag

SEQ ID NO: 5420531 - DNA, 14 bp, Homo sapiens
gcagtacctgggaa

SEQ ID NO: 5420532 - DNA, 18 bp, Homo sapiens
gcagtacctgggaaagga

SEQ ID NO: 5420533 - DNA, 19 bp, Homo sapiens
gcagtactcctccctgggg

SEQ ID NO: 5420534 - DNA, 13 bp, Homo sapiens
gcagtacttttgt

SEQ ID NO: 5420535 - DNA, 19 bp, Homo sapiens
gcagtagaaataatatgca

SEQ ID NO: 5420536 - DNA, 13 bp, Homo sapiens
gcagtagagagca

SEQ ID NO: 5420537 - DNA, 16 bp, Homo sapiens
gcagtagagagccttt

SEQ ID NO: 5420538 - DNA, 17 bp, Homo sapiens
gcagtagagagcctttc

SEQ ID NO: 5420539 - DNA, 16 bp, Homo sapiens
gcagtagatcattttt

SEQ ID NO: 5420540 - DNA, 18 bp, Homo sapiens
gcagtagattttctttaa

SEQ ID NO: 5420541 - DNA, 15 bp, Homo sapiens
gcagtagcagctgtg

SEQ ID NO: 5420542 - DNA, 21 bp, Homo sapiens
gcagtagccaaacaccacttt

SEQ ID NO: 5420543 - DNA, 13 bp, Homo sapiens
gcagtagccagca

SEQ ID NO: 5420544 - DNA, 22 bp, Homo sapiens
gcagtagcctcctcctgggctc

SEQ ID NO: 5420545 - DNA, 22 bp, Homo sapiens
gcagtaggcattctttagtcta

SEQ ID NO: 5420546 - DNA, 13 bp, Homo sapiens
gcagtaggggagg

SEQ ID NO: 5420547 - DNA, 17 bp, Homo sapiens
gcagtagtctctgtgct

SEQ ID NO: 5420548 - DNA, 23 bp, Homo sapiens
gcagtagtgccaaaaggcccctt

SEQ ID NO: 5420549 - DNA, 17 bp, Homo sapiens
gcagtagtttggtttga

SEQ ID NO: 5420550 - DNA, 17 bp, Homo sapiens
gcagtatataataactt

SEQ ID NO: 5420551 - DNA, 18 bp, Homo sapiens
gcagtatataataacttt

SEQ ID NO: 5420552 - DNA, 15 bp, Homo sapiens
gcagtatcagagggt

SEQ ID NO: 5420553 - DNA, 20 bp, Homo sapiens
gcagtatcggcactgtacaa

SEQ ID NO: 5420554 - DNA, 15 bp, Homo sapiens
gcagtatctctctgc

SEQ ID NO: 5420555 - DNA, 20 bp, Homo sapiens
gcagtatgatggcaggagaa

SEQ ID NO: 5420556 - DNA, 21 bp, Homo sapiens
gcagtatggcggaggccatgg

SEQ ID NO: 5420557 - DNA, 15 bp, Homo sapiens
gcagtatgtgatgga

SEQ ID NO: 5420558 - DNA, 18 bp, Homo sapiens
gcagtatgtgatggactg

SEQ ID NO: 5420559 - DNA, 15 bp, Homo sapiens
gcagtattcttgcac

SEQ ID NO: 5420560 - DNA, 20 bp, Homo sapiens
gcagtattgagttgtttaaa

SEQ ID NO: 5420561 - DNA, 23 bp, Homo sapiens
gcagtattgccacaatgcctctc

SEQ ID NO: 5420562 - DNA, 17 bp, Homo sapiens
gcagtattttgtgtcct

SEQ ID NO: 5420563 - DNA, 18 bp, Homo sapiens
gcagtcaaggttgtcaat

SEQ ID NO: 5420564 - DNA, 22 bp, Homo sapiens
gcagtcacactgctgggaagtg

SEQ ID NO: 5420565 - DNA, 17 bp, Homo sapiens
gcagtcacaggcccagg

SEQ ID NO: 5420566 - DNA, 12 bp, Homo sapiens
gcagtcacaggt

SEQ ID NO: 5420567 - DNA, 17 bp, Homo sapiens
gcagtcacatcacaata

SEQ ID NO: 5420568 - DNA, 15 bp, Homo sapiens
gcagtcaccacccag

SEQ ID NO: 5420569 - DNA, 18 bp, Homo sapiens
gcagtcaccacccagccc

SEQ ID NO: 5420570 - DNA, 22 bp, Homo sapiens
gcagtcaccacccagcccttcc

SEQ ID NO: 5420571 - DNA, 23 bp, Homo sapiens
gcagtcaccacccagcccttcct

SEQ ID NO: 5420572 - DNA, 17 bp, Homo sapiens
gcagtcacccctgtctg

SEQ ID NO: 5420573 - DNA, 17 bp, Homo sapiens
gcagtcacgtgaggccc

SEQ ID NO: 5420574 - DNA, 18 bp, Homo sapiens
gcagtcacgtgaggcccc

SEQ ID NO: 5420575 - DNA, 22 bp, Homo sapiens
gcagtcacgtgaggcccctgtg

SEQ ID NO: 5420576 - DNA, 20 bp, Homo sapiens
gcagtcactgggagaggtta

SEQ ID NO: 5420577 - DNA, 13 bp, Homo sapiens
gcagtcagagtcc

SEQ ID NO: 5420578 - DNA, 19 bp, Homo sapiens
gcagtcagcagatgctgtt

SEQ ID NO: 5420579 - DNA, 17 bp, Homo sapiens
gcagtcatcaacaaaag

SEQ ID NO: 5420580 - DNA, 23 bp, Homo sapiens
gcagtcatcaacaatgattaatc

SEQ ID NO: 5420581 - DNA, 14 bp, Homo sapiens
gcagtcatcagaag

SEQ ID NO: 5420582 - DNA, 21 bp, Homo sapiens
gcagtcatggagaaccaccta

SEQ ID NO: 5420583 - DNA, 12 bp, Homo sapiens
gcagtcattttg

SEQ ID NO: 5420584 - DNA, 22 bp, Homo sapiens
gcagtccacttctgacagcctc

SEQ ID NO: 5420585 - DNA, 22 bp, Homo sapiens
gcagtccagagcttcagggctg

SEQ ID NO: 5420586 - DNA, 15 bp, Homo sapiens
gcagtccagagcttt

SEQ ID NO: 5420587 - DNA, 18 bp, Homo sapiens
gcagtccagagcttttca

SEQ ID NO: 5420588 - DNA, 20 bp, Homo sapiens
gcagtccaggcctctctctg

SEQ ID NO: 5420589 - DNA, 23 bp, Homo sapiens
gcagtccaggcctctctctgctc

SEQ ID NO: 5420590 - DNA, 12 bp, Homo sapiens
gcagtccatgca

SEQ ID NO: 5420591 - DNA, 14 bp, Homo sapiens
gcagtccatgcatg

SEQ ID NO: 5420592 - DNA, 16 bp, Homo sapiens
gcagtccatgcatgac

SEQ ID NO: 5420593 - DNA, 13 bp, Homo sapiens
gcagtcccacact

SEQ ID NO: 5420594 - DNA, 18 bp, Homo sapiens
gcagtcccacactgtgca

SEQ ID NO: 5420595 - DNA, 20 bp, Homo sapiens
gcagtcccattcatattaag

SEQ ID NO: 5420596 - DNA, 14 bp, Homo sapiens
gcagtccccagccc

SEQ ID NO: 5420597 - DNA, 17 bp, Homo sapiens
gcagtccccagcccttc

SEQ ID NO: 5420598 - DNA, 22 bp, Homo sapiens
gcagtccccagcccttctgcct

SEQ ID NO: 5420599 - DNA, 23 bp, Homo sapiens
gcagtccccagcccttctgcctt

SEQ ID NO: 5420600 - DNA, 16 bp, Homo sapiens
gcagtccccagtcacc

SEQ ID NO: 5420601 - DNA, 21 bp, Homo sapiens
gcagtccccttccctccaaga

SEQ ID NO: 5420602 - DNA, 21 bp, Homo sapiens
gcagtcccgtggagggtaggg

SEQ ID NO: 5420603 - DNA, 13 bp, Homo sapiens
gcagtccctgctt

SEQ ID NO: 5420604 - DNA, 21 bp, Homo sapiens
gcagtccgtgtggatccaatg

SEQ ID NO: 5420605 - DNA, 15 bp, Homo sapiens
gcagtcctccggggt

SEQ ID NO: 5420606 - DNA, 18 bp, Homo sapiens
gcagtcctcggcagctcc

SEQ ID NO: 5420607 - DNA, 19 bp, Homo sapiens
gcagtcctgatcagagccg

SEQ ID NO: 5420608 - DNA, 17 bp, Homo sapiens
gcagtcctgcctcagcc

SEQ ID NO: 5420609 - DNA, 14 bp, Homo sapiens
gcagtcctggaggc

SEQ ID NO: 5420610 - DNA, 14 bp, Homo sapiens
gcagtcctggcccc

SEQ ID NO: 5420611 - DNA, 16 bp, Homo sapiens
gcagtcctgggtcctc

SEQ ID NO: 5420612 - DNA, 22 bp, Homo sapiens
gcagtcctggtggggctgagcc

SEQ ID NO: 5420613 - DNA, 13 bp, Homo sapiens
gcagtcctgttca

SEQ ID NO: 5420614 - DNA, 14 bp, Homo sapiens
gcagtccttggcct

SEQ ID NO: 5420615 - DNA, 15 bp, Homo sapiens
gcagtccttggcctg

SEQ ID NO: 5420616 - DNA, 18 bp, Homo sapiens
gcagtccttggcctgcta

SEQ ID NO: 5420617 - DNA, 15 bp, Homo sapiens
gcagtcctttgtaaa

SEQ ID NO: 5420618 - DNA, 22 bp, Homo sapiens
gcagtcgcaggatccgctgcca

SEQ ID NO: 5420619 - DNA, 19 bp, Homo sapiens
gcagtcgcccaagcagaca

SEQ ID NO: 5420620 - DNA, 17 bp, Homo sapiens
gcagtcgcctgcctgca

SEQ ID NO: 5420621 - DNA, 22 bp, Homo sapiens
gcagtcgcctgcctgcagcagg

SEQ ID NO: 5420622 - DNA, 18 bp, Homo sapiens
gcagtcgctgcagggagc

SEQ ID NO: 5420623 - DNA, 17 bp, Homo sapiens
gcagtcgcttgccaaag

SEQ ID NO: 5420624 - DNA, 18 bp, Homo sapiens
gcatacacacatgccctc

SEQ ID NO: 5420625 - DNA, 14 bp, Homo sapiens
gcatacacatgcac

SEQ ID NO: 5420626 - DNA, 21 bp, Homo sapiens
gcatacagaaatataataaaa

SEQ ID NO: 5420627 - DNA, 23 bp, Homo sapiens
gcatacaggttaacctgcagaaa

SEQ ID NO: 5420628 - DNA, 13 bp, Homo sapiens
gcatacagttttc

SEQ ID NO: 5420629 - DNA, 16 bp, Homo sapiens
gcatacattttctggt

SEQ ID NO: 5420630 - DNA, 16 bp, Homo sapiens
gcataccacaagacat

SEQ ID NO: 5420631 - DNA, 20 bp, Homo sapiens
gcataccacttttgttcttg

SEQ ID NO: 5420632 - DNA, 23 bp, Homo sapiens
gcataccaggttttacacttgca

SEQ ID NO: 5420633 - DNA, 18 bp, Homo sapiens
gcatacccaaaccaggtg

SEQ ID NO: 5420634 - DNA, 16 bp, Homo sapiens
gcatacctttattgtg

SEQ ID NO: 5420635 - DNA, 20 bp, Homo sapiens
gcatacgagagcagaggtct

SEQ ID NO: 5420636 - DNA, 14 bp, Homo sapiens
gcatacgtacacat

SEQ ID NO: 5420637 - DNA, 15 bp, Homo sapiens
gcatacgtacacatt

SEQ ID NO: 5420638 - DNA, 17 bp, Homo sapiens
gcatacgtacacatttt

SEQ ID NO: 5420639 - DNA, 18 bp, Homo sapiens
gcatacgtacacatttta

SEQ ID NO: 5420640 - DNA, 18 bp, Homo sapiens
gcatacgtattgttaaat

SEQ ID NO: 5420641 - DNA, 21 bp, Homo sapiens
gcatactccgtgaggctgctg

SEQ ID NO: 5420642 - DNA, 16 bp, Homo sapiens
gcatactgaaaatcca

SEQ ID NO: 5420643 - DNA, 13 bp, Homo sapiens
gcatactgtgtat

SEQ ID NO: 5420644 - DNA, 13 bp, Homo sapiens
gcatacttcaaaa

SEQ ID NO: 5420645 - DNA, 21 bp, Homo sapiens
gcatacttcaaaactgtttgt

SEQ ID NO: 5420646 - DNA, 14 bp, Homo sapiens
gcatacttggatat

SEQ ID NO: 5420647 - DNA, 19 bp, Homo sapiens
gcatactttgacaaggaaa

SEQ ID NO: 5420648 - DNA, 15 bp, Homo sapiens
gcatactttgtaaat

SEQ ID NO: 5420649 - DNA, 16 bp, Homo sapiens
gcatactttgtaaata

SEQ ID NO: 5420650 - DNA, 18 bp, Homo sapiens
gcatactttgtattttga

SEQ ID NO: 5420651 - DNA, 13 bp, Homo sapiens
gcatactttttaa

SEQ ID NO: 5420652 - DNA, 15 bp, Homo sapiens
gcatactttttaaaa

SEQ ID NO: 5420653 - DNA, 18 bp, Homo sapiens
gcatagaaaaaagtagca

SEQ ID NO: 5420654 - DNA, 16 bp, Homo sapiens
gcatagaaactgagga

SEQ ID NO: 5420655 - DNA, 17 bp, Homo sapiens
gcatagaaactgaggag

SEQ ID NO: 5420656 - DNA, 19 bp, Homo sapiens
gcatagaaactgaggagta

SEQ ID NO: 5420657 - DNA, 21 bp, Homo sapiens
gcatagaaactgaggagtagc

SEQ ID NO: 5420658 - DNA, 23 bp, Homo sapiens
gcatagaaactgaggagtagctg

SEQ ID NO: 5420659 - DNA, 14 bp, Homo sapiens
gcatagaaggagga

SEQ ID NO: 5420660 - DNA, 15 bp, Homo sapiens
gcatagaaggcaggt

SEQ ID NO: 5420661 - DNA, 13 bp, Homo sapiens
gcatagaagtaaa

SEQ ID NO: 5420662 - DNA, 14 bp, Homo sapiens
gcatagaataatga

SEQ ID NO: 5420663 - DNA, 16 bp, Homo sapiens
gcatagacaagtgttt

SEQ ID NO: 5420664 - DNA, 23 bp, Homo sapiens
gcatagacatggatgcgaggacc

SEQ ID NO: 5420665 - DNA, 15 bp, Homo sapiens
gcatagactgaggta

SEQ ID NO: 5420666 - DNA, 20 bp, Homo sapiens
gcatagactgaggtataaag

SEQ ID NO: 5420667 - DNA, 23 bp, Homo sapiens
gcatagactgaggtataaagaca

SEQ ID NO: 5420668 - DNA, 10 bp, Homo sapiens
gcatagagca

SEQ ID NO: 5420669 - DNA, 11 bp, Homo sapiens
gcatagagcaa

SEQ ID NO: 5420670 - DNA, 16 bp, Homo sapiens
gcatagagccctggcc

SEQ ID NO: 5420671 - DNA, 17 bp, Homo sapiens
gcatagagccctggcca

SEQ ID NO: 5420672 - DNA, 23 bp, Homo sapiens
gcatagagccctggccagccctt

SEQ ID NO: 5420673 - DNA, 23 bp, Homo sapiens
gcatagatgttttggtagattaa

SEQ ID NO: 5420674 - DNA, 17 bp, Homo sapiens
gcatagcagaggggcca

SEQ ID NO: 5420675 - DNA, 18 bp, Homo sapiens
gcatagcagaggggccag

SEQ ID NO: 5420676 - DNA, 22 bp, Homo sapiens
gcatagcagaggggccaggccc

SEQ ID NO: 5420677 - DNA, 23 bp, Homo sapiens
gcatagcagaggggccaggccca

SEQ ID NO: 5420678 - DNA, 24 bp, Homo sapiens
gcatagcagaggggccaggcccag

SEQ ID NO: 5420679 - DNA, 15 bp, Homo sapiens
gcatagcagctgcta

SEQ ID NO: 5420680 - DNA, 23 bp, Homo sapiens
gcatagccagcattcagcacaca

SEQ ID NO: 5420681 - DNA, 22 bp, Homo sapiens
gcatagccagttctgacagtgt

SEQ ID NO: 5420682 - DNA, 15 bp, Homo sapiens
gcatagcctgcctga

SEQ ID NO: 5420683 - DNA, 15 bp, Homo sapiens
gcatagcgtcctgcc

SEQ ID NO: 5420684 - DNA, 16 bp, Homo sapiens
gcatagcgtcctgccc

SEQ ID NO: 5420685 - DNA, 15 bp, Homo sapiens
gcatagctacaattt

SEQ ID NO: 5420686 - DNA, 18 bp, Homo sapiens
gcatagctacaatttgtt

SEQ ID NO: 5420687 - DNA, 16 bp, Homo sapiens
gcatagctttccagtt

SEQ ID NO: 5420688 - DNA, 14 bp, Homo sapiens
gcataggaaaagaa

SEQ ID NO: 5420689 - DNA, 14 bp, Homo sapiens
gcataggagtgtgt

SEQ ID NO: 5420690 - DNA, 18 bp, Homo sapiens
gcataggagtttggagga

SEQ ID NO: 5420691 - DNA, 17 bp, Homo sapiens
gcataggctccttcctg

SEQ ID NO: 5420692 - DNA, 15 bp, Homo sapiens
gcataggctgcccaa

SEQ ID NO: 5420693 - DNA, 20 bp, Homo sapiens
gcataggctggggacacagg

SEQ ID NO: 5420694 - DNA, 23 bp, Homo sapiens
gcatagggaatatgtaagtcagg

SEQ ID NO: 5420695 - DNA, 16 bp, Homo sapiens
gcataggggggagggt

SEQ ID NO: 5420696 - DNA, 17 bp, Homo sapiens
gcataggggggagggtc

SEQ ID NO: 5420697 - DNA, 22 bp, Homo sapiens
gcatagggtccactttggtaat

SEQ ID NO: 5420698 - DNA, 16 bp, Homo sapiens
gcatagggtttggaag

SEQ ID NO: 5420699 - DNA, 17 bp, Homo sapiens
gcataggtaagctgtgc

SEQ ID NO: 5420700 - DNA, 19 bp, Homo sapiens
gcataggtaagctgtgcct

SEQ ID NO: 5420701 - DNA, 19 bp, Homo sapiens
gcataggtgatccatgtaa

SEQ ID NO: 5420702 - DNA, 20 bp, Homo sapiens
gcataggtgatccatgtaac

SEQ ID NO: 5420703 - DNA, 20 bp, Homo sapiens
gcatagtaccaatcatttta

SEQ ID NO: 5420704 - DNA, 21 bp, Homo sapiens
gcatagtattccattgtgtga

SEQ ID NO: 5420705 - DNA, 22 bp, Homo sapiens
gcatagtctacttgttataaat

SEQ ID NO: 5420706 - DNA, 14 bp, Homo sapiens
gcatagtggcactt

SEQ ID NO: 5420707 - DNA, 20 bp, Homo sapiens
gcatagtgtgctcggacaca

SEQ ID NO: 5420708 - DNA, 20 bp, Homo sapiens
gcatagttctgcaataacag

SEQ ID NO: 5420709 - DNA, 21 bp, Homo sapiens
gcatagttgtagacaaagtac

SEQ ID NO: 5420710 - DNA, 22 bp, Homo sapiens
gcatataaaggttatgaaacat

SEQ ID NO: 5420711 - DNA, 23 bp, Homo sapiens
gcatataacttatattgtaagaa

SEQ ID NO: 5420712 - DNA, 16 bp, Homo sapiens
gcatataataaagaag

SEQ ID NO: 5420713 - DNA, 18 bp, Homo sapiens
gcatataatgaataaatc

SEQ ID NO: 5420714 - DNA, 19 bp, Homo sapiens
gcatataatgaataaatca

SEQ ID NO: 5420715 - DNA, 21 bp, Homo sapiens
gcatataattttcacttctgt

SEQ ID NO: 5420716 - DNA, 21 bp, Homo sapiens
gcatatactgaagtcttttct

SEQ ID NO: 5420717 - DNA, 13 bp, Homo sapiens
gcatatagaatat

SEQ ID NO: 5420718 - DNA, 17 bp, Homo sapiens
gcatatagttaaactga

SEQ ID NO: 5420719 - DNA, 13 bp, Homo sapiens
gcatatatataaa

SEQ ID NO: 5420720 - DNA, 19 bp, Homo sapiens
gcatatattcatacctgtt

SEQ ID NO: 5420721 - DNA, 14 bp, Homo sapiens
gcatatatttttat

SEQ ID NO: 5420722 - DNA, 16 bp, Homo sapiens
gcatatatttttatat

SEQ ID NO: 5420723 - DNA, 18 bp, Homo sapiens
gcatatcacccttccctg

SEQ ID NO: 5420724 - DNA, 23 bp, Homo sapiens
gcatatcacccttccctgctccc

SEQ ID NO: 5420725 - DNA, 20 bp, Homo sapiens
gcatatcattaaacaaataa

SEQ ID NO: 5420726 - DNA, 18 bp, Homo sapiens
gcatatccattgtggaaa

SEQ ID NO: 5420727 - DNA, 14 bp, Homo sapiens
gcatatcgctgggc

SEQ ID NO: 5420728 - DNA, 18 bp, Homo sapiens
gcatatctctagtccctg

SEQ ID NO: 5420729 - DNA, 19 bp, Homo sapiens
gcatatctctagtccctgt

SEQ ID NO: 5420730 - DNA, 12 bp, Homo sapiens
gcatatctgcct

SEQ ID NO: 5420731 - DNA, 16 bp, Homo sapiens
gcatatctgcctcccc

SEQ ID NO: 5420732 - DNA, 16 bp, Homo sapiens
gcatatgaaaggagag

SEQ ID NO: 5420733 - DNA, 16 bp, Homo sapiens
gcatatgacaaatgtt

SEQ ID NO: 5420734 - DNA, 19 bp, Homo sapiens
gcatatgacaaatgtttct

SEQ ID NO: 5420735 - DNA, 17 bp, Homo sapiens
gcatatgagcctgccct

SEQ ID NO: 5420736 - DNA, 23 bp, Homo sapiens
gcatatgatatatagttacaaca

SEQ ID NO: 5420737 - DNA, 14 bp, Homo sapiens
gcatatgcatgcca

SEQ ID NO: 5420738 - DNA, 21 bp, Homo sapiens
gcatatgcatgccaggctggg

SEQ ID NO: 5420739 - DNA, 21 bp, Homo sapiens
gcatatgcctacaaagctctg

SEQ ID NO: 5420740 - DNA, 19 bp, Homo sapiens
gcatatgctacacatatgt

SEQ ID NO: 5420741 - DNA, 23 bp, Homo sapiens
gcatatgggtgggattttgcaaa

SEQ ID NO: 5420742 - DNA, 17 bp, Homo sapiens
gcatatgggttagatgt

SEQ ID NO: 5420743 - DNA, 13 bp, Homo sapiens
gcatatgtgagtg

SEQ ID NO: 5420744 - DNA, 18 bp, Homo sapiens
gcatatgtgttggcttgt

SEQ ID NO: 5420745 - DNA, 18 bp, Homo sapiens
gcatatgttgaatacttt

SEQ ID NO: 5420746 - DNA, 21 bp, Homo sapiens
gcatatgtttccccatctctg

SEQ ID NO: 5420747 - DNA, 21 bp, Homo sapiens
gcatattagcatcatgtcttt

SEQ ID NO: 5420748 - DNA, 15 bp, Homo sapiens
gcatattagttaatc

SEQ ID NO: 5420749 - DNA, 16 bp, Homo sapiens
gcatattcaatgtatt

SEQ ID NO: 5420750 - DNA, 18 bp, Homo sapiens
gcatattcaggaagctca

SEQ ID NO: 5420751 - DNA, 20 bp, Homo sapiens
gcatattcaggaagctcagg

SEQ ID NO: 5420752 - DNA, 18 bp, Homo sapiens
gcatattccctgcacaca

SEQ ID NO: 5420753 - DNA, 15 bp, Homo sapiens
gcatattctattgta

SEQ ID NO: 5420754 - DNA, 22 bp, Homo sapiens
gcatattctattgtattatttg

SEQ ID NO: 5420755 - DNA, 16 bp, Homo sapiens
gcatattcttatgtat

SEQ ID NO: 5420756 - DNA, 22 bp, Homo sapiens
gcatattcttttctgcaaaata

SEQ ID NO: 5420757 - DNA, 20 bp, Homo sapiens
gcatattgataataaaattc

SEQ ID NO: 5420758 - DNA, 12 bp, Homo sapiens
gcatattggaaa

SEQ ID NO: 5420759 - DNA, 19 bp, Homo sapiens
gcatattgttattatataa

SEQ ID NO: 5420760 - DNA, 13 bp, Homo sapiens
gcatatttataag

SEQ ID NO: 5420761 - DNA, 14 bp, Homo sapiens
gcatatttatagag

SEQ ID NO: 5420762 - DNA, 23 bp, Homo sapiens
gcatatttatagcaatccatgtt

SEQ ID NO: 5420763 - DNA, 20 bp, Homo sapiens
gcatatttatattgtatatt

SEQ ID NO: 5420764 - DNA, 23 bp, Homo sapiens
gcatatttatattgtatattctg

SEQ ID NO: 5420765 - DNA, 23 bp, Homo sapiens
gcatatttatccaaaatgtgtat

SEQ ID NO: 5420766 - DNA, 13 bp, Homo sapiens
gcatatttccaat

SEQ ID NO: 5420767 - DNA, 17 bp, Homo sapiens
gcatatttccaataact

SEQ ID NO: 5420768 - DNA, 13 bp, Homo sapiens
gcatatttctgta

SEQ ID NO: 5420769 - DNA, 14 bp, Homo sapiens
gcatatttctgtat

SEQ ID NO: 5420770 - DNA, 18 bp, Homo sapiens
gcatatttgccaataaag

SEQ ID NO: 5420771 - DNA, 16 bp, Homo sapiens
gcatatttgctatgtc

SEQ ID NO: 5420772 - DNA, 19 bp, Homo sapiens
gcatatttgttactttact

SEQ ID NO: 5420773 - DNA, 20 bp, Homo sapiens
gcatatttgttactttactt

SEQ ID NO: 5420774 - DNA, 22 bp, Homo sapiens
gcatattttaatcattatttga

SEQ ID NO: 5420775 - DNA, 23 bp, Homo sapiens
gcatattttcttacttttattat

SEQ ID NO: 5420776 - DNA, 21 bp, Homo sapiens
gcatattttgagaaactgctg

SEQ ID NO: 5420777 - DNA, 14 bp, Homo sapiens
gcatattttgctgg

SEQ ID NO: 5420778 - DNA, 15 bp, Homo sapiens
gcatattttgctggt

SEQ ID NO: 5420779 - DNA, 15 bp, Homo sapiens
gcatatttttgcaca

SEQ ID NO: 5420780 - DNA, 16 bp, Homo sapiens
gcatcaaaagacaatt

SEQ ID NO: 5420781 - DNA, 19 bp, Homo sapiens
gcatcaaaagacaattctt

SEQ ID NO: 5420782 - DNA, 13 bp, Homo sapiens
gcatcaaaataca

SEQ ID NO: 5420783 - DNA, 13 bp, Homo sapiens
gcatcaaataata

SEQ ID NO: 5420784 - DNA, 13 bp, Homo sapiens
gcatcaaccacca

SEQ ID NO: 5420785 - DNA, 16 bp, Homo sapiens
gcatcaaccaccatgg

SEQ ID NO: 5420786 - DNA, 23 bp, Homo sapiens
gcatcaagaggtgggagggccct

SEQ ID NO: 5420787 - DNA, 21 bp, Homo sapiens
gcatcaagatgtgacatgttt

SEQ ID NO: 5420788 - DNA, 22 bp, Homo sapiens
gcatcaagggagacaccagtgg

SEQ ID NO: 5420789 - DNA, 19 bp, Homo sapiens
gcatcaatcctgtgtggtt

SEQ ID NO: 5420790 - DNA, 17 bp, Homo sapiens
gcatcaatgtattttat

SEQ ID NO: 5420791 - DNA, 23 bp, Homo sapiens
gcatcacactcaaggacaggagc

SEQ ID NO: 5420792 - DNA, 18 bp, Homo sapiens
gcatcacacttatatttt

SEQ ID NO: 5420793 - DNA, 19 bp, Homo sapiens
gcatcacagaccccagctg

SEQ ID NO: 5420794 - DNA, 16 bp, Homo sapiens
gcatcacagggcagag

SEQ ID NO: 5420795 - DNA, 12 bp, Homo sapiens
gcatcacagttt

SEQ ID NO: 5420796 - DNA, 22 bp, Homo sapiens
gcatcaccaccacacccctgcc

SEQ ID NO: 5420797 - DNA, 17 bp, Homo sapiens
gcatcacctcaccaagg

SEQ ID NO: 5420798 - DNA, 15 bp, Homo sapiens
gcatcacctcaggcc

SEQ ID NO: 5420799 - DNA, 15 bp, Homo sapiens
gcatcacctccacca

SEQ ID NO: 5420800 - DNA, 16 bp, Homo sapiens
gcatggacgcctggct

SEQ ID NO: 5420801 - DNA, 20 bp, Homo sapiens
gcatggacgcctggctccag

SEQ ID NO: 5420802 - DNA, 23 bp, Homo sapiens
gcatggagaagggttctgccctg

SEQ ID NO: 5420803 - DNA, 18 bp, Homo sapiens
gcatggagacagcagttt

SEQ ID NO: 5420804 - DNA, 18 bp, Homo sapiens
gcatggagatagccccac

SEQ ID NO: 5420805 - DNA, 13 bp, Homo sapiens
gcatggagcctgg

SEQ ID NO: 5420806 - DNA, 15 bp, Homo sapiens
gcatggagcctggaa

SEQ ID NO: 5420807 - DNA, 13 bp, Homo sapiens
gcatggaggaaaa

SEQ ID NO: 5420808 - DNA, 20 bp, Homo sapiens
gcatggagtatagtgcaaat

SEQ ID NO: 5420809 - DNA, 22 bp, Homo sapiens
gcatggagtgtgtattgttccc

SEQ ID NO: 5420810 - DNA, 15 bp, Homo sapiens
gcatggagtgtttga

SEQ ID NO: 5420811 - DNA, 21 bp, Homo sapiens
gcatggattttggataaatca

SEQ ID NO: 5420812 - DNA, 18 bp, Homo sapiens
gcatggcaaatcaggggc

SEQ ID NO: 5420813 - DNA, 19 bp, Homo sapiens
gcatggcaaatcaggggcc

SEQ ID NO: 5420814 - DNA, 22 bp, Homo sapiens
gcatggcaaatcaggggccaga

SEQ ID NO: 5420815 - DNA, 22 bp, Homo sapiens
gcatggcacctgtcgcccagtg

SEQ ID NO: 5420816 - DNA, 21 bp, Homo sapiens
gcatggcactccctccagcac

SEQ ID NO: 5420817 - DNA, 17 bp, Homo sapiens
gcatggcactgaccgcc

SEQ ID NO: 5420818 - DNA, 16 bp, Homo sapiens
gcatggcactgactga

SEQ ID NO: 5420819 - DNA, 14 bp, Homo sapiens
gcatggcagcaggc

SEQ ID NO: 5420820 - DNA, 20 bp, Homo sapiens
gcatggcagcaggcctgttg

SEQ ID NO: 5420821 - DNA, 12 bp, Homo sapiens
gcatggcagctg

SEQ ID NO: 5420822 - DNA, 13 bp, Homo sapiens
gcatggcagctgg

SEQ ID NO: 5420823 - DNA, 23 bp, Homo sapiens
gcatggcagctgggcccacagcc

SEQ ID NO: 5420824 - DNA, 13 bp, Homo sapiens
gcatggcaggagt

SEQ ID NO: 5420825 - DNA, 15 bp, Homo sapiens
gcatggcaggagtct

SEQ ID NO: 5420826 - DNA, 13 bp, Homo sapiens
gcatggcaggctg

SEQ ID NO: 5420827 - DNA, 16 bp, Homo sapiens
gcatggcaggctgggt

SEQ ID NO: 5420828 - DNA, 17 bp, Homo sapiens
gcatggcatcctccagc

SEQ ID NO: 5420829 - DNA, 20 bp, Homo sapiens
gcatggccacagccacctcc

SEQ ID NO: 5420830 - DNA, 13 bp, Homo sapiens
gcatggccaggtg

SEQ ID NO: 5420831 - DNA, 14 bp, Homo sapiens
gcatggccaggtgg

SEQ ID NO: 5420832 - DNA, 16 bp, Homo sapiens
gcatggcccctccagg

SEQ ID NO: 5420833 - DNA, 22 bp, Homo sapiens
gcatggccctgctgcccctccc

SEQ ID NO: 5420834 - DNA, 16 bp, Homo sapiens
gcatggccctggggtc

SEQ ID NO: 5420835 - DNA, 21 bp, Homo sapiens
gcatggccgcaacttcccagg

SEQ ID NO: 5420836 - DNA, 16 bp, Homo sapiens
gcatggcctcccagcc

SEQ ID NO: 5420837 - DNA, 19 bp, Homo sapiens
gcatggcctcccagccacc

SEQ ID NO: 5420838 - DNA, 21 bp, Homo sapiens
gcatggcctctaagagtgccc

SEQ ID NO: 5420839 - DNA, 22 bp, Homo sapiens
gcatggcgtagagggtgctgcc

SEQ ID NO: 5420840 - DNA, 15 bp, Homo sapiens
gcatggctcagagct

SEQ ID NO: 5420841 - DNA, 17 bp, Homo sapiens
gcatggctccagaaatg

SEQ ID NO: 5420842 - DNA, 18 bp, Homo sapiens
gcatggctccagaaatgt

SEQ ID NO: 5420843 - DNA, 19 bp, Homo sapiens
gcatggctccagaaatgtc

SEQ ID NO: 5420844 - DNA, 21 bp, Homo sapiens
gcatggctccagtctgctgcc

SEQ ID NO: 5420845 - DNA, 22 bp, Homo sapiens
gcatggctccagtctgctgccc

SEQ ID NO: 5420846 - DNA, 17 bp, Homo sapiens
gcatggctcctgtctgg

SEQ ID NO: 5420847 - DNA, 21 bp, Homo sapiens
gcatggctgccaatgggagct

SEQ ID NO: 5420848 - DNA, 16 bp, Homo sapiens
gcatggctggtgcctg

SEQ ID NO: 5420849 - DNA, 19 bp, Homo sapiens
gcatggcttgcccctgtgg

SEQ ID NO: 5420850 - DNA, 20 bp, Homo sapiens
gcatggcttggggagcagag

SEQ ID NO: 5420851 - DNA, 14 bp, Homo sapiens
gcatgggaaaaaga

SEQ ID NO: 5420852 - DNA, 15 bp, Homo sapiens
gcatgggaaaaagag

SEQ ID NO: 5420853 - DNA, 19 bp, Homo sapiens
gcatgggaaaaagagactc

SEQ ID NO: 5420854 - DNA, 19 bp, Homo sapiens
gcatgggaatgaatgtcag

SEQ ID NO: 5420855 - DNA, 19 bp, Homo sapiens
gcatgggcattgcagcctt

SEQ ID NO: 5420856 - DNA, 21 bp, Homo sapiens
gcatgggcattgcagccttgc

SEQ ID NO: 5420857 - DNA, 15 bp, Homo sapiens
gcatgggccagcccc

SEQ ID NO: 5420858 - DNA, 11 bp, Homo sapiens
gcatgggcctc

SEQ ID NO: 5420859 - DNA, 13 bp, Homo sapiens
gcatgggcctctc

SEQ ID NO: 5420860 - DNA, 15 bp, Homo sapiens
gcatgggcctctctg

SEQ ID NO: 5420861 - DNA, 22 bp, Homo sapiens
gcatgggcctggccacctctct

SEQ ID NO: 5420862 - DNA, 15 bp, Homo sapiens
gcatgggcgcaggcc

SEQ ID NO: 5420863 - DNA, 17 bp, Homo sapiens
gcatgggcgcaggccca

SEQ ID NO: 5420864 - DNA, 19 bp, Homo sapiens
gcatgggcgcaggcccagt

SEQ ID NO: 5420865 - DNA, 22 bp, Homo sapiens
gcatgggcgcaggcccagtgac

SEQ ID NO: 5420866 - DNA, 22 bp, Homo sapiens
gcatgggctcgccgtgtctcag

SEQ ID NO: 5420867 - DNA, 15 bp, Homo sapiens
gcatggggaggcagc

SEQ ID NO: 5420868 - DNA, 16 bp, Homo sapiens
gcatggggaggcagca

SEQ ID NO: 5420869 - DNA, 18 bp, Homo sapiens
gcatggggaggcagcaga

SEQ ID NO: 5420870 - DNA, 15 bp, Homo sapiens
gcatggggaggggag

SEQ ID NO: 5420871 - DNA, 17 bp, Homo sapiens
gcatggggaggggagag

SEQ ID NO: 5420872 - DNA, 23 bp, Homo sapiens
gcatggggataaaggagaaggca

SEQ ID NO: 5420873 - DNA, 20 bp, Homo sapiens
gcatggggcatgtcctttcc

SEQ ID NO: 5420874 - DNA, 14 bp, Homo sapiens
gcatggggccagga

SEQ ID NO: 5420875 - DNA, 19 bp, Homo sapiens
gcatggggcccctggccca

SEQ ID NO: 5420876 - DNA, 22 bp, Homo sapiens
gcatggggcccctggcccagag

SEQ ID NO: 5420877 - DNA, 22 bp, Homo sapiens
gcatgggggaccccttcccaca

SEQ ID NO: 5420878 - DNA, 22 bp, Homo sapiens
gcatgggggaccctgtgcatct

SEQ ID NO: 5420879 - DNA, 18 bp, Homo sapiens
gcatgggggcctcagggc

SEQ ID NO: 5420880 - DNA, 17 bp, Homo sapiens
gcatgggggctgccagc

SEQ ID NO: 5420881 - DNA, 18 bp, Homo sapiens
gcatggggtgggcctctg

SEQ ID NO: 5420882 - DNA, 15 bp, Homo sapiens
gcatgggtcagggtg

SEQ ID NO: 5420883 - DNA, 23 bp, Homo sapiens
gcatgggtcagggtgtgaggcca

SEQ ID NO: 5420884 - DNA, 18 bp, Homo sapiens
gcatgggtccagggcctg

SEQ ID NO: 5420885 - DNA, 22 bp, Homo sapiens
gcatgggtccttgatgccagag

SEQ ID NO: 5420886 - DNA, 17 bp, Homo sapiens
gcatgggtcgggagagg

SEQ ID NO: 5420887 - DNA, 19 bp, Homo sapiens
gcatgggtcgggagagggg

SEQ ID NO: 5420888 - DNA, 23 bp, Homo sapiens
gcatgggtgagacctgaccagtc

SEQ ID NO: 5420889 - DNA, 15 bp, Homo sapiens
gcatgggtgtgccct

SEQ ID NO: 5420890 - DNA, 21 bp, Homo sapiens
gcatggtcccacatccctggg

SEQ ID NO: 5420891 - DNA, 18 bp, Homo sapiens
gcatggtccctgccttag

SEQ ID NO: 5420892 - DNA, 20 bp, Homo sapiens
gcatggtcctggaggatgac

SEQ ID NO: 5420893 - DNA, 22 bp, Homo sapiens
gcatggtgagtgttggggttga

SEQ ID NO: 5420894 - DNA, 16 bp, Homo sapiens
gcatggtgccccagga

SEQ ID NO: 5420895 - DNA, 19 bp, Homo sapiens
gcatggtgccccaggacca

SEQ ID NO: 5420896 - DNA, 14 bp, Homo sapiens
gcatggtggccaga

SEQ ID NO: 5420897 - DNA, 16 bp, Homo sapiens
gcatggtggccagagg

SEQ ID NO: 5420898 - DNA, 19 bp, Homo sapiens
gcatggtggcgcaagcctg

SEQ ID NO: 5420899 - DNA, 19 bp, Homo sapiens
gcatggtgggagctggttg

SEQ ID NO: 5420900 - DNA, 19 bp, Homo sapiens
gcatggtggggcatgcctg

SEQ ID NO: 5420901 - DNA, 19 bp, Homo sapiens
gcatggtggtgtgtgccta

SEQ ID NO: 5420902 - DNA, 20 bp, Homo sapiens
gcatggtgttctcctgctgc

SEQ ID NO: 5420903 - DNA, 22 bp, Homo sapiens
gcatggttcattttctgatgcc

SEQ ID NO: 5420904 - DNA, 19 bp, Homo sapiens
gcatggttccttccctggg

SEQ ID NO: 5420905 - DNA, 14 bp, Homo sapiens
gcatggttgcagat

SEQ ID NO: 5420906 - DNA, 13 bp, Homo sapiens
gcatggtttcagc

SEQ ID NO: 5420907 - DNA, 14 bp, Homo sapiens
gcatggtttcagca

SEQ ID NO: 5420908 - DNA, 16 bp, Homo sapiens
gcatggttttagcaaa

SEQ ID NO: 5420909 - DNA, 23 bp, Homo sapiens
gcatgtaaaatcttcagctggtg

SEQ ID NO: 5420910 - DNA, 15 bp, Homo sapiens
gcatgtaaacacgcc

SEQ ID NO: 5420911 - DNA, 17 bp, Homo sapiens
gcatgtaaacacgcctg

SEQ ID NO: 5420912 - DNA, 19 bp, Homo sapiens
gcatgtaaagatgctgtgt

SEQ ID NO: 5420913 - DNA, 21 bp, Homo sapiens
gcatgtaacgcaagttcccag

SEQ ID NO: 5420914 - DNA, 17 bp, Homo sapiens
gcatgtacaaaaacaca

SEQ ID NO: 5420915 - DNA, 20 bp, Homo sapiens
gcatgtacaaaaacacaaat

SEQ ID NO: 5420916 - DNA, 13 bp, Homo sapiens
gcatgtacagtgt

SEQ ID NO: 5420917 - DNA, 20 bp, Homo sapiens
gcatgtacagtgttctgttt

SEQ ID NO: 5420918 - DNA, 23 bp, Homo sapiens
gcatgtacagtgttctgtttaat

SEQ ID NO: 5420919 - DNA, 18 bp, Homo sapiens
gcatgtaccatttgcatg

SEQ ID NO: 5420920 - DNA, 20 bp, Homo sapiens
gcatgtaccatttgcatggc

SEQ ID NO: 5420921 - DNA, 22 bp, Homo sapiens
gcatgtagactgtgccagaggc

SEQ ID NO: 5420922 - DNA, 17 bp, Homo sapiens
gcatgtagcatataaat

SEQ ID NO: 5420923 - DNA, 15 bp, Homo sapiens
gcatgtatgaatgta

SEQ ID NO: 5420924 - DNA, 15 bp, Homo sapiens
gcatgtatgtctgca

SEQ ID NO: 5420925 - DNA, 23 bp, Homo sapiens
gcatgtatgtctgcaggtgtctg

SEQ ID NO: 5420926 - DNA, 21 bp, Homo sapiens
gcatgtatgtgcacatgtgtc

SEQ ID NO: 5420927 - DNA, 12 bp, Homo sapiens
gcatgtatgtgt

SEQ ID NO: 5420928 - DNA, 21 bp, Homo sapiens
gcatgtattcactaaaataaa

SEQ ID NO: 5420929 - DNA, 15 bp, Homo sapiens
gcatgtattggcctg

SEQ ID NO: 5420930 - DNA, 20 bp, Homo sapiens
gcatgtattggcctggaggt

SEQ ID NO: 5420931 - DNA, 21 bp, Homo sapiens
gcatgtattgtaaacagaagg

SEQ ID NO: 5420932 - DNA, 18 bp, Homo sapiens
gcatgtatttttgtcaat

SEQ ID NO: 5420933 - DNA, 14 bp, Homo sapiens
gcatgtcaaacatg

SEQ ID NO: 5420934 - DNA, 16 bp, Homo sapiens
gcatgtcaacttttga

SEQ ID NO: 5420935 - DNA, 15 bp, Homo sapiens
gcatgtcacatgaca

SEQ ID NO: 5420936 - DNA, 16 bp, Homo sapiens
gcatgtcacatgacat

SEQ ID NO: 5420937 - DNA, 15 bp, Homo sapiens
gcatgtcagaggacc

SEQ ID NO: 5420938 - DNA, 18 bp, Homo sapiens
gcatgtcatttgcacaca

SEQ ID NO: 5420939 - DNA, 19 bp, Homo sapiens
gcatgtcccacccacccgc

SEQ ID NO: 5420940 - DNA, 16 bp, Homo sapiens
gcatgtcccatcacgt

SEQ ID NO: 5420941 - DNA, 23 bp, Homo sapiens
gcatgtccctaccgagtctcttc

SEQ ID NO: 5420942 - DNA, 23 bp, Homo sapiens
gcatgtccctccaaggctgtctt

SEQ ID NO: 5420943 - DNA, 13 bp, Homo sapiens
gcatgtcctttcc

SEQ ID NO: 5420944 - DNA, 19 bp, Homo sapiens
gcatgtcctttccatctgt

SEQ ID NO: 5420945 - DNA, 14 bp, Homo sapiens
gcatgtcggggccc

SEQ ID NO: 5420946 - DNA, 14 bp, Homo sapiens
gcatgtctactgct

SEQ ID NO: 5420947 - DNA, 17 bp, Homo sapiens
gcatgtctctgcttcca

SEQ ID NO: 5420948 - DNA, 22 bp, Homo sapiens
gcatgtctctgcttccatggct

SEQ ID NO: 5420949 - DNA, 12 bp, Homo sapiens
gcatgtctgcac

SEQ ID NO: 5420950 - DNA, 14 bp, Homo sapiens
gcatgtctgcacct

SEQ ID NO: 5420951 - DNA, 18 bp, Homo sapiens
gcatgtctgcacctccgc

SEQ ID NO: 5420952 - DNA, 20 bp, Homo sapiens
gcatgtctgccaaaatgcaa

SEQ ID NO: 5420953 - DNA, 17 bp, Homo sapiens
gcatgtctgcctatgca

SEQ ID NO: 5420954 - DNA, 17 bp, Homo sapiens
gcatgtctgcctggagt

SEQ ID NO: 5420955 - DNA, 17 bp, Homo sapiens
gcatgtcttttaaaatg

SEQ ID NO: 5420956 - DNA, 21 bp, Homo sapiens
gcatgtgaaaatcaaatacat

SEQ ID NO: 5420957 - DNA, 19 bp, Homo sapiens
gcatgtgaaacagtatcat

SEQ ID NO: 5420958 - DNA, 23 bp, Homo sapiens
gcatgtgactcctgaagggaagg

SEQ ID NO: 5420959 - DNA, 14 bp, Homo sapiens
gcatgtgagcacat

SEQ ID NO: 5420960 - DNA, 13 bp, Homo sapiens
gcatgtgatctcc

SEQ ID NO: 5420961 - DNA, 19 bp, Homo sapiens
gcatgtgatgagaggaaat

SEQ ID NO: 5420962 - DNA, 21 bp, Homo sapiens
gcatgtgatgagaggaaatca

SEQ ID NO: 5420963 - DNA, 21 bp, Homo sapiens
gcatgtgccaagattctactc

SEQ ID NO: 5420964 - DNA, 19 bp, Homo sapiens
gcatgtgccctcctgaggg

SEQ ID NO: 5420965 - DNA, 15 bp, Homo sapiens
gcatgtgcgtggaag

SEQ ID NO: 5420966 - DNA, 19 bp, Homo sapiens
gcatgtgcgtggaagtgtt

SEQ ID NO: 5420967 - DNA, 23 bp, Homo sapiens
gcatgtgcgtggaagtgttcctg

SEQ ID NO: 5420968 - DNA, 15 bp, Homo sapiens
gcatgtgctgtctcc

SEQ ID NO: 5420969 - DNA, 14 bp, Homo sapiens
gcatgtgctgtgtg

SEQ ID NO: 5420970 - DNA, 20 bp, Homo sapiens
gcatgtggaaatgacccaaa

SEQ ID NO: 5420971 - DNA, 16 bp, Homo sapiens
gcatgtggcctttatc

SEQ ID NO: 5420972 - DNA, 14 bp, Homo sapiens
gcatgtggcttctc

SEQ ID NO: 5420973 - DNA, 17 bp, Homo sapiens
gcatgtggcttttttaa

SEQ ID NO: 5420974 - DNA, 13 bp, Homo sapiens
gcatgtgggcttc

SEQ ID NO: 5420975 - DNA, 12 bp, Homo sapiens
gcatgtggggga

SEQ ID NO: 5420976 - DNA, 19 bp, Homo sapiens
gcatttccttccagcccat

SEQ ID NO: 5420977 - DNA, 21 bp, Homo sapiens
gcatttcgggaagggcatgca

SEQ ID NO: 5420978 - DNA, 12 bp, Homo sapiens
gcatttctaaaa

SEQ ID NO: 5420979 - DNA, 22 bp, Homo sapiens
gcatttctagtcccttctctct

SEQ ID NO: 5420980 - DNA, 21 bp, Homo sapiens
gcatttctatgcaggcagcac

SEQ ID NO: 5420981 - DNA, 23 bp, Homo sapiens
gcatttctcttctcagctcttcc

SEQ ID NO: 5420982 - DNA, 19 bp, Homo sapiens
gcatttctgaatagaaatg

SEQ ID NO: 5420983 - DNA, 14 bp, Homo sapiens
gcatttctgggcct

SEQ ID NO: 5420984 - DNA, 21 bp, Homo sapiens
gcatttcttatttgtttggtc

SEQ ID NO: 5420985 - DNA, 13 bp, Homo sapiens
gcatttcttttct

SEQ ID NO: 5420986 - DNA, 10 bp, Homo sapiens
gcatttgaat

SEQ ID NO: 5420987 - DNA, 19 bp, Homo sapiens
gcatttgaatactcctgtt

SEQ ID NO: 5420988 - DNA, 16 bp, Homo sapiens
gcatttgagaaatgca

SEQ ID NO: 5420989 - DNA, 18 bp, Homo sapiens
gcatttgaggtctgttct

SEQ ID NO: 5420990 - DNA, 19 bp, Homo sapiens
gcatttgaggtctgttctt

SEQ ID NO: 5420991 - DNA, 14 bp, Homo sapiens
gcatttgagtttat

SEQ ID NO: 5420992 - DNA, 12 bp, Homo sapiens
gcatttgcacct

SEQ ID NO: 5420993 - DNA, 14 bp, Homo sapiens
gcatttgccaagtc

SEQ ID NO: 5420994 - DNA, 15 bp, Homo sapiens
gcatttgccattcct

SEQ ID NO: 5420995 - DNA, 16 bp, Homo sapiens
gcatttgccattcctg

SEQ ID NO: 5420996 - DNA, 20 bp, Homo sapiens
gcatttgctaaggcagctga

SEQ ID NO: 5420997 - DNA, 12 bp, Homo sapiens
gcatttgctgaa

SEQ ID NO: 5420998 - DNA, 13 bp, Homo sapiens
gcatttgctgaat

SEQ ID NO: 5420999 - DNA, 14 bp, Homo sapiens
gcatttgctgaata

SEQ ID NO: 5421000 - DNA, 22 bp, Homo sapiens
gcatttgctgaataacaacaat

SEQ ID NO: 5421001 - DNA, 18 bp, Homo sapiens
gcatttgctgatttctag

SEQ ID NO: 5421002 - DNA, 19 bp, Homo sapiens
gcatttggaaccaaagtct

SEQ ID NO: 5421003 - DNA, 14 bp, Homo sapiens
gcatttggcagcac

SEQ ID NO: 5421004 - DNA, 19 bp, Homo sapiens
gcatttggctggagcccgg

SEQ ID NO: 5421005 - DNA, 13 bp, Homo sapiens
gcatttggcttcc

SEQ ID NO: 5421006 - DNA, 16 bp, Homo sapiens
gcatttggcttcctct

SEQ ID NO: 5421007 - DNA, 19 bp, Homo sapiens
gcatttggcttcctctgct

SEQ ID NO: 5421008 - DNA, 21 bp, Homo sapiens
gcatttggcttcctctgctgc

SEQ ID NO: 5421009 - DNA, 22 bp, Homo sapiens
gcatttggcttcctctgctgca

SEQ ID NO: 5421010 - DNA, 23 bp, Homo sapiens
gcatttggcttcctctgctgcat

SEQ ID NO: 5421011 - DNA, 16 bp, Homo sapiens
gcatttgggtccagga

SEQ ID NO: 5421012 - DNA, 18 bp, Homo sapiens
gcatttgggtccaggagg

SEQ ID NO: 5421013 - DNA, 21 bp, Homo sapiens
gcatttggtacacacttgacc

SEQ ID NO: 5421014 - DNA, 21 bp, Homo sapiens
gcatttggtaggaagcctgag

SEQ ID NO: 5421015 - DNA, 20 bp, Homo sapiens
gcatttggtaggtagtgatt

SEQ ID NO: 5421016 - DNA, 19 bp, Homo sapiens
gcatttggtctcaggcagc

SEQ ID NO: 5421017 - DNA, 15 bp, Homo sapiens
gcatttggtgagagt

SEQ ID NO: 5421018 - DNA, 22 bp, Homo sapiens
gcatttggtggcctaatttaca

SEQ ID NO: 5421019 - DNA, 22 bp, Homo sapiens
gcatttggtggtttcagaaatg

SEQ ID NO: 5421020 - DNA, 21 bp, Homo sapiens
gcatttggttttacacaggaa

SEQ ID NO: 5421021 - DNA, 13 bp, Homo sapiens
gcatttgtaaata

SEQ ID NO: 5421022 - DNA, 19 bp, Homo sapiens
gcatttgtattttgtgtga

SEQ ID NO: 5421023 - DNA, 19 bp, Homo sapiens
gcatttgtccttttgtgaa

SEQ ID NO: 5421024 - DNA, 16 bp, Homo sapiens
gcatttgtcttagaga

SEQ ID NO: 5421025 - DNA, 18 bp, Homo sapiens
gcatttgtcttagagaga

SEQ ID NO: 5421026 - DNA, 13 bp, Homo sapiens
gcatttgtgatca

SEQ ID NO: 5421027 - DNA, 20 bp, Homo sapiens
gcatttgtggtaatctacac

SEQ ID NO: 5421028 - DNA, 21 bp, Homo sapiens
gcatttgtggtaatctacacc

SEQ ID NO: 5421029 - DNA, 22 bp, Homo sapiens
gcatttgtggtaatctacacca

SEQ ID NO: 5421030 - DNA, 13 bp, Homo sapiens
gcatttgtgtgtt

SEQ ID NO: 5421031 - DNA, 17 bp, Homo sapiens
gcatttgttcagctccc

SEQ ID NO: 5421032 - DNA, 17 bp, Homo sapiens
gcatttgttctttgcca

SEQ ID NO: 5421033 - DNA, 16 bp, Homo sapiens
gcatttgtttgaactg

SEQ ID NO: 5421034 - DNA, 22 bp, Homo sapiens
gcattttaaaagcaattatatt

SEQ ID NO: 5421035 - DNA, 14 bp, Homo sapiens
gcattttaagcata

SEQ ID NO: 5421036 - DNA, 15 bp, Homo sapiens
gcattttaagcataa

SEQ ID NO: 5421037 - DNA, 19 bp, Homo sapiens
gcattttaagcataattaa

SEQ ID NO: 5421038 - DNA, 20 bp, Homo sapiens
gcattttaagtgtttaaaag

SEQ ID NO: 5421039 - DNA, 22 bp, Homo sapiens
gcattttacagtatcttcaaaa

SEQ ID NO: 5421040 - DNA, 12 bp, Homo sapiens
gcattttaccat

SEQ ID NO: 5421041 - DNA, 13 bp, Homo sapiens
gcattttactatg

SEQ ID NO: 5421042 - DNA, 20 bp, Homo sapiens
gcattttactatgcctgttg

SEQ ID NO: 5421043 - DNA, 17 bp, Homo sapiens
gcattttactgtacaga

SEQ ID NO: 5421044 - DNA, 17 bp, Homo sapiens
gcattttagaaactaca

SEQ ID NO: 5421045 - DNA, 19 bp, Homo sapiens
gcattttagaaactacaaa

SEQ ID NO: 5421046 - DNA, 13 bp, Homo sapiens
gcattttataaat

SEQ ID NO: 5421047 - DNA, 13 bp, Homo sapiens
gcattttcaacat

SEQ ID NO: 5421048 - DNA, 18 bp, Homo sapiens
gcattttcaccccaccct

SEQ ID NO: 5421049 - DNA, 15 bp, Homo sapiens
gcattttcagcatca

SEQ ID NO: 5421050 - DNA, 21 bp, Homo sapiens
gcattttcagtcgttgtgctt

SEQ ID NO: 5421051 - DNA, 18 bp, Homo sapiens
gcattttccagcactttg

SEQ ID NO: 5421052 - DNA, 20 bp, Homo sapiens
gcattttcctccatcgcagt

SEQ ID NO: 5421053 - DNA, 13 bp, Homo sapiens
gcattttcctcct

SEQ ID NO: 5421054 - DNA, 16 bp, Homo sapiens
gcattttcctcctctg

SEQ ID NO: 5421055 - DNA, 17 bp, Homo sapiens
gcattttcctcctctgc

SEQ ID NO: 5421056 - DNA, 23 bp, Homo sapiens
gcattttcctcgcctaggcctgt

SEQ ID NO: 5421057 - DNA, 13 bp, Homo sapiens
gcattttcctctg

SEQ ID NO: 5421058 - DNA, 15 bp, Homo sapiens
gcattttcctctgct

SEQ ID NO: 5421059 - DNA, 18 bp, Homo sapiens
gcattttcctctgctttg

SEQ ID NO: 5421060 - DNA, 13 bp, Homo sapiens
gcattttctcagg

SEQ ID NO: 5421061 - DNA, 15 bp, Homo sapiens
gcattttctcaggca

SEQ ID NO: 5421062 - DNA, 14 bp, Homo sapiens
gcattttctctagc

SEQ ID NO: 5421063 - DNA, 13 bp, Homo sapiens
gcattttctgaaa

SEQ ID NO: 5421064 - DNA, 17 bp, Homo sapiens
gcattttctgaaactaa

SEQ ID NO: 5421065 - DNA, 18 bp, Homo sapiens
gcattttctgcatctcca

SEQ ID NO: 5421066 - DNA, 18 bp, Homo sapiens
gcattttcttcacagtgc

SEQ ID NO: 5421067 - DNA, 14 bp, Homo sapiens
gcattttcttcact

SEQ ID NO: 5421068 - DNA, 18 bp, Homo sapiens
gcattttctttctgtttt

SEQ ID NO: 5421069 - DNA, 15 bp, Homo sapiens
gcattttgaaacaaa

SEQ ID NO: 5421070 - DNA, 23 bp, Homo sapiens
gcattttgaatgtgatcatcttt

SEQ ID NO: 5421071 - DNA, 18 bp, Homo sapiens
gcattttgatattgctgt

SEQ ID NO: 5421072 - DNA, 17 bp, Homo sapiens
gcattttgctattgtaa

SEQ ID NO: 5421073 - DNA, 23 bp, Homo sapiens
gcattttggagagtttcctgaaa

SEQ ID NO: 5421074 - DNA, 22 bp, Homo sapiens
gcattttgggggtttttaatct

SEQ ID NO: 5421075 - DNA, 22 bp, Homo sapiens
gcattttgggtgccattaaata

SEQ ID NO: 5421076 - DNA, 16 bp, Homo sapiens
gcattttggtttttcc

SEQ ID NO: 5421077 - DNA, 16 bp, Homo sapiens
gcattttgtttggtat

SEQ ID NO: 5421078 - DNA, 23 bp, Homo sapiens
gcatttttaaaactagcaactct

SEQ ID NO: 5421079 - DNA, 21 bp, Homo sapiens
gcatttttaaacttgaaatat

SEQ ID NO: 5421080 - DNA, 16 bp, Homo sapiens
gcatttttaagggagt

SEQ ID NO: 5421081 - DNA, 23 bp, Homo sapiens
gcatttttaattttcacaaaatg

SEQ ID NO: 5421082 - DNA, 21 bp, Homo sapiens
gcatttttactactattctgt

SEQ ID NO: 5421083 - DNA, 16 bp, Homo sapiens
gcatttttagctcctt

SEQ ID NO: 5421084 - DNA, 18 bp, Homo sapiens
gcatttttatgcagacag

SEQ ID NO: 5421085 - DNA, 12 bp, Homo sapiens
gcatttttcaga

SEQ ID NO: 5421086 - DNA, 11 bp, Homo sapiens
gcatttttgct

SEQ ID NO: 5421087 - DNA, 15 bp, Homo sapiens
gcatttttgtaactt

SEQ ID NO: 5421088 - DNA, 11 bp, Homo sapiens
gcatttttgtt

SEQ ID NO: 5421089 - DNA, 18 bp, Homo sapiens
gcattttttaaaacaaga

SEQ ID NO: 5421090 - DNA, 23 bp, Homo sapiens
gcattttttataattttctaagt

SEQ ID NO: 5421091 - DNA, 17 bp, Homo sapiens
gcattttttatgatatc

SEQ ID NO: 5421092 - DNA, 23 bp, Homo sapiens
gcatttttttattagtagaaagt

SEQ ID NO: 5421093 - DNA, 17 bp, Homo sapiens
gcatttttttattcagc

SEQ ID NO: 5421094 - DNA, 19 bp, Homo sapiens
gcatttttttattcagcag

SEQ ID NO: 5421095 - DNA, 16 bp, Homo sapiens
gccaaaaaaaaataca

SEQ ID NO: 5421096 - DNA, 16 bp, Homo sapiens
gccaaaaaatgggaga

SEQ ID NO: 5421097 - DNA, 14 bp, Homo sapiens
gccaaaaacaaaat

SEQ ID NO: 5421098 - DNA, 13 bp, Homo sapiens
gccaaaaaggacc

SEQ ID NO: 5421099 - DNA, 13 bp, Homo sapiens
gccaaaaaggata

SEQ ID NO: 5421100 - DNA, 17 bp, Homo sapiens
gccaaaacaagccaaag

SEQ ID NO: 5421101 - DNA, 21 bp, Homo sapiens
gccaaaacaatgcccgtaaga

SEQ ID NO: 5421102 - DNA, 23 bp, Homo sapiens
gccaaaacaatgtttaaaccttt

SEQ ID NO: 5421103 - DNA, 18 bp, Homo sapiens
gccaaaaccaaacccagg

SEQ ID NO: 5421104 - DNA, 18 bp, Homo sapiens
gccaaaaccacatgggct

SEQ ID NO: 5421105 - DNA, 16 bp, Homo sapiens
gccaaaaccaggcctc

SEQ ID NO: 5421106 - DNA, 18 bp, Homo sapiens
gccaaaaccaggcctctg

SEQ ID NO: 5421107 - DNA, 18 bp, Homo sapiens
gccaaaagatctggggag

SEQ ID NO: 5421108 - DNA, 19 bp, Homo sapiens
gccaaaaggaaaaagctcc

SEQ ID NO: 5421109 - DNA, 14 bp, Homo sapiens
gccaaaagggcagc

SEQ ID NO: 5421110 - DNA, 15 bp, Homo sapiens
gccaaaagggcagcc

SEQ ID NO: 5421111 - DNA, 17 bp, Homo sapiens
gccaaaagggcagccag

SEQ ID NO: 5421112 - DNA, 19 bp, Homo sapiens
gccaaaagtccctccctgc

SEQ ID NO: 5421113 - DNA, 15 bp, Homo sapiens
gccaaaataaagtct

SEQ ID NO: 5421114 - DNA, 15 bp, Homo sapiens
gccaaaataagacta

SEQ ID NO: 5421115 - DNA, 19 bp, Homo sapiens
gccaaaataatgtcttgtt

SEQ ID NO: 5421116 - DNA, 13 bp, Homo sapiens
gccaaaatatatt

SEQ ID NO: 5421117 - DNA, 20 bp, Homo sapiens
gccaaaatattgcttatgtc

SEQ ID NO: 5421118 - DNA, 17 bp, Homo sapiens
gccaaaatatttggaat

SEQ ID NO: 5421119 - DNA, 14 bp, Homo sapiens
gccaaaatgacttt

SEQ ID NO: 5421120 - DNA, 23 bp, Homo sapiens
gccaaaatggtacagcttctgga

SEQ ID NO: 5421121 - DNA, 23 bp, Homo sapiens
gccaaaatggttaatttttcctg

SEQ ID NO: 5421122 - DNA, 15 bp, Homo sapiens
gccaaaatgtactta

SEQ ID NO: 5421123 - DNA, 15 bp, Homo sapiens
gccaaaatgtcaatt

SEQ ID NO: 5421124 - DNA, 21 bp, Homo sapiens
gccaaaattaaggtgtttgaa

SEQ ID NO: 5421125 - DNA, 17 bp, Homo sapiens
gccaaaattcatttcta

SEQ ID NO: 5421126 - DNA, 15 bp, Homo sapiens
gccaaacaaaactga

SEQ ID NO: 5421127 - DNA, 13 bp, Homo sapiens
gccaaacacttta

SEQ ID NO: 5421128 - DNA, 13 bp, Homo sapiens
gccaaacagacag

SEQ ID NO: 5421129 - DNA, 20 bp, Homo sapiens
gccaaacatggccagactcc

SEQ ID NO: 5421130 - DNA, 24 bp, Homo sapiens
gccaaacattaatgttgatttcta

SEQ ID NO: 5421131 - DNA, 18 bp, Homo sapiens
gccaaaccagcagggagt

SEQ ID NO: 5421132 - DNA, 13 bp, Homo sapiens
gccaaacccagcc

SEQ ID NO: 5421133 - DNA, 22 bp, Homo sapiens
gccaaacccatgaggcaatgtc

SEQ ID NO: 5421134 - DNA, 23 bp, Homo sapiens
gccaaacccttgctttcctgggc

SEQ ID NO: 5421135 - DNA, 18 bp, Homo sapiens
gccaaacccttgtcagtg

SEQ ID NO: 5421136 - DNA, 22 bp, Homo sapiens
gccaaacctcctgtcagtgagg

SEQ ID NO: 5421137 - DNA, 15 bp, Homo sapiens
gccaaacctctgttc

SEQ ID NO: 5421138 - DNA, 17 bp, Homo sapiens
gccaaacctctgttcag

SEQ ID NO: 5421139 - DNA, 19 bp, Homo sapiens
gccaaactcacctgcccct

SEQ ID NO: 5421140 - DNA, 21 bp, Homo sapiens
gccaaactcacctgcccctca

SEQ ID NO: 5421141 - DNA, 17 bp, Homo sapiens
gccaaactctgccagcc

SEQ ID NO: 5421142 - DNA, 13 bp, Homo sapiens
gccaaactgctgg

SEQ ID NO: 5421143 - DNA, 14 bp, Homo sapiens
gccaaactgctgga

SEQ ID NO: 5421144 - DNA, 17 bp, Homo sapiens
gccaaactggtgcatga

SEQ ID NO: 5421145 - DNA, 23 bp, Homo sapiens
gccaaactgtccctcccttgctg

SEQ ID NO: 5421146 - DNA, 23 bp, Homo sapiens
gccaaactgttggaagttcactg

SEQ ID NO: 5421147 - DNA, 12 bp, Homo sapiens
gccaaacttggg

SEQ ID NO: 5421148 - DNA, 12 bp, Homo sapiens
gccaaagaaact

SEQ ID NO: 5421149 - DNA, 20 bp, Homo sapiens
gccaaagaaactcagaagag

SEQ ID NO: 5421150 - DNA, 13 bp, Homo sapiens
gccaaagaaatga

SEQ ID NO: 5421151 - DNA, 18 bp, Homo sapiens
gccaaagaaatgaacatt

SEQ ID NO: 5421152 - DNA, 18 bp, Homo sapiens
gccaaagaaatgggcctg

SEQ ID NO: 5421153 - DNA, 22 bp, Homo sapiens
gccaaagaaatgggcctgcctg

SEQ ID NO: 5421154 - DNA, 22 bp, Homo sapiens
gccacaaggaaaaggaggaggt

SEQ ID NO: 5421155 - DNA, 17 bp, Homo sapiens
gccacaaggaagaaatt

SEQ ID NO: 5421156 - DNA, 14 bp, Homo sapiens
gccacaaggacttc

SEQ ID NO: 5421157 - DNA, 18 bp, Homo sapiens
gccacaaggacttcctgt

SEQ ID NO: 5421158 - DNA, 22 bp, Homo sapiens
gccacaagggactgaggcaagc

SEQ ID NO: 5421159 - DNA, 23 bp, Homo sapiens
gccacaaggtggtgcttctgcca

SEQ ID NO: 5421160 - DNA, 15 bp, Homo sapiens
gccacaagtcttcca

SEQ ID NO: 5421161 - DNA, 13 bp, Homo sapiens
gccacaatcacta

SEQ ID NO: 5421162 - DNA, 22 bp, Homo sapiens
gccacaatcactaaatatctag

SEQ ID NO: 5421163 - DNA, 15 bp, Homo sapiens
gccacaatcctcccc

SEQ ID NO: 5421164 - DNA, 21 bp, Homo sapiens
gccacaatgcagttctgagca

SEQ ID NO: 5421165 - DNA, 17 bp, Homo sapiens
gccacaatgcctctccc

SEQ ID NO: 5421166 - DNA, 19 bp, Homo sapiens
gccacaatgcctctcccac

SEQ ID NO: 5421167 - DNA, 13 bp, Homo sapiens
gccacaatgtgat

SEQ ID NO: 5421168 - DNA, 19 bp, Homo sapiens
gccacaatgtgatatgtgt

SEQ ID NO: 5421169 - DNA, 18 bp, Homo sapiens
gccacacaaacgtttact

SEQ ID NO: 5421170 - DNA, 11 bp, Homo sapiens
gccacacacac

SEQ ID NO: 5421171 - DNA, 14 bp, Homo sapiens
gccacacacacaga

SEQ ID NO: 5421172 - DNA, 21 bp, Homo sapiens
gccacacacacagaaaatata

SEQ ID NO: 5421173 - DNA, 12 bp, Homo sapiens
gccacacacctt

SEQ ID NO: 5421174 - DNA, 13 bp, Homo sapiens
gccacacagaaac

SEQ ID NO: 5421175 - DNA, 19 bp, Homo sapiens
gccacacagcagcgcagcc

SEQ ID NO: 5421176 - DNA, 22 bp, Homo sapiens
gccacacagcagcgcagccgag

SEQ ID NO: 5421177 - DNA, 22 bp, Homo sapiens
gccacacagcccagaaggccag

SEQ ID NO: 5421178 - DNA, 14 bp, Homo sapiens
gccacacaggcagg

SEQ ID NO: 5421179 - DNA, 18 bp, Homo sapiens
gccacacaggcagggcct

SEQ ID NO: 5421180 - DNA, 21 bp, Homo sapiens
gccacacaggcagggcctggc

SEQ ID NO: 5421181 - DNA, 17 bp, Homo sapiens
gccacacattgtgcttg

SEQ ID NO: 5421182 - DNA, 14 bp, Homo sapiens
gccacaccaagctg

SEQ ID NO: 5421183 - DNA, 19 bp, Homo sapiens
gccacaccaagctgtgcca

SEQ ID NO: 5421184 - DNA, 20 bp, Homo sapiens
gccacaccaagctgtgccac

SEQ ID NO: 5421185 - DNA, 18 bp, Homo sapiens
gccacaccaatcagagag

SEQ ID NO: 5421186 - DNA, 13 bp, Homo sapiens
gccacaccactgc

SEQ ID NO: 5421187 - DNA, 15 bp, Homo sapiens
gccacaccactgcca

SEQ ID NO: 5421188 - DNA, 21 bp, Homo sapiens
gccacaccaggatagagactg

SEQ ID NO: 5421189 - DNA, 14 bp, Homo sapiens
gccacacccagagt

SEQ ID NO: 5421190 - DNA, 13 bp, Homo sapiens
gccacaccccaga

SEQ ID NO: 5421191 - DNA, 15 bp, Homo sapiens
gccacaccccagact

SEQ ID NO: 5421192 - DNA, 22 bp, Homo sapiens
gccacaccccagactccaggcc

SEQ ID NO: 5421193 - DNA, 13 bp, Homo sapiens
gccacacccctct

SEQ ID NO: 5421194 - DNA, 20 bp, Homo sapiens
gccacacccggctccccctg

SEQ ID NO: 5421195 - DNA, 22 bp, Homo sapiens
gccacaccctcccccgccactc

SEQ ID NO: 5421196 - DNA, 21 bp, Homo sapiens
gccacaccgtggcagcttgct

SEQ ID NO: 5421197 - DNA, 23 bp, Homo sapiens
gccacaccgtggcagcttgctgg

SEQ ID NO: 5421198 - DNA, 22 bp, Homo sapiens
gccacacctgagcgctgtggac

SEQ ID NO: 5421199 - DNA, 13 bp, Homo sapiens
gccacacgcaggc

SEQ ID NO: 5421200 - DNA, 14 bp, Homo sapiens
gccacacgcaggcg

SEQ ID NO: 5421201 - DNA, 19 bp, Homo sapiens
gccacacgcaggcggccag

SEQ ID NO: 5421202 - DNA, 17 bp, Homo sapiens
gccacacgcctctgtgt

SEQ ID NO: 5421203 - DNA, 18 bp, Homo sapiens
gccacacgctcactccag

SEQ ID NO: 5421204 - DNA, 14 bp, Homo sapiens
gccacacgctgccc

SEQ ID NO: 5421205 - DNA, 22 bp, Homo sapiens
gccacacgctgcccaggctctg

SEQ ID NO: 5421206 - DNA, 19 bp, Homo sapiens
gccacacggagaggccact

SEQ ID NO: 5421207 - DNA, 21 bp, Homo sapiens
gccacacgtctgaccctctcc

SEQ ID NO: 5421208 - DNA, 17 bp, Homo sapiens
gccacacgtggctggcg

SEQ ID NO: 5421209 - DNA, 16 bp, Homo sapiens
gccacactcagcacaa

SEQ ID NO: 5421210 - DNA, 14 bp, Homo sapiens
gccacactcagtcc

SEQ ID NO: 5421211 - DNA, 22 bp, Homo sapiens
gccacactctgggctccagagt

SEQ ID NO: 5421212 - DNA, 13 bp, Homo sapiens
gccacactgatgg

SEQ ID NO: 5421213 - DNA, 13 bp, Homo sapiens
gccacactgggcc

SEQ ID NO: 5421214 - DNA, 16 bp, Homo sapiens
gccacactgggcctgg

SEQ ID NO: 5421215 - DNA, 14 bp, Homo sapiens
gccacactggggct

SEQ ID NO: 5421216 - DNA, 18 bp, Homo sapiens
gccacactggggctgaca

SEQ ID NO: 5421217 - DNA, 12 bp, Homo sapiens
gccacactgtga

SEQ ID NO: 5421218 - DNA, 16 bp, Homo sapiens
gccacactgtgacaca

SEQ ID NO: 5421219 - DNA, 18 bp, Homo sapiens
gccacacttcgctcttga

SEQ ID NO: 5421220 - DNA, 20 bp, Homo sapiens
gccacacttcgctcttgagg

SEQ ID NO: 5421221 - DNA, 16 bp, Homo sapiens
gccacacttctcagga

SEQ ID NO: 5421222 - DNA, 17 bp, Homo sapiens
gccacacttctcaggac

SEQ ID NO: 5421223 - DNA, 19 bp, Homo sapiens
gccacacttctcaggacac

SEQ ID NO: 5421224 - DNA, 22 bp, Homo sapiens
gccacacttctcaggacacagg

SEQ ID NO: 5421225 - DNA, 21 bp, Homo sapiens
gccacactttcactggggatc

SEQ ID NO: 5421226 - DNA, 19 bp, Homo sapiens
gccacagaagccaggagca

SEQ ID NO: 5421227 - DNA, 18 bp, Homo sapiens
gccacagaaggtgaactt

SEQ ID NO: 5421228 - DNA, 19 bp, Homo sapiens
gccacagaaggtgaacttt

SEQ ID NO: 5421229 - DNA, 24 bp, Homo sapiens
gccacagacaactcacattgttca

SEQ ID NO: 5421230 - DNA, 14 bp, Homo sapiens
gccacagaccacct

SEQ ID NO: 5421231 - DNA, 18 bp, Homo sapiens
gccacagacccccagggc

SEQ ID NO: 5421232 - DNA, 13 bp, Homo sapiens
gccacagacccct

SEQ ID NO: 5421233 - DNA, 20 bp, Homo sapiens
gccacagacccctgggagct

SEQ ID NO: 5421234 - DNA, 20 bp, Homo sapiens
gccacagagaaagtacttct

SEQ ID NO: 5421235 - DNA, 23 bp, Homo sapiens
gccacagagaaagtacttctcca

SEQ ID NO: 5421236 - DNA, 14 bp, Homo sapiens
gccacagagaacct

SEQ ID NO: 5421237 - DNA, 13 bp, Homo sapiens
gccacagagaaga

SEQ ID NO: 5421238 - DNA, 12 bp, Homo sapiens
gccacagaggcc

SEQ ID NO: 5421239 - DNA, 13 bp, Homo sapiens
gccacagaggccc

SEQ ID NO: 5421240 - DNA, 14 bp, Homo sapiens
gccacagaggcccc

SEQ ID NO: 5421241 - DNA, 20 bp, Homo sapiens
gccacagaggccccacctga

SEQ ID NO: 5421242 - DNA, 13 bp, Homo sapiens
gccacagcaagga

SEQ ID NO: 5421243 - DNA, 21 bp, Homo sapiens
gccacagcactagagtcaccc

SEQ ID NO: 5421244 - DNA, 10 bp, Homo sapiens
gccacagcag

SEQ ID NO: 5421245 - DNA, 13 bp, Homo sapiens
gccacagcagagc

SEQ ID NO: 5421246 - DNA, 14 bp, Homo sapiens
gccacagcagagca

SEQ ID NO: 5421247 - DNA, 15 bp, Homo sapiens
gccacagcagagcat

SEQ ID NO: 5421248 - DNA, 19 bp, Homo sapiens
gccacagcagcatttttat

SEQ ID NO: 5421249 - DNA, 20 bp, Homo sapiens
gccacagcagcctctgaagt

SEQ ID NO: 5421250 - DNA, 13 bp, Homo sapiens
gccacagccaagc

SEQ ID NO: 5421251 - DNA, 16 bp, Homo sapiens
gccacagccaagccca

SEQ ID NO: 5421252 - DNA, 16 bp, Homo sapiens
gccacagccagaaccc

SEQ ID NO: 5421253 - DNA, 13 bp, Homo sapiens
gccacagccagag

SEQ ID NO: 5421254 - DNA, 23 bp, Homo sapiens
gccacagccagaggagggcagag

SEQ ID NO: 5421255 - DNA, 12 bp, Homo sapiens
gccacagccagg

SEQ ID NO: 5421256 - DNA, 14 bp, Homo sapiens
gccacagccagggg

SEQ ID NO: 5421257 - DNA, 16 bp, Homo sapiens
gccacagcccaggcct

SEQ ID NO: 5421258 - DNA, 23 bp, Homo sapiens
gccacagcccaggcctccagctc

SEQ ID NO: 5421259 - DNA, 11 bp, Homo sapiens
gccacagcccc

SEQ ID NO: 5421260 - DNA, 12 bp, Homo sapiens
gccacagcccca

SEQ ID NO: 5421261 - DNA, 22 bp, Homo sapiens
gccacagccccacagcacccag

SEQ ID NO: 5421262 - DNA, 23 bp, Homo sapiens
gccacagccccacagcacccagg

SEQ ID NO: 5421263 - DNA, 12 bp, Homo sapiens
gccacagccccc

SEQ ID NO: 5421264 - DNA, 16 bp, Homo sapiens
gccacagccgcctttg

SEQ ID NO: 5421265 - DNA, 17 bp, Homo sapiens
gccacagccgcctttgg

SEQ ID NO: 5421266 - DNA, 17 bp, Homo sapiens
gccacagcctccccacc

SEQ ID NO: 5421267 - DNA, 18 bp, Homo sapiens
gccacagcctccccaccc

SEQ ID NO: 5421268 - DNA, 16 bp, Homo sapiens
gccacagcctcccctg

SEQ ID NO: 5421269 - DNA, 17 bp, Homo sapiens
gccacagcctgctggca

SEQ ID NO: 5421270 - DNA, 19 bp, Homo sapiens
gccacagcctgctggcagg

SEQ ID NO: 5421271 - DNA, 20 bp, Homo sapiens
gccacagcctgctggcaggg

SEQ ID NO: 5421272 - DNA, 21 bp, Homo sapiens
gccacagcctgctggcagggc

SEQ ID NO: 5421273 - DNA, 24 bp, Homo sapiens
gccacagcctgctggcagggccag

SEQ ID NO: 5421274 - DNA, 12 bp, Homo sapiens
gccacagccttc

SEQ ID NO: 5421275 - DNA, 18 bp, Homo sapiens
gccacagcgccagcctca

SEQ ID NO: 5421276 - DNA, 15 bp, Homo sapiens
gccacagcgtgctgg

SEQ ID NO: 5421277 - DNA, 16 bp, Homo sapiens
gccacagcgtgctggc

SEQ ID NO: 5421278 - DNA, 17 bp, Homo sapiens
gccacagcgtgctggcg

SEQ ID NO: 5421279 - DNA, 12 bp, Homo sapiens
gccacagctcaa

SEQ ID NO: 5421280 - DNA, 11 bp, Homo sapiens
gccacagctct

SEQ ID NO: 5421281 - DNA, 17 bp, Homo sapiens
gccacagctgctgttct

SEQ ID NO: 5421282 - DNA, 18 bp, Homo sapiens
gccacagctgctgttctc

SEQ ID NO: 5421283 - DNA, 19 bp, Homo sapiens
gccacagctgctgttctca

SEQ ID NO: 5421284 - DNA, 10 bp, Homo sapiens
gccacagctt

SEQ ID NO: 5421285 - DNA, 22 bp, Homo sapiens
gccacagcttcttcatctttaa

SEQ ID NO: 5421286 - DNA, 15 bp, Homo sapiens
gccacagcttttgca

SEQ ID NO: 5421287 - DNA, 16 bp, Homo sapiens
gccacagcttttgcaa

SEQ ID NO: 5421288 - DNA, 19 bp, Homo sapiens
gccacaggaacggccctgc

SEQ ID NO: 5421289 - DNA, 20 bp, Homo sapiens
gccacaggaacggccctgca

SEQ ID NO: 5421290 - DNA, 15 bp, Homo sapiens
gccacaggaaggagg

SEQ ID NO: 5421291 - DNA, 12 bp, Homo sapiens
gccacaggacac

SEQ ID NO: 5421292 - DNA, 11 bp, Homo sapiens
gccacaggaga

SEQ ID NO: 5421293 - DNA, 14 bp, Homo sapiens
gccacaggcagacg

SEQ ID NO: 5421294 - DNA, 18 bp, Homo sapiens
gccacaggcaggtcacag

SEQ ID NO: 5421295 - DNA, 15 bp, Homo sapiens
gccacaggcagtcca

SEQ ID NO: 5421296 - DNA, 13 bp, Homo sapiens
gccacaggcctcc

SEQ ID NO: 5421297 - DNA, 14 bp, Homo sapiens
gccacaggcctccc

SEQ ID NO: 5421298 - DNA, 21 bp, Homo sapiens
gccacaggcctccctgtttga

SEQ ID NO: 5421299 - DNA, 13 bp, Homo sapiens
gccacaggcctga

SEQ ID NO: 5421300 - DNA, 15 bp, Homo sapiens
gccacaggcctgaga

SEQ ID NO: 5421301 - DNA, 20 bp, Homo sapiens
gccacaggcctgagatttca

SEQ ID NO: 5421302 - DNA, 19 bp, Homo sapiens
gccacaggcctggcctcaa

SEQ ID NO: 5421303 - DNA, 12 bp, Homo sapiens
gccacaggctag

SEQ ID NO: 5421304 - DNA, 17 bp, Homo sapiens
gccacaggctagatccc

SEQ ID NO: 5421305 - DNA, 12 bp, Homo sapiens
gccacaggctgc

SEQ ID NO: 5421306 - DNA, 23 bp, Homo sapiens
gccacaggctgcaagctgcaggg

SEQ ID NO: 5421307 - DNA, 16 bp, Homo sapiens
gccacagggaagctca

SEQ ID NO: 5421308 - DNA, 18 bp, Homo sapiens
gccacagggaagctcaca

SEQ ID NO: 5421309 - DNA, 17 bp, Homo sapiens
gccacagggagctccgt

SEQ ID NO: 5421310 - DNA, 20 bp, Homo sapiens
gccacagggcggtgctagct

SEQ ID NO: 5421311 - DNA, 18 bp, Homo sapiens
gccacagggtctgcctcc

SEQ ID NO: 5421312 - DNA, 19 bp, Homo sapiens
gccacagggtctgcctcca

SEQ ID NO: 5421313 - DNA, 23 bp, Homo sapiens
gccacagggtctgcctccagcca

SEQ ID NO: 5421314 - DNA, 15 bp, Homo sapiens
gccacaggtctttat

SEQ ID NO: 5421315 - DNA, 15 bp, Homo sapiens
gccacaggttttaag

SEQ ID NO: 5421316 - DNA, 20 bp, Homo sapiens
gccacagtaatactcattcc

SEQ ID NO: 5421317 - DNA, 16 bp, Homo sapiens
gccacagtacatatgt

SEQ ID NO: 5421318 - DNA, 15 bp, Homo sapiens
gccacagtagaactg

SEQ ID NO: 5421319 - DNA, 16 bp, Homo sapiens
gccacagtcactggat

SEQ ID NO: 5421320 - DNA, 17 bp, Homo sapiens
gccacagtcatggtggc

SEQ ID NO: 5421321 - DNA, 15 bp, Homo sapiens
gccacagtgggatga

SEQ ID NO: 5421322 - DNA, 15 bp, Homo sapiens
gccacagtggggccc

SEQ ID NO: 5421323 - DNA, 20 bp, Homo sapiens
gccacagtggggcccatggc

SEQ ID NO: 5421324 - DNA, 17 bp, Homo sapiens
gccacagtggggctgca

SEQ ID NO: 5421325 - DNA, 20 bp, Homo sapiens
gccacagtggggctgcaggc

SEQ ID NO: 5421326 - DNA, 19 bp, Homo sapiens
gccacagtggtactctgtg

SEQ ID NO: 5421327 - DNA, 15 bp, Homo sapiens
gccacagttccccta

SEQ ID NO: 5421328 - DNA, 17 bp, Homo sapiens
gccacagttctaagacc

SEQ ID NO: 5421329 - DNA, 16 bp, Homo sapiens
gccacatacttgcagc

SEQ ID NO: 5421330 - DNA, 16 bp, Homo sapiens
gccacatcaaaccttt

SEQ ID NO: 5421331 - DNA, 18 bp, Homo sapiens
gccacatcacacagacct

SEQ ID NO: 5421332 - DNA, 16 bp, Homo sapiens
gccacatcagccccac

SEQ ID NO: 5421333 - DNA, 15 bp, Homo sapiens
gccacatcattctgt

SEQ ID NO: 5421334 - DNA, 14 bp, Homo sapiens
gccagaaaaagaag

SEQ ID NO: 5421335 - DNA, 16 bp, Homo sapiens
gccagaaaaagaagaa

SEQ ID NO: 5421336 - DNA, 17 bp, Homo sapiens
gccagaaaaagaagaag

SEQ ID NO: 5421337 - DNA, 19 bp, Homo sapiens
gccagaaaaagaagaagga

SEQ ID NO: 5421338 - DNA, 17 bp, Homo sapiens
gccagaaaaggcagcca

SEQ ID NO: 5421339 - DNA, 23 bp, Homo sapiens
gccagaaaaggcagccagatccc

SEQ ID NO: 5421340 - DNA, 19 bp, Homo sapiens
gccagaaaggtgtgaggag

SEQ ID NO: 5421341 - DNA, 21 bp, Homo sapiens
gccagaaaggtgtgaggagag

SEQ ID NO: 5421342 - DNA, 15 bp, Homo sapiens
gccagaaatgggcag

SEQ ID NO: 5421343 - DNA, 18 bp, Homo sapiens
gccagaacagtttgtaca

SEQ ID NO: 5421344 - DNA, 20 bp, Homo sapiens
gccagaaccccgagccctac

SEQ ID NO: 5421345 - DNA, 17 bp, Homo sapiens
gccagaacctggagggc

SEQ ID NO: 5421346 - DNA, 22 bp, Homo sapiens
gccagaacgtggctctgctggc

SEQ ID NO: 5421347 - DNA, 13 bp, Homo sapiens
gccagaacttcga

SEQ ID NO: 5421348 - DNA, 19 bp, Homo sapiens
gccagaagactcctaggcc

SEQ ID NO: 5421349 - DNA, 19 bp, Homo sapiens
gccagaagatgaacagact

SEQ ID NO: 5421350 - DNA, 12 bp, Homo sapiens
gccagaagctga

SEQ ID NO: 5421351 - DNA, 17 bp, Homo sapiens
gccagaaggagggcaga

SEQ ID NO: 5421352 - DNA, 19 bp, Homo sapiens
gccagaaggagggcagagc

SEQ ID NO: 5421353 - DNA, 20 bp, Homo sapiens
gccagaaggagggcagagcc

SEQ ID NO: 5421354 - DNA, 23 bp, Homo sapiens
gccagaaggcaagatcagattaa

SEQ ID NO: 5421355 - DNA, 17 bp, Homo sapiens
gccagaagtaacttatt

SEQ ID NO: 5421356 - DNA, 16 bp, Homo sapiens
gccagaagtcaaggct

SEQ ID NO: 5421357 - DNA, 23 bp, Homo sapiens
gccagaagttgtggatttcagtt

SEQ ID NO: 5421358 - DNA, 23 bp, Homo sapiens
gccagaatactgggttcttagtt

SEQ ID NO: 5421359 - DNA, 22 bp, Homo sapiens
gccagaatcagcacagataaaa

SEQ ID NO: 5421360 - DNA, 18 bp, Homo sapiens
gccagaatctcattactg

SEQ ID NO: 5421361 - DNA, 14 bp, Homo sapiens
gccagaatgccctg

SEQ ID NO: 5421362 - DNA, 16 bp, Homo sapiens
gccagaatgtttcctg

SEQ ID NO: 5421363 - DNA, 17 bp, Homo sapiens
gccagacaaaatttgag

SEQ ID NO: 5421364 - DNA, 22 bp, Homo sapiens
gccagacactgagcttctgaga

SEQ ID NO: 5421365 - DNA, 19 bp, Homo sapiens
gccagacagaccttcacag

SEQ ID NO: 5421366 - DNA, 17 bp, Homo sapiens
gccagacagagatcaga

SEQ ID NO: 5421367 - DNA, 22 bp, Homo sapiens
gccagacatcaacagataaata

SEQ ID NO: 5421368 - DNA, 18 bp, Homo sapiens
gccagacatgccacaagg

SEQ ID NO: 5421369 - DNA, 11 bp, Homo sapiens
gccagacatgg

SEQ ID NO: 5421370 - DNA, 14 bp, Homo sapiens
gccagaccacagca

SEQ ID NO: 5421371 - DNA, 17 bp, Homo sapiens
gccagaccccctggaga

SEQ ID NO: 5421372 - DNA, 20 bp, Homo sapiens
gccagaccccgtggctctgg

SEQ ID NO: 5421373 - DNA, 23 bp, Homo sapiens
gccagaccccgtggctctgggag

SEQ ID NO: 5421374 - DNA, 19 bp, Homo sapiens
gccagaccgcagagaggct

SEQ ID NO: 5421375 - DNA, 16 bp, Homo sapiens
gccagacctagcaggc

SEQ ID NO: 5421376 - DNA, 22 bp, Homo sapiens
gccagacctagcaggctgttcc

SEQ ID NO: 5421377 - DNA, 19 bp, Homo sapiens
gccagacctgcatggtcaa

SEQ ID NO: 5421378 - DNA, 22 bp, Homo sapiens
gccagacctgcatggtcaagcc

SEQ ID NO: 5421379 - DNA, 22 bp, Homo sapiens
gccagacgctcattcagcatct

SEQ ID NO: 5421380 - DNA, 15 bp, Homo sapiens
gccagacggcccgcc

SEQ ID NO: 5421381 - DNA, 21 bp, Homo sapiens
gccagactctaggttatacaa

SEQ ID NO: 5421382 - DNA, 15 bp, Homo sapiens
gccagactctggtct

SEQ ID NO: 5421383 - DNA, 12 bp, Homo sapiens
gccagactctgt

SEQ ID NO: 5421384 - DNA, 15 bp, Homo sapiens
gccagactctgtctc

SEQ ID NO: 5421385 - DNA, 13 bp, Homo sapiens
gccagactggctg

SEQ ID NO: 5421386 - DNA, 14 bp, Homo sapiens
gccagactggctgc

SEQ ID NO: 5421387 - DNA, 22 bp, Homo sapiens
gccagactggctgcacagccca

SEQ ID NO: 5421388 - DNA, 18 bp, Homo sapiens
gccagactgtccagggaa

SEQ ID NO: 5421389 - DNA, 17 bp, Homo sapiens
gccagacttctggagga

SEQ ID NO: 5421390 - DNA, 16 bp, Homo sapiens
gccagacttgcttcct

SEQ ID NO: 5421391 - DNA, 11 bp, Homo sapiens
gccagagaaag

SEQ ID NO: 5421392 - DNA, 10 bp, Homo sapiens
gccagagaag

SEQ ID NO: 5421393 - DNA, 13 bp, Homo sapiens
gccagagaagcta

SEQ ID NO: 5421394 - DNA, 21 bp, Homo sapiens
gccagagaagtctggtcagag

SEQ ID NO: 5421395 - DNA, 16 bp, Homo sapiens
gccagagaagtgacag

SEQ ID NO: 5421396 - DNA, 18 bp, Homo sapiens
gccagagaagtgacaggg

SEQ ID NO: 5421397 - DNA, 12 bp, Homo sapiens
gccagagacaca

SEQ ID NO: 5421398 - DNA, 15 bp, Homo sapiens
gccagagacacaagc

SEQ ID NO: 5421399 - DNA, 20 bp, Homo sapiens
gccagagacacaagccttcg

SEQ ID NO: 5421400 - DNA, 21 bp, Homo sapiens
gccagagacacaagccttcgg

SEQ ID NO: 5421401 - DNA, 16 bp, Homo sapiens
gccagagagcagggga

SEQ ID NO: 5421402 - DNA, 13 bp, Homo sapiens
gccagagaggagc

SEQ ID NO: 5421403 - DNA, 16 bp, Homo sapiens
gccagagagggcccag

SEQ ID NO: 5421404 - DNA, 19 bp, Homo sapiens
gccagagagggcccagctg

SEQ ID NO: 5421405 - DNA, 20 bp, Homo sapiens
gccagagatccaaaagaagc

SEQ ID NO: 5421406 - DNA, 15 bp, Homo sapiens
gccagagatgcaata

SEQ ID NO: 5421407 - DNA, 16 bp, Homo sapiens
gccagagcaaacagaa

SEQ ID NO: 5421408 - DNA, 21 bp, Homo sapiens
gccagagcacctcaggaccct

SEQ ID NO: 5421409 - DNA, 13 bp, Homo sapiens
gccagagcagctc

SEQ ID NO: 5421410 - DNA, 16 bp, Homo sapiens
gccagagcaggagccc

SEQ ID NO: 5421411 - DNA, 17 bp, Homo sapiens
gccagagcaggagcccc

SEQ ID NO: 5421412 - DNA, 12 bp, Homo sapiens
gccagagcaggg

SEQ ID NO: 5421413 - DNA, 13 bp, Homo sapiens
gccagagccaacc

SEQ ID NO: 5421414 - DNA, 14 bp, Homo sapiens
gccagagccaacct

SEQ ID NO: 5421415 - DNA, 16 bp, Homo sapiens
gccagagccaacctgg

SEQ ID NO: 5421416 - DNA, 17 bp, Homo sapiens
gccagagccaacctgga

SEQ ID NO: 5421417 - DNA, 14 bp, Homo sapiens
gccagagccagggg

SEQ ID NO: 5421418 - DNA, 23 bp, Homo sapiens
gccagagcccaagtgccatccca

SEQ ID NO: 5421419 - DNA, 17 bp, Homo sapiens
gccagagccccaagcag

SEQ ID NO: 5421420 - DNA, 19 bp, Homo sapiens
gccagagccggccgccttc

SEQ ID NO: 5421421 - DNA, 12 bp, Homo sapiens
gccagagcctct

SEQ ID NO: 5421422 - DNA, 13 bp, Homo sapiens
gccagagcctctg

SEQ ID NO: 5421423 - DNA, 20 bp, Homo sapiens
gccagagcctctggcccctc

SEQ ID NO: 5421424 - DNA, 22 bp, Homo sapiens
gccagagcctctggcccctcac

SEQ ID NO: 5421425 - DNA, 18 bp, Homo sapiens
gccagagcctggggctct

SEQ ID NO: 5421426 - DNA, 13 bp, Homo sapiens
gccagagcctggt

SEQ ID NO: 5421427 - DNA, 19 bp, Homo sapiens
gccagagcctggtagagac

SEQ ID NO: 5421428 - DNA, 17 bp, Homo sapiens
gccagagccttaataaa

SEQ ID NO: 5421429 - DNA, 17 bp, Homo sapiens
gccagagccttggagga

SEQ ID NO: 5421430 - DNA, 10 bp, Homo sapiens
gccagagcta

SEQ ID NO: 5421431 - DNA, 22 bp, Homo sapiens
gccagagctacccgcagagttc

SEQ ID NO: 5421432 - DNA, 13 bp, Homo sapiens
gccagagctccca

SEQ ID NO: 5421433 - DNA, 15 bp, Homo sapiens
gccagagctcccagg

SEQ ID NO: 5421434 - DNA, 21 bp, Homo sapiens
gccagagctggaaggcagggc

SEQ ID NO: 5421435 - DNA, 22 bp, Homo sapiens
gccagagctggaaggcagggca

SEQ ID NO: 5421436 - DNA, 13 bp, Homo sapiens
gccagagctgtgc

SEQ ID NO: 5421437 - DNA, 14 bp, Homo sapiens
gccagagctgtgcc

SEQ ID NO: 5421438 - DNA, 15 bp, Homo sapiens
gccagagctgtgcct

SEQ ID NO: 5421439 - DNA, 15 bp, Homo sapiens
gccagagctttgttt

SEQ ID NO: 5421440 - DNA, 18 bp, Homo sapiens
gccagaggaactgtccag

SEQ ID NO: 5421441 - DNA, 19 bp, Homo sapiens
gccagaggaatcctggcag

SEQ ID NO: 5421442 - DNA, 23 bp, Homo sapiens
gccagaggaatcctggcagccca

SEQ ID NO: 5421443 - DNA, 16 bp, Homo sapiens
gccagaggacaaggaa

SEQ ID NO: 5421444 - DNA, 15 bp, Homo sapiens
gccagaggagagagg

SEQ ID NO: 5421445 - DNA, 22 bp, Homo sapiens
gccagaggagagaggaccccct

SEQ ID NO: 5421446 - DNA, 19 bp, Homo sapiens
gccagaggatgctctttcc

SEQ ID NO: 5421447 - DNA, 20 bp, Homo sapiens
gccagaggatgctctttccc

SEQ ID NO: 5421448 - DNA, 23 bp, Homo sapiens
gccagaggatgctctttcccagg

SEQ ID NO: 5421449 - DNA, 20 bp, Homo sapiens
gccagaggcagaaccctggt

SEQ ID NO: 5421450 - DNA, 22 bp, Homo sapiens
gccagaggcattttttaaatca

SEQ ID NO: 5421451 - DNA, 15 bp, Homo sapiens
gccagaggccaggat

SEQ ID NO: 5421452 - DNA, 19 bp, Homo sapiens
gccagaggccaggatgcct

SEQ ID NO: 5421453 - DNA, 14 bp, Homo sapiens
gccagaggccccca

SEQ ID NO: 5421454 - DNA, 19 bp, Homo sapiens
gccagaggcccccagccca

SEQ ID NO: 5421455 - DNA, 14 bp, Homo sapiens
gccagaggccctcg

SEQ ID NO: 5421456 - DNA, 14 bp, Homo sapiens
gccagaggccctgg

SEQ ID NO: 5421457 - DNA, 19 bp, Homo sapiens
gccagaggccctggaggga

SEQ ID NO: 5421458 - DNA, 11 bp, Homo sapiens
gccagaggcct

SEQ ID NO: 5421459 - DNA, 14 bp, Homo sapiens
gccagaggcctggt

SEQ ID NO: 5421460 - DNA, 17 bp, Homo sapiens
gccagaggcctggtgcc

SEQ ID NO: 5421461 - DNA, 20 bp, Homo sapiens
gccagaggcctggtgccctg

SEQ ID NO: 5421462 - DNA, 23 bp, Homo sapiens
gccagaggcctggtgccctggcc

SEQ ID NO: 5421463 - DNA, 21 bp, Homo sapiens
gccagaggctcgaggggctca

SEQ ID NO: 5421464 - DNA, 22 bp, Homo sapiens
gccagaggctcgttgactggct

SEQ ID NO: 5421465 - DNA, 19 bp, Homo sapiens
gccagaggctggagacagg

SEQ ID NO: 5421466 - DNA, 11 bp, Homo sapiens
gccagagggac

SEQ ID NO: 5421467 - DNA, 20 bp, Homo sapiens
gccagagggagtgacagagg

SEQ ID NO: 5421468 - DNA, 13 bp, Homo sapiens
gccagagggccag

SEQ ID NO: 5421469 - DNA, 15 bp, Homo sapiens
gccagagggccagca

SEQ ID NO: 5421470 - DNA, 17 bp, Homo sapiens
gccagagggccagcagg

SEQ ID NO: 5421471 - DNA, 16 bp, Homo sapiens
gccagaggtgcttcac

SEQ ID NO: 5421472 - DNA, 15 bp, Homo sapiens
gccagaggtgggcag

SEQ ID NO: 5421473 - DNA, 17 bp, Homo sapiens
gccagaggtgggcaggt

SEQ ID NO: 5421474 - DNA, 12 bp, Homo sapiens
gccagagtcaac

SEQ ID NO: 5421475 - DNA, 14 bp, Homo sapiens
gccagagtcaacaa

SEQ ID NO: 5421476 - DNA, 17 bp, Homo sapiens
gccagagtcaacaaatt

SEQ ID NO: 5421477 - DNA, 22 bp, Homo sapiens
gccagagtcaacaaattaaata

SEQ ID NO: 5421478 - DNA, 15 bp, Homo sapiens
gccagagtctcccag

SEQ ID NO: 5421479 - DNA, 19 bp, Homo sapiens
gccagagtctcccagtggg

SEQ ID NO: 5421480 - DNA, 21 bp, Homo sapiens
gccagagtctcccagtgggtg

SEQ ID NO: 5421481 - DNA, 15 bp, Homo sapiens
gccagagtggccacg

SEQ ID NO: 5421482 - DNA, 14 bp, Homo sapiens
gccagagtggcctg

SEQ ID NO: 5421483 - DNA, 24 bp, Homo sapiens
gccagagtggcctggccaggagct

SEQ ID NO: 5421484 - DNA, 19 bp, Homo sapiens
gccagagtgtcctgctacc

SEQ ID NO: 5421485 - DNA, 21 bp, Homo sapiens
gccagagtgtcctgctacctt

SEQ ID NO: 5421486 - DNA, 19 bp, Homo sapiens
gccagagttgttctcaggg

SEQ ID NO: 5421487 - DNA, 21 bp, Homo sapiens
gccagagttgttctcaggggt

SEQ ID NO: 5421488 - DNA, 23 bp, Homo sapiens
gccagagtttgcctccctgcact

SEQ ID NO: 5421489 - DNA, 17 bp, Homo sapiens
gccagataaaatgttca

SEQ ID NO: 5421490 - DNA, 21 bp, Homo sapiens
gccagatataactgtcttgtt

SEQ ID NO: 5421491 - DNA, 11 bp, Homo sapiens
gccagatccag

SEQ ID NO: 5421492 - DNA, 16 bp, Homo sapiens
gccagatccagcctgg

SEQ ID NO: 5421493 - DNA, 17 bp, Homo sapiens
gccagatccagcctggg

SEQ ID NO: 5421494 - DNA, 13 bp, Homo sapiens
gccagatccccag

SEQ ID NO: 5421495 - DNA, 18 bp, Homo sapiens
gccagatccccagggcag

SEQ ID NO: 5421496 - DNA, 19 bp, Homo sapiens
gccagatccccagggcagc

SEQ ID NO: 5421497 - DNA, 21 bp, Homo sapiens
gccagatccccagggcagcct

SEQ ID NO: 5421498 - DNA, 17 bp, Homo sapiens
gccagatcctcttctca

SEQ ID NO: 5421499 - DNA, 15 bp, Homo sapiens
gccagatcctcttgg

SEQ ID NO: 5421500 - DNA, 22 bp, Homo sapiens
gccagatgcacatccctggaag

SEQ ID NO: 5421501 - DNA, 20 bp, Homo sapiens
gccagatgcaggacaggagg

SEQ ID NO: 5421502 - DNA, 15 bp, Homo sapiens
gccagatgcctcccc

SEQ ID NO: 5421503 - DNA, 16 bp, Homo sapiens
gccagatgcctcccca

SEQ ID NO: 5421504 - DNA, 20 bp, Homo sapiens
gccagatgctagagcctctg

SEQ ID NO: 5421505 - DNA, 19 bp, Homo sapiens
gccagatgctgatgttcag

SEQ ID NO: 5421506 - DNA, 21 bp, Homo sapiens
gccagatgctgatgttcagtg

SEQ ID NO: 5421507 - DNA, 14 bp, Homo sapiens
gccagatggggcct

SEQ ID NO: 5421508 - DNA, 18 bp, Homo sapiens
gccagatgtgggctcaga

SEQ ID NO: 5421509 - DNA, 21 bp, Homo sapiens
gccagatgttgttcctggcta

SEQ ID NO: 5421510 - DNA, 16 bp, Homo sapiens
gccagattaggcctgg

SEQ ID NO: 5421511 - DNA, 17 bp, Homo sapiens
gccagattaggcctgga

SEQ ID NO: 5421512 - DNA, 18 bp, Homo sapiens
gccaggaccacacagtcc

SEQ ID NO: 5421513 - DNA, 19 bp, Homo sapiens
gccaggaccacacagtccc

SEQ ID NO: 5421514 - DNA, 20 bp, Homo sapiens
gccaggaccacacagtcccc

SEQ ID NO: 5421515 - DNA, 21 bp, Homo sapiens
gccaggaccacacagtcccca

SEQ ID NO: 5421516 - DNA, 22 bp, Homo sapiens
gccaggaccacacagtccccag

SEQ ID NO: 5421517 - DNA, 11 bp, Homo sapiens
gccaggaccag

SEQ ID NO: 5421518 - DNA, 12 bp, Homo sapiens
gccaggaccagc

SEQ ID NO: 5421519 - DNA, 14 bp, Homo sapiens
gccaggaccagcct

SEQ ID NO: 5421520 - DNA, 22 bp, Homo sapiens
gccaggacccaccactggaagc

SEQ ID NO: 5421521 - DNA, 14 bp, Homo sapiens
gccaggaccccagg

SEQ ID NO: 5421522 - DNA, 23 bp, Homo sapiens
gccaggaccctgacctccgcccc

SEQ ID NO: 5421523 - DNA, 18 bp, Homo sapiens
gccaggactcccagaacc

SEQ ID NO: 5421524 - DNA, 17 bp, Homo sapiens
gccaggactccccaggc

SEQ ID NO: 5421525 - DNA, 14 bp, Homo sapiens
gccaggactctctt

SEQ ID NO: 5421526 - DNA, 19 bp, Homo sapiens
gccaggactgagccccgca

SEQ ID NO: 5421527 - DNA, 14 bp, Homo sapiens
gccaggactgtgac

SEQ ID NO: 5421528 - DNA, 15 bp, Homo sapiens
gccaggactgtgata

SEQ ID NO: 5421529 - DNA, 14 bp, Homo sapiens
gccaggactttgag

SEQ ID NO: 5421530 - DNA, 16 bp, Homo sapiens
gccaggagaagacccc

SEQ ID NO: 5421531 - DNA, 19 bp, Homo sapiens
gccaggagaagacccctgc

SEQ ID NO: 5421532 - DNA, 21 bp, Homo sapiens
gccaggagaagacccctgccc

SEQ ID NO: 5421533 - DNA, 23 bp, Homo sapiens
gccaggagaagacccctgcccaa

SEQ ID NO: 5421534 - DNA, 13 bp, Homo sapiens
gccaggagaagct

SEQ ID NO: 5421535 - DNA, 17 bp, Homo sapiens
gccaggagaagctcagc

SEQ ID NO: 5421536 - DNA, 19 bp, Homo sapiens
gccaggagaagctcagctg

SEQ ID NO: 5421537 - DNA, 17 bp, Homo sapiens
gccaggagaagttgagg

SEQ ID NO: 5421538 - DNA, 17 bp, Homo sapiens
gccaggagaccctgtct

SEQ ID NO: 5421539 - DNA, 11 bp, Homo sapiens
gccaggagaga

SEQ ID NO: 5421540 - DNA, 13 bp, Homo sapiens
gccaggagagaga

SEQ ID NO: 5421541 - DNA, 17 bp, Homo sapiens
gccaggagagcttaggg

SEQ ID NO: 5421542 - DNA, 17 bp, Homo sapiens
gccaggagatggcccca

SEQ ID NO: 5421543 - DNA, 19 bp, Homo sapiens
gccaggagatggccccaac

SEQ ID NO: 5421544 - DNA, 21 bp, Homo sapiens
gccaggagattcagagctcaa

SEQ ID NO: 5421545 - DNA, 10 bp, Homo sapiens
gccaggagca

SEQ ID NO: 5421546 - DNA, 18 bp, Homo sapiens
gccaggagcaatgggact

SEQ ID NO: 5421547 - DNA, 19 bp, Homo sapiens
gccaggagcaatgggactg

SEQ ID NO: 5421548 - DNA, 20 bp, Homo sapiens
gccaggagcaatgggactgg

SEQ ID NO: 5421549 - DNA, 23 bp, Homo sapiens
gccaggagcaatgggactggagt

SEQ ID NO: 5421550 - DNA, 13 bp, Homo sapiens
gccaggagcagcc

SEQ ID NO: 5421551 - DNA, 17 bp, Homo sapiens
gccaggagcagccctgg

SEQ ID NO: 5421552 - DNA, 18 bp, Homo sapiens
gccaggagcagccctggc

SEQ ID NO: 5421553 - DNA, 22 bp, Homo sapiens
gccaggagcagccctggccccc

SEQ ID NO: 5421554 - DNA, 14 bp, Homo sapiens
gccaggagcagcct

SEQ ID NO: 5421555 - DNA, 21 bp, Homo sapiens
gccaggagcaggcacgggtgg

SEQ ID NO: 5421556 - DNA, 14 bp, Homo sapiens
gccaggagccgggc

SEQ ID NO: 5421557 - DNA, 20 bp, Homo sapiens
gccaggagccgggcctccca

SEQ ID NO: 5421558 - DNA, 22 bp, Homo sapiens
gccaggagctgggcagaaggcc

SEQ ID NO: 5421559 - DNA, 23 bp, Homo sapiens
gccaggagctgtcaccaaggaaa

SEQ ID NO: 5421560 - DNA, 16 bp, Homo sapiens
gccaggaggccaggct

SEQ ID NO: 5421561 - DNA, 20 bp, Homo sapiens
gccaggaggcggcagctctt

SEQ ID NO: 5421562 - DNA, 14 bp, Homo sapiens
gccaggaggctgcc

SEQ ID NO: 5421563 - DNA, 15 bp, Homo sapiens
gccaggaggctgcca

SEQ ID NO: 5421564 - DNA, 22 bp, Homo sapiens
gccaggaggctggcagtacaga

SEQ ID NO: 5421565 - DNA, 23 bp, Homo sapiens
gccaggaggctttaagctccagc

SEQ ID NO: 5421566 - DNA, 21 bp, Homo sapiens
gccaggagggacaaaggagcc

SEQ ID NO: 5421567 - DNA, 17 bp, Homo sapiens
gccaggaggtcctcctc

SEQ ID NO: 5421568 - DNA, 19 bp, Homo sapiens
gccaggaggtcctcctctc

SEQ ID NO: 5421569 - DNA, 17 bp, Homo sapiens
gccaggaggtgccactg

SEQ ID NO: 5421570 - DNA, 19 bp, Homo sapiens
gccaggaggttggtgactg

SEQ ID NO: 5421571 - DNA, 17 bp, Homo sapiens
gccaggagtaagacaag

SEQ ID NO: 5421572 - DNA, 14 bp, Homo sapiens
gccaggagtctgtg

SEQ ID NO: 5421573 - DNA, 20 bp, Homo sapiens
gccaggagtgggtttccctg

SEQ ID NO: 5421574 - DNA, 22 bp, Homo sapiens
gccaggatcatggtgtaataag

SEQ ID NO: 5421575 - DNA, 16 bp, Homo sapiens
gccaggatggcgcagg

SEQ ID NO: 5421576 - DNA, 23 bp, Homo sapiens
gccaggatggtctcgatctcctg

SEQ ID NO: 5421577 - DNA, 18 bp, Homo sapiens
gccaggattcaggcctct

SEQ ID NO: 5421578 - DNA, 17 bp, Homo sapiens
gccaggattcctctctc

SEQ ID NO: 5421579 - DNA, 24 bp, Homo sapiens
gccaggattggcacaagctccctg

SEQ ID NO: 5421580 - DNA, 20 bp, Homo sapiens
gccaggattttgtattgcca

SEQ ID NO: 5421581 - DNA, 14 bp, Homo sapiens
gccaggcacaggca

SEQ ID NO: 5421582 - DNA, 16 bp, Homo sapiens
gccaggcacaggcagg

SEQ ID NO: 5421583 - DNA, 19 bp, Homo sapiens
gccaggcacaggcagggca

SEQ ID NO: 5421584 - DNA, 14 bp, Homo sapiens
gccaggcacagggc

SEQ ID NO: 5421585 - DNA, 19 bp, Homo sapiens
gccaggcaccacagcctcc

SEQ ID NO: 5421586 - DNA, 18 bp, Homo sapiens
gccaggcaccatctgcca

SEQ ID NO: 5421587 - DNA, 17 bp, Homo sapiens
gccaggcacccacatcc

SEQ ID NO: 5421588 - DNA, 18 bp, Homo sapiens
gccaggcacccatgtggg

SEQ ID NO: 5421589 - DNA, 16 bp, Homo sapiens
gccaggcacctggcct

SEQ ID NO: 5421590 - DNA, 17 bp, Homo sapiens
gccaggcacctggcctg

SEQ ID NO: 5421591 - DNA, 22 bp, Homo sapiens
gccaggcacctggcctgctggg

SEQ ID NO: 5421592 - DNA, 19 bp, Homo sapiens
gccaggcactgccttctcc

SEQ ID NO: 5421593 - DNA, 11 bp, Homo sapiens
gccaggcagaa

SEQ ID NO: 5421594 - DNA, 22 bp, Homo sapiens
gccaggcagaatggctgcacgt

SEQ ID NO: 5421595 - DNA, 14 bp, Homo sapiens
gccaggcagagaac

SEQ ID NO: 5421596 - DNA, 18 bp, Homo sapiens
gccaggcagatcctctgg

SEQ ID NO: 5421597 - DNA, 14 bp, Homo sapiens
gccaggcagatctg

SEQ ID NO: 5421598 - DNA, 12 bp, Homo sapiens
gccaggcaggcg

SEQ ID NO: 5421599 - DNA, 13 bp, Homo sapiens
gccaggcaggcga

SEQ ID NO: 5421600 - DNA, 15 bp, Homo sapiens
gccaggcaggggtgg

SEQ ID NO: 5421601 - DNA, 22 bp, Homo sapiens
gccaggcaggggtgggagagcc

SEQ ID NO: 5421602 - DNA, 17 bp, Homo sapiens
gccaggcaggggtgggg

SEQ ID NO: 5421603 - DNA, 18 bp, Homo sapiens
gccaggcaggtgcctgga

SEQ ID NO: 5421604 - DNA, 19 bp, Homo sapiens
gccaggcattggctcagcc

SEQ ID NO: 5421605 - DNA, 16 bp, Homo sapiens
gccaggccaaagatcc

SEQ ID NO: 5421606 - DNA, 18 bp, Homo sapiens
gccaggccaactgccccg

SEQ ID NO: 5421607 - DNA, 24 bp, Homo sapiens
gccaggccaatgttgctgatggcc

SEQ ID NO: 5421608 - DNA, 13 bp, Homo sapiens
gccaggccacaag

SEQ ID NO: 5421609 - DNA, 18 bp, Homo sapiens
gccaggccacaagaccct

SEQ ID NO: 5421610 - DNA, 15 bp, Homo sapiens
gccaggccaccagga

SEQ ID NO: 5421611 - DNA, 16 bp, Homo sapiens
gccaggccaccaggat

SEQ ID NO: 5421612 - DNA, 19 bp, Homo sapiens
gccaggccaccaggatggc

SEQ ID NO: 5421613 - DNA, 14 bp, Homo sapiens
gccaggccagcctc

SEQ ID NO: 5421614 - DNA, 19 bp, Homo sapiens
gccaggccagcctccgaga

SEQ ID NO: 5421615 - DNA, 11 bp, Homo sapiens
gccaggccagg

SEQ ID NO: 5421616 - DNA, 16 bp, Homo sapiens
gccaggccaggaccac

SEQ ID NO: 5421617 - DNA, 17 bp, Homo sapiens
gccaggccaggaccaca

SEQ ID NO: 5421618 - DNA, 21 bp, Homo sapiens
gccaggccaggaccacacagt

SEQ ID NO: 5421619 - DNA, 11 bp, Homo sapiens
gccaggcccag

SEQ ID NO: 5421620 - DNA, 13 bp, Homo sapiens
gccaggcccaggc

SEQ ID NO: 5421621 - DNA, 15 bp, Homo sapiens
gccaggcccaggcag

SEQ ID NO: 5421622 - DNA, 17 bp, Homo sapiens
gccaggcccaggcagag

SEQ ID NO: 5421623 - DNA, 19 bp, Homo sapiens
gccaggcccaggccagccc

SEQ ID NO: 5421624 - DNA, 15 bp, Homo sapiens
gccaggcccaggcct

SEQ ID NO: 5421625 - DNA, 20 bp, Homo sapiens
gccaggcccaggcctcacca

SEQ ID NO: 5421626 - DNA, 19 bp, Homo sapiens
gccaggcccatctcaggtg

SEQ ID NO: 5421627 - DNA, 22 bp, Homo sapiens
gccaggcccatctcaggtgcca

SEQ ID NO: 5421628 - DNA, 23 bp, Homo sapiens
gccaggcccatctcaggtgccac

SEQ ID NO: 5421629 - DNA, 21 bp, Homo sapiens
gccaggccccaccccttccct

SEQ ID NO: 5421630 - DNA, 18 bp, Homo sapiens
gccaggcccccaagcctg

SEQ ID NO: 5421631 - DNA, 17 bp, Homo sapiens
gccaggcccccaccaca

SEQ ID NO: 5421632 - DNA, 23 bp, Homo sapiens
gccaggcccgcaccccggcctca

SEQ ID NO: 5421633 - DNA, 22 bp, Homo sapiens
gccaggcccggcatgaggcccc

SEQ ID NO: 5421634 - DNA, 18 bp, Homo sapiens
gccaggcccggggctggc

SEQ ID NO: 5421635 - DNA, 18 bp, Homo sapiens
gccaggccctcctgctgg

SEQ ID NO: 5421636 - DNA, 15 bp, Homo sapiens
gccaggccctctctg

SEQ ID NO: 5421637 - DNA, 17 bp, Homo sapiens
gccaggccctctctgca

SEQ ID NO: 5421638 - DNA, 18 bp, Homo sapiens
gccaggccctctctgcag

SEQ ID NO: 5421639 - DNA, 23 bp, Homo sapiens
gccaggccctctctgcagtcctc

SEQ ID NO: 5421640 - DNA, 17 bp, Homo sapiens
gccaggccctctgccca

SEQ ID NO: 5421641 - DNA, 20 bp, Homo sapiens
gccaggccctctgcccactc

SEQ ID NO: 5421642 - DNA, 15 bp, Homo sapiens
gccaggccctggagg

SEQ ID NO: 5421643 - DNA, 21 bp, Homo sapiens
gccaggccctggagggcagag

SEQ ID NO: 5421644 - DNA, 21 bp, Homo sapiens
gccaggcccttgtcggcccca

SEQ ID NO: 5421645 - DNA, 16 bp, Homo sapiens
gccaggccgcgcccag

SEQ ID NO: 5421646 - DNA, 18 bp, Homo sapiens
gccaggccgcgcccagca

SEQ ID NO: 5421647 - DNA, 13 bp, Homo sapiens
gccaggccgggcc

SEQ ID NO: 5421648 - DNA, 18 bp, Homo sapiens
gccaggccgggcctgtac

SEQ ID NO: 5421649 - DNA, 21 bp, Homo sapiens
gccaggcctagtaaccaaggc

SEQ ID NO: 5421650 - DNA, 18 bp, Homo sapiens
gccaggcctcagggacca

SEQ ID NO: 5421651 - DNA, 14 bp, Homo sapiens
gccaggcctcccgc

SEQ ID NO: 5421652 - DNA, 17 bp, Homo sapiens
gccaggcctccctcggg

SEQ ID NO: 5421653 - DNA, 20 bp, Homo sapiens
gccaggcctccctcgggctg

SEQ ID NO: 5421654 - DNA, 11 bp, Homo sapiens
gccaggcctct

SEQ ID NO: 5421655 - DNA, 13 bp, Homo sapiens
gccaggcctctgc

SEQ ID NO: 5421656 - DNA, 16 bp, Homo sapiens
gccaggcctctgctgg

SEQ ID NO: 5421657 - DNA, 20 bp, Homo sapiens
gccaggcctctgctggctca

SEQ ID NO: 5421658 - DNA, 16 bp, Homo sapiens
gccaggcctgccagcc

SEQ ID NO: 5421659 - DNA, 14 bp, Homo sapiens
gccaggcctgcggg

SEQ ID NO: 5421660 - DNA, 13 bp, Homo sapiens
gccaggcctggct

SEQ ID NO: 5421661 - DNA, 14 bp, Homo sapiens
gccaggcctgggtc

SEQ ID NO: 5421662 - DNA, 17 bp, Homo sapiens
gccaggccttatctgaa

SEQ ID NO: 5421663 - DNA, 14 bp, Homo sapiens
gccaggcgagcctg

SEQ ID NO: 5421664 - DNA, 15 bp, Homo sapiens
gccaggcgagcctga

SEQ ID NO: 5421665 - DNA, 19 bp, Homo sapiens
gccaggcgagcctgactct

SEQ ID NO: 5421666 - DNA, 22 bp, Homo sapiens
gccaggcgctagcacagctccc

SEQ ID NO: 5421667 - DNA, 12 bp, Homo sapiens
gccaggcgctgc

SEQ ID NO: 5421668 - DNA, 14 bp, Homo sapiens
gccaggcgctgcag

SEQ ID NO: 5421669 - DNA, 23 bp, Homo sapiens
gccaggcggacaaagttcagtgt

SEQ ID NO: 5421670 - DNA, 15 bp, Homo sapiens
gccaggcggccctgg

SEQ ID NO: 5421671 - DNA, 16 bp, Homo sapiens
gccaggcgggctcaag

SEQ ID NO: 5421672 - DNA, 21 bp, Homo sapiens
gccaggcggggcgccccaaga

SEQ ID NO: 5421673 - DNA, 18 bp, Homo sapiens
gccaggcgttggtgccac

SEQ ID NO: 5421674 - DNA, 21 bp, Homo sapiens
gccaggcgttggtgccacttc

SEQ ID NO: 5421675 - DNA, 16 bp, Homo sapiens
gccaggctagaatgga

SEQ ID NO: 5421676 - DNA, 19 bp, Homo sapiens
gccaggctagactaggagg

SEQ ID NO: 5421677 - DNA, 17 bp, Homo sapiens
gccaggctcactcacag

SEQ ID NO: 5421678 - DNA, 15 bp, Homo sapiens
gccaggctcaggaga

SEQ ID NO: 5421679 - DNA, 17 bp, Homo sapiens
gccaggctcaggccatg

SEQ ID NO: 5421680 - DNA, 12 bp, Homo sapiens
gccaggctccct

SEQ ID NO: 5421681 - DNA, 15 bp, Homo sapiens
gccaggctccctgac

SEQ ID NO: 5421682 - DNA, 20 bp, Homo sapiens
gccaggctccctttctcttc

SEQ ID NO: 5421683 - DNA, 16 bp, Homo sapiens
gccaggctcctacctg

SEQ ID NO: 5421684 - DNA, 20 bp, Homo sapiens
gccaggctccttcctgtctt

SEQ ID NO: 5421685 - DNA, 14 bp, Homo sapiens
gccaggctctccct

SEQ ID NO: 5421686 - DNA, 16 bp, Homo sapiens
gccaggctctccgggc

SEQ ID NO: 5421687 - DNA, 13 bp, Homo sapiens
gccaggctctgcc

SEQ ID NO: 5421688 - DNA, 16 bp, Homo sapiens
gccaggctctgcctgg

SEQ ID NO: 5421689 - DNA, 20 bp, Homo sapiens
gccaggctctgtgctgaccc

SEQ ID NO: 5421690 - DNA, 20 bp, Homo sapiens
gccaggttgcagctgctctt

SEQ ID NO: 5421691 - DNA, 17 bp, Homo sapiens
gccaggtttttggtctg

SEQ ID NO: 5421692 - DNA, 22 bp, Homo sapiens
gccagtaacgcgtcttcctgag

SEQ ID NO: 5421693 - DNA, 19 bp, Homo sapiens
gccagtaaggcagctctgt

SEQ ID NO: 5421694 - DNA, 21 bp, Homo sapiens
gccagtaagggaaatagaaaa

SEQ ID NO: 5421695 - DNA, 19 bp, Homo sapiens
gccagtaatcctgtaggaa

SEQ ID NO: 5421696 - DNA, 23 bp, Homo sapiens
gccagtacagagaaattctgtgg

SEQ ID NO: 5421697 - DNA, 20 bp, Homo sapiens
gccagtaccagtgagtggcc

SEQ ID NO: 5421698 - DNA, 14 bp, Homo sapiens
gccagtagctgcca

SEQ ID NO: 5421699 - DNA, 22 bp, Homo sapiens
gccagtaggagacacgacagca

SEQ ID NO: 5421700 - DNA, 15 bp, Homo sapiens
gccagtatataagct

SEQ ID NO: 5421701 - DNA, 18 bp, Homo sapiens
gccagtatataagctgtt

SEQ ID NO: 5421702 - DNA, 23 bp, Homo sapiens
gccagtatctatatatgtgtatg

SEQ ID NO: 5421703 - DNA, 15 bp, Homo sapiens
gccagtattttaaaa

SEQ ID NO: 5421704 - DNA, 18 bp, Homo sapiens
gccagtcaagaagaaaaa

SEQ ID NO: 5421705 - DNA, 17 bp, Homo sapiens
gccagtcaccccggcca

SEQ ID NO: 5421706 - DNA, 20 bp, Homo sapiens
gccagtcaccttctgggcaa

SEQ ID NO: 5421707 - DNA, 12 bp, Homo sapiens
gccagtcactgc

SEQ ID NO: 5421708 - DNA, 15 bp, Homo sapiens
gccagtcactgctgc

SEQ ID NO: 5421709 - DNA, 16 bp, Homo sapiens
gccagtcactgctgca

SEQ ID NO: 5421710 - DNA, 17 bp, Homo sapiens
gccagtcactgctgcaa

SEQ ID NO: 5421711 - DNA, 14 bp, Homo sapiens
gccagtcaggcagg

SEQ ID NO: 5421712 - DNA, 20 bp, Homo sapiens
gccagtcatcatctcttgat

SEQ ID NO: 5421713 - DNA, 19 bp, Homo sapiens
gccagtcccacggctctgt

SEQ ID NO: 5421714 - DNA, 21 bp, Homo sapiens
gccagtcccacggctctgtgc

SEQ ID NO: 5421715 - DNA, 16 bp, Homo sapiens
gccagtccccatttct

SEQ ID NO: 5421716 - DNA, 21 bp, Homo sapiens
gccagtccccatttctgcctc

SEQ ID NO: 5421717 - DNA, 22 bp, Homo sapiens
gccagtccccgaggagctgggc

SEQ ID NO: 5421718 - DNA, 18 bp, Homo sapiens
gccagtccccgctagtgg

SEQ ID NO: 5421719 - DNA, 14 bp, Homo sapiens
gccagtcctagagc

SEQ ID NO: 5421720 - DNA, 19 bp, Homo sapiens
gccagtcctagagctcctg

SEQ ID NO: 5421721 - DNA, 24 bp, Homo sapiens
gccagtcctagagctcctgtccct

SEQ ID NO: 5421722 - DNA, 19 bp, Homo sapiens
gccagtcctagctgcacag

SEQ ID NO: 5421723 - DNA, 15 bp, Homo sapiens
gccagtcctcctcag

SEQ ID NO: 5421724 - DNA, 13 bp, Homo sapiens
gccagtcctgcaa

SEQ ID NO: 5421725 - DNA, 17 bp, Homo sapiens
gccagtcctgcctggcc

SEQ ID NO: 5421726 - DNA, 19 bp, Homo sapiens
gccagtcctggttgtctga

SEQ ID NO: 5421727 - DNA, 16 bp, Homo sapiens
gccagtcgcgctgcct

SEQ ID NO: 5421728 - DNA, 17 bp, Homo sapiens
gccagtcgcgctgcctg

SEQ ID NO: 5421729 - DNA, 20 bp, Homo sapiens
gccagtcgcgctgcctgtgt

SEQ ID NO: 5421730 - DNA, 18 bp, Homo sapiens
gccagtcgggagagccag

SEQ ID NO: 5421731 - DNA, 20 bp, Homo sapiens
gccagtcgggagagccaggc

SEQ ID NO: 5421732 - DNA, 13 bp, Homo sapiens
gccagtctcagag

SEQ ID NO: 5421733 - DNA, 17 bp, Homo sapiens
gccagtctcattgtcac

SEQ ID NO: 5421734 - DNA, 13 bp, Homo sapiens
gccagtctcccag

SEQ ID NO: 5421735 - DNA, 22 bp, Homo sapiens
gccagtctcctatacccagcag

SEQ ID NO: 5421736 - DNA, 13 bp, Homo sapiens
gccagtctgcgtc

SEQ ID NO: 5421737 - DNA, 14 bp, Homo sapiens
gccagtctgcgtca

SEQ ID NO: 5421738 - DNA, 15 bp, Homo sapiens
gccagtctgggctgc

SEQ ID NO: 5421739 - DNA, 17 bp, Homo sapiens
gccagtcttgcctaggc

SEQ ID NO: 5421740 - DNA, 18 bp, Homo sapiens
gccagtcttgcctaggcc

SEQ ID NO: 5421741 - DNA, 21 bp, Homo sapiens
gccagtctttgaactgcagca

SEQ ID NO: 5421742 - DNA, 15 bp, Homo sapiens
gccagtgaaatagaa

SEQ ID NO: 5421743 - DNA, 17 bp, Homo sapiens
gccagtgaaatgtgaag

SEQ ID NO: 5421744 - DNA, 19 bp, Homo sapiens
gccagtgaacttggctttc

SEQ ID NO: 5421745 - DNA, 19 bp, Homo sapiens
gccagtgaagggttttgtg

SEQ ID NO: 5421746 - DNA, 18 bp, Homo sapiens
gccagtgaagtccttcag

SEQ ID NO: 5421747 - DNA, 14 bp, Homo sapiens
gccagtgaatctgt

SEQ ID NO: 5421748 - DNA, 17 bp, Homo sapiens
gccagtgaccaaccttt

SEQ ID NO: 5421749 - DNA, 23 bp, Homo sapiens
gccagtgacctttgacctcggtg

SEQ ID NO: 5421750 - DNA, 21 bp, Homo sapiens
gccagtgactccaggagagga

SEQ ID NO: 5421751 - DNA, 13 bp, Homo sapiens
gccagtgactttt

SEQ ID NO: 5421752 - DNA, 16 bp, Homo sapiens
gccagtgagaagctga

SEQ ID NO: 5421753 - DNA, 20 bp, Homo sapiens
gccagtgagggctgggccca

SEQ ID NO: 5421754 - DNA, 15 bp, Homo sapiens
gccagtgatgatgtt

SEQ ID NO: 5421755 - DNA, 18 bp, Homo sapiens
gccagtgatgatgttttg

SEQ ID NO: 5421756 - DNA, 16 bp, Homo sapiens
gccagtgcacagggaa

SEQ ID NO: 5421757 - DNA, 14 bp, Homo sapiens
gccagtgcagccac

SEQ ID NO: 5421758 - DNA, 18 bp, Homo sapiens
gccagtgcagccactggc

SEQ ID NO: 5421759 - DNA, 13 bp, Homo sapiens
gccagtgccagga

SEQ ID NO: 5421760 - DNA, 16 bp, Homo sapiens
gccagtgccaggacag

SEQ ID NO: 5421761 - DNA, 19 bp, Homo sapiens
gccagtgccaggacagctg

SEQ ID NO: 5421762 - DNA, 23 bp, Homo sapiens
gccagtgccagggtgggctgggg

SEQ ID NO: 5421763 - DNA, 23 bp, Homo sapiens
gccagtgccattccactccactc

SEQ ID NO: 5421764 - DNA, 13 bp, Homo sapiens
gccagtgccctga

SEQ ID NO: 5421765 - DNA, 15 bp, Homo sapiens
gccagtgccctgagc

SEQ ID NO: 5421766 - DNA, 16 bp, Homo sapiens
gccagtgccctgagcc

SEQ ID NO: 5421767 - DNA, 18 bp, Homo sapiens
gccagtgccctgatccca

SEQ ID NO: 5421768 - DNA, 15 bp, Homo sapiens
gccagtgccttacct

SEQ ID NO: 5421769 - DNA, 19 bp, Homo sapiens
gccagtgccttacctcctg

SEQ ID NO: 5421770 - DNA, 21 bp, Homo sapiens
gccagtgccttacctcctgcc

SEQ ID NO: 5421771 - DNA, 13 bp, Homo sapiens
gccagtgccttat

SEQ ID NO: 5421772 - DNA, 14 bp, Homo sapiens
gccagtgctgcttc

SEQ ID NO: 5421773 - DNA, 18 bp, Homo sapiens
gccagtgctgcttcttgc

SEQ ID NO: 5421774 - DNA, 15 bp, Homo sapiens
gccagtgctggtcac

SEQ ID NO: 5421775 - DNA, 17 bp, Homo sapiens
gccagtggaagaaacac

SEQ ID NO: 5421776 - DNA, 12 bp, Homo sapiens
gccagtggacag

SEQ ID NO: 5421777 - DNA, 17 bp, Homo sapiens
gccagtggacagaggga

SEQ ID NO: 5421778 - DNA, 18 bp, Homo sapiens
gccagtggacagagggag

SEQ ID NO: 5421779 - DNA, 22 bp, Homo sapiens
gccagtggacagagggagaagg

SEQ ID NO: 5421780 - DNA, 20 bp, Homo sapiens
gccagtggatcccctgcggt

SEQ ID NO: 5421781 - DNA, 17 bp, Homo sapiens
gccagtggcacaggaga

SEQ ID NO: 5421782 - DNA, 20 bp, Homo sapiens
gccagtggcactctgtgtgg

SEQ ID NO: 5421783 - DNA, 22 bp, Homo sapiens
gccagtggcccccgggcctgca

SEQ ID NO: 5421784 - DNA, 15 bp, Homo sapiens
gccagtgggaccctc

SEQ ID NO: 5421785 - DNA, 16 bp, Homo sapiens
gccagtgggcgggcca

SEQ ID NO: 5421786 - DNA, 21 bp, Homo sapiens
gccagtgggcgggccatgagg

SEQ ID NO: 5421787 - DNA, 21 bp, Homo sapiens
gccagtggggaactgagggca

SEQ ID NO: 5421788 - DNA, 15 bp, Homo sapiens
gccagtggggcctgt

SEQ ID NO: 5421789 - DNA, 16 bp, Homo sapiens
gccagtggggcctgtg

SEQ ID NO: 5421790 - DNA, 17 bp, Homo sapiens
gccagtggggcctgtgg

SEQ ID NO: 5421791 - DNA, 18 bp, Homo sapiens
gccagtgtaaggcatagg

SEQ ID NO: 5421792 - DNA, 22 bp, Homo sapiens
gccagtgtccttcgaggaaccc

SEQ ID NO: 5421793 - DNA, 13 bp, Homo sapiens
gccagtgtctgtc

SEQ ID NO: 5421794 - DNA, 15 bp, Homo sapiens
gccagtgtctgtccc

SEQ ID NO: 5421795 - DNA, 21 bp, Homo sapiens
gccagtgtctgtcccggggtc

SEQ ID NO: 5421796 - DNA, 13 bp, Homo sapiens
gccagtgtctttc

SEQ ID NO: 5421797 - DNA, 13 bp, Homo sapiens
gccagtgtgctga

SEQ ID NO: 5421798 - DNA, 22 bp, Homo sapiens
gccagtgtgttactcatcttta

SEQ ID NO: 5421799 - DNA, 21 bp, Homo sapiens
gccagtgttgtgggcttcctg

SEQ ID NO: 5421800 - DNA, 17 bp, Homo sapiens
gccagtgtttaaaactt

SEQ ID NO: 5421801 - DNA, 15 bp, Homo sapiens
gccagtgtttctgaa

SEQ ID NO: 5421802 - DNA, 20 bp, Homo sapiens
gccagttcagtacctggagg

SEQ ID NO: 5421803 - DNA, 12 bp, Homo sapiens
gccagttcctgt

SEQ ID NO: 5421804 - DNA, 19 bp, Homo sapiens
gccagttctccttccctgc

SEQ ID NO: 5421805 - DNA, 13 bp, Homo sapiens
gccagttctgggg

SEQ ID NO: 5421806 - DNA, 15 bp, Homo sapiens
gccagttctggggcc

SEQ ID NO: 5421807 - DNA, 23 bp, Homo sapiens
gccagttctggggcccgcctgcc

SEQ ID NO: 5421808 - DNA, 21 bp, Homo sapiens
gccagttctttccataataaa

SEQ ID NO: 5421809 - DNA, 18 bp, Homo sapiens
gccagttgaatttatgga

SEQ ID NO: 5421810 - DNA, 17 bp, Homo sapiens
gccagttgatctgctct

SEQ ID NO: 5421811 - DNA, 19 bp, Homo sapiens
gccagttgatctgctctgt

SEQ ID NO: 5421812 - DNA, 21 bp, Homo sapiens
gccagttgggctcgcactgcc

SEQ ID NO: 5421813 - DNA, 13 bp, Homo sapiens
gccagttggtccc

SEQ ID NO: 5421814 - DNA, 21 bp, Homo sapiens
gccagtttgaagcctgtgcct

SEQ ID NO: 5421815 - DNA, 15 bp, Homo sapiens
gccagttttccctgg

SEQ ID NO: 5421816 - DNA, 21 bp, Homo sapiens
gccagttttctgttcagcttt

SEQ ID NO: 5421817 - DNA, 20 bp, Homo sapiens
gccagttttgtttcctttca

SEQ ID NO: 5421818 - DNA, 22 bp, Homo sapiens
gccataaaaaggaacaagactg

SEQ ID NO: 5421819 - DNA, 20 bp, Homo sapiens
gccataaaacattaagaaaa

SEQ ID NO: 5421820 - DNA, 20 bp, Homo sapiens
gccataaaagcattgtctct

SEQ ID NO: 5421821 - DNA, 16 bp, Homo sapiens
gccataaacggttcct

SEQ ID NO: 5421822 - DNA, 18 bp, Homo sapiens
gccataaacggttcctgg

SEQ ID NO: 5421823 - DNA, 23 bp, Homo sapiens
gccataaacggttcctggtgact

SEQ ID NO: 5421824 - DNA, 16 bp, Homo sapiens
gccataacgtgccccc

SEQ ID NO: 5421825 - DNA, 17 bp, Homo sapiens
gccataacttgtttgta

SEQ ID NO: 5421826 - DNA, 21 bp, Homo sapiens
gccataagctacacagaggcc

SEQ ID NO: 5421827 - DNA, 11 bp, Homo sapiens
gccataataaa

SEQ ID NO: 5421828 - DNA, 21 bp, Homo sapiens
gccataatacaaaaggctcca

SEQ ID NO: 5421829 - DNA, 10 bp, Homo sapiens
gccataatat

SEQ ID NO: 5421830 - DNA, 17 bp, Homo sapiens
gccataatgttgcttct

SEQ ID NO: 5421831 - DNA, 13 bp, Homo sapiens
gccataattatga

SEQ ID NO: 5421832 - DNA, 15 bp, Homo sapiens
gccataattatgaaa

SEQ ID NO: 5421833 - DNA, 14 bp, Homo sapiens
gccataattttgca

SEQ ID NO: 5421834 - DNA, 16 bp, Homo sapiens
gccataattttgcata

SEQ ID NO: 5421835 - DNA, 15 bp, Homo sapiens
gccataccttctccc

SEQ ID NO: 5421836 - DNA, 16 bp, Homo sapiens
gccataccttctccca

SEQ ID NO: 5421837 - DNA, 22 bp, Homo sapiens
gccataccttctcccaggcctc

SEQ ID NO: 5421838 - DNA, 15 bp, Homo sapiens
gccatactgcgtcca

SEQ ID NO: 5421839 - DNA, 21 bp, Homo sapiens
gccatactgcgtccaccctga

SEQ ID NO: 5421840 - DNA, 15 bp, Homo sapiens
gccatactggcctcg

SEQ ID NO: 5421841 - DNA, 21 bp, Homo sapiens
gccatactggcctcgcctggc

SEQ ID NO: 5421842 - DNA, 22 bp, Homo sapiens
gccatactggcctcgcctggcc

SEQ ID NO: 5421843 - DNA, 23 bp, Homo sapiens
gccatactggcctcgcctggcct

SEQ ID NO: 5421844 - DNA, 18 bp, Homo sapiens
gccatacttatctctctg

SEQ ID NO: 5421845 - DNA, 16 bp, Homo sapiens
gccatacttgttctgt

SEQ ID NO: 5421846 - DNA, 17 bp, Homo sapiens
gccatagaccctgaggc

SEQ ID NO: 5421847 - DNA, 19 bp, Homo sapiens
gccatagaccctgaggccc

SEQ ID NO: 5421848 - DNA, 13 bp, Homo sapiens
gccatagagcctg

SEQ ID NO: 5421849 - DNA, 17 bp, Homo sapiens
gccatagagcctgaaat

SEQ ID NO: 5421850 - DNA, 23 bp, Homo sapiens
gccatagagcctgaaatcatctt

SEQ ID NO: 5421851 - DNA, 14 bp, Homo sapiens
gccatagaggccca

SEQ ID NO: 5421852 - DNA, 20 bp, Homo sapiens
gccatagaggcccaggcacc

SEQ ID NO: 5421853 - DNA, 17 bp, Homo sapiens
gccatagagtacactgc

SEQ ID NO: 5421854 - DNA, 16 bp, Homo sapiens
gccatagagtttaaca

SEQ ID NO: 5421855 - DNA, 14 bp, Homo sapiens
gccatagccaggag

SEQ ID NO: 5421856 - DNA, 15 bp, Homo sapiens
gccatagccccaggc

SEQ ID NO: 5421857 - DNA, 19 bp, Homo sapiens
gccatagccccagtaggac

SEQ ID NO: 5421858 - DNA, 21 bp, Homo sapiens
gccatagcctccacggagagc

SEQ ID NO: 5421859 - DNA, 18 bp, Homo sapiens
gccatagctcctgctcca

SEQ ID NO: 5421860 - DNA, 15 bp, Homo sapiens
gccataggccctttc

SEQ ID NO: 5421861 - DNA, 16 bp, Homo sapiens
gccataggccctttca

SEQ ID NO: 5421862 - DNA, 14 bp, Homo sapiens
gccatagggggctg

SEQ ID NO: 5421863 - DNA, 23 bp, Homo sapiens
gccatagggtctgcagcctgctg

SEQ ID NO: 5421864 - DNA, 24 bp, Homo sapiens
gccatagggtctgcagcctgctgg

SEQ ID NO: 5421865 - DNA, 23 bp, Homo sapiens
gccataggtctaaataggatcct

SEQ ID NO: 5421866 - DNA, 19 bp, Homo sapiens
gccatatatgaccagaagc

SEQ ID NO: 5421867 - DNA, 15 bp, Homo sapiens
gccattgcactccag

SEQ ID NO: 5421868 - DNA, 20 bp, Homo sapiens
gccattgcggccccaggagg

SEQ ID NO: 5421869 - DNA, 13 bp, Homo sapiens
gccattggcctct

SEQ ID NO: 5421870 - DNA, 16 bp, Homo sapiens
gccattggcctctgtc

SEQ ID NO: 5421871 - DNA, 21 bp, Homo sapiens
gccattggccttaactggccc

SEQ ID NO: 5421872 - DNA, 22 bp, Homo sapiens
gccattggccttaactggccct

SEQ ID NO: 5421873 - DNA, 20 bp, Homo sapiens
gccattggctatttaaaact

SEQ ID NO: 5421874 - DNA, 22 bp, Homo sapiens
gccattgggaccctccagtgct

SEQ ID NO: 5421875 - DNA, 21 bp, Homo sapiens
gccattgtatttcttcatccc

SEQ ID NO: 5421876 - DNA, 17 bp, Homo sapiens
gccattgtctttcctcc

SEQ ID NO: 5421877 - DNA, 18 bp, Homo sapiens
gccattgtgtatgatttt

SEQ ID NO: 5421878 - DNA, 18 bp, Homo sapiens
gccatttaaaaagttgta

SEQ ID NO: 5421879 - DNA, 22 bp, Homo sapiens
gccatttaaagcttattaaaac

SEQ ID NO: 5421880 - DNA, 17 bp, Homo sapiens
gccatttaactggagct

SEQ ID NO: 5421881 - DNA, 19 bp, Homo sapiens
gccatttagaatctagaaa

SEQ ID NO: 5421882 - DNA, 21 bp, Homo sapiens
gccatttagaatctagaaatg

SEQ ID NO: 5421883 - DNA, 22 bp, Homo sapiens
gccatttatacctttgaaatat

SEQ ID NO: 5421884 - DNA, 13 bp, Homo sapiens
gccatttatttat

SEQ ID NO: 5421885 - DNA, 18 bp, Homo sapiens
gccatttccatggctctg

SEQ ID NO: 5421886 - DNA, 19 bp, Homo sapiens
gccatttccatggctctgt

SEQ ID NO: 5421887 - DNA, 14 bp, Homo sapiens
gccatttccccctc

SEQ ID NO: 5421888 - DNA, 20 bp, Homo sapiens
gccatttcctcacgtgcagg

SEQ ID NO: 5421889 - DNA, 14 bp, Homo sapiens
gccatttcctgtct

SEQ ID NO: 5421890 - DNA, 15 bp, Homo sapiens
gccatttctcaggga

SEQ ID NO: 5421891 - DNA, 13 bp, Homo sapiens
gccatttctctgc

SEQ ID NO: 5421892 - DNA, 16 bp, Homo sapiens
gccatttctgaactgt

SEQ ID NO: 5421893 - DNA, 13 bp, Homo sapiens
gccatttgatacc

SEQ ID NO: 5421894 - DNA, 22 bp, Homo sapiens
gccatttgctagttctgctgcc

SEQ ID NO: 5421895 - DNA, 13 bp, Homo sapiens
gccatttgctgcc

SEQ ID NO: 5421896 - DNA, 14 bp, Homo sapiens
gccatttgctgccc

SEQ ID NO: 5421897 - DNA, 16 bp, Homo sapiens
gccatttggaagcttt

SEQ ID NO: 5421898 - DNA, 16 bp, Homo sapiens
gccatttgtaatgaat

SEQ ID NO: 5421899 - DNA, 20 bp, Homo sapiens
gccatttgtaatgaatttgt

SEQ ID NO: 5421900 - DNA, 13 bp, Homo sapiens
gccatttgtccca

SEQ ID NO: 5421901 - DNA, 21 bp, Homo sapiens
gccatttgtcttttgtaaagt

SEQ ID NO: 5421902 - DNA, 17 bp, Homo sapiens
gccatttgttacagttt

SEQ ID NO: 5421903 - DNA, 14 bp, Homo sapiens
gccattttaaaatg

SEQ ID NO: 5421904 - DNA, 22 bp, Homo sapiens
gccattttaaattttattttta

SEQ ID NO: 5421905 - DNA, 21 bp, Homo sapiens
gccattttattaaacattttc

SEQ ID NO: 5421906 - DNA, 20 bp, Homo sapiens
gccattttcttgcctgaggc

SEQ ID NO: 5421907 - DNA, 20 bp, Homo sapiens
gccattttgcattttcatct

SEQ ID NO: 5421908 - DNA, 20 bp, Homo sapiens
gccattttgtaactgcctac

SEQ ID NO: 5421909 - DNA, 19 bp, Homo sapiens
gccattttgtgaatggatt

SEQ ID NO: 5421910 - DNA, 13 bp, Homo sapiens
gccatttttacat

SEQ ID NO: 5421911 - DNA, 14 bp, Homo sapiens
gccatttttactgt

SEQ ID NO: 5421912 - DNA, 22 bp, Homo sapiens
gccatttttagtttaaaatctt

SEQ ID NO: 5421913 - DNA, 19 bp, Homo sapiens
gccatttttcagtagcagg

SEQ ID NO: 5421914 - DNA, 23 bp, Homo sapiens
gccatttttcagtagcaggacct

SEQ ID NO: 5421915 - DNA, 17 bp, Homo sapiens
gccatttttctataaat

SEQ ID NO: 5421916 - DNA, 13 bp, Homo sapiens
gccatttttctgg

SEQ ID NO: 5421917 - DNA, 13 bp, Homo sapiens
gcccaaaacagtt

SEQ ID NO: 5421918 - DNA, 18 bp, Homo sapiens
gcccaaaacccagggcaa

SEQ ID NO: 5421919 - DNA, 15 bp, Homo sapiens
gcccaaaagccatgt

SEQ ID NO: 5421920 - DNA, 15 bp, Homo sapiens
gcccaaaatgtgaag

SEQ ID NO: 5421921 - DNA, 14 bp, Homo sapiens
gcccaaaatttgat

SEQ ID NO: 5421922 - DNA, 22 bp, Homo sapiens
gcccaaacaccctcctggcaca

SEQ ID NO: 5421923 - DNA, 19 bp, Homo sapiens
gcccaaacagctgtattta

SEQ ID NO: 5421924 - DNA, 22 bp, Homo sapiens
gcccaaaccaccagaagcccag

SEQ ID NO: 5421925 - DNA, 17 bp, Homo sapiens
gcccaaaccagggggaa

SEQ ID NO: 5421926 - DNA, 11 bp, Homo sapiens
gcccaaactcc

SEQ ID NO: 5421927 - DNA, 15 bp, Homo sapiens
gcccaaactcccctt

SEQ ID NO: 5421928 - DNA, 16 bp, Homo sapiens
gcccaaactccccttc

SEQ ID NO: 5421929 - DNA, 23 bp, Homo sapiens
gcccaaactccccttccctgggg

SEQ ID NO: 5421930 - DNA, 21 bp, Homo sapiens
gcccaaagagaaatcacaggg

SEQ ID NO: 5421931 - DNA, 16 bp, Homo sapiens
gcccaaagccagacag

SEQ ID NO: 5421932 - DNA, 12 bp, Homo sapiens
gcccaaagctgg

SEQ ID NO: 5421933 - DNA, 16 bp, Homo sapiens
gcccaaaggacgcact

SEQ ID NO: 5421934 - DNA, 15 bp, Homo sapiens
gcccaaaggcccagg

SEQ ID NO: 5421935 - DNA, 18 bp, Homo sapiens
gcccaaaggcccagggag

SEQ ID NO: 5421936 - DNA, 21 bp, Homo sapiens
gcccaaaggggacaggcctca

SEQ ID NO: 5421937 - DNA, 14 bp, Homo sapiens
gcccaaataacagt

SEQ ID NO: 5421938 - DNA, 14 bp, Homo sapiens
gcccaaatggctct

SEQ ID NO: 5421939 - DNA, 15 bp, Homo sapiens
gcccaaatggctctg

SEQ ID NO: 5421940 - DNA, 16 bp, Homo sapiens
gcccaaatggctctgt

SEQ ID NO: 5421941 - DNA, 23 bp, Homo sapiens
gcccaaatggctctgtgaaatca

SEQ ID NO: 5421942 - DNA, 19 bp, Homo sapiens
gcccaaatgtcagggttct

SEQ ID NO: 5421943 - DNA, 20 bp, Homo sapiens
gcccaaattatcaagctaat

SEQ ID NO: 5421944 - DNA, 21 bp, Homo sapiens
gcccaaattatcaagctaata

SEQ ID NO: 5421945 - DNA, 17 bp, Homo sapiens
gcccaaattcatataaa

SEQ ID NO: 5421946 - DNA, 14 bp, Homo sapiens
gcccaacaccagcc

SEQ ID NO: 5421947 - DNA, 17 bp, Homo sapiens
gcccaacaccagcccct

SEQ ID NO: 5421948 - DNA, 14 bp, Homo sapiens
gcccaacagcactt

SEQ ID NO: 5421949 - DNA, 13 bp, Homo sapiens
gcccaaccacact

SEQ ID NO: 5421950 - DNA, 13 bp, Homo sapiens
gcccaaccaggag

SEQ ID NO: 5421951 - DNA, 21 bp, Homo sapiens
gcccaaccaggaggggtctgc

SEQ ID NO: 5421952 - DNA, 15 bp, Homo sapiens
gcccaaccaggccct

SEQ ID NO: 5421953 - DNA, 19 bp, Homo sapiens
gcccaaccaggttgcagta

SEQ ID NO: 5421954 - DNA, 16 bp, Homo sapiens
gcccaacccaaccact

SEQ ID NO: 5421955 - DNA, 15 bp, Homo sapiens
gcccaacccccacct

SEQ ID NO: 5421956 - DNA, 17 bp, Homo sapiens
gcccaacccccacctcc

SEQ ID NO: 5421957 - DNA, 13 bp, Homo sapiens
gcccaaccctgtc

SEQ ID NO: 5421958 - DNA, 15 bp, Homo sapiens
gcccaacccttctaa

SEQ ID NO: 5421959 - DNA, 10 bp, Homo sapiens
gcccaacctc

SEQ ID NO: 5421960 - DNA, 13 bp, Homo sapiens
gcccaacctcctg

SEQ ID NO: 5421961 - DNA, 14 bp, Homo sapiens
gcccaacctcctga

SEQ ID NO: 5421962 - DNA, 17 bp, Homo sapiens
gcccaactcccagccac

SEQ ID NO: 5421963 - DNA, 18 bp, Homo sapiens
gcccaacttccagaggac

SEQ ID NO: 5421964 - DNA, 19 bp, Homo sapiens
gcccaagagcccgtgccac

SEQ ID NO: 5421965 - DNA, 15 bp, Homo sapiens
gcccaagagccctgt

SEQ ID NO: 5421966 - DNA, 19 bp, Homo sapiens
gcccaagagccctgtggcc

SEQ ID NO: 5421967 - DNA, 21 bp, Homo sapiens
gcccaagagccctgtggccgc

SEQ ID NO: 5421968 - DNA, 19 bp, Homo sapiens
gcccaagaggtctgagccc

SEQ ID NO: 5421969 - DNA, 13 bp, Homo sapiens
gcccaagagtggg

SEQ ID NO: 5421970 - DNA, 15 bp, Homo sapiens
gcccaagattcttca

SEQ ID NO: 5421971 - DNA, 20 bp, Homo sapiens
gcccaagcagacagccctgg

SEQ ID NO: 5421972 - DNA, 15 bp, Homo sapiens
gcccaagcatgcccc

SEQ ID NO: 5421973 - DNA, 19 bp, Homo sapiens
gcccaagcatgccccaccc

SEQ ID NO: 5421974 - DNA, 20 bp, Homo sapiens
gcccaagcatgccccaccca

SEQ ID NO: 5421975 - DNA, 23 bp, Homo sapiens
gcccaagccagaggctgggttca

SEQ ID NO: 5421976 - DNA, 14 bp, Homo sapiens
gcccaagcccaggc

SEQ ID NO: 5421977 - DNA, 17 bp, Homo sapiens
gcccaagcccaggccac

SEQ ID NO: 5421978 - DNA, 13 bp, Homo sapiens
gcccaagccccat

SEQ ID NO: 5421979 - DNA, 17 bp, Homo sapiens
gcccaagctaagccatc

SEQ ID NO: 5421980 - DNA, 15 bp, Homo sapiens
gcccaagctggagtg

SEQ ID NO: 5421981 - DNA, 13 bp, Homo sapiens
gcccaagctgggc

SEQ ID NO: 5421982 - DNA, 20 bp, Homo sapiens
gcccaagcttaatagccctc

SEQ ID NO: 5421983 - DNA, 23 bp, Homo sapiens
gcccaagcttaatagccctcccc

SEQ ID NO: 5421984 - DNA, 14 bp, Homo sapiens
gcccaagcttccct

SEQ ID NO: 5421985 - DNA, 18 bp, Homo sapiens
gcccaagcttccctccat

SEQ ID NO: 5421986 - DNA, 22 bp, Homo sapiens
gcccaaggacagttcagagatc

SEQ ID NO: 5421987 - DNA, 24 bp, Homo sapiens
gcccaaggacagttcagagatcag

SEQ ID NO: 5421988 - DNA, 19 bp, Homo sapiens
gcccaaggcccccacctct

SEQ ID NO: 5421989 - DNA, 16 bp, Homo sapiens
gcccaaggcggcccct

SEQ ID NO: 5421990 - DNA, 10 bp, Homo sapiens
gcccaaggct

SEQ ID NO: 5421991 - DNA, 13 bp, Homo sapiens
gcccaaggctgca

SEQ ID NO: 5421992 - DNA, 23 bp, Homo sapiens
gcccaagggaaagaaaaggaagg

SEQ ID NO: 5421993 - DNA, 19 bp, Homo sapiens
gcccaagggatctggtcct

SEQ ID NO: 5421994 - DNA, 15 bp, Homo sapiens
gcccaagggatggca

SEQ ID NO: 5421995 - DNA, 22 bp, Homo sapiens
gcccaagggcctcccaccagag

SEQ ID NO: 5421996 - DNA, 15 bp, Homo sapiens
gcccaaggtcccctc

SEQ ID NO: 5421997 - DNA, 17 bp, Homo sapiens
gcccaaggtgctgatgt

SEQ ID NO: 5421998 - DNA, 20 bp, Homo sapiens
gcccaaggttaaaaagttca

SEQ ID NO: 5421999 - DNA, 17 bp, Homo sapiens
gcccaagtcacacagct

SEQ ID NO: 5422000 - DNA, 18 bp, Homo sapiens
gcccaagtcacacagcta

SEQ ID NO: 5422001 - DNA, 15 bp, Homo sapiens
gcccaagtccaaatg

SEQ ID NO: 5422002 - DNA, 13 bp, Homo sapiens
gcccaagtccctg

SEQ ID NO: 5422003 - DNA, 15 bp, Homo sapiens
gcccaagtccctgtt

SEQ ID NO: 5422004 - DNA, 16 bp, Homo sapiens
gcccaagtctcctagg

SEQ ID NO: 5422005 - DNA, 14 bp, Homo sapiens
gcccaagtgaccag

SEQ ID NO: 5422006 - DNA, 15 bp, Homo sapiens
gcccaagtgaccagg

SEQ ID NO: 5422007 - DNA, 20 bp, Homo sapiens
gcccaagtgaccagggaagt

SEQ ID NO: 5422008 - DNA, 12 bp, Homo sapiens
gcccaagtgcca

SEQ ID NO: 5422009 - DNA, 16 bp, Homo sapiens
gcccaagtgccatccc

SEQ ID NO: 5422010 - DNA, 19 bp, Homo sapiens
gcccaagtgccatcccaca

SEQ ID NO: 5422011 - DNA, 22 bp, Homo sapiens
gcccaagtgccatcccacattc

SEQ ID NO: 5422012 - DNA, 18 bp, Homo sapiens
gcccaagtggctcttggg

SEQ ID NO: 5422013 - DNA, 19 bp, Homo sapiens
gcccaagtggctcttggga

SEQ ID NO: 5422014 - DNA, 19 bp, Homo sapiens
gcccaagtgggcagtcacc

SEQ ID NO: 5422015 - DNA, 20 bp, Homo sapiens
gcccaagtggggtgctctgg

SEQ ID NO: 5422016 - DNA, 19 bp, Homo sapiens
gcccaagttcatgcagctg

SEQ ID NO: 5422017 - DNA, 15 bp, Homo sapiens
gcccaagttgctctg

SEQ ID NO: 5422018 - DNA, 17 bp, Homo sapiens
gcccaagttgctctgta

SEQ ID NO: 5422019 - DNA, 21 bp, Homo sapiens
gcccaagttgtggtgctgaca

SEQ ID NO: 5422020 - DNA, 11 bp, Homo sapiens
gcccaataaag

SEQ ID NO: 5422021 - DNA, 12 bp, Homo sapiens
gcccaatatatt

SEQ ID NO: 5422022 - DNA, 18 bp, Homo sapiens
gcccaatattataatttt

SEQ ID NO: 5422023 - DNA, 14 bp, Homo sapiens
gcccaatcactgcc

SEQ ID NO: 5422024 - DNA, 22 bp, Homo sapiens
gcccaatccaggtacgcacaga

SEQ ID NO: 5422025 - DNA, 13 bp, Homo sapiens
gcccaatcctccc

SEQ ID NO: 5422026 - DNA, 17 bp, Homo sapiens
gcccaatcctccctgga

SEQ ID NO: 5422027 - DNA, 18 bp, Homo sapiens
gcccaatcctccctggag

SEQ ID NO: 5422028 - DNA, 23 bp, Homo sapiens
gcccaatctcgtcaggctgccag

SEQ ID NO: 5422029 - DNA, 14 bp, Homo sapiens
gcccaatctgagca

SEQ ID NO: 5422030 - DNA, 14 bp, Homo sapiens
gcccaatgaaatga

SEQ ID NO: 5422031 - DNA, 14 bp, Homo sapiens
gcccaatgaataat

SEQ ID NO: 5422032 - DNA, 14 bp, Homo sapiens
gcccaatgaattat

SEQ ID NO: 5422033 - DNA, 19 bp, Homo sapiens
gcccaatgcatagagccct

SEQ ID NO: 5422034 - DNA, 20 bp, Homo sapiens
gcccaatgcatagagccctg

SEQ ID NO: 5422035 - DNA, 22 bp, Homo sapiens
gcccaattcttacaaacatgtg

SEQ ID NO: 5422036 - DNA, 17 bp, Homo sapiens
gcccaatttcacagagt

SEQ ID NO: 5422037 - DNA, 22 bp, Homo sapiens
gcccaatttcacagagtacaaa

SEQ ID NO: 5422038 - DNA, 21 bp, Homo sapiens
gcccacaaactgatttctcac

SEQ ID NO: 5422039 - DNA, 16 bp, Homo sapiens
gcccacaaaggggaga

SEQ ID NO: 5422040 - DNA, 17 bp, Homo sapiens
gcccacaaaggggagaa

SEQ ID NO: 5422041 - DNA, 15 bp, Homo sapiens
gcccacaacgtcccc

SEQ ID NO: 5422042 - DNA, 16 bp, Homo sapiens
gcccacaatcctcctg

SEQ ID NO: 5422043 - DNA, 21 bp, Homo sapiens
gcccacacacactccttcccc

SEQ ID NO: 5422044 - DNA, 12 bp, Homo sapiens
gcccacacacag

SEQ ID NO: 5422045 - DNA, 16 bp, Homo sapiens
gcccacacactttcca

SEQ ID NO: 5422046 - DNA, 16 bp, Homo sapiens
gcccagcccagagcca

SEQ ID NO: 5422047 - DNA, 13 bp, Homo sapiens
gcccagcccagct

SEQ ID NO: 5422048 - DNA, 15 bp, Homo sapiens
gcccagcccagctca

SEQ ID NO: 5422049 - DNA, 14 bp, Homo sapiens
gcccagcccagctg

SEQ ID NO: 5422050 - DNA, 18 bp, Homo sapiens
gcccagcccaggcctggt

SEQ ID NO: 5422051 - DNA, 16 bp, Homo sapiens
gcccagcccatggaga

SEQ ID NO: 5422052 - DNA, 22 bp, Homo sapiens
gcccagcccatttgggctctgg

SEQ ID NO: 5422053 - DNA, 18 bp, Homo sapiens
gcccagccccactcctct

SEQ ID NO: 5422054 - DNA, 15 bp, Homo sapiens
gcccagccccatccc

SEQ ID NO: 5422055 - DNA, 15 bp, Homo sapiens
gcccagcccccacag

SEQ ID NO: 5422056 - DNA, 23 bp, Homo sapiens
gcccagcccccacagtgctgtct

SEQ ID NO: 5422057 - DNA, 16 bp, Homo sapiens
gcccagcccccacccc

SEQ ID NO: 5422058 - DNA, 17 bp, Homo sapiens
gcccagcccctactgct

SEQ ID NO: 5422059 - DNA, 16 bp, Homo sapiens
gcccagcccctgcccc

SEQ ID NO: 5422060 - DNA, 18 bp, Homo sapiens
gcccagcccctgccccta

SEQ ID NO: 5422061 - DNA, 18 bp, Homo sapiens
gcccagcccctggtggtg

SEQ ID NO: 5422062 - DNA, 19 bp, Homo sapiens
gcccagcccctgtttactg

SEQ ID NO: 5422063 - DNA, 16 bp, Homo sapiens
gcccagccccttctga

SEQ ID NO: 5422064 - DNA, 18 bp, Homo sapiens
gcccagcccggaccttgg

SEQ ID NO: 5422065 - DNA, 16 bp, Homo sapiens
gcccagcccggctgac

SEQ ID NO: 5422066 - DNA, 10 bp, Homo sapiens
gcccagccct

SEQ ID NO: 5422067 - DNA, 16 bp, Homo sapiens
gcccagccctaaacat

SEQ ID NO: 5422068 - DNA, 16 bp, Homo sapiens
gcccagccctcccagc

SEQ ID NO: 5422069 - DNA, 21 bp, Homo sapiens
gcccagccctgctggccgcct

SEQ ID NO: 5422070 - DNA, 15 bp, Homo sapiens
gcccagccctggccc

SEQ ID NO: 5422071 - DNA, 13 bp, Homo sapiens
gcccagccctggg

SEQ ID NO: 5422072 - DNA, 13 bp, Homo sapiens
gcccagccgaccc

SEQ ID NO: 5422073 - DNA, 19 bp, Homo sapiens
gcccagccgaccccctctc

SEQ ID NO: 5422074 - DNA, 13 bp, Homo sapiens
gcccagccggcct

SEQ ID NO: 5422075 - DNA, 15 bp, Homo sapiens
gcccagccggcctct

SEQ ID NO: 5422076 - DNA, 19 bp, Homo sapiens
gcccagccggcctctctgg

SEQ ID NO: 5422077 - DNA, 24 bp, Homo sapiens
gcccagccggcctctctggcctcc

SEQ ID NO: 5422078 - DNA, 13 bp, Homo sapiens
gcccagccgggca

SEQ ID NO: 5422079 - DNA, 23 bp, Homo sapiens
gcccagccgggcacagtggcgca

SEQ ID NO: 5422080 - DNA, 15 bp, Homo sapiens
gcccagccggggtgg

SEQ ID NO: 5422081 - DNA, 14 bp, Homo sapiens
gcccagcctaccct

SEQ ID NO: 5422082 - DNA, 14 bp, Homo sapiens
gcccagcctaggcc

SEQ ID NO: 5422083 - DNA, 17 bp, Homo sapiens
gcccagcctagtcaggg

SEQ ID NO: 5422084 - DNA, 21 bp, Homo sapiens
gcccagcctatctctcttctg

SEQ ID NO: 5422085 - DNA, 17 bp, Homo sapiens
gcccagcctcctcccac

SEQ ID NO: 5422086 - DNA, 12 bp, Homo sapiens
gcccagcctctc

SEQ ID NO: 5422087 - DNA, 16 bp, Homo sapiens
gcccagcctctctggc

SEQ ID NO: 5422088 - DNA, 20 bp, Homo sapiens
gcccagcctctctggctcag

SEQ ID NO: 5422089 - DNA, 13 bp, Homo sapiens
gcccagcctctgc

SEQ ID NO: 5422090 - DNA, 14 bp, Homo sapiens
gcccagcctctgtc

SEQ ID NO: 5422091 - DNA, 16 bp, Homo sapiens
gcccagcctctgtccc

SEQ ID NO: 5422092 - DNA, 18 bp, Homo sapiens
gcccagcctgagccccaa

SEQ ID NO: 5422093 - DNA, 11 bp, Homo sapiens
gcccagcctgc

SEQ ID NO: 5422094 - DNA, 13 bp, Homo sapiens
gcccagcctgccc

SEQ ID NO: 5422095 - DNA, 14 bp, Homo sapiens
gcccagcctgctca

SEQ ID NO: 5422096 - DNA, 17 bp, Homo sapiens
gcccagcctgctcagca

SEQ ID NO: 5422097 - DNA, 19 bp, Homo sapiens
gcccagcctgctcagcagg

SEQ ID NO: 5422098 - DNA, 15 bp, Homo sapiens
gcccagcctgctctc

SEQ ID NO: 5422099 - DNA, 15 bp, Homo sapiens
gcccagcctggagcc

SEQ ID NO: 5422100 - DNA, 16 bp, Homo sapiens
gcccagcctggagccg

SEQ ID NO: 5422101 - DNA, 14 bp, Homo sapiens
gcccagcctggccc

SEQ ID NO: 5422102 - DNA, 17 bp, Homo sapiens
gcccagcctggccccaa

SEQ ID NO: 5422103 - DNA, 15 bp, Homo sapiens
gcccagcctgtcctg

SEQ ID NO: 5422104 - DNA, 19 bp, Homo sapiens
gcccagcctgtggcctcag

SEQ ID NO: 5422105 - DNA, 17 bp, Homo sapiens
gcccagcctttgttccc

SEQ ID NO: 5422106 - DNA, 14 bp, Homo sapiens
gcccagcgacacag

SEQ ID NO: 5422107 - DNA, 14 bp, Homo sapiens
gcccagcgccaagt

SEQ ID NO: 5422108 - DNA, 16 bp, Homo sapiens
gcccagcgccatcctg

SEQ ID NO: 5422109 - DNA, 19 bp, Homo sapiens
gcccagcgcggacatcccc

SEQ ID NO: 5422110 - DNA, 22 bp, Homo sapiens
gcccagcgctcgccacgctcag

SEQ ID NO: 5422111 - DNA, 16 bp, Homo sapiens
gcccagcgctctcctg

SEQ ID NO: 5422112 - DNA, 20 bp, Homo sapiens
gcccagcgctctcctggacg

SEQ ID NO: 5422113 - DNA, 15 bp, Homo sapiens
gcccagcgctctgcc

SEQ ID NO: 5422114 - DNA, 18 bp, Homo sapiens
gcccagcggcccctccca

SEQ ID NO: 5422115 - DNA, 20 bp, Homo sapiens
gcccagcggctcttcctgga

SEQ ID NO: 5422116 - DNA, 21 bp, Homo sapiens
gcccagcggcttgcctgcctg

SEQ ID NO: 5422117 - DNA, 18 bp, Homo sapiens
gcccagcgggcagatggg

SEQ ID NO: 5422118 - DNA, 15 bp, Homo sapiens
gcccagctacattcc

SEQ ID NO: 5422119 - DNA, 20 bp, Homo sapiens
gcccagctatacctgtgcct

SEQ ID NO: 5422120 - DNA, 23 bp, Homo sapiens
gcccagctatggccccagggttg

SEQ ID NO: 5422121 - DNA, 18 bp, Homo sapiens
gcccagctattaccacac

SEQ ID NO: 5422122 - DNA, 15 bp, Homo sapiens
gcccagctcagaggg

SEQ ID NO: 5422123 - DNA, 16 bp, Homo sapiens
gcccagctcagtgcca

SEQ ID NO: 5422124 - DNA, 21 bp, Homo sapiens
gcccagctcatgtaggtgagc

SEQ ID NO: 5422125 - DNA, 12 bp, Homo sapiens
gcccagctccaa

SEQ ID NO: 5422126 - DNA, 14 bp, Homo sapiens
gcccagctccaggg

SEQ ID NO: 5422127 - DNA, 15 bp, Homo sapiens
gcccagctccagggc

SEQ ID NO: 5422128 - DNA, 16 bp, Homo sapiens
gcccagctccagggcc

SEQ ID NO: 5422129 - DNA, 11 bp, Homo sapiens
gcccagctccc

SEQ ID NO: 5422130 - DNA, 13 bp, Homo sapiens
gcccagctcctca

SEQ ID NO: 5422131 - DNA, 17 bp, Homo sapiens
gcccagctcctgaataa

SEQ ID NO: 5422132 - DNA, 14 bp, Homo sapiens
gcccagctcctgac

SEQ ID NO: 5422133 - DNA, 11 bp, Homo sapiens
gcccagctctg

SEQ ID NO: 5422134 - DNA, 15 bp, Homo sapiens
gcccagctcttgctc

SEQ ID NO: 5422135 - DNA, 17 bp, Homo sapiens
gcccagctcttgctctc

SEQ ID NO: 5422136 - DNA, 14 bp, Homo sapiens
gcccagctctttgt

SEQ ID NO: 5422137 - DNA, 16 bp, Homo sapiens
gcccagctgaggctgg

SEQ ID NO: 5422138 - DNA, 12 bp, Homo sapiens
gcccagctgagt

SEQ ID NO: 5422139 - DNA, 18 bp, Homo sapiens
gcccagctgatctaagga

SEQ ID NO: 5422140 - DNA, 24 bp, Homo sapiens
gcccagctgcacctgccagcctgg

SEQ ID NO: 5422141 - DNA, 12 bp, Homo sapiens
gcccagctgcca

SEQ ID NO: 5422142 - DNA, 14 bp, Homo sapiens
gcccagctgccagg

SEQ ID NO: 5422143 - DNA, 17 bp, Homo sapiens
gcccagctgccagggaa

SEQ ID NO: 5422144 - DNA, 11 bp, Homo sapiens
gcccagctgct

SEQ ID NO: 5422145 - DNA, 14 bp, Homo sapiens
gcccagctgctccc

SEQ ID NO: 5422146 - DNA, 14 bp, Homo sapiens
gcccagctgctctg

SEQ ID NO: 5422147 - DNA, 16 bp, Homo sapiens
gcccagctgctctgcc

SEQ ID NO: 5422148 - DNA, 20 bp, Homo sapiens
gcccagctgctctgcccaga

SEQ ID NO: 5422149 - DNA, 21 bp, Homo sapiens
gcccagctgctctgcccagag

SEQ ID NO: 5422150 - DNA, 14 bp, Homo sapiens
gcccagctggccgg

SEQ ID NO: 5422151 - DNA, 16 bp, Homo sapiens
gcccagctggccggaa

SEQ ID NO: 5422152 - DNA, 19 bp, Homo sapiens
gcccagctggccggaagga

SEQ ID NO: 5422153 - DNA, 23 bp, Homo sapiens
gcccagctggccggaaggagact

SEQ ID NO: 5422154 - DNA, 15 bp, Homo sapiens
gcccagctgggctct

SEQ ID NO: 5422155 - DNA, 17 bp, Homo sapiens
gcccagctgtagccatg

SEQ ID NO: 5422156 - DNA, 20 bp, Homo sapiens
gcccagctgtagccatggct

SEQ ID NO: 5422157 - DNA, 21 bp, Homo sapiens
gcccagctgtagccatggctc

SEQ ID NO: 5422158 - DNA, 19 bp, Homo sapiens
gcccagctgtgctgggagg

SEQ ID NO: 5422159 - DNA, 22 bp, Homo sapiens
gcccagctgtgggcggctcctg

SEQ ID NO: 5422160 - DNA, 16 bp, Homo sapiens
gcccagcttccatgct

SEQ ID NO: 5422161 - DNA, 21 bp, Homo sapiens
gcccagcttgaaaccttcact

SEQ ID NO: 5422162 - DNA, 13 bp, Homo sapiens
gcccagcttggag

SEQ ID NO: 5422163 - DNA, 15 bp, Homo sapiens
gcccagcttgggccc

SEQ ID NO: 5422164 - DNA, 19 bp, Homo sapiens
gcccagcttgggcccagct

SEQ ID NO: 5422165 - DNA, 18 bp, Homo sapiens
gcccagctttcaaaggac

SEQ ID NO: 5422166 - DNA, 12 bp, Homo sapiens
gcccaggaagcc

SEQ ID NO: 5422167 - DNA, 15 bp, Homo sapiens
gcccaggaagcccac

SEQ ID NO: 5422168 - DNA, 23 bp, Homo sapiens
gcccaggaagcccacactatgca

SEQ ID NO: 5422169 - DNA, 23 bp, Homo sapiens
gcccaggaaggcctaggctagga

SEQ ID NO: 5422170 - DNA, 22 bp, Homo sapiens
gcccaggaaggcggcaggcaga

SEQ ID NO: 5422171 - DNA, 23 bp, Homo sapiens
gcccaggaaggcggcaggcagag

SEQ ID NO: 5422172 - DNA, 11 bp, Homo sapiens
gcccaggaagt

SEQ ID NO: 5422173 - DNA, 19 bp, Homo sapiens
gcccaggaagtaattttct

SEQ ID NO: 5422174 - DNA, 18 bp, Homo sapiens
gcccaggaagtctcatct

SEQ ID NO: 5422175 - DNA, 23 bp, Homo sapiens
gcccaggaattagagaagctgaa

SEQ ID NO: 5422176 - DNA, 15 bp, Homo sapiens
gcccaggacactgcc

SEQ ID NO: 5422177 - DNA, 13 bp, Homo sapiens
gcccaggacagct

SEQ ID NO: 5422178 - DNA, 15 bp, Homo sapiens
gcccaggacagctgg

SEQ ID NO: 5422179 - DNA, 13 bp, Homo sapiens
gcccaggaccagc

SEQ ID NO: 5422180 - DNA, 14 bp, Homo sapiens
gcccaggaccagct

SEQ ID NO: 5422181 - DNA, 15 bp, Homo sapiens
gcccaggaccagctg

SEQ ID NO: 5422182 - DNA, 16 bp, Homo sapiens
gcccaggaccagctgg

SEQ ID NO: 5422183 - DNA, 13 bp, Homo sapiens
gcccaggacccca

SEQ ID NO: 5422184 - DNA, 20 bp, Homo sapiens
gcccaggacggggccggcca

SEQ ID NO: 5422185 - DNA, 21 bp, Homo sapiens
gcccaggacgtcctatctccc

SEQ ID NO: 5422186 - DNA, 18 bp, Homo sapiens
gcccaggagacagaccac

SEQ ID NO: 5422187 - DNA, 22 bp, Homo sapiens
gcccaggagacagaccacttgc

SEQ ID NO: 5422188 - DNA, 14 bp, Homo sapiens
gcccaggagagaga

SEQ ID NO: 5422189 - DNA, 17 bp, Homo sapiens
gcccaggagagagaaag

SEQ ID NO: 5422190 - DNA, 23 bp, Homo sapiens
gcccaggagagagaaagccaggc

SEQ ID NO: 5422191 - DNA, 21 bp, Homo sapiens
gcccaggagagccagccctcc

SEQ ID NO: 5422192 - DNA, 21 bp, Homo sapiens
gcccaggagagcccccaccag

SEQ ID NO: 5422193 - DNA, 23 bp, Homo sapiens
gcccaggagcggcgatgcactcg

SEQ ID NO: 5422194 - DNA, 11 bp, Homo sapiens
gcccaggagct

SEQ ID NO: 5422195 - DNA, 20 bp, Homo sapiens
gcccaggagctcccctcccc

SEQ ID NO: 5422196 - DNA, 15 bp, Homo sapiens
gcccaggagctctgc

SEQ ID NO: 5422197 - DNA, 22 bp, Homo sapiens
gcccaggagctctgcgccaggc

SEQ ID NO: 5422198 - DNA, 23 bp, Homo sapiens
gcccaggagctctgcgccaggca

SEQ ID NO: 5422199 - DNA, 15 bp, Homo sapiens
gcccaggaggacctg

SEQ ID NO: 5422200 - DNA, 14 bp, Homo sapiens
gcccaggagtccag

SEQ ID NO: 5422201 - DNA, 15 bp, Homo sapiens
gcccaggagtccagg

SEQ ID NO: 5422202 - DNA, 22 bp, Homo sapiens
gcccaggagtccaggcccccag

SEQ ID NO: 5422203 - DNA, 13 bp, Homo sapiens
gcccaggagtttg

SEQ ID NO: 5422204 - DNA, 17 bp, Homo sapiens
gcccaggagtttggcca

SEQ ID NO: 5422205 - DNA, 18 bp, Homo sapiens
gcccaggagtttggccag

SEQ ID NO: 5422206 - DNA, 15 bp, Homo sapiens
gcccaggatactggc

SEQ ID NO: 5422207 - DNA, 23 bp, Homo sapiens
gcccaggatactggcacagaggt

SEQ ID NO: 5422208 - DNA, 19 bp, Homo sapiens
gcccaggatggagtgcagt

SEQ ID NO: 5422209 - DNA, 12 bp, Homo sapiens
gcccaggcaagg

SEQ ID NO: 5422210 - DNA, 20 bp, Homo sapiens
gcccaggcacaacttcagca

SEQ ID NO: 5422211 - DNA, 22 bp, Homo sapiens
gcccaggcaccaccaggagcag

SEQ ID NO: 5422212 - DNA, 23 bp, Homo sapiens
gcccaggcaccaccaggagcagc

SEQ ID NO: 5422213 - DNA, 24 bp, Homo sapiens
gcccaggcaccaccaggagcagca

SEQ ID NO: 5422214 - DNA, 16 bp, Homo sapiens
gcccaggcactgcaaa

SEQ ID NO: 5422215 - DNA, 15 bp, Homo sapiens
gcccaggcagagagc

SEQ ID NO: 5422216 - DNA, 18 bp, Homo sapiens
gcccaggcagcacctgga

SEQ ID NO: 5422217 - DNA, 19 bp, Homo sapiens
gcccaggcagcacctggag

SEQ ID NO: 5422218 - DNA, 11 bp, Homo sapiens
gcccaggcagg

SEQ ID NO: 5422219 - DNA, 13 bp, Homo sapiens
gcccaggcaggcc

SEQ ID NO: 5422220 - DNA, 17 bp, Homo sapiens
gcccaggcaggcccagc

SEQ ID NO: 5422221 - DNA, 12 bp, Homo sapiens
gcccaggcaggt

SEQ ID NO: 5422222 - DNA, 13 bp, Homo sapiens
gcccaggcaggtc

SEQ ID NO: 5422223 - DNA, 17 bp, Homo sapiens
gcccaggcaggtctgca

SEQ ID NO: 5422224 - DNA, 12 bp, Homo sapiens
gcccaggccaca

SEQ ID NO: 5422225 - DNA, 13 bp, Homo sapiens
gcccaggccacag

SEQ ID NO: 5422226 - DNA, 16 bp, Homo sapiens
gccccagcctccaggc

SEQ ID NO: 5422227 - DNA, 16 bp, Homo sapiens
gccccagcctccctga

SEQ ID NO: 5422228 - DNA, 15 bp, Homo sapiens
gccccagcctcctga

SEQ ID NO: 5422229 - DNA, 17 bp, Homo sapiens
gccccagcctgctagct

SEQ ID NO: 5422230 - DNA, 22 bp, Homo sapiens
gccccagcctgctagctagctc

SEQ ID NO: 5422231 - DNA, 18 bp, Homo sapiens
gccccagcctggcccagc

SEQ ID NO: 5422232 - DNA, 19 bp, Homo sapiens
gccccagcctggcccagct

SEQ ID NO: 5422233 - DNA, 18 bp, Homo sapiens
gccccagcctgtccttgt

SEQ ID NO: 5422234 - DNA, 19 bp, Homo sapiens
gccccagcgcggcttggcc

SEQ ID NO: 5422235 - DNA, 23 bp, Homo sapiens
gccccagcgctgacgtgtcagga

SEQ ID NO: 5422236 - DNA, 22 bp, Homo sapiens
gccccagcgggctggcgggcct

SEQ ID NO: 5422237 - DNA, 16 bp, Homo sapiens
gccccagcgtctgcag

SEQ ID NO: 5422238 - DNA, 17 bp, Homo sapiens
gccccagcgtctgcagg

SEQ ID NO: 5422239 - DNA, 21 bp, Homo sapiens
gccccagcgtctgcagggtga

SEQ ID NO: 5422240 - DNA, 20 bp, Homo sapiens
gccccagctcctcttcctgc

SEQ ID NO: 5422241 - DNA, 20 bp, Homo sapiens
gccccagctctggatgaagg

SEQ ID NO: 5422242 - DNA, 17 bp, Homo sapiens
gccccagctgacatgga

SEQ ID NO: 5422243 - DNA, 19 bp, Homo sapiens
gccccagctgactgtggcc

SEQ ID NO: 5422244 - DNA, 16 bp, Homo sapiens
gccccagctgccaggc

SEQ ID NO: 5422245 - DNA, 23 bp, Homo sapiens
gccccagctgccaggcggccctg

SEQ ID NO: 5422246 - DNA, 18 bp, Homo sapiens
gccccagctggctgggtc

SEQ ID NO: 5422247 - DNA, 19 bp, Homo sapiens
gccccagctggctgggtcg

SEQ ID NO: 5422248 - DNA, 19 bp, Homo sapiens
gccccagctgtgactgagg

SEQ ID NO: 5422249 - DNA, 14 bp, Homo sapiens
gccccaggaccagc

SEQ ID NO: 5422250 - DNA, 16 bp, Homo sapiens
gccccaggaccagctc

SEQ ID NO: 5422251 - DNA, 17 bp, Homo sapiens
gccccaggaccagctca

SEQ ID NO: 5422252 - DNA, 15 bp, Homo sapiens
gccccaggactctgg

SEQ ID NO: 5422253 - DNA, 17 bp, Homo sapiens
gccccaggactctggca

SEQ ID NO: 5422254 - DNA, 19 bp, Homo sapiens
gccccaggactctggcact

SEQ ID NO: 5422255 - DNA, 18 bp, Homo sapiens
gccccaggagaagggaca

SEQ ID NO: 5422256 - DNA, 17 bp, Homo sapiens
gccccaggagcccgtca

SEQ ID NO: 5422257 - DNA, 20 bp, Homo sapiens
gccccaggatcactctctgc

SEQ ID NO: 5422258 - DNA, 15 bp, Homo sapiens
gccccaggcaggctg

SEQ ID NO: 5422259 - DNA, 13 bp, Homo sapiens
gccccaggccagg

SEQ ID NO: 5422260 - DNA, 16 bp, Homo sapiens
gccccaggccaggtag

SEQ ID NO: 5422261 - DNA, 15 bp, Homo sapiens
gccccaggcccgccc

SEQ ID NO: 5422262 - DNA, 19 bp, Homo sapiens
gccccaggcccgccctgcc

SEQ ID NO: 5422263 - DNA, 14 bp, Homo sapiens
gccccaggccctcc

SEQ ID NO: 5422264 - DNA, 15 bp, Homo sapiens
gccccaggccctccc

SEQ ID NO: 5422265 - DNA, 20 bp, Homo sapiens
gccccaggccggagcccaga

SEQ ID NO: 5422266 - DNA, 21 bp, Homo sapiens
gccccaggccggagcccagat

SEQ ID NO: 5422267 - DNA, 22 bp, Homo sapiens
gccccaggcctccctcccccgg

SEQ ID NO: 5422268 - DNA, 15 bp, Homo sapiens
gccccaggcctgaaa

SEQ ID NO: 5422269 - DNA, 13 bp, Homo sapiens
gccccaggcctgg

SEQ ID NO: 5422270 - DNA, 14 bp, Homo sapiens
gccccaggcctgga

SEQ ID NO: 5422271 - DNA, 23 bp, Homo sapiens
gccccaggctcaggctgcccagc

SEQ ID NO: 5422272 - DNA, 20 bp, Homo sapiens
gccccaggctcccctggtct

SEQ ID NO: 5422273 - DNA, 19 bp, Homo sapiens
gccccaggctcgtggactg

SEQ ID NO: 5422274 - DNA, 18 bp, Homo sapiens
gccccaggctgagagcca

SEQ ID NO: 5422275 - DNA, 19 bp, Homo sapiens
gccccaggctgagagccag

SEQ ID NO: 5422276 - DNA, 20 bp, Homo sapiens
gccccaggctggatgctggg

SEQ ID NO: 5422277 - DNA, 18 bp, Homo sapiens
gccccaggcttccgcgcc

SEQ ID NO: 5422278 - DNA, 23 bp, Homo sapiens
gccccaggcttgtcactagcagc

SEQ ID NO: 5422279 - DNA, 11 bp, Homo sapiens
gccccagggac

SEQ ID NO: 5422280 - DNA, 17 bp, Homo sapiens
gccccagggagtccagg

SEQ ID NO: 5422281 - DNA, 20 bp, Homo sapiens
gccccagggagtccagggtt

SEQ ID NO: 5422282 - DNA, 12 bp, Homo sapiens
gccccagggcac

SEQ ID NO: 5422283 - DNA, 18 bp, Homo sapiens
gccccagggccctgctca

SEQ ID NO: 5422284 - DNA, 13 bp, Homo sapiens
gccccagggcctg

SEQ ID NO: 5422285 - DNA, 14 bp, Homo sapiens
gccccagggcctgg

SEQ ID NO: 5422286 - DNA, 15 bp, Homo sapiens
gccccagggcctggg

SEQ ID NO: 5422287 - DNA, 17 bp, Homo sapiens
gccccagggctgtgggt

SEQ ID NO: 5422288 - DNA, 18 bp, Homo sapiens
gccccaggggaacactgg

SEQ ID NO: 5422289 - DNA, 20 bp, Homo sapiens
gccccaggggaactggcagc

SEQ ID NO: 5422290 - DNA, 13 bp, Homo sapiens
gccccaggggacg

SEQ ID NO: 5422291 - DNA, 17 bp, Homo sapiens
gccccaggggacgtggg

SEQ ID NO: 5422292 - DNA, 23 bp, Homo sapiens
gccccaggggacgtgggccctgc

SEQ ID NO: 5422293 - DNA, 19 bp, Homo sapiens
gccccaggggcagcaaggc

SEQ ID NO: 5422294 - DNA, 20 bp, Homo sapiens
gccccaggggcagcaaggcc

SEQ ID NO: 5422295 - DNA, 20 bp, Homo sapiens
gccccagggggcggggtgca

SEQ ID NO: 5422296 - DNA, 16 bp, Homo sapiens
gccccaggggggcctc

SEQ ID NO: 5422297 - DNA, 17 bp, Homo sapiens
gccccaggggggcctcc

SEQ ID NO: 5422298 - DNA, 20 bp, Homo sapiens
gccccaggggtgcctgtggg

SEQ ID NO: 5422299 - DNA, 22 bp, Homo sapiens
gccccagggtctgaaaggggtg

SEQ ID NO: 5422300 - DNA, 20 bp, Homo sapiens
gccccagggtcttccctacc

SEQ ID NO: 5422301 - DNA, 20 bp, Homo sapiens
gccccagggtgagcagggcc

SEQ ID NO: 5422302 - DNA, 16 bp, Homo sapiens
gccccagggtgcccag

SEQ ID NO: 5422303 - DNA, 20 bp, Homo sapiens
gccccaggtacacctccccc

SEQ ID NO: 5422304 - DNA, 19 bp, Homo sapiens
gccccaggtctccccaggc

SEQ ID NO: 5422305 - DNA, 20 bp, Homo sapiens
gccccaggtgccaccaataa

SEQ ID NO: 5422306 - DNA, 23 bp, Homo sapiens
gccccaggtgccaccaataaaaa

SEQ ID NO: 5422307 - DNA, 15 bp, Homo sapiens
gccccagtcagcctc

SEQ ID NO: 5422308 - DNA, 16 bp, Homo sapiens
gccccagtcagcctct

SEQ ID NO: 5422309 - DNA, 11 bp, Homo sapiens
gccccagtcct

SEQ ID NO: 5422310 - DNA, 13 bp, Homo sapiens
gccccagtcctgg

SEQ ID NO: 5422311 - DNA, 18 bp, Homo sapiens
gccccagtcctggttcag

SEQ ID NO: 5422312 - DNA, 21 bp, Homo sapiens
gccccagtcctggttcagtgg

SEQ ID NO: 5422313 - DNA, 14 bp, Homo sapiens
gccccagtcttcct

SEQ ID NO: 5422314 - DNA, 23 bp, Homo sapiens
gccccagtgcctagatgcatggc

SEQ ID NO: 5422315 - DNA, 16 bp, Homo sapiens
gccccagtgctggaag

SEQ ID NO: 5422316 - DNA, 19 bp, Homo sapiens
gccccagtggctgttctgg

SEQ ID NO: 5422317 - DNA, 21 bp, Homo sapiens
gccccagtggtgcgggccagg

SEQ ID NO: 5422318 - DNA, 19 bp, Homo sapiens
gccccagttgtatttattt

SEQ ID NO: 5422319 - DNA, 16 bp, Homo sapiens
gccccagtttggggtg

SEQ ID NO: 5422320 - DNA, 21 bp, Homo sapiens
gccccagtttggggtgccaag

SEQ ID NO: 5422321 - DNA, 22 bp, Homo sapiens
gccccagtttggggtgccaaga

SEQ ID NO: 5422322 - DNA, 16 bp, Homo sapiens
gccccatagaaaacaa

SEQ ID NO: 5422323 - DNA, 16 bp, Homo sapiens
gccccatcagaggctg

SEQ ID NO: 5422324 - DNA, 18 bp, Homo sapiens
gccccatcagaggctggg

SEQ ID NO: 5422325 - DNA, 17 bp, Homo sapiens
gccccatcagcatccca

SEQ ID NO: 5422326 - DNA, 17 bp, Homo sapiens
gccccatcagctccagc

SEQ ID NO: 5422327 - DNA, 19 bp, Homo sapiens
gccccatcaggactcttgt

SEQ ID NO: 5422328 - DNA, 22 bp, Homo sapiens
gccccatccaaccactgtacac

SEQ ID NO: 5422329 - DNA, 20 bp, Homo sapiens
gccccatccagcatgtgtgt

SEQ ID NO: 5422330 - DNA, 14 bp, Homo sapiens
gccccatccctgtc

SEQ ID NO: 5422331 - DNA, 16 bp, Homo sapiens
gccccatccctgtcct

SEQ ID NO: 5422332 - DNA, 12 bp, Homo sapiens
gccccatcctca

SEQ ID NO: 5422333 - DNA, 18 bp, Homo sapiens
gccccatcctccagcagg

SEQ ID NO: 5422334 - DNA, 14 bp, Homo sapiens
gccccatcctggcc

SEQ ID NO: 5422335 - DNA, 15 bp, Homo sapiens
gccccatcctgggcc

SEQ ID NO: 5422336 - DNA, 19 bp, Homo sapiens
gccccatccttcccgcagc

SEQ ID NO: 5422337 - DNA, 20 bp, Homo sapiens
gccccatcgccccaactcca

SEQ ID NO: 5422338 - DNA, 21 bp, Homo sapiens
gccccatctccacaggagaga

SEQ ID NO: 5422339 - DNA, 21 bp, Homo sapiens
gccccatctcccctcagctcg

SEQ ID NO: 5422340 - DNA, 15 bp, Homo sapiens
gccccatctgcgggg

SEQ ID NO: 5422341 - DNA, 15 bp, Homo sapiens
gccccatctgtgcat

SEQ ID NO: 5422342 - DNA, 19 bp, Homo sapiens
gccccatcttggtcctgtc

SEQ ID NO: 5422343 - DNA, 16 bp, Homo sapiens
gccccatgacctccag

SEQ ID NO: 5422344 - DNA, 16 bp, Homo sapiens
gccccatgcctgtcca

SEQ ID NO: 5422345 - DNA, 17 bp, Homo sapiens
gccccatgcctgtccag

SEQ ID NO: 5422346 - DNA, 13 bp, Homo sapiens
gccccatgctctg

SEQ ID NO: 5422347 - DNA, 14 bp, Homo sapiens
gccccatgctctgc

SEQ ID NO: 5422348 - DNA, 17 bp, Homo sapiens
gccccatgctctgcccc

SEQ ID NO: 5422349 - DNA, 16 bp, Homo sapiens
gccccatgctggagcc

SEQ ID NO: 5422350 - DNA, 21 bp, Homo sapiens
gccccatgctggagcctgtgt

SEQ ID NO: 5422351 - DNA, 19 bp, Homo sapiens
gccccatggacaacactaa

SEQ ID NO: 5422352 - DNA, 17 bp, Homo sapiens
gccccatggcagctcct

SEQ ID NO: 5422353 - DNA, 18 bp, Homo sapiens
gccccatgggccctcagc

SEQ ID NO: 5422354 - DNA, 18 bp, Homo sapiens
gccccatggtcacagacc

SEQ ID NO: 5422355 - DNA, 20 bp, Homo sapiens
gccccatggtcacagacccc

SEQ ID NO: 5422356 - DNA, 21 bp, Homo sapiens
gccccatgtgccttgtccagg

SEQ ID NO: 5422357 - DNA, 13 bp, Homo sapiens
gccccattaactg

SEQ ID NO: 5422358 - DNA, 11 bp, Homo sapiens
gccccattcag

SEQ ID NO: 5422359 - DNA, 17 bp, Homo sapiens
gccccattccagctctc

SEQ ID NO: 5422360 - DNA, 18 bp, Homo sapiens
gccccattctcactgcta

SEQ ID NO: 5422361 - DNA, 20 bp, Homo sapiens
gccccattctccctccatgg

SEQ ID NO: 5422362 - DNA, 14 bp, Homo sapiens
gccccattctgcct

SEQ ID NO: 5422363 - DNA, 15 bp, Homo sapiens
gcccccaaaagtgtc

SEQ ID NO: 5422364 - DNA, 16 bp, Homo sapiens
gcccccaaacccccat

SEQ ID NO: 5422365 - DNA, 24 bp, Homo sapiens
gcccccaaagatagacaggtcctg

SEQ ID NO: 5422366 - DNA, 17 bp, Homo sapiens
gcccccaaattgccttc

SEQ ID NO: 5422367 - DNA, 21 bp, Homo sapiens
gcccccaaattgccttcagcc

SEQ ID NO: 5422368 - DNA, 23 bp, Homo sapiens
gcccccaaattgccttcagccct

SEQ ID NO: 5422369 - DNA, 15 bp, Homo sapiens
gcccccaacacaggc

SEQ ID NO: 5422370 - DNA, 16 bp, Homo sapiens
gcccccaacactccag

SEQ ID NO: 5422371 - DNA, 21 bp, Homo sapiens
gcccccaacactccaggccct

SEQ ID NO: 5422372 - DNA, 17 bp, Homo sapiens
gcccccaacccctcctc

SEQ ID NO: 5422373 - DNA, 19 bp, Homo sapiens
gcccccaacccctcctccc

SEQ ID NO: 5422374 - DNA, 16 bp, Homo sapiens
gcccccaacctcaggg

SEQ ID NO: 5422375 - DNA, 19 bp, Homo sapiens
gcccccaacctcagggctc

SEQ ID NO: 5422376 - DNA, 19 bp, Homo sapiens
gcccccaaggaggcagcct

SEQ ID NO: 5422377 - DNA, 22 bp, Homo sapiens
gcccccaataaaccagtgtgaa

SEQ ID NO: 5422378 - DNA, 22 bp, Homo sapiens
gcccccaatttcccagactaga

SEQ ID NO: 5422379 - DNA, 16 bp, Homo sapiens
gcccccacacctggcc

SEQ ID NO: 5422380 - DNA, 17 bp, Homo sapiens
gcccccacacctggccc

SEQ ID NO: 5422381 - DNA, 23 bp, Homo sapiens
gcccccacagaaagactgagctc

SEQ ID NO: 5422382 - DNA, 15 bp, Homo sapiens
gcccccacagatcca

SEQ ID NO: 5422383 - DNA, 18 bp, Homo sapiens
gcccccacagccctggaa

SEQ ID NO: 5422384 - DNA, 15 bp, Homo sapiens
gcccccacagcgctc

SEQ ID NO: 5422385 - DNA, 17 bp, Homo sapiens
gcccccacagctccttg

SEQ ID NO: 5422386 - DNA, 21 bp, Homo sapiens
gcccccacatttgtgccgaca

SEQ ID NO: 5422387 - DNA, 19 bp, Homo sapiens
gcccccaccacaaacacag

SEQ ID NO: 5422388 - DNA, 22 bp, Homo sapiens
gcccccaccacggccactggcc

SEQ ID NO: 5422389 - DNA, 21 bp, Homo sapiens
gcccccaccactaggactctg

SEQ ID NO: 5422390 - DNA, 23 bp, Homo sapiens
gcccccaccagcagcacaattct

SEQ ID NO: 5422391 - DNA, 12 bp, Homo sapiens
gcccccaccagg

SEQ ID NO: 5422392 - DNA, 14 bp, Homo sapiens
gcccccacccacct

SEQ ID NO: 5422393 - DNA, 13 bp, Homo sapiens
gcccccacccagt

SEQ ID NO: 5422394 - DNA, 16 bp, Homo sapiens
gcccccacccatgcca

SEQ ID NO: 5422395 - DNA, 20 bp, Homo sapiens
gcccccaccccagcacagct

SEQ ID NO: 5422396 - DNA, 16 bp, Homo sapiens
gcccccaccccaggct

SEQ ID NO: 5422397 - DNA, 18 bp, Homo sapiens
gcccccacccccaccctc

SEQ ID NO: 5422398 - DNA, 21 bp, Homo sapiens
gcccccaccccggggaccctg

SEQ ID NO: 5422399 - DNA, 22 bp, Homo sapiens
gcccccaccccggggaccctgt

SEQ ID NO: 5422400 - DNA, 19 bp, Homo sapiens
gcccccaccccttccccag

SEQ ID NO: 5422401 - DNA, 20 bp, Homo sapiens
gcccccaccccttccccagg

SEQ ID NO: 5422402 - DNA, 13 bp, Homo sapiens
gccccgtgaggca

SEQ ID NO: 5422403 - DNA, 19 bp, Homo sapiens
gccccgtgcagactggagg

SEQ ID NO: 5422404 - DNA, 14 bp, Homo sapiens
gccccgtgctcctc

SEQ ID NO: 5422405 - DNA, 20 bp, Homo sapiens
gccccgtgctcctctgcccg

SEQ ID NO: 5422406 - DNA, 17 bp, Homo sapiens
gccccgtggggttcctc

SEQ ID NO: 5422407 - DNA, 12 bp, Homo sapiens
gccccgtgggtg

SEQ ID NO: 5422408 - DNA, 14 bp, Homo sapiens
gccccgtgtagccc

SEQ ID NO: 5422409 - DNA, 13 bp, Homo sapiens
gccccgtgtcccc

SEQ ID NO: 5422410 - DNA, 18 bp, Homo sapiens
gccccgtgtccccccagg

SEQ ID NO: 5422411 - DNA, 16 bp, Homo sapiens
gccccgtgtgaatgta

SEQ ID NO: 5422412 - DNA, 17 bp, Homo sapiens
gccccgtgtgaatgtag

SEQ ID NO: 5422413 - DNA, 18 bp, Homo sapiens
gccccgtgtgaatgtagc

SEQ ID NO: 5422414 - DNA, 16 bp, Homo sapiens
gccccgtgtgcacacc

SEQ ID NO: 5422415 - DNA, 18 bp, Homo sapiens
gccccgttccctgtcaga

SEQ ID NO: 5422416 - DNA, 15 bp, Homo sapiens
gccccgttctgtttg

SEQ ID NO: 5422417 - DNA, 19 bp, Homo sapiens
gccccgttgcttcccgctg

SEQ ID NO: 5422418 - DNA, 19 bp, Homo sapiens
gcccctaaagagcatcctg

SEQ ID NO: 5422419 - DNA, 17 bp, Homo sapiens
gcccctaaagatgggag

SEQ ID NO: 5422420 - DNA, 16 bp, Homo sapiens
gcccctaccccacacc

SEQ ID NO: 5422421 - DNA, 13 bp, Homo sapiens
gcccctacccctg

SEQ ID NO: 5422422 - DNA, 15 bp, Homo sapiens
gcccctacccctgcc

SEQ ID NO: 5422423 - DNA, 17 bp, Homo sapiens
gcccctacccctgccct

SEQ ID NO: 5422424 - DNA, 23 bp, Homo sapiens
gcccctaccttgagaccctcttc

SEQ ID NO: 5422425 - DNA, 17 bp, Homo sapiens
gcccctacgggcgctgc

SEQ ID NO: 5422426 - DNA, 13 bp, Homo sapiens
gcccctactgctg

SEQ ID NO: 5422427 - DNA, 14 bp, Homo sapiens
gcccctactgctgt

SEQ ID NO: 5422428 - DNA, 15 bp, Homo sapiens
gcccctactgctgtg

SEQ ID NO: 5422429 - DNA, 19 bp, Homo sapiens
gcccctactgctgtgaacc

SEQ ID NO: 5422430 - DNA, 15 bp, Homo sapiens
gcccctactgtgggc

SEQ ID NO: 5422431 - DNA, 19 bp, Homo sapiens
gcccctagaaacccaagct

SEQ ID NO: 5422432 - DNA, 17 bp, Homo sapiens
gcccctagaagggaagg

SEQ ID NO: 5422433 - DNA, 17 bp, Homo sapiens
gcccctagaatcagcct

SEQ ID NO: 5422434 - DNA, 18 bp, Homo sapiens
gcccctagcccaggagag

SEQ ID NO: 5422435 - DNA, 19 bp, Homo sapiens
gcccctagcccaggagaga

SEQ ID NO: 5422436 - DNA, 20 bp, Homo sapiens
gcccctagcccaggagagag

SEQ ID NO: 5422437 - DNA, 19 bp, Homo sapiens
gcccctagccggttcctgt

SEQ ID NO: 5422438 - DNA, 21 bp, Homo sapiens
gcccctagcgctatctccctg

SEQ ID NO: 5422439 - DNA, 19 bp, Homo sapiens
gcccctaggatgctgcagc

SEQ ID NO: 5422440 - DNA, 17 bp, Homo sapiens
gcccctagggtccctcg

SEQ ID NO: 5422441 - DNA, 21 bp, Homo sapiens
gcccctaggtgcccagggcca

SEQ ID NO: 5422442 - DNA, 19 bp, Homo sapiens
gcccctatagcactgagct

SEQ ID NO: 5422443 - DNA, 21 bp, Homo sapiens
gcccctatagcactgagctca

SEQ ID NO: 5422444 - DNA, 14 bp, Homo sapiens
gcccctcaaaggga

SEQ ID NO: 5422445 - DNA, 21 bp, Homo sapiens
gcccctcaaagggagagaaaa

SEQ ID NO: 5422446 - DNA, 19 bp, Homo sapiens
gcccctcaacagccaagtg

SEQ ID NO: 5422447 - DNA, 14 bp, Homo sapiens
gcccctcacaacag

SEQ ID NO: 5422448 - DNA, 13 bp, Homo sapiens
gcccctcacatcc

SEQ ID NO: 5422449 - DNA, 20 bp, Homo sapiens
gcccctcacccaccatggac

SEQ ID NO: 5422450 - DNA, 12 bp, Homo sapiens
gcccctcaccct

SEQ ID NO: 5422451 - DNA, 18 bp, Homo sapiens
gcccctcaccctctgtcc

SEQ ID NO: 5422452 - DNA, 13 bp, Homo sapiens
gcccctcacctgg

SEQ ID NO: 5422453 - DNA, 16 bp, Homo sapiens
gcccctcacctggtac

SEQ ID NO: 5422454 - DNA, 12 bp, Homo sapiens
gcccctcacctt

SEQ ID NO: 5422455 - DNA, 16 bp, Homo sapiens
gcccctcaccttgggc

SEQ ID NO: 5422456 - DNA, 22 bp, Homo sapiens
gcccctcaccttgggctggggg

SEQ ID NO: 5422457 - DNA, 23 bp, Homo sapiens
gcccctcaccttgggctggggga

SEQ ID NO: 5422458 - DNA, 19 bp, Homo sapiens
gcccctcactggctggact

SEQ ID NO: 5422459 - DNA, 14 bp, Homo sapiens
gcccctcacttcca

SEQ ID NO: 5422460 - DNA, 17 bp, Homo sapiens
gcccctcacttgaggag

SEQ ID NO: 5422461 - DNA, 20 bp, Homo sapiens
gcccctcacttgaggaggag

SEQ ID NO: 5422462 - DNA, 13 bp, Homo sapiens
gcccctcagagaa

SEQ ID NO: 5422463 - DNA, 14 bp, Homo sapiens
gcccctcagagaat

SEQ ID NO: 5422464 - DNA, 23 bp, Homo sapiens
gcccctcagagccctgccctgca

SEQ ID NO: 5422465 - DNA, 17 bp, Homo sapiens
gcccctcagccaccctt

SEQ ID NO: 5422466 - DNA, 14 bp, Homo sapiens
gcccctcagccctt

SEQ ID NO: 5422467 - DNA, 21 bp, Homo sapiens
gcccctcagcccttgccccca

SEQ ID NO: 5422468 - DNA, 22 bp, Homo sapiens
gcccctcagcctctgccactgt

SEQ ID NO: 5422469 - DNA, 13 bp, Homo sapiens
gcccctcagcctg

SEQ ID NO: 5422470 - DNA, 22 bp, Homo sapiens
gcccctcagcctgcctgaagag

SEQ ID NO: 5422471 - DNA, 18 bp, Homo sapiens
gcccctcaggggaagctg

SEQ ID NO: 5422472 - DNA, 20 bp, Homo sapiens
gcccctcaggggaagctgct

SEQ ID NO: 5422473 - DNA, 22 bp, Homo sapiens
gcccctcaggggaagctgctag

SEQ ID NO: 5422474 - DNA, 17 bp, Homo sapiens
gcccctcagggggccag

SEQ ID NO: 5422475 - DNA, 19 bp, Homo sapiens
gcccctcagggggccagct

SEQ ID NO: 5422476 - DNA, 17 bp, Homo sapiens
gcccctccaaacctcca

SEQ ID NO: 5422477 - DNA, 18 bp, Homo sapiens
gcccctccaaacctccag

SEQ ID NO: 5422478 - DNA, 18 bp, Homo sapiens
gcccctccaatcctcccc

SEQ ID NO: 5422479 - DNA, 13 bp, Homo sapiens
gcccctccagcac

SEQ ID NO: 5422480 - DNA, 12 bp, Homo sapiens
gcccctccagct

SEQ ID NO: 5422481 - DNA, 14 bp, Homo sapiens
gcccctccaggaac

SEQ ID NO: 5422482 - DNA, 14 bp, Homo sapiens
gcccctcccaagcg

SEQ ID NO: 5422483 - DNA, 21 bp, Homo sapiens
gcccctcccacacccaaagct

SEQ ID NO: 5422484 - DNA, 17 bp, Homo sapiens
gcccctcccacatcccc

SEQ ID NO: 5422485 - DNA, 18 bp, Homo sapiens
gcccctcccacatccccc

SEQ ID NO: 5422486 - DNA, 12 bp, Homo sapiens
gcccctcccacc

SEQ ID NO: 5422487 - DNA, 14 bp, Homo sapiens
gcccctcccaccac

SEQ ID NO: 5422488 - DNA, 15 bp, Homo sapiens
gcccctcccaccaca

SEQ ID NO: 5422489 - DNA, 13 bp, Homo sapiens
gcccctcccacgc

SEQ ID NO: 5422490 - DNA, 14 bp, Homo sapiens
gcccctcccagcct

SEQ ID NO: 5422491 - DNA, 12 bp, Homo sapiens
gcccctcccagt

SEQ ID NO: 5422492 - DNA, 17 bp, Homo sapiens
gcccctccccagactct

SEQ ID NO: 5422493 - DNA, 18 bp, Homo sapiens
gcccctccccagactctc

SEQ ID NO: 5422494 - DNA, 13 bp, Homo sapiens
gcccctccccagc

SEQ ID NO: 5422495 - DNA, 22 bp, Homo sapiens
gcccctccccagccagcccttc

SEQ ID NO: 5422496 - DNA, 16 bp, Homo sapiens
gcccctccccagcccc

SEQ ID NO: 5422497 - DNA, 17 bp, Homo sapiens
gcccctccccagccccc

SEQ ID NO: 5422498 - DNA, 13 bp, Homo sapiens
gcccctccccatg

SEQ ID NO: 5422499 - DNA, 21 bp, Homo sapiens
gcccctcccccaacccccacc

SEQ ID NO: 5422500 - DNA, 14 bp, Homo sapiens
gcccctcccccagg

SEQ ID NO: 5422501 - DNA, 17 bp, Homo sapiens
gcccctccccctaccgc

SEQ ID NO: 5422502 - DNA, 20 bp, Homo sapiens
gcccctccccctaccgcatg

SEQ ID NO: 5422503 - DNA, 16 bp, Homo sapiens
gcccctccccctgcca

SEQ ID NO: 5422504 - DNA, 17 bp, Homo sapiens
gcccctccccgcctcct

SEQ ID NO: 5422505 - DNA, 23 bp, Homo sapiens
gcccctccccgcctcctccctgc

SEQ ID NO: 5422506 - DNA, 24 bp, Homo sapiens
gcccctccccgtccctgtccccca

SEQ ID NO: 5422507 - DNA, 16 bp, Homo sapiens
gcccctcccctcagag

SEQ ID NO: 5422508 - DNA, 21 bp, Homo sapiens
gcccctcccctcagcctgccc

SEQ ID NO: 5422509 - DNA, 14 bp, Homo sapiens
gcccctcccctgca

SEQ ID NO: 5422510 - DNA, 13 bp, Homo sapiens
gcccctcccgccc

SEQ ID NO: 5422511 - DNA, 15 bp, Homo sapiens
gcccctccctacctc

SEQ ID NO: 5422512 - DNA, 18 bp, Homo sapiens
gcccctccctcagggagc

SEQ ID NO: 5422513 - DNA, 15 bp, Homo sapiens
gcccctccctcctct

SEQ ID NO: 5422514 - DNA, 19 bp, Homo sapiens
gcccctccctcctctggcc

SEQ ID NO: 5422515 - DNA, 22 bp, Homo sapiens
gcccctccctcctctggcccag

SEQ ID NO: 5422516 - DNA, 17 bp, Homo sapiens
gcccctccctcctgtgt

SEQ ID NO: 5422517 - DNA, 15 bp, Homo sapiens
gcccctccctctgcc

SEQ ID NO: 5422518 - DNA, 16 bp, Homo sapiens
gcccctccctctgccc

SEQ ID NO: 5422519 - DNA, 18 bp, Homo sapiens
gcccctccctctgcccca

SEQ ID NO: 5422520 - DNA, 19 bp, Homo sapiens
gcccctccctctgccccaa

SEQ ID NO: 5422521 - DNA, 13 bp, Homo sapiens
gcccctccctgcc

SEQ ID NO: 5422522 - DNA, 19 bp, Homo sapiens
gcccctccgggcagagacc

SEQ ID NO: 5422523 - DNA, 16 bp, Homo sapiens
gcccctccgtccccag

SEQ ID NO: 5422524 - DNA, 19 bp, Homo sapiens
gcccctcctaacccagcag

SEQ ID NO: 5422525 - DNA, 18 bp, Homo sapiens
gcccctcctagacccagg

SEQ ID NO: 5422526 - DNA, 11 bp, Homo sapiens
gcccctcctcc

SEQ ID NO: 5422527 - DNA, 19 bp, Homo sapiens
gcccctcctccagagcctg

SEQ ID NO: 5422528 - DNA, 15 bp, Homo sapiens
gcccctcctccagcc

SEQ ID NO: 5422529 - DNA, 17 bp, Homo sapiens
gcccctcctcccccggc

SEQ ID NO: 5422530 - DNA, 16 bp, Homo sapiens
gcccctcctccccttc

SEQ ID NO: 5422531 - DNA, 23 bp, Homo sapiens
gcccctcctccccttcctgcacc

SEQ ID NO: 5422532 - DNA, 15 bp, Homo sapiens
gcccctcctccctca

SEQ ID NO: 5422533 - DNA, 16 bp, Homo sapiens
gcccctcctccctcag

SEQ ID NO: 5422534 - DNA, 20 bp, Homo sapiens
gcccctcctccctcagaccc

SEQ ID NO: 5422535 - DNA, 22 bp, Homo sapiens
gcccctcctccctcagacccag

SEQ ID NO: 5422536 - DNA, 17 bp, Homo sapiens
gcccctcctccctcagg

SEQ ID NO: 5422537 - DNA, 18 bp, Homo sapiens
gcccctcctccctcaggc

SEQ ID NO: 5422538 - DNA, 13 bp, Homo sapiens
gcccctcctctcc

SEQ ID NO: 5422539 - DNA, 15 bp, Homo sapiens
gcccctcctctcctc

SEQ ID NO: 5422540 - DNA, 23 bp, Homo sapiens
gcccctcctctcctcgtccggcc

SEQ ID NO: 5422541 - DNA, 18 bp, Homo sapiens
gcccctcctctctgccct

SEQ ID NO: 5422542 - DNA, 14 bp, Homo sapiens
gcccctcctctgcc

SEQ ID NO: 5422543 - DNA, 22 bp, Homo sapiens
gcccctcctgactcatccgcct

SEQ ID NO: 5422544 - DNA, 15 bp, Homo sapiens
gcccctcctggagca

SEQ ID NO: 5422545 - DNA, 21 bp, Homo sapiens
gcccctcctggagcagaaagt

SEQ ID NO: 5422546 - DNA, 12 bp, Homo sapiens
gcccctcctggg

SEQ ID NO: 5422547 - DNA, 14 bp, Homo sapiens
gcccctcctgggtg

SEQ ID NO: 5422548 - DNA, 15 bp, Homo sapiens
gcccctccttctccc

SEQ ID NO: 5422549 - DNA, 17 bp, Homo sapiens
gcccctccttctcccct

SEQ ID NO: 5422550 - DNA, 18 bp, Homo sapiens
gcccctccttctcccctg

SEQ ID NO: 5422551 - DNA, 19 bp, Homo sapiens
gcccctccttttggcctgg

SEQ ID NO: 5422552 - DNA, 22 bp, Homo sapiens
gcccctccttttggcctggggg

SEQ ID NO: 5422553 - DNA, 19 bp, Homo sapiens
gcccctcgaccctgtgcag

SEQ ID NO: 5422554 - DNA, 17 bp, Homo sapiens
gcccctcgaggcctaca

SEQ ID NO: 5422555 - DNA, 15 bp, Homo sapiens
gcccctcgcacacag

SEQ ID NO: 5422556 - DNA, 18 bp, Homo sapiens
gcccctcgcacacagggc

SEQ ID NO: 5422557 - DNA, 19 bp, Homo sapiens
gcccctcgcacacagggct

SEQ ID NO: 5422558 - DNA, 20 bp, Homo sapiens
gcccctcgcacacagggctc

SEQ ID NO: 5422559 - DNA, 15 bp, Homo sapiens
gcccctcgccagctt

SEQ ID NO: 5422560 - DNA, 15 bp, Homo sapiens
gcccctcgcccgccc

SEQ ID NO: 5422561 - DNA, 15 bp, Homo sapiens
gcccctcgcctgtgg

SEQ ID NO: 5422562 - DNA, 15 bp, Homo sapiens
gcccctcgctgctgc

SEQ ID NO: 5422563 - DNA, 23 bp, Homo sapiens
gcccctcggcattcacacacagc

SEQ ID NO: 5422564 - DNA, 19 bp, Homo sapiens
gcccctcgtgacctacagg

SEQ ID NO: 5422565 - DNA, 17 bp, Homo sapiens
gcccctcgttgcccagc

SEQ ID NO: 5422566 - DNA, 19 bp, Homo sapiens
gcccctcgttgcccagcac

SEQ ID NO: 5422567 - DNA, 15 bp, Homo sapiens
gcccctctcacaggc

SEQ ID NO: 5422568 - DNA, 19 bp, Homo sapiens
gcccctctcacaggcagct

SEQ ID NO: 5422569 - DNA, 14 bp, Homo sapiens
gcccctctcaccaa

SEQ ID NO: 5422570 - DNA, 13 bp, Homo sapiens
gcccctctcagcc

SEQ ID NO: 5422571 - DNA, 20 bp, Homo sapiens
gcccctctcagccctcacac

SEQ ID NO: 5422572 - DNA, 20 bp, Homo sapiens
gcccctctccaagcgcctgg

SEQ ID NO: 5422573 - DNA, 18 bp, Homo sapiens
gcccctctccccagggaa

SEQ ID NO: 5422574 - DNA, 20 bp, Homo sapiens
gcccctctcccctctctgct

SEQ ID NO: 5422575 - DNA, 21 bp, Homo sapiens
gcccctctcccttgggctctg

SEQ ID NO: 5422576 - DNA, 14 bp, Homo sapiens
gcccctctcctccg

SEQ ID NO: 5422577 - DNA, 17 bp, Homo sapiens
gcccctctctagggacc

SEQ ID NO: 5422578 - DNA, 13 bp, Homo sapiens
gcccctctctcac

SEQ ID NO: 5422579 - DNA, 15 bp, Homo sapiens
gcccctctctgggcc

SEQ ID NO: 5422580 - DNA, 23 bp, Homo sapiens
gcccctctctgtttaccctccct

SEQ ID NO: 5422581 - DNA, 15 bp, Homo sapiens
gccctaaaagcacac

SEQ ID NO: 5422582 - DNA, 19 bp, Homo sapiens
gccctaaaattccactgcg

SEQ ID NO: 5422583 - DNA, 18 bp, Homo sapiens
gccctaaatagcagaaag

SEQ ID NO: 5422584 - DNA, 18 bp, Homo sapiens
gccctaaccccttccaga

SEQ ID NO: 5422585 - DNA, 21 bp, Homo sapiens
gccctaacgggggtgcggcag

SEQ ID NO: 5422586 - DNA, 16 bp, Homo sapiens
gccctaagatgccttg

SEQ ID NO: 5422587 - DNA, 21 bp, Homo sapiens
gccctaagattgaaaaggaag

SEQ ID NO: 5422588 - DNA, 16 bp, Homo sapiens
gccctaagcagaaagt

SEQ ID NO: 5422589 - DNA, 14 bp, Homo sapiens
gccctaagccccca

SEQ ID NO: 5422590 - DNA, 15 bp, Homo sapiens
gccctaagcccccag

SEQ ID NO: 5422591 - DNA, 17 bp, Homo sapiens
gccctaagcccccaggg

SEQ ID NO: 5422592 - DNA, 12 bp, Homo sapiens
gccctaagcctg

SEQ ID NO: 5422593 - DNA, 19 bp, Homo sapiens
gccctaagcctgtccccag

SEQ ID NO: 5422594 - DNA, 20 bp, Homo sapiens
gccctaagcctgtccccaga

SEQ ID NO: 5422595 - DNA, 21 bp, Homo sapiens
gccctaagcctgtccccagac

SEQ ID NO: 5422596 - DNA, 14 bp, Homo sapiens
gccctaagggactt

SEQ ID NO: 5422597 - DNA, 17 bp, Homo sapiens
gccctaaggttttgttg

SEQ ID NO: 5422598 - DNA, 21 bp, Homo sapiens
gccctaagtgttgaagaagag

SEQ ID NO: 5422599 - DNA, 20 bp, Homo sapiens
gccctaatgcgcaggctggc

SEQ ID NO: 5422600 - DNA, 15 bp, Homo sapiens
gccctaattcatctt

SEQ ID NO: 5422601 - DNA, 22 bp, Homo sapiens
gccctacacacagaccgcgccc

SEQ ID NO: 5422602 - DNA, 20 bp, Homo sapiens
gccctacagaggtctctgcc

SEQ ID NO: 5422603 - DNA, 20 bp, Homo sapiens
gccctaccagcgcccgctgg

SEQ ID NO: 5422604 - DNA, 23 bp, Homo sapiens
gccctaccagcgcccgctgggct

SEQ ID NO: 5422605 - DNA, 12 bp, Homo sapiens
gccctaccctca

SEQ ID NO: 5422606 - DNA, 13 bp, Homo sapiens
gccctaccctcct

SEQ ID NO: 5422607 - DNA, 16 bp, Homo sapiens
gccctaccctcctgct

SEQ ID NO: 5422608 - DNA, 18 bp, Homo sapiens
gccctaccctcctgctga

SEQ ID NO: 5422609 - DNA, 20 bp, Homo sapiens
gccctaccctcctgctgagc

SEQ ID NO: 5422610 - DNA, 23 bp, Homo sapiens
gccctaccctcctgctgagctgc

SEQ ID NO: 5422611 - DNA, 14 bp, Homo sapiens
gccctacctgggga

SEQ ID NO: 5422612 - DNA, 17 bp, Homo sapiens
gccctacctggggaaag

SEQ ID NO: 5422613 - DNA, 22 bp, Homo sapiens
gccctactccactgccctggca

SEQ ID NO: 5422614 - DNA, 16 bp, Homo sapiens
gccctactccctgcag

SEQ ID NO: 5422615 - DNA, 20 bp, Homo sapiens
gccctactccctgcagatgc

SEQ ID NO: 5422616 - DNA, 13 bp, Homo sapiens
gccctactcctgc

SEQ ID NO: 5422617 - DNA, 21 bp, Homo sapiens
gccctactctgtgtaatagaa

SEQ ID NO: 5422618 - DNA, 21 bp, Homo sapiens
gccctacttctttgctttgcc

SEQ ID NO: 5422619 - DNA, 21 bp, Homo sapiens
gccctagaagatcacagcagg

SEQ ID NO: 5422620 - DNA, 13 bp, Homo sapiens
gccctagaccctc

SEQ ID NO: 5422621 - DNA, 13 bp, Homo sapiens
gccctagagcaca

SEQ ID NO: 5422622 - DNA, 17 bp, Homo sapiens
gccctagagcacactgt

SEQ ID NO: 5422623 - DNA, 19 bp, Homo sapiens
gccctagagcctgcctgga

SEQ ID NO: 5422624 - DNA, 20 bp, Homo sapiens
gccctagagcctgcctggag

SEQ ID NO: 5422625 - DNA, 21 bp, Homo sapiens
gccctagagcctgcctggagc

SEQ ID NO: 5422626 - DNA, 22 bp, Homo sapiens
gccctagaggcgagccaggcaa

SEQ ID NO: 5422627 - DNA, 20 bp, Homo sapiens
gccctagatgcacgtggggc

SEQ ID NO: 5422628 - DNA, 17 bp, Homo sapiens
gccctagcagtttgcct

SEQ ID NO: 5422629 - DNA, 23 bp, Homo sapiens
gccctagcagtttgcctctgcac

SEQ ID NO: 5422630 - DNA, 22 bp, Homo sapiens
gccctagcccagactctgagct

SEQ ID NO: 5422631 - DNA, 21 bp, Homo sapiens
gccctagcccagcgctctgcc

SEQ ID NO: 5422632 - DNA, 14 bp, Homo sapiens
gccctagccctgct

SEQ ID NO: 5422633 - DNA, 21 bp, Homo sapiens
gccctagcgctctcttccaga

SEQ ID NO: 5422634 - DNA, 14 bp, Homo sapiens
gccctagcggctgc

SEQ ID NO: 5422635 - DNA, 16 bp, Homo sapiens
gccctagcggctgctc

SEQ ID NO: 5422636 - DNA, 13 bp, Homo sapiens
gccctagctccac

SEQ ID NO: 5422637 - DNA, 15 bp, Homo sapiens
gccctagctgtccca

SEQ ID NO: 5422638 - DNA, 16 bp, Homo sapiens
gccctaggaacctcga

SEQ ID NO: 5422639 - DNA, 19 bp, Homo sapiens
gccctaggcatactctcca

SEQ ID NO: 5422640 - DNA, 14 bp, Homo sapiens
gccctaggctaccc

SEQ ID NO: 5422641 - DNA, 18 bp, Homo sapiens
gccctagggctcagaggg

SEQ ID NO: 5422642 - DNA, 19 bp, Homo sapiens
gccctagtgggagcccagc

SEQ ID NO: 5422643 - DNA, 22 bp, Homo sapiens
gccctagtgggagcccagcaca

SEQ ID NO: 5422644 - DNA, 18 bp, Homo sapiens
gccctatatacctcacta

SEQ ID NO: 5422645 - DNA, 16 bp, Homo sapiens
gccctatgtctcagga

SEQ ID NO: 5422646 - DNA, 17 bp, Homo sapiens
gccctatgtgaaaagat

SEQ ID NO: 5422647 - DNA, 20 bp, Homo sapiens
gccctattataattgtcatg

SEQ ID NO: 5422648 - DNA, 22 bp, Homo sapiens
gccctattgctgctaagtcatt

SEQ ID NO: 5422649 - DNA, 14 bp, Homo sapiens
gccctatttctatg

SEQ ID NO: 5422650 - DNA, 15 bp, Homo sapiens
gccctatttttgcaa

SEQ ID NO: 5422651 - DNA, 16 bp, Homo sapiens
gccctcaaaagcactt

SEQ ID NO: 5422652 - DNA, 19 bp, Homo sapiens
gccctcaaaatgacagcca

SEQ ID NO: 5422653 - DNA, 19 bp, Homo sapiens
gccctcaacaggcccaggg

SEQ ID NO: 5422654 - DNA, 23 bp, Homo sapiens
gccctcaagaacatgatgggcct

SEQ ID NO: 5422655 - DNA, 16 bp, Homo sapiens
gccctcaaggcctccc

SEQ ID NO: 5422656 - DNA, 17 bp, Homo sapiens
gccctcaaggcctccca

SEQ ID NO: 5422657 - DNA, 18 bp, Homo sapiens
gccctcaaggcctcccac

SEQ ID NO: 5422658 - DNA, 18 bp, Homo sapiens
gccctcaataagccagca

SEQ ID NO: 5422659 - DNA, 13 bp, Homo sapiens
gccctcacccctg

SEQ ID NO: 5422660 - DNA, 19 bp, Homo sapiens
gccctcacccctgccctgg

SEQ ID NO: 5422661 - DNA, 18 bp, Homo sapiens
gccctcacccctggttct

SEQ ID NO: 5422662 - DNA, 22 bp, Homo sapiens
gccctcacccctggttctcatc

SEQ ID NO: 5422663 - DNA, 15 bp, Homo sapiens
gccctcaccctgggg

SEQ ID NO: 5422664 - DNA, 16 bp, Homo sapiens
gccctcaccctggggc

SEQ ID NO: 5422665 - DNA, 17 bp, Homo sapiens
gccctcaccctggggct

SEQ ID NO: 5422666 - DNA, 13 bp, Homo sapiens
gccctcacctccc

SEQ ID NO: 5422667 - DNA, 17 bp, Homo sapiens
gccctcacctctgagga

SEQ ID NO: 5422668 - DNA, 18 bp, Homo sapiens
gccctcacctctgaggac

SEQ ID NO: 5422669 - DNA, 15 bp, Homo sapiens
gccctcacctctgat

SEQ ID NO: 5422670 - DNA, 15 bp, Homo sapiens
gccctcactcaggaa

SEQ ID NO: 5422671 - DNA, 21 bp, Homo sapiens
gccctcactcaggaaccctgg

SEQ ID NO: 5422672 - DNA, 19 bp, Homo sapiens
gccctcactccactcccct

SEQ ID NO: 5422673 - DNA, 20 bp, Homo sapiens
gccctcactccactcccctc

SEQ ID NO: 5422674 - DNA, 16 bp, Homo sapiens
gccctcactcttgaag

SEQ ID NO: 5422675 - DNA, 23 bp, Homo sapiens
gccctcagaacccttggcttgcc

SEQ ID NO: 5422676 - DNA, 21 bp, Homo sapiens
gccctcagagctcttgctgtt

SEQ ID NO: 5422677 - DNA, 17 bp, Homo sapiens
gccctcagaggaaaggc

SEQ ID NO: 5422678 - DNA, 16 bp, Homo sapiens
gccctcagatcccagg

SEQ ID NO: 5422679 - DNA, 17 bp, Homo sapiens
gccctcagatcccaggg

SEQ ID NO: 5422680 - DNA, 20 bp, Homo sapiens
gccctcagatcccagggtac

SEQ ID NO: 5422681 - DNA, 17 bp, Homo sapiens
gccctcagatgtccctt

SEQ ID NO: 5422682 - DNA, 19 bp, Homo sapiens
gccctcagctccctgaccc

SEQ ID NO: 5422683 - DNA, 21 bp, Homo sapiens
gccctcagctggtcctgacca

SEQ ID NO: 5422684 - DNA, 11 bp, Homo sapiens
gccctcaggcc

SEQ ID NO: 5422685 - DNA, 12 bp, Homo sapiens
gccctcaggcca

SEQ ID NO: 5422686 - DNA, 13 bp, Homo sapiens
gccctcaggccag

SEQ ID NO: 5422687 - DNA, 20 bp, Homo sapiens
gccctcaggccagtgccagg

SEQ ID NO: 5422688 - DNA, 21 bp, Homo sapiens
gccctcaggccattccccaac

SEQ ID NO: 5422689 - DNA, 16 bp, Homo sapiens
gccctcaggctcccca

SEQ ID NO: 5422690 - DNA, 16 bp, Homo sapiens
gccctcaggcttgggg

SEQ ID NO: 5422691 - DNA, 18 bp, Homo sapiens
gccctcaggggcctctct

SEQ ID NO: 5422692 - DNA, 23 bp, Homo sapiens
gccctcaggtcagggtgaggatg

SEQ ID NO: 5422693 - DNA, 21 bp, Homo sapiens
gccctcagtcacccccacttc

SEQ ID NO: 5422694 - DNA, 23 bp, Homo sapiens
gccctcagtcagttcccggagca

SEQ ID NO: 5422695 - DNA, 21 bp, Homo sapiens
gccctcagtgggctccctggc

SEQ ID NO: 5422696 - DNA, 16 bp, Homo sapiens
gccctcagttccttca

SEQ ID NO: 5422697 - DNA, 17 bp, Homo sapiens
gccctcagttccttcat

SEQ ID NO: 5422698 - DNA, 24 bp, Homo sapiens
gccctcataaaccaatgtggcaag

SEQ ID NO: 5422699 - DNA, 19 bp, Homo sapiens
gccctcatccgtattcttt

SEQ ID NO: 5422700 - DNA, 14 bp, Homo sapiens
gccctcatctccag

SEQ ID NO: 5422701 - DNA, 21 bp, Homo sapiens
gccctcatgggacctgccctc

SEQ ID NO: 5422702 - DNA, 23 bp, Homo sapiens
gccctcatgggtcctagcccttc

SEQ ID NO: 5422703 - DNA, 20 bp, Homo sapiens
gccctcattacggctcctct

SEQ ID NO: 5422704 - DNA, 18 bp, Homo sapiens
gccctcattactgggcct

SEQ ID NO: 5422705 - DNA, 19 bp, Homo sapiens
gccctcattactgggcctt

SEQ ID NO: 5422706 - DNA, 21 bp, Homo sapiens
gccctcattactgggccttag

SEQ ID NO: 5422707 - DNA, 14 bp, Homo sapiens
gccctccaaaagca

SEQ ID NO: 5422708 - DNA, 19 bp, Homo sapiens
gccctccaagaccttctcc

SEQ ID NO: 5422709 - DNA, 21 bp, Homo sapiens
gccctccaagaccttctcctt

SEQ ID NO: 5422710 - DNA, 15 bp, Homo sapiens
gccctccacacccgc

SEQ ID NO: 5422711 - DNA, 17 bp, Homo sapiens
gccctccacccactagg

SEQ ID NO: 5422712 - DNA, 15 bp, Homo sapiens
gccctccactccagc

SEQ ID NO: 5422713 - DNA, 12 bp, Homo sapiens
gccctccagagc

SEQ ID NO: 5422714 - DNA, 13 bp, Homo sapiens
gccctccagagca

SEQ ID NO: 5422715 - DNA, 16 bp, Homo sapiens
gccctccagagcagga

SEQ ID NO: 5422716 - DNA, 18 bp, Homo sapiens
gccctccagagccccaca

SEQ ID NO: 5422717 - DNA, 17 bp, Homo sapiens
gccctccagctctttcc

SEQ ID NO: 5422718 - DNA, 21 bp, Homo sapiens
gccctccagctctttcctcct

SEQ ID NO: 5422719 - DNA, 18 bp, Homo sapiens
gccctccagctgctgctc

SEQ ID NO: 5422720 - DNA, 13 bp, Homo sapiens
gccctccagggcc

SEQ ID NO: 5422721 - DNA, 15 bp, Homo sapiens
gccctccagggccag

SEQ ID NO: 5422722 - DNA, 21 bp, Homo sapiens
gccctccagtgggctgatgct

SEQ ID NO: 5422723 - DNA, 16 bp, Homo sapiens
gccctccatcccgaca

SEQ ID NO: 5422724 - DNA, 14 bp, Homo sapiens
gccctccatccgtg

SEQ ID NO: 5422725 - DNA, 15 bp, Homo sapiens
gccctccatggcctg

SEQ ID NO: 5422726 - DNA, 23 bp, Homo sapiens
gccctccatggtcctgtctgtcc

SEQ ID NO: 5422727 - DNA, 12 bp, Homo sapiens
gccctcccaaag

SEQ ID NO: 5422728 - DNA, 14 bp, Homo sapiens
gccctcccaagtcc

SEQ ID NO: 5422729 - DNA, 13 bp, Homo sapiens
gccctcccacagc

SEQ ID NO: 5422730 - DNA, 15 bp, Homo sapiens
gccctcccacagcct

SEQ ID NO: 5422731 - DNA, 15 bp, Homo sapiens
gccctcccaccaccc

SEQ ID NO: 5422732 - DNA, 15 bp, Homo sapiens
gccctcccaccccct

SEQ ID NO: 5422733 - DNA, 18 bp, Homo sapiens
gccctcccaccccctccc

SEQ ID NO: 5422734 - DNA, 20 bp, Homo sapiens
gccctcccaccccctccccg

SEQ ID NO: 5422735 - DNA, 22 bp, Homo sapiens
gccctcccaccccctccccggg

SEQ ID NO: 5422736 - DNA, 16 bp, Homo sapiens
gccctcccacctccgc

SEQ ID NO: 5422737 - DNA, 23 bp, Homo sapiens
gccctcccactttgctgttcctt

SEQ ID NO: 5422738 - DNA, 17 bp, Homo sapiens
gccctcccagaccccct

SEQ ID NO: 5422739 - DNA, 22 bp, Homo sapiens
gccctcccagacccccttgccc

SEQ ID NO: 5422740 - DNA, 24 bp, Homo sapiens
gccctcccagcaagtttcaccttg

SEQ ID NO: 5422741 - DNA, 15 bp, Homo sapiens
gccctcccagcccat

SEQ ID NO: 5422742 - DNA, 21 bp, Homo sapiens
gccctcccaggctctcaacag

SEQ ID NO: 5422743 - DNA, 14 bp, Homo sapiens
gccctccccacctg

SEQ ID NO: 5422744 - DNA, 19 bp, Homo sapiens
gccctccccatggagccag

SEQ ID NO: 5422745 - DNA, 13 bp, Homo sapiens
gccctcccccacg

SEQ ID NO: 5422746 - DNA, 16 bp, Homo sapiens
gccctcccccagctcc

SEQ ID NO: 5422747 - DNA, 16 bp, Homo sapiens
gccctccccccagctc

SEQ ID NO: 5422748 - DNA, 17 bp, Homo sapiens
gccctccccccagctcc

SEQ ID NO: 5422749 - DNA, 22 bp, Homo sapiens
gccctccccccagctccctgca

SEQ ID NO: 5422750 - DNA, 16 bp, Homo sapiens
gccctccccctcaacc

SEQ ID NO: 5422751 - DNA, 22 bp, Homo sapiens
gccctccccctcaacctcacca

SEQ ID NO: 5422752 - DNA, 17 bp, Homo sapiens
gccctccccctgccaga

SEQ ID NO: 5422753 - DNA, 19 bp, Homo sapiens
gccctccccctgccagagg

SEQ ID NO: 5422754 - DNA, 22 bp, Homo sapiens
gccctccccctgccagaggcct

SEQ ID NO: 5422755 - DNA, 23 bp, Homo sapiens
gccctcccccttccccttctgtg

SEQ ID NO: 5422756 - DNA, 14 bp, Homo sapiens
gccctcccctcagc

SEQ ID NO: 5422757 - DNA, 16 bp, Homo sapiens
gccctgcctgcccact

SEQ ID NO: 5422758 - DNA, 11 bp, Homo sapiens
gccctgcctgg

SEQ ID NO: 5422759 - DNA, 13 bp, Homo sapiens
gccctgcctggag

SEQ ID NO: 5422760 - DNA, 14 bp, Homo sapiens
gccctgcctggagg

SEQ ID NO: 5422761 - DNA, 16 bp, Homo sapiens
gccctgcctggaggac

SEQ ID NO: 5422762 - DNA, 18 bp, Homo sapiens
gccctgcctggaggacct

SEQ ID NO: 5422763 - DNA, 20 bp, Homo sapiens
gccctgcctggaggacctga

SEQ ID NO: 5422764 - DNA, 23 bp, Homo sapiens
gccctgcctggaggacctgagcc

SEQ ID NO: 5422765 - DNA, 20 bp, Homo sapiens
gccctgcctgggccttggct

SEQ ID NO: 5422766 - DNA, 14 bp, Homo sapiens
gccctgccttcagc

SEQ ID NO: 5422767 - DNA, 13 bp, Homo sapiens
gccctgccttgcc

SEQ ID NO: 5422768 - DNA, 21 bp, Homo sapiens
gccctgccttgccgctcccct

SEQ ID NO: 5422769 - DNA, 17 bp, Homo sapiens
gccctgccttgctgcct

SEQ ID NO: 5422770 - DNA, 22 bp, Homo sapiens
gccctgcgaagtggctctcagg

SEQ ID NO: 5422771 - DNA, 15 bp, Homo sapiens
gccctgcgccctgtg

SEQ ID NO: 5422772 - DNA, 16 bp, Homo sapiens
gccctgcgccctgtgc

SEQ ID NO: 5422773 - DNA, 22 bp, Homo sapiens
gccctgcgctaacactgtcctg

SEQ ID NO: 5422774 - DNA, 14 bp, Homo sapiens
gccctgcggagacc

SEQ ID NO: 5422775 - DNA, 14 bp, Homo sapiens
gccctgcggctctg

SEQ ID NO: 5422776 - DNA, 19 bp, Homo sapiens
gccctgcggctctggaaag

SEQ ID NO: 5422777 - DNA, 19 bp, Homo sapiens
gccctgcgtaaccctcgcc

SEQ ID NO: 5422778 - DNA, 23 bp, Homo sapiens
gccctgcgtaaccctcgccctgt

SEQ ID NO: 5422779 - DNA, 17 bp, Homo sapiens
gccctgcgtcccttctc

SEQ ID NO: 5422780 - DNA, 23 bp, Homo sapiens
gccctgctatttcaggccctcag

SEQ ID NO: 5422781 - DNA, 15 bp, Homo sapiens
gccctgctcaggcct

SEQ ID NO: 5422782 - DNA, 17 bp, Homo sapiens
gccctgctccaactcca

SEQ ID NO: 5422783 - DNA, 13 bp, Homo sapiens
gccctgctccctg

SEQ ID NO: 5422784 - DNA, 18 bp, Homo sapiens
gccctgctccctgcctcc

SEQ ID NO: 5422785 - DNA, 22 bp, Homo sapiens
gccctgctcctccctggctgcc

SEQ ID NO: 5422786 - DNA, 16 bp, Homo sapiens
gccctgctctgcccag

SEQ ID NO: 5422787 - DNA, 17 bp, Homo sapiens
gccctgctctgcccagg

SEQ ID NO: 5422788 - DNA, 22 bp, Homo sapiens
gccctgctcttctctccccagc

SEQ ID NO: 5422789 - DNA, 18 bp, Homo sapiens
gccctgctctttctctga

SEQ ID NO: 5422790 - DNA, 20 bp, Homo sapiens
gccctgctgaagctgctgca

SEQ ID NO: 5422791 - DNA, 22 bp, Homo sapiens
gccctgctgaagctgctgcagc

SEQ ID NO: 5422792 - DNA, 15 bp, Homo sapiens
gccctgctgagcaca

SEQ ID NO: 5422793 - DNA, 13 bp, Homo sapiens
gccctgctgagtc

SEQ ID NO: 5422794 - DNA, 22 bp, Homo sapiens
gccctgctgagtcccaggctga

SEQ ID NO: 5422795 - DNA, 16 bp, Homo sapiens
gccctgctgccacagc

SEQ ID NO: 5422796 - DNA, 12 bp, Homo sapiens
gccctgctgccc

SEQ ID NO: 5422797 - DNA, 13 bp, Homo sapiens
gccctgctgccct

SEQ ID NO: 5422798 - DNA, 14 bp, Homo sapiens
gccctgctgccctc

SEQ ID NO: 5422799 - DNA, 22 bp, Homo sapiens
gccctgctgccgcctcccagcc

SEQ ID NO: 5422800 - DNA, 22 bp, Homo sapiens
gccctgctgctgacccagcctg

SEQ ID NO: 5422801 - DNA, 20 bp, Homo sapiens
gccctgctggccgcctcacc

SEQ ID NO: 5422802 - DNA, 22 bp, Homo sapiens
gccctgctggccgcctcacccc

SEQ ID NO: 5422803 - DNA, 23 bp, Homo sapiens
gccctgctggccgcctcaccccc

SEQ ID NO: 5422804 - DNA, 16 bp, Homo sapiens
gccctgctggcctgtc

SEQ ID NO: 5422805 - DNA, 21 bp, Homo sapiens
gccctgctggggatccccgcc

SEQ ID NO: 5422806 - DNA, 23 bp, Homo sapiens
gccctgctgtcagaccttcttcc

SEQ ID NO: 5422807 - DNA, 14 bp, Homo sapiens
gccctgctttcaga

SEQ ID NO: 5422808 - DNA, 13 bp, Homo sapiens
gccctgctttgca

SEQ ID NO: 5422809 - DNA, 16 bp, Homo sapiens
gccctgctttgcaaac

SEQ ID NO: 5422810 - DNA, 18 bp, Homo sapiens
gccctgctttgggctgcc

SEQ ID NO: 5422811 - DNA, 20 bp, Homo sapiens
gccctgctttgggctgccct

SEQ ID NO: 5422812 - DNA, 22 bp, Homo sapiens
gccctgctttgggctgccctgg

SEQ ID NO: 5422813 - DNA, 11 bp, Homo sapiens
gccctgctttt

SEQ ID NO: 5422814 - DNA, 12 bp, Homo sapiens
gccctgcttttt

SEQ ID NO: 5422815 - DNA, 16 bp, Homo sapiens
gccctgctttttttct

SEQ ID NO: 5422816 - DNA, 20 bp, Homo sapiens
gccctggaagccggcggccc

SEQ ID NO: 5422817 - DNA, 16 bp, Homo sapiens
gccctggacacagccc

SEQ ID NO: 5422818 - DNA, 20 bp, Homo sapiens
gccctggacagatggcccaa

SEQ ID NO: 5422819 - DNA, 22 bp, Homo sapiens
gccctggacagatggcccaagg

SEQ ID NO: 5422820 - DNA, 18 bp, Homo sapiens
gccctggaccttgggcct

SEQ ID NO: 5422821 - DNA, 16 bp, Homo sapiens
gccctggactgtgtgc

SEQ ID NO: 5422822 - DNA, 22 bp, Homo sapiens
gccctggagaccccaccagcct

SEQ ID NO: 5422823 - DNA, 18 bp, Homo sapiens
gccctggagagccccatg

SEQ ID NO: 5422824 - DNA, 15 bp, Homo sapiens
gccctggagcagcca

SEQ ID NO: 5422825 - DNA, 18 bp, Homo sapiens
gccctggagccaactgct

SEQ ID NO: 5422826 - DNA, 15 bp, Homo sapiens
gccctggagccaggg

SEQ ID NO: 5422827 - DNA, 14 bp, Homo sapiens
gccctggagctcaa

SEQ ID NO: 5422828 - DNA, 16 bp, Homo sapiens
gccctggagctcaggg

SEQ ID NO: 5422829 - DNA, 12 bp, Homo sapiens
gccctggaggat

SEQ ID NO: 5422830 - DNA, 19 bp, Homo sapiens
gccctggaggccgctgctg

SEQ ID NO: 5422831 - DNA, 15 bp, Homo sapiens
gccctggaggcggtg

SEQ ID NO: 5422832 - DNA, 22 bp, Homo sapiens
gccctggaggctggatggctcc

SEQ ID NO: 5422833 - DNA, 14 bp, Homo sapiens
gccctggagggagg

SEQ ID NO: 5422834 - DNA, 14 bp, Homo sapiens
gccctggagggcag

SEQ ID NO: 5422835 - DNA, 16 bp, Homo sapiens
gccctggaggggccca

SEQ ID NO: 5422836 - DNA, 18 bp, Homo sapiens
gccctggaggtctccagg

SEQ ID NO: 5422837 - DNA, 18 bp, Homo sapiens
gccctggaggtgccagca

SEQ ID NO: 5422838 - DNA, 15 bp, Homo sapiens
gccctggaggtggct

SEQ ID NO: 5422839 - DNA, 18 bp, Homo sapiens
gccctggaggtggctgag

SEQ ID NO: 5422840 - DNA, 15 bp, Homo sapiens
gccctggagtcatgc

SEQ ID NO: 5422841 - DNA, 19 bp, Homo sapiens
gccctggagtcatgccaag

SEQ ID NO: 5422842 - DNA, 20 bp, Homo sapiens
gccctggagtcatgccaagc

SEQ ID NO: 5422843 - DNA, 20 bp, Homo sapiens
gccctggatcagcgtggcct

SEQ ID NO: 5422844 - DNA, 14 bp, Homo sapiens
gccctggatggcct

SEQ ID NO: 5422845 - DNA, 19 bp, Homo sapiens
gccctggatggcctctggg

SEQ ID NO: 5422846 - DNA, 21 bp, Homo sapiens
gccctggatggcctctggggc

SEQ ID NO: 5422847 - DNA, 23 bp, Homo sapiens
gccctggatggcctctggggcag

SEQ ID NO: 5422848 - DNA, 15 bp, Homo sapiens
gccctggatggtggc

SEQ ID NO: 5422849 - DNA, 18 bp, Homo sapiens
gccctggatgtgcccaca

SEQ ID NO: 5422850 - DNA, 20 bp, Homo sapiens
gccctggatgtgcccacagg

SEQ ID NO: 5422851 - DNA, 18 bp, Homo sapiens
gccctggatttcagaaag

SEQ ID NO: 5422852 - DNA, 20 bp, Homo sapiens
gccctggcacccccacaagc

SEQ ID NO: 5422853 - DNA, 12 bp, Homo sapiens
gccctggcagaa

SEQ ID NO: 5422854 - DNA, 16 bp, Homo sapiens
gccctggcagcagcag

SEQ ID NO: 5422855 - DNA, 12 bp, Homo sapiens
gccctggcagga

SEQ ID NO: 5422856 - DNA, 16 bp, Homo sapiens
gccctggcaggcaggg

SEQ ID NO: 5422857 - DNA, 15 bp, Homo sapiens
gccctggcatgtcaa

SEQ ID NO: 5422858 - DNA, 15 bp, Homo sapiens
gccctggccaagctt

SEQ ID NO: 5422859 - DNA, 15 bp, Homo sapiens
gccctggccactggc

SEQ ID NO: 5422860 - DNA, 16 bp, Homo sapiens
gccctggccactggcc

SEQ ID NO: 5422861 - DNA, 18 bp, Homo sapiens
gccctggccactggccct

SEQ ID NO: 5422862 - DNA, 16 bp, Homo sapiens
gccctggccagaggct

SEQ ID NO: 5422863 - DNA, 16 bp, Homo sapiens
gccctggccagccctt

SEQ ID NO: 5422864 - DNA, 14 bp, Homo sapiens
gccctggccagccg

SEQ ID NO: 5422865 - DNA, 15 bp, Homo sapiens
gccctggccagccgg

SEQ ID NO: 5422866 - DNA, 13 bp, Homo sapiens
gccctggcccacc

SEQ ID NO: 5422867 - DNA, 22 bp, Homo sapiens
gccctggcccaccccccagcct

SEQ ID NO: 5422868 - DNA, 21 bp, Homo sapiens
gccctggcccagcctgtggcc

SEQ ID NO: 5422869 - DNA, 13 bp, Homo sapiens
gccctggcccagg

SEQ ID NO: 5422870 - DNA, 17 bp, Homo sapiens
gccctggcccaggtgcc

SEQ ID NO: 5422871 - DNA, 21 bp, Homo sapiens
gccctggcccccatcagccct

SEQ ID NO: 5422872 - DNA, 22 bp, Homo sapiens
gccctggcccccatcagccctg

SEQ ID NO: 5422873 - DNA, 16 bp, Homo sapiens
gccctggcccctgtgg

SEQ ID NO: 5422874 - DNA, 14 bp, Homo sapiens
gccctggccctgcc

SEQ ID NO: 5422875 - DNA, 17 bp, Homo sapiens
gccctggccctgcccag

SEQ ID NO: 5422876 - DNA, 18 bp, Homo sapiens
gccctggccctgcccagc

SEQ ID NO: 5422877 - DNA, 12 bp, Homo sapiens
gccctggccctt

SEQ ID NO: 5422878 - DNA, 15 bp, Homo sapiens
gccctggccctttcc

SEQ ID NO: 5422879 - DNA, 23 bp, Homo sapiens
gccctggccctttccccttcccc

SEQ ID NO: 5422880 - DNA, 10 bp, Homo sapiens
gccctggcct

SEQ ID NO: 5422881 - DNA, 12 bp, Homo sapiens
gccctggcctac

SEQ ID NO: 5422882 - DNA, 13 bp, Homo sapiens
gccctggcctacc

SEQ ID NO: 5422883 - DNA, 16 bp, Homo sapiens
gccctggcctaccaca

SEQ ID NO: 5422884 - DNA, 19 bp, Homo sapiens
gccctggcctaccacagct

SEQ ID NO: 5422885 - DNA, 22 bp, Homo sapiens
gccctggcctaccacagctgcc

SEQ ID NO: 5422886 - DNA, 23 bp, Homo sapiens
gccctggcctaccacagctgcct

SEQ ID NO: 5422887 - DNA, 12 bp, Homo sapiens
gccctggcctcc

SEQ ID NO: 5422888 - DNA, 19 bp, Homo sapiens
gccctggcctcccctgcca

SEQ ID NO: 5422889 - DNA, 16 bp, Homo sapiens
gccctggcctgctggg

SEQ ID NO: 5422890 - DNA, 16 bp, Homo sapiens
gccctggcgggtggct

SEQ ID NO: 5422891 - DNA, 17 bp, Homo sapiens
gccctggcgggtggctg

SEQ ID NO: 5422892 - DNA, 18 bp, Homo sapiens
gccctggcgggtggctgc

SEQ ID NO: 5422893 - DNA, 20 bp, Homo sapiens
gccctggctcccacaggccc

SEQ ID NO: 5422894 - DNA, 17 bp, Homo sapiens
gccctggctcccacctg

SEQ ID NO: 5422895 - DNA, 14 bp, Homo sapiens
gccctggctccttg

SEQ ID NO: 5422896 - DNA, 19 bp, Homo sapiens
gccctggctccttgcagca

SEQ ID NO: 5422897 - DNA, 23 bp, Homo sapiens
gccctggctccttgcagcagggc

SEQ ID NO: 5422898 - DNA, 14 bp, Homo sapiens
gccctggctctgcc

SEQ ID NO: 5422899 - DNA, 15 bp, Homo sapiens
gccctggctctgccc

SEQ ID NO: 5422900 - DNA, 16 bp, Homo sapiens
gccctggctctgcccc

SEQ ID NO: 5422901 - DNA, 17 bp, Homo sapiens
gccctggctctgcccct

SEQ ID NO: 5422902 - DNA, 17 bp, Homo sapiens
gccctggctctttagaa

SEQ ID NO: 5422903 - DNA, 15 bp, Homo sapiens
gccctggctgaagga

SEQ ID NO: 5422904 - DNA, 16 bp, Homo sapiens
gccctggctgaaggac

SEQ ID NO: 5422905 - DNA, 18 bp, Homo sapiens
gccctggctgaaggactg

SEQ ID NO: 5422906 - DNA, 20 bp, Homo sapiens
gccctggctgaaggactgtg

SEQ ID NO: 5422907 - DNA, 16 bp, Homo sapiens
gccctggctgctgccc

SEQ ID NO: 5422908 - DNA, 19 bp, Homo sapiens
gccctggctgctgccccca

SEQ ID NO: 5422909 - DNA, 12 bp, Homo sapiens
gccctggctgtg

SEQ ID NO: 5422910 - DNA, 23 bp, Homo sapiens
gccctgggaaaccccttctctgt

SEQ ID NO: 5422911 - DNA, 15 bp, Homo sapiens
gccctgggaaccact

SEQ ID NO: 5422912 - DNA, 15 bp, Homo sapiens
gccctgggaggctct

SEQ ID NO: 5422913 - DNA, 22 bp, Homo sapiens
gccctgggcaaggaagctttgg

SEQ ID NO: 5422914 - DNA, 12 bp, Homo sapiens
gccctgggccag

SEQ ID NO: 5422915 - DNA, 20 bp, Homo sapiens
gccctgggccagcccaggat

SEQ ID NO: 5422916 - DNA, 15 bp, Homo sapiens
gccctgggccaggca

SEQ ID NO: 5422917 - DNA, 19 bp, Homo sapiens
gccctgggccaggcaggcg

SEQ ID NO: 5422918 - DNA, 20 bp, Homo sapiens
gccctgggccccaccaccta

SEQ ID NO: 5422919 - DNA, 16 bp, Homo sapiens
gccctgggccccgcct

SEQ ID NO: 5422920 - DNA, 17 bp, Homo sapiens
gccctgggccccgcctc

SEQ ID NO: 5422921 - DNA, 19 bp, Homo sapiens
gccctgggccccgcctcaa

SEQ ID NO: 5422922 - DNA, 12 bp, Homo sapiens
gccctgggcctc

SEQ ID NO: 5422923 - DNA, 15 bp, Homo sapiens
gccctgggcctcagt

SEQ ID NO: 5422924 - DNA, 16 bp, Homo sapiens
gccctgggcctccacc

SEQ ID NO: 5422925 - DNA, 18 bp, Homo sapiens
gccctgggcctccacctc

SEQ ID NO: 5422926 - DNA, 15 bp, Homo sapiens
gccctgggcctgcct

SEQ ID NO: 5422927 - DNA, 14 bp, Homo sapiens
gccctgggcgagcc

SEQ ID NO: 5422928 - DNA, 21 bp, Homo sapiens
gccctgggcgcagctgaagcc

SEQ ID NO: 5422929 - DNA, 13 bp, Homo sapiens
gccctgggctcct

SEQ ID NO: 5422930 - DNA, 16 bp, Homo sapiens
gccctgggctcctctt

SEQ ID NO: 5422931 - DNA, 17 bp, Homo sapiens
gccctgggctcggaggc

SEQ ID NO: 5422932 - DNA, 23 bp, Homo sapiens
gccctgggctcggaggctgcccc

SEQ ID NO: 5422933 - DNA, 14 bp, Homo sapiens
gccctgggctctgg

SEQ ID NO: 5422934 - DNA, 17 bp, Homo sapiens
gccctgggctctgggtt

SEQ ID NO: 5422935 - DNA, 15 bp, Homo sapiens
gccctgggctgatgg

SEQ ID NO: 5422936 - DNA, 13 bp, Homo sapiens
gccgacgcctgtg

SEQ ID NO: 5422937 - DNA, 18 bp, Homo sapiens
gccgacgcttgcacgacc

SEQ ID NO: 5422938 - DNA, 11 bp, Homo sapiens
gccgactcagg

SEQ ID NO: 5422939 - DNA, 16 bp, Homo sapiens
gccgactcagggacct

SEQ ID NO: 5422940 - DNA, 14 bp, Homo sapiens
gccgactggctgtg

SEQ ID NO: 5422941 - DNA, 21 bp, Homo sapiens
gccgactttgtaccccccaac

SEQ ID NO: 5422942 - DNA, 23 bp, Homo sapiens
gccgagaccccatcttccagcca

SEQ ID NO: 5422943 - DNA, 14 bp, Homo sapiens
gccgagacctcaag

SEQ ID NO: 5422944 - DNA, 22 bp, Homo sapiens
gccgagacctcaagccctgagg

SEQ ID NO: 5422945 - DNA, 16 bp, Homo sapiens
gccgagagcctgctcc

SEQ ID NO: 5422946 - DNA, 22 bp, Homo sapiens
gccgagagcctgctcccccacc

SEQ ID NO: 5422947 - DNA, 21 bp, Homo sapiens
gccgagaggacagaatggata

SEQ ID NO: 5422948 - DNA, 15 bp, Homo sapiens
gccgagatcacacca

SEQ ID NO: 5422949 - DNA, 22 bp, Homo sapiens
gccgagatcacaccactgtact

SEQ ID NO: 5422950 - DNA, 18 bp, Homo sapiens
gccgagatcacgccactg

SEQ ID NO: 5422951 - DNA, 19 bp, Homo sapiens
gccgagatcacgccactgc

SEQ ID NO: 5422952 - DNA, 17 bp, Homo sapiens
gccgagattgcaccact

SEQ ID NO: 5422953 - DNA, 19 bp, Homo sapiens
gccgagattgcaccactgc

SEQ ID NO: 5422954 - DNA, 19 bp, Homo sapiens
gccgagcaaccgtggccct

SEQ ID NO: 5422955 - DNA, 20 bp, Homo sapiens
gccgagcaaccgtggccctt

SEQ ID NO: 5422956 - DNA, 14 bp, Homo sapiens
gccgagccagcaag

SEQ ID NO: 5422957 - DNA, 14 bp, Homo sapiens
gccgagcccacacc

SEQ ID NO: 5422958 - DNA, 19 bp, Homo sapiens
gccgagcccacaccatctg

SEQ ID NO: 5422959 - DNA, 22 bp, Homo sapiens
gccgagcccacaccatctggcc

SEQ ID NO: 5422960 - DNA, 13 bp, Homo sapiens
gccgagcccagct

SEQ ID NO: 5422961 - DNA, 15 bp, Homo sapiens
gccgagccgggcctg

SEQ ID NO: 5422962 - DNA, 16 bp, Homo sapiens
gccgagctcctgggga

SEQ ID NO: 5422963 - DNA, 23 bp, Homo sapiens
gccgagctcctggggagctcctg

SEQ ID NO: 5422964 - DNA, 22 bp, Homo sapiens
gccgagctcgtgtatcctgggg

SEQ ID NO: 5422965 - DNA, 23 bp, Homo sapiens
gccgagctcgtgtatcctggggc

SEQ ID NO: 5422966 - DNA, 16 bp, Homo sapiens
gccgagctgcctggcg

SEQ ID NO: 5422967 - DNA, 20 bp, Homo sapiens
gccgagctgtcggagggctg

SEQ ID NO: 5422968 - DNA, 21 bp, Homo sapiens
gccgagctgtcggagggctgg

SEQ ID NO: 5422969 - DNA, 19 bp, Homo sapiens
gccgaggaagggcccccgg

SEQ ID NO: 5422970 - DNA, 16 bp, Homo sapiens
gccgaggaccaccagc

SEQ ID NO: 5422971 - DNA, 22 bp, Homo sapiens
gccgaggaccaccagcaggcag

SEQ ID NO: 5422972 - DNA, 16 bp, Homo sapiens
gccgaggagcgcccgg

SEQ ID NO: 5422973 - DNA, 18 bp, Homo sapiens
gccgaggaggtgcctgga

SEQ ID NO: 5422974 - DNA, 18 bp, Homo sapiens
gccgaggcaggggctggg

SEQ ID NO: 5422975 - DNA, 20 bp, Homo sapiens
gccgaggcaggggctgggca

SEQ ID NO: 5422976 - DNA, 12 bp, Homo sapiens
gccgaggcctgg

SEQ ID NO: 5422977 - DNA, 13 bp, Homo sapiens
gccgagggccagg

SEQ ID NO: 5422978 - DNA, 15 bp, Homo sapiens
gccgagggccaggca

SEQ ID NO: 5422979 - DNA, 17 bp, Homo sapiens
gccgaggggagagaggg

SEQ ID NO: 5422980 - DNA, 21 bp, Homo sapiens
gccgaggtcactctgggcctg

SEQ ID NO: 5422981 - DNA, 13 bp, Homo sapiens
gccgaggtcccat

SEQ ID NO: 5422982 - DNA, 19 bp, Homo sapiens
gccgaggtccctgctgcca

SEQ ID NO: 5422983 - DNA, 20 bp, Homo sapiens
gccgaggtgggtggattgcc

SEQ ID NO: 5422984 - DNA, 15 bp, Homo sapiens
gccgagtccaagctg

SEQ ID NO: 5422985 - DNA, 20 bp, Homo sapiens
gccgagtccaggagccccag

SEQ ID NO: 5422986 - DNA, 21 bp, Homo sapiens
gccgagtccaggagccccagc

SEQ ID NO: 5422987 - DNA, 18 bp, Homo sapiens
gccgagtctgtcctggaa

SEQ ID NO: 5422988 - DNA, 21 bp, Homo sapiens
gccgatagagggacggccaag

SEQ ID NO: 5422989 - DNA, 13 bp, Homo sapiens
gccgatgagctgg

SEQ ID NO: 5422990 - DNA, 13 bp, Homo sapiens
gccgatggaaaat

SEQ ID NO: 5422991 - DNA, 16 bp, Homo sapiens
gccgattcctccagcc

SEQ ID NO: 5422992 - DNA, 20 bp, Homo sapiens
gccgatttcctaagctgttg

SEQ ID NO: 5422993 - DNA, 16 bp, Homo sapiens
gccgcaaaccacactg

SEQ ID NO: 5422994 - DNA, 21 bp, Homo sapiens
gccgcaaatccataccccctg

SEQ ID NO: 5422995 - DNA, 22 bp, Homo sapiens
gccgcaaatccataccccctgc

SEQ ID NO: 5422996 - DNA, 22 bp, Homo sapiens
gccgcaaattgtaccttttttg

SEQ ID NO: 5422997 - DNA, 15 bp, Homo sapiens
gccgcaagctctcag

SEQ ID NO: 5422998 - DNA, 14 bp, Homo sapiens
gccgcaagggcctg

SEQ ID NO: 5422999 - DNA, 15 bp, Homo sapiens
gccgcaagggcctgg

SEQ ID NO: 5423000 - DNA, 16 bp, Homo sapiens
gccgcaagggcctgga

SEQ ID NO: 5423001 - DNA, 17 bp, Homo sapiens
gccgcaagggcctggac

SEQ ID NO: 5423002 - DNA, 23 bp, Homo sapiens
gccgcaagggcctggacggggtc

SEQ ID NO: 5423003 - DNA, 22 bp, Homo sapiens
gccgcaatctggctcctcctgg

SEQ ID NO: 5423004 - DNA, 12 bp, Homo sapiens
gccgcaccagcc

SEQ ID NO: 5423005 - DNA, 13 bp, Homo sapiens
gccgcaccccaga

SEQ ID NO: 5423006 - DNA, 15 bp, Homo sapiens
gccgcaccccagagt

SEQ ID NO: 5423007 - DNA, 20 bp, Homo sapiens
gccgcacctaaagcagccag

SEQ ID NO: 5423008 - DNA, 19 bp, Homo sapiens
gccgcacgcctctccctgc

SEQ ID NO: 5423009 - DNA, 12 bp, Homo sapiens
gccgcagaagca

SEQ ID NO: 5423010 - DNA, 22 bp, Homo sapiens
gccgcagaagcagcccctcgag

SEQ ID NO: 5423011 - DNA, 18 bp, Homo sapiens
gccgcagacgggcacaga

SEQ ID NO: 5423012 - DNA, 14 bp, Homo sapiens
gccgcagagaaatg

SEQ ID NO: 5423013 - DNA, 12 bp, Homo sapiens
gccgcagagctg

SEQ ID NO: 5423014 - DNA, 21 bp, Homo sapiens
gccgcagaggtgtaggggtgg

SEQ ID NO: 5423015 - DNA, 22 bp, Homo sapiens
gccgcagccacaccgctggctc

SEQ ID NO: 5423016 - DNA, 16 bp, Homo sapiens
gccgcagcccccactg

SEQ ID NO: 5423017 - DNA, 12 bp, Homo sapiens
gccgcagccctg

SEQ ID NO: 5423018 - DNA, 17 bp, Homo sapiens
gccgcagccctgcagag

SEQ ID NO: 5423019 - DNA, 20 bp, Homo sapiens
gccgcagccctgcagagggc

SEQ ID NO: 5423020 - DNA, 14 bp, Homo sapiens
gccgcagcggtggg

SEQ ID NO: 5423021 - DNA, 14 bp, Homo sapiens
gccgcagctcttgc

SEQ ID NO: 5423022 - DNA, 14 bp, Homo sapiens
gccgcaggagggag

SEQ ID NO: 5423023 - DNA, 15 bp, Homo sapiens
gccgcaggagggagg

SEQ ID NO: 5423024 - DNA, 20 bp, Homo sapiens
gccgcagggacagaactgaa

SEQ ID NO: 5423025 - DNA, 17 bp, Homo sapiens
gccgcagggacggggac

SEQ ID NO: 5423026 - DNA, 19 bp, Homo sapiens
gccgcagggcccaccttgg

SEQ ID NO: 5423027 - DNA, 21 bp, Homo sapiens
gccgcagggcgctccggcaga

SEQ ID NO: 5423028 - DNA, 14 bp, Homo sapiens
gccgcaggtgggtg

SEQ ID NO: 5423029 - DNA, 22 bp, Homo sapiens
gccgcaggtgggtgctgccctg

SEQ ID NO: 5423030 - DNA, 15 bp, Homo sapiens
gccgcatctcacagc

SEQ ID NO: 5423031 - DNA, 18 bp, Homo sapiens
gccgcatctcacagctat

SEQ ID NO: 5423032 - DNA, 17 bp, Homo sapiens
gccgcatctgcctggag

SEQ ID NO: 5423033 - DNA, 19 bp, Homo sapiens
gccgcatctgcctggagcc

SEQ ID NO: 5423034 - DNA, 20 bp, Homo sapiens
gccgcatctgcctggagcct

SEQ ID NO: 5423035 - DNA, 17 bp, Homo sapiens
gccgcatcttctccatc

SEQ ID NO: 5423036 - DNA, 18 bp, Homo sapiens
gccgcatcttctccatct

SEQ ID NO: 5423037 - DNA, 12 bp, Homo sapiens
gccgcatggccc

SEQ ID NO: 5423038 - DNA, 14 bp, Homo sapiens
gccgcatggcccct

SEQ ID NO: 5423039 - DNA, 16 bp, Homo sapiens
gccgcattccctgagt

SEQ ID NO: 5423040 - DNA, 13 bp, Homo sapiens
gccgccaccagcc

SEQ ID NO: 5423041 - DNA, 15 bp, Homo sapiens
gccgccacccccatc

SEQ ID NO: 5423042 - DNA, 21 bp, Homo sapiens
gccgccacccccatcttccac

SEQ ID NO: 5423043 - DNA, 22 bp, Homo sapiens
gccgccacctgaggtgggctgg

SEQ ID NO: 5423044 - DNA, 20 bp, Homo sapiens
gccgccactaggtgtcccca

SEQ ID NO: 5423045 - DNA, 13 bp, Homo sapiens
gccgccactggct

SEQ ID NO: 5423046 - DNA, 19 bp, Homo sapiens
gccgccagcgtgtggagca

SEQ ID NO: 5423047 - DNA, 11 bp, Homo sapiens
gccgccagctg

SEQ ID NO: 5423048 - DNA, 16 bp, Homo sapiens
gccgccagctgccgca

SEQ ID NO: 5423049 - DNA, 17 bp, Homo sapiens
gccgccagctgccgcac

SEQ ID NO: 5423050 - DNA, 15 bp, Homo sapiens
gccgccagctgggag

SEQ ID NO: 5423051 - DNA, 17 bp, Homo sapiens
gccgccagtacttgtca

SEQ ID NO: 5423052 - DNA, 18 bp, Homo sapiens
gccgccagttcatctttt

SEQ ID NO: 5423053 - DNA, 16 bp, Homo sapiens
gccgccatcagcccaa

SEQ ID NO: 5423054 - DNA, 15 bp, Homo sapiens
gccgccatccgggac

SEQ ID NO: 5423055 - DNA, 17 bp, Homo sapiens
gccgccattgccaccag

SEQ ID NO: 5423056 - DNA, 21 bp, Homo sapiens
gccgccattgccaccaggaga

SEQ ID NO: 5423057 - DNA, 14 bp, Homo sapiens
gccgcccaaggccc

SEQ ID NO: 5423058 - DNA, 15 bp, Homo sapiens
gccgcccacctcgct

SEQ ID NO: 5423059 - DNA, 19 bp, Homo sapiens
gccgcccacctcgctcccc

SEQ ID NO: 5423060 - DNA, 13 bp, Homo sapiens
gccgcccacctgc

SEQ ID NO: 5423061 - DNA, 13 bp, Homo sapiens
gccgcccacgccg

SEQ ID NO: 5423062 - DNA, 18 bp, Homo sapiens
gccgcccagacaccacag

SEQ ID NO: 5423063 - DNA, 19 bp, Homo sapiens
gccgcccagacaccacaga

SEQ ID NO: 5423064 - DNA, 19 bp, Homo sapiens
gccgccccagcctctgagc

SEQ ID NO: 5423065 - DNA, 22 bp, Homo sapiens
gccgcccccacctgcggccgcc

SEQ ID NO: 5423066 - DNA, 14 bp, Homo sapiens
gccgcccccgcctg

SEQ ID NO: 5423067 - DNA, 16 bp, Homo sapiens
gccgcccccgcctggg

SEQ ID NO: 5423068 - DNA, 17 bp, Homo sapiens
gccgccccgccccagag

SEQ ID NO: 5423069 - DNA, 20 bp, Homo sapiens
gccgccccgccccagagctc

SEQ ID NO: 5423070 - DNA, 16 bp, Homo sapiens
gccgccccgtgcctgt

SEQ ID NO: 5423071 - DNA, 15 bp, Homo sapiens
gccgcccctgaggct

SEQ ID NO: 5423072 - DNA, 23 bp, Homo sapiens
gccgcccgctcccttcctgccac

SEQ ID NO: 5423073 - DNA, 16 bp, Homo sapiens
gccgcccgggcccaga

SEQ ID NO: 5423074 - DNA, 18 bp, Homo sapiens
gccgcccgggcccagagg

SEQ ID NO: 5423075 - DNA, 12 bp, Homo sapiens
gccgccctccat

SEQ ID NO: 5423076 - DNA, 16 bp, Homo sapiens
gccgccctggacagat

SEQ ID NO: 5423077 - DNA, 15 bp, Homo sapiens
gccgccctgggctgt

SEQ ID NO: 5423078 - DNA, 20 bp, Homo sapiens
gccgccgaagggcagccccg

SEQ ID NO: 5423079 - DNA, 23 bp, Homo sapiens
gccgccgaagggcagccccgcga

SEQ ID NO: 5423080 - DNA, 24 bp, Homo sapiens
gccgccgaagggcagccccgcgac

SEQ ID NO: 5423081 - DNA, 14 bp, Homo sapiens
gccgccgcagctgg

SEQ ID NO: 5423082 - DNA, 15 bp, Homo sapiens
gccgccgcccacgcc

SEQ ID NO: 5423083 - DNA, 14 bp, Homo sapiens
gccgccgcccgctg

SEQ ID NO: 5423084 - DNA, 15 bp, Homo sapiens
gccgccgcccgctgg

SEQ ID NO: 5423085 - DNA, 15 bp, Homo sapiens
gccgccgccgccgcc

SEQ ID NO: 5423086 - DNA, 15 bp, Homo sapiens
gccgccgcctcgccc

SEQ ID NO: 5423087 - DNA, 16 bp, Homo sapiens
gccgccgcctcgccca

SEQ ID NO: 5423088 - DNA, 13 bp, Homo sapiens
gccgccgcgggtg

SEQ ID NO: 5423089 - DNA, 23 bp, Homo sapiens
gccgccgctaggtagagtctgag

SEQ ID NO: 5423090 - DNA, 17 bp, Homo sapiens
gccgccggaagtggctc

SEQ ID NO: 5423091 - DNA, 18 bp, Homo sapiens
gccgccgtctctgtcccg

SEQ ID NO: 5423092 - DNA, 21 bp, Homo sapiens
gccgccgtgacctattcaccc

SEQ ID NO: 5423093 - DNA, 19 bp, Homo sapiens
gccgccgtggtgacccctg

SEQ ID NO: 5423094 - DNA, 18 bp, Homo sapiens
gccgccgttgagggctga

SEQ ID NO: 5423095 - DNA, 16 bp, Homo sapiens
gccgcctactggacgc

SEQ ID NO: 5423096 - DNA, 17 bp, Homo sapiens
gccgcctaggctcagcg

SEQ ID NO: 5423097 - DNA, 13 bp, Homo sapiens
gccgcctcaatgt

SEQ ID NO: 5423098 - DNA, 13 bp, Homo sapiens
gccgcctcacctt

SEQ ID NO: 5423099 - DNA, 19 bp, Homo sapiens
gccgcctcaccttccttga

SEQ ID NO: 5423100 - DNA, 13 bp, Homo sapiens
gccgcctccagga

SEQ ID NO: 5423101 - DNA, 16 bp, Homo sapiens
gccgcctccaggagcc

SEQ ID NO: 5423102 - DNA, 13 bp, Homo sapiens
gccgcctcccacg

SEQ ID NO: 5423103 - DNA, 16 bp, Homo sapiens
gccgcctcccagcctg

SEQ ID NO: 5423104 - DNA, 19 bp, Homo sapiens
gccgcctccctcacccggc

SEQ ID NO: 5423105 - DNA, 20 bp, Homo sapiens
gccgcctccctcacccggca

SEQ ID NO: 5423106 - DNA, 12 bp, Homo sapiens
gccgcctcctcc

SEQ ID NO: 5423107 - DNA, 14 bp, Homo sapiens
gccgcctcctccag

SEQ ID NO: 5423108 - DNA, 23 bp, Homo sapiens
gccgcctcctcggggctccaggc

SEQ ID NO: 5423109 - DNA, 21 bp, Homo sapiens
gccgcctcggagtgtggcctg

SEQ ID NO: 5423110 - DNA, 22 bp, Homo sapiens
gccgcctcggagtgtggcctgg

SEQ ID NO: 5423111 - DNA, 20 bp, Homo sapiens
gccgcctctcctccatcttc

SEQ ID NO: 5423112 - DNA, 15 bp, Homo sapiens
gccgcctgccctgcc

SEQ ID NO: 5423113 - DNA, 16 bp, Homo sapiens
gccgcctgccctgcct

SEQ ID NO: 5423114 - DNA, 21 bp, Homo sapiens
gcctagcatggggtcagcccc

SEQ ID NO: 5423115 - DNA, 22 bp, Homo sapiens
gcctagcatggggtcagcccca

SEQ ID NO: 5423116 - DNA, 18 bp, Homo sapiens
gcctagccacctcccacc

SEQ ID NO: 5423117 - DNA, 14 bp, Homo sapiens
gcctagcccaccct

SEQ ID NO: 5423118 - DNA, 18 bp, Homo sapiens
gcctagcccaccctgctg

SEQ ID NO: 5423119 - DNA, 23 bp, Homo sapiens
gcctagcccaccctgctgccttc

SEQ ID NO: 5423120 - DNA, 21 bp, Homo sapiens
gcctagccccaggtcttttct

SEQ ID NO: 5423121 - DNA, 13 bp, Homo sapiens
gcctagccctccc

SEQ ID NO: 5423122 - DNA, 19 bp, Homo sapiens
gcctagccgacctcagcct

SEQ ID NO: 5423123 - DNA, 14 bp, Homo sapiens
gcctagcctggctc

SEQ ID NO: 5423124 - DNA, 16 bp, Homo sapiens
gcctagcctggctctg

SEQ ID NO: 5423125 - DNA, 17 bp, Homo sapiens
gcctagcctggctctgc

SEQ ID NO: 5423126 - DNA, 20 bp, Homo sapiens
gcctagcgatctctcctggc

SEQ ID NO: 5423127 - DNA, 21 bp, Homo sapiens
gcctagcgatctctcctggcc

SEQ ID NO: 5423128 - DNA, 17 bp, Homo sapiens
gcctagcggagcccagc

SEQ ID NO: 5423129 - DNA, 20 bp, Homo sapiens
gcctagcggagcccagcctg

SEQ ID NO: 5423130 - DNA, 21 bp, Homo sapiens
gcctagcggagcccagcctgg

SEQ ID NO: 5423131 - DNA, 22 bp, Homo sapiens
gcctagctaccttctctaccca

SEQ ID NO: 5423132 - DNA, 16 bp, Homo sapiens
gcctagctcctgccac

SEQ ID NO: 5423133 - DNA, 18 bp, Homo sapiens
gcctagctcttgggcctg

SEQ ID NO: 5423134 - DNA, 23 bp, Homo sapiens
gcctagctcttgggcctgacctc

SEQ ID NO: 5423135 - DNA, 24 bp, Homo sapiens
gcctagctgctacaaagaagacat

SEQ ID NO: 5423136 - DNA, 22 bp, Homo sapiens
gcctaggaccactcagccccta

SEQ ID NO: 5423137 - DNA, 12 bp, Homo sapiens
gcctaggaccta

SEQ ID NO: 5423138 - DNA, 20 bp, Homo sapiens
gcctaggacctatgttgtaa

SEQ ID NO: 5423139 - DNA, 12 bp, Homo sapiens
gcctaggagctg

SEQ ID NO: 5423140 - DNA, 22 bp, Homo sapiens
gcctaggagctggctggcaggt

SEQ ID NO: 5423141 - DNA, 22 bp, Homo sapiens
gcctaggagctggggagggaga

SEQ ID NO: 5423142 - DNA, 17 bp, Homo sapiens
gcctaggatcttcactg

SEQ ID NO: 5423143 - DNA, 23 bp, Homo sapiens
gcctaggattcacaccccacctg

SEQ ID NO: 5423144 - DNA, 12 bp, Homo sapiens
gcctaggattct

SEQ ID NO: 5423145 - DNA, 14 bp, Homo sapiens
gcctaggatttcag

SEQ ID NO: 5423146 - DNA, 22 bp, Homo sapiens
gcctaggcacctccccgctctc

SEQ ID NO: 5423147 - DNA, 14 bp, Homo sapiens
gcctaggccagctc

SEQ ID NO: 5423148 - DNA, 13 bp, Homo sapiens
gcctaggccaggt

SEQ ID NO: 5423149 - DNA, 14 bp, Homo sapiens
gcctaggccaggtg

SEQ ID NO: 5423150 - DNA, 17 bp, Homo sapiens
gcctaggcctagtcctg

SEQ ID NO: 5423151 - DNA, 13 bp, Homo sapiens
gcctaggcctcag

SEQ ID NO: 5423152 - DNA, 17 bp, Homo sapiens
gcctaggcctcagccag

SEQ ID NO: 5423153 - DNA, 16 bp, Homo sapiens
gcctaggcctgggcag

SEQ ID NO: 5423154 - DNA, 17 bp, Homo sapiens
gcctaggcctgggcagt

SEQ ID NO: 5423155 - DNA, 15 bp, Homo sapiens
gcctaggcttggctc

SEQ ID NO: 5423156 - DNA, 22 bp, Homo sapiens
gcctaggggtcagggaccaagg

SEQ ID NO: 5423157 - DNA, 21 bp, Homo sapiens
gcctagggttgcttgggccac

SEQ ID NO: 5423158 - DNA, 18 bp, Homo sapiens
gcctaggtcccccaagca

SEQ ID NO: 5423159 - DNA, 15 bp, Homo sapiens
gcctaggtcccttcc

SEQ ID NO: 5423160 - DNA, 20 bp, Homo sapiens
gcctaggtgacagagtgaga

SEQ ID NO: 5423161 - DNA, 16 bp, Homo sapiens
gcctaggtgcagctcc

SEQ ID NO: 5423162 - DNA, 16 bp, Homo sapiens
gcctaggtgggagcca

SEQ ID NO: 5423163 - DNA, 20 bp, Homo sapiens
gcctaggtgggagccaccac

SEQ ID NO: 5423164 - DNA, 23 bp, Homo sapiens
gcctaggtgttgtcagcaggcag

SEQ ID NO: 5423165 - DNA, 18 bp, Homo sapiens
gcctagtaaatgttaact

SEQ ID NO: 5423166 - DNA, 14 bp, Homo sapiens
gcctagtaaccaag

SEQ ID NO: 5423167 - DNA, 17 bp, Homo sapiens
gcctagtaaccaaggcc

SEQ ID NO: 5423168 - DNA, 19 bp, Homo sapiens
gcctagtaaccaaggccct

SEQ ID NO: 5423169 - DNA, 14 bp, Homo sapiens
gcctagtaggagct

SEQ ID NO: 5423170 - DNA, 14 bp, Homo sapiens
gcctagtattgaca

SEQ ID NO: 5423171 - DNA, 15 bp, Homo sapiens
gcctagtcagccaca

SEQ ID NO: 5423172 - DNA, 18 bp, Homo sapiens
gcctagtcagccacatgg

SEQ ID NO: 5423173 - DNA, 14 bp, Homo sapiens
gcctagtcccttcc

SEQ ID NO: 5423174 - DNA, 22 bp, Homo sapiens
gcctagtgaaggcttctctctg

SEQ ID NO: 5423175 - DNA, 18 bp, Homo sapiens
gcctagtggcttcagccc

SEQ ID NO: 5423176 - DNA, 23 bp, Homo sapiens
gcctagtggcttcagcccctggg

SEQ ID NO: 5423177 - DNA, 17 bp, Homo sapiens
gcctagttcatccaatc

SEQ ID NO: 5423178 - DNA, 22 bp, Homo sapiens
gcctagtttcttacacactgtc

SEQ ID NO: 5423179 - DNA, 24 bp, Homo sapiens
gcctataaatttactctgttgaat

SEQ ID NO: 5423180 - DNA, 15 bp, Homo sapiens
gcctataactttttt

SEQ ID NO: 5423181 - DNA, 18 bp, Homo sapiens
gcctataatcccagcatt

SEQ ID NO: 5423182 - DNA, 16 bp, Homo sapiens
gcctataatcccagct

SEQ ID NO: 5423183 - DNA, 19 bp, Homo sapiens
gcctataatcccagctact

SEQ ID NO: 5423184 - DNA, 20 bp, Homo sapiens
gcctataatcccagctactg

SEQ ID NO: 5423185 - DNA, 18 bp, Homo sapiens
gcctataatcttatacaa

SEQ ID NO: 5423186 - DNA, 18 bp, Homo sapiens
gcctatacgtttctgtgg

SEQ ID NO: 5423187 - DNA, 20 bp, Homo sapiens
gcctatagattgatttacct

SEQ ID NO: 5423188 - DNA, 21 bp, Homo sapiens
gcctatagattgatttacctt

SEQ ID NO: 5423189 - DNA, 15 bp, Homo sapiens
gcctatagtaaatgt

SEQ ID NO: 5423190 - DNA, 13 bp, Homo sapiens
gcctatagtccca

SEQ ID NO: 5423191 - DNA, 15 bp, Homo sapiens
gcctatagtcccact

SEQ ID NO: 5423192 - DNA, 16 bp, Homo sapiens
gcctatatatgtaaat

SEQ ID NO: 5423193 - DNA, 17 bp, Homo sapiens
gcctatatatgtaaata

SEQ ID NO: 5423194 - DNA, 15 bp, Homo sapiens
gcctatatctgagag

SEQ ID NO: 5423195 - DNA, 16 bp, Homo sapiens
gcctatatttataaac

SEQ ID NO: 5423196 - DNA, 19 bp, Homo sapiens
gcctatcaggtgcccctct

SEQ ID NO: 5423197 - DNA, 16 bp, Homo sapiens
gcctatcagtgtgccc

SEQ ID NO: 5423198 - DNA, 18 bp, Homo sapiens
gcctatcagtgtgccccc

SEQ ID NO: 5423199 - DNA, 19 bp, Homo sapiens
gcctatcagtgtgcccccc

SEQ ID NO: 5423200 - DNA, 14 bp, Homo sapiens
gcctatccatcctg

SEQ ID NO: 5423201 - DNA, 15 bp, Homo sapiens
gcctatccatcctgc

SEQ ID NO: 5423202 - DNA, 18 bp, Homo sapiens
gcctatctgcctggaggc

SEQ ID NO: 5423203 - DNA, 12 bp, Homo sapiens
gcctatcttagg

SEQ ID NO: 5423204 - DNA, 14 bp, Homo sapiens
gcctatctttaaac

SEQ ID NO: 5423205 - DNA, 13 bp, Homo sapiens
gcctatgaaactg

SEQ ID NO: 5423206 - DNA, 18 bp, Homo sapiens
gcctatgaaactggttta

SEQ ID NO: 5423207 - DNA, 18 bp, Homo sapiens
gcctatgacttgggcacc

SEQ ID NO: 5423208 - DNA, 19 bp, Homo sapiens
gcctatgatactgtctctc

SEQ ID NO: 5423209 - DNA, 15 bp, Homo sapiens
gcctatgatcccagc

SEQ ID NO: 5423210 - DNA, 14 bp, Homo sapiens
gcctatgcacatat

SEQ ID NO: 5423211 - DNA, 22 bp, Homo sapiens
gcctatgcacatatggactctg

SEQ ID NO: 5423212 - DNA, 17 bp, Homo sapiens
gcctatgcactgaagag

SEQ ID NO: 5423213 - DNA, 18 bp, Homo sapiens
gcctatgcactgaagagc

SEQ ID NO: 5423214 - DNA, 23 bp, Homo sapiens
gcctatgcactgaagagctcttg

SEQ ID NO: 5423215 - DNA, 16 bp, Homo sapiens
gcctatgccctgccct

SEQ ID NO: 5423216 - DNA, 14 bp, Homo sapiens
gcctatggagagcc

SEQ ID NO: 5423217 - DNA, 21 bp, Homo sapiens
gcctatggagagccctgggac

SEQ ID NO: 5423218 - DNA, 16 bp, Homo sapiens
gcctatggcagaaaaa

SEQ ID NO: 5423219 - DNA, 15 bp, Homo sapiens
gcctatgtctcctct

SEQ ID NO: 5423220 - DNA, 14 bp, Homo sapiens
gcctatgtctggca

SEQ ID NO: 5423221 - DNA, 16 bp, Homo sapiens
gcctatgtctggcaga

SEQ ID NO: 5423222 - DNA, 22 bp, Homo sapiens
gcctatgtgcatgcagcatcta

SEQ ID NO: 5423223 - DNA, 21 bp, Homo sapiens
gcctattatctgtcagctgca

SEQ ID NO: 5423224 - DNA, 22 bp, Homo sapiens
gcctattccaggaattcctctt

SEQ ID NO: 5423225 - DNA, 23 bp, Homo sapiens
gcctattgctagagctcctccct

SEQ ID NO: 5423226 - DNA, 20 bp, Homo sapiens
gcctattgcttgggtctctc

SEQ ID NO: 5423227 - DNA, 21 bp, Homo sapiens
gcctattgcttgggtctctct

SEQ ID NO: 5423228 - DNA, 20 bp, Homo sapiens
gcctattgttgaataaatgt

SEQ ID NO: 5423229 - DNA, 13 bp, Homo sapiens
gcctatttactgg

SEQ ID NO: 5423230 - DNA, 16 bp, Homo sapiens
gcctatttattggggt

SEQ ID NO: 5423231 - DNA, 21 bp, Homo sapiens
gcctatttcagtggcacgtca

SEQ ID NO: 5423232 - DNA, 12 bp, Homo sapiens
gcctatttcccc

SEQ ID NO: 5423233 - DNA, 13 bp, Homo sapiens
gcctatttgtgtg

SEQ ID NO: 5423234 - DNA, 19 bp, Homo sapiens
gcctcaaaaacgccctcaa

SEQ ID NO: 5423235 - DNA, 22 bp, Homo sapiens
gcctcaaaaacgccctcaagaa

SEQ ID NO: 5423236 - DNA, 15 bp, Homo sapiens
gcctcaaatccagga

SEQ ID NO: 5423237 - DNA, 19 bp, Homo sapiens
gcctcaaatccaggaccct

SEQ ID NO: 5423238 - DNA, 14 bp, Homo sapiens
gcctcaacagcagg

SEQ ID NO: 5423239 - DNA, 15 bp, Homo sapiens
gcctcaacagcagga

SEQ ID NO: 5423240 - DNA, 22 bp, Homo sapiens
gcctcaacagcaggaggcacag

SEQ ID NO: 5423241 - DNA, 15 bp, Homo sapiens
gcctcaaccctccct

SEQ ID NO: 5423242 - DNA, 17 bp, Homo sapiens
gcctcaaccctccctca

SEQ ID NO: 5423243 - DNA, 19 bp, Homo sapiens
gcctcaaccctccctcagc

SEQ ID NO: 5423244 - DNA, 15 bp, Homo sapiens
gcctcaacctcccaa

SEQ ID NO: 5423245 - DNA, 18 bp, Homo sapiens
gcctcaacctcctgggct

SEQ ID NO: 5423246 - DNA, 16 bp, Homo sapiens
gcctcaaccttctggg

SEQ ID NO: 5423247 - DNA, 19 bp, Homo sapiens
gcctcaagaaaggcccgga

SEQ ID NO: 5423248 - DNA, 23 bp, Homo sapiens
gcctcaagaaatatactctccca

SEQ ID NO: 5423249 - DNA, 17 bp, Homo sapiens
gcctcaagagcacacag

SEQ ID NO: 5423250 - DNA, 21 bp, Homo sapiens
gcctcaagcaatccacctgcc

SEQ ID NO: 5423251 - DNA, 19 bp, Homo sapiens
gcctcaagccatcttcccg

SEQ ID NO: 5423252 - DNA, 15 bp, Homo sapiens
gcctcaagcgatcct

SEQ ID NO: 5423253 - DNA, 13 bp, Homo sapiens
gcctcaagcgtgg

SEQ ID NO: 5423254 - DNA, 23 bp, Homo sapiens
gcctcaaggaagagccagccgta

SEQ ID NO: 5423255 - DNA, 21 bp, Homo sapiens
gcctcaaggttttaggttcta

SEQ ID NO: 5423256 - DNA, 22 bp, Homo sapiens
gcctcaagtgattctcctgcct

SEQ ID NO: 5423257 - DNA, 13 bp, Homo sapiens
gcctcaagttcaa

SEQ ID NO: 5423258 - DNA, 20 bp, Homo sapiens
gcctcaagttccagtgcaga

SEQ ID NO: 5423259 - DNA, 21 bp, Homo sapiens
gcctcaagttccatgcttgag

SEQ ID NO: 5423260 - DNA, 23 bp, Homo sapiens
gcctcaatctaaggccttccctg

SEQ ID NO: 5423261 - DNA, 17 bp, Homo sapiens
gcctcaatgtgaccagg

SEQ ID NO: 5423262 - DNA, 17 bp, Homo sapiens
gcctcacaaatgctgtg

SEQ ID NO: 5423263 - DNA, 18 bp, Homo sapiens
gcctcacaaatgctgtgg

SEQ ID NO: 5423264 - DNA, 14 bp, Homo sapiens
gcctcacagatgct

SEQ ID NO: 5423265 - DNA, 15 bp, Homo sapiens
gcctcacagcagtga

SEQ ID NO: 5423266 - DNA, 21 bp, Homo sapiens
gcctcacagtccttaccagca

SEQ ID NO: 5423267 - DNA, 14 bp, Homo sapiens
gcctcacatctccc

SEQ ID NO: 5423268 - DNA, 23 bp, Homo sapiens
gcctcacattcccccggtgcctc

SEQ ID NO: 5423269 - DNA, 19 bp, Homo sapiens
gcctcacatttttttctac

SEQ ID NO: 5423270 - DNA, 14 bp, Homo sapiens
gcctcaccacaccc

SEQ ID NO: 5423271 - DNA, 21 bp, Homo sapiens
gcctcaccacacccaggtctc

SEQ ID NO: 5423272 - DNA, 15 bp, Homo sapiens
gcctcaccaggccca

SEQ ID NO: 5423273 - DNA, 20 bp, Homo sapiens
gcctcacccacccctgcaca

SEQ ID NO: 5423274 - DNA, 15 bp, Homo sapiens
gcctcacccagaagg

SEQ ID NO: 5423275 - DNA, 16 bp, Homo sapiens
gcctcacccagaagga

SEQ ID NO: 5423276 - DNA, 16 bp, Homo sapiens
gcctcaccccctcggg

SEQ ID NO: 5423277 - DNA, 23 bp, Homo sapiens
gcctcaccccctcgggtctcctc

SEQ ID NO: 5423278 - DNA, 11 bp, Homo sapiens
gcctcacccct

SEQ ID NO: 5423279 - DNA, 19 bp, Homo sapiens
gcctcacccctcccctggg

SEQ ID NO: 5423280 - DNA, 20 bp, Homo sapiens
gcctcacccctcccctggga

SEQ ID NO: 5423281 - DNA, 21 bp, Homo sapiens
gcctcacccctcccctgggac

SEQ ID NO: 5423282 - DNA, 22 bp, Homo sapiens
gcctcacccctcccctgggact

SEQ ID NO: 5423283 - DNA, 14 bp, Homo sapiens
gcctcacccctgca

SEQ ID NO: 5423284 - DNA, 17 bp, Homo sapiens
gcctcacccctgcaggc

SEQ ID NO: 5423285 - DNA, 15 bp, Homo sapiens
gcctcacccctgccc

SEQ ID NO: 5423286 - DNA, 17 bp, Homo sapiens
gcctcacccctgcccct

SEQ ID NO: 5423287 - DNA, 19 bp, Homo sapiens
gcctcaccctcccaagtag

SEQ ID NO: 5423288 - DNA, 15 bp, Homo sapiens
gcctcaccctgcttg

SEQ ID NO: 5423289 - DNA, 20 bp, Homo sapiens
gcctcaccctgcttggggcc

SEQ ID NO: 5423290 - DNA, 16 bp, Homo sapiens
gcctccccacatatgg

SEQ ID NO: 5423291 - DNA, 17 bp, Homo sapiens
gcctccccaccctcctc

SEQ ID NO: 5423292 - DNA, 19 bp, Homo sapiens
gcctccccacggccgctcc

SEQ ID NO: 5423293 - DNA, 20 bp, Homo sapiens
gcctccccatacttcctggg

SEQ ID NO: 5423294 - DNA, 22 bp, Homo sapiens
gcctccccatacttcctgggat

SEQ ID NO: 5423295 - DNA, 24 bp, Homo sapiens
gcctccccatacttcctgggatga

SEQ ID NO: 5423296 - DNA, 18 bp, Homo sapiens
gcctccccatttcccatc

SEQ ID NO: 5423297 - DNA, 20 bp, Homo sapiens
gcctccccatttcccatctg

SEQ ID NO: 5423298 - DNA, 13 bp, Homo sapiens
gcctcccccaaag

SEQ ID NO: 5423299 - DNA, 16 bp, Homo sapiens
gcctcccccaggctgc

SEQ ID NO: 5423300 - DNA, 19 bp, Homo sapiens
gcctcccccaggctgcgcc

SEQ ID NO: 5423301 - DNA, 20 bp, Homo sapiens
gcctccccccagaccccgcc

SEQ ID NO: 5423302 - DNA, 19 bp, Homo sapiens
gcctccccccagcccctcc

SEQ ID NO: 5423303 - DNA, 17 bp, Homo sapiens
gcctcccccgccagccc

SEQ ID NO: 5423304 - DNA, 22 bp, Homo sapiens
gcctccccctcccccattccct

SEQ ID NO: 5423305 - DNA, 21 bp, Homo sapiens
gcctccccgggggtccccgga

SEQ ID NO: 5423306 - DNA, 20 bp, Homo sapiens
gcctcccctccatgggcgtc

SEQ ID NO: 5423307 - DNA, 14 bp, Homo sapiens
gcctcccctcccct

SEQ ID NO: 5423308 - DNA, 17 bp, Homo sapiens
gcctcccctcccctggg

SEQ ID NO: 5423309 - DNA, 20 bp, Homo sapiens
gcctcccctcccctggggac

SEQ ID NO: 5423310 - DNA, 19 bp, Homo sapiens
gcctcccctcctctgcttg

SEQ ID NO: 5423311 - DNA, 15 bp, Homo sapiens
gcctcccctgaggat

SEQ ID NO: 5423312 - DNA, 20 bp, Homo sapiens
gcctcccctgaggatcccct

SEQ ID NO: 5423313 - DNA, 13 bp, Homo sapiens
gcctcccctgcgg

SEQ ID NO: 5423314 - DNA, 24 bp, Homo sapiens
gcctcccctgcggagctgcatgga

SEQ ID NO: 5423315 - DNA, 13 bp, Homo sapiens
gcctcccctgggc

SEQ ID NO: 5423316 - DNA, 15 bp, Homo sapiens
gcctcccctgggcag

SEQ ID NO: 5423317 - DNA, 16 bp, Homo sapiens
gcctcccctgtgcagt

SEQ ID NO: 5423318 - DNA, 13 bp, Homo sapiens
gcctccccttccc

SEQ ID NO: 5423319 - DNA, 15 bp, Homo sapiens
gcctccccttcccag

SEQ ID NO: 5423320 - DNA, 19 bp, Homo sapiens
gcctccccttcttcccgcc

SEQ ID NO: 5423321 - DNA, 17 bp, Homo sapiens
gcctcccgaggaggggc

SEQ ID NO: 5423322 - DNA, 18 bp, Homo sapiens
gcctcccgagtagctggg

SEQ ID NO: 5423323 - DNA, 19 bp, Homo sapiens
gcctcccgagtagctggga

SEQ ID NO: 5423324 - DNA, 20 bp, Homo sapiens
gcctcccgagtagctgggac

SEQ ID NO: 5423325 - DNA, 23 bp, Homo sapiens
gcctcccgagtagctgggactac

SEQ ID NO: 5423326 - DNA, 19 bp, Homo sapiens
gcctcccgcatgctgcctg

SEQ ID NO: 5423327 - DNA, 16 bp, Homo sapiens
gcctcccgccaccctg

SEQ ID NO: 5423328 - DNA, 19 bp, Homo sapiens
gcctcccgccaccctgtct

SEQ ID NO: 5423329 - DNA, 21 bp, Homo sapiens
gcctcccgccaccctgtctca

SEQ ID NO: 5423330 - DNA, 17 bp, Homo sapiens
gcctcccgcctcccccg

SEQ ID NO: 5423331 - DNA, 19 bp, Homo sapiens
gcctcccgcgttgggcaac

SEQ ID NO: 5423332 - DNA, 20 bp, Homo sapiens
gcctcccggctttgcaggga

SEQ ID NO: 5423333 - DNA, 20 bp, Homo sapiens
gcctcccgggaagcatcctc

SEQ ID NO: 5423334 - DNA, 23 bp, Homo sapiens
gcctcccgggaagcatcctcccc

SEQ ID NO: 5423335 - DNA, 19 bp, Homo sapiens
gcctcccggggcccaggac

SEQ ID NO: 5423336 - DNA, 17 bp, Homo sapiens
gcctcccggggtgcccg

SEQ ID NO: 5423337 - DNA, 16 bp, Homo sapiens
gcctccctagtagctg

SEQ ID NO: 5423338 - DNA, 13 bp, Homo sapiens
gcctccctcaacc

SEQ ID NO: 5423339 - DNA, 17 bp, Homo sapiens
gcctccctcaccctgag

SEQ ID NO: 5423340 - DNA, 13 bp, Homo sapiens
gcctccctcagcc

SEQ ID NO: 5423341 - DNA, 18 bp, Homo sapiens
gcctccctcaggctctgt

SEQ ID NO: 5423342 - DNA, 14 bp, Homo sapiens
gcctccctccaccc

SEQ ID NO: 5423343 - DNA, 20 bp, Homo sapiens
gcctccctccaccccaggac

SEQ ID NO: 5423344 - DNA, 12 bp, Homo sapiens
gcctccctccag

SEQ ID NO: 5423345 - DNA, 16 bp, Homo sapiens
gcctccctccagagac

SEQ ID NO: 5423346 - DNA, 14 bp, Homo sapiens
gcctccctcctcgt

SEQ ID NO: 5423347 - DNA, 16 bp, Homo sapiens
gcctccctcctgcccc

SEQ ID NO: 5423348 - DNA, 16 bp, Homo sapiens
gcctccctccttgggt

SEQ ID NO: 5423349 - DNA, 22 bp, Homo sapiens
gcctccctctcagaggcctgct

SEQ ID NO: 5423350 - DNA, 23 bp, Homo sapiens
gcctccctctcagaggcctgctg

SEQ ID NO: 5423351 - DNA, 21 bp, Homo sapiens
gcctccctctccatatctcct

SEQ ID NO: 5423352 - DNA, 12 bp, Homo sapiens
gcctccctctga

SEQ ID NO: 5423353 - DNA, 20 bp, Homo sapiens
gcctccctctgacctgcagg

SEQ ID NO: 5423354 - DNA, 15 bp, Homo sapiens
gcctccctgagcctg

SEQ ID NO: 5423355 - DNA, 13 bp, Homo sapiens
gcctccctgagct

SEQ ID NO: 5423356 - DNA, 16 bp, Homo sapiens
gcctccctgcacttca

SEQ ID NO: 5423357 - DNA, 15 bp, Homo sapiens
gcctccctgcagcca

SEQ ID NO: 5423358 - DNA, 16 bp, Homo sapiens
gcctccctggctcctc

SEQ ID NO: 5423359 - DNA, 17 bp, Homo sapiens
gcctccctggctcctcc

SEQ ID NO: 5423360 - DNA, 21 bp, Homo sapiens
gcctccctggggaccaggagc

SEQ ID NO: 5423361 - DNA, 22 bp, Homo sapiens
gcctccctggggaccaggagct

SEQ ID NO: 5423362 - DNA, 16 bp, Homo sapiens
gcctccctggtccctt

SEQ ID NO: 5423363 - DNA, 13 bp, Homo sapiens
gcctccctgtctc

SEQ ID NO: 5423364 - DNA, 21 bp, Homo sapiens
gcctccctgttgaagctctgg

SEQ ID NO: 5423365 - DNA, 20 bp, Homo sapiens
gcctcccttcatgcatggaa

SEQ ID NO: 5423366 - DNA, 19 bp, Homo sapiens
gcctcccttccatgcccca

SEQ ID NO: 5423367 - DNA, 12 bp, Homo sapiens
gcctcccttcct

SEQ ID NO: 5423368 - DNA, 18 bp, Homo sapiens
gcctcccttcctccgctc

SEQ ID NO: 5423369 - DNA, 22 bp, Homo sapiens
gcctcccttgagtaggccctgc

SEQ ID NO: 5423370 - DNA, 15 bp, Homo sapiens
gcctcccttgggctg

SEQ ID NO: 5423371 - DNA, 14 bp, Homo sapiens
gcctcccttgtggc

SEQ ID NO: 5423372 - DNA, 17 bp, Homo sapiens
gcctccctttgccagcc

SEQ ID NO: 5423373 - DNA, 23 bp, Homo sapiens
gcctccctttgccagccacccct

SEQ ID NO: 5423374 - DNA, 16 bp, Homo sapiens
gcctccctttggggag

SEQ ID NO: 5423375 - DNA, 15 bp, Homo sapiens
gcctcccttttctcc

SEQ ID NO: 5423376 - DNA, 18 bp, Homo sapiens
gcctcccttttctcctct

SEQ ID NO: 5423377 - DNA, 14 bp, Homo sapiens
gcctccgacgctgc

SEQ ID NO: 5423378 - DNA, 17 bp, Homo sapiens
gcctccgaggctccccg

SEQ ID NO: 5423379 - DNA, 21 bp, Homo sapiens
gcctccgagggacgcggctcc

SEQ ID NO: 5423380 - DNA, 22 bp, Homo sapiens
gcctccgcacctgaccgctgcc

SEQ ID NO: 5423381 - DNA, 17 bp, Homo sapiens
gcctccgcagtgtctcc

SEQ ID NO: 5423382 - DNA, 14 bp, Homo sapiens
gcctccgcccaaat

SEQ ID NO: 5423383 - DNA, 17 bp, Homo sapiens
gcctccgcctgctgtgt

SEQ ID NO: 5423384 - DNA, 17 bp, Homo sapiens
gcctccgctgggcttca

SEQ ID NO: 5423385 - DNA, 20 bp, Homo sapiens
gcctccgcttatcctgctag

SEQ ID NO: 5423386 - DNA, 21 bp, Homo sapiens
gcctccgcttatcctgctagc

SEQ ID NO: 5423387 - DNA, 23 bp, Homo sapiens
gcctccgcttatcctgctagcag

SEQ ID NO: 5423388 - DNA, 15 bp, Homo sapiens
gcctccgcttccctg

SEQ ID NO: 5423389 - DNA, 20 bp, Homo sapiens
gcctccggccctgccccaca

SEQ ID NO: 5423390 - DNA, 21 bp, Homo sapiens
gcctccggcgtcagcctccag

SEQ ID NO: 5423391 - DNA, 22 bp, Homo sapiens
gcctccggcgtcttgcccagca

SEQ ID NO: 5423392 - DNA, 16 bp, Homo sapiens
gcctccgggcctcggc

SEQ ID NO: 5423393 - DNA, 23 bp, Homo sapiens
gcctccgggcctcggcctggctt

SEQ ID NO: 5423394 - DNA, 19 bp, Homo sapiens
gcctccgtcactacctggc

SEQ ID NO: 5423395 - DNA, 15 bp, Homo sapiens
gcctccgtcaggaga

SEQ ID NO: 5423396 - DNA, 14 bp, Homo sapiens
gcctccgtcatcca

SEQ ID NO: 5423397 - DNA, 21 bp, Homo sapiens
gcctccgtcatccatgccctc

SEQ ID NO: 5423398 - DNA, 17 bp, Homo sapiens
gcctccgtcttcccagc

SEQ ID NO: 5423399 - DNA, 22 bp, Homo sapiens
gcctccgtggaacattctggat

SEQ ID NO: 5423400 - DNA, 15 bp, Homo sapiens
gcctccgttcccacc

SEQ ID NO: 5423401 - DNA, 19 bp, Homo sapiens
gcctccgtttatgggcctt

SEQ ID NO: 5423402 - DNA, 20 bp, Homo sapiens
gcctccgtttatgggccttg

SEQ ID NO: 5423403 - DNA, 17 bp, Homo sapiens
gcctcctaaggctcccc

SEQ ID NO: 5423404 - DNA, 20 bp, Homo sapiens
gcctcctaaggctccccacc

SEQ ID NO: 5423405 - DNA, 22 bp, Homo sapiens
gcctcctactccagtatgacag

SEQ ID NO: 5423406 - DNA, 16 bp, Homo sapiens
gcctcctagagtgcag

SEQ ID NO: 5423407 - DNA, 11 bp, Homo sapiens
gcctcctaggc

SEQ ID NO: 5423408 - DNA, 14 bp, Homo sapiens
gcctcctaggctcc

SEQ ID NO: 5423409 - DNA, 14 bp, Homo sapiens
gcctcctaggctgg

SEQ ID NO: 5423410 - DNA, 18 bp, Homo sapiens
gcctcctaggctggaagc

SEQ ID NO: 5423411 - DNA, 16 bp, Homo sapiens
gcctcctaggggaagg

SEQ ID NO: 5423412 - DNA, 18 bp, Homo sapiens
gcctcctaggggaagggg

SEQ ID NO: 5423413 - DNA, 16 bp, Homo sapiens
gcctcctcacccccag

SEQ ID NO: 5423414 - DNA, 19 bp, Homo sapiens
gcctcctcacccccagctt

SEQ ID NO: 5423415 - DNA, 21 bp, Homo sapiens
gcctcctcagcagcctcactg

SEQ ID NO: 5423416 - DNA, 21 bp, Homo sapiens
gcctcctcagcctctgcaact

SEQ ID NO: 5423417 - DNA, 14 bp, Homo sapiens
gcctcctcagcttt

SEQ ID NO: 5423418 - DNA, 15 bp, Homo sapiens
gcctcctcaggagcc

SEQ ID NO: 5423419 - DNA, 23 bp, Homo sapiens
gcctcctcatcagtgtgtaaata

SEQ ID NO: 5423420 - DNA, 15 bp, Homo sapiens
gcctcctcatcccgt

SEQ ID NO: 5423421 - DNA, 22 bp, Homo sapiens
gcctcctcatcccgtgttctcc

SEQ ID NO: 5423422 - DNA, 23 bp, Homo sapiens
gcctcctcatctgggggagtgga

SEQ ID NO: 5423423 - DNA, 13 bp, Homo sapiens
gcctcctccagcc

SEQ ID NO: 5423424 - DNA, 18 bp, Homo sapiens
gcctcctccagctcctgc

SEQ ID NO: 5423425 - DNA, 17 bp, Homo sapiens
gcctcctcccactggga

SEQ ID NO: 5423426 - DNA, 16 bp, Homo sapiens
gcctcctcccatccag

SEQ ID NO: 5423427 - DNA, 17 bp, Homo sapiens
gcctcctcccatccagc

SEQ ID NO: 5423428 - DNA, 14 bp, Homo sapiens
gcctcctccccagg

SEQ ID NO: 5423429 - DNA, 16 bp, Homo sapiens
gcctcctcccccaccc

SEQ ID NO: 5423430 - DNA, 17 bp, Homo sapiens
gcctcctcccccacccc

SEQ ID NO: 5423431 - DNA, 18 bp, Homo sapiens
gcctcctccctcccagct

SEQ ID NO: 5423432 - DNA, 21 bp, Homo sapiens
gcctcctccctcccagctgca

SEQ ID NO: 5423433 - DNA, 17 bp, Homo sapiens
gcctcctccctccctct

SEQ ID NO: 5423434 - DNA, 21 bp, Homo sapiens
gcctcctccctccctctccga

SEQ ID NO: 5423435 - DNA, 13 bp, Homo sapiens
gcctcctccctgc

SEQ ID NO: 5423436 - DNA, 16 bp, Homo sapiens
gcctcctccctgcctg

SEQ ID NO: 5423437 - DNA, 18 bp, Homo sapiens
gcctcctccctggctgca

SEQ ID NO: 5423438 - DNA, 20 bp, Homo sapiens
gcctcctccctggctgcagc

SEQ ID NO: 5423439 - DNA, 16 bp, Homo sapiens
gcctcctcccttagct

SEQ ID NO: 5423440 - DNA, 18 bp, Homo sapiens
gcctcctcctagctggag

SEQ ID NO: 5423441 - DNA, 15 bp, Homo sapiens
gcctcctcctcaccc

SEQ ID NO: 5423442 - DNA, 14 bp, Homo sapiens
gcctcctcctcacg

SEQ ID NO: 5423443 - DNA, 13 bp, Homo sapiens
gcctcctcctgag

SEQ ID NO: 5423444 - DNA, 23 bp, Homo sapiens
gcctcctcctgagagctgttccc

SEQ ID NO: 5423445 - DNA, 15 bp, Homo sapiens
gcctcctcctgcatg

SEQ ID NO: 5423446 - DNA, 17 bp, Homo sapiens
gcctcctcctgccctcc

SEQ ID NO: 5423447 - DNA, 22 bp, Homo sapiens
gcctcctcctgccctccgcccc

SEQ ID NO: 5423448 - DNA, 15 bp, Homo sapiens
gcctcctcctgggct

SEQ ID NO: 5423449 - DNA, 17 bp, Homo sapiens
gcctcctcctgggctcc

SEQ ID NO: 5423450 - DNA, 20 bp, Homo sapiens
gcctcctcctgggctccaga

SEQ ID NO: 5423451 - DNA, 22 bp, Homo sapiens
gcctcctcctgggctccagagg

SEQ ID NO: 5423452 - DNA, 16 bp, Homo sapiens
gcctcctccttcccaa

SEQ ID NO: 5423453 - DNA, 18 bp, Homo sapiens
gcctcctcggggctccag

SEQ ID NO: 5423454 - DNA, 16 bp, Homo sapiens
gcctcctctaacaggg

SEQ ID NO: 5423455 - DNA, 20 bp, Homo sapiens
gcctcctctaacaggggctg

SEQ ID NO: 5423456 - DNA, 14 bp, Homo sapiens
gcctcctctcctcc

SEQ ID NO: 5423457 - DNA, 23 bp, Homo sapiens
gcctcctctctcagtttttatat

SEQ ID NO: 5423458 - DNA, 13 bp, Homo sapiens
gcctcctctctcc

SEQ ID NO: 5423459 - DNA, 18 bp, Homo sapiens
gcctcctctctccctgcc

SEQ ID NO: 5423460 - DNA, 16 bp, Homo sapiens
gcctcctctgtccagg

SEQ ID NO: 5423461 - DNA, 17 bp, Homo sapiens
gcctcctgaacagctgg

SEQ ID NO: 5423462 - DNA, 20 bp, Homo sapiens
gcctcctgacacacctgcag

SEQ ID NO: 5423463 - DNA, 14 bp, Homo sapiens
gcctcctgagcctg

SEQ ID NO: 5423464 - DNA, 17 bp, Homo sapiens
gcctcctgagcctgtgg

SEQ ID NO: 5423465 - DNA, 17 bp, Homo sapiens
gcctcctgagtagctgg

SEQ ID NO: 5423466 - DNA, 20 bp, Homo sapiens
gcctcctgagtagctgggac

SEQ ID NO: 5423467 - DNA, 22 bp, Homo sapiens
gcctctggctgcctggcccagg

SEQ ID NO: 5423468 - DNA, 16 bp, Homo sapiens
gcctctggcttccctg

SEQ ID NO: 5423469 - DNA, 12 bp, Homo sapiens
gcctctgggacc

SEQ ID NO: 5423470 - DNA, 17 bp, Homo sapiens
gcctctgggacccacag

SEQ ID NO: 5423471 - DNA, 18 bp, Homo sapiens
gcctctgggacccacaga

SEQ ID NO: 5423472 - DNA, 17 bp, Homo sapiens
gcctctgggatctgcca

SEQ ID NO: 5423473 - DNA, 17 bp, Homo sapiens
gcctctgggctcacacc

SEQ ID NO: 5423474 - DNA, 22 bp, Homo sapiens
gcctctgggctcacaccagccc

SEQ ID NO: 5423475 - DNA, 12 bp, Homo sapiens
gcctctggggag

SEQ ID NO: 5423476 - DNA, 15 bp, Homo sapiens
gcctctggggagacc

SEQ ID NO: 5423477 - DNA, 17 bp, Homo sapiens
gcctctggggcagagct

SEQ ID NO: 5423478 - DNA, 17 bp, Homo sapiens
gcctctggggcaggacc

SEQ ID NO: 5423479 - DNA, 12 bp, Homo sapiens
gcctctgggtca

SEQ ID NO: 5423480 - DNA, 14 bp, Homo sapiens
gcctctgggtgagt

SEQ ID NO: 5423481 - DNA, 19 bp, Homo sapiens
gcctctgggtgagtggctg

SEQ ID NO: 5423482 - DNA, 21 bp, Homo sapiens
gcctctgggtgagtggctgac

SEQ ID NO: 5423483 - DNA, 11 bp, Homo sapiens
gcctctggtgt

SEQ ID NO: 5423484 - DNA, 14 bp, Homo sapiens
gcctctggttgcct

SEQ ID NO: 5423485 - DNA, 15 bp, Homo sapiens
gcctctggttgcctc

SEQ ID NO: 5423486 - DNA, 18 bp, Homo sapiens
gcctctggttgcctcccc

SEQ ID NO: 5423487 - DNA, 22 bp, Homo sapiens
gcctctgtaccgcccggcagcc

SEQ ID NO: 5423488 - DNA, 19 bp, Homo sapiens
gcctctgtcatatcttcac

SEQ ID NO: 5423489 - DNA, 21 bp, Homo sapiens
gcctctgtccaaacatttcat

SEQ ID NO: 5423490 - DNA, 18 bp, Homo sapiens
gcctctgtccgtgcccct

SEQ ID NO: 5423491 - DNA, 16 bp, Homo sapiens
gcctctgtcctcccat

SEQ ID NO: 5423492 - DNA, 12 bp, Homo sapiens
gcctctgtcctg

SEQ ID NO: 5423493 - DNA, 15 bp, Homo sapiens
gcctctgtcctggcc

SEQ ID NO: 5423494 - DNA, 20 bp, Homo sapiens
gcctctgtcctggcccggga

SEQ ID NO: 5423495 - DNA, 18 bp, Homo sapiens
gcctctgtcctggctgtg

SEQ ID NO: 5423496 - DNA, 17 bp, Homo sapiens
gcctctgtctagcatgc

SEQ ID NO: 5423497 - DNA, 21 bp, Homo sapiens
gcctctgtctagcatgccaac

SEQ ID NO: 5423498 - DNA, 22 bp, Homo sapiens
gcctctgtctagcatgccaaca

SEQ ID NO: 5423499 - DNA, 13 bp, Homo sapiens
gcctctgtctcct

SEQ ID NO: 5423500 - DNA, 20 bp, Homo sapiens
gcctctgtctggcaatgcca

SEQ ID NO: 5423501 - DNA, 18 bp, Homo sapiens
gcctctgtcttctggact

SEQ ID NO: 5423502 - DNA, 20 bp, Homo sapiens
gcctctgtgcacagtggctt

SEQ ID NO: 5423503 - DNA, 16 bp, Homo sapiens
gcctctgtggaagaga

SEQ ID NO: 5423504 - DNA, 12 bp, Homo sapiens
gcctctgtgtca

SEQ ID NO: 5423505 - DNA, 15 bp, Homo sapiens
gcctctgtgtcactg

SEQ ID NO: 5423506 - DNA, 22 bp, Homo sapiens
gcctctgttcagttcattccca

SEQ ID NO: 5423507 - DNA, 13 bp, Homo sapiens
gcctcttaaaaat

SEQ ID NO: 5423508 - DNA, 20 bp, Homo sapiens
gcctcttaaagctgcctgta

SEQ ID NO: 5423509 - DNA, 23 bp, Homo sapiens
gcctcttaaagctgcctgtagtt

SEQ ID NO: 5423510 - DNA, 23 bp, Homo sapiens
gcctcttaccttcccgcctcggc

SEQ ID NO: 5423511 - DNA, 18 bp, Homo sapiens
gcctcttagacttctgct

SEQ ID NO: 5423512 - DNA, 19 bp, Homo sapiens
gcctcttagacttctgctt

SEQ ID NO: 5423513 - DNA, 17 bp, Homo sapiens
gcctcttcaaattagaa

SEQ ID NO: 5423514 - DNA, 15 bp, Homo sapiens
gcctcttcagcccct

SEQ ID NO: 5423515 - DNA, 15 bp, Homo sapiens
gcctcttcaggcctg

SEQ ID NO: 5423516 - DNA, 20 bp, Homo sapiens
gcctcttcaggcctgctagt

SEQ ID NO: 5423517 - DNA, 18 bp, Homo sapiens
gcctcttccccctgcttc

SEQ ID NO: 5423518 - DNA, 22 bp, Homo sapiens
gcctcttccccctgcttccacc

SEQ ID NO: 5423519 - DNA, 13 bp, Homo sapiens
gcctcttccctct

SEQ ID NO: 5423520 - DNA, 12 bp, Homo sapiens
gcctcttcctcc

SEQ ID NO: 5423521 - DNA, 21 bp, Homo sapiens
gcctcttcctccctccctgca

SEQ ID NO: 5423522 - DNA, 22 bp, Homo sapiens
gcctcttcctccctccctgcag

SEQ ID NO: 5423523 - DNA, 21 bp, Homo sapiens
gcctcttcctctgggcagcgc

SEQ ID NO: 5423524 - DNA, 20 bp, Homo sapiens
gcctcttcgcctttcccacc

SEQ ID NO: 5423525 - DNA, 21 bp, Homo sapiens
gcctcttcgcctttcccaccc

SEQ ID NO: 5423526 - DNA, 14 bp, Homo sapiens
gcctcttcgggaag

SEQ ID NO: 5423527 - DNA, 22 bp, Homo sapiens
gcctcttctacttgtaaaatgc

SEQ ID NO: 5423528 - DNA, 17 bp, Homo sapiens
gcctcttctagagccgt

SEQ ID NO: 5423529 - DNA, 23 bp, Homo sapiens
gcctcttctctactctagggaaa

SEQ ID NO: 5423530 - DNA, 16 bp, Homo sapiens
gcctcttctctcagac

SEQ ID NO: 5423531 - DNA, 12 bp, Homo sapiens
gcctcttctctg

SEQ ID NO: 5423532 - DNA, 14 bp, Homo sapiens
gcctcttctctgca

SEQ ID NO: 5423533 - DNA, 23 bp, Homo sapiens
gcctcttctgggctactgccact

SEQ ID NO: 5423534 - DNA, 17 bp, Homo sapiens
gcctcttctgtcccaag

SEQ ID NO: 5423535 - DNA, 16 bp, Homo sapiens
gcctcttcttcttcag

SEQ ID NO: 5423536 - DNA, 13 bp, Homo sapiens
gcctcttctttgt

SEQ ID NO: 5423537 - DNA, 15 bp, Homo sapiens
gcctcttctttgtgc

SEQ ID NO: 5423538 - DNA, 16 bp, Homo sapiens
gcctcttctttgtgcc

SEQ ID NO: 5423539 - DNA, 20 bp, Homo sapiens
gcctcttctttgtgcctttg

SEQ ID NO: 5423540 - DNA, 23 bp, Homo sapiens
gcctcttgaatgcttaaatgatc

SEQ ID NO: 5423541 - DNA, 13 bp, Homo sapiens
gcctcttgaccag

SEQ ID NO: 5423542 - DNA, 16 bp, Homo sapiens
gcctcttgaccaggct

SEQ ID NO: 5423543 - DNA, 20 bp, Homo sapiens
gcctcttgaccaggctgcct

SEQ ID NO: 5423544 - DNA, 22 bp, Homo sapiens
gcctcttgaccaggctgcctcc

SEQ ID NO: 5423545 - DNA, 18 bp, Homo sapiens
gcctcttgagagccccac

SEQ ID NO: 5423546 - DNA, 18 bp, Homo sapiens
gcctcttgagcagtggct

SEQ ID NO: 5423547 - DNA, 21 bp, Homo sapiens
gcctcttgagcagtggctggt

SEQ ID NO: 5423548 - DNA, 18 bp, Homo sapiens
gcctcttgctgaaagcca

SEQ ID NO: 5423549 - DNA, 20 bp, Homo sapiens
gcctcttggacctctgctct

SEQ ID NO: 5423550 - DNA, 21 bp, Homo sapiens
gcctcttggacctctgctctg

SEQ ID NO: 5423551 - DNA, 20 bp, Homo sapiens
gcctcttggagaccttaccc

SEQ ID NO: 5423552 - DNA, 16 bp, Homo sapiens
gcctcttggcacctgc

SEQ ID NO: 5423553 - DNA, 21 bp, Homo sapiens
gcctcttggctatttctgtgt

SEQ ID NO: 5423554 - DNA, 22 bp, Homo sapiens
gcctcttggctatttctgtgtc

SEQ ID NO: 5423555 - DNA, 19 bp, Homo sapiens
gcctcttggggaaggggca

SEQ ID NO: 5423556 - DNA, 16 bp, Homo sapiens
gcctcttgtagtcttg

SEQ ID NO: 5423557 - DNA, 16 bp, Homo sapiens
gcctcttgtcccttgg

SEQ ID NO: 5423558 - DNA, 16 bp, Homo sapiens
gcctcttgtcttccta

SEQ ID NO: 5423559 - DNA, 17 bp, Homo sapiens
gcctcttgtgctcacgc

SEQ ID NO: 5423560 - DNA, 21 bp, Homo sapiens
gcctcttgtggaccccgcctg

SEQ ID NO: 5423561 - DNA, 21 bp, Homo sapiens
gcctcttgttcttagggcttg

SEQ ID NO: 5423562 - DNA, 23 bp, Homo sapiens
gcctcttgttcttagggcttgga

SEQ ID NO: 5423563 - DNA, 16 bp, Homo sapiens
gcctctttaaattatg

SEQ ID NO: 5423564 - DNA, 20 bp, Homo sapiens
gcctctttaacagctttctc

SEQ ID NO: 5423565 - DNA, 12 bp, Homo sapiens
gcctctttccct

SEQ ID NO: 5423566 - DNA, 16 bp, Homo sapiens
gcctctttccctagga

SEQ ID NO: 5423567 - DNA, 14 bp, Homo sapiens
gcctctttcccttc

SEQ ID NO: 5423568 - DNA, 14 bp, Homo sapiens
gcctctttctccct

SEQ ID NO: 5423569 - DNA, 17 bp, Homo sapiens
gcctctttctgtccctt

SEQ ID NO: 5423570 - DNA, 14 bp, Homo sapiens
gcctctttgctgct

SEQ ID NO: 5423571 - DNA, 17 bp, Homo sapiens
gcctctttgctgctttg

SEQ ID NO: 5423572 - DNA, 23 bp, Homo sapiens
gcctctttgtctaaaacaataaa

SEQ ID NO: 5423573 - DNA, 22 bp, Homo sapiens
gcctctttgtgtttttgttgtt

SEQ ID NO: 5423574 - DNA, 17 bp, Homo sapiens
gcctcttttacctgctg

SEQ ID NO: 5423575 - DNA, 20 bp, Homo sapiens
gcctctttttccttcttcag

SEQ ID NO: 5423576 - DNA, 16 bp, Homo sapiens
gcctctttttgccctt

SEQ ID NO: 5423577 - DNA, 15 bp, Homo sapiens
gcctgaaaaatggga

SEQ ID NO: 5423578 - DNA, 13 bp, Homo sapiens
gcctgaaaacctt

SEQ ID NO: 5423579 - DNA, 21 bp, Homo sapiens
gcctgaaaaggaaggaccagg

SEQ ID NO: 5423580 - DNA, 12 bp, Homo sapiens
gcctgaaaaggg

SEQ ID NO: 5423581 - DNA, 13 bp, Homo sapiens
gcctgaaacagcc

SEQ ID NO: 5423582 - DNA, 20 bp, Homo sapiens
gcctgaaacccgccctcagg

SEQ ID NO: 5423583 - DNA, 13 bp, Homo sapiens
gcctgaaagcaac

SEQ ID NO: 5423584 - DNA, 15 bp, Homo sapiens
gcctgaaagcaacag

SEQ ID NO: 5423585 - DNA, 18 bp, Homo sapiens
gcctgaaagcaacagctg

SEQ ID NO: 5423586 - DNA, 16 bp, Homo sapiens
gcctgaaagccacaat

SEQ ID NO: 5423587 - DNA, 19 bp, Homo sapiens
gcctgaaatgtttccaggc

SEQ ID NO: 5423588 - DNA, 15 bp, Homo sapiens
gcctgaaattttaaa

SEQ ID NO: 5423589 - DNA, 22 bp, Homo sapiens
gcctgaacactcagttgcaggg

SEQ ID NO: 5423590 - DNA, 15 bp, Homo sapiens
gcctgaacagaagct

SEQ ID NO: 5423591 - DNA, 20 bp, Homo sapiens
gcctgaacagaagctcttac

SEQ ID NO: 5423592 - DNA, 22 bp, Homo sapiens
gcctgaacagccctctctctca

SEQ ID NO: 5423593 - DNA, 15 bp, Homo sapiens
gcctgaacatccttc

SEQ ID NO: 5423594 - DNA, 21 bp, Homo sapiens
gcctgaaccacagcggaggag

SEQ ID NO: 5423595 - DNA, 23 bp, Homo sapiens
gcctgaacccgtccattcagaaa

SEQ ID NO: 5423596 - DNA, 13 bp, Homo sapiens
gcctgaactccag

SEQ ID NO: 5423597 - DNA, 14 bp, Homo sapiens
gcctgaactccaga

SEQ ID NO: 5423598 - DNA, 15 bp, Homo sapiens
gcctgaactccagag

SEQ ID NO: 5423599 - DNA, 16 bp, Homo sapiens
gcctgaactgagcccc

SEQ ID NO: 5423600 - DNA, 19 bp, Homo sapiens
gcctgaactgagccccagc

SEQ ID NO: 5423601 - DNA, 15 bp, Homo sapiens
gcctgaactgaggag

SEQ ID NO: 5423602 - DNA, 16 bp, Homo sapiens
gcctgaactgaggcct

SEQ ID NO: 5423603 - DNA, 14 bp, Homo sapiens
gcctgaagagagga

SEQ ID NO: 5423604 - DNA, 11 bp, Homo sapiens
gcctgaagagc

SEQ ID NO: 5423605 - DNA, 17 bp, Homo sapiens
gcctgaagatcagagct

SEQ ID NO: 5423606 - DNA, 14 bp, Homo sapiens
gcctgaagcctgga

SEQ ID NO: 5423607 - DNA, 17 bp, Homo sapiens
gcctgaagctggcctgg

SEQ ID NO: 5423608 - DNA, 18 bp, Homo sapiens
gcctgaaggggcgtctgt

SEQ ID NO: 5423609 - DNA, 22 bp, Homo sapiens
gcctgaagtcacacagtgagtc

SEQ ID NO: 5423610 - DNA, 20 bp, Homo sapiens
gcctgaagtcttctcctcca

SEQ ID NO: 5423611 - DNA, 16 bp, Homo sapiens
gcctgaataaagagcc

SEQ ID NO: 5423612 - DNA, 17 bp, Homo sapiens
gcctgaatcatgagcct

SEQ ID NO: 5423613 - DNA, 18 bp, Homo sapiens
gcctgaatcatgagcctg

SEQ ID NO: 5423614 - DNA, 21 bp, Homo sapiens
gcctgaatcatgagcctgctg

SEQ ID NO: 5423615 - DNA, 20 bp, Homo sapiens
gcctgaatccacctgcagtt

SEQ ID NO: 5423616 - DNA, 18 bp, Homo sapiens
gcctgaattgctttctgc

SEQ ID NO: 5423617 - DNA, 10 bp, Homo sapiens
gcctgaattt

SEQ ID NO: 5423618 - DNA, 17 bp, Homo sapiens
gcctgacaacagcctga

SEQ ID NO: 5423619 - DNA, 14 bp, Homo sapiens
gcctgacaaggcca

SEQ ID NO: 5423620 - DNA, 14 bp, Homo sapiens
gcctgacaattatg

SEQ ID NO: 5423621 - DNA, 17 bp, Homo sapiens
gcctgacaattatgaaa

SEQ ID NO: 5423622 - DNA, 23 bp, Homo sapiens
gcctgacacaatggtagctctga

SEQ ID NO: 5423623 - DNA, 17 bp, Homo sapiens
gcctgacacaggccagc

SEQ ID NO: 5423624 - DNA, 19 bp, Homo sapiens
gcctgacacaggccagcct

SEQ ID NO: 5423625 - DNA, 22 bp, Homo sapiens
gcctgacaccacgctggagctg

SEQ ID NO: 5423626 - DNA, 13 bp, Homo sapiens
gcctgacagaaac

SEQ ID NO: 5423627 - DNA, 16 bp, Homo sapiens
gcctgacagcatcctc

SEQ ID NO: 5423628 - DNA, 16 bp, Homo sapiens
gcctgacagccagaac

SEQ ID NO: 5423629 - DNA, 18 bp, Homo sapiens
gcctgacaggctgtgact

SEQ ID NO: 5423630 - DNA, 20 bp, Homo sapiens
gcctgacaggttcccagcag

SEQ ID NO: 5423631 - DNA, 22 bp, Homo sapiens
gcctgacaggttcccagcagct

SEQ ID NO: 5423632 - DNA, 16 bp, Homo sapiens
gcctgacccacggggc

SEQ ID NO: 5423633 - DNA, 19 bp, Homo sapiens
gcctgacccacggggcagt

SEQ ID NO: 5423634 - DNA, 14 bp, Homo sapiens
gcctgaccccaggc

SEQ ID NO: 5423635 - DNA, 22 bp, Homo sapiens
gcctgaccccttcactatgact

SEQ ID NO: 5423636 - DNA, 22 bp, Homo sapiens
gcctgaccccttgctcccttca

SEQ ID NO: 5423637 - DNA, 23 bp, Homo sapiens
gcctgaccctacttcttttgctc

SEQ ID NO: 5423638 - DNA, 16 bp, Homo sapiens
gcctgacctccagtcc

SEQ ID NO: 5423639 - DNA, 17 bp, Homo sapiens
gcctgacctccagtcct

SEQ ID NO: 5423640 - DNA, 18 bp, Homo sapiens
gcctgacctccagtcctg

SEQ ID NO: 5423641 - DNA, 15 bp, Homo sapiens
gcctgacctccccct

SEQ ID NO: 5423642 - DNA, 18 bp, Homo sapiens
gcctgacgaaatggaaac

SEQ ID NO: 5423643 - DNA, 16 bp, Homo sapiens
gcctgacgctcagccc

SEQ ID NO: 5423644 - DNA, 20 bp, Homo sapiens
gcctgcgcccaccccgctct

SEQ ID NO: 5423645 - DNA, 22 bp, Homo sapiens
gcctgcgcccaccccgctctgc

SEQ ID NO: 5423646 - DNA, 23 bp, Homo sapiens
gcctgcgcccagagctggcctcc

SEQ ID NO: 5423647 - DNA, 19 bp, Homo sapiens
gcctgcgcctcctcctgca

SEQ ID NO: 5423648 - DNA, 13 bp, Homo sapiens
gcctgcgcctgca

SEQ ID NO: 5423649 - DNA, 13 bp, Homo sapiens
gcctgcgcctgct

SEQ ID NO: 5423650 - DNA, 17 bp, Homo sapiens
gcctgcgcctgctgcct

SEQ ID NO: 5423651 - DNA, 16 bp, Homo sapiens
gcctgcgctcctctgc

SEQ ID NO: 5423652 - DNA, 22 bp, Homo sapiens
gcctgcgctcctctgcagcctg

SEQ ID NO: 5423653 - DNA, 23 bp, Homo sapiens
gcctgcgctcctctgcagcctga

SEQ ID NO: 5423654 - DNA, 16 bp, Homo sapiens
gcctgcgctcggcagg

SEQ ID NO: 5423655 - DNA, 20 bp, Homo sapiens
gcctgcgctcggcaggaagg

SEQ ID NO: 5423656 - DNA, 21 bp, Homo sapiens
gcctgcggcccagaagtttcc

SEQ ID NO: 5423657 - DNA, 17 bp, Homo sapiens
gcctgcggccgggctgc

SEQ ID NO: 5423658 - DNA, 20 bp, Homo sapiens
gcctgcggccgggctgccct

SEQ ID NO: 5423659 - DNA, 17 bp, Homo sapiens
gcctgcggcctgctgga

SEQ ID NO: 5423660 - DNA, 17 bp, Homo sapiens
gcctgcggcgccagcct

SEQ ID NO: 5423661 - DNA, 12 bp, Homo sapiens
gcctgcggctgc

SEQ ID NO: 5423662 - DNA, 15 bp, Homo sapiens
gcctgcggctgctgg

SEQ ID NO: 5423663 - DNA, 16 bp, Homo sapiens
gcctgcggctgctggc

SEQ ID NO: 5423664 - DNA, 22 bp, Homo sapiens
gcctgcggctgctggcacagac

SEQ ID NO: 5423665 - DNA, 23 bp, Homo sapiens
gcctgcggctgctggcacagact

SEQ ID NO: 5423666 - DNA, 16 bp, Homo sapiens
gcctgcgggcccctgg

SEQ ID NO: 5423667 - DNA, 18 bp, Homo sapiens
gcctgcggggcagcaggg

SEQ ID NO: 5423668 - DNA, 17 bp, Homo sapiens
gcctgcggtcaaggcca

SEQ ID NO: 5423669 - DNA, 17 bp, Homo sapiens
gcctgcgtcatggctca

SEQ ID NO: 5423670 - DNA, 20 bp, Homo sapiens
gcctgcgtcatggctcaagg

SEQ ID NO: 5423671 - DNA, 16 bp, Homo sapiens
gcctgcgtcttccgcc

SEQ ID NO: 5423672 - DNA, 18 bp, Homo sapiens
gcctgcgtcttccgcccc

SEQ ID NO: 5423673 - DNA, 15 bp, Homo sapiens
gcctgcgtgcgctgg

SEQ ID NO: 5423674 - DNA, 15 bp, Homo sapiens
gcctgcgtggcctgg

SEQ ID NO: 5423675 - DNA, 19 bp, Homo sapiens
gcctgcgtggcctggggct

SEQ ID NO: 5423676 - DNA, 21 bp, Homo sapiens
gcctgcgtggcctggggctgc

SEQ ID NO: 5423677 - DNA, 17 bp, Homo sapiens
gcctgcgtggctgaccc

SEQ ID NO: 5423678 - DNA, 22 bp, Homo sapiens
gcctgcgtggctgacccccctc

SEQ ID NO: 5423679 - DNA, 19 bp, Homo sapiens
gcctgcgtgtgtctgtgtt

SEQ ID NO: 5423680 - DNA, 20 bp, Homo sapiens
gcctgcgttcttgtgacaga

SEQ ID NO: 5423681 - DNA, 19 bp, Homo sapiens
gcctgcgttggtccagagc

SEQ ID NO: 5423682 - DNA, 21 bp, Homo sapiens
gcctgcgtttggaggcccctg

SEQ ID NO: 5423683 - DNA, 22 bp, Homo sapiens
gcctgcgtttggaggcccctgg

SEQ ID NO: 5423684 - DNA, 21 bp, Homo sapiens
gcctgctaaggaacaatgccg

SEQ ID NO: 5423685 - DNA, 23 bp, Homo sapiens
gcctgctagagcaacccctgtac

SEQ ID NO: 5423686 - DNA, 15 bp, Homo sapiens
gcctgctagcggctg

SEQ ID NO: 5423687 - DNA, 20 bp, Homo sapiens
gcctgctagctagctcaact

SEQ ID NO: 5423688 - DNA, 22 bp, Homo sapiens
gcctgctagctagctcaactag

SEQ ID NO: 5423689 - DNA, 18 bp, Homo sapiens
gcctgctatccagccgca

SEQ ID NO: 5423690 - DNA, 13 bp, Homo sapiens
gcctgctcagcag

SEQ ID NO: 5423691 - DNA, 16 bp, Homo sapiens
gcctgctcagcagcca

SEQ ID NO: 5423692 - DNA, 14 bp, Homo sapiens
gcctgctcaggtgc

SEQ ID NO: 5423693 - DNA, 18 bp, Homo sapiens
gcctgctccagctgttca

SEQ ID NO: 5423694 - DNA, 15 bp, Homo sapiens
gcctgctcccagcag

SEQ ID NO: 5423695 - DNA, 16 bp, Homo sapiens
gcctgctcccagcagc

SEQ ID NO: 5423696 - DNA, 20 bp, Homo sapiens
gcctgctcccagcagcccta

SEQ ID NO: 5423697 - DNA, 18 bp, Homo sapiens
gcctgctcccatcctcac

SEQ ID NO: 5423698 - DNA, 11 bp, Homo sapiens
gcctgctcccc

SEQ ID NO: 5423699 - DNA, 13 bp, Homo sapiens
gcctgctccccca

SEQ ID NO: 5423700 - DNA, 14 bp, Homo sapiens
gcctgctccctgtc

SEQ ID NO: 5423701 - DNA, 15 bp, Homo sapiens
gcctgctccctgtct

SEQ ID NO: 5423702 - DNA, 15 bp, Homo sapiens
gcctgctccttccct

SEQ ID NO: 5423703 - DNA, 14 bp, Homo sapiens
gcctgctccttggc

SEQ ID NO: 5423704 - DNA, 15 bp, Homo sapiens
gcctgctctcgaggc

SEQ ID NO: 5423705 - DNA, 13 bp, Homo sapiens
gcctgctctgcca

SEQ ID NO: 5423706 - DNA, 19 bp, Homo sapiens
gcctgctctgccactggga

SEQ ID NO: 5423707 - DNA, 21 bp, Homo sapiens
gcctgctctgtgagccccaca

SEQ ID NO: 5423708 - DNA, 22 bp, Homo sapiens
gcctgctctgtgagccccacag

SEQ ID NO: 5423709 - DNA, 23 bp, Homo sapiens
gcctgctgaatgatttccaaaga

SEQ ID NO: 5423710 - DNA, 13 bp, Homo sapiens
gcctgctgagagc

SEQ ID NO: 5423711 - DNA, 15 bp, Homo sapiens
gcctgctgagagccc

SEQ ID NO: 5423712 - DNA, 18 bp, Homo sapiens
gcctgctgagatgaggag

SEQ ID NO: 5423713 - DNA, 18 bp, Homo sapiens
gcctgctgagctgtgccc

SEQ ID NO: 5423714 - DNA, 14 bp, Homo sapiens
gcctgctgaggcct

SEQ ID NO: 5423715 - DNA, 15 bp, Homo sapiens
gcctgctgaggcctt

SEQ ID NO: 5423716 - DNA, 17 bp, Homo sapiens
gcctgctgaggccttct

SEQ ID NO: 5423717 - DNA, 20 bp, Homo sapiens
gcctgctgaggccttctctt

SEQ ID NO: 5423718 - DNA, 10 bp, Homo sapiens
gcctgctgca

SEQ ID NO: 5423719 - DNA, 18 bp, Homo sapiens
gcctgctgccagtgcagc

SEQ ID NO: 5423720 - DNA, 21 bp, Homo sapiens
gcctgctgccagtgcagccac

SEQ ID NO: 5423721 - DNA, 22 bp, Homo sapiens
gcctgctgccagtgcagccact

SEQ ID NO: 5423722 - DNA, 23 bp, Homo sapiens
gcctgctgccagtgcagccactg

SEQ ID NO: 5423723 - DNA, 13 bp, Homo sapiens
gcctgctgcccag

SEQ ID NO: 5423724 - DNA, 17 bp, Homo sapiens
gcctgctgcctgctgag

SEQ ID NO: 5423725 - DNA, 13 bp, Homo sapiens
gcctgctgcggca

SEQ ID NO: 5423726 - DNA, 19 bp, Homo sapiens
gcctgctgctgagaacctg

SEQ ID NO: 5423727 - DNA, 21 bp, Homo sapiens
gcctgctgctgagaacctggc

SEQ ID NO: 5423728 - DNA, 15 bp, Homo sapiens
gcctgctgctgccaa

SEQ ID NO: 5423729 - DNA, 19 bp, Homo sapiens
gcctgctggaagcccagcc

SEQ ID NO: 5423730 - DNA, 19 bp, Homo sapiens
gcctgctggaggcctcagg

SEQ ID NO: 5423731 - DNA, 13 bp, Homo sapiens
gcctgctggatct

SEQ ID NO: 5423732 - DNA, 22 bp, Homo sapiens
gcctgctggcacccaccgtgga

SEQ ID NO: 5423733 - DNA, 12 bp, Homo sapiens
gcctgctggcag

SEQ ID NO: 5423734 - DNA, 14 bp, Homo sapiens
gcctgctggcaggg

SEQ ID NO: 5423735 - DNA, 16 bp, Homo sapiens
gcctgctggcagggcc

SEQ ID NO: 5423736 - DNA, 17 bp, Homo sapiens
gcctgctggcagggcca

SEQ ID NO: 5423737 - DNA, 16 bp, Homo sapiens
gcctgctggcatcagg

SEQ ID NO: 5423738 - DNA, 20 bp, Homo sapiens
gcctgctggcatcaggtctg

SEQ ID NO: 5423739 - DNA, 12 bp, Homo sapiens
gcctgctggctg

SEQ ID NO: 5423740 - DNA, 11 bp, Homo sapiens
gcctgctgggc

SEQ ID NO: 5423741 - DNA, 12 bp, Homo sapiens
gcctgctgggca

SEQ ID NO: 5423742 - DNA, 13 bp, Homo sapiens
gcctgctgggcac

SEQ ID NO: 5423743 - DNA, 15 bp, Homo sapiens
gcctgctgggcactg

SEQ ID NO: 5423744 - DNA, 13 bp, Homo sapiens
gcctgctgggctc

SEQ ID NO: 5423745 - DNA, 17 bp, Homo sapiens
gcctgctgggctccccc

SEQ ID NO: 5423746 - DNA, 16 bp, Homo sapiens
gcctgctgggctctcc

SEQ ID NO: 5423747 - DNA, 17 bp, Homo sapiens
gcctgctgggctctcca

SEQ ID NO: 5423748 - DNA, 18 bp, Homo sapiens
gcctgctgggctctccac

SEQ ID NO: 5423749 - DNA, 17 bp, Homo sapiens
gcctgctgggcttggct

SEQ ID NO: 5423750 - DNA, 16 bp, Homo sapiens
gcctgctgggtgccag

SEQ ID NO: 5423751 - DNA, 20 bp, Homo sapiens
gcctgctgggtgccaggtgc

SEQ ID NO: 5423752 - DNA, 23 bp, Homo sapiens
gcctgctgtcaagtcccccagca

SEQ ID NO: 5423753 - DNA, 22 bp, Homo sapiens
gcctgctgtgattccactacac

SEQ ID NO: 5423754 - DNA, 13 bp, Homo sapiens
gcctgctgtgctg

SEQ ID NO: 5423755 - DNA, 14 bp, Homo sapiens
gcctgctgtggagc

SEQ ID NO: 5423756 - DNA, 13 bp, Homo sapiens
gcctgctgtgggg

SEQ ID NO: 5423757 - DNA, 16 bp, Homo sapiens
gcctgctgtgtccttc

SEQ ID NO: 5423758 - DNA, 20 bp, Homo sapiens
gcctgctgtgttaagaggac

SEQ ID NO: 5423759 - DNA, 22 bp, Homo sapiens
gcctgcttaaaaggtataatta

SEQ ID NO: 5423760 - DNA, 14 bp, Homo sapiens
gcctgcttcacacc

SEQ ID NO: 5423761 - DNA, 20 bp, Homo sapiens
gcctgcttcacacccctcag

SEQ ID NO: 5423762 - DNA, 14 bp, Homo sapiens
gcctgcttcccaca

SEQ ID NO: 5423763 - DNA, 23 bp, Homo sapiens
gcctgcttccccctccccctcct

SEQ ID NO: 5423764 - DNA, 15 bp, Homo sapiens
gcctgcttcctggac

SEQ ID NO: 5423765 - DNA, 17 bp, Homo sapiens
gcctgcttcctggaccg

SEQ ID NO: 5423766 - DNA, 13 bp, Homo sapiens
gcctgcttctgcc

SEQ ID NO: 5423767 - DNA, 20 bp, Homo sapiens
gcctgcttcttctctccaca

SEQ ID NO: 5423768 - DNA, 16 bp, Homo sapiens
gcctgcttctttccag

SEQ ID NO: 5423769 - DNA, 22 bp, Homo sapiens
gcctgctttagaatgttttcct

SEQ ID NO: 5423770 - DNA, 20 bp, Homo sapiens
gcctgctttgacgggccagg

SEQ ID NO: 5423771 - DNA, 21 bp, Homo sapiens
gcctgctttgacgggccaggc

SEQ ID NO: 5423772 - DNA, 23 bp, Homo sapiens
gcctgctttgacgggccaggccc

SEQ ID NO: 5423773 - DNA, 17 bp, Homo sapiens
gcctgctttggcctttc

SEQ ID NO: 5423774 - DNA, 22 bp, Homo sapiens
gcctgctttggcctttccttgt

SEQ ID NO: 5423775 - DNA, 16 bp, Homo sapiens
gcctgcttttgtgtcc

SEQ ID NO: 5423776 - DNA, 18 bp, Homo sapiens
gcctgctttttatggcct

SEQ ID NO: 5423777 - DNA, 19 bp, Homo sapiens
gcctgctttttatggcctg

SEQ ID NO: 5423778 - DNA, 22 bp, Homo sapiens
gcctgctttttatggcctgtga

SEQ ID NO: 5423779 - DNA, 16 bp, Homo sapiens
gcctgctttttggaaa

SEQ ID NO: 5423780 - DNA, 15 bp, Homo sapiens
gcctggaaattaaac

SEQ ID NO: 5423781 - DNA, 23 bp, Homo sapiens
gcctggaacaccagcagcactgg

SEQ ID NO: 5423782 - DNA, 17 bp, Homo sapiens
gcctggaaccagggagg

SEQ ID NO: 5423783 - DNA, 14 bp, Homo sapiens
gcctggaagacaga

SEQ ID NO: 5423784 - DNA, 15 bp, Homo sapiens
gcctggaagacagag

SEQ ID NO: 5423785 - DNA, 23 bp, Homo sapiens
gcctggaagacagagacctcctg

SEQ ID NO: 5423786 - DNA, 15 bp, Homo sapiens
gcctggaagagcagc

SEQ ID NO: 5423787 - DNA, 21 bp, Homo sapiens
gcctggaagcactacagagca

SEQ ID NO: 5423788 - DNA, 16 bp, Homo sapiens
gcctggaagctttgtc

SEQ ID NO: 5423789 - DNA, 22 bp, Homo sapiens
gcctggaagctttgtcccctgc

SEQ ID NO: 5423790 - DNA, 18 bp, Homo sapiens
gcctggacacagtcaggg

SEQ ID NO: 5423791 - DNA, 22 bp, Homo sapiens
gcctggacacagtcagggcggg

SEQ ID NO: 5423792 - DNA, 21 bp, Homo sapiens
gcctggacagtatcccacatc

SEQ ID NO: 5423793 - DNA, 22 bp, Homo sapiens
gcctggacagtatcccacatcc

SEQ ID NO: 5423794 - DNA, 20 bp, Homo sapiens
gcctggaccattcctgtccc

SEQ ID NO: 5423795 - DNA, 14 bp, Homo sapiens
gcctggaccctgtg

SEQ ID NO: 5423796 - DNA, 15 bp, Homo sapiens
gcctggaccgagatg

SEQ ID NO: 5423797 - DNA, 18 bp, Homo sapiens
gcctggaccgagatgtga

SEQ ID NO: 5423798 - DNA, 20 bp, Homo sapiens
gcctggaccgagatgtgagt

SEQ ID NO: 5423799 - DNA, 22 bp, Homo sapiens
gcctggaccgcttcccagaggc

SEQ ID NO: 5423800 - DNA, 18 bp, Homo sapiens
gcctggacctatgcaggg

SEQ ID NO: 5423801 - DNA, 20 bp, Homo sapiens
gcctggacctatgcagggag

SEQ ID NO: 5423802 - DNA, 22 bp, Homo sapiens
gcctggacctatgcagggaggc

SEQ ID NO: 5423803 - DNA, 20 bp, Homo sapiens
gcctggacctctgacagcag

SEQ ID NO: 5423804 - DNA, 23 bp, Homo sapiens
gcctggacctctgacagcagcat

SEQ ID NO: 5423805 - DNA, 11 bp, Homo sapiens
gcctggacctg

SEQ ID NO: 5423806 - DNA, 16 bp, Homo sapiens
gcctggacctgcctcc

SEQ ID NO: 5423807 - DNA, 23 bp, Homo sapiens
gcctggacctgcctcctgcctgc

SEQ ID NO: 5423808 - DNA, 15 bp, Homo sapiens
gcctggacctgggat

SEQ ID NO: 5423809 - DNA, 16 bp, Homo sapiens
gcctggacgcagccac

SEQ ID NO: 5423810 - DNA, 14 bp, Homo sapiens
gcctggacgggccc

SEQ ID NO: 5423811 - DNA, 15 bp, Homo sapiens
gcctggacgggccct

SEQ ID NO: 5423812 - DNA, 15 bp, Homo sapiens
gcctggactctaagc

SEQ ID NO: 5423813 - DNA, 14 bp, Homo sapiens
gcctggactctgcc

SEQ ID NO: 5423814 - DNA, 19 bp, Homo sapiens
gcctggactgactgcagcc

SEQ ID NO: 5423815 - DNA, 21 bp, Homo sapiens
gcctggactgcacaggcagca

SEQ ID NO: 5423816 - DNA, 13 bp, Homo sapiens
gcctggactgttt

SEQ ID NO: 5423817 - DNA, 14 bp, Homo sapiens
gcctggactttcct

SEQ ID NO: 5423818 - DNA, 17 bp, Homo sapiens
gcctggactttcctgca

SEQ ID NO: 5423819 - DNA, 18 bp, Homo sapiens
gcctggactttcctgcaa

SEQ ID NO: 5423820 - DNA, 13 bp, Homo sapiens
gcctggagaagct

SEQ ID NO: 5423821 - DNA, 14 bp, Homo sapiens
gcctgggggctcct

SEQ ID NO: 5423822 - DNA, 14 bp, Homo sapiens
gcctgggggctggg

SEQ ID NO: 5423823 - DNA, 13 bp, Homo sapiens
gcctggggggaac

SEQ ID NO: 5423824 - DNA, 16 bp, Homo sapiens
gcctgggggtgccagg

SEQ ID NO: 5423825 - DNA, 23 bp, Homo sapiens
gcctgggggtggggggactgcct

SEQ ID NO: 5423826 - DNA, 19 bp, Homo sapiens
gcctgggggttttccaagc

SEQ ID NO: 5423827 - DNA, 21 bp, Homo sapiens
gcctgggggttttccaagccc

SEQ ID NO: 5423828 - DNA, 17 bp, Homo sapiens
gcctggggtaggaggaa

SEQ ID NO: 5423829 - DNA, 21 bp, Homo sapiens
gcctggggtaggaggaacagg

SEQ ID NO: 5423830 - DNA, 14 bp, Homo sapiens
gcctggggtcaggc

SEQ ID NO: 5423831 - DNA, 14 bp, Homo sapiens
gcctggggtctgga

SEQ ID NO: 5423832 - DNA, 18 bp, Homo sapiens
gcctggggtgacccggca

SEQ ID NO: 5423833 - DNA, 18 bp, Homo sapiens
gcctggggtgcatctcct

SEQ ID NO: 5423834 - DNA, 19 bp, Homo sapiens
gcctggggtgcatctcctc

SEQ ID NO: 5423835 - DNA, 20 bp, Homo sapiens
gcctggggtgcatctcctcc

SEQ ID NO: 5423836 - DNA, 20 bp, Homo sapiens
gcctggggtggaggctaagc

SEQ ID NO: 5423837 - DNA, 19 bp, Homo sapiens
gcctggggtggcctggccc

SEQ ID NO: 5423838 - DNA, 21 bp, Homo sapiens
gcctggggtgggacagggagg

SEQ ID NO: 5423839 - DNA, 20 bp, Homo sapiens
gcctggggtgggtgtgagca

SEQ ID NO: 5423840 - DNA, 18 bp, Homo sapiens
gcctggggtgtcctacag

SEQ ID NO: 5423841 - DNA, 21 bp, Homo sapiens
gcctggggtgtcctacagtga

SEQ ID NO: 5423842 - DNA, 22 bp, Homo sapiens
gcctggggtgttagtggcaccg

SEQ ID NO: 5423843 - DNA, 23 bp, Homo sapiens
gcctggggttcccgagggagctg

SEQ ID NO: 5423844 - DNA, 17 bp, Homo sapiens
gcctggggttgtccccg

SEQ ID NO: 5423845 - DNA, 20 bp, Homo sapiens
gcctggggttgtccccgctg

SEQ ID NO: 5423846 - DNA, 17 bp, Homo sapiens
gcctgggtaggccccac

SEQ ID NO: 5423847 - DNA, 20 bp, Homo sapiens
gcctgggtaggccccacaag

SEQ ID NO: 5423848 - DNA, 22 bp, Homo sapiens
gcctgggtaggccccacaaggc

SEQ ID NO: 5423849 - DNA, 21 bp, Homo sapiens
gcctgggtcacacacggaggc

SEQ ID NO: 5423850 - DNA, 18 bp, Homo sapiens
gcctgggtcacagagtga

SEQ ID NO: 5423851 - DNA, 23 bp, Homo sapiens
gcctgggtcacagagtgagactc

SEQ ID NO: 5423852 - DNA, 17 bp, Homo sapiens
gcctgggtcacgctcaa

SEQ ID NO: 5423853 - DNA, 17 bp, Homo sapiens
gcctgggtcatgggcct

SEQ ID NO: 5423854 - DNA, 18 bp, Homo sapiens
gcctgggtcatgggcctg

SEQ ID NO: 5423855 - DNA, 16 bp, Homo sapiens
gcctgggtccagggga

SEQ ID NO: 5423856 - DNA, 15 bp, Homo sapiens
gcctgggtcccaggg

SEQ ID NO: 5423857 - DNA, 16 bp, Homo sapiens
gcctgggtcccagggc

SEQ ID NO: 5423858 - DNA, 18 bp, Homo sapiens
gcctgggtcccagggctg

SEQ ID NO: 5423859 - DNA, 19 bp, Homo sapiens
gcctgggtcccagggctgg

SEQ ID NO: 5423860 - DNA, 20 bp, Homo sapiens
gcctgggtcccagggctggc

SEQ ID NO: 5423861 - DNA, 17 bp, Homo sapiens
gcctgggtccccctcct

SEQ ID NO: 5423862 - DNA, 21 bp, Homo sapiens
gcctgggtccccctcctgcac

SEQ ID NO: 5423863 - DNA, 17 bp, Homo sapiens
gcctgggtcctcccagc

SEQ ID NO: 5423864 - DNA, 18 bp, Homo sapiens
gcctgggtcctcccagct

SEQ ID NO: 5423865 - DNA, 19 bp, Homo sapiens
gcctgggtcctcccagctg

SEQ ID NO: 5423866 - DNA, 19 bp, Homo sapiens
gcctgggtcctcggccctg

SEQ ID NO: 5423867 - DNA, 17 bp, Homo sapiens
gcctgggtctccacatc

SEQ ID NO: 5423868 - DNA, 20 bp, Homo sapiens
gcctgggtctccctggtggg

SEQ ID NO: 5423869 - DNA, 20 bp, Homo sapiens
gcctgggtgacaaagcgaga

SEQ ID NO: 5423870 - DNA, 23 bp, Homo sapiens
gcctgggtgacaaagtgagactc

SEQ ID NO: 5423871 - DNA, 14 bp, Homo sapiens
gcctgggtgacaga

SEQ ID NO: 5423872 - DNA, 15 bp, Homo sapiens
gcctgggtgacagag

SEQ ID NO: 5423873 - DNA, 16 bp, Homo sapiens
gcctgggtgacagagc

SEQ ID NO: 5423874 - DNA, 19 bp, Homo sapiens
gcctgggtgacagagcgag

SEQ ID NO: 5423875 - DNA, 15 bp, Homo sapiens
gcctgggtgacagtg

SEQ ID NO: 5423876 - DNA, 19 bp, Homo sapiens
gcctgggtgacccccactg

SEQ ID NO: 5423877 - DNA, 22 bp, Homo sapiens
gcctgggtgagaatcctgcctc

SEQ ID NO: 5423878 - DNA, 19 bp, Homo sapiens
gcctgggtgatctgctgct

SEQ ID NO: 5423879 - DNA, 14 bp, Homo sapiens
gcctgggtgctggc

SEQ ID NO: 5423880 - DNA, 15 bp, Homo sapiens
gcctgggtgctggct

SEQ ID NO: 5423881 - DNA, 17 bp, Homo sapiens
gcctgggtgctggctgc

SEQ ID NO: 5423882 - DNA, 19 bp, Homo sapiens
gcctgggtggatcggcctc

SEQ ID NO: 5423883 - DNA, 23 bp, Homo sapiens
gcctgggtggcagagtgagactc

SEQ ID NO: 5423884 - DNA, 13 bp, Homo sapiens
gcctgggtggcca

SEQ ID NO: 5423885 - DNA, 14 bp, Homo sapiens
gcctgggtgggaca

SEQ ID NO: 5423886 - DNA, 15 bp, Homo sapiens
gcctgggtgggacag

SEQ ID NO: 5423887 - DNA, 17 bp, Homo sapiens
gcctgggtgggacagcc

SEQ ID NO: 5423888 - DNA, 22 bp, Homo sapiens
gcctgggtggggcagggcctgg

SEQ ID NO: 5423889 - DNA, 18 bp, Homo sapiens
gcctgggtggggctgctc

SEQ ID NO: 5423890 - DNA, 24 bp, Homo sapiens
gcctgggtggggctgctcctccag

SEQ ID NO: 5423891 - DNA, 14 bp, Homo sapiens
gcctgggtgtcaag

SEQ ID NO: 5423892 - DNA, 15 bp, Homo sapiens
gcctgggttgggggc

SEQ ID NO: 5423893 - DNA, 16 bp, Homo sapiens
gcctgggttgggggca

SEQ ID NO: 5423894 - DNA, 19 bp, Homo sapiens
gcctgggtttggtgtatgg

SEQ ID NO: 5423895 - DNA, 22 bp, Homo sapiens
gcctggtactctggcaaatgat

SEQ ID NO: 5423896 - DNA, 18 bp, Homo sapiens
gcctggtaggtctggatt

SEQ ID NO: 5423897 - DNA, 20 bp, Homo sapiens
gcctggtatatccaaaagct

SEQ ID NO: 5423898 - DNA, 14 bp, Homo sapiens
gcctggtattttca

SEQ ID NO: 5423899 - DNA, 17 bp, Homo sapiens
gcctggtcacagggcat

SEQ ID NO: 5423900 - DNA, 14 bp, Homo sapiens
gcctggtcagcaga

SEQ ID NO: 5423901 - DNA, 16 bp, Homo sapiens
gcctggtcagcagagc

SEQ ID NO: 5423902 - DNA, 16 bp, Homo sapiens
gcctggtccctgggag

SEQ ID NO: 5423903 - DNA, 13 bp, Homo sapiens
gcctggtcctccc

SEQ ID NO: 5423904 - DNA, 18 bp, Homo sapiens
gcctggtcctccctccca

SEQ ID NO: 5423905 - DNA, 19 bp, Homo sapiens
gcctggtcctccctcccaa

SEQ ID NO: 5423906 - DNA, 20 bp, Homo sapiens
gcctggtccttccctgatgg

SEQ ID NO: 5423907 - DNA, 22 bp, Homo sapiens
gcctggtccttccctgatggcc

SEQ ID NO: 5423908 - DNA, 17 bp, Homo sapiens
gcctggtcgccttccac

SEQ ID NO: 5423909 - DNA, 22 bp, Homo sapiens
gcctggtctcaccctggaggca

SEQ ID NO: 5423910 - DNA, 19 bp, Homo sapiens
gcctggtctcctgccccca

SEQ ID NO: 5423911 - DNA, 13 bp, Homo sapiens
gcctggtctctag

SEQ ID NO: 5423912 - DNA, 12 bp, Homo sapiens
gcctggtctgga

SEQ ID NO: 5423913 - DNA, 13 bp, Homo sapiens
gcctggtctggag

SEQ ID NO: 5423914 - DNA, 14 bp, Homo sapiens
gcctggtctggagc

SEQ ID NO: 5423915 - DNA, 16 bp, Homo sapiens
gcctggtctggagccc

SEQ ID NO: 5423916 - DNA, 14 bp, Homo sapiens
gcctggtctgggag

SEQ ID NO: 5423917 - DNA, 15 bp, Homo sapiens
gcctggtctgggagt

SEQ ID NO: 5423918 - DNA, 17 bp, Homo sapiens
gcctggtctgtgcattg

SEQ ID NO: 5423919 - DNA, 15 bp, Homo sapiens
gcctggtgacaggca

SEQ ID NO: 5423920 - DNA, 17 bp, Homo sapiens
gcctggtgacaggcaga

SEQ ID NO: 5423921 - DNA, 13 bp, Homo sapiens
gcctggtgcagtg

SEQ ID NO: 5423922 - DNA, 13 bp, Homo sapiens
gcctggtgcattg

SEQ ID NO: 5423923 - DNA, 13 bp, Homo sapiens
gcctggtgccctg

SEQ ID NO: 5423924 - DNA, 14 bp, Homo sapiens
gcctggtgccctgg

SEQ ID NO: 5423925 - DNA, 18 bp, Homo sapiens
gcctggtgccctggccca

SEQ ID NO: 5423926 - DNA, 19 bp, Homo sapiens
gcctggtgccctggcccag

SEQ ID NO: 5423927 - DNA, 17 bp, Homo sapiens
gcctggtgcgctgtgct

SEQ ID NO: 5423928 - DNA, 16 bp, Homo sapiens
gcctggtggcagctgc

SEQ ID NO: 5423929 - DNA, 12 bp, Homo sapiens
gcctggtggccc

SEQ ID NO: 5423930 - DNA, 18 bp, Homo sapiens
gcctggtggcccagctat

SEQ ID NO: 5423931 - DNA, 15 bp, Homo sapiens
gcctggtgggccacg

SEQ ID NO: 5423932 - DNA, 18 bp, Homo sapiens
gcctggtgggggaagggg

SEQ ID NO: 5423933 - DNA, 20 bp, Homo sapiens
gcctggtgggtcagggggag

SEQ ID NO: 5423934 - DNA, 16 bp, Homo sapiens
gcctggtggttttcaa

SEQ ID NO: 5423935 - DNA, 21 bp, Homo sapiens
gcctggttaaataaggcaggg

SEQ ID NO: 5423936 - DNA, 14 bp, Homo sapiens
gcctggttagaggc

SEQ ID NO: 5423937 - DNA, 19 bp, Homo sapiens
gcctggttcagacacagct

SEQ ID NO: 5423938 - DNA, 22 bp, Homo sapiens
gcctggttcagacacagctctt

SEQ ID NO: 5423939 - DNA, 23 bp, Homo sapiens
gcctggttcagacacagctcttc

SEQ ID NO: 5423940 - DNA, 14 bp, Homo sapiens
gcctggttccctct

SEQ ID NO: 5423941 - DNA, 15 bp, Homo sapiens
gcctggttccctctt

SEQ ID NO: 5423942 - DNA, 20 bp, Homo sapiens
gcctggttccctctttcctg

SEQ ID NO: 5423943 - DNA, 18 bp, Homo sapiens
gcctggttcgtgccatgc

SEQ ID NO: 5423944 - DNA, 19 bp, Homo sapiens
gcctggttctaggctgctg

SEQ ID NO: 5423945 - DNA, 20 bp, Homo sapiens
gcctggttctaggctgctgc

SEQ ID NO: 5423946 - DNA, 18 bp, Homo sapiens
gcctggtttctgggtgct

SEQ ID NO: 5423947 - DNA, 22 bp, Homo sapiens
gcctggtttgcaaagaccacct

SEQ ID NO: 5423948 - DNA, 23 bp, Homo sapiens
gcctggttttcgtcatcttccct

SEQ ID NO: 5423949 - DNA, 19 bp, Homo sapiens
gcctgtaacaagccagatt

SEQ ID NO: 5423950 - DNA, 22 bp, Homo sapiens
gcctgtaacactcctctgcgtc

SEQ ID NO: 5423951 - DNA, 14 bp, Homo sapiens
gcctgtaatcccag

SEQ ID NO: 5423952 - DNA, 18 bp, Homo sapiens
gcctgtaatcccagaact

SEQ ID NO: 5423953 - DNA, 16 bp, Homo sapiens
gcctgtaatcccagca

SEQ ID NO: 5423954 - DNA, 17 bp, Homo sapiens
gcctgtaatcccagcac

SEQ ID NO: 5423955 - DNA, 18 bp, Homo sapiens
gcctgtaatcccagcact

SEQ ID NO: 5423956 - DNA, 18 bp, Homo sapiens
gcctgtaatcccagcagt

SEQ ID NO: 5423957 - DNA, 16 bp, Homo sapiens
gcctgtaatcccagct

SEQ ID NO: 5423958 - DNA, 17 bp, Homo sapiens
gcctgtaatcccagcta

SEQ ID NO: 5423959 - DNA, 19 bp, Homo sapiens
gcctgtaatcccagctact

SEQ ID NO: 5423960 - DNA, 19 bp, Homo sapiens
gcctgtaatcccagtactt

SEQ ID NO: 5423961 - DNA, 20 bp, Homo sapiens
gcctgtaatcctagcacttt

SEQ ID NO: 5423962 - DNA, 17 bp, Homo sapiens
gcctgtaatctttttct

SEQ ID NO: 5423963 - DNA, 18 bp, Homo sapiens
gcctgtaatctttttctc

SEQ ID NO: 5423964 - DNA, 19 bp, Homo sapiens
gcctgtacagaagaaactg

SEQ ID NO: 5423965 - DNA, 11 bp, Homo sapiens
gcctgtacagt

SEQ ID NO: 5423966 - DNA, 12 bp, Homo sapiens
gcctgtacagtc

SEQ ID NO: 5423967 - DNA, 15 bp, Homo sapiens
gcctgtacagtctgt

SEQ ID NO: 5423968 - DNA, 21 bp, Homo sapiens
gcctgtacagtctgtcttctg

SEQ ID NO: 5423969 - DNA, 14 bp, Homo sapiens
gcctgtactgcctg

SEQ ID NO: 5423970 - DNA, 16 bp, Homo sapiens
gcctgtactgcctgct

SEQ ID NO: 5423971 - DNA, 18 bp, Homo sapiens
gcctgtactgcctgcttg

SEQ ID NO: 5423972 - DNA, 20 bp, Homo sapiens
gcctgtactgcctgcttggg

SEQ ID NO: 5423973 - DNA, 19 bp, Homo sapiens
gcctgtagagccagccttg

SEQ ID NO: 5423974 - DNA, 15 bp, Homo sapiens
gcctgtagagttgct

SEQ ID NO: 5423975 - DNA, 20 bp, Homo sapiens
gcctgtagctttcctggtcc

SEQ ID NO: 5423976 - DNA, 21 bp, Homo sapiens
gcctgtagtccatctccagca

SEQ ID NO: 5423977 - DNA, 14 bp, Homo sapiens
gcctgtagtcccag

SEQ ID NO: 5423978 - DNA, 22 bp, Homo sapiens
gcctgtagtcccagctactcag

SEQ ID NO: 5423979 - DNA, 16 bp, Homo sapiens
gcctgtagttaggaaa

SEQ ID NO: 5423980 - DNA, 19 bp, Homo sapiens
gcctgtagttaggaaataa

SEQ ID NO: 5423981 - DNA, 15 bp, Homo sapiens
gcctgtatactttag

SEQ ID NO: 5423982 - DNA, 16 bp, Homo sapiens
gcctgtatagacagca

SEQ ID NO: 5423983 - DNA, 18 bp, Homo sapiens
gcctgtatagacagcact

SEQ ID NO: 5423984 - DNA, 23 bp, Homo sapiens
gcctgtatcctccctggcagaca

SEQ ID NO: 5423985 - DNA, 19 bp, Homo sapiens
gcctgtatgagacaggaaa

SEQ ID NO: 5423986 - DNA, 16 bp, Homo sapiens
gcctgtattcccagct

SEQ ID NO: 5423987 - DNA, 16 bp, Homo sapiens
gcctgtatttgagaga

SEQ ID NO: 5423988 - DNA, 18 bp, Homo sapiens
gcctgtatttgagagact

SEQ ID NO: 5423989 - DNA, 19 bp, Homo sapiens
gcctgtatttgagagactg

SEQ ID NO: 5423990 - DNA, 17 bp, Homo sapiens
gcctgtcaagagggagg

SEQ ID NO: 5423991 - DNA, 16 bp, Homo sapiens
gcctgtcaataaatgt

SEQ ID NO: 5423992 - DNA, 17 bp, Homo sapiens
gcctgtcaataaatgtt

SEQ ID NO: 5423993 - DNA, 15 bp, Homo sapiens
gcctgtcacaataaa

SEQ ID NO: 5423994 - DNA, 18 bp, Homo sapiens
gcctgtcacaataaagtt

SEQ ID NO: 5423995 - DNA, 16 bp, Homo sapiens
gcctgtcaccagagct

SEQ ID NO: 5423996 - DNA, 18 bp, Homo sapiens
gcctgtcaccagagcttc

SEQ ID NO: 5423997 - DNA, 14 bp, Homo sapiens
gcctgtcaccccag

SEQ ID NO: 5423998 - DNA, 23 bp, Homo sapiens
gccttcatcctcctccccagctc

SEQ ID NO: 5423999 - DNA, 15 bp, Homo sapiens
gccttcatgccagtg

SEQ ID NO: 5424000 - DNA, 16 bp, Homo sapiens
gccttcatgccagtgc

SEQ ID NO: 5424001 - DNA, 22 bp, Homo sapiens
gccttcattaaatgtttgttga

SEQ ID NO: 5424002 - DNA, 13 bp, Homo sapiens
gccttcattacct

SEQ ID NO: 5424003 - DNA, 19 bp, Homo sapiens
gccttccaaaacctgcttc

SEQ ID NO: 5424004 - DNA, 22 bp, Homo sapiens
gccttccaaaacctgcttcctt

SEQ ID NO: 5424005 - DNA, 20 bp, Homo sapiens
gccttccaactagctgggac

SEQ ID NO: 5424006 - DNA, 23 bp, Homo sapiens
gccttccaactagctgggactac

SEQ ID NO: 5424007 - DNA, 12 bp, Homo sapiens
gccttccaccca

SEQ ID NO: 5424008 - DNA, 15 bp, Homo sapiens
gccttccaccctgcc

SEQ ID NO: 5424009 - DNA, 16 bp, Homo sapiens
gccttccaccctgccc

SEQ ID NO: 5424010 - DNA, 20 bp, Homo sapiens
gccttccaccggcactcatg

SEQ ID NO: 5424011 - DNA, 21 bp, Homo sapiens
gccttccagaaagcaggagca

SEQ ID NO: 5424012 - DNA, 16 bp, Homo sapiens
gccttccagatcctct

SEQ ID NO: 5424013 - DNA, 20 bp, Homo sapiens
gccttccagatcctctctgg

SEQ ID NO: 5424014 - DNA, 13 bp, Homo sapiens
gccttccagctgc

SEQ ID NO: 5424015 - DNA, 19 bp, Homo sapiens
gccttccagggatttgcct

SEQ ID NO: 5424016 - DNA, 16 bp, Homo sapiens
gccttccagtggcttc

SEQ ID NO: 5424017 - DNA, 17 bp, Homo sapiens
gccttccagtggcttct

SEQ ID NO: 5424018 - DNA, 21 bp, Homo sapiens
gccttccagtggcttctccca

SEQ ID NO: 5424019 - DNA, 18 bp, Homo sapiens
gccttccagttttgtgga

SEQ ID NO: 5424020 - DNA, 14 bp, Homo sapiens
gccttccataatta

SEQ ID NO: 5424021 - DNA, 21 bp, Homo sapiens
gccttccataattatgacagt

SEQ ID NO: 5424022 - DNA, 20 bp, Homo sapiens
gccttccatgtcggcctcta

SEQ ID NO: 5424023 - DNA, 21 bp, Homo sapiens
gccttcccaagttgtgcttga

SEQ ID NO: 5424024 - DNA, 17 bp, Homo sapiens
gccttcccagcttcccg

SEQ ID NO: 5424025 - DNA, 14 bp, Homo sapiens
gccttcccatggcc

SEQ ID NO: 5424026 - DNA, 22 bp, Homo sapiens
gccttccccacccaccaaccct

SEQ ID NO: 5424027 - DNA, 18 bp, Homo sapiens
gccttccccctcccaggg

SEQ ID NO: 5424028 - DNA, 23 bp, Homo sapiens
gccttcccccttcctttggtgcc

SEQ ID NO: 5424029 - DNA, 20 bp, Homo sapiens
gccttccccttatcctccct

SEQ ID NO: 5424030 - DNA, 16 bp, Homo sapiens
gccttccccttgccca

SEQ ID NO: 5424031 - DNA, 16 bp, Homo sapiens
gccttccccttttgcc

SEQ ID NO: 5424032 - DNA, 20 bp, Homo sapiens
gccttccccttttgcctggc

SEQ ID NO: 5424033 - DNA, 21 bp, Homo sapiens
gccttccccttttgcctggct

SEQ ID NO: 5424034 - DNA, 16 bp, Homo sapiens
gccttcccgccggagg

SEQ ID NO: 5424035 - DNA, 16 bp, Homo sapiens
gccttcccgggcgggc

SEQ ID NO: 5424036 - DNA, 23 bp, Homo sapiens
gccttccctagctttagaccctg

SEQ ID NO: 5424037 - DNA, 24 bp, Homo sapiens
gccttccctagctttagaccctgg

SEQ ID NO: 5424038 - DNA, 16 bp, Homo sapiens
gccttccctcactctt

SEQ ID NO: 5424039 - DNA, 18 bp, Homo sapiens
gccttccctcactcttcc

SEQ ID NO: 5424040 - DNA, 24 bp, Homo sapiens
gccttccctcactcttcctcatcc

SEQ ID NO: 5424041 - DNA, 15 bp, Homo sapiens
gccttccctctgcat

SEQ ID NO: 5424042 - DNA, 17 bp, Homo sapiens
gccttccctctgcattg

SEQ ID NO: 5424043 - DNA, 14 bp, Homo sapiens
gccttcccttctct

SEQ ID NO: 5424044 - DNA, 20 bp, Homo sapiens
gccttcccttctctggtctc

SEQ ID NO: 5424045 - DNA, 14 bp, Homo sapiens
gccttccctttaca

SEQ ID NO: 5424046 - DNA, 19 bp, Homo sapiens
gccttccgacaccactggg

SEQ ID NO: 5424047 - DNA, 20 bp, Homo sapiens
gccttccgacaccactggga

SEQ ID NO: 5424048 - DNA, 17 bp, Homo sapiens
gccttccgctcccacca

SEQ ID NO: 5424049 - DNA, 21 bp, Homo sapiens
gccttccgctcccaccagccc

SEQ ID NO: 5424050 - DNA, 20 bp, Homo sapiens
gccttccgtgggtcatccca

SEQ ID NO: 5424051 - DNA, 21 bp, Homo sapiens
gccttccgtgggtcatcccag

SEQ ID NO: 5424052 - DNA, 22 bp, Homo sapiens
gccttccgtgggtcatcccagc

SEQ ID NO: 5424053 - DNA, 15 bp, Homo sapiens
gccttcctaagcctg

SEQ ID NO: 5424054 - DNA, 17 bp, Homo sapiens
gccttcctaagcctgtg

SEQ ID NO: 5424055 - DNA, 16 bp, Homo sapiens
gccttcctaccctctc

SEQ ID NO: 5424056 - DNA, 13 bp, Homo sapiens
gccttcctcagct

SEQ ID NO: 5424057 - DNA, 15 bp, Homo sapiens
gccttcctcagctgc

SEQ ID NO: 5424058 - DNA, 20 bp, Homo sapiens
gccttcctcagctgcctcct

SEQ ID NO: 5424059 - DNA, 20 bp, Homo sapiens
gccttcctccatggcccatc

SEQ ID NO: 5424060 - DNA, 15 bp, Homo sapiens
gccttcctccccgcc

SEQ ID NO: 5424061 - DNA, 14 bp, Homo sapiens
gccttcctcctcca

SEQ ID NO: 5424062 - DNA, 20 bp, Homo sapiens
gccttcctcctccacagtgc

SEQ ID NO: 5424063 - DNA, 15 bp, Homo sapiens
gccttcctcgtgcag

SEQ ID NO: 5424064 - DNA, 18 bp, Homo sapiens
gccttcctcgtgcagagc

SEQ ID NO: 5424065 - DNA, 19 bp, Homo sapiens
gccttcctcgtgcagagct

SEQ ID NO: 5424066 - DNA, 16 bp, Homo sapiens
gccttcctctctccag

SEQ ID NO: 5424067 - DNA, 18 bp, Homo sapiens
gccttcctctctccagat

SEQ ID NO: 5424068 - DNA, 13 bp, Homo sapiens
gccttcctctgca

SEQ ID NO: 5424069 - DNA, 16 bp, Homo sapiens
gccttcctctgcagct

SEQ ID NO: 5424070 - DNA, 17 bp, Homo sapiens
gccttcctctgcagctg

SEQ ID NO: 5424071 - DNA, 20 bp, Homo sapiens
gccttcctctgcagctgacc

SEQ ID NO: 5424072 - DNA, 16 bp, Homo sapiens
gccttcctgcagtctc

SEQ ID NO: 5424073 - DNA, 13 bp, Homo sapiens
gccttcctggctt

SEQ ID NO: 5424074 - DNA, 22 bp, Homo sapiens
gccttcctgtctttctggccct

SEQ ID NO: 5424075 - DNA, 19 bp, Homo sapiens
gccttcctgtttttcacat

SEQ ID NO: 5424076 - DNA, 11 bp, Homo sapiens
gccttccttcc

SEQ ID NO: 5424077 - DNA, 19 bp, Homo sapiens
gccttccttctgctcccac

SEQ ID NO: 5424078 - DNA, 21 bp, Homo sapiens
gccttccttctgctcccaccc

SEQ ID NO: 5424079 - DNA, 19 bp, Homo sapiens
gccttccttgaccttcctc

SEQ ID NO: 5424080 - DNA, 20 bp, Homo sapiens
gccttccttgaccttcctct

SEQ ID NO: 5424081 - DNA, 19 bp, Homo sapiens
gccttcctttctcctgccc

SEQ ID NO: 5424082 - DNA, 22 bp, Homo sapiens
gccttcctttctcctgccccaa

SEQ ID NO: 5424083 - DNA, 21 bp, Homo sapiens
gccttccttttgaggagctgg

SEQ ID NO: 5424084 - DNA, 23 bp, Homo sapiens
gccttcgaaaagaaattgtcctt

SEQ ID NO: 5424085 - DNA, 18 bp, Homo sapiens
gccttcgaccacagcaag

SEQ ID NO: 5424086 - DNA, 16 bp, Homo sapiens
gccttcgaggtcagag

SEQ ID NO: 5424087 - DNA, 13 bp, Homo sapiens
gccttcgatttta

SEQ ID NO: 5424088 - DNA, 21 bp, Homo sapiens
gccttcgcttcttgcctctgt

SEQ ID NO: 5424089 - DNA, 21 bp, Homo sapiens
gccttcggcctccatcctgag

SEQ ID NO: 5424090 - DNA, 18 bp, Homo sapiens
gccttcgtgtgctgctgc

SEQ ID NO: 5424091 - DNA, 15 bp, Homo sapiens
gccttctaaaggtgt

SEQ ID NO: 5424092 - DNA, 16 bp, Homo sapiens
gccttctaaattccca

SEQ ID NO: 5424093 - DNA, 17 bp, Homo sapiens
gccttctagattcactg

SEQ ID NO: 5424094 - DNA, 19 bp, Homo sapiens
gccttctaggaatggagga

SEQ ID NO: 5424095 - DNA, 21 bp, Homo sapiens
gccttctaggaatggaggagc

SEQ ID NO: 5424096 - DNA, 14 bp, Homo sapiens
gccttctcagctct

SEQ ID NO: 5424097 - DNA, 23 bp, Homo sapiens
gccttctcagctctccaccccca

SEQ ID NO: 5424098 - DNA, 16 bp, Homo sapiens
gccttctcaggccccg

SEQ ID NO: 5424099 - DNA, 17 bp, Homo sapiens
gccttctcatgatccaa

SEQ ID NO: 5424100 - DNA, 12 bp, Homo sapiens
gccttctccagg

SEQ ID NO: 5424101 - DNA, 19 bp, Homo sapiens
gccttctccaggcttcccc

SEQ ID NO: 5424102 - DNA, 23 bp, Homo sapiens
gccttctccatatctccatggcc

SEQ ID NO: 5424103 - DNA, 20 bp, Homo sapiens
gccttctcccacatgaggcc

SEQ ID NO: 5424104 - DNA, 17 bp, Homo sapiens
gccttctcctgcctaca

SEQ ID NO: 5424105 - DNA, 17 bp, Homo sapiens
gccttctccttccccag

SEQ ID NO: 5424106 - DNA, 18 bp, Homo sapiens
gccttctccttccccagg

SEQ ID NO: 5424107 - DNA, 21 bp, Homo sapiens
gccttctccttccccaggatg

SEQ ID NO: 5424108 - DNA, 15 bp, Homo sapiens
gccttctctcagctc

SEQ ID NO: 5424109 - DNA, 15 bp, Homo sapiens
gccttctctctctgg

SEQ ID NO: 5424110 - DNA, 22 bp, Homo sapiens
gccttctcttgaggcctgtgct

SEQ ID NO: 5424111 - DNA, 16 bp, Homo sapiens
gccttctgaactccat

SEQ ID NO: 5424112 - DNA, 17 bp, Homo sapiens
gccttctgacggccctg

SEQ ID NO: 5424113 - DNA, 18 bp, Homo sapiens
gccttctgacggccctgc

SEQ ID NO: 5424114 - DNA, 20 bp, Homo sapiens
gccttctgacggccctgcaa

SEQ ID NO: 5424115 - DNA, 16 bp, Homo sapiens
gccttctgatgaaatg

SEQ ID NO: 5424116 - DNA, 23 bp, Homo sapiens
gccttctgatgtctctaaagcac

SEQ ID NO: 5424117 - DNA, 13 bp, Homo sapiens
gccttctgcagca

SEQ ID NO: 5424118 - DNA, 21 bp, Homo sapiens
gccttctgccaacgcctcctg

SEQ ID NO: 5424119 - DNA, 19 bp, Homo sapiens
gccttctgccaccagcccc

SEQ ID NO: 5424120 - DNA, 20 bp, Homo sapiens
gccttctgccaccagcccct

SEQ ID NO: 5424121 - DNA, 12 bp, Homo sapiens
gccttctgctga

SEQ ID NO: 5424122 - DNA, 16 bp, Homo sapiens
gccttctgctgcccag

SEQ ID NO: 5424123 - DNA, 15 bp, Homo sapiens
gccttctggatccat

SEQ ID NO: 5424124 - DNA, 21 bp, Homo sapiens
gccttctggattcttggcccg

SEQ ID NO: 5424125 - DNA, 22 bp, Homo sapiens
gccttctgggaagggagagggc

SEQ ID NO: 5424126 - DNA, 19 bp, Homo sapiens
gccttctggtgttggacaa

SEQ ID NO: 5424127 - DNA, 22 bp, Homo sapiens
gccttctggtttcttccagcca

SEQ ID NO: 5424128 - DNA, 16 bp, Homo sapiens
gccttctgtcctggtg

SEQ ID NO: 5424129 - DNA, 14 bp, Homo sapiens
gccttctgtggggc

SEQ ID NO: 5424130 - DNA, 22 bp, Homo sapiens
gccttctgtggggctgggcacc

SEQ ID NO: 5424131 - DNA, 17 bp, Homo sapiens
gccttcttagagtttta

SEQ ID NO: 5424132 - DNA, 19 bp, Homo sapiens
gccttcttattctcactcc

SEQ ID NO: 5424133 - DNA, 20 bp, Homo sapiens
gccttcttattctcactcca

SEQ ID NO: 5424134 - DNA, 13 bp, Homo sapiens
gccttcttccagg

SEQ ID NO: 5424135 - DNA, 14 bp, Homo sapiens
gccttcttccatcc

SEQ ID NO: 5424136 - DNA, 20 bp, Homo sapiens
gccttcttccatcccaggac

SEQ ID NO: 5424137 - DNA, 19 bp, Homo sapiens
gccttcttccttgaggggc

SEQ ID NO: 5424138 - DNA, 17 bp, Homo sapiens
gccttcttctgccactt

SEQ ID NO: 5424139 - DNA, 18 bp, Homo sapiens
gccttcttctttttgctg

SEQ ID NO: 5424140 - DNA, 21 bp, Homo sapiens
gccttcttctttttgctgttg

SEQ ID NO: 5424141 - DNA, 16 bp, Homo sapiens
gccttcttgccagcca

SEQ ID NO: 5424142 - DNA, 13 bp, Homo sapiens
gccttcttgctgc

SEQ ID NO: 5424143 - DNA, 19 bp, Homo sapiens
gccttcttggtttcagcca

SEQ ID NO: 5424144 - DNA, 11 bp, Homo sapiens
gccttctttga

SEQ ID NO: 5424145 - DNA, 15 bp, Homo sapiens
gccttctttgcttgc

SEQ ID NO: 5424146 - DNA, 19 bp, Homo sapiens
gccttctttgcttgcctct

SEQ ID NO: 5424147 - DNA, 15 bp, Homo sapiens
gccttctttttctgg

SEQ ID NO: 5424148 - DNA, 16 bp, Homo sapiens
gccttctttttctgga

SEQ ID NO: 5424149 - DNA, 19 bp, Homo sapiens
gccttgaaaaacaagtctt

SEQ ID NO: 5424150 - DNA, 12 bp, Homo sapiens
gccttgaaaaca

SEQ ID NO: 5424151 - DNA, 19 bp, Homo sapiens
gccttgaaaacaaacaaat

SEQ ID NO: 5424152 - DNA, 21 bp, Homo sapiens
gccttgaaatttacacagtga

SEQ ID NO: 5424153 - DNA, 23 bp, Homo sapiens
gccttgaacaacccaatctggct

SEQ ID NO: 5424154 - DNA, 18 bp, Homo sapiens
gccttgaaccacttccct

SEQ ID NO: 5424155 - DNA, 14 bp, Homo sapiens
gccttgaactttga

SEQ ID NO: 5424156 - DNA, 17 bp, Homo sapiens
gccttgaagacagagca

SEQ ID NO: 5424157 - DNA, 15 bp, Homo sapiens
gccttgaagccactg

SEQ ID NO: 5424158 - DNA, 22 bp, Homo sapiens
gccttgaatatcccctcccagt

SEQ ID NO: 5424159 - DNA, 16 bp, Homo sapiens
gccttgacaagtacat

SEQ ID NO: 5424160 - DNA, 19 bp, Homo sapiens
gccttgaccattctccacc

SEQ ID NO: 5424161 - DNA, 23 bp, Homo sapiens
gccttgagagaaaaagtgcccct

SEQ ID NO: 5424162 - DNA, 19 bp, Homo sapiens
gccttgagagacccagctg

SEQ ID NO: 5424163 - DNA, 18 bp, Homo sapiens
gccttgagatgcttcact

SEQ ID NO: 5424164 - DNA, 14 bp, Homo sapiens
gccttgagcacaaa

SEQ ID NO: 5424165 - DNA, 14 bp, Homo sapiens
gccttgagtctctg

SEQ ID NO: 5424166 - DNA, 16 bp, Homo sapiens
gccttgagtctctgaa

SEQ ID NO: 5424167 - DNA, 20 bp, Homo sapiens
gccttgagtgacatgcggct

SEQ ID NO: 5424168 - DNA, 21 bp, Homo sapiens
gccttgatccccttgatagat

SEQ ID NO: 5424169 - DNA, 15 bp, Homo sapiens
gccttgatgaagcct

SEQ ID NO: 5424170 - DNA, 20 bp, Homo sapiens
gccttgatgaagcctgtgcc

SEQ ID NO: 5424171 - DNA, 23 bp, Homo sapiens
gccttgatgaagcctgtgccacc

SEQ ID NO: 5424172 - DNA, 16 bp, Homo sapiens
gccttgatgactgcct

SEQ ID NO: 5424173 - DNA, 18 bp, Homo sapiens
gccttgatggagaaggaa

SEQ ID NO: 5424174 - DNA, 20 bp, Homo sapiens
gcgcagggaggatgccacag

SEQ ID NO: 5424175 - DNA, 12 bp, Homo sapiens
gcgcagggctgg

SEQ ID NO: 5424176 - DNA, 14 bp, Homo sapiens
gcgcagggctggca

SEQ ID NO: 5424177 - DNA, 23 bp, Homo sapiens
gcgcagggtggtggtattctgtc

SEQ ID NO: 5424178 - DNA, 18 bp, Homo sapiens
gcgcaggtgccatgcctg

SEQ ID NO: 5424179 - DNA, 20 bp, Homo sapiens
gcgcaggtgccatgcctgct

SEQ ID NO: 5424180 - DNA, 23 bp, Homo sapiens
gcgcaggtgccatgcctgctccc

SEQ ID NO: 5424181 - DNA, 13 bp, Homo sapiens
gcgcagtccccag

SEQ ID NO: 5424182 - DNA, 22 bp, Homo sapiens
gcgcagtgcttctctacagact

SEQ ID NO: 5424183 - DNA, 23 bp, Homo sapiens
gcgcataggcctgctttgtctcc

SEQ ID NO: 5424184 - DNA, 20 bp, Homo sapiens
gcgcatagtgtgctcggaca

SEQ ID NO: 5424185 - DNA, 20 bp, Homo sapiens
gcgcatcaatgtattttatc

SEQ ID NO: 5424186 - DNA, 13 bp, Homo sapiens
gcgcatcagactg

SEQ ID NO: 5424187 - DNA, 21 bp, Homo sapiens
gcgcatccaatctcaaggaat

SEQ ID NO: 5424188 - DNA, 11 bp, Homo sapiens
gcgcatctaac

SEQ ID NO: 5424189 - DNA, 16 bp, Homo sapiens
gcgcatctcttcctga

SEQ ID NO: 5424190 - DNA, 17 bp, Homo sapiens
gcgcatctcttcctgat

SEQ ID NO: 5424191 - DNA, 19 bp, Homo sapiens
gcgcatgagtatctgtggg

SEQ ID NO: 5424192 - DNA, 20 bp, Homo sapiens
gcgcatgagtatctgtggga

SEQ ID NO: 5424193 - DNA, 20 bp, Homo sapiens
gcgcatgcctcccaggccac

SEQ ID NO: 5424194 - DNA, 15 bp, Homo sapiens
gcgcatggcgccccg

SEQ ID NO: 5424195 - DNA, 19 bp, Homo sapiens
gcgcatgtaatcccagcta

SEQ ID NO: 5424196 - DNA, 13 bp, Homo sapiens
gcgcatgtgtgca

SEQ ID NO: 5424197 - DNA, 17 bp, Homo sapiens
gcgcattgttttgcatc

SEQ ID NO: 5424198 - DNA, 18 bp, Homo sapiens
gcgccaaataatgtctct

SEQ ID NO: 5424199 - DNA, 21 bp, Homo sapiens
gcgccaagcaacctgggtcca

SEQ ID NO: 5424200 - DNA, 12 bp, Homo sapiens
gcgccaccacca

SEQ ID NO: 5424201 - DNA, 21 bp, Homo sapiens
gcgccaccgagtgccttcaac

SEQ ID NO: 5424202 - DNA, 19 bp, Homo sapiens
gcgccactgagacggcaga

SEQ ID NO: 5424203 - DNA, 20 bp, Homo sapiens
gcgccactgcactccagcct

SEQ ID NO: 5424204 - DNA, 19 bp, Homo sapiens
gcgccactgctccgtggag

SEQ ID NO: 5424205 - DNA, 21 bp, Homo sapiens
gcgccagcacagaaacagagg

SEQ ID NO: 5424206 - DNA, 11 bp, Homo sapiens
gcgccagctcc

SEQ ID NO: 5424207 - DNA, 13 bp, Homo sapiens
gcgccaggacagc

SEQ ID NO: 5424208 - DNA, 22 bp, Homo sapiens
gcgccaggatggaacacggcca

SEQ ID NO: 5424209 - DNA, 13 bp, Homo sapiens
gcgccaggcagag

SEQ ID NO: 5424210 - DNA, 21 bp, Homo sapiens
gcgccaggcagagctgagggc

SEQ ID NO: 5424211 - DNA, 23 bp, Homo sapiens
gcgccaggcagagctgagggccc

SEQ ID NO: 5424212 - DNA, 14 bp, Homo sapiens
gcgccaggctggag

SEQ ID NO: 5424213 - DNA, 13 bp, Homo sapiens
gcgccagggccca

SEQ ID NO: 5424214 - DNA, 16 bp, Homo sapiens
gcgccagggcccaggc

SEQ ID NO: 5424215 - DNA, 15 bp, Homo sapiens
gcgccagggctcaga

SEQ ID NO: 5424216 - DNA, 20 bp, Homo sapiens
gcgccagtacattccaactt

SEQ ID NO: 5424217 - DNA, 13 bp, Homo sapiens
gcgccagtcctgc

SEQ ID NO: 5424218 - DNA, 23 bp, Homo sapiens
gcgccatctcggctcactgcaac

SEQ ID NO: 5424219 - DNA, 18 bp, Homo sapiens
gcgccatgtgtgtcagcc

SEQ ID NO: 5424220 - DNA, 16 bp, Homo sapiens
gcgcccaccccgctct

SEQ ID NO: 5424221 - DNA, 17 bp, Homo sapiens
gcgcccacccggcccgg

SEQ ID NO: 5424222 - DNA, 18 bp, Homo sapiens
gcgcccacccggcccggc

SEQ ID NO: 5424223 - DNA, 14 bp, Homo sapiens
gcgcccaccctggg

SEQ ID NO: 5424224 - DNA, 19 bp, Homo sapiens
gcgcccaccctgggctcca

SEQ ID NO: 5424225 - DNA, 21 bp, Homo sapiens
gcgcccaccctgggctccaca

SEQ ID NO: 5424226 - DNA, 13 bp, Homo sapiens
gcgcccacctccc

SEQ ID NO: 5424227 - DNA, 12 bp, Homo sapiens
gcgcccacctgc

SEQ ID NO: 5424228 - DNA, 18 bp, Homo sapiens
gcgcccagagctggcctc

SEQ ID NO: 5424229 - DNA, 17 bp, Homo sapiens
gcgcccagcagcctgcc

SEQ ID NO: 5424230 - DNA, 22 bp, Homo sapiens
gcgcccaggccagtgctgtgag

SEQ ID NO: 5424231 - DNA, 15 bp, Homo sapiens
gcgcccaggcctgct

SEQ ID NO: 5424232 - DNA, 16 bp, Homo sapiens
gcgcccaggcctgctg

SEQ ID NO: 5424233 - DNA, 17 bp, Homo sapiens
gcgcccaggcctgctgg

SEQ ID NO: 5424234 - DNA, 19 bp, Homo sapiens
gcgcccaggcctgctggca

SEQ ID NO: 5424235 - DNA, 19 bp, Homo sapiens
gcgcccagtccttccacct

SEQ ID NO: 5424236 - DNA, 19 bp, Homo sapiens
gcgcccattcgtctgtccc

SEQ ID NO: 5424237 - DNA, 18 bp, Homo sapiens
gcgccccaacccgtggag

SEQ ID NO: 5424238 - DNA, 21 bp, Homo sapiens
gcgccccaacccgtggaggct

SEQ ID NO: 5424239 - DNA, 19 bp, Homo sapiens
gcgccccaccgccgtggag

SEQ ID NO: 5424240 - DNA, 19 bp, Homo sapiens
gcgccccatgggccctcag

SEQ ID NO: 5424241 - DNA, 13 bp, Homo sapiens
gcgcccccactcc

SEQ ID NO: 5424242 - DNA, 16 bp, Homo sapiens
gcgcccccactcctcc

SEQ ID NO: 5424243 - DNA, 12 bp, Homo sapiens
gcgcccccagga

SEQ ID NO: 5424244 - DNA, 15 bp, Homo sapiens
gcgcccccaggcctg

SEQ ID NO: 5424245 - DNA, 16 bp, Homo sapiens
gcgcccccatctgtct

SEQ ID NO: 5424246 - DNA, 15 bp, Homo sapiens
gcgccccccagtgga

SEQ ID NO: 5424247 - DNA, 16 bp, Homo sapiens
gcgcccccctcccaga

SEQ ID NO: 5424248 - DNA, 17 bp, Homo sapiens
gcgcccccctcccagag

SEQ ID NO: 5424249 - DNA, 18 bp, Homo sapiens
gcgcccccctcccagagg

SEQ ID NO: 5424250 - DNA, 12 bp, Homo sapiens
gcgccccccttt

SEQ ID NO: 5424251 - DNA, 14 bp, Homo sapiens
gcgcccccgagccc

SEQ ID NO: 5424252 - DNA, 17 bp, Homo sapiens
gcgcccccgccccaggc

SEQ ID NO: 5424253 - DNA, 20 bp, Homo sapiens
gcgcccccttctttgcagct

SEQ ID NO: 5424254 - DNA, 20 bp, Homo sapiens
gcgccccgcccccaccccta

SEQ ID NO: 5424255 - DNA, 14 bp, Homo sapiens
gcgccccgcctccc

SEQ ID NO: 5424256 - DNA, 20 bp, Homo sapiens
gcgcccctcagcctctgcca

SEQ ID NO: 5424257 - DNA, 11 bp, Homo sapiens
gcgcccctccc

SEQ ID NO: 5424258 - DNA, 12 bp, Homo sapiens
gcgcccctctgc

SEQ ID NO: 5424259 - DNA, 14 bp, Homo sapiens
gcgcccctctgcgc

SEQ ID NO: 5424260 - DNA, 16 bp, Homo sapiens
gcgcccctctgcgccc

SEQ ID NO: 5424261 - DNA, 14 bp, Homo sapiens
gcgcccctgcccag

SEQ ID NO: 5424262 - DNA, 18 bp, Homo sapiens
gcgcccctgcccagcacc

SEQ ID NO: 5424263 - DNA, 14 bp, Homo sapiens
gcgcccctgggact

SEQ ID NO: 5424264 - DNA, 13 bp, Homo sapiens
gcgcccctgggag

SEQ ID NO: 5424265 - DNA, 22 bp, Homo sapiens
gcgcccctggtggtcacaggct

SEQ ID NO: 5424266 - DNA, 13 bp, Homo sapiens
gcgcccctgtcca

SEQ ID NO: 5424267 - DNA, 14 bp, Homo sapiens
gcgcccctgtccat

SEQ ID NO: 5424268 - DNA, 13 bp, Homo sapiens
gcgccccttcccc

SEQ ID NO: 5424269 - DNA, 17 bp, Homo sapiens
gcgcccgcccctgcagc

SEQ ID NO: 5424270 - DNA, 13 bp, Homo sapiens
gcgcccgcgcccg

SEQ ID NO: 5424271 - DNA, 13 bp, Homo sapiens
gcgcccgcggcgc

SEQ ID NO: 5424272 - DNA, 13 bp, Homo sapiens
gcgcccgctgggc

SEQ ID NO: 5424273 - DNA, 16 bp, Homo sapiens
gcgcccgctgggctga

SEQ ID NO: 5424274 - DNA, 17 bp, Homo sapiens
gcgccctcccccatggg

SEQ ID NO: 5424275 - DNA, 18 bp, Homo sapiens
gcgccctccctccctcca

SEQ ID NO: 5424276 - DNA, 18 bp, Homo sapiens
gcgccctccgacctctct

SEQ ID NO: 5424277 - DNA, 16 bp, Homo sapiens
gcgccctctctgctcc

SEQ ID NO: 5424278 - DNA, 12 bp, Homo sapiens
gcgccctgcaga

SEQ ID NO: 5424279 - DNA, 18 bp, Homo sapiens
gcgccctgcagaccctgc

SEQ ID NO: 5424280 - DNA, 15 bp, Homo sapiens
gcgccctgcagggcc

SEQ ID NO: 5424281 - DNA, 13 bp, Homo sapiens
gcgccctggaagc

SEQ ID NO: 5424282 - DNA, 16 bp, Homo sapiens
gcgccctggacttggt

SEQ ID NO: 5424283 - DNA, 12 bp, Homo sapiens
gcgccctggccc

SEQ ID NO: 5424284 - DNA, 14 bp, Homo sapiens
gcgccctggccccc

SEQ ID NO: 5424285 - DNA, 14 bp, Homo sapiens
gcgcccttcctctc

SEQ ID NO: 5424286 - DNA, 16 bp, Homo sapiens
gcgcccttggcttctg

SEQ ID NO: 5424287 - DNA, 18 bp, Homo sapiens
gcgccctttccccgacgc

SEQ ID NO: 5424288 - DNA, 16 bp, Homo sapiens
gcgccgactccctgag

SEQ ID NO: 5424289 - DNA, 15 bp, Homo sapiens
gcgccgatgccaccg

SEQ ID NO: 5424290 - DNA, 19 bp, Homo sapiens
gcgccgcaaaccacactgg

SEQ ID NO: 5424291 - DNA, 21 bp, Homo sapiens
gcgccgcaaaccacactggac

SEQ ID NO: 5424292 - DNA, 16 bp, Homo sapiens
gcgccgcgtggacagc

SEQ ID NO: 5424293 - DNA, 22 bp, Homo sapiens
gcgccgcgtggacagccggagc

SEQ ID NO: 5424294 - DNA, 23 bp, Homo sapiens
gcgccggcaaaactttggcactg

SEQ ID NO: 5424295 - DNA, 13 bp, Homo sapiens
gcgccggcgcccc

SEQ ID NO: 5424296 - DNA, 15 bp, Homo sapiens
gcgccggcgccccgg

SEQ ID NO: 5424297 - DNA, 19 bp, Homo sapiens
gcgccggtccggcgccccg

SEQ ID NO: 5424298 - DNA, 18 bp, Homo sapiens
gcgccggttccacgtggg

SEQ ID NO: 5424299 - DNA, 19 bp, Homo sapiens
gcgccgtgagttctcaggg

SEQ ID NO: 5424300 - DNA, 17 bp, Homo sapiens
gcgccgtgctgggcagc

SEQ ID NO: 5424301 - DNA, 14 bp, Homo sapiens
gcgccgtgctgtaa

SEQ ID NO: 5424302 - DNA, 14 bp, Homo sapiens
gcgcctaagccttt

SEQ ID NO: 5424303 - DNA, 20 bp, Homo sapiens
gcgcctagagcgcggctggc

SEQ ID NO: 5424304 - DNA, 20 bp, Homo sapiens
gcgcctaggttgtgttgaga

SEQ ID NO: 5424305 - DNA, 20 bp, Homo sapiens
gcgcctagtggggtctccct

SEQ ID NO: 5424306 - DNA, 17 bp, Homo sapiens
gcgcctataatcccagc

SEQ ID NO: 5424307 - DNA, 21 bp, Homo sapiens
gcgcctcaactctgctgaggg

SEQ ID NO: 5424308 - DNA, 17 bp, Homo sapiens
gcgcctcagccctcagt

SEQ ID NO: 5424309 - DNA, 16 bp, Homo sapiens
gcgcctcctcctgcat

SEQ ID NO: 5424310 - DNA, 19 bp, Homo sapiens
gcgcctccttaggagtggg

SEQ ID NO: 5424311 - DNA, 15 bp, Homo sapiens
gcgcctccttccttg

SEQ ID NO: 5424312 - DNA, 13 bp, Homo sapiens
gcgcctcgcccca

SEQ ID NO: 5424313 - DNA, 21 bp, Homo sapiens
gcgcctcgccggatctgaggg

SEQ ID NO: 5424314 - DNA, 17 bp, Homo sapiens
gcgcctcgtgctggcgg

SEQ ID NO: 5424315 - DNA, 14 bp, Homo sapiens
gcgcctctccactg

SEQ ID NO: 5424316 - DNA, 22 bp, Homo sapiens
gcgcctgcacctgcgcctggct

SEQ ID NO: 5424317 - DNA, 11 bp, Homo sapiens
gcgcctgcccg

SEQ ID NO: 5424318 - DNA, 23 bp, Homo sapiens
gcgcctgcccgagagagacccca

SEQ ID NO: 5424319 - DNA, 12 bp, Homo sapiens
gcgcctgccctg

SEQ ID NO: 5424320 - DNA, 16 bp, Homo sapiens
gcgcctgccctgccca

SEQ ID NO: 5424321 - DNA, 20 bp, Homo sapiens
gcgcctgccctgcccaagtg

SEQ ID NO: 5424322 - DNA, 12 bp, Homo sapiens
gcgcctgccttt

SEQ ID NO: 5424323 - DNA, 15 bp, Homo sapiens
gcgcctgcgctcctc

SEQ ID NO: 5424324 - DNA, 23 bp, Homo sapiens
gcgcctgcgctcctctgcagcct

SEQ ID NO: 5424325 - DNA, 13 bp, Homo sapiens
gcgcctgcgtccg

SEQ ID NO: 5424326 - DNA, 19 bp, Homo sapiens
gcgcctgctccctccagaa

SEQ ID NO: 5424327 - DNA, 18 bp, Homo sapiens
gcgcctgctgcctgctga

SEQ ID NO: 5424328 - DNA, 17 bp, Homo sapiens
gcgcctggagagcgagg

SEQ ID NO: 5424329 - DNA, 16 bp, Homo sapiens
gcgcctggcctccagg

SEQ ID NO: 5424330 - DNA, 14 bp, Homo sapiens
gcgcctggctgctg

SEQ ID NO: 5424331 - DNA, 11 bp, Homo sapiens
gcgcctggctt

SEQ ID NO: 5424332 - DNA, 18 bp, Homo sapiens
gcgcctgggtcctcccag

SEQ ID NO: 5424333 - DNA, 19 bp, Homo sapiens
gcgcctgggtcctcccagc

SEQ ID NO: 5424334 - DNA, 14 bp, Homo sapiens
gcgcctgtcccctc

SEQ ID NO: 5424335 - DNA, 15 bp, Homo sapiens
gcgcctgtcgggccc

SEQ ID NO: 5424336 - DNA, 18 bp, Homo sapiens
gcgcctgtcgggcccgca

SEQ ID NO: 5424337 - DNA, 16 bp, Homo sapiens
gcgcctgtgatgctgg

SEQ ID NO: 5424338 - DNA, 21 bp, Homo sapiens
gcgccttaaggatgttctagc

SEQ ID NO: 5424339 - DNA, 23 bp, Homo sapiens
gcgccttcgtgcctgagaccagg

SEQ ID NO: 5424340 - DNA, 19 bp, Homo sapiens
gcgccttctacctgcagga

SEQ ID NO: 5424341 - DNA, 22 bp, Homo sapiens
gcgccttgtctcctactcctga

SEQ ID NO: 5424342 - DNA, 16 bp, Homo sapiens
gcgcctttcccaactc

SEQ ID NO: 5424343 - DNA, 14 bp, Homo sapiens
gcgcctttgtatta

SEQ ID NO: 5424344 - DNA, 14 bp, Homo sapiens
gcgccttttcagcc

SEQ ID NO: 5424345 - DNA, 18 bp, Homo sapiens
gcgccttttcagcccttt

SEQ ID NO: 5424346 - DNA, 20 bp, Homo sapiens
gcgccttttcagccctttgc

SEQ ID NO: 5424347 - DNA, 12 bp, Homo sapiens
gcgcgatctcag

SEQ ID NO: 5424348 - DNA, 18 bp, Homo sapiens
gcgcgatctcggctcagc

SEQ ID NO: 5424349 - DNA, 19 bp, Homo sapiens
gcgcgcagcgcgtgcacag

SEQ ID NO: 5424350 - DNA, 18 bp, Homo sapiens
gcgcgccaccgtgcctgg

SEQ ID NO: 5424351 - DNA, 18 bp, Homo sapiens
gcgcgcccttccttcccg

SEQ ID NO: 5424352 - DNA, 14 bp, Homo sapiens
gcgcgcctgccttt

SEQ ID NO: 5424353 - DNA, 15 bp, Homo sapiens
gcgcgcgcacacaca

SEQ ID NO: 5424354 - DNA, 17 bp, Homo sapiens
gcgggaggcaccagctc

SEQ ID NO: 5424355 - DNA, 22 bp, Homo sapiens
gcgggaggcagcgccccaccac

SEQ ID NO: 5424356 - DNA, 12 bp, Homo sapiens
gcgggaggccac

SEQ ID NO: 5424357 - DNA, 15 bp, Homo sapiens
gcgggaggccctggc

SEQ ID NO: 5424358 - DNA, 18 bp, Homo sapiens
gcgggaggccctggccct

SEQ ID NO: 5424359 - DNA, 19 bp, Homo sapiens
gcgggaggccctggccctt

SEQ ID NO: 5424360 - DNA, 15 bp, Homo sapiens
gcgggagggcctgca

SEQ ID NO: 5424361 - DNA, 13 bp, Homo sapiens
gcgggagggggcg

SEQ ID NO: 5424362 - DNA, 20 bp, Homo sapiens
gcgggagggttccgccactc

SEQ ID NO: 5424363 - DNA, 23 bp, Homo sapiens
gcgggagtcagggacctgctgct

SEQ ID NO: 5424364 - DNA, 17 bp, Homo sapiens
gcgggagtctcctcact

SEQ ID NO: 5424365 - DNA, 20 bp, Homo sapiens
gcgggatcctccacagagag

SEQ ID NO: 5424366 - DNA, 16 bp, Homo sapiens
gcgggatgggccaccg

SEQ ID NO: 5424367 - DNA, 21 bp, Homo sapiens
gcgggatgggctcgctgaacc

SEQ ID NO: 5424368 - DNA, 16 bp, Homo sapiens
gcgggatggggctccc

SEQ ID NO: 5424369 - DNA, 17 bp, Homo sapiens
gcgggcacacctcctcc

SEQ ID NO: 5424370 - DNA, 19 bp, Homo sapiens
gcgggcacacctcctccca

SEQ ID NO: 5424371 - DNA, 17 bp, Homo sapiens
gcgggcacagggcacca

SEQ ID NO: 5424372 - DNA, 20 bp, Homo sapiens
gcgggcacagggcaccagag

SEQ ID NO: 5424373 - DNA, 22 bp, Homo sapiens
gcgggcacagggcaccagaggc

SEQ ID NO: 5424374 - DNA, 20 bp, Homo sapiens
gcgggcacctatagtcccag

SEQ ID NO: 5424375 - DNA, 23 bp, Homo sapiens
gcgggcactgggtacccaagtga

SEQ ID NO: 5424376 - DNA, 19 bp, Homo sapiens
gcgggcagagggctggagg

SEQ ID NO: 5424377 - DNA, 15 bp, Homo sapiens
gcgggcagcacagca

SEQ ID NO: 5424378 - DNA, 16 bp, Homo sapiens
gcgggcagcccctgct

SEQ ID NO: 5424379 - DNA, 18 bp, Homo sapiens
gcgggcagcccctgctgg

SEQ ID NO: 5424380 - DNA, 16 bp, Homo sapiens
gcgggcagcgggccag

SEQ ID NO: 5424381 - DNA, 18 bp, Homo sapiens
gcgggcaggggagggtca

SEQ ID NO: 5424382 - DNA, 15 bp, Homo sapiens
gcgggccaaggactg

SEQ ID NO: 5424383 - DNA, 17 bp, Homo sapiens
gcgggccaaggactgcc

SEQ ID NO: 5424384 - DNA, 14 bp, Homo sapiens
gcgggccacagggc

SEQ ID NO: 5424385 - DNA, 16 bp, Homo sapiens
gcgggccaccaagttc

SEQ ID NO: 5424386 - DNA, 19 bp, Homo sapiens
gcgggccagccaggcgggc

SEQ ID NO: 5424387 - DNA, 21 bp, Homo sapiens
gcgggccagccaggcgggctc

SEQ ID NO: 5424388 - DNA, 11 bp, Homo sapiens
gcgggccaggg

SEQ ID NO: 5424389 - DNA, 13 bp, Homo sapiens
gcgggccagggtg

SEQ ID NO: 5424390 - DNA, 20 bp, Homo sapiens
gcgggccaggtctggcgcca

SEQ ID NO: 5424391 - DNA, 21 bp, Homo sapiens
gcgggccaggtctggcgccag

SEQ ID NO: 5424392 - DNA, 14 bp, Homo sapiens
gcgggcccagctga

SEQ ID NO: 5424393 - DNA, 23 bp, Homo sapiens
gcgggccctgcctgagggtgggc

SEQ ID NO: 5424394 - DNA, 14 bp, Homo sapiens
gcgggcctggccct

SEQ ID NO: 5424395 - DNA, 16 bp, Homo sapiens
gcgggcctggccctca

SEQ ID NO: 5424396 - DNA, 19 bp, Homo sapiens
gcgggcctggccctcactc

SEQ ID NO: 5424397 - DNA, 23 bp, Homo sapiens
gcgggcctgtttggtgaggacct

SEQ ID NO: 5424398 - DNA, 23 bp, Homo sapiens
gcgggcgcactgcctctcacagc

SEQ ID NO: 5424399 - DNA, 21 bp, Homo sapiens
gcgggcgctgctgggagcaga

SEQ ID NO: 5424400 - DNA, 18 bp, Homo sapiens
gcgggcggaggcggctcc

SEQ ID NO: 5424401 - DNA, 15 bp, Homo sapiens
gcgggcggagggagg

SEQ ID NO: 5424402 - DNA, 23 bp, Homo sapiens
gcgggcggaggggatccagccac

SEQ ID NO: 5424403 - DNA, 16 bp, Homo sapiens
gcgggcggatcacctg

SEQ ID NO: 5424404 - DNA, 12 bp, Homo sapiens
gcgggcggccag

SEQ ID NO: 5424405 - DNA, 14 bp, Homo sapiens
gcgggcgtgggagg

SEQ ID NO: 5424406 - DNA, 14 bp, Homo sapiens
gcgggctcaaggaa

SEQ ID NO: 5424407 - DNA, 15 bp, Homo sapiens
gcgggctcagagctt

SEQ ID NO: 5424408 - DNA, 16 bp, Homo sapiens
gcgggctcagagcttt

SEQ ID NO: 5424409 - DNA, 14 bp, Homo sapiens
gcgggctccctcct

SEQ ID NO: 5424410 - DNA, 17 bp, Homo sapiens
gcgggctccctcctctg

SEQ ID NO: 5424411 - DNA, 21 bp, Homo sapiens
gcgggctccctcctctggcag

SEQ ID NO: 5424412 - DNA, 15 bp, Homo sapiens
gcgggctcggaggct

SEQ ID NO: 5424413 - DNA, 15 bp, Homo sapiens
gcgggctgaggccag

SEQ ID NO: 5424414 - DNA, 18 bp, Homo sapiens
gcgggctgaggccagagt

SEQ ID NO: 5424415 - DNA, 13 bp, Homo sapiens
gcgggctgagggc

SEQ ID NO: 5424416 - DNA, 21 bp, Homo sapiens
gcgggctgggggtagcctgga

SEQ ID NO: 5424417 - DNA, 22 bp, Homo sapiens
gcgggcttttctggggcccagg

SEQ ID NO: 5424418 - DNA, 23 bp, Homo sapiens
gcgggcttttctggggcccagga

SEQ ID NO: 5424419 - DNA, 14 bp, Homo sapiens
gcggggacagctcc

SEQ ID NO: 5424420 - DNA, 18 bp, Homo sapiens
gcggggacagctccttct

SEQ ID NO: 5424421 - DNA, 19 bp, Homo sapiens
gcggggacagctccttctg

SEQ ID NO: 5424422 - DNA, 15 bp, Homo sapiens
gcggggaggaggaac

SEQ ID NO: 5424423 - DNA, 15 bp, Homo sapiens
gcggggcagcaggag

SEQ ID NO: 5424424 - DNA, 18 bp, Homo sapiens
gcggggcaggaggcctgg

SEQ ID NO: 5424425 - DNA, 16 bp, Homo sapiens
gcggggcccacgcacg

SEQ ID NO: 5424426 - DNA, 12 bp, Homo sapiens
gcggggcccctg

SEQ ID NO: 5424427 - DNA, 19 bp, Homo sapiens
gcggggcccctgctccgag

SEQ ID NO: 5424428 - DNA, 20 bp, Homo sapiens
gcggggcctgcaggccagtc

SEQ ID NO: 5424429 - DNA, 15 bp, Homo sapiens
gcggggcctgtctca

SEQ ID NO: 5424430 - DNA, 20 bp, Homo sapiens
gcggggcgccccaagagccc

SEQ ID NO: 5424431 - DNA, 20 bp, Homo sapiens
gcggggcggcatccgagccc

SEQ ID NO: 5424432 - DNA, 15 bp, Homo sapiens
gcggggctcctcctg

SEQ ID NO: 5424433 - DNA, 20 bp, Homo sapiens
gcggggctcctcctgaagga

SEQ ID NO: 5424434 - DNA, 20 bp, Homo sapiens
gcggggctcgaggctggtgc

SEQ ID NO: 5424435 - DNA, 21 bp, Homo sapiens
gcggggctctaggatggggca

SEQ ID NO: 5424436 - DNA, 22 bp, Homo sapiens
gcggggctgtgcgggcgcccgg

SEQ ID NO: 5424437 - DNA, 21 bp, Homo sapiens
gcggggcttgccttctggtgt

SEQ ID NO: 5424438 - DNA, 19 bp, Homo sapiens
gcggggcttttaaaaggaa

SEQ ID NO: 5424439 - DNA, 20 bp, Homo sapiens
gcggggcttttaaaaggaaa

SEQ ID NO: 5424440 - DNA, 20 bp, Homo sapiens
gcgggggagcaggcagtggg

SEQ ID NO: 5424441 - DNA, 17 bp, Homo sapiens
gcgggggagccaacagc

SEQ ID NO: 5424442 - DNA, 23 bp, Homo sapiens
gcgggggcaacgattcacagcct

SEQ ID NO: 5424443 - DNA, 13 bp, Homo sapiens
gcgggggcaggcc

SEQ ID NO: 5424444 - DNA, 17 bp, Homo sapiens
gcgggggcggaggagga

SEQ ID NO: 5424445 - DNA, 17 bp, Homo sapiens
gcgggggctaactggcc

SEQ ID NO: 5424446 - DNA, 11 bp, Homo sapiens
gcggggggagg

SEQ ID NO: 5424447 - DNA, 19 bp, Homo sapiens
gcggggggggcgcctggag

SEQ ID NO: 5424448 - DNA, 21 bp, Homo sapiens
gcgggggggggggcggtgtca

SEQ ID NO: 5424449 - DNA, 21 bp, Homo sapiens
gcggggggtgtcttccctgcc

SEQ ID NO: 5424450 - DNA, 22 bp, Homo sapiens
gcgggggtttgagccctggacc

SEQ ID NO: 5424451 - DNA, 19 bp, Homo sapiens
gcggggtcccctctgtgct

SEQ ID NO: 5424452 - DNA, 18 bp, Homo sapiens
gcggggtggggtgggggt

SEQ ID NO: 5424453 - DNA, 14 bp, Homo sapiens
gcgggtaaaaagag

SEQ ID NO: 5424454 - DNA, 22 bp, Homo sapiens
gcgggtatgaagtgtggggcgg

SEQ ID NO: 5424455 - DNA, 20 bp, Homo sapiens
gcgggtcacaggagggaggg

SEQ ID NO: 5424456 - DNA, 18 bp, Homo sapiens
gcgggtccacttgccagg

SEQ ID NO: 5424457 - DNA, 20 bp, Homo sapiens
gcgggtccacttgccagggc

SEQ ID NO: 5424458 - DNA, 16 bp, Homo sapiens
gcgggtcccagctact

SEQ ID NO: 5424459 - DNA, 14 bp, Homo sapiens
gcgggtcctagctg

SEQ ID NO: 5424460 - DNA, 22 bp, Homo sapiens
gcgggtcctcagctgctcccac

SEQ ID NO: 5424461 - DNA, 21 bp, Homo sapiens
gcgggtctcctcccagcggcc

SEQ ID NO: 5424462 - DNA, 22 bp, Homo sapiens
gcgggtgacagctccgggatca

SEQ ID NO: 5424463 - DNA, 15 bp, Homo sapiens
gcgggtgatggccag

SEQ ID NO: 5424464 - DNA, 20 bp, Homo sapiens
gcgggtgatggccagcccct

SEQ ID NO: 5424465 - DNA, 20 bp, Homo sapiens
gcgggtggatcacaaggtca

SEQ ID NO: 5424466 - DNA, 19 bp, Homo sapiens
gcgggtggatcacctgagg

SEQ ID NO: 5424467 - DNA, 14 bp, Homo sapiens
gcgggtggctgcaa

SEQ ID NO: 5424468 - DNA, 18 bp, Homo sapiens
gcgggtggctgcaagccc

SEQ ID NO: 5424469 - DNA, 16 bp, Homo sapiens
gcgggtggctggagcc

SEQ ID NO: 5424470 - DNA, 14 bp, Homo sapiens
gcgggtgggggtgg

SEQ ID NO: 5424471 - DNA, 13 bp, Homo sapiens
gcgggtgggtggg

SEQ ID NO: 5424472 - DNA, 15 bp, Homo sapiens
gcggtagccagcaca

SEQ ID NO: 5424473 - DNA, 21 bp, Homo sapiens
gcggtagccagcacacagggc

SEQ ID NO: 5424474 - DNA, 22 bp, Homo sapiens
gcggtagccagcacacagggca

SEQ ID NO: 5424475 - DNA, 19 bp, Homo sapiens
gcggtaggggctgcaggga

SEQ ID NO: 5424476 - DNA, 17 bp, Homo sapiens
gcggtaggtgctggcct

SEQ ID NO: 5424477 - DNA, 20 bp, Homo sapiens
gcggtatgtgcgtgtgcgtg

SEQ ID NO: 5424478 - DNA, 17 bp, Homo sapiens
gcggtcaggctgggcag

SEQ ID NO: 5424479 - DNA, 15 bp, Homo sapiens
gcggtcatgtgtgca

SEQ ID NO: 5424480 - DNA, 19 bp, Homo sapiens
gcggtcatgtgtgcatgtg

SEQ ID NO: 5424481 - DNA, 22 bp, Homo sapiens
gcggtccaatgccacctagact

SEQ ID NO: 5424482 - DNA, 14 bp, Homo sapiens
gcggtccacccagg

SEQ ID NO: 5424483 - DNA, 21 bp, Homo sapiens
gcggtccagaggaggtgcccg

SEQ ID NO: 5424484 - DNA, 13 bp, Homo sapiens
gcggtcccagctc

SEQ ID NO: 5424485 - DNA, 12 bp, Homo sapiens
gcggtccccatc

SEQ ID NO: 5424486 - DNA, 19 bp, Homo sapiens
gcggtccccatccccacca

SEQ ID NO: 5424487 - DNA, 22 bp, Homo sapiens
gcggtcccctccgccaggcgag

SEQ ID NO: 5424488 - DNA, 23 bp, Homo sapiens
gcggtcctgcacagattcccagg

SEQ ID NO: 5424489 - DNA, 12 bp, Homo sapiens
gcggtgctctgg

SEQ ID NO: 5424490 - DNA, 13 bp, Homo sapiens
gcggtgctctggc

SEQ ID NO: 5424491 - DNA, 14 bp, Homo sapiens
gcggtgctctggcg

SEQ ID NO: 5424492 - DNA, 21 bp, Homo sapiens
gcggtgctctggcggcttcct

SEQ ID NO: 5424493 - DNA, 22 bp, Homo sapiens
gcggtgctctggcggcttcctg

SEQ ID NO: 5424494 - DNA, 21 bp, Homo sapiens
gcggtgctgactgaggcctgc

SEQ ID NO: 5424495 - DNA, 16 bp, Homo sapiens
gcggtgctgtcctcag

SEQ ID NO: 5424496 - DNA, 18 bp, Homo sapiens
gcggtgctgtcctcaggt

SEQ ID NO: 5424497 - DNA, 19 bp, Homo sapiens
gcggtggaaggagcctgcg

SEQ ID NO: 5424498 - DNA, 14 bp, Homo sapiens
gcggtggaccaaag

SEQ ID NO: 5424499 - DNA, 18 bp, Homo sapiens
gcggtggactgcgctgga

SEQ ID NO: 5424500 - DNA, 19 bp, Homo sapiens
gcggtggccacagcgtgct

SEQ ID NO: 5424501 - DNA, 15 bp, Homo sapiens
gcggtggccctgtcc

SEQ ID NO: 5424502 - DNA, 23 bp, Homo sapiens
gcggtggctcatgcctgtaatcc

SEQ ID NO: 5424503 - DNA, 16 bp, Homo sapiens
gcggtggctgccccgg

SEQ ID NO: 5424504 - DNA, 14 bp, Homo sapiens
gcggtgggaaggaa

SEQ ID NO: 5424505 - DNA, 14 bp, Homo sapiens
gcggtgggcagcca

SEQ ID NO: 5424506 - DNA, 16 bp, Homo sapiens
gcggtggggagagatg

SEQ ID NO: 5424507 - DNA, 14 bp, Homo sapiens
gcggtggtttgtaa

SEQ ID NO: 5424508 - DNA, 24 bp, Homo sapiens
gcggtgtcaggtcccagcgagcca

SEQ ID NO: 5424509 - DNA, 15 bp, Homo sapiens
gcggtgtctgcagct

SEQ ID NO: 5424510 - DNA, 22 bp, Homo sapiens
gcggtgtgtcctctgtgcccac

SEQ ID NO: 5424511 - DNA, 22 bp, Homo sapiens
gcggttataaaaaatggttcag

SEQ ID NO: 5424512 - DNA, 17 bp, Homo sapiens
gcggttgggaggcaggt

SEQ ID NO: 5424513 - DNA, 23 bp, Homo sapiens
gcggttggtgacttgtctgcctc

SEQ ID NO: 5424514 - DNA, 18 bp, Homo sapiens
gcggtttatcgccctggc

SEQ ID NO: 5424515 - DNA, 15 bp, Homo sapiens
gcggtttccaggcca

SEQ ID NO: 5424516 - DNA, 13 bp, Homo sapiens
gcggtttcctggt

SEQ ID NO: 5424517 - DNA, 18 bp, Homo sapiens
gcgtaaatggttttcaac

SEQ ID NO: 5424518 - DNA, 16 bp, Homo sapiens
gcgtaaccctcgccct

SEQ ID NO: 5424519 - DNA, 21 bp, Homo sapiens
gcgtaaccctcgccctgtccc

SEQ ID NO: 5424520 - DNA, 16 bp, Homo sapiens
gcgtaagtacagagaa

SEQ ID NO: 5424521 - DNA, 17 bp, Homo sapiens
gcgtaagtacagagaag

SEQ ID NO: 5424522 - DNA, 17 bp, Homo sapiens
gcgtaatgggcctgccc

SEQ ID NO: 5424523 - DNA, 12 bp, Homo sapiens
gcgtacacagag

SEQ ID NO: 5424524 - DNA, 13 bp, Homo sapiens
gcgtacacagaga

SEQ ID NO: 5424525 - DNA, 18 bp, Homo sapiens
gcgtactacccagctctg

SEQ ID NO: 5424526 - DNA, 22 bp, Homo sapiens
gcgtagaaaacgcacctccatc

SEQ ID NO: 5424527 - DNA, 14 bp, Homo sapiens
gcgtagagagccgg

SEQ ID NO: 5424528 - DNA, 21 bp, Homo sapiens
gcgtagatcaccagaataaac

SEQ ID NO: 5424529 - DNA, 18 bp, Homo sapiens
gcgtaggctacagagaag

SEQ ID NO: 5424530 - DNA, 23 bp, Homo sapiens
gctacccctcgactcagcaccac

SEQ ID NO: 5424531 - DNA, 22 bp, Homo sapiens
gctaccccttctttgcagggct

SEQ ID NO: 5424532 - DNA, 13 bp, Homo sapiens
gctaccccttgtg

SEQ ID NO: 5424533 - DNA, 15 bp, Homo sapiens
gctacccgctgtggc

SEQ ID NO: 5424534 - DNA, 17 bp, Homo sapiens
gctaccctcagcctcca

SEQ ID NO: 5424535 - DNA, 13 bp, Homo sapiens
gctaccctccctg

SEQ ID NO: 5424536 - DNA, 19 bp, Homo sapiens
gctaccctccctgctgtcc

SEQ ID NO: 5424537 - DNA, 12 bp, Homo sapiens
gctaccctgagc

SEQ ID NO: 5424538 - DNA, 19 bp, Homo sapiens
gctaccctgagctgaggca

SEQ ID NO: 5424539 - DNA, 19 bp, Homo sapiens
gctaccctgggaagctgcc

SEQ ID NO: 5424540 - DNA, 16 bp, Homo sapiens
gctacccttgccaagg

SEQ ID NO: 5424541 - DNA, 14 bp, Homo sapiens
gctacccttttcct

SEQ ID NO: 5424542 - DNA, 19 bp, Homo sapiens
gctacccttttcctttgtg

SEQ ID NO: 5424543 - DNA, 20 bp, Homo sapiens
gctacccttttcctttgtgg

SEQ ID NO: 5424544 - DNA, 16 bp, Homo sapiens
gctaccctttttctcc

SEQ ID NO: 5424545 - DNA, 21 bp, Homo sapiens
gctaccctttttctccagctg

SEQ ID NO: 5424546 - DNA, 17 bp, Homo sapiens
gctaccgccctgggctg

SEQ ID NO: 5424547 - DNA, 21 bp, Homo sapiens
gctaccgccctgggctggact

SEQ ID NO: 5424548 - DNA, 21 bp, Homo sapiens
gctaccgtggatctccttccc

SEQ ID NO: 5424549 - DNA, 14 bp, Homo sapiens
gctaccgttgactt

SEQ ID NO: 5424550 - DNA, 13 bp, Homo sapiens
gctacctcagaaa

SEQ ID NO: 5424551 - DNA, 19 bp, Homo sapiens
gctacctcagtgctcctgg

SEQ ID NO: 5424552 - DNA, 12 bp, Homo sapiens
gctacctccctc

SEQ ID NO: 5424553 - DNA, 13 bp, Homo sapiens
gctacctccctcc

SEQ ID NO: 5424554 - DNA, 15 bp, Homo sapiens
gctacctctctgtcc

SEQ ID NO: 5424555 - DNA, 21 bp, Homo sapiens
gctacctctctgtcccttgct

SEQ ID NO: 5424556 - DNA, 15 bp, Homo sapiens
gctacctggttttca

SEQ ID NO: 5424557 - DNA, 16 bp, Homo sapiens
gctacctggttttcat

SEQ ID NO: 5424558 - DNA, 17 bp, Homo sapiens
gctacctgtgtggacag

SEQ ID NO: 5424559 - DNA, 15 bp, Homo sapiens
gctaccttattgtac

SEQ ID NO: 5424560 - DNA, 23 bp, Homo sapiens
gctaccttgccccaacccttctt

SEQ ID NO: 5424561 - DNA, 20 bp, Homo sapiens
gctacctttgtattctctcc

SEQ ID NO: 5424562 - DNA, 14 bp, Homo sapiens
gctacgtgcctccc

SEQ ID NO: 5424563 - DNA, 13 bp, Homo sapiens
gctacgtgtgaaa

SEQ ID NO: 5424564 - DNA, 16 bp, Homo sapiens
gctacgtgtgaaatct

SEQ ID NO: 5424565 - DNA, 23 bp, Homo sapiens
gctacgtgtgaaatctgtctttg

SEQ ID NO: 5424566 - DNA, 17 bp, Homo sapiens
gctacgtgtgatttttc

SEQ ID NO: 5424567 - DNA, 19 bp, Homo sapiens
gctacgtgtgatttttctg

SEQ ID NO: 5424568 - DNA, 20 bp, Homo sapiens
gctacgtgtgatttttctgg

SEQ ID NO: 5424569 - DNA, 16 bp, Homo sapiens
gctacgttagcagccc

SEQ ID NO: 5424570 - DNA, 13 bp, Homo sapiens
gctactaacagat

SEQ ID NO: 5424571 - DNA, 14 bp, Homo sapiens
gctactaacagatt

SEQ ID NO: 5424572 - DNA, 22 bp, Homo sapiens
gctactaacagattataataaa

SEQ ID NO: 5424573 - DNA, 23 bp, Homo sapiens
gctactaacagattataataaat

SEQ ID NO: 5424574 - DNA, 16 bp, Homo sapiens
gctactaatgatgttt

SEQ ID NO: 5424575 - DNA, 15 bp, Homo sapiens
gctactaattatata

SEQ ID NO: 5424576 - DNA, 14 bp, Homo sapiens
gctactagcaaaat

SEQ ID NO: 5424577 - DNA, 17 bp, Homo sapiens
gctactagggaggctga

SEQ ID NO: 5424578 - DNA, 13 bp, Homo sapiens
gctactataatca

SEQ ID NO: 5424579 - DNA, 22 bp, Homo sapiens
gctactcactcaagttcaagga

SEQ ID NO: 5424580 - DNA, 16 bp, Homo sapiens
gctactcagaagcctg

SEQ ID NO: 5424581 - DNA, 12 bp, Homo sapiens
gctactcagcag

SEQ ID NO: 5424582 - DNA, 21 bp, Homo sapiens
gctactcagcagccctcctca

SEQ ID NO: 5424583 - DNA, 20 bp, Homo sapiens
gctactcaggaggctgaggc

SEQ ID NO: 5424584 - DNA, 21 bp, Homo sapiens
gctactcagtggggctggcat

SEQ ID NO: 5424585 - DNA, 20 bp, Homo sapiens
gctactcatgaggctgaggc

SEQ ID NO: 5424586 - DNA, 21 bp, Homo sapiens
gctactcccctttcttccaaa

SEQ ID NO: 5424587 - DNA, 14 bp, Homo sapiens
gctactccctggac

SEQ ID NO: 5424588 - DNA, 14 bp, Homo sapiens
gctactcctgtgct

SEQ ID NO: 5424589 - DNA, 21 bp, Homo sapiens
gctactcgggaggctgaggca

SEQ ID NO: 5424590 - DNA, 22 bp, Homo sapiens
gctactcgggaggctgaggcag

SEQ ID NO: 5424591 - DNA, 23 bp, Homo sapiens
gctactcgggaggctgaggcagg

SEQ ID NO: 5424592 - DNA, 19 bp, Homo sapiens
gctactcgtgagcgccagt

SEQ ID NO: 5424593 - DNA, 16 bp, Homo sapiens
gctactctagttctgt

SEQ ID NO: 5424594 - DNA, 22 bp, Homo sapiens
gctactctccccacgagggctg

SEQ ID NO: 5424595 - DNA, 16 bp, Homo sapiens
gctactctgtccaggc

SEQ ID NO: 5424596 - DNA, 17 bp, Homo sapiens
gctactctgtccaggcc

SEQ ID NO: 5424597 - DNA, 18 bp, Homo sapiens
gctactctgtccaggcca

SEQ ID NO: 5424598 - DNA, 14 bp, Homo sapiens
gctactctgtgcca

SEQ ID NO: 5424599 - DNA, 15 bp, Homo sapiens
gctactctgtgccag

SEQ ID NO: 5424600 - DNA, 18 bp, Homo sapiens
gctactctgttccttcac

SEQ ID NO: 5424601 - DNA, 14 bp, Homo sapiens
gctactcttcagaa

SEQ ID NO: 5424602 - DNA, 19 bp, Homo sapiens
gctactgaaaaaaatggag

SEQ ID NO: 5424603 - DNA, 20 bp, Homo sapiens
gctactgaaaaaaatggagt

SEQ ID NO: 5424604 - DNA, 14 bp, Homo sapiens
gctactgacccaga

SEQ ID NO: 5424605 - DNA, 21 bp, Homo sapiens
gctactgagacttggaacctc

SEQ ID NO: 5424606 - DNA, 17 bp, Homo sapiens
gctactgatttcctttg

SEQ ID NO: 5424607 - DNA, 20 bp, Homo sapiens
gctactgccaacctcgctcc

SEQ ID NO: 5424608 - DNA, 13 bp, Homo sapiens
gctactgccatcc

SEQ ID NO: 5424609 - DNA, 17 bp, Homo sapiens
gctactgccatcctggc

SEQ ID NO: 5424610 - DNA, 12 bp, Homo sapiens
gctactgcttca

SEQ ID NO: 5424611 - DNA, 19 bp, Homo sapiens
gctactggcagctcctctc

SEQ ID NO: 5424612 - DNA, 18 bp, Homo sapiens
gctactggcatagtttca

SEQ ID NO: 5424613 - DNA, 19 bp, Homo sapiens
gctactggcattaattatt

SEQ ID NO: 5424614 - DNA, 16 bp, Homo sapiens
gctactggggaggctg

SEQ ID NO: 5424615 - DNA, 18 bp, Homo sapiens
gctactggggaggctgag

SEQ ID NO: 5424616 - DNA, 20 bp, Homo sapiens
gctactggggaggctgaggc

SEQ ID NO: 5424617 - DNA, 17 bp, Homo sapiens
gctactggttacctgga

SEQ ID NO: 5424618 - DNA, 18 bp, Homo sapiens
gctactggttacctggag

SEQ ID NO: 5424619 - DNA, 20 bp, Homo sapiens
gctactggttacctggagaa

SEQ ID NO: 5424620 - DNA, 21 bp, Homo sapiens
gctactggttacctggagaag

SEQ ID NO: 5424621 - DNA, 13 bp, Homo sapiens
gctactgtaactt

SEQ ID NO: 5424622 - DNA, 21 bp, Homo sapiens
gctactgtaatgctgcctcag

SEQ ID NO: 5424623 - DNA, 19 bp, Homo sapiens
gctactgtcctacccaccc

SEQ ID NO: 5424624 - DNA, 22 bp, Homo sapiens
gctactgtctacgttaagataa

SEQ ID NO: 5424625 - DNA, 16 bp, Homo sapiens
gctactgtctcactga

SEQ ID NO: 5424626 - DNA, 21 bp, Homo sapiens
gctactgtctcactgaaacat

SEQ ID NO: 5424627 - DNA, 18 bp, Homo sapiens
gctactgttgtaagaatt

SEQ ID NO: 5424628 - DNA, 15 bp, Homo sapiens
gctacttaacttggt

SEQ ID NO: 5424629 - DNA, 21 bp, Homo sapiens
gctacttaattcctttctcat

SEQ ID NO: 5424630 - DNA, 16 bp, Homo sapiens
gctacttctgggaaaa

SEQ ID NO: 5424631 - DNA, 14 bp, Homo sapiens
gctacttggcaggc

SEQ ID NO: 5424632 - DNA, 16 bp, Homo sapiens
gctacttgggaggctg

SEQ ID NO: 5424633 - DNA, 17 bp, Homo sapiens
gctacttgggaggctga

SEQ ID NO: 5424634 - DNA, 16 bp, Homo sapiens
gctactttgccttttg

SEQ ID NO: 5424635 - DNA, 18 bp, Homo sapiens
gctacttttacttgttca

SEQ ID NO: 5424636 - DNA, 23 bp, Homo sapiens
gctacttttacttgttcatttct

SEQ ID NO: 5424637 - DNA, 19 bp, Homo sapiens
gctacttttgaaaatcaag

SEQ ID NO: 5424638 - DNA, 20 bp, Homo sapiens
gctagaaaaaaaaaacactt

SEQ ID NO: 5424639 - DNA, 18 bp, Homo sapiens
gctagaaaaatgttcttt

SEQ ID NO: 5424640 - DNA, 12 bp, Homo sapiens
gctagaaacaat

SEQ ID NO: 5424641 - DNA, 17 bp, Homo sapiens
gctagaaacataatttt

SEQ ID NO: 5424642 - DNA, 23 bp, Homo sapiens
gctagaaagagaaaaagccctct

SEQ ID NO: 5424643 - DNA, 18 bp, Homo sapiens
gctagaaatatgatttta

SEQ ID NO: 5424644 - DNA, 11 bp, Homo sapiens
gctagaaatga

SEQ ID NO: 5424645 - DNA, 18 bp, Homo sapiens
gctagaaccaagaagggc

SEQ ID NO: 5424646 - DNA, 19 bp, Homo sapiens
gctagaaccaagaagggct

SEQ ID NO: 5424647 - DNA, 18 bp, Homo sapiens
gctagaacctagaagggc

SEQ ID NO: 5424648 - DNA, 19 bp, Homo sapiens
gctagaacctggaagggct

SEQ ID NO: 5424649 - DNA, 20 bp, Homo sapiens
gctagaacctggagagctag

SEQ ID NO: 5424650 - DNA, 15 bp, Homo sapiens
gctagaacctggagg

SEQ ID NO: 5424651 - DNA, 17 bp, Homo sapiens
gctagaacgtgtttaat

SEQ ID NO: 5424652 - DNA, 16 bp, Homo sapiens
gctagaactccctttc

SEQ ID NO: 5424653 - DNA, 12 bp, Homo sapiens
gctagaactttt

SEQ ID NO: 5424654 - DNA, 17 bp, Homo sapiens
gctagaacttttttaaa

SEQ ID NO: 5424655 - DNA, 19 bp, Homo sapiens
gctagaacttttttaaata

SEQ ID NO: 5424656 - DNA, 22 bp, Homo sapiens
gctagaacttttttaaataaac

SEQ ID NO: 5424657 - DNA, 23 bp, Homo sapiens
gctagaagaaaacaaactgtcac

SEQ ID NO: 5424658 - DNA, 23 bp, Homo sapiens
gctagaagaaagtaaaaagaaca

SEQ ID NO: 5424659 - DNA, 22 bp, Homo sapiens
gctagaagaatttgagaagaaa

SEQ ID NO: 5424660 - DNA, 22 bp, Homo sapiens
gctagaagatccacatcctcta

SEQ ID NO: 5424661 - DNA, 15 bp, Homo sapiens
gctagaaggccacat

SEQ ID NO: 5424662 - DNA, 23 bp, Homo sapiens
gctagaagtctgtccaaatttaa

SEQ ID NO: 5424663 - DNA, 20 bp, Homo sapiens
gctagaagtgggccaggaca

SEQ ID NO: 5424664 - DNA, 21 bp, Homo sapiens
gctagaataggagaaaatgaa

SEQ ID NO: 5424665 - DNA, 12 bp, Homo sapiens
gctagaatccac

SEQ ID NO: 5424666 - DNA, 22 bp, Homo sapiens
gctagaatggaaaactgcctgt

SEQ ID NO: 5424667 - DNA, 21 bp, Homo sapiens
gctagaattgagtgtttaaag

SEQ ID NO: 5424668 - DNA, 19 bp, Homo sapiens
gctagacaaaggcccagaa

SEQ ID NO: 5424669 - DNA, 19 bp, Homo sapiens
gctagacaaggttgctgtt

SEQ ID NO: 5424670 - DNA, 20 bp, Homo sapiens
gctagacaatgatttggcca

SEQ ID NO: 5424671 - DNA, 22 bp, Homo sapiens
gctagacgagcaggcttcttcc

SEQ ID NO: 5424672 - DNA, 15 bp, Homo sapiens
gctagacgcaccgcc

SEQ ID NO: 5424673 - DNA, 15 bp, Homo sapiens
gctagactaggagac

SEQ ID NO: 5424674 - DNA, 16 bp, Homo sapiens
gctagactaggagacc

SEQ ID NO: 5424675 - DNA, 15 bp, Homo sapiens
gctagactcctcagg

SEQ ID NO: 5424676 - DNA, 22 bp, Homo sapiens
gctagactcctcaggagagacc

SEQ ID NO: 5424677 - DNA, 22 bp, Homo sapiens
gctagactggtgactgattctt

SEQ ID NO: 5424678 - DNA, 19 bp, Homo sapiens
gctagacttagattcatta

SEQ ID NO: 5424679 - DNA, 18 bp, Homo sapiens
gctagagaaattcttgtt

SEQ ID NO: 5424680 - DNA, 14 bp, Homo sapiens
gctagagagaaaaa

SEQ ID NO: 5424681 - DNA, 22 bp, Homo sapiens
gctagagaggggcctctggctg

SEQ ID NO: 5424682 - DNA, 19 bp, Homo sapiens
gctagagataaaacagaat

SEQ ID NO: 5424683 - DNA, 20 bp, Homo sapiens
gctagagatatggcagcgaa

SEQ ID NO: 5424684 - DNA, 21 bp, Homo sapiens
gctagagatatggcagcgaaa

SEQ ID NO: 5424685 - DNA, 14 bp, Homo sapiens
gctagagcagacag

SEQ ID NO: 5424686 - DNA, 18 bp, Homo sapiens
gctagagcagacaggcct

SEQ ID NO: 5424687 - DNA, 23 bp, Homo sapiens
gctagagcagcccaaatttttct

SEQ ID NO: 5424688 - DNA, 19 bp, Homo sapiens
gctagagcattctggggtg

SEQ ID NO: 5424689 - DNA, 18 bp, Homo sapiens
gctagagccgaggggaga

SEQ ID NO: 5424690 - DNA, 18 bp, Homo sapiens
gctagaggaagcagccaa

SEQ ID NO: 5424691 - DNA, 23 bp, Homo sapiens
gctagaggaataaagctgtgagc

SEQ ID NO: 5424692 - DNA, 13 bp, Homo sapiens
gctagaggccatg

SEQ ID NO: 5424693 - DNA, 20 bp, Homo sapiens
gctagaggccatggaggcag

SEQ ID NO: 5424694 - DNA, 13 bp, Homo sapiens
gctagaggcctga

SEQ ID NO: 5424695 - DNA, 18 bp, Homo sapiens
gctagaggcttttattag

SEQ ID NO: 5424696 - DNA, 15 bp, Homo sapiens
gctagagggcccaaa

SEQ ID NO: 5424697 - DNA, 18 bp, Homo sapiens
gctagaggttcaaagata

SEQ ID NO: 5424698 - DNA, 16 bp, Homo sapiens
gctagagttaaaagtt

SEQ ID NO: 5424699 - DNA, 15 bp, Homo sapiens
gctagatatgcctta

SEQ ID NO: 5424700 - DNA, 15 bp, Homo sapiens
gctagatccagccca

SEQ ID NO: 5424701 - DNA, 23 bp, Homo sapiens
gctagatgagaattcagctgccc

SEQ ID NO: 5424702 - DNA, 18 bp, Homo sapiens
gctagatggaatggaaaa

SEQ ID NO: 5424703 - DNA, 13 bp, Homo sapiens
gctagatgtatgt

SEQ ID NO: 5424704 - DNA, 16 bp, Homo sapiens
gctagatgtatgtact

SEQ ID NO: 5424705 - DNA, 18 bp, Homo sapiens
gctagatgtatgtacttc

SEQ ID NO: 5424706 - DNA, 15 bp, Homo sapiens
gctcaaagatgtact

SEQ ID NO: 5424707 - DNA, 21 bp, Homo sapiens
gctcaaagatgtactgagagg

SEQ ID NO: 5424708 - DNA, 23 bp, Homo sapiens
gctcaaagatgtactgagaggag

SEQ ID NO: 5424709 - DNA, 20 bp, Homo sapiens
gctcaaagcccttcctacct

SEQ ID NO: 5424710 - DNA, 12 bp, Homo sapiens
gctcaaaggcac

SEQ ID NO: 5424711 - DNA, 16 bp, Homo sapiens
gctcaaaggcacagtg

SEQ ID NO: 5424712 - DNA, 14 bp, Homo sapiens
gctcaaatattgaa

SEQ ID NO: 5424713 - DNA, 14 bp, Homo sapiens
gctcaaatcattta

SEQ ID NO: 5424714 - DNA, 18 bp, Homo sapiens
gctcaaatgatcctccca

SEQ ID NO: 5424715 - DNA, 19 bp, Homo sapiens
gctcaaatgatcctcccac

SEQ ID NO: 5424716 - DNA, 16 bp, Homo sapiens
gctcaacacatgagaa

SEQ ID NO: 5424717 - DNA, 15 bp, Homo sapiens
gctcaaccactgtgg

SEQ ID NO: 5424718 - DNA, 16 bp, Homo sapiens
gctcaacccccctccc

SEQ ID NO: 5424719 - DNA, 22 bp, Homo sapiens
gctcaacctacagtggagggag

SEQ ID NO: 5424720 - DNA, 14 bp, Homo sapiens
gctcaacctctctc

SEQ ID NO: 5424721 - DNA, 22 bp, Homo sapiens
gctcaactaattttatttctat

SEQ ID NO: 5424722 - DNA, 22 bp, Homo sapiens
gctcaactcacagcttctccaa

SEQ ID NO: 5424723 - DNA, 23 bp, Homo sapiens
gctcaactcgggggcgcctggag

SEQ ID NO: 5424724 - DNA, 19 bp, Homo sapiens
gctcaactctacccctgct

SEQ ID NO: 5424725 - DNA, 20 bp, Homo sapiens
gctcaactctacccctgctc

SEQ ID NO: 5424726 - DNA, 15 bp, Homo sapiens
gctcaacttgcaaaa

SEQ ID NO: 5424727 - DNA, 18 bp, Homo sapiens
gctcaagaatcctctggg

SEQ ID NO: 5424728 - DNA, 15 bp, Homo sapiens
gctcaagaggcccag

SEQ ID NO: 5424729 - DNA, 18 bp, Homo sapiens
gctcaagaggcccaggga

SEQ ID NO: 5424730 - DNA, 20 bp, Homo sapiens
gctcaagaggcccagggagc

SEQ ID NO: 5424731 - DNA, 19 bp, Homo sapiens
gctcaagatgacagctctt

SEQ ID NO: 5424732 - DNA, 17 bp, Homo sapiens
gctcaagcaatcctcct

SEQ ID NO: 5424733 - DNA, 23 bp, Homo sapiens
gctcaagcaatcctcctgagtga

SEQ ID NO: 5424734 - DNA, 24 bp, Homo sapiens
gctcaagcaatcctcctgcctcag

SEQ ID NO: 5424735 - DNA, 15 bp, Homo sapiens
gctcaagcagcaaaa

SEQ ID NO: 5424736 - DNA, 15 bp, Homo sapiens
gctcaagcagcgacc

SEQ ID NO: 5424737 - DNA, 16 bp, Homo sapiens
gctcaagcagtcctcc

SEQ ID NO: 5424738 - DNA, 19 bp, Homo sapiens
gctcaagcattctgtttat

SEQ ID NO: 5424739 - DNA, 18 bp, Homo sapiens
gctcaagccgtggccggg

SEQ ID NO: 5424740 - DNA, 18 bp, Homo sapiens
gctcaagcgattctcctg

SEQ ID NO: 5424741 - DNA, 15 bp, Homo sapiens
gctcaagctttcccg

SEQ ID NO: 5424742 - DNA, 20 bp, Homo sapiens
gctcaaggaaaggcctgaaa

SEQ ID NO: 5424743 - DNA, 16 bp, Homo sapiens
gctcaaggcaatgggc

SEQ ID NO: 5424744 - DNA, 22 bp, Homo sapiens
gctcaaggccacaggcacacag

SEQ ID NO: 5424745 - DNA, 14 bp, Homo sapiens
gctcaaggccagct

SEQ ID NO: 5424746 - DNA, 17 bp, Homo sapiens
gctcaaggctgcagtga

SEQ ID NO: 5424747 - DNA, 19 bp, Homo sapiens
gctcaagggaccctgggtg

SEQ ID NO: 5424748 - DNA, 20 bp, Homo sapiens
gctcaagggaccctgggtgg

SEQ ID NO: 5424749 - DNA, 22 bp, Homo sapiens
gctcaagtgatcctcacgcctt

SEQ ID NO: 5424750 - DNA, 19 bp, Homo sapiens
gctcaataaacttgtgcct

SEQ ID NO: 5424751 - DNA, 20 bp, Homo sapiens
gctcaataaacttgtgcctc

SEQ ID NO: 5424752 - DNA, 21 bp, Homo sapiens
gctcaataaacttgtgcctcc

SEQ ID NO: 5424753 - DNA, 14 bp, Homo sapiens
gctcaataaagatt

SEQ ID NO: 5424754 - DNA, 22 bp, Homo sapiens
gctcaataaatgtgtgttgact

SEQ ID NO: 5424755 - DNA, 18 bp, Homo sapiens
gctcaatacctggcctca

SEQ ID NO: 5424756 - DNA, 17 bp, Homo sapiens
gctcaatactctctgag

SEQ ID NO: 5424757 - DNA, 19 bp, Homo sapiens
gctcaatattcctgaatga

SEQ ID NO: 5424758 - DNA, 22 bp, Homo sapiens
gctcaatattcctgaatgaaat

SEQ ID NO: 5424759 - DNA, 16 bp, Homo sapiens
gctcaatcaagaaaat

SEQ ID NO: 5424760 - DNA, 20 bp, Homo sapiens
gctcaatccctgaggactga

SEQ ID NO: 5424761 - DNA, 16 bp, Homo sapiens
gctcaatcctctaagc

SEQ ID NO: 5424762 - DNA, 20 bp, Homo sapiens
gctcaatgcaacctctgccc

SEQ ID NO: 5424763 - DNA, 14 bp, Homo sapiens
gctcaatgcccagt

SEQ ID NO: 5424764 - DNA, 19 bp, Homo sapiens
gctcaatggagaatataaa

SEQ ID NO: 5424765 - DNA, 14 bp, Homo sapiens
gctcaatgtgctgt

SEQ ID NO: 5424766 - DNA, 17 bp, Homo sapiens
gctcaattcaagtgaca

SEQ ID NO: 5424767 - DNA, 20 bp, Homo sapiens
gctcaattcaagtgacacat

SEQ ID NO: 5424768 - DNA, 19 bp, Homo sapiens
gctcaattgttaatgtgat

SEQ ID NO: 5424769 - DNA, 14 bp, Homo sapiens
gctcaatttcagca

SEQ ID NO: 5424770 - DNA, 18 bp, Homo sapiens
gctcacaacttgggttct

SEQ ID NO: 5424771 - DNA, 18 bp, Homo sapiens
gctcacaagcccaggctg

SEQ ID NO: 5424772 - DNA, 20 bp, Homo sapiens
gctcacaaggcagcaaggcc

SEQ ID NO: 5424773 - DNA, 19 bp, Homo sapiens
gctcacacaatcagaccaa

SEQ ID NO: 5424774 - DNA, 15 bp, Homo sapiens
gctcacaccaaattt

SEQ ID NO: 5424775 - DNA, 14 bp, Homo sapiens
gctcacaccccatt

SEQ ID NO: 5424776 - DNA, 20 bp, Homo sapiens
gctcacaccctaccttcccc

SEQ ID NO: 5424777 - DNA, 23 bp, Homo sapiens
gctcacaccctaccttccccaga

SEQ ID NO: 5424778 - DNA, 20 bp, Homo sapiens
gctcacaccggcactgtgca

SEQ ID NO: 5424779 - DNA, 22 bp, Homo sapiens
gctcacacctgcaatcccagca

SEQ ID NO: 5424780 - DNA, 14 bp, Homo sapiens
gctcacacctgtaa

SEQ ID NO: 5424781 - DNA, 12 bp, Homo sapiens
gctcacactcat

SEQ ID NO: 5424782 - DNA, 11 bp, Homo sapiens
gctcacactcc

SEQ ID NO: 5424783 - DNA, 15 bp, Homo sapiens
gctcacactcctggg

SEQ ID NO: 5424784 - DNA, 22 bp, Homo sapiens
gctcacactgagaatgtaagaa

SEQ ID NO: 5424785 - DNA, 15 bp, Homo sapiens
gctcacagcacattt

SEQ ID NO: 5424786 - DNA, 17 bp, Homo sapiens
gctcacagcacatttgt

SEQ ID NO: 5424787 - DNA, 15 bp, Homo sapiens
gctcacagccaccac

SEQ ID NO: 5424788 - DNA, 21 bp, Homo sapiens
gctcacagccaccacctggat

SEQ ID NO: 5424789 - DNA, 12 bp, Homo sapiens
gctcacaggact

SEQ ID NO: 5424790 - DNA, 14 bp, Homo sapiens
gctcacaggcctct

SEQ ID NO: 5424791 - DNA, 13 bp, Homo sapiens
gctcacagggcag

SEQ ID NO: 5424792 - DNA, 14 bp, Homo sapiens
gctcacagggcagg

SEQ ID NO: 5424793 - DNA, 22 bp, Homo sapiens
gctcacagtacaatgtttcaga

SEQ ID NO: 5424794 - DNA, 13 bp, Homo sapiens
gctcacagttcct

SEQ ID NO: 5424795 - DNA, 15 bp, Homo sapiens
gctcacagttcctcg

SEQ ID NO: 5424796 - DNA, 19 bp, Homo sapiens
gctcacagttcctcgccct

SEQ ID NO: 5424797 - DNA, 21 bp, Homo sapiens
gctcacagttcctcgccctgg

SEQ ID NO: 5424798 - DNA, 22 bp, Homo sapiens
gctcacagttcctcgccctggg

SEQ ID NO: 5424799 - DNA, 23 bp, Homo sapiens
gctcacagttcctcgccctgggt

SEQ ID NO: 5424800 - DNA, 15 bp, Homo sapiens
gctcacattcccaag

SEQ ID NO: 5424801 - DNA, 15 bp, Homo sapiens
gctcacattccctct

SEQ ID NO: 5424802 - DNA, 18 bp, Homo sapiens
gctcacattccctctcat

SEQ ID NO: 5424803 - DNA, 18 bp, Homo sapiens
gctcaccaagctgttcca

SEQ ID NO: 5424804 - DNA, 23 bp, Homo sapiens
gctcaccaattccacttcctgcc

SEQ ID NO: 5424805 - DNA, 19 bp, Homo sapiens
gctcaccacctgcctctaa

SEQ ID NO: 5424806 - DNA, 23 bp, Homo sapiens
gctcaccagccccagtgcccaca

SEQ ID NO: 5424807 - DNA, 20 bp, Homo sapiens
gctcaccagccctgcagccc

SEQ ID NO: 5424808 - DNA, 14 bp, Homo sapiens
gctcaccaggcctg

SEQ ID NO: 5424809 - DNA, 17 bp, Homo sapiens
gctcaccaggcctggcc

SEQ ID NO: 5424810 - DNA, 18 bp, Homo sapiens
gctcaccaggcctggcct

SEQ ID NO: 5424811 - DNA, 23 bp, Homo sapiens
gctcaccaggcctggcctctggg

SEQ ID NO: 5424812 - DNA, 20 bp, Homo sapiens
gctcacccaggacctctggg

SEQ ID NO: 5424813 - DNA, 19 bp, Homo sapiens
gctcacccagtgccctctc

SEQ ID NO: 5424814 - DNA, 18 bp, Homo sapiens
gctcacccattgtctcat

SEQ ID NO: 5424815 - DNA, 18 bp, Homo sapiens
gctcacccccttctccat

SEQ ID NO: 5424816 - DNA, 14 bp, Homo sapiens
gctcacccctgggc

SEQ ID NO: 5424817 - DNA, 16 bp, Homo sapiens
gctcacccctgggcag

SEQ ID NO: 5424818 - DNA, 14 bp, Homo sapiens
gctcaccctgcccg

SEQ ID NO: 5424819 - DNA, 15 bp, Homo sapiens
gctcaccctgcccgc

SEQ ID NO: 5424820 - DNA, 20 bp, Homo sapiens
gctcaccctgcccgctccca

SEQ ID NO: 5424821 - DNA, 22 bp, Homo sapiens
gctcaccctgcccgctcccaac

SEQ ID NO: 5424822 - DNA, 15 bp, Homo sapiens
gctcaccgcccatca

SEQ ID NO: 5424823 - DNA, 16 bp, Homo sapiens
gctcaccgcccatcag

SEQ ID NO: 5424824 - DNA, 24 bp, Homo sapiens
gctcaccgcctgctacacaggcag

SEQ ID NO: 5424825 - DNA, 16 bp, Homo sapiens
gctcaccgctggccct

SEQ ID NO: 5424826 - DNA, 15 bp, Homo sapiens
gctcacctagagcca

SEQ ID NO: 5424827 - DNA, 18 bp, Homo sapiens
gctcacctagagccagac

SEQ ID NO: 5424828 - DNA, 20 bp, Homo sapiens
gctcacctagagccagacca

SEQ ID NO: 5424829 - DNA, 13 bp, Homo sapiens
gctcacctcagag

SEQ ID NO: 5424830 - DNA, 14 bp, Homo sapiens
gctcacctcagagc

SEQ ID NO: 5424831 - DNA, 16 bp, Homo sapiens
gctcacctcagagcag

SEQ ID NO: 5424832 - DNA, 21 bp, Homo sapiens
gctcacctcagagcagggcca

SEQ ID NO: 5424833 - DNA, 12 bp, Homo sapiens
gctcacctctgc

SEQ ID NO: 5424834 - DNA, 13 bp, Homo sapiens
gctcacctctgcc

SEQ ID NO: 5424835 - DNA, 13 bp, Homo sapiens
gctcacctggggt

SEQ ID NO: 5424836 - DNA, 21 bp, Homo sapiens
gctcacctgttgcttacaatt

SEQ ID NO: 5424837 - DNA, 22 bp, Homo sapiens
gctcacctgttgcttacaattt

SEQ ID NO: 5424838 - DNA, 21 bp, Homo sapiens
gctcacctttagaacaggaga

SEQ ID NO: 5424839 - DNA, 21 bp, Homo sapiens
gctcacgcctatgatcccagc

SEQ ID NO: 5424840 - DNA, 22 bp, Homo sapiens
gctcacgcctatgatcccagca

SEQ ID NO: 5424841 - DNA, 22 bp, Homo sapiens
gctcacgcctgtaatcccagca

SEQ ID NO: 5424842 - DNA, 18 bp, Homo sapiens
gctcacgcgttctgggag

SEQ ID NO: 5424843 - DNA, 22 bp, Homo sapiens
gctcacgctcccccgcagtccc

SEQ ID NO: 5424844 - DNA, 15 bp, Homo sapiens
gctcacgctgacagc

SEQ ID NO: 5424845 - DNA, 18 bp, Homo sapiens
gctcacgctgacagcctc

SEQ ID NO: 5424846 - DNA, 22 bp, Homo sapiens
gctcacgctgacagcctcctag

SEQ ID NO: 5424847 - DNA, 12 bp, Homo sapiens
gctcacggcagc

SEQ ID NO: 5424848 - DNA, 17 bp, Homo sapiens
gctcacggcagcctcaa

SEQ ID NO: 5424849 - DNA, 22 bp, Homo sapiens
gctcacgtaatgcattgcctgt

SEQ ID NO: 5424850 - DNA, 18 bp, Homo sapiens
gctcacgtcgcggccgcc

SEQ ID NO: 5424851 - DNA, 13 bp, Homo sapiens
gctcacgtctctg

SEQ ID NO: 5424852 - DNA, 18 bp, Homo sapiens
gctcactacctcctcagg

SEQ ID NO: 5424853 - DNA, 12 bp, Homo sapiens
gctcactactga

SEQ ID NO: 5424854 - DNA, 14 bp, Homo sapiens
gctcactactgaac

SEQ ID NO: 5424855 - DNA, 15 bp, Homo sapiens
gctcactcagccacc

SEQ ID NO: 5424856 - DNA, 11 bp, Homo sapiens
gctcactcagg

SEQ ID NO: 5424857 - DNA, 13 bp, Homo sapiens
gctcactcaggac

SEQ ID NO: 5424858 - DNA, 22 bp, Homo sapiens
gctcactcattgcagatcccag

SEQ ID NO: 5424859 - DNA, 18 bp, Homo sapiens
gctcactcccgctgagcc

SEQ ID NO: 5424860 - DNA, 20 bp, Homo sapiens
gctcactccctaaagccctc

SEQ ID NO: 5424861 - DNA, 15 bp, Homo sapiens
gctcactctggcccc

SEQ ID NO: 5424862 - DNA, 18 bp, Homo sapiens
gctcactgaaacctctgc

SEQ ID NO: 5424863 - DNA, 14 bp, Homo sapiens
gctcactgagctgg

SEQ ID NO: 5424864 - DNA, 17 bp, Homo sapiens
gctcactgcaacctccg

SEQ ID NO: 5424865 - DNA, 19 bp, Homo sapiens
gctcactgcaacctctgcc

SEQ ID NO: 5424866 - DNA, 22 bp, Homo sapiens
gctcactgcaacctctgcctcc

SEQ ID NO: 5424867 - DNA, 23 bp, Homo sapiens
gctcactgcaacttccgcctcct

SEQ ID NO: 5424868 - DNA, 19 bp, Homo sapiens
gctcactgcaagctctgcc

SEQ ID NO: 5424869 - DNA, 23 bp, Homo sapiens
gctcactgcaagctctgcctccc

SEQ ID NO: 5424870 - DNA, 14 bp, Homo sapiens
gctcactgcaatct

SEQ ID NO: 5424871 - DNA, 18 bp, Homo sapiens
gctcactgcaatctctgc

SEQ ID NO: 5424872 - DNA, 23 bp, Homo sapiens
gctcactgcaatctctgcctccc

SEQ ID NO: 5424873 - DNA, 14 bp, Homo sapiens
gctcactgcagcct

SEQ ID NO: 5424874 - DNA, 16 bp, Homo sapiens
gctcactgcagcctcg

SEQ ID NO: 5424875 - DNA, 16 bp, Homo sapiens
gctcactgcatcctcc

SEQ ID NO: 5424876 - DNA, 20 bp, Homo sapiens
gctcactgcatcctccgcct

SEQ ID NO: 5424877 - DNA, 22 bp, Homo sapiens
gctcactgccaggccagcctcc

SEQ ID NO: 5424878 - DNA, 21 bp, Homo sapiens
gctcactgctaagaatatttg

SEQ ID NO: 5424879 - DNA, 14 bp, Homo sapiens
gctcactggctggg

SEQ ID NO: 5424880 - DNA, 13 bp, Homo sapiens
gctcactgggccc

SEQ ID NO: 5424881 - DNA, 19 bp, Homo sapiens
gctcactgggcccgagcct

SEQ ID NO: 5424882 - DNA, 13 bp, Homo sapiens
gctcccacctccc

SEQ ID NO: 5424883 - DNA, 22 bp, Homo sapiens
gctcccacctcccttcccacct

SEQ ID NO: 5424884 - DNA, 22 bp, Homo sapiens
gctcccacctcctgacaccctt

SEQ ID NO: 5424885 - DNA, 16 bp, Homo sapiens
gctcccacctggctct

SEQ ID NO: 5424886 - DNA, 18 bp, Homo sapiens
gctcccacctggctctgt

SEQ ID NO: 5424887 - DNA, 16 bp, Homo sapiens
gctcccacgccctcct

SEQ ID NO: 5424888 - DNA, 19 bp, Homo sapiens
gctcccacgccctcctccc

SEQ ID NO: 5424889 - DNA, 20 bp, Homo sapiens
gctcccacgccctcctccct

SEQ ID NO: 5424890 - DNA, 16 bp, Homo sapiens
gctcccacgcctgctt

SEQ ID NO: 5424891 - DNA, 18 bp, Homo sapiens
gctcccacgcctgcttct

SEQ ID NO: 5424892 - DNA, 23 bp, Homo sapiens
gctcccacggggaccactgggcc

SEQ ID NO: 5424893 - DNA, 15 bp, Homo sapiens
gctcccactgcccct

SEQ ID NO: 5424894 - DNA, 17 bp, Homo sapiens
gctcccacttctgccag

SEQ ID NO: 5424895 - DNA, 18 bp, Homo sapiens
gctcccacttctgccaga

SEQ ID NO: 5424896 - DNA, 18 bp, Homo sapiens
gctcccagacccagggca

SEQ ID NO: 5424897 - DNA, 19 bp, Homo sapiens
gctcccagacccagggcag

SEQ ID NO: 5424898 - DNA, 12 bp, Homo sapiens
gctcccagcagc

SEQ ID NO: 5424899 - DNA, 23 bp, Homo sapiens
gctcccagcagccctaaggatct

SEQ ID NO: 5424900 - DNA, 22 bp, Homo sapiens
gctcccagcatttgtccaccca

SEQ ID NO: 5424901 - DNA, 13 bp, Homo sapiens
gctcccagcccct

SEQ ID NO: 5424902 - DNA, 18 bp, Homo sapiens
gctcccagcccctacctt

SEQ ID NO: 5424903 - DNA, 15 bp, Homo sapiens
gctcccagcctcagc

SEQ ID NO: 5424904 - DNA, 12 bp, Homo sapiens
gctcccagcctg

SEQ ID NO: 5424905 - DNA, 14 bp, Homo sapiens
gctcccagcctgct

SEQ ID NO: 5424906 - DNA, 13 bp, Homo sapiens
gctcccagctctc

SEQ ID NO: 5424907 - DNA, 15 bp, Homo sapiens
gctcccagctgtgct

SEQ ID NO: 5424908 - DNA, 13 bp, Homo sapiens
gctcccaggacgc

SEQ ID NO: 5424909 - DNA, 14 bp, Homo sapiens
gctcccaggacgca

SEQ ID NO: 5424910 - DNA, 20 bp, Homo sapiens
gctcccaggacgcagggaga

SEQ ID NO: 5424911 - DNA, 22 bp, Homo sapiens
gctcccaggacgcagggagacc

SEQ ID NO: 5424912 - DNA, 21 bp, Homo sapiens
gctcccaggagggctttgtgt

SEQ ID NO: 5424913 - DNA, 20 bp, Homo sapiens
gctcccaggcattccccagg

SEQ ID NO: 5424914 - DNA, 13 bp, Homo sapiens
gctcccaggccaa

SEQ ID NO: 5424915 - DNA, 19 bp, Homo sapiens
gctcccaggccccaggcct

SEQ ID NO: 5424916 - DNA, 22 bp, Homo sapiens
gctcccaggccgagaagccagt

SEQ ID NO: 5424917 - DNA, 23 bp, Homo sapiens
gctcccaggccgagaagccagtg

SEQ ID NO: 5424918 - DNA, 22 bp, Homo sapiens
gctcccagggacacctgggaga

SEQ ID NO: 5424919 - DNA, 12 bp, Homo sapiens
gctcccagggtg

SEQ ID NO: 5424920 - DNA, 13 bp, Homo sapiens
gctcccagggtgg

SEQ ID NO: 5424921 - DNA, 20 bp, Homo sapiens
gctcccaggttcccccagca

SEQ ID NO: 5424922 - DNA, 15 bp, Homo sapiens
gctcccagtcctgcc

SEQ ID NO: 5424923 - DNA, 18 bp, Homo sapiens
gctcccagtcctgcctga

SEQ ID NO: 5424924 - DNA, 21 bp, Homo sapiens
gctcccagtgggagcttcccg

SEQ ID NO: 5424925 - DNA, 22 bp, Homo sapiens
gctcccagtgtcttcctgtggg

SEQ ID NO: 5424926 - DNA, 19 bp, Homo sapiens
gctcccatagcgctggctc

SEQ ID NO: 5424927 - DNA, 20 bp, Homo sapiens
gctcccatagcgctggctca

SEQ ID NO: 5424928 - DNA, 21 bp, Homo sapiens
gctcccatcattccttctggc

SEQ ID NO: 5424929 - DNA, 15 bp, Homo sapiens
gctcccatctcctga

SEQ ID NO: 5424930 - DNA, 15 bp, Homo sapiens
gctcccattcctccc

SEQ ID NO: 5424931 - DNA, 15 bp, Homo sapiens
gctcccatttctact

SEQ ID NO: 5424932 - DNA, 12 bp, Homo sapiens
gctccccaaggc

SEQ ID NO: 5424933 - DNA, 22 bp, Homo sapiens
gctccccacacgtgctcgcagc

SEQ ID NO: 5424934 - DNA, 13 bp, Homo sapiens
gctccccacagct

SEQ ID NO: 5424935 - DNA, 22 bp, Homo sapiens
gctccccacccgcctcccgcct

SEQ ID NO: 5424936 - DNA, 12 bp, Homo sapiens
gctccccaccta

SEQ ID NO: 5424937 - DNA, 16 bp, Homo sapiens
gctccccacctaccca

SEQ ID NO: 5424938 - DNA, 20 bp, Homo sapiens
gctccccacctacccagctg

SEQ ID NO: 5424939 - DNA, 16 bp, Homo sapiens
gctccccacctggaca

SEQ ID NO: 5424940 - DNA, 17 bp, Homo sapiens
gctccccacctggacac

SEQ ID NO: 5424941 - DNA, 23 bp, Homo sapiens
gctccccacctggacacacactc

SEQ ID NO: 5424942 - DNA, 24 bp, Homo sapiens
gctccccacgagtcacctgcaagc

SEQ ID NO: 5424943 - DNA, 20 bp, Homo sapiens
gctccccacgcccccatgca

SEQ ID NO: 5424944 - DNA, 14 bp, Homo sapiens
gctccccactctgc

SEQ ID NO: 5424945 - DNA, 18 bp, Homo sapiens
gctccccactctgctctg

SEQ ID NO: 5424946 - DNA, 19 bp, Homo sapiens
gctccccactctgctctga

SEQ ID NO: 5424947 - DNA, 12 bp, Homo sapiens
gctccccagagg

SEQ ID NO: 5424948 - DNA, 21 bp, Homo sapiens
gctccccagcccacctgctcc

SEQ ID NO: 5424949 - DNA, 22 bp, Homo sapiens
gctccccagcccacctgctccc

SEQ ID NO: 5424950 - DNA, 23 bp, Homo sapiens
gctccccagcccacctgctccca

SEQ ID NO: 5424951 - DNA, 14 bp, Homo sapiens
gctccccagcccca

SEQ ID NO: 5424952 - DNA, 19 bp, Homo sapiens
gctccccagccctggctct

SEQ ID NO: 5424953 - DNA, 11 bp, Homo sapiens
gctccccagga

SEQ ID NO: 5424954 - DNA, 12 bp, Homo sapiens
gctccccaggac

SEQ ID NO: 5424955 - DNA, 15 bp, Homo sapiens
gctccccaggagctc

SEQ ID NO: 5424956 - DNA, 19 bp, Homo sapiens
gctccccaggagctcaggt

SEQ ID NO: 5424957 - DNA, 16 bp, Homo sapiens
gctccccaggccaccc

SEQ ID NO: 5424958 - DNA, 14 bp, Homo sapiens
gctccccagggctc

SEQ ID NO: 5424959 - DNA, 17 bp, Homo sapiens
gctccccagggctccct

SEQ ID NO: 5424960 - DNA, 20 bp, Homo sapiens
gctccccagtgctcctggcc

SEQ ID NO: 5424961 - DNA, 14 bp, Homo sapiens
gctccccatgtgtc

SEQ ID NO: 5424962 - DNA, 22 bp, Homo sapiens
gctcccccagcaaagcccccag

SEQ ID NO: 5424963 - DNA, 20 bp, Homo sapiens
gctcccccaggctgttctcc

SEQ ID NO: 5424964 - DNA, 14 bp, Homo sapiens
gctcccccatcctc

SEQ ID NO: 5424965 - DNA, 16 bp, Homo sapiens
gctcccccatcctccc

SEQ ID NO: 5424966 - DNA, 18 bp, Homo sapiens
gctccccccgcccaccca

SEQ ID NO: 5424967 - DNA, 16 bp, Homo sapiens
gctcccccgcagtccc

SEQ ID NO: 5424968 - DNA, 16 bp, Homo sapiens
gctcccccgccctgcc

SEQ ID NO: 5424969 - DNA, 15 bp, Homo sapiens
gctccccctctgctt

SEQ ID NO: 5424970 - DNA, 14 bp, Homo sapiens
gctccccctgccag

SEQ ID NO: 5424971 - DNA, 15 bp, Homo sapiens
gctccccctgccagc

SEQ ID NO: 5424972 - DNA, 13 bp, Homo sapiens
gctccccctggac

SEQ ID NO: 5424973 - DNA, 14 bp, Homo sapiens
gctccccctggacg

SEQ ID NO: 5424974 - DNA, 13 bp, Homo sapiens
gctccccctgtcc

SEQ ID NO: 5424975 - DNA, 18 bp, Homo sapiens
gctcccccttgcccgcca

SEQ ID NO: 5424976 - DNA, 13 bp, Homo sapiens
gctcccccttttc

SEQ ID NO: 5424977 - DNA, 17 bp, Homo sapiens
gctcccccttttccctc

SEQ ID NO: 5424978 - DNA, 16 bp, Homo sapiens
gctccccgcctgttcc

SEQ ID NO: 5424979 - DNA, 17 bp, Homo sapiens
gctccccgcctgttccc

SEQ ID NO: 5424980 - DNA, 17 bp, Homo sapiens
gctccccggcactgcag

SEQ ID NO: 5424981 - DNA, 23 bp, Homo sapiens
gctccccgggggcagacacctgt

SEQ ID NO: 5424982 - DNA, 20 bp, Homo sapiens
gctcccctaaagccaggctc

SEQ ID NO: 5424983 - DNA, 24 bp, Homo sapiens
gctcccctagacatggcctctgga

SEQ ID NO: 5424984 - DNA, 11 bp, Homo sapiens
gctcccctcca

SEQ ID NO: 5424985 - DNA, 17 bp, Homo sapiens
gctcccctccacagctg

SEQ ID NO: 5424986 - DNA, 17 bp, Homo sapiens
gctcccctccatcccca

SEQ ID NO: 5424987 - DNA, 22 bp, Homo sapiens
gctcccctccatccccatcggc

SEQ ID NO: 5424988 - DNA, 15 bp, Homo sapiens
gctcccctcccaggg

SEQ ID NO: 5424989 - DNA, 21 bp, Homo sapiens
gctcccctcccaggggagcca

SEQ ID NO: 5424990 - DNA, 14 bp, Homo sapiens
gctcccctccccaa

SEQ ID NO: 5424991 - DNA, 21 bp, Homo sapiens
gctcccctccccaactgacca

SEQ ID NO: 5424992 - DNA, 19 bp, Homo sapiens
gctcccctcgacagctctc

SEQ ID NO: 5424993 - DNA, 18 bp, Homo sapiens
gctcccctcggagaagag

SEQ ID NO: 5424994 - DNA, 15 bp, Homo sapiens
gctcccctctcctcc

SEQ ID NO: 5424995 - DNA, 21 bp, Homo sapiens
gctcccctctggaatcttccc

SEQ ID NO: 5424996 - DNA, 12 bp, Homo sapiens
gctcccctcttc

SEQ ID NO: 5424997 - DNA, 15 bp, Homo sapiens
gctcccctcttcctc

SEQ ID NO: 5424998 - DNA, 16 bp, Homo sapiens
gctcccctcttttgta

SEQ ID NO: 5424999 - DNA, 20 bp, Homo sapiens
gctcccctgaggctggcatc

SEQ ID NO: 5425000 - DNA, 17 bp, Homo sapiens
gctcccctgcagccctg

SEQ ID NO: 5425001 - DNA, 14 bp, Homo sapiens
gctcccctgccaca

SEQ ID NO: 5425002 - DNA, 17 bp, Homo sapiens
gctcccctgcccagcct

SEQ ID NO: 5425003 - DNA, 13 bp, Homo sapiens
gctcccctgcctt

SEQ ID NO: 5425004 - DNA, 22 bp, Homo sapiens
gctcccctgccttaacctggga

SEQ ID NO: 5425005 - DNA, 16 bp, Homo sapiens
gctcccctgctgaggc

SEQ ID NO: 5425006 - DNA, 20 bp, Homo sapiens
gctcccctggagccagcagg

SEQ ID NO: 5425007 - DNA, 15 bp, Homo sapiens
gctcccctggtctcc

SEQ ID NO: 5425008 - DNA, 21 bp, Homo sapiens
gctccccttggacctccaggg

SEQ ID NO: 5425009 - DNA, 14 bp, Homo sapiens
gctcccgagctact

SEQ ID NO: 5425010 - DNA, 19 bp, Homo sapiens
gctcccgagctactctctt

SEQ ID NO: 5425011 - DNA, 16 bp, Homo sapiens
gctcccgccccagggt

SEQ ID NO: 5425012 - DNA, 18 bp, Homo sapiens
gctcccgccccagggtct

SEQ ID NO: 5425013 - DNA, 19 bp, Homo sapiens
gctcccgcctccaacccct

SEQ ID NO: 5425014 - DNA, 23 bp, Homo sapiens
gctcccgcctgtaatcccagtac

SEQ ID NO: 5425015 - DNA, 14 bp, Homo sapiens
gctcccgctgtggc

SEQ ID NO: 5425016 - DNA, 22 bp, Homo sapiens
gctcccgcttgctctcctggag

SEQ ID NO: 5425017 - DNA, 15 bp, Homo sapiens
gctcccggcaagcgc

SEQ ID NO: 5425018 - DNA, 15 bp, Homo sapiens
gctcccggcatcctg

SEQ ID NO: 5425019 - DNA, 21 bp, Homo sapiens
gctcccggcatcctgaaagcc

SEQ ID NO: 5425020 - DNA, 13 bp, Homo sapiens
gctcccggcccgc

SEQ ID NO: 5425021 - DNA, 18 bp, Homo sapiens
gctcccggcccgcctgcc

SEQ ID NO: 5425022 - DNA, 20 bp, Homo sapiens
gctcccgggactcactggca

SEQ ID NO: 5425023 - DNA, 24 bp, Homo sapiens
gctcccgggactcactggcagccc

SEQ ID NO: 5425024 - DNA, 17 bp, Homo sapiens
gctcccgggcctcaggg

SEQ ID NO: 5425025 - DNA, 19 bp, Homo sapiens
gctcccggttccctcccca

SEQ ID NO: 5425026 - DNA, 21 bp, Homo sapiens
gctcccggttccctccccagc

SEQ ID NO: 5425027 - DNA, 21 bp, Homo sapiens
gctccctaaactttggccttt

SEQ ID NO: 5425028 - DNA, 19 bp, Homo sapiens
gctccctacattccccaga

SEQ ID NO: 5425029 - DNA, 20 bp, Homo sapiens
gctccctacattccccagag

SEQ ID NO: 5425030 - DNA, 22 bp, Homo sapiens
gctccctacattccccagagtg

SEQ ID NO: 5425031 - DNA, 16 bp, Homo sapiens
gctccctaccacctcc

SEQ ID NO: 5425032 - DNA, 14 bp, Homo sapiens
gctccctcactctc

SEQ ID NO: 5425033 - DNA, 15 bp, Homo sapiens
gctccctcactctca

SEQ ID NO: 5425034 - DNA, 18 bp, Homo sapiens
gctccctcactctcagga

SEQ ID NO: 5425035 - DNA, 10 bp, Homo sapiens
gctccctcag

SEQ ID NO: 5425036 - DNA, 11 bp, Homo sapiens
gctccctcaga

SEQ ID NO: 5425037 - DNA, 13 bp, Homo sapiens
gctccctcagcct

SEQ ID NO: 5425038 - DNA, 20 bp, Homo sapiens
gctccctcagcctcagagga

SEQ ID NO: 5425039 - DNA, 21 bp, Homo sapiens
gctccctcagcctcagaggag

SEQ ID NO: 5425040 - DNA, 17 bp, Homo sapiens
gctccctcatgcagata

SEQ ID NO: 5425041 - DNA, 12 bp, Homo sapiens
gctccctccaga

SEQ ID NO: 5425042 - DNA, 15 bp, Homo sapiens
gctccctcccaccca

SEQ ID NO: 5425043 - DNA, 18 bp, Homo sapiens
gctccctcccaggactct

SEQ ID NO: 5425044 - DNA, 20 bp, Homo sapiens
gctccctcccatcctccagc

SEQ ID NO: 5425045 - DNA, 18 bp, Homo sapiens
gctccctccccctgcccc

SEQ ID NO: 5425046 - DNA, 17 bp, Homo sapiens
gctccctcccctgccct

SEQ ID NO: 5425047 - DNA, 13 bp, Homo sapiens
gctccctcccgca

SEQ ID NO: 5425048 - DNA, 19 bp, Homo sapiens
gctccctccgcccccaggt

SEQ ID NO: 5425049 - DNA, 12 bp, Homo sapiens
gctccctcctcc

SEQ ID NO: 5425050 - DNA, 13 bp, Homo sapiens
gctccctcctccc

SEQ ID NO: 5425051 - DNA, 15 bp, Homo sapiens
gctccctcctcccat

SEQ ID NO: 5425052 - DNA, 20 bp, Homo sapiens
gctccctcctcccatctcct

SEQ ID NO: 5425053 - DNA, 15 bp, Homo sapiens
gctccctcctctggc

SEQ ID NO: 5425054 - DNA, 13 bp, Homo sapiens
gctccctcctgca

SEQ ID NO: 5425055 - DNA, 13 bp, Homo sapiens
gctccctcctgga

SEQ ID NO: 5425056 - DNA, 19 bp, Homo sapiens
gctccctcctggagcatcc

SEQ ID NO: 5425057 - DNA, 13 bp, Homo sapiens
gctccctcgctgt

SEQ ID NO: 5425058 - DNA, 17 bp, Homo sapiens
gctccctcgctgtatga

SEQ ID NO: 5425059 - DNA, 21 bp, Homo sapiens
gctccctctccaagacagcag

SEQ ID NO: 5425060 - DNA, 14 bp, Homo sapiens
gctcctcctccctg

SEQ ID NO: 5425061 - DNA, 13 bp, Homo sapiens
gctcctcctctca

SEQ ID NO: 5425062 - DNA, 14 bp, Homo sapiens
gctcctcctctcat

SEQ ID NO: 5425063 - DNA, 18 bp, Homo sapiens
gctcctcctctctggact

SEQ ID NO: 5425064 - DNA, 13 bp, Homo sapiens
gctcctcctgaag

SEQ ID NO: 5425065 - DNA, 14 bp, Homo sapiens
gctcctcctgccct

SEQ ID NO: 5425066 - DNA, 13 bp, Homo sapiens
gctcctcctgtgt

SEQ ID NO: 5425067 - DNA, 17 bp, Homo sapiens
gctcctcctgtgtgact

SEQ ID NO: 5425068 - DNA, 18 bp, Homo sapiens
gctcctcgagatcccaac

SEQ ID NO: 5425069 - DNA, 15 bp, Homo sapiens
gctcctcgagggcag

SEQ ID NO: 5425070 - DNA, 21 bp, Homo sapiens
gctcctcgctcgcacctgcct

SEQ ID NO: 5425071 - DNA, 16 bp, Homo sapiens
gctcctcggccagagc

SEQ ID NO: 5425072 - DNA, 19 bp, Homo sapiens
gctcctcgggtggggcctg

SEQ ID NO: 5425073 - DNA, 21 bp, Homo sapiens
gctcctcggtgttacttccct

SEQ ID NO: 5425074 - DNA, 21 bp, Homo sapiens
gctcctctaggccctgtgagc

SEQ ID NO: 5425075 - DNA, 16 bp, Homo sapiens
gctcctctaggggcag

SEQ ID NO: 5425076 - DNA, 17 bp, Homo sapiens
gctcctctaggggcagc

SEQ ID NO: 5425077 - DNA, 20 bp, Homo sapiens
gctcctctaggggcagcctc

SEQ ID NO: 5425078 - DNA, 13 bp, Homo sapiens
gctcctctatagg

SEQ ID NO: 5425079 - DNA, 19 bp, Homo sapiens
gctcctctccagacacaga

SEQ ID NO: 5425080 - DNA, 13 bp, Homo sapiens
gctcctctccagg

SEQ ID NO: 5425081 - DNA, 17 bp, Homo sapiens
gctcctctccagtctga

SEQ ID NO: 5425082 - DNA, 16 bp, Homo sapiens
gctcctctccccagca

SEQ ID NO: 5425083 - DNA, 19 bp, Homo sapiens
gctcctctccccagcccag

SEQ ID NO: 5425084 - DNA, 20 bp, Homo sapiens
gctcctctccccagcccaga

SEQ ID NO: 5425085 - DNA, 16 bp, Homo sapiens
gctcctctcctggagg

SEQ ID NO: 5425086 - DNA, 17 bp, Homo sapiens
gctcctctccttgggct

SEQ ID NO: 5425087 - DNA, 23 bp, Homo sapiens
gctcctctccttgggctcctggc

SEQ ID NO: 5425088 - DNA, 24 bp, Homo sapiens
gctcctctctgaagcgactctcct

SEQ ID NO: 5425089 - DNA, 15 bp, Homo sapiens
gctcctctcttgggt

SEQ ID NO: 5425090 - DNA, 16 bp, Homo sapiens
gctcctctctttgtgg

SEQ ID NO: 5425091 - DNA, 11 bp, Homo sapiens
gctcctctgag

SEQ ID NO: 5425092 - DNA, 18 bp, Homo sapiens
gctcctctgcagcctgag

SEQ ID NO: 5425093 - DNA, 20 bp, Homo sapiens
gctcctctgcatcttgctct

SEQ ID NO: 5425094 - DNA, 11 bp, Homo sapiens
gctcctctgcc

SEQ ID NO: 5425095 - DNA, 12 bp, Homo sapiens
gctcctctgcct

SEQ ID NO: 5425096 - DNA, 17 bp, Homo sapiens
gctcctctgcctgtgcc

SEQ ID NO: 5425097 - DNA, 18 bp, Homo sapiens
gctcctctgcctttgtgc

SEQ ID NO: 5425098 - DNA, 20 bp, Homo sapiens
gctcctctgcctttgtgctc

SEQ ID NO: 5425099 - DNA, 14 bp, Homo sapiens
gctcctctgctcca

SEQ ID NO: 5425100 - DNA, 14 bp, Homo sapiens
gctcctctgctgct

SEQ ID NO: 5425101 - DNA, 15 bp, Homo sapiens
gctcctctgctgctc

SEQ ID NO: 5425102 - DNA, 12 bp, Homo sapiens
gctcctctgctt

SEQ ID NO: 5425103 - DNA, 11 bp, Homo sapiens
gctcctctggg

SEQ ID NO: 5425104 - DNA, 19 bp, Homo sapiens
gctcctctgtcctgcttct

SEQ ID NO: 5425105 - DNA, 14 bp, Homo sapiens
gctcctctgttcag

SEQ ID NO: 5425106 - DNA, 15 bp, Homo sapiens
gctcctcttccccag

SEQ ID NO: 5425107 - DNA, 23 bp, Homo sapiens
gctcctcttccccagacgcctgg

SEQ ID NO: 5425108 - DNA, 17 bp, Homo sapiens
gctcctcttgattcctg

SEQ ID NO: 5425109 - DNA, 19 bp, Homo sapiens
gctcctcttgattcctggt

SEQ ID NO: 5425110 - DNA, 12 bp, Homo sapiens
gctcctcttgtt

SEQ ID NO: 5425111 - DNA, 22 bp, Homo sapiens
gctcctcttgttcctgaaatgt

SEQ ID NO: 5425112 - DNA, 12 bp, Homo sapiens
gctcctctttcc

SEQ ID NO: 5425113 - DNA, 17 bp, Homo sapiens
gctcctctttcccctcc

SEQ ID NO: 5425114 - DNA, 22 bp, Homo sapiens
gctcctgaaagaaacgctagaa

SEQ ID NO: 5425115 - DNA, 22 bp, Homo sapiens
gctcctgaaccagtcctgctgc

SEQ ID NO: 5425116 - DNA, 12 bp, Homo sapiens
gctcctgaagga

SEQ ID NO: 5425117 - DNA, 12 bp, Homo sapiens
gctcctgacaat

SEQ ID NO: 5425118 - DNA, 17 bp, Homo sapiens
gctcctgacactgctgg

SEQ ID NO: 5425119 - DNA, 13 bp, Homo sapiens
gctcctgaccaaa

SEQ ID NO: 5425120 - DNA, 20 bp, Homo sapiens
gctcctgacccctccctgca

SEQ ID NO: 5425121 - DNA, 21 bp, Homo sapiens
gctcctgacccctccctgcag

SEQ ID NO: 5425122 - DNA, 18 bp, Homo sapiens
gctcctgacttagcccgt

SEQ ID NO: 5425123 - DNA, 21 bp, Homo sapiens
gctcctgagaaaggtgaggag

SEQ ID NO: 5425124 - DNA, 12 bp, Homo sapiens
gctcctgagaca

SEQ ID NO: 5425125 - DNA, 19 bp, Homo sapiens
gctcctgagacacatgggt

SEQ ID NO: 5425126 - DNA, 17 bp, Homo sapiens
gctcctgagggagctcc

SEQ ID NO: 5425127 - DNA, 21 bp, Homo sapiens
gctcctgaggggcatctgccc

SEQ ID NO: 5425128 - DNA, 17 bp, Homo sapiens
gctcctgagtagctggg

SEQ ID NO: 5425129 - DNA, 16 bp, Homo sapiens
gctcctgatcagaggc

SEQ ID NO: 5425130 - DNA, 18 bp, Homo sapiens
gctcctgatcagaggcat

SEQ ID NO: 5425131 - DNA, 21 bp, Homo sapiens
gctcctgcaaaaggaggtgaa

SEQ ID NO: 5425132 - DNA, 14 bp, Homo sapiens
gctcctgcagcatg

SEQ ID NO: 5425133 - DNA, 21 bp, Homo sapiens
gctcctgccaccacgcccggc

SEQ ID NO: 5425134 - DNA, 22 bp, Homo sapiens
gctcctgccaccacgcccggct

SEQ ID NO: 5425135 - DNA, 13 bp, Homo sapiens
gctcctgccactg

SEQ ID NO: 5425136 - DNA, 14 bp, Homo sapiens
gctcctgccactga

SEQ ID NO: 5425137 - DNA, 12 bp, Homo sapiens
gctcctgcccac

SEQ ID NO: 5425138 - DNA, 15 bp, Homo sapiens
gctcctgcccacgtg

SEQ ID NO: 5425139 - DNA, 14 bp, Homo sapiens
gctcctgcccagcc

SEQ ID NO: 5425140 - DNA, 18 bp, Homo sapiens
gctcctgcccaggagcag

SEQ ID NO: 5425141 - DNA, 19 bp, Homo sapiens
gctcctgcccaggagcagc

SEQ ID NO: 5425142 - DNA, 19 bp, Homo sapiens
gctcctgcccaggccacag

SEQ ID NO: 5425143 - DNA, 22 bp, Homo sapiens
gctcctgccgcagacgggcaca

SEQ ID NO: 5425144 - DNA, 15 bp, Homo sapiens
gctcctgccgcagag

SEQ ID NO: 5425145 - DNA, 17 bp, Homo sapiens
gctcctgccgcagagct

SEQ ID NO: 5425146 - DNA, 19 bp, Homo sapiens
gctcctgccgcagagctgg

SEQ ID NO: 5425147 - DNA, 15 bp, Homo sapiens
gctcctgccttctgt

SEQ ID NO: 5425148 - DNA, 17 bp, Homo sapiens
gctcctgccttctgtcc

SEQ ID NO: 5425149 - DNA, 19 bp, Homo sapiens
gctcctgccttctgtcctg

SEQ ID NO: 5425150 - DNA, 22 bp, Homo sapiens
gctcctgccttgatgaagcccg

SEQ ID NO: 5425151 - DNA, 22 bp, Homo sapiens
gctcctgctgaaacacctccca

SEQ ID NO: 5425152 - DNA, 15 bp, Homo sapiens
gctcctgctgcacca

SEQ ID NO: 5425153 - DNA, 23 bp, Homo sapiens
gctcctgctggggggcagggccc

SEQ ID NO: 5425154 - DNA, 12 bp, Homo sapiens
gctcctgcttcc

SEQ ID NO: 5425155 - DNA, 17 bp, Homo sapiens
gctcctgcttcccctcc

SEQ ID NO: 5425156 - DNA, 16 bp, Homo sapiens
gctcctgcttctcctg

SEQ ID NO: 5425157 - DNA, 15 bp, Homo sapiens
gctcctgcttttctg

SEQ ID NO: 5425158 - DNA, 17 bp, Homo sapiens
gctcctgcttttctgtc

SEQ ID NO: 5425159 - DNA, 22 bp, Homo sapiens
gctcctgcttttctgtcctggg

SEQ ID NO: 5425160 - DNA, 23 bp, Homo sapiens
gctcctgcttttggggctcttga

SEQ ID NO: 5425161 - DNA, 21 bp, Homo sapiens
gctcctggaaaggctcagtct

SEQ ID NO: 5425162 - DNA, 23 bp, Homo sapiens
gctcctggaaaggctcagtctca

SEQ ID NO: 5425163 - DNA, 22 bp, Homo sapiens
gctcctggaaccaatcccgtga

SEQ ID NO: 5425164 - DNA, 13 bp, Homo sapiens
gctcctggaacct

SEQ ID NO: 5425165 - DNA, 17 bp, Homo sapiens
gctcctggaacctggca

SEQ ID NO: 5425166 - DNA, 18 bp, Homo sapiens
gctcctggaacctggcag

SEQ ID NO: 5425167 - DNA, 18 bp, Homo sapiens
gctcctggacctaaaggg

SEQ ID NO: 5425168 - DNA, 21 bp, Homo sapiens
gctcctggacctaaagggtat

SEQ ID NO: 5425169 - DNA, 17 bp, Homo sapiens
gctcctggactcattgc

SEQ ID NO: 5425170 - DNA, 14 bp, Homo sapiens
gctcctggagccag

SEQ ID NO: 5425171 - DNA, 15 bp, Homo sapiens
gctcctggagccagc

SEQ ID NO: 5425172 - DNA, 19 bp, Homo sapiens
gctcctggagcctttgaat

SEQ ID NO: 5425173 - DNA, 23 bp, Homo sapiens
gctcctggccaggataatatatt

SEQ ID NO: 5425174 - DNA, 19 bp, Homo sapiens
gctcctggcccactgcatc

SEQ ID NO: 5425175 - DNA, 17 bp, Homo sapiens
gctcctggcccagcctt

SEQ ID NO: 5425176 - DNA, 11 bp, Homo sapiens
gctcctggctg

SEQ ID NO: 5425177 - DNA, 15 bp, Homo sapiens
gctcctggctgccag

SEQ ID NO: 5425178 - DNA, 17 bp, Homo sapiens
gctcctggctgccaggc

SEQ ID NO: 5425179 - DNA, 18 bp, Homo sapiens
gctcctggctgccaggcg

SEQ ID NO: 5425180 - DNA, 19 bp, Homo sapiens
gctcctggctgccaggcgt

SEQ ID NO: 5425181 - DNA, 20 bp, Homo sapiens
gctcctggctgtgcccagca

SEQ ID NO: 5425182 - DNA, 23 bp, Homo sapiens
gctcctggctgtgcccagcaggc

SEQ ID NO: 5425183 - DNA, 19 bp, Homo sapiens
gctcctgggaggccctggc

SEQ ID NO: 5425184 - DNA, 22 bp, Homo sapiens
gctcctgggaggccctggcaga

SEQ ID NO: 5425185 - DNA, 13 bp, Homo sapiens
gctcctgggaggg

SEQ ID NO: 5425186 - DNA, 14 bp, Homo sapiens
gctcctgggaggga

SEQ ID NO: 5425187 - DNA, 16 bp, Homo sapiens
gctcctgggccggctg

SEQ ID NO: 5425188 - DNA, 14 bp, Homo sapiens
gctcctggggagaa

SEQ ID NO: 5425189 - DNA, 16 bp, Homo sapiens
gctcctggggagctcc

SEQ ID NO: 5425190 - DNA, 23 bp, Homo sapiens
gctcctggggagctcctgggacc

SEQ ID NO: 5425191 - DNA, 15 bp, Homo sapiens
gctcctggggcagag

SEQ ID NO: 5425192 - DNA, 11 bp, Homo sapiens
gctcctgggtt

SEQ ID NO: 5425193 - DNA, 23 bp, Homo sapiens
gctcctgggttccctaggcccta

SEQ ID NO: 5425194 - DNA, 12 bp, Homo sapiens
gctcctgggttg

SEQ ID NO: 5425195 - DNA, 14 bp, Homo sapiens
gctcctgggttgga

SEQ ID NO: 5425196 - DNA, 23 bp, Homo sapiens
gctcctgggttggagggaaccac

SEQ ID NO: 5425197 - DNA, 12 bp, Homo sapiens
gctcctggtggg

SEQ ID NO: 5425198 - DNA, 14 bp, Homo sapiens
gctcctggtggggc

SEQ ID NO: 5425199 - DNA, 21 bp, Homo sapiens
gctcctggtggggcagaaagg

SEQ ID NO: 5425200 - DNA, 23 bp, Homo sapiens
gctcctgtacttgtcctcagctt

SEQ ID NO: 5425201 - DNA, 17 bp, Homo sapiens
gctcctgtccctaccca

SEQ ID NO: 5425202 - DNA, 21 bp, Homo sapiens
gctcctgtccctacccactct

SEQ ID NO: 5425203 - DNA, 13 bp, Homo sapiens
gctcctgtccctc

SEQ ID NO: 5425204 - DNA, 22 bp, Homo sapiens
gctcctgtcctcccatcccctg

SEQ ID NO: 5425205 - DNA, 17 bp, Homo sapiens
gctcctgtctgccagcc

SEQ ID NO: 5425206 - DNA, 19 bp, Homo sapiens
gctcctgtctgccagccag

SEQ ID NO: 5425207 - DNA, 12 bp, Homo sapiens
gctcctgtgccc

SEQ ID NO: 5425208 - DNA, 17 bp, Homo sapiens
gctcctgtgctcaccct

SEQ ID NO: 5425209 - DNA, 14 bp, Homo sapiens
gctcctgtgctttc

SEQ ID NO: 5425210 - DNA, 18 bp, Homo sapiens
gctcctgtggcaggaggc

SEQ ID NO: 5425211 - DNA, 20 bp, Homo sapiens
gctcctgtggccccaccctg

SEQ ID NO: 5425212 - DNA, 21 bp, Homo sapiens
gctcctgtggccccaccctgg

SEQ ID NO: 5425213 - DNA, 11 bp, Homo sapiens
gctcctgtggt

SEQ ID NO: 5425214 - DNA, 23 bp, Homo sapiens
gctcctgtggtagtcctcccaag

SEQ ID NO: 5425215 - DNA, 13 bp, Homo sapiens
gctcctgtgtctt

SEQ ID NO: 5425216 - DNA, 20 bp, Homo sapiens
gctcctgtttaactccctag

SEQ ID NO: 5425217 - DNA, 17 bp, Homo sapiens
gctcctgtttggaaatg

SEQ ID NO: 5425218 - DNA, 22 bp, Homo sapiens
gctcctgttttgcacagccaaa

SEQ ID NO: 5425219 - DNA, 22 bp, Homo sapiens
gctccttaccaatattattaaa

SEQ ID NO: 5425220 - DNA, 19 bp, Homo sapiens
gctccttagggttttctct

SEQ ID NO: 5425221 - DNA, 18 bp, Homo sapiens
gctccttcactgaacatg

SEQ ID NO: 5425222 - DNA, 18 bp, Homo sapiens
gctccttcactgttccct

SEQ ID NO: 5425223 - DNA, 24 bp, Homo sapiens
gctccttcactgttccctctggct

SEQ ID NO: 5425224 - DNA, 21 bp, Homo sapiens
gctccttcaggcgaagggtgg

SEQ ID NO: 5425225 - DNA, 18 bp, Homo sapiens
gctccttcagttctgctt

SEQ ID NO: 5425226 - DNA, 14 bp, Homo sapiens
gctccttcatgctt

SEQ ID NO: 5425227 - DNA, 17 bp, Homo sapiens
gctccttcatgcttttc

SEQ ID NO: 5425228 - DNA, 12 bp, Homo sapiens
gctccttccaga

SEQ ID NO: 5425229 - DNA, 18 bp, Homo sapiens
gctccttcccatcgctgt

SEQ ID NO: 5425230 - DNA, 16 bp, Homo sapiens
gctccttcccctgcac

SEQ ID NO: 5425231 - DNA, 17 bp, Homo sapiens
gctccttcccctgcacc

SEQ ID NO: 5425232 - DNA, 23 bp, Homo sapiens
gctccttcccctgcacctggcct

SEQ ID NO: 5425233 - DNA, 15 bp, Homo sapiens
gctccttcccttgct

SEQ ID NO: 5425234 - DNA, 11 bp, Homo sapiens
gctccttcctg

SEQ ID NO: 5425235 - DNA, 13 bp, Homo sapiens
gctccttcctgtg

SEQ ID NO: 5425236 - DNA, 22 bp, Homo sapiens
gctccttcctgtggcctcatcc

SEQ ID NO: 5425237 - DNA, 22 bp, Homo sapiens
gctccttcctgtgggtggggct

SEQ ID NO: 5425238 - DNA, 15 bp, Homo sapiens
gctctgagcaggggc

SEQ ID NO: 5425239 - DNA, 18 bp, Homo sapiens
gctctgagcagttgttat

SEQ ID NO: 5425240 - DNA, 16 bp, Homo sapiens
gctctgagccagatta

SEQ ID NO: 5425241 - DNA, 17 bp, Homo sapiens
gctctgagccagattac

SEQ ID NO: 5425242 - DNA, 13 bp, Homo sapiens
gctctgagccagt

SEQ ID NO: 5425243 - DNA, 11 bp, Homo sapiens
gctctgagccc

SEQ ID NO: 5425244 - DNA, 12 bp, Homo sapiens
gctctgagctgt

SEQ ID NO: 5425245 - DNA, 10 bp, Homo sapiens
gctctgaggc

SEQ ID NO: 5425246 - DNA, 14 bp, Homo sapiens
gctctgaggcaacc

SEQ ID NO: 5425247 - DNA, 23 bp, Homo sapiens
gctctgaggctgccccaggggca

SEQ ID NO: 5425248 - DNA, 16 bp, Homo sapiens
gctctgaggcttccag

SEQ ID NO: 5425249 - DNA, 20 bp, Homo sapiens
gctctgaggcttccagagag

SEQ ID NO: 5425250 - DNA, 14 bp, Homo sapiens
gctctgaggggcac

SEQ ID NO: 5425251 - DNA, 23 bp, Homo sapiens
gctctgaggtcaataaagcagag

SEQ ID NO: 5425252 - DNA, 21 bp, Homo sapiens
gctctgatcatccactgtgcc

SEQ ID NO: 5425253 - DNA, 22 bp, Homo sapiens
gctctgatcatccactgtgcca

SEQ ID NO: 5425254 - DNA, 13 bp, Homo sapiens
gctctgatccctc

SEQ ID NO: 5425255 - DNA, 23 bp, Homo sapiens
gctctgatccctctacagagctt

SEQ ID NO: 5425256 - DNA, 13 bp, Homo sapiens
gctctgatgaaaa

SEQ ID NO: 5425257 - DNA, 23 bp, Homo sapiens
gctctgatgaaaaattgctgact

SEQ ID NO: 5425258 - DNA, 16 bp, Homo sapiens
gctctgatgcatcaga

SEQ ID NO: 5425259 - DNA, 20 bp, Homo sapiens
gctctgatgcatcagaaagg

SEQ ID NO: 5425260 - DNA, 22 bp, Homo sapiens
gctctgattggaatttctggcc

SEQ ID NO: 5425261 - DNA, 16 bp, Homo sapiens
gctctgatttccttcc

SEQ ID NO: 5425262 - DNA, 17 bp, Homo sapiens
gctctgatttccttcca

SEQ ID NO: 5425263 - DNA, 13 bp, Homo sapiens
gctctgcacagat

SEQ ID NO: 5425264 - DNA, 17 bp, Homo sapiens
gctctgcaccttctgac

SEQ ID NO: 5425265 - DNA, 22 bp, Homo sapiens
gctctgcagcacattgccctga

SEQ ID NO: 5425266 - DNA, 23 bp, Homo sapiens
gctctgcagcacattgccctgag

SEQ ID NO: 5425267 - DNA, 13 bp, Homo sapiens
gctctgcagccca

SEQ ID NO: 5425268 - DNA, 16 bp, Homo sapiens
gctctgcagcccacag

SEQ ID NO: 5425269 - DNA, 17 bp, Homo sapiens
gctctgcagcccacaga

SEQ ID NO: 5425270 - DNA, 20 bp, Homo sapiens
gctctgcagcccacagagga

SEQ ID NO: 5425271 - DNA, 22 bp, Homo sapiens
gctctgcagcccacagaggaca

SEQ ID NO: 5425272 - DNA, 15 bp, Homo sapiens
gctctgcagcccagg

SEQ ID NO: 5425273 - DNA, 19 bp, Homo sapiens
gctctgcagcccagggacc

SEQ ID NO: 5425274 - DNA, 11 bp, Homo sapiens
gctctgcaggc

SEQ ID NO: 5425275 - DNA, 14 bp, Homo sapiens
gctctgcaggcacc

SEQ ID NO: 5425276 - DNA, 16 bp, Homo sapiens
gctctgcaggcacctt

SEQ ID NO: 5425277 - DNA, 18 bp, Homo sapiens
gctctgcaggcaccttag

SEQ ID NO: 5425278 - DNA, 14 bp, Homo sapiens
gctctgcaggccac

SEQ ID NO: 5425279 - DNA, 17 bp, Homo sapiens
gctctgcaggctgggga

SEQ ID NO: 5425280 - DNA, 20 bp, Homo sapiens
gctctgcaggcttaataaaa

SEQ ID NO: 5425281 - DNA, 14 bp, Homo sapiens
gctctgcatacaca

SEQ ID NO: 5425282 - DNA, 21 bp, Homo sapiens
gctctgcatgcggcccagccc

SEQ ID NO: 5425283 - DNA, 16 bp, Homo sapiens
gctctgcatgctcctc

SEQ ID NO: 5425284 - DNA, 20 bp, Homo sapiens
gctctgcatgctcctctgcc

SEQ ID NO: 5425285 - DNA, 21 bp, Homo sapiens
gctctgcatgctcctctgcct

SEQ ID NO: 5425286 - DNA, 22 bp, Homo sapiens
gctctgcatgctcctctgcctg

SEQ ID NO: 5425287 - DNA, 23 bp, Homo sapiens
gctctgccaacttcttcagagct

SEQ ID NO: 5425288 - DNA, 17 bp, Homo sapiens
gctctgccaatgtgggc

SEQ ID NO: 5425289 - DNA, 13 bp, Homo sapiens
gctctgccagtcc

SEQ ID NO: 5425290 - DNA, 18 bp, Homo sapiens
gctctgccagtcctgtcc

SEQ ID NO: 5425291 - DNA, 14 bp, Homo sapiens
gctctgccatcagc

SEQ ID NO: 5425292 - DNA, 18 bp, Homo sapiens
gctctgcccacctggggt

SEQ ID NO: 5425293 - DNA, 16 bp, Homo sapiens
gctctgcccactgtga

SEQ ID NO: 5425294 - DNA, 13 bp, Homo sapiens
gctctgcccagag

SEQ ID NO: 5425295 - DNA, 22 bp, Homo sapiens
gctctgcccaggcaaggaacag

SEQ ID NO: 5425296 - DNA, 23 bp, Homo sapiens
gctctgcccaggcaaggaacaga

SEQ ID NO: 5425297 - DNA, 14 bp, Homo sapiens
gctctgcccatgcc

SEQ ID NO: 5425298 - DNA, 15 bp, Homo sapiens
gctctgcccatgcct

SEQ ID NO: 5425299 - DNA, 18 bp, Homo sapiens
gctctgccccaagccccc

SEQ ID NO: 5425300 - DNA, 12 bp, Homo sapiens
gctctgccccag

SEQ ID NO: 5425301 - DNA, 13 bp, Homo sapiens
gctctgccccagc

SEQ ID NO: 5425302 - DNA, 17 bp, Homo sapiens
gctctgccccaggccct

SEQ ID NO: 5425303 - DNA, 23 bp, Homo sapiens
gctctgcccccgcgggttctaga

SEQ ID NO: 5425304 - DNA, 18 bp, Homo sapiens
gctctgccccctccccca

SEQ ID NO: 5425305 - DNA, 12 bp, Homo sapiens
gctctgcccctc

SEQ ID NO: 5425306 - DNA, 14 bp, Homo sapiens
gctctgcccctccg

SEQ ID NO: 5425307 - DNA, 18 bp, Homo sapiens
gctctgcccctccgtccc

SEQ ID NO: 5425308 - DNA, 15 bp, Homo sapiens
gctctgccccttccc

SEQ ID NO: 5425309 - DNA, 19 bp, Homo sapiens
gctctgccccttccccatg

SEQ ID NO: 5425310 - DNA, 22 bp, Homo sapiens
gctctgccccttgggcatccac

SEQ ID NO: 5425311 - DNA, 14 bp, Homo sapiens
gctctgccctccct

SEQ ID NO: 5425312 - DNA, 15 bp, Homo sapiens
gctctgccctccctg

SEQ ID NO: 5425313 - DNA, 20 bp, Homo sapiens
gctctgccctccctggcctc

SEQ ID NO: 5425314 - DNA, 16 bp, Homo sapiens
gctctgccctggaaag

SEQ ID NO: 5425315 - DNA, 13 bp, Homo sapiens
gctctgccctggc

SEQ ID NO: 5425316 - DNA, 15 bp, Homo sapiens
gctctgccctggctg

SEQ ID NO: 5425317 - DNA, 21 bp, Homo sapiens
gctctgcccttgttccctagg

SEQ ID NO: 5425318 - DNA, 20 bp, Homo sapiens
gctctgccgccgcccgctgg

SEQ ID NO: 5425319 - DNA, 17 bp, Homo sapiens
gctctgccgtctctgga

SEQ ID NO: 5425320 - DNA, 17 bp, Homo sapiens
gctctgcctcaactcca

SEQ ID NO: 5425321 - DNA, 22 bp, Homo sapiens
gctctgcctcagacgttgcctg

SEQ ID NO: 5425322 - DNA, 23 bp, Homo sapiens
gctctgcctcagacgttgcctga

SEQ ID NO: 5425323 - DNA, 15 bp, Homo sapiens
gctctgcctcccatc

SEQ ID NO: 5425324 - DNA, 13 bp, Homo sapiens
gctctgcctcccg

SEQ ID NO: 5425325 - DNA, 19 bp, Homo sapiens
gctctgcctctaactccct

SEQ ID NO: 5425326 - DNA, 20 bp, Homo sapiens
gctctgcctctaactccctc

SEQ ID NO: 5425327 - DNA, 16 bp, Homo sapiens
gctctgcctgacagag

SEQ ID NO: 5425328 - DNA, 15 bp, Homo sapiens
gctctgcctggagtg

SEQ ID NO: 5425329 - DNA, 15 bp, Homo sapiens
gctctgcctgtctgg

SEQ ID NO: 5425330 - DNA, 16 bp, Homo sapiens
gctctgcctttgctct

SEQ ID NO: 5425331 - DNA, 13 bp, Homo sapiens
gctctgcgccagg

SEQ ID NO: 5425332 - DNA, 18 bp, Homo sapiens
gctctgcgccaggcagag

SEQ ID NO: 5425333 - DNA, 19 bp, Homo sapiens
gctctgcgccaggcagagc

SEQ ID NO: 5425334 - DNA, 20 bp, Homo sapiens
gctctgcgccaggcagagct

SEQ ID NO: 5425335 - DNA, 20 bp, Homo sapiens
gctctgcgtcggtcctggtg

SEQ ID NO: 5425336 - DNA, 22 bp, Homo sapiens
gctctgctcaaatgttgcagga

SEQ ID NO: 5425337 - DNA, 18 bp, Homo sapiens
gctctgctcatctacaca

SEQ ID NO: 5425338 - DNA, 18 bp, Homo sapiens
gctctgctgacagacaca

SEQ ID NO: 5425339 - DNA, 15 bp, Homo sapiens
gctctgctgacttct

SEQ ID NO: 5425340 - DNA, 22 bp, Homo sapiens
gctctgctgatgacccccccag

SEQ ID NO: 5425341 - DNA, 13 bp, Homo sapiens
gctctgctgctga

SEQ ID NO: 5425342 - DNA, 13 bp, Homo sapiens
gctctgctggaag

SEQ ID NO: 5425343 - DNA, 19 bp, Homo sapiens
gctctgctggcctggccgg

SEQ ID NO: 5425344 - DNA, 14 bp, Homo sapiens
gctctgcttgacaa

SEQ ID NO: 5425345 - DNA, 20 bp, Homo sapiens
gctctgcttgccgaaactgg

SEQ ID NO: 5425346 - DNA, 17 bp, Homo sapiens
gctctgcttttcctgtc

SEQ ID NO: 5425347 - DNA, 21 bp, Homo sapiens
gctctggaaaacctgaggcca

SEQ ID NO: 5425348 - DNA, 23 bp, Homo sapiens
gctctggaaaacctgaggccaaa

SEQ ID NO: 5425349 - DNA, 21 bp, Homo sapiens
gctctggaaaatgtgacccag

SEQ ID NO: 5425350 - DNA, 23 bp, Homo sapiens
gctctggaactgattgctcccag

SEQ ID NO: 5425351 - DNA, 21 bp, Homo sapiens
gctctggaagcctgctgattt

SEQ ID NO: 5425352 - DNA, 13 bp, Homo sapiens
gctctggacagat

SEQ ID NO: 5425353 - DNA, 23 bp, Homo sapiens
gctctggacagcagaagcctcca

SEQ ID NO: 5425354 - DNA, 16 bp, Homo sapiens
gctctggacaggcatg

SEQ ID NO: 5425355 - DNA, 11 bp, Homo sapiens
gctctggacca

SEQ ID NO: 5425356 - DNA, 12 bp, Homo sapiens
gctctggacctg

SEQ ID NO: 5425357 - DNA, 13 bp, Homo sapiens
gctctggacctgc

SEQ ID NO: 5425358 - DNA, 19 bp, Homo sapiens
gctctggagacagccccag

SEQ ID NO: 5425359 - DNA, 20 bp, Homo sapiens
gctctggagacagccccaga

SEQ ID NO: 5425360 - DNA, 13 bp, Homo sapiens
gctctggagagaa

SEQ ID NO: 5425361 - DNA, 15 bp, Homo sapiens
gctctggagagaaac

SEQ ID NO: 5425362 - DNA, 16 bp, Homo sapiens
gctctggagcagccaa

SEQ ID NO: 5425363 - DNA, 16 bp, Homo sapiens
gctctggagccacctg

SEQ ID NO: 5425364 - DNA, 14 bp, Homo sapiens
gctctggagccaga

SEQ ID NO: 5425365 - DNA, 22 bp, Homo sapiens
gctctggagccagagagacaga

SEQ ID NO: 5425366 - DNA, 20 bp, Homo sapiens
gctctggaggaagttctcca

SEQ ID NO: 5425367 - DNA, 21 bp, Homo sapiens
gctctggaggagcaagggggc

SEQ ID NO: 5425368 - DNA, 20 bp, Homo sapiens
gctctggaggtgctgctcta

SEQ ID NO: 5425369 - DNA, 22 bp, Homo sapiens
gctctggagtgagtctgtcata

SEQ ID NO: 5425370 - DNA, 15 bp, Homo sapiens
gctctggatcctgca

SEQ ID NO: 5425371 - DNA, 15 bp, Homo sapiens
gctctggatgaaggc

SEQ ID NO: 5425372 - DNA, 16 bp, Homo sapiens
gctctggatgaaggca

SEQ ID NO: 5425373 - DNA, 17 bp, Homo sapiens
gctctggatgaaggcaa

SEQ ID NO: 5425374 - DNA, 21 bp, Homo sapiens
gctctggcaccatcagcctgt

SEQ ID NO: 5425375 - DNA, 17 bp, Homo sapiens
gctctggcaggtggcca

SEQ ID NO: 5425376 - DNA, 23 bp, Homo sapiens
gctctggcaggtggccagggctc

SEQ ID NO: 5425377 - DNA, 19 bp, Homo sapiens
gctctggccaagggccaga

SEQ ID NO: 5425378 - DNA, 14 bp, Homo sapiens
gctctggccaccct

SEQ ID NO: 5425379 - DNA, 17 bp, Homo sapiens
gctctggccaccctggc

SEQ ID NO: 5425380 - DNA, 15 bp, Homo sapiens
gctctggccccaggc

SEQ ID NO: 5425381 - DNA, 13 bp, Homo sapiens
gctctggccccgc

SEQ ID NO: 5425382 - DNA, 19 bp, Homo sapiens
gctctggcccttgcctttg

SEQ ID NO: 5425383 - DNA, 23 bp, Homo sapiens
gctctggcggcttcctgtccact

SEQ ID NO: 5425384 - DNA, 15 bp, Homo sapiens
gctctggctcacaga

SEQ ID NO: 5425385 - DNA, 18 bp, Homo sapiens
gctctggctcacagactg

SEQ ID NO: 5425386 - DNA, 21 bp, Homo sapiens
gctctggctccagaggacctg

SEQ ID NO: 5425387 - DNA, 15 bp, Homo sapiens
gctctggctccctgg

SEQ ID NO: 5425388 - DNA, 15 bp, Homo sapiens
gctctggctgaaccc

SEQ ID NO: 5425389 - DNA, 14 bp, Homo sapiens
gctctggctgcttt

SEQ ID NO: 5425390 - DNA, 17 bp, Homo sapiens
gctctggctggagagga

SEQ ID NO: 5425391 - DNA, 14 bp, Homo sapiens
gctctggcttgccc

SEQ ID NO: 5425392 - DNA, 16 bp, Homo sapiens
gctctggcttgcccca

SEQ ID NO: 5425393 - DNA, 23 bp, Homo sapiens
gctctggcttgccccaggactct

SEQ ID NO: 5425394 - DNA, 16 bp, Homo sapiens
gctctgggacgtggac

SEQ ID NO: 5425395 - DNA, 17 bp, Homo sapiens
gctctgggagagccagc

SEQ ID NO: 5425396 - DNA, 14 bp, Homo sapiens
gctctgggattctg

SEQ ID NO: 5425397 - DNA, 17 bp, Homo sapiens
gctctgggcacagtgct

SEQ ID NO: 5425398 - DNA, 18 bp, Homo sapiens
gctctgggcacagtgctg

SEQ ID NO: 5425399 - DNA, 20 bp, Homo sapiens
gctctgggcacagtgctgcc

SEQ ID NO: 5425400 - DNA, 23 bp, Homo sapiens
gctctgggcacagtgctgcccct

SEQ ID NO: 5425401 - DNA, 14 bp, Homo sapiens
gctctgggccattc

SEQ ID NO: 5425402 - DNA, 20 bp, Homo sapiens
gctctgggccattctccaca

SEQ ID NO: 5425403 - DNA, 21 bp, Homo sapiens
gctctgggccgggcctggggc

SEQ ID NO: 5425404 - DNA, 12 bp, Homo sapiens
gctctgggcctc

SEQ ID NO: 5425405 - DNA, 14 bp, Homo sapiens
gctctgggcctctt

SEQ ID NO: 5425406 - DNA, 15 bp, Homo sapiens
gctctgggcctgagg

SEQ ID NO: 5425407 - DNA, 20 bp, Homo sapiens
gctctgggctcagggctgga

SEQ ID NO: 5425408 - DNA, 23 bp, Homo sapiens
gctctgggctcagggctggagtg

SEQ ID NO: 5425409 - DNA, 12 bp, Homo sapiens
gctctgggctgg

SEQ ID NO: 5425410 - DNA, 15 bp, Homo sapiens
gctctgggctggctg

SEQ ID NO: 5425411 - DNA, 16 bp, Homo sapiens
gctctgggctggctgc

SEQ ID NO: 5425412 - DNA, 21 bp, Homo sapiens
gctctgggctggctgctccta

SEQ ID NO: 5425413 - DNA, 17 bp, Homo sapiens
gctctggggacagcttc

SEQ ID NO: 5425414 - DNA, 19 bp, Homo sapiens
gctctggggatttctggga

SEQ ID NO: 5425415 - DNA, 20 bp, Homo sapiens
gctctggggatttctgggat

SEQ ID NO: 5425416 - DNA, 14 bp, Homo sapiens
gctgacagacacag

SEQ ID NO: 5425417 - DNA, 18 bp, Homo sapiens
gctgacagacacaggccc

SEQ ID NO: 5425418 - DNA, 24 bp, Homo sapiens
gctgacagagcaggtctgcaggcc

SEQ ID NO: 5425419 - DNA, 15 bp, Homo sapiens
gctgacagagccaga

SEQ ID NO: 5425420 - DNA, 18 bp, Homo sapiens
gctgacagagccagaggc

SEQ ID NO: 5425421 - DNA, 13 bp, Homo sapiens
gctgacagagccc

SEQ ID NO: 5425422 - DNA, 13 bp, Homo sapiens
gctgacagataca

SEQ ID NO: 5425423 - DNA, 21 bp, Homo sapiens
gctgacagatacatagatgga

SEQ ID NO: 5425424 - DNA, 16 bp, Homo sapiens
gctgacagcctcctag

SEQ ID NO: 5425425 - DNA, 13 bp, Homo sapiens
gctgacagctgct

SEQ ID NO: 5425426 - DNA, 14 bp, Homo sapiens
gctgacagctgctc

SEQ ID NO: 5425427 - DNA, 15 bp, Homo sapiens
gctgacagctgctcc

SEQ ID NO: 5425428 - DNA, 12 bp, Homo sapiens
gctgacaggatg

SEQ ID NO: 5425429 - DNA, 21 bp, Homo sapiens
gctgacaggatgtggcactgc

SEQ ID NO: 5425430 - DNA, 19 bp, Homo sapiens
gctgacagtcagctgtggg

SEQ ID NO: 5425431 - DNA, 16 bp, Homo sapiens
gctgacatctgtgttt

SEQ ID NO: 5425432 - DNA, 16 bp, Homo sapiens
gctgacatcttgcacg

SEQ ID NO: 5425433 - DNA, 15 bp, Homo sapiens
gctgacatgctcaca

SEQ ID NO: 5425434 - DNA, 23 bp, Homo sapiens
gctgacatggctttgctttgtgt

SEQ ID NO: 5425435 - DNA, 16 bp, Homo sapiens
gctgacattcacctgc

SEQ ID NO: 5425436 - DNA, 17 bp, Homo sapiens
gctgacattcactgagt

SEQ ID NO: 5425437 - DNA, 15 bp, Homo sapiens
gctgaccaagagaga

SEQ ID NO: 5425438 - DNA, 20 bp, Homo sapiens
gctgaccaagagagaaagaa

SEQ ID NO: 5425439 - DNA, 16 bp, Homo sapiens
gctgaccaattgtgct

SEQ ID NO: 5425440 - DNA, 22 bp, Homo sapiens
gctgaccagctggagtgagggc

SEQ ID NO: 5425441 - DNA, 19 bp, Homo sapiens
gctgaccataacagtgcca

SEQ ID NO: 5425442 - DNA, 23 bp, Homo sapiens
gctgaccataacagtgccagctt

SEQ ID NO: 5425443 - DNA, 15 bp, Homo sapiens
gctgacccagcatct

SEQ ID NO: 5425444 - DNA, 20 bp, Homo sapiens
gctgacccagcatctcccag

SEQ ID NO: 5425445 - DNA, 22 bp, Homo sapiens
gctgacccagcatctcccagca

SEQ ID NO: 5425446 - DNA, 15 bp, Homo sapiens
gctgacccagtccct

SEQ ID NO: 5425447 - DNA, 18 bp, Homo sapiens
gctgacccatgggcagga

SEQ ID NO: 5425448 - DNA, 19 bp, Homo sapiens
gctgaccccaaagagcctg

SEQ ID NO: 5425449 - DNA, 13 bp, Homo sapiens
gctgaccccagga

SEQ ID NO: 5425450 - DNA, 22 bp, Homo sapiens
gctgaccccaggaagtgggaga

SEQ ID NO: 5425451 - DNA, 20 bp, Homo sapiens
gctgaccccaggtcagccct

SEQ ID NO: 5425452 - DNA, 22 bp, Homo sapiens
gctgaccccaggtcagccctgt

SEQ ID NO: 5425453 - DNA, 23 bp, Homo sapiens
gctgaccccaggtcagccctgtg

SEQ ID NO: 5425454 - DNA, 18 bp, Homo sapiens
gctgaccccctcccccca

SEQ ID NO: 5425455 - DNA, 21 bp, Homo sapiens
gctgaccccgagaagtgctct

SEQ ID NO: 5425456 - DNA, 22 bp, Homo sapiens
gctgaccccgagaagtgctctt

SEQ ID NO: 5425457 - DNA, 18 bp, Homo sapiens
gctgacccggcctctctg

SEQ ID NO: 5425458 - DNA, 15 bp, Homo sapiens
gctgaccctcctgtt

SEQ ID NO: 5425459 - DNA, 14 bp, Homo sapiens
gctgaccctgggcc

SEQ ID NO: 5425460 - DNA, 15 bp, Homo sapiens
gctgaccctgggcct

SEQ ID NO: 5425461 - DNA, 18 bp, Homo sapiens
gctgaccctgggcctgga

SEQ ID NO: 5425462 - DNA, 16 bp, Homo sapiens
gctgacctcaaccctg

SEQ ID NO: 5425463 - DNA, 16 bp, Homo sapiens
gctgacctcacctggt

SEQ ID NO: 5425464 - DNA, 19 bp, Homo sapiens
gctgacctcacctggtcct

SEQ ID NO: 5425465 - DNA, 18 bp, Homo sapiens
gctgacctcactgtcctg

SEQ ID NO: 5425466 - DNA, 18 bp, Homo sapiens
gctgacctcccagtgacc

SEQ ID NO: 5425467 - DNA, 18 bp, Homo sapiens
gctgacctctgttgtcct

SEQ ID NO: 5425468 - DNA, 19 bp, Homo sapiens
gctgacctctgttgtcctc

SEQ ID NO: 5425469 - DNA, 12 bp, Homo sapiens
gctgacctgctg

SEQ ID NO: 5425470 - DNA, 13 bp, Homo sapiens
gctgacctgctgt

SEQ ID NO: 5425471 - DNA, 14 bp, Homo sapiens
gctgacctgctgtg

SEQ ID NO: 5425472 - DNA, 14 bp, Homo sapiens
gctgacctgttttt

SEQ ID NO: 5425473 - DNA, 18 bp, Homo sapiens
gctgaccttcacccagag

SEQ ID NO: 5425474 - DNA, 20 bp, Homo sapiens
gctgaccttcctcgcagaga

SEQ ID NO: 5425475 - DNA, 23 bp, Homo sapiens
gctgaccttcctcgcagagaggc

SEQ ID NO: 5425476 - DNA, 19 bp, Homo sapiens
gctgacgaacttccatggc

SEQ ID NO: 5425477 - DNA, 14 bp, Homo sapiens
gctgacgaggctgg

SEQ ID NO: 5425478 - DNA, 22 bp, Homo sapiens
gctgacgatggggggctgatgg

SEQ ID NO: 5425479 - DNA, 17 bp, Homo sapiens
gctgacgggaggcccca

SEQ ID NO: 5425480 - DNA, 19 bp, Homo sapiens
gctgacggtttctccccgg

SEQ ID NO: 5425481 - DNA, 22 bp, Homo sapiens
gctgacgtttgacaccagggcc

SEQ ID NO: 5425482 - DNA, 21 bp, Homo sapiens
gctgactactactctgccaat

SEQ ID NO: 5425483 - DNA, 14 bp, Homo sapiens
gctgactcagtgca

SEQ ID NO: 5425484 - DNA, 15 bp, Homo sapiens
gctgactcctggtcc

SEQ ID NO: 5425485 - DNA, 16 bp, Homo sapiens
gctgactcgtggcgcg

SEQ ID NO: 5425486 - DNA, 23 bp, Homo sapiens
gctgactctttttggactcagcc

SEQ ID NO: 5425487 - DNA, 14 bp, Homo sapiens
gctgactgaatgca

SEQ ID NO: 5425488 - DNA, 20 bp, Homo sapiens
gctgactgaggcctgcttcc

SEQ ID NO: 5425489 - DNA, 21 bp, Homo sapiens
gctgactgaggcctgcttccc

SEQ ID NO: 5425490 - DNA, 17 bp, Homo sapiens
gctgactgcaccagcgc

SEQ ID NO: 5425491 - DNA, 22 bp, Homo sapiens
gctgactggccagttgcccaga

SEQ ID NO: 5425492 - DNA, 16 bp, Homo sapiens
gctgactgggggcctc

SEQ ID NO: 5425493 - DNA, 21 bp, Homo sapiens
gctgactgggggcctctgcct

SEQ ID NO: 5425494 - DNA, 21 bp, Homo sapiens
gctgacttagcctcctcccaa

SEQ ID NO: 5425495 - DNA, 19 bp, Homo sapiens
gctgacttcatctcccacc

SEQ ID NO: 5425496 - DNA, 24 bp, Homo sapiens
gctgacttcatctcccacctagca

SEQ ID NO: 5425497 - DNA, 15 bp, Homo sapiens
gctgacttcatctgg

SEQ ID NO: 5425498 - DNA, 16 bp, Homo sapiens
gctgacttcatctggg

SEQ ID NO: 5425499 - DNA, 19 bp, Homo sapiens
gctgacttcccaagccctg

SEQ ID NO: 5425500 - DNA, 14 bp, Homo sapiens
gctgacttggctgg

SEQ ID NO: 5425501 - DNA, 15 bp, Homo sapiens
gctgacttggctggt

SEQ ID NO: 5425502 - DNA, 16 bp, Homo sapiens
gctgacttggctggtg

SEQ ID NO: 5425503 - DNA, 22 bp, Homo sapiens
gctgacttggctggtgtggtac

SEQ ID NO: 5425504 - DNA, 14 bp, Homo sapiens
gctgagaaatgcag

SEQ ID NO: 5425505 - DNA, 13 bp, Homo sapiens
gctgagaacctgg

SEQ ID NO: 5425506 - DNA, 14 bp, Homo sapiens
gctgagaactcctg

SEQ ID NO: 5425507 - DNA, 15 bp, Homo sapiens
gctgagaactcctga

SEQ ID NO: 5425508 - DNA, 16 bp, Homo sapiens
gctgagaactcctgac

SEQ ID NO: 5425509 - DNA, 23 bp, Homo sapiens
gctgagaagaagctgaggatcct

SEQ ID NO: 5425510 - DNA, 14 bp, Homo sapiens
gctgagaagaatga

SEQ ID NO: 5425511 - DNA, 13 bp, Homo sapiens
gctgagaagagga

SEQ ID NO: 5425512 - DNA, 18 bp, Homo sapiens
gctgagaagcttttgaat

SEQ ID NO: 5425513 - DNA, 18 bp, Homo sapiens
gctgagaatagaaggaaa

SEQ ID NO: 5425514 - DNA, 17 bp, Homo sapiens
gctgagaatctgggggt

SEQ ID NO: 5425515 - DNA, 22 bp, Homo sapiens
gctgagacaggagaatcacctg

SEQ ID NO: 5425516 - DNA, 12 bp, Homo sapiens
gctgagacatcc

SEQ ID NO: 5425517 - DNA, 18 bp, Homo sapiens
gctgagacatccctcatc

SEQ ID NO: 5425518 - DNA, 20 bp, Homo sapiens
gctgagacccttatttaaaa

SEQ ID NO: 5425519 - DNA, 9 bp, Homo sapiens
gctgagact

SEQ ID NO: 5425520 - DNA, 14 bp, Homo sapiens
gctgagactacagg

SEQ ID NO: 5425521 - DNA, 17 bp, Homo sapiens
gctgagactacaggtga

SEQ ID NO: 5425522 - DNA, 20 bp, Homo sapiens
gctgagactggatactgccc

SEQ ID NO: 5425523 - DNA, 14 bp, Homo sapiens
gctgagagaacctc

SEQ ID NO: 5425524 - DNA, 15 bp, Homo sapiens
gctgagagacccaag

SEQ ID NO: 5425525 - DNA, 17 bp, Homo sapiens
gctgagagacccaagga

SEQ ID NO: 5425526 - DNA, 20 bp, Homo sapiens
gctgagagacccaaggagga

SEQ ID NO: 5425527 - DNA, 15 bp, Homo sapiens
gctgagagaccctgg

SEQ ID NO: 5425528 - DNA, 16 bp, Homo sapiens
gctgagagacctcagg

SEQ ID NO: 5425529 - DNA, 14 bp, Homo sapiens
gctgagagccagat

SEQ ID NO: 5425530 - DNA, 14 bp, Homo sapiens
gctgagagctgggc

SEQ ID NO: 5425531 - DNA, 18 bp, Homo sapiens
gctgagaggaagatgaag

SEQ ID NO: 5425532 - DNA, 19 bp, Homo sapiens
gctgagaggcaccagtcca

SEQ ID NO: 5425533 - DNA, 22 bp, Homo sapiens
gctgagaggcagacttccctga

SEQ ID NO: 5425534 - DNA, 13 bp, Homo sapiens
gctgagaggggct

SEQ ID NO: 5425535 - DNA, 18 bp, Homo sapiens
gctgagatcgaagaggcc

SEQ ID NO: 5425536 - DNA, 18 bp, Homo sapiens
gctgagatgtttagtagc

SEQ ID NO: 5425537 - DNA, 20 bp, Homo sapiens
gctgagatgtttagtagctg

SEQ ID NO: 5425538 - DNA, 20 bp, Homo sapiens
gctgagattggaaaagggca

SEQ ID NO: 5425539 - DNA, 18 bp, Homo sapiens
gctgagcaacctcttcag

SEQ ID NO: 5425540 - DNA, 17 bp, Homo sapiens
gctgagcaccaggggat

SEQ ID NO: 5425541 - DNA, 21 bp, Homo sapiens
gctgagcacccagctctgtct

SEQ ID NO: 5425542 - DNA, 15 bp, Homo sapiens
gctgagcaggacagc

SEQ ID NO: 5425543 - DNA, 21 bp, Homo sapiens
gctgagcaggaggggggctgg

SEQ ID NO: 5425544 - DNA, 15 bp, Homo sapiens
gctgagcaggcccga

SEQ ID NO: 5425545 - DNA, 13 bp, Homo sapiens
gctgagcagggcc

SEQ ID NO: 5425546 - DNA, 14 bp, Homo sapiens
gctgagcagggccg

SEQ ID NO: 5425547 - DNA, 16 bp, Homo sapiens
gctgagcatggagaca

SEQ ID NO: 5425548 - DNA, 17 bp, Homo sapiens
gctgagcatggagacag

SEQ ID NO: 5425549 - DNA, 18 bp, Homo sapiens
gctgagcatggagacagc

SEQ ID NO: 5425550 - DNA, 15 bp, Homo sapiens
gctgagcatggggcg

SEQ ID NO: 5425551 - DNA, 12 bp, Homo sapiens
gctgagccactc

SEQ ID NO: 5425552 - DNA, 13 bp, Homo sapiens
gctgagccactcg

SEQ ID NO: 5425553 - DNA, 16 bp, Homo sapiens
gctgagccactcgcag

SEQ ID NO: 5425554 - DNA, 16 bp, Homo sapiens
gctgagccagctgcag

SEQ ID NO: 5425555 - DNA, 11 bp, Homo sapiens
gctgagccagg

SEQ ID NO: 5425556 - DNA, 12 bp, Homo sapiens
gctgagccaggc

SEQ ID NO: 5425557 - DNA, 12 bp, Homo sapiens
gctgagccatga

SEQ ID NO: 5425558 - DNA, 18 bp, Homo sapiens
gctgagccatgaggagcg

SEQ ID NO: 5425559 - DNA, 20 bp, Homo sapiens
gctgagccatgggggtttgg

SEQ ID NO: 5425560 - DNA, 19 bp, Homo sapiens
gctgagccattgagtgctg

SEQ ID NO: 5425561 - DNA, 19 bp, Homo sapiens
gctgagcccagccacctcc

SEQ ID NO: 5425562 - DNA, 22 bp, Homo sapiens
gctgagccccccatgcccctcc

SEQ ID NO: 5425563 - DNA, 23 bp, Homo sapiens
gctgagccccccatgcccctccc

SEQ ID NO: 5425564 - DNA, 15 bp, Homo sapiens
gctgagccccctctc

SEQ ID NO: 5425565 - DNA, 19 bp, Homo sapiens
gctgagcccctccctcctg

SEQ ID NO: 5425566 - DNA, 21 bp, Homo sapiens
gctgagcccctccctcctgtg

SEQ ID NO: 5425567 - DNA, 14 bp, Homo sapiens
gctgagcccctcct

SEQ ID NO: 5425568 - DNA, 15 bp, Homo sapiens
gctgagcccctcctc

SEQ ID NO: 5425569 - DNA, 19 bp, Homo sapiens
gctgagcccctcctctcct

SEQ ID NO: 5425570 - DNA, 12 bp, Homo sapiens
gctgagcccctg

SEQ ID NO: 5425571 - DNA, 15 bp, Homo sapiens
gctgagcccctgggg

SEQ ID NO: 5425572 - DNA, 22 bp, Homo sapiens
gctgagcccctggtcttctcta

SEQ ID NO: 5425573 - DNA, 21 bp, Homo sapiens
gctgagcccggaaactccaca

SEQ ID NO: 5425574 - DNA, 12 bp, Homo sapiens
gctgagccctgc

SEQ ID NO: 5425575 - DNA, 14 bp, Homo sapiens
gctgagccctggca

SEQ ID NO: 5425576 - DNA, 13 bp, Homo sapiens
gctgagccctgta

SEQ ID NO: 5425577 - DNA, 22 bp, Homo sapiens
gctgagcctactgtctccttcc

SEQ ID NO: 5425578 - DNA, 16 bp, Homo sapiens
gctgagcctcagtctc

SEQ ID NO: 5425579 - DNA, 19 bp, Homo sapiens
gctgagcctctgctcccca

SEQ ID NO: 5425580 - DNA, 14 bp, Homo sapiens
gctgagcctgaggc

SEQ ID NO: 5425581 - DNA, 12 bp, Homo sapiens
gctgagcctgca

SEQ ID NO: 5425582 - DNA, 20 bp, Homo sapiens
gctgagcctgcagggaagcc

SEQ ID NO: 5425583 - DNA, 16 bp, Homo sapiens
gctgagccttcagagt

SEQ ID NO: 5425584 - DNA, 17 bp, Homo sapiens
gctgagccttcagagta

SEQ ID NO: 5425585 - DNA, 14 bp, Homo sapiens
gctgagcgccagga

SEQ ID NO: 5425586 - DNA, 21 bp, Homo sapiens
gctgagcgcccccgagccctg

SEQ ID NO: 5425587 - DNA, 21 bp, Homo sapiens
gctgagcgtggaagggggagg

SEQ ID NO: 5425588 - DNA, 15 bp, Homo sapiens
gctgagctacctggg

SEQ ID NO: 5425589 - DNA, 20 bp, Homo sapiens
gctgagctcacaaggcagca

SEQ ID NO: 5425590 - DNA, 15 bp, Homo sapiens
gctgagctccagcca

SEQ ID NO: 5425591 - DNA, 18 bp, Homo sapiens
gctgagctctgacctgcc

SEQ ID NO: 5425592 - DNA, 15 bp, Homo sapiens
gctgagctctgagag

SEQ ID NO: 5425593 - DNA, 16 bp, Homo sapiens
gctgagctctgagagg

SEQ ID NO: 5425594 - DNA, 23 bp, Homo sapiens
gctgagctctgagaggccctgga

SEQ ID NO: 5425595 - DNA, 17 bp, Homo sapiens
gctgcaggggcctctgt

SEQ ID NO: 5425596 - DNA, 12 bp, Homo sapiens
gctgcaggggct

SEQ ID NO: 5425597 - DNA, 13 bp, Homo sapiens
gctgcaggggctc

SEQ ID NO: 5425598 - DNA, 20 bp, Homo sapiens
gctgcaggggctctggagag

SEQ ID NO: 5425599 - DNA, 21 bp, Homo sapiens
gctgcaggggctctggagaga

SEQ ID NO: 5425600 - DNA, 12 bp, Homo sapiens
gctgcagggtgg

SEQ ID NO: 5425601 - DNA, 21 bp, Homo sapiens
gctgcaggtacttcctcctga

SEQ ID NO: 5425602 - DNA, 13 bp, Homo sapiens
gctgcaggtgccc

SEQ ID NO: 5425603 - DNA, 18 bp, Homo sapiens
gctgcagtatgaaaataa

SEQ ID NO: 5425604 - DNA, 21 bp, Homo sapiens
gctgcagtatggccagacgtg

SEQ ID NO: 5425605 - DNA, 19 bp, Homo sapiens
gctgcagtcaacagttcaa

SEQ ID NO: 5425606 - DNA, 22 bp, Homo sapiens
gctgcagtcaacagttcaaaga

SEQ ID NO: 5425607 - DNA, 23 bp, Homo sapiens
gctgcagtcaacagttcaaagaa

SEQ ID NO: 5425608 - DNA, 17 bp, Homo sapiens
gctgcagtcacatcaca

SEQ ID NO: 5425609 - DNA, 22 bp, Homo sapiens
gctgcagtcacgtgtaaacagg

SEQ ID NO: 5425610 - DNA, 20 bp, Homo sapiens
gctgcagtcagcacagagag

SEQ ID NO: 5425611 - DNA, 21 bp, Homo sapiens
gctgcagtcttctctctggct

SEQ ID NO: 5425612 - DNA, 20 bp, Homo sapiens
gctgcagtgacgtgcacctg

SEQ ID NO: 5425613 - DNA, 15 bp, Homo sapiens
gctgcagtgagccat

SEQ ID NO: 5425614 - DNA, 15 bp, Homo sapiens
gctgcagtggctccc

SEQ ID NO: 5425615 - DNA, 20 bp, Homo sapiens
gctgcagttaccacagcaac

SEQ ID NO: 5425616 - DNA, 18 bp, Homo sapiens
gctgcagttagcacagag

SEQ ID NO: 5425617 - DNA, 22 bp, Homo sapiens
gctgcagttctactcaggctgg

SEQ ID NO: 5425618 - DNA, 19 bp, Homo sapiens
gctgcagttggtctccctg

SEQ ID NO: 5425619 - DNA, 18 bp, Homo sapiens
gctgcataaatttgtaat

SEQ ID NO: 5425620 - DNA, 15 bp, Homo sapiens
gctgcatacagggga

SEQ ID NO: 5425621 - DNA, 17 bp, Homo sapiens
gctgcatatgagtcttt

SEQ ID NO: 5425622 - DNA, 18 bp, Homo sapiens
gctgcatcaaatgcatgc

SEQ ID NO: 5425623 - DNA, 16 bp, Homo sapiens
gctgcatccccttcca

SEQ ID NO: 5425624 - DNA, 17 bp, Homo sapiens
gctgcatccccttccag

SEQ ID NO: 5425625 - DNA, 23 bp, Homo sapiens
gctgcatcccgagcaaccctctg

SEQ ID NO: 5425626 - DNA, 12 bp, Homo sapiens
gctgcatcctca

SEQ ID NO: 5425627 - DNA, 16 bp, Homo sapiens
gctgcatcctcagccc

SEQ ID NO: 5425628 - DNA, 18 bp, Homo sapiens
gctgcatcctcagcccca

SEQ ID NO: 5425629 - DNA, 20 bp, Homo sapiens
gctgcatcctcagccccagg

SEQ ID NO: 5425630 - DNA, 21 bp, Homo sapiens
gctgcatcctcagccccaggg

SEQ ID NO: 5425631 - DNA, 22 bp, Homo sapiens
gctgcatcctccaagaatctat

SEQ ID NO: 5425632 - DNA, 22 bp, Homo sapiens
gctgcatctataatgtcagctt

SEQ ID NO: 5425633 - DNA, 14 bp, Homo sapiens
gctgcatctgataa

SEQ ID NO: 5425634 - DNA, 22 bp, Homo sapiens
gctgcatctgggattcccacca

SEQ ID NO: 5425635 - DNA, 13 bp, Homo sapiens
gctgcatcttata

SEQ ID NO: 5425636 - DNA, 21 bp, Homo sapiens
gctgcatgaaaaacattccac

SEQ ID NO: 5425637 - DNA, 13 bp, Homo sapiens
gctgcatgatgtt

SEQ ID NO: 5425638 - DNA, 15 bp, Homo sapiens
gctgcatgccctctc

SEQ ID NO: 5425639 - DNA, 14 bp, Homo sapiens
gctgcatgcctggt

SEQ ID NO: 5425640 - DNA, 17 bp, Homo sapiens
gctgcatggacgcctgg

SEQ ID NO: 5425641 - DNA, 19 bp, Homo sapiens
gctgcatggacgcctggct

SEQ ID NO: 5425642 - DNA, 21 bp, Homo sapiens
gctgcatggacgcctggctcc

SEQ ID NO: 5425643 - DNA, 23 bp, Homo sapiens
gctgcatggacgcctggctccag

SEQ ID NO: 5425644 - DNA, 16 bp, Homo sapiens
gctgcatggagcctgg

SEQ ID NO: 5425645 - DNA, 14 bp, Homo sapiens
gctgcatggcacat

SEQ ID NO: 5425646 - DNA, 23 bp, Homo sapiens
gctgcattaccagcttaaaacac

SEQ ID NO: 5425647 - DNA, 20 bp, Homo sapiens
gctgcattgaaaagagctga

SEQ ID NO: 5425648 - DNA, 17 bp, Homo sapiens
gctgcatttaaaagata

SEQ ID NO: 5425649 - DNA, 19 bp, Homo sapiens
gctgcatttggctggagcc

SEQ ID NO: 5425650 - DNA, 18 bp, Homo sapiens
gctgcattttaagcataa

SEQ ID NO: 5425651 - DNA, 12 bp, Homo sapiens
gctgccaaaacc

SEQ ID NO: 5425652 - DNA, 16 bp, Homo sapiens
gctgccaaaaccacat

SEQ ID NO: 5425653 - DNA, 13 bp, Homo sapiens
gctgccaaatgcg

SEQ ID NO: 5425654 - DNA, 15 bp, Homo sapiens
gctgccaaattttgg

SEQ ID NO: 5425655 - DNA, 17 bp, Homo sapiens
gctgccaaattttggcc

SEQ ID NO: 5425656 - DNA, 15 bp, Homo sapiens
gctgccaaggccaga

SEQ ID NO: 5425657 - DNA, 19 bp, Homo sapiens
gctgccaaggtggagggaa

SEQ ID NO: 5425658 - DNA, 19 bp, Homo sapiens
gctgccaatatcctaataa

SEQ ID NO: 5425659 - DNA, 20 bp, Homo sapiens
gctgccaatgggagctcatg

SEQ ID NO: 5425660 - DNA, 18 bp, Homo sapiens
gctgccacacggaagcaa

SEQ ID NO: 5425661 - DNA, 15 bp, Homo sapiens
gctgccacacttcag

SEQ ID NO: 5425662 - DNA, 17 bp, Homo sapiens
gctgccacacttcaggc

SEQ ID NO: 5425663 - DNA, 21 bp, Homo sapiens
gctgccacacttcaggctctt

SEQ ID NO: 5425664 - DNA, 22 bp, Homo sapiens
gctgccacagcaaggaaatgtc

SEQ ID NO: 5425665 - DNA, 20 bp, Homo sapiens
gctgccaccaaatctgtcta

SEQ ID NO: 5425666 - DNA, 15 bp, Homo sapiens
gctgccaccacgtct

SEQ ID NO: 5425667 - DNA, 15 bp, Homo sapiens
gctgccaccagcccc

SEQ ID NO: 5425668 - DNA, 12 bp, Homo sapiens
gctgccacccct

SEQ ID NO: 5425669 - DNA, 20 bp, Homo sapiens
gctgccaccccttggcactg

SEQ ID NO: 5425670 - DNA, 13 bp, Homo sapiens
gctgccacccgcc

SEQ ID NO: 5425671 - DNA, 15 bp, Homo sapiens
gctgccactctgctg

SEQ ID NO: 5425672 - DNA, 14 bp, Homo sapiens
gctgccactgggca

SEQ ID NO: 5425673 - DNA, 16 bp, Homo sapiens
gctgccagaatcaggt

SEQ ID NO: 5425674 - DNA, 18 bp, Homo sapiens
gctgccagacatggacct

SEQ ID NO: 5425675 - DNA, 13 bp, Homo sapiens
gctgccagagaac

SEQ ID NO: 5425676 - DNA, 17 bp, Homo sapiens
gctgccagagaagtctg

SEQ ID NO: 5425677 - DNA, 10 bp, Homo sapiens
gctgccagca

SEQ ID NO: 5425678 - DNA, 18 bp, Homo sapiens
gctgccagcacagagcgt

SEQ ID NO: 5425679 - DNA, 16 bp, Homo sapiens
gctgccagcacagtag

SEQ ID NO: 5425680 - DNA, 13 bp, Homo sapiens
gctgccagcagcc

SEQ ID NO: 5425681 - DNA, 18 bp, Homo sapiens
gctgccagcagccccgtc

SEQ ID NO: 5425682 - DNA, 13 bp, Homo sapiens
gctgccagcccag

SEQ ID NO: 5425683 - DNA, 15 bp, Homo sapiens
gctgccagcccagaa

SEQ ID NO: 5425684 - DNA, 19 bp, Homo sapiens
gctgccagccgagatagcc

SEQ ID NO: 5425685 - DNA, 15 bp, Homo sapiens
gctgccagcctgagc

SEQ ID NO: 5425686 - DNA, 21 bp, Homo sapiens
gctgccagcctgagcggaggc

SEQ ID NO: 5425687 - DNA, 19 bp, Homo sapiens
gctgccagcctgaggtgcc

SEQ ID NO: 5425688 - DNA, 22 bp, Homo sapiens
gctgccagcctgaggtgcccac

SEQ ID NO: 5425689 - DNA, 14 bp, Homo sapiens
gctgccagccttcc

SEQ ID NO: 5425690 - DNA, 16 bp, Homo sapiens
gctgccagccttgagc

SEQ ID NO: 5425691 - DNA, 20 bp, Homo sapiens
gctgccagcgtctgttgtgg

SEQ ID NO: 5425692 - DNA, 19 bp, Homo sapiens
gctgccagctctcaggacc

SEQ ID NO: 5425693 - DNA, 18 bp, Homo sapiens
gctgccagctctgtatca

SEQ ID NO: 5425694 - DNA, 19 bp, Homo sapiens
gctgccagcttcaggtgac

SEQ ID NO: 5425695 - DNA, 10 bp, Homo sapiens
gctgccagga

SEQ ID NO: 5425696 - DNA, 13 bp, Homo sapiens
gctgccaggaaac

SEQ ID NO: 5425697 - DNA, 14 bp, Homo sapiens
gctgccaggacacc

SEQ ID NO: 5425698 - DNA, 16 bp, Homo sapiens
gctgccaggacacctg

SEQ ID NO: 5425699 - DNA, 13 bp, Homo sapiens
gctgccaggcccg

SEQ ID NO: 5425700 - DNA, 17 bp, Homo sapiens
gctgccaggcccggcat

SEQ ID NO: 5425701 - DNA, 18 bp, Homo sapiens
gctgccaggcggccctgg

SEQ ID NO: 5425702 - DNA, 15 bp, Homo sapiens
gctgccaggctccca

SEQ ID NO: 5425703 - DNA, 18 bp, Homo sapiens
gctgccaggctcccactg

SEQ ID NO: 5425704 - DNA, 14 bp, Homo sapiens
gctgccagggaaga

SEQ ID NO: 5425705 - DNA, 17 bp, Homo sapiens
gctgccagggaagacag

SEQ ID NO: 5425706 - DNA, 20 bp, Homo sapiens
gctgccagggaagacagagc

SEQ ID NO: 5425707 - DNA, 21 bp, Homo sapiens
gctgccagggaagacagagca

SEQ ID NO: 5425708 - DNA, 13 bp, Homo sapiens
gctgccagggctt

SEQ ID NO: 5425709 - DNA, 17 bp, Homo sapiens
gctgccaggggctctgt

SEQ ID NO: 5425710 - DNA, 16 bp, Homo sapiens
gctgccaggggctgcg

SEQ ID NO: 5425711 - DNA, 17 bp, Homo sapiens
gctgccagggggcaagg

SEQ ID NO: 5425712 - DNA, 10 bp, Homo sapiens
gctgccagta

SEQ ID NO: 5425713 - DNA, 15 bp, Homo sapiens
gctgccagtaccagc

SEQ ID NO: 5425714 - DNA, 22 bp, Homo sapiens
gctgccagtgcagccactggct

SEQ ID NO: 5425715 - DNA, 13 bp, Homo sapiens
gctgccagtgcct

SEQ ID NO: 5425716 - DNA, 16 bp, Homo sapiens
gctgccataattctaa

SEQ ID NO: 5425717 - DNA, 17 bp, Homo sapiens
gctgccataattctaag

SEQ ID NO: 5425718 - DNA, 20 bp, Homo sapiens
gctgccatagggtctgcagc

SEQ ID NO: 5425719 - DNA, 19 bp, Homo sapiens
gctgccatcaccgctgggt

SEQ ID NO: 5425720 - DNA, 21 bp, Homo sapiens
gctgccatcaccgctgggtgg

SEQ ID NO: 5425721 - DNA, 23 bp, Homo sapiens
gctgccatccaggttcagcttgt

SEQ ID NO: 5425722 - DNA, 20 bp, Homo sapiens
gctgccatccttgctgcagc

SEQ ID NO: 5425723 - DNA, 21 bp, Homo sapiens
gctgccatccttgctgcagct

SEQ ID NO: 5425724 - DNA, 15 bp, Homo sapiens
gctgccatcttgctt

SEQ ID NO: 5425725 - DNA, 19 bp, Homo sapiens
gctgccatgacagaggctg

SEQ ID NO: 5425726 - DNA, 14 bp, Homo sapiens
gctgccatgccact

SEQ ID NO: 5425727 - DNA, 17 bp, Homo sapiens
gctgccatgccactgcc

SEQ ID NO: 5425728 - DNA, 19 bp, Homo sapiens
gctgccatgccactgccag

SEQ ID NO: 5425729 - DNA, 16 bp, Homo sapiens
gctgccatttccctga

SEQ ID NO: 5425730 - DNA, 16 bp, Homo sapiens
gctgcccaatctccat

SEQ ID NO: 5425731 - DNA, 17 bp, Homo sapiens
gctgcccaatctccatc

SEQ ID NO: 5425732 - DNA, 13 bp, Homo sapiens
gctgcccacacca

SEQ ID NO: 5425733 - DNA, 17 bp, Homo sapiens
gctgcccaccccctgct

SEQ ID NO: 5425734 - DNA, 19 bp, Homo sapiens
gctgcccaccccctgctgg

SEQ ID NO: 5425735 - DNA, 20 bp, Homo sapiens
gctgcccaccccctgctggt

SEQ ID NO: 5425736 - DNA, 23 bp, Homo sapiens
gctgcccaccccctgctggtgcc

SEQ ID NO: 5425737 - DNA, 20 bp, Homo sapiens
gctgcccacgctcctgccct

SEQ ID NO: 5425738 - DNA, 17 bp, Homo sapiens
gctgcccacggccaccc

SEQ ID NO: 5425739 - DNA, 18 bp, Homo sapiens
gctgcccacggccaccca

SEQ ID NO: 5425740 - DNA, 19 bp, Homo sapiens
gctgcccacgtcccgggca

SEQ ID NO: 5425741 - DNA, 15 bp, Homo sapiens
gctgcccactctggg

SEQ ID NO: 5425742 - DNA, 22 bp, Homo sapiens
gctgcccactgtttctcttgag

SEQ ID NO: 5425743 - DNA, 21 bp, Homo sapiens
gctgcccagacacagactggc

SEQ ID NO: 5425744 - DNA, 18 bp, Homo sapiens
gctgcccagacacatggg

SEQ ID NO: 5425745 - DNA, 12 bp, Homo sapiens
gctgcccagagc

SEQ ID NO: 5425746 - DNA, 14 bp, Homo sapiens
gctgcccagagctg

SEQ ID NO: 5425747 - DNA, 12 bp, Homo sapiens
gctgcccagccc

SEQ ID NO: 5425748 - DNA, 15 bp, Homo sapiens
gctgcccagcccctc

SEQ ID NO: 5425749 - DNA, 21 bp, Homo sapiens
gctgcccagcccctcctccct

SEQ ID NO: 5425750 - DNA, 18 bp, Homo sapiens
gctgcccagccctcccag

SEQ ID NO: 5425751 - DNA, 16 bp, Homo sapiens
gctgcccagccctggc

SEQ ID NO: 5425752 - DNA, 17 bp, Homo sapiens
gctgcccagccctggcc

SEQ ID NO: 5425753 - DNA, 16 bp, Homo sapiens
gctgcccagcggctct

SEQ ID NO: 5425754 - DNA, 20 bp, Homo sapiens
gctgcccagcggctcttcct

SEQ ID NO: 5425755 - DNA, 12 bp, Homo sapiens
gctgcccaggag

SEQ ID NO: 5425756 - DNA, 13 bp, Homo sapiens
gctgcccaggaga

SEQ ID NO: 5425757 - DNA, 15 bp, Homo sapiens
gctgcccaggccaca

SEQ ID NO: 5425758 - DNA, 16 bp, Homo sapiens
gctgcccaggccacag

SEQ ID NO: 5425759 - DNA, 17 bp, Homo sapiens
gctgcccaggccacagc

SEQ ID NO: 5425760 - DNA, 13 bp, Homo sapiens
gctgcccaggctc

SEQ ID NO: 5425761 - DNA, 16 bp, Homo sapiens
gctgcccaggctctgc

SEQ ID NO: 5425762 - DNA, 20 bp, Homo sapiens
gctgcccaggctctgctgac

SEQ ID NO: 5425763 - DNA, 19 bp, Homo sapiens
gctgcccaggggcttcaga

SEQ ID NO: 5425764 - DNA, 13 bp, Homo sapiens
gctgcccatccca

SEQ ID NO: 5425765 - DNA, 14 bp, Homo sapiens
gctgcccatcccag

SEQ ID NO: 5425766 - DNA, 16 bp, Homo sapiens
gctgcccatcccagtc

SEQ ID NO: 5425767 - DNA, 21 bp, Homo sapiens
gctgcccatttcgtgagcccc

SEQ ID NO: 5425768 - DNA, 14 bp, Homo sapiens
gctgccccaacctg

SEQ ID NO: 5425769 - DNA, 16 bp, Homo sapiens
gctgccccaacctgct

SEQ ID NO: 5425770 - DNA, 15 bp, Homo sapiens
gctgccccacctgcc

SEQ ID NO: 5425771 - DNA, 22 bp, Homo sapiens
gctgccccagctgactgtggcc

SEQ ID NO: 5425772 - DNA, 12 bp, Homo sapiens
gctgccccaggc

SEQ ID NO: 5425773 - DNA, 14 bp, Homo sapiens
gctgccccaggccg

SEQ ID NO: 5425774 - DNA, 22 bp, Homo sapiens
gctgcttgagtggacagcagct

SEQ ID NO: 5425775 - DNA, 14 bp, Homo sapiens
gctgcttgcagcca

SEQ ID NO: 5425776 - DNA, 15 bp, Homo sapiens
gctgcttgcagccag

SEQ ID NO: 5425777 - DNA, 17 bp, Homo sapiens
gctgcttgcagccagga

SEQ ID NO: 5425778 - DNA, 19 bp, Homo sapiens
gctgcttgcccaagtcaca

SEQ ID NO: 5425779 - DNA, 22 bp, Homo sapiens
gctgcttgcccccatgctggcg

SEQ ID NO: 5425780 - DNA, 18 bp, Homo sapiens
gctgcttggagtgcccca

SEQ ID NO: 5425781 - DNA, 19 bp, Homo sapiens
gctgcttggagtgccccaa

SEQ ID NO: 5425782 - DNA, 23 bp, Homo sapiens
gctgcttggatgcgagcttggcc

SEQ ID NO: 5425783 - DNA, 13 bp, Homo sapiens
gctgcttggcctt

SEQ ID NO: 5425784 - DNA, 18 bp, Homo sapiens
gctgcttggtagcacttt

SEQ ID NO: 5425785 - DNA, 22 bp, Homo sapiens
gctgcttggtagcactttaaaa

SEQ ID NO: 5425786 - DNA, 18 bp, Homo sapiens
gctgcttgtcctgctctc

SEQ ID NO: 5425787 - DNA, 16 bp, Homo sapiens
gctgcttgtgcctccc

SEQ ID NO: 5425788 - DNA, 21 bp, Homo sapiens
gctgcttgtgcctcccttccc

SEQ ID NO: 5425789 - DNA, 22 bp, Homo sapiens
gctgcttgtgtccctcctggga

SEQ ID NO: 5425790 - DNA, 22 bp, Homo sapiens
gctgctttaacagtggagctga

SEQ ID NO: 5425791 - DNA, 23 bp, Homo sapiens
gctgctttaattgtgaattgata

SEQ ID NO: 5425792 - DNA, 13 bp, Homo sapiens
gctgctttccaac

SEQ ID NO: 5425793 - DNA, 19 bp, Homo sapiens
gctgctttccaacacacaa

SEQ ID NO: 5425794 - DNA, 18 bp, Homo sapiens
gctgctttcccctgtggg

SEQ ID NO: 5425795 - DNA, 19 bp, Homo sapiens
gctgctttctgttgtcatt

SEQ ID NO: 5425796 - DNA, 14 bp, Homo sapiens
gctgctttgacaag

SEQ ID NO: 5425797 - DNA, 13 bp, Homo sapiens
gctgctttgcttc

SEQ ID NO: 5425798 - DNA, 14 bp, Homo sapiens
gctgctttgcttct

SEQ ID NO: 5425799 - DNA, 16 bp, Homo sapiens
gctgctttggctgact

SEQ ID NO: 5425800 - DNA, 19 bp, Homo sapiens
gctgctttggctgactggg

SEQ ID NO: 5425801 - DNA, 15 bp, Homo sapiens
gctgctttgtgggct

SEQ ID NO: 5425802 - DNA, 20 bp, Homo sapiens
gctgctttgttgttctgcct

SEQ ID NO: 5425803 - DNA, 21 bp, Homo sapiens
gctgctttgttgttctgcctg

SEQ ID NO: 5425804 - DNA, 18 bp, Homo sapiens
gctgcttttatatctgta

SEQ ID NO: 5425805 - DNA, 12 bp, Homo sapiens
gctgcttttcct

SEQ ID NO: 5425806 - DNA, 12 bp, Homo sapiens
gctgcttttctt

SEQ ID NO: 5425807 - DNA, 16 bp, Homo sapiens
gctgcttttgagcctc

SEQ ID NO: 5425808 - DNA, 22 bp, Homo sapiens
gctgctttttttgaaactttga

SEQ ID NO: 5425809 - DNA, 11 bp, Homo sapiens
gctggaaaact

SEQ ID NO: 5425810 - DNA, 18 bp, Homo sapiens
gctggaaaactgccacaa

SEQ ID NO: 5425811 - DNA, 22 bp, Homo sapiens
gctggaaaagggtcttgggaaa

SEQ ID NO: 5425812 - DNA, 17 bp, Homo sapiens
gctggaaaataatactg

SEQ ID NO: 5425813 - DNA, 22 bp, Homo sapiens
gctggaaaataatactgctgag

SEQ ID NO: 5425814 - DNA, 22 bp, Homo sapiens
gctggaaaatcatattgagaat

SEQ ID NO: 5425815 - DNA, 17 bp, Homo sapiens
gctggaaacacagtcac

SEQ ID NO: 5425816 - DNA, 22 bp, Homo sapiens
gctggaaaccaagtcaggccag

SEQ ID NO: 5425817 - DNA, 17 bp, Homo sapiens
gctggaaagaggagaag

SEQ ID NO: 5425818 - DNA, 20 bp, Homo sapiens
gctggaaagcagagcctcct

SEQ ID NO: 5425819 - DNA, 18 bp, Homo sapiens
gctggaaaggccagcagc

SEQ ID NO: 5425820 - DNA, 14 bp, Homo sapiens
gctggaacccagga

SEQ ID NO: 5425821 - DNA, 20 bp, Homo sapiens
gctggaacccaggaggtgga

SEQ ID NO: 5425822 - DNA, 14 bp, Homo sapiens
gctggaactcttga

SEQ ID NO: 5425823 - DNA, 21 bp, Homo sapiens
gctggaactcttgacagctat

SEQ ID NO: 5425824 - DNA, 14 bp, Homo sapiens
gctggaagaacatc

SEQ ID NO: 5425825 - DNA, 17 bp, Homo sapiens
gctggaagaaccactgt

SEQ ID NO: 5425826 - DNA, 23 bp, Homo sapiens
gctggaagaagtgagcagtgttg

SEQ ID NO: 5425827 - DNA, 21 bp, Homo sapiens
gctggaagacgcaagggcctg

SEQ ID NO: 5425828 - DNA, 23 bp, Homo sapiens
gctggaagacgcaagggcctgat

SEQ ID NO: 5425829 - DNA, 12 bp, Homo sapiens
gctggaagagcc

SEQ ID NO: 5425830 - DNA, 14 bp, Homo sapiens
gctggaagagggtg

SEQ ID NO: 5425831 - DNA, 21 bp, Homo sapiens
gctggaagaggtgggtggtgg

SEQ ID NO: 5425832 - DNA, 15 bp, Homo sapiens
gctggaagatcctgc

SEQ ID NO: 5425833 - DNA, 18 bp, Homo sapiens
gctggaagatcctgcggg

SEQ ID NO: 5425834 - DNA, 13 bp, Homo sapiens
gctggaagctgtc

SEQ ID NO: 5425835 - DNA, 20 bp, Homo sapiens
gctggaaggaaagcaaggca

SEQ ID NO: 5425836 - DNA, 15 bp, Homo sapiens
gctggaaggagccag

SEQ ID NO: 5425837 - DNA, 23 bp, Homo sapiens
gctggaaggcagggcagagggaa

SEQ ID NO: 5425838 - DNA, 20 bp, Homo sapiens
gctggaagggaggaaggcct

SEQ ID NO: 5425839 - DNA, 19 bp, Homo sapiens
gctggaaggggcagcagga

SEQ ID NO: 5425840 - DNA, 13 bp, Homo sapiens
gctggaagggtca

SEQ ID NO: 5425841 - DNA, 18 bp, Homo sapiens
gctggaagtctacctgct

SEQ ID NO: 5425842 - DNA, 20 bp, Homo sapiens
gctggaagtctacctgctgg

SEQ ID NO: 5425843 - DNA, 21 bp, Homo sapiens
gctggaagtctacctgctgga

SEQ ID NO: 5425844 - DNA, 20 bp, Homo sapiens
gctggaagtctccatgaaga

SEQ ID NO: 5425845 - DNA, 17 bp, Homo sapiens
gctggaagtggctctgg

SEQ ID NO: 5425846 - DNA, 14 bp, Homo sapiens
gctggaatattaaa

SEQ ID NO: 5425847 - DNA, 19 bp, Homo sapiens
gctggaatcaatttcccag

SEQ ID NO: 5425848 - DNA, 18 bp, Homo sapiens
gctggaatccagaaggaa

SEQ ID NO: 5425849 - DNA, 19 bp, Homo sapiens
gctggaatctggagagcta

SEQ ID NO: 5425850 - DNA, 14 bp, Homo sapiens
gctggaatgaggga

SEQ ID NO: 5425851 - DNA, 14 bp, Homo sapiens
gctggaatgctggg

SEQ ID NO: 5425852 - DNA, 18 bp, Homo sapiens
gctggaatgggagacctg

SEQ ID NO: 5425853 - DNA, 19 bp, Homo sapiens
gctggaatggggacctggg

SEQ ID NO: 5425854 - DNA, 20 bp, Homo sapiens
gctggaatgggggccaggct

SEQ ID NO: 5425855 - DNA, 14 bp, Homo sapiens
gctggaatgtgcca

SEQ ID NO: 5425856 - DNA, 22 bp, Homo sapiens
gctggaattccacagggaccag

SEQ ID NO: 5425857 - DNA, 18 bp, Homo sapiens
gctggaattttttattct

SEQ ID NO: 5425858 - DNA, 19 bp, Homo sapiens
gctggacaaactgcaccag

SEQ ID NO: 5425859 - DNA, 15 bp, Homo sapiens
gctggacaacccaga

SEQ ID NO: 5425860 - DNA, 19 bp, Homo sapiens
gctggacaagaagctgcta

SEQ ID NO: 5425861 - DNA, 18 bp, Homo sapiens
gctggacaccctctgccg

SEQ ID NO: 5425862 - DNA, 13 bp, Homo sapiens
gctggacagaggg

SEQ ID NO: 5425863 - DNA, 17 bp, Homo sapiens
gctggacagaggggcag

SEQ ID NO: 5425864 - DNA, 16 bp, Homo sapiens
gctggacagcctccgc

SEQ ID NO: 5425865 - DNA, 13 bp, Homo sapiens
gctggacagcggc

SEQ ID NO: 5425866 - DNA, 18 bp, Homo sapiens
gctggacatactgctgga

SEQ ID NO: 5425867 - DNA, 23 bp, Homo sapiens
gctggacatgagatggagaggct

SEQ ID NO: 5425868 - DNA, 14 bp, Homo sapiens
gctggaccaactgc

SEQ ID NO: 5425869 - DNA, 21 bp, Homo sapiens
gctggaccacgtctccctggc

SEQ ID NO: 5425870 - DNA, 12 bp, Homo sapiens
gctggacccagc

SEQ ID NO: 5425871 - DNA, 15 bp, Homo sapiens
gctggaccctgacca

SEQ ID NO: 5425872 - DNA, 21 bp, Homo sapiens
gctggaccctgaccagctccc

SEQ ID NO: 5425873 - DNA, 22 bp, Homo sapiens
gctggaccctgaccagctcccc

SEQ ID NO: 5425874 - DNA, 13 bp, Homo sapiens
gctggaccctgct

SEQ ID NO: 5425875 - DNA, 18 bp, Homo sapiens
gctggaccctgcttcacc

SEQ ID NO: 5425876 - DNA, 21 bp, Homo sapiens
gctggaccctgcttcaccctc

SEQ ID NO: 5425877 - DNA, 13 bp, Homo sapiens
gctggacctgcac

SEQ ID NO: 5425878 - DNA, 21 bp, Homo sapiens
gctggaccttgaactgggtac

SEQ ID NO: 5425879 - DNA, 19 bp, Homo sapiens
gctggacggggactgggga

SEQ ID NO: 5425880 - DNA, 18 bp, Homo sapiens
gctggacgtctttctttt

SEQ ID NO: 5425881 - DNA, 14 bp, Homo sapiens
gctggactacccac

SEQ ID NO: 5425882 - DNA, 15 bp, Homo sapiens
gctggactattgtgc

SEQ ID NO: 5425883 - DNA, 20 bp, Homo sapiens
gctggactccagatctgcac

SEQ ID NO: 5425884 - DNA, 21 bp, Homo sapiens
gctggactctcagtctctgag

SEQ ID NO: 5425885 - DNA, 16 bp, Homo sapiens
gctggactctgcatcc

SEQ ID NO: 5425886 - DNA, 16 bp, Homo sapiens
gctggactctggcacc

SEQ ID NO: 5425887 - DNA, 14 bp, Homo sapiens
gctggactgaccaa

SEQ ID NO: 5425888 - DNA, 23 bp, Homo sapiens
gctggactgaccaaagactgcag

SEQ ID NO: 5425889 - DNA, 14 bp, Homo sapiens
gctggactgaggac

SEQ ID NO: 5425890 - DNA, 13 bp, Homo sapiens
gctggactgaggc

SEQ ID NO: 5425891 - DNA, 14 bp, Homo sapiens
gctggactgaggcc

SEQ ID NO: 5425892 - DNA, 16 bp, Homo sapiens
gctggactgaggcctg

SEQ ID NO: 5425893 - DNA, 20 bp, Homo sapiens
gctggactgatggttgcttt

SEQ ID NO: 5425894 - DNA, 24 bp, Homo sapiens
gctggactgatggttgctttgagc

SEQ ID NO: 5425895 - DNA, 14 bp, Homo sapiens
gctggactggaggc

SEQ ID NO: 5425896 - DNA, 23 bp, Homo sapiens
gctggactggaggcccctggagc

SEQ ID NO: 5425897 - DNA, 19 bp, Homo sapiens
gctggactggaggctgggt

SEQ ID NO: 5425898 - DNA, 22 bp, Homo sapiens
gctggactggaggtgggcatgc

SEQ ID NO: 5425899 - DNA, 13 bp, Homo sapiens
gctggactggcca

SEQ ID NO: 5425900 - DNA, 14 bp, Homo sapiens
gctggactggccat

SEQ ID NO: 5425901 - DNA, 14 bp, Homo sapiens
gctggactgggtgg

SEQ ID NO: 5425902 - DNA, 20 bp, Homo sapiens
gctggactgggtgggcccca

SEQ ID NO: 5425903 - DNA, 23 bp, Homo sapiens
gctggactgggtgggccccacag

SEQ ID NO: 5425904 - DNA, 18 bp, Homo sapiens
gctggactgtagaaggtg

SEQ ID NO: 5425905 - DNA, 20 bp, Homo sapiens
gctggacttctacctgccct

SEQ ID NO: 5425906 - DNA, 21 bp, Homo sapiens
gctggacttctacctgccctc

SEQ ID NO: 5425907 - DNA, 23 bp, Homo sapiens
gctggacttctacctgccctcaa

SEQ ID NO: 5425908 - DNA, 13 bp, Homo sapiens
gctggacttggag

SEQ ID NO: 5425909 - DNA, 19 bp, Homo sapiens
gctggactttaaaaaaaca

SEQ ID NO: 5425910 - DNA, 12 bp, Homo sapiens
gctggagaaaga

SEQ ID NO: 5425911 - DNA, 21 bp, Homo sapiens
gctggagaaagagctgcctgg

SEQ ID NO: 5425912 - DNA, 17 bp, Homo sapiens
gctggagaaagatgcag

SEQ ID NO: 5425913 - DNA, 17 bp, Homo sapiens
gctggagaaagccacgc

SEQ ID NO: 5425914 - DNA, 19 bp, Homo sapiens
gctggagaaagccacgccc

SEQ ID NO: 5425915 - DNA, 17 bp, Homo sapiens
gctggagaaatcttgaa

SEQ ID NO: 5425916 - DNA, 13 bp, Homo sapiens
gctggagaagaga

SEQ ID NO: 5425917 - DNA, 14 bp, Homo sapiens
gctggagaagagag

SEQ ID NO: 5425918 - DNA, 13 bp, Homo sapiens
gctggagaccaga

SEQ ID NO: 5425919 - DNA, 17 bp, Homo sapiens
gctggagaccatgcaga

SEQ ID NO: 5425920 - DNA, 22 bp, Homo sapiens
gctggagaccatgcagagcgcc

SEQ ID NO: 5425921 - DNA, 18 bp, Homo sapiens
gctggagactcctaggca

SEQ ID NO: 5425922 - DNA, 12 bp, Homo sapiens
gctggagaggtt

SEQ ID NO: 5425923 - DNA, 18 bp, Homo sapiens
gctggagataacagcctc

SEQ ID NO: 5425924 - DNA, 19 bp, Homo sapiens
gctggagataacagcctct

SEQ ID NO: 5425925 - DNA, 21 bp, Homo sapiens
gctggagataacagcctcttg

SEQ ID NO: 5425926 - DNA, 16 bp, Homo sapiens
gctggagatactgatt

SEQ ID NO: 5425927 - DNA, 17 bp, Homo sapiens
gctggagatggctgctg

SEQ ID NO: 5425928 - DNA, 14 bp, Homo sapiens
gctggagcactggg

SEQ ID NO: 5425929 - DNA, 23 bp, Homo sapiens
gctggagcagcggattgctctgg

SEQ ID NO: 5425930 - DNA, 22 bp, Homo sapiens
gctggagcagtttggggcaggg

SEQ ID NO: 5425931 - DNA, 23 bp, Homo sapiens
gctggagcagtttggggcagggg

SEQ ID NO: 5425932 - DNA, 21 bp, Homo sapiens
gctggagcatgagccagctct

SEQ ID NO: 5425933 - DNA, 20 bp, Homo sapiens
gctggagcccacagcgagcc

SEQ ID NO: 5425934 - DNA, 23 bp, Homo sapiens
gctggagcccagcgtcagaagtc

SEQ ID NO: 5425935 - DNA, 14 bp, Homo sapiens
gctggagccccatc

SEQ ID NO: 5425936 - DNA, 21 bp, Homo sapiens
gctggagccccatcgcctggg

SEQ ID NO: 5425937 - DNA, 10 bp, Homo sapiens
gctggagcct

SEQ ID NO: 5425938 - DNA, 21 bp, Homo sapiens
gctggagcctcggtggccatg

SEQ ID NO: 5425939 - DNA, 23 bp, Homo sapiens
gctggagcctcggtggccatgct

SEQ ID NO: 5425940 - DNA, 13 bp, Homo sapiens
gctggagcctgag

SEQ ID NO: 5425941 - DNA, 12 bp, Homo sapiens
gctggagcctgg

SEQ ID NO: 5425942 - DNA, 17 bp, Homo sapiens
gctggagcctggtgccc

SEQ ID NO: 5425943 - DNA, 13 bp, Homo sapiens
gctggagcctgtg

SEQ ID NO: 5425944 - DNA, 14 bp, Homo sapiens
gctggagcctgtgt

SEQ ID NO: 5425945 - DNA, 18 bp, Homo sapiens
gctggagctaaggccagc

SEQ ID NO: 5425946 - DNA, 20 bp, Homo sapiens
gctggagctaaggccagcta

SEQ ID NO: 5425947 - DNA, 12 bp, Homo sapiens
gctggagctcct

SEQ ID NO: 5425948 - DNA, 14 bp, Homo sapiens
gctggagctcctcc

SEQ ID NO: 5425949 - DNA, 22 bp, Homo sapiens
gctggagctcctccctccagct

SEQ ID NO: 5425950 - DNA, 23 bp, Homo sapiens
gctggagctcctccctccagctg

SEQ ID NO: 5425951 - DNA, 13 bp, Homo sapiens
gctgggagagcca

SEQ ID NO: 5425952 - DNA, 14 bp, Homo sapiens
gctgggagagccaa

SEQ ID NO: 5425953 - DNA, 16 bp, Homo sapiens
gctgggagagccaagg

SEQ ID NO: 5425954 - DNA, 13 bp, Homo sapiens
gctgggagagcct

SEQ ID NO: 5425955 - DNA, 17 bp, Homo sapiens
gctgggagagccttcca

SEQ ID NO: 5425956 - DNA, 16 bp, Homo sapiens
gctgggagatgctctc

SEQ ID NO: 5425957 - DNA, 14 bp, Homo sapiens
gctgggagcactgg

SEQ ID NO: 5425958 - DNA, 14 bp, Homo sapiens
gctgggagcaggac

SEQ ID NO: 5425959 - DNA, 19 bp, Homo sapiens
gctgggagcctcgcccctc

SEQ ID NO: 5425960 - DNA, 14 bp, Homo sapiens
gctgggagcctggt

SEQ ID NO: 5425961 - DNA, 14 bp, Homo sapiens
gctgggagctccac

SEQ ID NO: 5425962 - DNA, 16 bp, Homo sapiens
gctgggagctccactc

SEQ ID NO: 5425963 - DNA, 18 bp, Homo sapiens
gctgggagctccactctg

SEQ ID NO: 5425964 - DNA, 22 bp, Homo sapiens
gctgggagctccactctgcttc

SEQ ID NO: 5425965 - DNA, 15 bp, Homo sapiens
gctgggagctctgca

SEQ ID NO: 5425966 - DNA, 16 bp, Homo sapiens
gctgggagctctgcag

SEQ ID NO: 5425967 - DNA, 13 bp, Homo sapiens
gctgggagctgaa

SEQ ID NO: 5425968 - DNA, 15 bp, Homo sapiens
gctgggaggaaggac

SEQ ID NO: 5425969 - DNA, 17 bp, Homo sapiens
gctgggaggactggacc

SEQ ID NO: 5425970 - DNA, 15 bp, Homo sapiens
gctgggaggagcccc

SEQ ID NO: 5425971 - DNA, 24 bp, Homo sapiens
gctgggaggagcccctggacatgc

SEQ ID NO: 5425972 - DNA, 17 bp, Homo sapiens
gctgggaggagggcagg

SEQ ID NO: 5425973 - DNA, 16 bp, Homo sapiens
gctgggaggcaagagg

SEQ ID NO: 5425974 - DNA, 14 bp, Homo sapiens
gctgggaggcatgg

SEQ ID NO: 5425975 - DNA, 19 bp, Homo sapiens
gctgggagggagggggagg

SEQ ID NO: 5425976 - DNA, 12 bp, Homo sapiens
gctgggaggggg

SEQ ID NO: 5425977 - DNA, 22 bp, Homo sapiens
gctgggagggggcccttccaga

SEQ ID NO: 5425978 - DNA, 21 bp, Homo sapiens
gctgggaggtcccagggccct

SEQ ID NO: 5425979 - DNA, 18 bp, Homo sapiens
gctgggagtagttgtctt

SEQ ID NO: 5425980 - DNA, 13 bp, Homo sapiens
gctgggagtccct

SEQ ID NO: 5425981 - DNA, 19 bp, Homo sapiens
gctgggagttctagaacca

SEQ ID NO: 5425982 - DNA, 18 bp, Homo sapiens
gctgggataactggccag

SEQ ID NO: 5425983 - DNA, 23 bp, Homo sapiens
gctgggatacacacggctccccc

SEQ ID NO: 5425984 - DNA, 15 bp, Homo sapiens
gctgggatatgtagt

SEQ ID NO: 5425985 - DNA, 21 bp, Homo sapiens
gctgggatcagagcaggagca

SEQ ID NO: 5425986 - DNA, 19 bp, Homo sapiens
gctgggatcccacagccct

SEQ ID NO: 5425987 - DNA, 19 bp, Homo sapiens
gctgggatctactttccct

SEQ ID NO: 5425988 - DNA, 23 bp, Homo sapiens
gctgggatgacaggtgtgagcca

SEQ ID NO: 5425989 - DNA, 18 bp, Homo sapiens
gctgggatggtgggcttc

SEQ ID NO: 5425990 - DNA, 20 bp, Homo sapiens
gctgggatggtgggcttcag

SEQ ID NO: 5425991 - DNA, 23 bp, Homo sapiens
gctgggattacaggcgcctgcca

SEQ ID NO: 5425992 - DNA, 19 bp, Homo sapiens
gctgggattacaggctcct

SEQ ID NO: 5425993 - DNA, 20 bp, Homo sapiens
gctgggattacaggtgcgtg

SEQ ID NO: 5425994 - DNA, 19 bp, Homo sapiens
gctgggattacaggtgtga

SEQ ID NO: 5425995 - DNA, 22 bp, Homo sapiens
gctgggattactggcatgagcc

SEQ ID NO: 5425996 - DNA, 21 bp, Homo sapiens
gctgggattataggcatgagc

SEQ ID NO: 5425997 - DNA, 16 bp, Homo sapiens
gctgggattgtgggca

SEQ ID NO: 5425998 - DNA, 20 bp, Homo sapiens
gctgggcaaggaaaaagaaa

SEQ ID NO: 5425999 - DNA, 22 bp, Homo sapiens
gctgggcacacgcctcccactg

SEQ ID NO: 5426000 - DNA, 15 bp, Homo sapiens
gctgggcaccgtgtc

SEQ ID NO: 5426001 - DNA, 20 bp, Homo sapiens
gctgggcaccgtgtcctcct

SEQ ID NO: 5426002 - DNA, 22 bp, Homo sapiens
gctgggcaccgtgtcctcctct

SEQ ID NO: 5426003 - DNA, 15 bp, Homo sapiens
gctgggcactgccag

SEQ ID NO: 5426004 - DNA, 23 bp, Homo sapiens
gctgggcactgctccaagggaca

SEQ ID NO: 5426005 - DNA, 20 bp, Homo sapiens
gctgggcactgctctcacct

SEQ ID NO: 5426006 - DNA, 15 bp, Homo sapiens
gctgggcactgggca

SEQ ID NO: 5426007 - DNA, 20 bp, Homo sapiens
gctgggcactgggcactagc

SEQ ID NO: 5426008 - DNA, 13 bp, Homo sapiens
gctgggcacttcc

SEQ ID NO: 5426009 - DNA, 19 bp, Homo sapiens
gctgggcacttccctgctg

SEQ ID NO: 5426010 - DNA, 19 bp, Homo sapiens
gctgggcagaaggccaaga

SEQ ID NO: 5426011 - DNA, 14 bp, Homo sapiens
gctgggcagaaggg

SEQ ID NO: 5426012 - DNA, 13 bp, Homo sapiens
gctgggcagagga

SEQ ID NO: 5426013 - DNA, 14 bp, Homo sapiens
gctgggcagaggaa

SEQ ID NO: 5426014 - DNA, 15 bp, Homo sapiens
gctgggcagaggaaa

SEQ ID NO: 5426015 - DNA, 17 bp, Homo sapiens
gctgggcagagggaggt

SEQ ID NO: 5426016 - DNA, 19 bp, Homo sapiens
gctgggcagaggggagagg

SEQ ID NO: 5426017 - DNA, 14 bp, Homo sapiens
gctgggcagcccca

SEQ ID NO: 5426018 - DNA, 18 bp, Homo sapiens
gctgggcagccccagaga

SEQ ID NO: 5426019 - DNA, 16 bp, Homo sapiens
gctgggcagggccctg

SEQ ID NO: 5426020 - DNA, 22 bp, Homo sapiens
gctgggcagggccctgtggctc

SEQ ID NO: 5426021 - DNA, 16 bp, Homo sapiens
gctgggcagggccgca

SEQ ID NO: 5426022 - DNA, 18 bp, Homo sapiens
gctgggcagggccgcagg

SEQ ID NO: 5426023 - DNA, 23 bp, Homo sapiens
gctgggcagggccgcagggcgct

SEQ ID NO: 5426024 - DNA, 17 bp, Homo sapiens
gctgggcaggtcctggg

SEQ ID NO: 5426025 - DNA, 22 bp, Homo sapiens
gctgggcaggtcctggggaggc

SEQ ID NO: 5426026 - DNA, 23 bp, Homo sapiens
gctgggcaggtcctggggaggct

SEQ ID NO: 5426027 - DNA, 19 bp, Homo sapiens
gctgggcagtttttctgta

SEQ ID NO: 5426028 - DNA, 13 bp, Homo sapiens
gctgggcatccca

SEQ ID NO: 5426029 - DNA, 12 bp, Homo sapiens
gctgggcatggt

SEQ ID NO: 5426030 - DNA, 14 bp, Homo sapiens
gctgggcatggtcg

SEQ ID NO: 5426031 - DNA, 21 bp, Homo sapiens
gctgggccagcctcagctcag

SEQ ID NO: 5426032 - DNA, 14 bp, Homo sapiens
gctgggccagggaa

SEQ ID NO: 5426033 - DNA, 14 bp, Homo sapiens
gctgggccagtggc

SEQ ID NO: 5426034 - DNA, 16 bp, Homo sapiens
gctgggccagtggcac

SEQ ID NO: 5426035 - DNA, 19 bp, Homo sapiens
gctgggccagtggctgggg

SEQ ID NO: 5426036 - DNA, 19 bp, Homo sapiens
gctgggccatgtccaaaga

SEQ ID NO: 5426037 - DNA, 20 bp, Homo sapiens
gctgggccatgtccaaagag

SEQ ID NO: 5426038 - DNA, 18 bp, Homo sapiens
gctgggcccaaaggccca

SEQ ID NO: 5426039 - DNA, 22 bp, Homo sapiens
gctgggcccaaaggcccaggga

SEQ ID NO: 5426040 - DNA, 19 bp, Homo sapiens
gctgggcccaaccctgtct

SEQ ID NO: 5426041 - DNA, 20 bp, Homo sapiens
gctgggcccaaccctgtctg

SEQ ID NO: 5426042 - DNA, 13 bp, Homo sapiens
gctgggcccacag

SEQ ID NO: 5426043 - DNA, 20 bp, Homo sapiens
gctgggcccacagcccccac

SEQ ID NO: 5426044 - DNA, 21 bp, Homo sapiens
gctgggcccacagcccccacc

SEQ ID NO: 5426045 - DNA, 15 bp, Homo sapiens
gctgggcccacccag

SEQ ID NO: 5426046 - DNA, 12 bp, Homo sapiens
gctgggcccaga

SEQ ID NO: 5426047 - DNA, 18 bp, Homo sapiens
gctgggcccagaggcaca

SEQ ID NO: 5426048 - DNA, 19 bp, Homo sapiens
gctgggcccagaggcacag

SEQ ID NO: 5426049 - DNA, 17 bp, Homo sapiens
gctgggcccagcccctc

SEQ ID NO: 5426050 - DNA, 16 bp, Homo sapiens
gctgggcccagccggg

SEQ ID NO: 5426051 - DNA, 15 bp, Homo sapiens
gctgggccccaccta

SEQ ID NO: 5426052 - DNA, 16 bp, Homo sapiens
gctgggccccatgctc

SEQ ID NO: 5426053 - DNA, 19 bp, Homo sapiens
gctgggcccccagcctggc

SEQ ID NO: 5426054 - DNA, 22 bp, Homo sapiens
gctgggccccccagctcagggg

SEQ ID NO: 5426055 - DNA, 17 bp, Homo sapiens
gctgggcccctccagga

SEQ ID NO: 5426056 - DNA, 22 bp, Homo sapiens
gctgggcccctgcctctctgca

SEQ ID NO: 5426057 - DNA, 13 bp, Homo sapiens
gctgggcccctgg

SEQ ID NO: 5426058 - DNA, 17 bp, Homo sapiens
gctgggcccctggggac

SEQ ID NO: 5426059 - DNA, 24 bp, Homo sapiens
gctgggcccctggggacagagcca

SEQ ID NO: 5426060 - DNA, 17 bp, Homo sapiens
gctgggccctcttatct

SEQ ID NO: 5426061 - DNA, 13 bp, Homo sapiens
gctgggccctgcc

SEQ ID NO: 5426062 - DNA, 16 bp, Homo sapiens
gctgggcccttcctgg

SEQ ID NO: 5426063 - DNA, 19 bp, Homo sapiens
gctgggccgcaagggcctg

SEQ ID NO: 5426064 - DNA, 21 bp, Homo sapiens
gctgggccgcaagggcctgga

SEQ ID NO: 5426065 - DNA, 17 bp, Homo sapiens
gctgggccggccagcct

SEQ ID NO: 5426066 - DNA, 22 bp, Homo sapiens
gctgggcctcattctagcacct

SEQ ID NO: 5426067 - DNA, 17 bp, Homo sapiens
gctgggcctcccctggg

SEQ ID NO: 5426068 - DNA, 18 bp, Homo sapiens
gctgggcctcctgcctcc

SEQ ID NO: 5426069 - DNA, 18 bp, Homo sapiens
gctgggcctccttcttcc

SEQ ID NO: 5426070 - DNA, 22 bp, Homo sapiens
gctgggcctgggcttccacagt

SEQ ID NO: 5426071 - DNA, 13 bp, Homo sapiens
gctgggcctgggg

SEQ ID NO: 5426072 - DNA, 22 bp, Homo sapiens
gctgggcctgtgcactgggcag

SEQ ID NO: 5426073 - DNA, 21 bp, Homo sapiens
gctgggcctttccagcccaac

SEQ ID NO: 5426074 - DNA, 23 bp, Homo sapiens
gctgggcgcctctgtcctggccc

SEQ ID NO: 5426075 - DNA, 17 bp, Homo sapiens
gctgggcgtgtgtgaca

SEQ ID NO: 5426076 - DNA, 22 bp, Homo sapiens
gctgggctagaggctgagcacc

SEQ ID NO: 5426077 - DNA, 23 bp, Homo sapiens
gctgggctaggcataggtctctt

SEQ ID NO: 5426078 - DNA, 15 bp, Homo sapiens
gctgggctcacaggc

SEQ ID NO: 5426079 - DNA, 17 bp, Homo sapiens
gctgggctcacaggcct

SEQ ID NO: 5426080 - DNA, 14 bp, Homo sapiens
gctgggctcagtga

SEQ ID NO: 5426081 - DNA, 14 bp, Homo sapiens
gctgggctctccac

SEQ ID NO: 5426082 - DNA, 15 bp, Homo sapiens
gctgggctctccacc

SEQ ID NO: 5426083 - DNA, 19 bp, Homo sapiens
gctgggctctccacctcag

SEQ ID NO: 5426084 - DNA, 21 bp, Homo sapiens
gctgggctctccacctcagcc

SEQ ID NO: 5426085 - DNA, 15 bp, Homo sapiens
gctgggctctgcctt

SEQ ID NO: 5426086 - DNA, 13 bp, Homo sapiens
gctgggctctggt

SEQ ID NO: 5426087 - DNA, 14 bp, Homo sapiens
gctgggctctgtct

SEQ ID NO: 5426088 - DNA, 20 bp, Homo sapiens
gctgggctcttaactgttgc

SEQ ID NO: 5426089 - DNA, 21 bp, Homo sapiens
gctgggctcttaactgttgct

SEQ ID NO: 5426090 - DNA, 11 bp, Homo sapiens
gctgggctgag

SEQ ID NO: 5426091 - DNA, 13 bp, Homo sapiens
gctgggctgagcc

SEQ ID NO: 5426092 - DNA, 14 bp, Homo sapiens
gctgggctgagcca

SEQ ID NO: 5426093 - DNA, 17 bp, Homo sapiens
gctgggctgagcccctg

SEQ ID NO: 5426094 - DNA, 18 bp, Homo sapiens
gctgggctgagcccctgg

SEQ ID NO: 5426095 - DNA, 13 bp, Homo sapiens
gctgggctgctcc

SEQ ID NO: 5426096 - DNA, 20 bp, Homo sapiens
gctgggctgctcctgaatga

SEQ ID NO: 5426097 - DNA, 13 bp, Homo sapiens
gctgggctgtctc

SEQ ID NO: 5426098 - DNA, 15 bp, Homo sapiens
gctgggctgttggct

SEQ ID NO: 5426099 - DNA, 18 bp, Homo sapiens
gctgggcttcagtggcag

SEQ ID NO: 5426100 - DNA, 20 bp, Homo sapiens
gctgggcttcagtggcagct

SEQ ID NO: 5426101 - DNA, 23 bp, Homo sapiens
gctgggcttcattccggactggc

SEQ ID NO: 5426102 - DNA, 17 bp, Homo sapiens
gctgggcttggcctgga

SEQ ID NO: 5426103 - DNA, 22 bp, Homo sapiens
gctgggctttgggaagtttgct

SEQ ID NO: 5426104 - DNA, 23 bp, Homo sapiens
gctgggctttggggctggtggga

SEQ ID NO: 5426105 - DNA, 12 bp, Homo sapiens
gctggggaaagg

SEQ ID NO: 5426106 - DNA, 12 bp, Homo sapiens
gctggggaacag

SEQ ID NO: 5426107 - DNA, 13 bp, Homo sapiens
gctggggaacaga

SEQ ID NO: 5426108 - DNA, 23 bp, Homo sapiens
gctggggaacagagcgggcctct

SEQ ID NO: 5426109 - DNA, 16 bp, Homo sapiens
gctggggaagacagtg

SEQ ID NO: 5426110 - DNA, 12 bp, Homo sapiens
gctggggaaggg

SEQ ID NO: 5426111 - DNA, 20 bp, Homo sapiens
gctggggaagggttttcttt

SEQ ID NO: 5426112 - DNA, 23 bp, Homo sapiens
gctggggaagggttttcttttct

SEQ ID NO: 5426113 - DNA, 20 bp, Homo sapiens
gctggggaagtacgtcccag

SEQ ID NO: 5426114 - DNA, 20 bp, Homo sapiens
gctggggacacaggatcctg

SEQ ID NO: 5426115 - DNA, 16 bp, Homo sapiens
gctggggacagagggt

SEQ ID NO: 5426116 - DNA, 23 bp, Homo sapiens
gctggggacagctttcctgggtg

SEQ ID NO: 5426117 - DNA, 18 bp, Homo sapiens
gctggggacaggtcctca

SEQ ID NO: 5426118 - DNA, 17 bp, Homo sapiens
gctggggacccacccag

SEQ ID NO: 5426119 - DNA, 18 bp, Homo sapiens
gctggggacccacccagc

SEQ ID NO: 5426120 - DNA, 22 bp, Homo sapiens
gctggggaccggttcccacaag

SEQ ID NO: 5426121 - DNA, 23 bp, Homo sapiens
gctggggacctggtaccctcctg

SEQ ID NO: 5426122 - DNA, 17 bp, Homo sapiens
gctggggactcagggac

SEQ ID NO: 5426123 - DNA, 17 bp, Homo sapiens
gctggggactctggcac

SEQ ID NO: 5426124 - DNA, 20 bp, Homo sapiens
gctggggactctggcacagt

SEQ ID NO: 5426125 - DNA, 13 bp, Homo sapiens
gctggggagatgg

SEQ ID NO: 5426126 - DNA, 16 bp, Homo sapiens
gctggggagatggggg

SEQ ID NO: 5426127 - DNA, 15 bp, Homo sapiens
gctggggagcagctg

SEQ ID NO: 5426128 - DNA, 22 bp, Homo sapiens
gctgtctgaaaaagtgttttta

SEQ ID NO: 5426129 - DNA, 17 bp, Homo sapiens
gctgtctgaccagagaa

SEQ ID NO: 5426130 - DNA, 19 bp, Homo sapiens
gctgtctgagtagtggcca

SEQ ID NO: 5426131 - DNA, 15 bp, Homo sapiens
gctgtctgcagcctt

SEQ ID NO: 5426132 - DNA, 14 bp, Homo sapiens
gctgtctgccaggc

SEQ ID NO: 5426133 - DNA, 15 bp, Homo sapiens
gctgtctgccaggca

SEQ ID NO: 5426134 - DNA, 17 bp, Homo sapiens
gctgtctgccaggcact

SEQ ID NO: 5426135 - DNA, 13 bp, Homo sapiens
gctgtctgcctgt

SEQ ID NO: 5426136 - DNA, 17 bp, Homo sapiens
gctgtctgcctgtattt

SEQ ID NO: 5426137 - DNA, 24 bp, Homo sapiens
gctgtctgcggagccagcgcctgc

SEQ ID NO: 5426138 - DNA, 21 bp, Homo sapiens
gctgtctggatccttcccaag

SEQ ID NO: 5426139 - DNA, 23 bp, Homo sapiens
gctgtctggatccttcccaaggt

SEQ ID NO: 5426140 - DNA, 15 bp, Homo sapiens
gctgtctggcacagc

SEQ ID NO: 5426141 - DNA, 13 bp, Homo sapiens
gctgtctggccag

SEQ ID NO: 5426142 - DNA, 23 bp, Homo sapiens
gctgtctgggtgtccgccatcca

SEQ ID NO: 5426143 - DNA, 18 bp, Homo sapiens
gctgtctggtgaggtggc

SEQ ID NO: 5426144 - DNA, 14 bp, Homo sapiens
gctgtctgtctcta

SEQ ID NO: 5426145 - DNA, 14 bp, Homo sapiens
gctgtctgtgccat

SEQ ID NO: 5426146 - DNA, 14 bp, Homo sapiens
gctgtctgtggctt

SEQ ID NO: 5426147 - DNA, 15 bp, Homo sapiens
gctgtctgtggcttc

SEQ ID NO: 5426148 - DNA, 16 bp, Homo sapiens
gctgtctgtgggccgc

SEQ ID NO: 5426149 - DNA, 23 bp, Homo sapiens
gctgtcttactaataggtctgga

SEQ ID NO: 5426150 - DNA, 23 bp, Homo sapiens
gctgtcttcagtctcacagagaa

SEQ ID NO: 5426151 - DNA, 17 bp, Homo sapiens
gctgtcttcccctgaga

SEQ ID NO: 5426152 - DNA, 22 bp, Homo sapiens
gctgtcttctcaggctctgccc

SEQ ID NO: 5426153 - DNA, 17 bp, Homo sapiens
gctgtcttctcccagag

SEQ ID NO: 5426154 - DNA, 23 bp, Homo sapiens
gctgtcttctggacaggctctgc

SEQ ID NO: 5426155 - DNA, 24 bp, Homo sapiens
gctgtcttctggacaggctctgct

SEQ ID NO: 5426156 - DNA, 15 bp, Homo sapiens
gctgtcttctggtct

SEQ ID NO: 5426157 - DNA, 16 bp, Homo sapiens
gctgtcttctggtctg

SEQ ID NO: 5426158 - DNA, 17 bp, Homo sapiens
gctgtcttgccccagtt

SEQ ID NO: 5426159 - DNA, 14 bp, Homo sapiens
gctgtctttctcta

SEQ ID NO: 5426160 - DNA, 20 bp, Homo sapiens
gctgtctttcttgctccctg

SEQ ID NO: 5426161 - DNA, 22 bp, Homo sapiens
gctgtcttttctttgccatctc

SEQ ID NO: 5426162 - DNA, 20 bp, Homo sapiens
gctgtgaaacagtgtggatg

SEQ ID NO: 5426163 - DNA, 14 bp, Homo sapiens
gctgtgaaatgact

SEQ ID NO: 5426164 - DNA, 20 bp, Homo sapiens
gctgtgaacaagtgaacaca

SEQ ID NO: 5426165 - DNA, 16 bp, Homo sapiens
gctgtgaacatgcctc

SEQ ID NO: 5426166 - DNA, 18 bp, Homo sapiens
gctgtgaacatgcctcct

SEQ ID NO: 5426167 - DNA, 20 bp, Homo sapiens
gctgtgaaccctggggcctg

SEQ ID NO: 5426168 - DNA, 22 bp, Homo sapiens
gctgtgaaccctggggcctgac

SEQ ID NO: 5426169 - DNA, 13 bp, Homo sapiens
gctgtgaactcag

SEQ ID NO: 5426170 - DNA, 20 bp, Homo sapiens
gctgtgaactcagagcccct

SEQ ID NO: 5426171 - DNA, 17 bp, Homo sapiens
gctgtgacaaccctggc

SEQ ID NO: 5426172 - DNA, 18 bp, Homo sapiens
gctgtgacaaccctggcc

SEQ ID NO: 5426173 - DNA, 21 bp, Homo sapiens
gctgtgacaccccccttctga

SEQ ID NO: 5426174 - DNA, 14 bp, Homo sapiens
gctgtgacaggtat

SEQ ID NO: 5426175 - DNA, 19 bp, Homo sapiens
gctgtgaccctcaattcat

SEQ ID NO: 5426176 - DNA, 14 bp, Homo sapiens
gctgtgacctgctg

SEQ ID NO: 5426177 - DNA, 15 bp, Homo sapiens
gctgtgacctgctga

SEQ ID NO: 5426178 - DNA, 16 bp, Homo sapiens
gctgtgacctgctgag

SEQ ID NO: 5426179 - DNA, 18 bp, Homo sapiens
gctgtgacgcagccggag

SEQ ID NO: 5426180 - DNA, 16 bp, Homo sapiens
gctgtgactctgggca

SEQ ID NO: 5426181 - DNA, 17 bp, Homo sapiens
gctgtgactctgggcag

SEQ ID NO: 5426182 - DNA, 21 bp, Homo sapiens
gctgtgactctgggcagggac

SEQ ID NO: 5426183 - DNA, 15 bp, Homo sapiens
gctgtgagacagtgg

SEQ ID NO: 5426184 - DNA, 20 bp, Homo sapiens
gctgtgagacagtgggaaat

SEQ ID NO: 5426185 - DNA, 13 bp, Homo sapiens
gctgtgagcagct

SEQ ID NO: 5426186 - DNA, 22 bp, Homo sapiens
gctgtgagcagctagtggtggc

SEQ ID NO: 5426187 - DNA, 21 bp, Homo sapiens
gctgtgagcaggcggggagga

SEQ ID NO: 5426188 - DNA, 12 bp, Homo sapiens
gctgtgagcccc

SEQ ID NO: 5426189 - DNA, 21 bp, Homo sapiens
gctgtgaggaatgctctgtgc

SEQ ID NO: 5426190 - DNA, 11 bp, Homo sapiens
gctgtgaggac

SEQ ID NO: 5426191 - DNA, 12 bp, Homo sapiens
gctgtgaggaca

SEQ ID NO: 5426192 - DNA, 18 bp, Homo sapiens
gctgtgaggacagggccc

SEQ ID NO: 5426193 - DNA, 16 bp, Homo sapiens
gctgtgaggcccctgg

SEQ ID NO: 5426194 - DNA, 18 bp, Homo sapiens
gctgtgaggcccctggac

SEQ ID NO: 5426195 - DNA, 20 bp, Homo sapiens
gctgtgaggcttgcccagga

SEQ ID NO: 5426196 - DNA, 24 bp, Homo sapiens
gctgtgaggcttgcccaggagcaa

SEQ ID NO: 5426197 - DNA, 14 bp, Homo sapiens
gctgtgagggaggg

SEQ ID NO: 5426198 - DNA, 18 bp, Homo sapiens
gctgtgagtgtaagtgtg

SEQ ID NO: 5426199 - DNA, 18 bp, Homo sapiens
gctgtgagttctccctgt

SEQ ID NO: 5426200 - DNA, 14 bp, Homo sapiens
gctgtgataaccag

SEQ ID NO: 5426201 - DNA, 15 bp, Homo sapiens
gctgtgatcttaaaa

SEQ ID NO: 5426202 - DNA, 15 bp, Homo sapiens
gctgtgatgctgtgt

SEQ ID NO: 5426203 - DNA, 14 bp, Homo sapiens
gctgtgatgtcaca

SEQ ID NO: 5426204 - DNA, 13 bp, Homo sapiens
gctgtgattgctg

SEQ ID NO: 5426205 - DNA, 17 bp, Homo sapiens
gctgtgattgctgccag

SEQ ID NO: 5426206 - DNA, 19 bp, Homo sapiens
gctgtgcaacggtctcctg

SEQ ID NO: 5426207 - DNA, 18 bp, Homo sapiens
gctgtgcacaaagtggca

SEQ ID NO: 5426208 - DNA, 21 bp, Homo sapiens
gctgtgcacaaagtggcataa

SEQ ID NO: 5426209 - DNA, 21 bp, Homo sapiens
gctgtgcacccagaagaagat

SEQ ID NO: 5426210 - DNA, 21 bp, Homo sapiens
gctgtgcaccttacattccta

SEQ ID NO: 5426211 - DNA, 16 bp, Homo sapiens
gctgtgcagctctcta

SEQ ID NO: 5426212 - DNA, 10 bp, Homo sapiens
gctgtgccaa

SEQ ID NO: 5426213 - DNA, 14 bp, Homo sapiens
gctgtgccaaagca

SEQ ID NO: 5426214 - DNA, 13 bp, Homo sapiens
gctgtgccacagg

SEQ ID NO: 5426215 - DNA, 12 bp, Homo sapiens
gctgtgccaccc

SEQ ID NO: 5426216 - DNA, 17 bp, Homo sapiens
gctgtgccaccctgggc

SEQ ID NO: 5426217 - DNA, 22 bp, Homo sapiens
gctgtgccaccctgggctctgt

SEQ ID NO: 5426218 - DNA, 13 bp, Homo sapiens
gctgtgccagctg

SEQ ID NO: 5426219 - DNA, 14 bp, Homo sapiens
gctgtgccagctgc

SEQ ID NO: 5426220 - DNA, 19 bp, Homo sapiens
gctgtgccagctgcttctg

SEQ ID NO: 5426221 - DNA, 14 bp, Homo sapiens
gctgtgccaggagg

SEQ ID NO: 5426222 - DNA, 15 bp, Homo sapiens
gctgtgccaggaggc

SEQ ID NO: 5426223 - DNA, 12 bp, Homo sapiens
gctgtgccaggc

SEQ ID NO: 5426224 - DNA, 22 bp, Homo sapiens
gctgtgccaggctgggaggctc

SEQ ID NO: 5426225 - DNA, 20 bp, Homo sapiens
gctgtgcccagcaggcccag

SEQ ID NO: 5426226 - DNA, 16 bp, Homo sapiens
gctgtgccccctctgg

SEQ ID NO: 5426227 - DNA, 18 bp, Homo sapiens
gctgtgccctcctgggag

SEQ ID NO: 5426228 - DNA, 16 bp, Homo sapiens
gctgtgccctcttgat

SEQ ID NO: 5426229 - DNA, 13 bp, Homo sapiens
gctgtgccgaggc

SEQ ID NO: 5426230 - DNA, 17 bp, Homo sapiens
gctgtgcctcccaaaat

SEQ ID NO: 5426231 - DNA, 19 bp, Homo sapiens
gctgtgcctcgcatcctat

SEQ ID NO: 5426232 - DNA, 18 bp, Homo sapiens
gctgtgcctcgctcccca

SEQ ID NO: 5426233 - DNA, 12 bp, Homo sapiens
gctgtgcctctg

SEQ ID NO: 5426234 - DNA, 15 bp, Homo sapiens
gctgtgcctctgcct

SEQ ID NO: 5426235 - DNA, 16 bp, Homo sapiens
gctgtgcctgaggctg

SEQ ID NO: 5426236 - DNA, 17 bp, Homo sapiens
gctgtgcctgaggctgg

SEQ ID NO: 5426237 - DNA, 20 bp, Homo sapiens
gctgtgcctgaggctggctg

SEQ ID NO: 5426238 - DNA, 12 bp, Homo sapiens
gctgtgcctgct

SEQ ID NO: 5426239 - DNA, 13 bp, Homo sapiens
gctgtgcctgcta

SEQ ID NO: 5426240 - DNA, 17 bp, Homo sapiens
gctgtgcctgctagagc

SEQ ID NO: 5426241 - DNA, 18 bp, Homo sapiens
gctgtgcctgctcagcag

SEQ ID NO: 5426242 - DNA, 22 bp, Homo sapiens
gctgtgcctgctcagcagccag

SEQ ID NO: 5426243 - DNA, 14 bp, Homo sapiens
gctgtgccttccct

SEQ ID NO: 5426244 - DNA, 18 bp, Homo sapiens
gctgtgcgcccagggctg

SEQ ID NO: 5426245 - DNA, 16 bp, Homo sapiens
gctgtgcggatctctg

SEQ ID NO: 5426246 - DNA, 17 bp, Homo sapiens
gctgtgctacgtgtgaa

SEQ ID NO: 5426247 - DNA, 18 bp, Homo sapiens
gctgtgctacgtgtgaaa

SEQ ID NO: 5426248 - DNA, 19 bp, Homo sapiens
gctgtgctacgtgtgaaat

SEQ ID NO: 5426249 - DNA, 21 bp, Homo sapiens
gctgtgctacgtgtgaaatct

SEQ ID NO: 5426250 - DNA, 23 bp, Homo sapiens
gctgtgctacgtgtgaaatctgt

SEQ ID NO: 5426251 - DNA, 16 bp, Homo sapiens
gctgtgctaggtctga

SEQ ID NO: 5426252 - DNA, 14 bp, Homo sapiens
gctgtgctcagaga

SEQ ID NO: 5426253 - DNA, 19 bp, Homo sapiens
gctgtgctccacactcaga

SEQ ID NO: 5426254 - DNA, 20 bp, Homo sapiens
gctgtgctccacactcagaa

SEQ ID NO: 5426255 - DNA, 22 bp, Homo sapiens
gctgtgctccacactcagaaaa

SEQ ID NO: 5426256 - DNA, 22 bp, Homo sapiens
gctgtgctccagcagtgctggg

SEQ ID NO: 5426257 - DNA, 14 bp, Homo sapiens
gctgtgctcttcct

SEQ ID NO: 5426258 - DNA, 15 bp, Homo sapiens
gctgtgctcttcctc

SEQ ID NO: 5426259 - DNA, 11 bp, Homo sapiens
gctgtgctgca

SEQ ID NO: 5426260 - DNA, 15 bp, Homo sapiens
gctgtgctgccctgc

SEQ ID NO: 5426261 - DNA, 22 bp, Homo sapiens
gctgtgctgccctgcccacctg

SEQ ID NO: 5426262 - DNA, 13 bp, Homo sapiens
gctgtgctgctca

SEQ ID NO: 5426263 - DNA, 14 bp, Homo sapiens
gctgtgctgctttt

SEQ ID NO: 5426264 - DNA, 22 bp, Homo sapiens
gctgtgctgcttttgagcctca

SEQ ID NO: 5426265 - DNA, 10 bp, Homo sapiens
gctgtgctgg

SEQ ID NO: 5426266 - DNA, 13 bp, Homo sapiens
gctgtgctggtct

SEQ ID NO: 5426267 - DNA, 20 bp, Homo sapiens
gctgtgctggtctctaggcc

SEQ ID NO: 5426268 - DNA, 13 bp, Homo sapiens
gctgtgctgtgga

SEQ ID NO: 5426269 - DNA, 14 bp, Homo sapiens
gctgtgctgtgtct

SEQ ID NO: 5426270 - DNA, 18 bp, Homo sapiens
gctgtgcttgaaggccct

SEQ ID NO: 5426271 - DNA, 19 bp, Homo sapiens
gctgtgcttgaaggccctg

SEQ ID NO: 5426272 - DNA, 23 bp, Homo sapiens
gctgtgcttgaaggccctgctga

SEQ ID NO: 5426273 - DNA, 22 bp, Homo sapiens
gctgtggaccatggagtggcag

SEQ ID NO: 5426274 - DNA, 19 bp, Homo sapiens
gctgtggaccgtggacagg

SEQ ID NO: 5426275 - DNA, 19 bp, Homo sapiens
gctgtggagacaatgtctg

SEQ ID NO: 5426276 - DNA, 17 bp, Homo sapiens
gctgtggagcccattgt

SEQ ID NO: 5426277 - DNA, 17 bp, Homo sapiens
gctgtggaggattgcta

SEQ ID NO: 5426278 - DNA, 13 bp, Homo sapiens
gctgtggcagccg

SEQ ID NO: 5426279 - DNA, 18 bp, Homo sapiens
gctgtggcatcaggaaag

SEQ ID NO: 5426280 - DNA, 19 bp, Homo sapiens
gctgtggcatcaggaaagg

SEQ ID NO: 5426281 - DNA, 14 bp, Homo sapiens
gctgtggccaggag

SEQ ID NO: 5426282 - DNA, 20 bp, Homo sapiens
gctgtggccaggaggtgcca

SEQ ID NO: 5426283 - DNA, 14 bp, Homo sapiens
gctgtggccaggcc

SEQ ID NO: 5426284 - DNA, 16 bp, Homo sapiens
gctgtggccagggtga

SEQ ID NO: 5426285 - DNA, 17 bp, Homo sapiens
gctgtggccagggtgag

SEQ ID NO: 5426286 - DNA, 21 bp, Homo sapiens
gctgtggccagggtgagagct

SEQ ID NO: 5426287 - DNA, 22 bp, Homo sapiens
gctgtggccagggtgagagctg

SEQ ID NO: 5426288 - DNA, 18 bp, Homo sapiens
gctgtggccccctgtccc

SEQ ID NO: 5426289 - DNA, 15 bp, Homo sapiens
gctgtggcccctcct

SEQ ID NO: 5426290 - DNA, 22 bp, Homo sapiens
gctgtggcccctccttctcccc

SEQ ID NO: 5426291 - DNA, 23 bp, Homo sapiens
gctgtggcccctccttctcccct

SEQ ID NO: 5426292 - DNA, 23 bp, Homo sapiens
gctgtggccggtgccagctgccc

SEQ ID NO: 5426293 - DNA, 19 bp, Homo sapiens
gctgtggccgtctcctccc

SEQ ID NO: 5426294 - DNA, 15 bp, Homo sapiens
gctgtggcctcaccc

SEQ ID NO: 5426295 - DNA, 14 bp, Homo sapiens
gctgtggcctcact

SEQ ID NO: 5426296 - DNA, 14 bp, Homo sapiens
gctgtggcctgggc

SEQ ID NO: 5426297 - DNA, 15 bp, Homo sapiens
gctgtggcctgggca

SEQ ID NO: 5426298 - DNA, 12 bp, Homo sapiens
gctgtggctcca

SEQ ID NO: 5426299 - DNA, 16 bp, Homo sapiens
gctgtggctccctcct

SEQ ID NO: 5426300 - DNA, 18 bp, Homo sapiens
gctgtggctctgggtggg

SEQ ID NO: 5426301 - DNA, 11 bp, Homo sapiens
gctgtggctgg

SEQ ID NO: 5426302 - DNA, 14 bp, Homo sapiens
gctgtggctggagg

SEQ ID NO: 5426303 - DNA, 15 bp, Homo sapiens
gctgtggctgggggg

SEQ ID NO: 5426304 - DNA, 16 bp, Homo sapiens
gctgtggctgggggga

SEQ ID NO: 5426305 - DNA, 21 bp, Homo sapiens
gctgtggctgggtggtcagca

SEQ ID NO: 5426306 - DNA, 13 bp, Homo sapiens
gctgtggctggtg

SEQ ID NO: 5426307 - DNA, 15 bp, Homo sapiens
gcttagtcactgcct

SEQ ID NO: 5426308 - DNA, 18 bp, Homo sapiens
gcttagtcactgcctgca

SEQ ID NO: 5426309 - DNA, 15 bp, Homo sapiens
gcttagtgaaaatac

SEQ ID NO: 5426310 - DNA, 20 bp, Homo sapiens
gcttagttggctttgcccac

SEQ ID NO: 5426311 - DNA, 20 bp, Homo sapiens
gcttagtttgtgtgttgtct

SEQ ID NO: 5426312 - DNA, 13 bp, Homo sapiens
gcttataaacaca

SEQ ID NO: 5426313 - DNA, 19 bp, Homo sapiens
gcttataaacacattgaat

SEQ ID NO: 5426314 - DNA, 15 bp, Homo sapiens
gcttataaatgtgta

SEQ ID NO: 5426315 - DNA, 18 bp, Homo sapiens
gcttataacctagttaaa

SEQ ID NO: 5426316 - DNA, 20 bp, Homo sapiens
gcttataatgaaatctgttt

SEQ ID NO: 5426317 - DNA, 12 bp, Homo sapiens
gcttatacactt

SEQ ID NO: 5426318 - DNA, 18 bp, Homo sapiens
gcttatacgaaataattg

SEQ ID NO: 5426319 - DNA, 22 bp, Homo sapiens
gcttatacgaaataattgttgt

SEQ ID NO: 5426320 - DNA, 16 bp, Homo sapiens
gcttatagaataaaag

SEQ ID NO: 5426321 - DNA, 17 bp, Homo sapiens
gcttataggtggcctct

SEQ ID NO: 5426322 - DNA, 15 bp, Homo sapiens
gcttatatctggcct

SEQ ID NO: 5426323 - DNA, 20 bp, Homo sapiens
gcttatatctggcctctgct

SEQ ID NO: 5426324 - DNA, 14 bp, Homo sapiens
gcttatatgtcctt

SEQ ID NO: 5426325 - DNA, 13 bp, Homo sapiens
gcttatattcaac

SEQ ID NO: 5426326 - DNA, 23 bp, Homo sapiens
gcttatattcaaccatggacttt

SEQ ID NO: 5426327 - DNA, 20 bp, Homo sapiens
gcttatatttgacattcttc

SEQ ID NO: 5426328 - DNA, 21 bp, Homo sapiens
gcttatattttcagcaaagaa

SEQ ID NO: 5426329 - DNA, 22 bp, Homo sapiens
gcttatcagaactcctttctaa

SEQ ID NO: 5426330 - DNA, 13 bp, Homo sapiens
gcttatcatcagc

SEQ ID NO: 5426331 - DNA, 15 bp, Homo sapiens
gcttatcatcagccc

SEQ ID NO: 5426332 - DNA, 23 bp, Homo sapiens
gcttatcatgctgtctttacatg

SEQ ID NO: 5426333 - DNA, 23 bp, Homo sapiens
gcttatcctgttttcatggacag

SEQ ID NO: 5426334 - DNA, 17 bp, Homo sapiens
gcttatccttccacgga

SEQ ID NO: 5426335 - DNA, 20 bp, Homo sapiens
gcttatctcagttatgagta

SEQ ID NO: 5426336 - DNA, 17 bp, Homo sapiens
gcttatctccctgcttc

SEQ ID NO: 5426337 - DNA, 13 bp, Homo sapiens
gcttatctgcccc

SEQ ID NO: 5426338 - DNA, 18 bp, Homo sapiens
gcttatctgcccctcccc

SEQ ID NO: 5426339 - DNA, 19 bp, Homo sapiens
gcttatctgcccctccccc

SEQ ID NO: 5426340 - DNA, 16 bp, Homo sapiens
gcttatctttctttcc

SEQ ID NO: 5426341 - DNA, 23 bp, Homo sapiens
gcttatgatagcaaatggcctca

SEQ ID NO: 5426342 - DNA, 21 bp, Homo sapiens
gcttatgatgggctccccagg

SEQ ID NO: 5426343 - DNA, 15 bp, Homo sapiens
gcttatgctcttaat

SEQ ID NO: 5426344 - DNA, 14 bp, Homo sapiens
gcttatggccaggg

SEQ ID NO: 5426345 - DNA, 17 bp, Homo sapiens
gcttatgggtggctttc

SEQ ID NO: 5426346 - DNA, 20 bp, Homo sapiens
gcttatggtaccagatgcag

SEQ ID NO: 5426347 - DNA, 21 bp, Homo sapiens
gcttatgtagctttttattat

SEQ ID NO: 5426348 - DNA, 16 bp, Homo sapiens
gcttatgtctctgcct

SEQ ID NO: 5426349 - DNA, 16 bp, Homo sapiens
gcttatgttaaactct

SEQ ID NO: 5426350 - DNA, 20 bp, Homo sapiens
gcttatgttaatagtaattc

SEQ ID NO: 5426351 - DNA, 12 bp, Homo sapiens
gcttatgttttt

SEQ ID NO: 5426352 - DNA, 16 bp, Homo sapiens
gcttattaatgctaag

SEQ ID NO: 5426353 - DNA, 19 bp, Homo sapiens
gcttattaatgctaagggc

SEQ ID NO: 5426354 - DNA, 18 bp, Homo sapiens
gcttattccatgactgct

SEQ ID NO: 5426355 - DNA, 22 bp, Homo sapiens
gcttattcccaactgctctgcc

SEQ ID NO: 5426356 - DNA, 16 bp, Homo sapiens
gcttattctcaaagca

SEQ ID NO: 5426357 - DNA, 17 bp, Homo sapiens
gcttattgtgtgcgctg

SEQ ID NO: 5426358 - DNA, 20 bp, Homo sapiens
gcttattgttccaagacatt

SEQ ID NO: 5426359 - DNA, 16 bp, Homo sapiens
gcttattgtttctctg

SEQ ID NO: 5426360 - DNA, 11 bp, Homo sapiens
gcttatttaat

SEQ ID NO: 5426361 - DNA, 16 bp, Homo sapiens
gcttatttaataaaga

SEQ ID NO: 5426362 - DNA, 15 bp, Homo sapiens
gcttatttattgtat

SEQ ID NO: 5426363 - DNA, 17 bp, Homo sapiens
gcttatttattgtattc

SEQ ID NO: 5426364 - DNA, 18 bp, Homo sapiens
gcttatttcatctgttct

SEQ ID NO: 5426365 - DNA, 15 bp, Homo sapiens
gcttatttccctcat

SEQ ID NO: 5426366 - DNA, 19 bp, Homo sapiens
gcttatttctatgacaaat

SEQ ID NO: 5426367 - DNA, 22 bp, Homo sapiens
gcttatttggaaattttagtta

SEQ ID NO: 5426368 - DNA, 13 bp, Homo sapiens
gcttattttaatg

SEQ ID NO: 5426369 - DNA, 11 bp, Homo sapiens
gcttattttat

SEQ ID NO: 5426370 - DNA, 21 bp, Homo sapiens
gcttattttatgatagtttgt

SEQ ID NO: 5426371 - DNA, 15 bp, Homo sapiens
gcttattttgtggct

SEQ ID NO: 5426372 - DNA, 20 bp, Homo sapiens
gcttatttttaaaataaaaa

SEQ ID NO: 5426373 - DNA, 15 bp, Homo sapiens
gcttatttttctgtg

SEQ ID NO: 5426374 - DNA, 18 bp, Homo sapiens
gcttattttttaaaataa

SEQ ID NO: 5426375 - DNA, 19 bp, Homo sapiens
gcttattttttaaaataat

SEQ ID NO: 5426376 - DNA, 20 bp, Homo sapiens
gcttattttttaaaatattt

SEQ ID NO: 5426377 - DNA, 19 bp, Homo sapiens
gcttcaaatgatccttcct

SEQ ID NO: 5426378 - DNA, 22 bp, Homo sapiens
gcttcaaatgatccttcctact

SEQ ID NO: 5426379 - DNA, 17 bp, Homo sapiens
gcttcaaattatagaaa

SEQ ID NO: 5426380 - DNA, 15 bp, Homo sapiens
gcttcaacagccaag

SEQ ID NO: 5426381 - DNA, 17 bp, Homo sapiens
gcttcaacagccaagct

SEQ ID NO: 5426382 - DNA, 19 bp, Homo sapiens
gcttcaacagccaagctgg

SEQ ID NO: 5426383 - DNA, 22 bp, Homo sapiens
gcttcaacattctttgcaagat

SEQ ID NO: 5426384 - DNA, 15 bp, Homo sapiens
gcttcaagctctctg

SEQ ID NO: 5426385 - DNA, 21 bp, Homo sapiens
gcttcaaggatatactgcagc

SEQ ID NO: 5426386 - DNA, 14 bp, Homo sapiens
gcttcaaggatcct

SEQ ID NO: 5426387 - DNA, 18 bp, Homo sapiens
gcttcaaggatcctgagc

SEQ ID NO: 5426388 - DNA, 20 bp, Homo sapiens
gcttcaaggatcctgagcca

SEQ ID NO: 5426389 - DNA, 21 bp, Homo sapiens
gcttcaaggatcctgagccag

SEQ ID NO: 5426390 - DNA, 12 bp, Homo sapiens
gcttcaagtgat

SEQ ID NO: 5426391 - DNA, 23 bp, Homo sapiens
gcttcaagtgatatatgtattta

SEQ ID NO: 5426392 - DNA, 14 bp, Homo sapiens
gcttcaagtgcctt

SEQ ID NO: 5426393 - DNA, 20 bp, Homo sapiens
gcttcaagtgccttttgctg

SEQ ID NO: 5426394 - DNA, 24 bp, Homo sapiens
gcttcaagtgccttttgctgcgca

SEQ ID NO: 5426395 - DNA, 16 bp, Homo sapiens
gcttcaataaatcttt

SEQ ID NO: 5426396 - DNA, 19 bp, Homo sapiens
gcttcaatctacgatgtta

SEQ ID NO: 5426397 - DNA, 20 bp, Homo sapiens
gcttcaatttattgcacaaa

SEQ ID NO: 5426398 - DNA, 12 bp, Homo sapiens
gcttcacacccc

SEQ ID NO: 5426399 - DNA, 15 bp, Homo sapiens
gcttcacagccacac

SEQ ID NO: 5426400 - DNA, 17 bp, Homo sapiens
gcttcacagtagagcca

SEQ ID NO: 5426401 - DNA, 20 bp, Homo sapiens
gcttcacagtagagccagct

SEQ ID NO: 5426402 - DNA, 14 bp, Homo sapiens
gcttcacatttgta

SEQ ID NO: 5426403 - DNA, 16 bp, Homo sapiens
gcttcaccagtctgtc

SEQ ID NO: 5426404 - DNA, 18 bp, Homo sapiens
gcttcaccagtctgtcta

SEQ ID NO: 5426405 - DNA, 23 bp, Homo sapiens
gcttcaccagtctgtctactgtg

SEQ ID NO: 5426406 - DNA, 20 bp, Homo sapiens
gcttcacccaccaggccagc

SEQ ID NO: 5426407 - DNA, 14 bp, Homo sapiens
gcttcacccctgca

SEQ ID NO: 5426408 - DNA, 20 bp, Homo sapiens
gcttcacccctgcacttcag

SEQ ID NO: 5426409 - DNA, 21 bp, Homo sapiens
gcttcacccctgcacttcaga

SEQ ID NO: 5426410 - DNA, 22 bp, Homo sapiens
gcttcaccctgaatggttccat

SEQ ID NO: 5426411 - DNA, 22 bp, Homo sapiens
gcttcacctctgggaccccagc

SEQ ID NO: 5426412 - DNA, 14 bp, Homo sapiens
gcttcaccttggag

SEQ ID NO: 5426413 - DNA, 15 bp, Homo sapiens
gcttcacggaagagc

SEQ ID NO: 5426414 - DNA, 20 bp, Homo sapiens
gcttcacggaagagccttgc

SEQ ID NO: 5426415 - DNA, 23 bp, Homo sapiens
gcttcacggacaggaagcacagc

SEQ ID NO: 5426416 - DNA, 16 bp, Homo sapiens
gcttcacggactcttt

SEQ ID NO: 5426417 - DNA, 16 bp, Homo sapiens
gcttcactcatgcaaa

SEQ ID NO: 5426418 - DNA, 18 bp, Homo sapiens
gcttcactcctgctgtaa

SEQ ID NO: 5426419 - DNA, 22 bp, Homo sapiens
gcttcactctatccaaagtgtc

SEQ ID NO: 5426420 - DNA, 18 bp, Homo sapiens
gcttcactctctccgtct

SEQ ID NO: 5426421 - DNA, 14 bp, Homo sapiens
gcttcactgaccag

SEQ ID NO: 5426422 - DNA, 15 bp, Homo sapiens
gcttcactgaccagc

SEQ ID NO: 5426423 - DNA, 23 bp, Homo sapiens
gcttcactgccccctccgtccca

SEQ ID NO: 5426424 - DNA, 15 bp, Homo sapiens
gcttcactgtataaa

SEQ ID NO: 5426425 - DNA, 12 bp, Homo sapiens
gcttcacttctg

SEQ ID NO: 5426426 - DNA, 17 bp, Homo sapiens
gcttcagaattaaaact

SEQ ID NO: 5426427 - DNA, 13 bp, Homo sapiens
gcttcagaattgt

SEQ ID NO: 5426428 - DNA, 12 bp, Homo sapiens
gcttcagagcct

SEQ ID NO: 5426429 - DNA, 16 bp, Homo sapiens
gcttcagagcctagcc

SEQ ID NO: 5426430 - DNA, 17 bp, Homo sapiens
gcttcagagcctagcca

SEQ ID NO: 5426431 - DNA, 19 bp, Homo sapiens
gcttcagagcctagccacc

SEQ ID NO: 5426432 - DNA, 19 bp, Homo sapiens
gcttcagaggcctggcatc

SEQ ID NO: 5426433 - DNA, 17 bp, Homo sapiens
gcttcagagtttgtgtg

SEQ ID NO: 5426434 - DNA, 16 bp, Homo sapiens
gcttcagcaggaggca

SEQ ID NO: 5426435 - DNA, 19 bp, Homo sapiens
gcttcagcatatttatagc

SEQ ID NO: 5426436 - DNA, 16 bp, Homo sapiens
gcttcagccacagttt

SEQ ID NO: 5426437 - DNA, 15 bp, Homo sapiens
gcttcagccaggagc

SEQ ID NO: 5426438 - DNA, 13 bp, Homo sapiens
gcttcagccaggc

SEQ ID NO: 5426439 - DNA, 16 bp, Homo sapiens
gcttcagcccccacca

SEQ ID NO: 5426440 - DNA, 17 bp, Homo sapiens
gcttcagcccctggggt

SEQ ID NO: 5426441 - DNA, 19 bp, Homo sapiens
gcttcagcccctggggtac

SEQ ID NO: 5426442 - DNA, 14 bp, Homo sapiens
gcttcagcctccca

SEQ ID NO: 5426443 - DNA, 21 bp, Homo sapiens
gcttcagcctcccacagtgct

SEQ ID NO: 5426444 - DNA, 17 bp, Homo sapiens
gcttcagcctccccacc

SEQ ID NO: 5426445 - DNA, 12 bp, Homo sapiens
gcttcagcctga

SEQ ID NO: 5426446 - DNA, 20 bp, Homo sapiens
gcttcagcctgaggctgaga

SEQ ID NO: 5426447 - DNA, 23 bp, Homo sapiens
gcttcagcctgaggctgagactg

SEQ ID NO: 5426448 - DNA, 22 bp, Homo sapiens
gcttcagctgctgaagggaggg

SEQ ID NO: 5426449 - DNA, 13 bp, Homo sapiens
gcttcaggaggga

SEQ ID NO: 5426450 - DNA, 17 bp, Homo sapiens
gcttcaggatactgtag

SEQ ID NO: 5426451 - DNA, 18 bp, Homo sapiens
gcttcaggcaccagcatc

SEQ ID NO: 5426452 - DNA, 13 bp, Homo sapiens
gcttcagggcagg

SEQ ID NO: 5426453 - DNA, 19 bp, Homo sapiens
gcttcagggcaggtggggt

SEQ ID NO: 5426454 - DNA, 23 bp, Homo sapiens
gcttcagggcgcacagcatgaga

SEQ ID NO: 5426455 - DNA, 13 bp, Homo sapiens
gcttcagggctgg

SEQ ID NO: 5426456 - DNA, 18 bp, Homo sapiens
gcttcagggctgggcagg

SEQ ID NO: 5426457 - DNA, 19 bp, Homo sapiens
gcttcaggggactgttctc

SEQ ID NO: 5426458 - DNA, 21 bp, Homo sapiens
gcttcaggtccaggctgtgtt

SEQ ID NO: 5426459 - DNA, 16 bp, Homo sapiens
gcttcaggtctctgtg

SEQ ID NO: 5426460 - DNA, 18 bp, Homo sapiens
gcttcaggtgagccaagg

SEQ ID NO: 5426461 - DNA, 22 bp, Homo sapiens
gcttcaggttagtgacatttaa

SEQ ID NO: 5426462 - DNA, 22 bp, Homo sapiens
gcttcaggttatcgaaataaca

SEQ ID NO: 5426463 - DNA, 16 bp, Homo sapiens
gcttcaggttgcattg

SEQ ID NO: 5426464 - DNA, 19 bp, Homo sapiens
gcttcagtaaaaggacctc

SEQ ID NO: 5426465 - DNA, 17 bp, Homo sapiens
gcttcagtaacaagtgt

SEQ ID NO: 5426466 - DNA, 23 bp, Homo sapiens
gcttcagtacttgtgaaacacag

SEQ ID NO: 5426467 - DNA, 19 bp, Homo sapiens
gcttcagtcatcagccagc

SEQ ID NO: 5426468 - DNA, 23 bp, Homo sapiens
gcttcagtggaaatcaatcagaa

SEQ ID NO: 5426469 - DNA, 14 bp, Homo sapiens
gcttcagtggagaa

SEQ ID NO: 5426470 - DNA, 15 bp, Homo sapiens
gcttcagtggcagct

SEQ ID NO: 5426471 - DNA, 20 bp, Homo sapiens
gcttcagtggcagctgcttt

SEQ ID NO: 5426472 - DNA, 18 bp, Homo sapiens
gcttcagttgttctttag

SEQ ID NO: 5426473 - DNA, 18 bp, Homo sapiens
gcttcagttgttttcccg

SEQ ID NO: 5426474 - DNA, 19 bp, Homo sapiens
gcttcagtttcctggtctg

SEQ ID NO: 5426475 - DNA, 22 bp, Homo sapiens
gcttcataaatgaagcagcttt

SEQ ID NO: 5426476 - DNA, 23 bp, Homo sapiens
gcttcatacttcatgaaatcctg

SEQ ID NO: 5426477 - DNA, 14 bp, Homo sapiens
gcttcatagagact

SEQ ID NO: 5426478 - DNA, 17 bp, Homo sapiens
gcttcatagagacttgg

SEQ ID NO: 5426479 - DNA, 14 bp, Homo sapiens
gcttcataggcaga

SEQ ID NO: 5426480 - DNA, 18 bp, Homo sapiens
gcttcataggcagagccc

SEQ ID NO: 5426481 - DNA, 21 bp, Homo sapiens
gcttcataggcagagcccgcc

SEQ ID NO: 5426482 - DNA, 18 bp, Homo sapiens
gcttcatagtattggagc

SEQ ID NO: 5426483 - DNA, 14 bp, Homo sapiens
gcttgattaaacag

SEQ ID NO: 5426484 - DNA, 19 bp, Homo sapiens
gcttgattctaaaggggac

SEQ ID NO: 5426485 - DNA, 18 bp, Homo sapiens
gcttgattttaatacatt

SEQ ID NO: 5426486 - DNA, 16 bp, Homo sapiens
gcttgcaatgtagtca

SEQ ID NO: 5426487 - DNA, 14 bp, Homo sapiens
gcttgcacacttcc

SEQ ID NO: 5426488 - DNA, 22 bp, Homo sapiens
gcttgcactgatgtccctcctt

SEQ ID NO: 5426489 - DNA, 11 bp, Homo sapiens
gcttgcagaac

SEQ ID NO: 5426490 - DNA, 17 bp, Homo sapiens
gcttgcagtgaagtgtt

SEQ ID NO: 5426491 - DNA, 19 bp, Homo sapiens
gcttgcagtgagccgagat

SEQ ID NO: 5426492 - DNA, 23 bp, Homo sapiens
gcttgcataataagctaaagagg

SEQ ID NO: 5426493 - DNA, 19 bp, Homo sapiens
gcttgcatcctatttggtg

SEQ ID NO: 5426494 - DNA, 13 bp, Homo sapiens
gcttgcatggaga

SEQ ID NO: 5426495 - DNA, 15 bp, Homo sapiens
gcttgccaaagcaga

SEQ ID NO: 5426496 - DNA, 17 bp, Homo sapiens
gcttgccaaagcagatt

SEQ ID NO: 5426497 - DNA, 21 bp, Homo sapiens
gcttgccaaagtacagaattt

SEQ ID NO: 5426498 - DNA, 15 bp, Homo sapiens
gcttgccaaggcaga

SEQ ID NO: 5426499 - DNA, 18 bp, Homo sapiens
gcttgccaaggcagaggc

SEQ ID NO: 5426500 - DNA, 14 bp, Homo sapiens
gcttgccacactct

SEQ ID NO: 5426501 - DNA, 21 bp, Homo sapiens
gcttgccacactcttcttcaa

SEQ ID NO: 5426502 - DNA, 14 bp, Homo sapiens
gcttgccacagagc

SEQ ID NO: 5426503 - DNA, 15 bp, Homo sapiens
gcttgccacagctct

SEQ ID NO: 5426504 - DNA, 16 bp, Homo sapiens
gcttgccatccctccc

SEQ ID NO: 5426505 - DNA, 17 bp, Homo sapiens
gcttgccatttttcaaa

SEQ ID NO: 5426506 - DNA, 24 bp, Homo sapiens
gcttgcccaagtcacacagctagt

SEQ ID NO: 5426507 - DNA, 15 bp, Homo sapiens
gcttgcccaggagca

SEQ ID NO: 5426508 - DNA, 23 bp, Homo sapiens
gcttgcccagtacatttaaattt

SEQ ID NO: 5426509 - DNA, 15 bp, Homo sapiens
gcttgccccaggact

SEQ ID NO: 5426510 - DNA, 17 bp, Homo sapiens
gcttgcccgctcccaca

SEQ ID NO: 5426511 - DNA, 19 bp, Homo sapiens
gcttgcccgctcccacagc

SEQ ID NO: 5426512 - DNA, 20 bp, Homo sapiens
gcttgccctaagcagaaagt

SEQ ID NO: 5426513 - DNA, 21 bp, Homo sapiens
gcttgccctaagcagaaagtg

SEQ ID NO: 5426514 - DNA, 17 bp, Homo sapiens
gcttgccctccaaatgt

SEQ ID NO: 5426515 - DNA, 16 bp, Homo sapiens
gcttgccgaaactgga

SEQ ID NO: 5426516 - DNA, 22 bp, Homo sapiens
gcttgccgactggctgtgagac

SEQ ID NO: 5426517 - DNA, 16 bp, Homo sapiens
gcttgccgggcctggg

SEQ ID NO: 5426518 - DNA, 24 bp, Homo sapiens
gcttgccgggcctgggcctcctgg

SEQ ID NO: 5426519 - DNA, 13 bp, Homo sapiens
gcttgcctagggc

SEQ ID NO: 5426520 - DNA, 21 bp, Homo sapiens
gcttgcctagggcctggtcca

SEQ ID NO: 5426521 - DNA, 14 bp, Homo sapiens
gcttgcctcggctc

SEQ ID NO: 5426522 - DNA, 15 bp, Homo sapiens
gcttgcctcggctcc

SEQ ID NO: 5426523 - DNA, 15 bp, Homo sapiens
gcttgcctctctgtt

SEQ ID NO: 5426524 - DNA, 14 bp, Homo sapiens
gcttgcctgcaggc

SEQ ID NO: 5426525 - DNA, 15 bp, Homo sapiens
gcttgcctgcagggc

SEQ ID NO: 5426526 - DNA, 17 bp, Homo sapiens
gcttgcctgcagggcca

SEQ ID NO: 5426527 - DNA, 22 bp, Homo sapiens
gcttgcctgcagggccatggct

SEQ ID NO: 5426528 - DNA, 23 bp, Homo sapiens
gcttgcctgggctgggcagcctt

SEQ ID NO: 5426529 - DNA, 14 bp, Homo sapiens
gcttgcctggtcac

SEQ ID NO: 5426530 - DNA, 19 bp, Homo sapiens
gcttgcctgtttcttctct

SEQ ID NO: 5426531 - DNA, 18 bp, Homo sapiens
gcttgctaccaatctgtg

SEQ ID NO: 5426532 - DNA, 21 bp, Homo sapiens
gcttgctccagattctgatgc

SEQ ID NO: 5426533 - DNA, 19 bp, Homo sapiens
gcttgctcccaagcccctg

SEQ ID NO: 5426534 - DNA, 20 bp, Homo sapiens
gcttgctcccgccccagggt

SEQ ID NO: 5426535 - DNA, 18 bp, Homo sapiens
gcttgctctcctggagca

SEQ ID NO: 5426536 - DNA, 14 bp, Homo sapiens
gcttgctgaggggc

SEQ ID NO: 5426537 - DNA, 15 bp, Homo sapiens
gcttgctgatggctg

SEQ ID NO: 5426538 - DNA, 21 bp, Homo sapiens
gcttgctgatggctgctggag

SEQ ID NO: 5426539 - DNA, 23 bp, Homo sapiens
gcttgctgatggctgctggaggg

SEQ ID NO: 5426540 - DNA, 21 bp, Homo sapiens
gcttgctgcaccccaagtcca

SEQ ID NO: 5426541 - DNA, 21 bp, Homo sapiens
gcttgctggaacacaggggcc

SEQ ID NO: 5426542 - DNA, 18 bp, Homo sapiens
gcttgctgggtacctggt

SEQ ID NO: 5426543 - DNA, 14 bp, Homo sapiens
gcttgctgttccca

SEQ ID NO: 5426544 - DNA, 20 bp, Homo sapiens
gcttgcttagagtgcccagc

SEQ ID NO: 5426545 - DNA, 14 bp, Homo sapiens
gcttgcttctctgc

SEQ ID NO: 5426546 - DNA, 15 bp, Homo sapiens
gcttgcttctgcagc

SEQ ID NO: 5426547 - DNA, 17 bp, Homo sapiens
gcttgcttgccgagcct

SEQ ID NO: 5426548 - DNA, 14 bp, Homo sapiens
gcttgcttttcatg

SEQ ID NO: 5426549 - DNA, 19 bp, Homo sapiens
gcttggaaagcatcacctc

SEQ ID NO: 5426550 - DNA, 21 bp, Homo sapiens
gcttggaaattccttgcccca

SEQ ID NO: 5426551 - DNA, 23 bp, Homo sapiens
gcttggaaattccttgccccaca

SEQ ID NO: 5426552 - DNA, 21 bp, Homo sapiens
gcttggaacccggtgctccct

SEQ ID NO: 5426553 - DNA, 15 bp, Homo sapiens
gcttggaagaaggaa

SEQ ID NO: 5426554 - DNA, 23 bp, Homo sapiens
gcttggaagagcctgcaggtgct

SEQ ID NO: 5426555 - DNA, 15 bp, Homo sapiens
gcttggacatcagtg

SEQ ID NO: 5426556 - DNA, 13 bp, Homo sapiens
gcttggaccactt

SEQ ID NO: 5426557 - DNA, 23 bp, Homo sapiens
gcttggacctcgtgctttaagtg

SEQ ID NO: 5426558 - DNA, 23 bp, Homo sapiens
gcttggactacacaatacagtat

SEQ ID NO: 5426559 - DNA, 19 bp, Homo sapiens
gcttggactacctataaat

SEQ ID NO: 5426560 - DNA, 16 bp, Homo sapiens
gcttggacttcctggg

SEQ ID NO: 5426561 - DNA, 22 bp, Homo sapiens
gcttggacttcctggggccccg

SEQ ID NO: 5426562 - DNA, 21 bp, Homo sapiens
gcttggagagtcttgggcctg

SEQ ID NO: 5426563 - DNA, 16 bp, Homo sapiens
gcttggagcagagacg

SEQ ID NO: 5426564 - DNA, 16 bp, Homo sapiens
gcttggagcagagggg

SEQ ID NO: 5426565 - DNA, 16 bp, Homo sapiens
gcttggagcagaggtg

SEQ ID NO: 5426566 - DNA, 18 bp, Homo sapiens
gcttggagccccctggcg

SEQ ID NO: 5426567 - DNA, 14 bp, Homo sapiens
gcttggagctgagc

SEQ ID NO: 5426568 - DNA, 20 bp, Homo sapiens
gcttggaggacaaataagaa

SEQ ID NO: 5426569 - DNA, 21 bp, Homo sapiens
gcttggagggaagggagaaag

SEQ ID NO: 5426570 - DNA, 20 bp, Homo sapiens
gcttggaggtcacagctgga

SEQ ID NO: 5426571 - DNA, 12 bp, Homo sapiens
gcttggagtgca

SEQ ID NO: 5426572 - DNA, 14 bp, Homo sapiens
gcttggagtgccac

SEQ ID NO: 5426573 - DNA, 19 bp, Homo sapiens
gcttggatcctgggctggg

SEQ ID NO: 5426574 - DNA, 15 bp, Homo sapiens
gcttggatctggggt

SEQ ID NO: 5426575 - DNA, 16 bp, Homo sapiens
gcttggatgtttttag

SEQ ID NO: 5426576 - DNA, 22 bp, Homo sapiens
gcttggatgtttttagttctga

SEQ ID NO: 5426577 - DNA, 17 bp, Homo sapiens
gcttggattctctgaga

SEQ ID NO: 5426578 - DNA, 20 bp, Homo sapiens
gcttggcaattcatggggca

SEQ ID NO: 5426579 - DNA, 15 bp, Homo sapiens
gcttggcagagagga

SEQ ID NO: 5426580 - DNA, 17 bp, Homo sapiens
gcttggccacagccagg

SEQ ID NO: 5426581 - DNA, 18 bp, Homo sapiens
gcttggccacagccaggg

SEQ ID NO: 5426582 - DNA, 15 bp, Homo sapiens
gcttggcccagcgcc

SEQ ID NO: 5426583 - DNA, 13 bp, Homo sapiens
gcttggcccagga

SEQ ID NO: 5426584 - DNA, 15 bp, Homo sapiens
gcttggcccaggagt

SEQ ID NO: 5426585 - DNA, 16 bp, Homo sapiens
gcttggcccaggagtt

SEQ ID NO: 5426586 - DNA, 16 bp, Homo sapiens
gcttggcccggccggc

SEQ ID NO: 5426587 - DNA, 23 bp, Homo sapiens
gcttggcccggccggcctggcac

SEQ ID NO: 5426588 - DNA, 23 bp, Homo sapiens
gcttggccctctttcctctgtgg

SEQ ID NO: 5426589 - DNA, 15 bp, Homo sapiens
gcttggccctgcgcc

SEQ ID NO: 5426590 - DNA, 18 bp, Homo sapiens
gcttggccctgcgccctg

SEQ ID NO: 5426591 - DNA, 14 bp, Homo sapiens
gcttggccctggca

SEQ ID NO: 5426592 - DNA, 15 bp, Homo sapiens
gcttggccctggcag

SEQ ID NO: 5426593 - DNA, 17 bp, Homo sapiens
gcttggccctggcagcc

SEQ ID NO: 5426594 - DNA, 15 bp, Homo sapiens
gcttggccctttcct

SEQ ID NO: 5426595 - DNA, 20 bp, Homo sapiens
gcttggccgccatccgggac

SEQ ID NO: 5426596 - DNA, 13 bp, Homo sapiens
gcttggcctggag

SEQ ID NO: 5426597 - DNA, 18 bp, Homo sapiens
gcttggccttgggccggt

SEQ ID NO: 5426598 - DNA, 12 bp, Homo sapiens
gcttggccttgt

SEQ ID NO: 5426599 - DNA, 20 bp, Homo sapiens
gcttggcggctctagcccca

SEQ ID NO: 5426600 - DNA, 19 bp, Homo sapiens
gcttggcgtggagcaggcg

SEQ ID NO: 5426601 - DNA, 22 bp, Homo sapiens
gcttggctcacaaggcccagga

SEQ ID NO: 5426602 - DNA, 14 bp, Homo sapiens
gcttggctcgcacc

SEQ ID NO: 5426603 - DNA, 16 bp, Homo sapiens
gcttggctcgcacccc

SEQ ID NO: 5426604 - DNA, 20 bp, Homo sapiens
gcttggctctcctctggcta

SEQ ID NO: 5426605 - DNA, 23 bp, Homo sapiens
gcttggctcttggcttccagaag

SEQ ID NO: 5426606 - DNA, 13 bp, Homo sapiens
gcttggctgcccc

SEQ ID NO: 5426607 - DNA, 16 bp, Homo sapiens
gcttggctgtcccctc

SEQ ID NO: 5426608 - DNA, 15 bp, Homo sapiens
gcttggcttatgaaa

SEQ ID NO: 5426609 - DNA, 16 bp, Homo sapiens
gcttggcttcccctcc

SEQ ID NO: 5426610 - DNA, 22 bp, Homo sapiens
gcttggcttcccctccacccta

SEQ ID NO: 5426611 - DNA, 22 bp, Homo sapiens
gcttggcttcctcttcttgttg

SEQ ID NO: 5426612 - DNA, 23 bp, Homo sapiens
gcttgggacgtgtacagcacaga

SEQ ID NO: 5426613 - DNA, 19 bp, Homo sapiens
gcttgggactcaggtctgt

SEQ ID NO: 5426614 - DNA, 21 bp, Homo sapiens
gcttgggactcaggtctgtaa

SEQ ID NO: 5426615 - DNA, 21 bp, Homo sapiens
gcttgggagagcccctggggc

SEQ ID NO: 5426616 - DNA, 21 bp, Homo sapiens
gcttgggagagtcaggcaggg

SEQ ID NO: 5426617 - DNA, 13 bp, Homo sapiens
gcttgggagcctg

SEQ ID NO: 5426618 - DNA, 20 bp, Homo sapiens
gcttgggaggaaacctgaga

SEQ ID NO: 5426619 - DNA, 16 bp, Homo sapiens
gcttgggcagatctcc

SEQ ID NO: 5426620 - DNA, 18 bp, Homo sapiens
gcttgggccactgccctc

SEQ ID NO: 5426621 - DNA, 22 bp, Homo sapiens
gcttgggccactgccctctcca

SEQ ID NO: 5426622 - DNA, 14 bp, Homo sapiens
gcttgggcccagct

SEQ ID NO: 5426623 - DNA, 15 bp, Homo sapiens
gcttgggcccagctg

SEQ ID NO: 5426624 - DNA, 19 bp, Homo sapiens
gcttgggcccagctgggct

SEQ ID NO: 5426625 - DNA, 20 bp, Homo sapiens
gcttgggcccagtagcccca

SEQ ID NO: 5426626 - DNA, 13 bp, Homo sapiens
gcttgggcctgca

SEQ ID NO: 5426627 - DNA, 18 bp, Homo sapiens
gcttgggctgacccagca

SEQ ID NO: 5426628 - DNA, 23 bp, Homo sapiens
gcttgggctgacccagcatctcc

SEQ ID NO: 5426629 - DNA, 16 bp, Homo sapiens
gcttgggctggtcaga

SEQ ID NO: 5426630 - DNA, 23 bp, Homo sapiens
gcttgggcttccatttgtgtgtg

SEQ ID NO: 5426631 - DNA, 12 bp, Homo sapiens
gcttggggaaaa

SEQ ID NO: 5426632 - DNA, 22 bp, Homo sapiens
gcttggggaccagagctgccac

SEQ ID NO: 5426633 - DNA, 18 bp, Homo sapiens
gcttggggacctgaactg

SEQ ID NO: 5426634 - DNA, 14 bp, Homo sapiens
gcttggggagcaga

SEQ ID NO: 5426635 - DNA, 16 bp, Homo sapiens
gcttggggagcagagt

SEQ ID NO: 5426636 - DNA, 21 bp, Homo sapiens
gcttggggagcaggtctctgg

SEQ ID NO: 5426637 - DNA, 23 bp, Homo sapiens
gcttggggagcaggtctctggca

SEQ ID NO: 5426638 - DNA, 23 bp, Homo sapiens
gcttggggccaccaaagctgccc

SEQ ID NO: 5426639 - DNA, 16 bp, Homo sapiens
gcttggggctatttgt

SEQ ID NO: 5426640 - DNA, 23 bp, Homo sapiens
gcttggggctgcacctcctaccc

SEQ ID NO: 5426641 - DNA, 16 bp, Homo sapiens
gcttggggcttcctaa

SEQ ID NO: 5426642 - DNA, 20 bp, Homo sapiens
gcttggggggctccaggggg

SEQ ID NO: 5426643 - DNA, 22 bp, Homo sapiens
gcttgggggttttcaatgtgaa

SEQ ID NO: 5426644 - DNA, 18 bp, Homo sapiens
gcttggggtagagaggac

SEQ ID NO: 5426645 - DNA, 20 bp, Homo sapiens
gcttggggtgtggggtgggg

SEQ ID NO: 5426646 - DNA, 22 bp, Homo sapiens
gcttgggtcctactcctggagc

SEQ ID NO: 5426647 - DNA, 13 bp, Homo sapiens
gcttgggtggaga

SEQ ID NO: 5426648 - DNA, 16 bp, Homo sapiens
gcttgggtggagaagc

SEQ ID NO: 5426649 - DNA, 17 bp, Homo sapiens
gcttgggtggagaagcc

SEQ ID NO: 5426650 - DNA, 19 bp, Homo sapiens
gcttgggtggagaagccat

SEQ ID NO: 5426651 - DNA, 17 bp, Homo sapiens
gcttggtaaaacacaga

SEQ ID NO: 5426652 - DNA, 24 bp, Homo sapiens
gcttggtagttaacacatcaaata

SEQ ID NO: 5426653 - DNA, 18 bp, Homo sapiens
gcttggtcctagggtggg

SEQ ID NO: 5426654 - DNA, 23 bp, Homo sapiens
gcttggtctagaatggatttttc

SEQ ID NO: 5426655 - DNA, 15 bp, Homo sapiens
gcttggtctgtttga

SEQ ID NO: 5426656 - DNA, 15 bp, Homo sapiens
gcttggtgagtctgt

SEQ ID NO: 5426657 - DNA, 13 bp, Homo sapiens
gcttggtgcatga

SEQ ID NO: 5426658 - DNA, 22 bp, Homo sapiens
gcttggtggccaagcctggccc

SEQ ID NO: 5426659 - DNA, 14 bp, Homo sapiens
gctttgacgggcca

SEQ ID NO: 5426660 - DNA, 20 bp, Homo sapiens
gctttgacgtattatctgtt

SEQ ID NO: 5426661 - DNA, 16 bp, Homo sapiens
gctttgactcaggagc

SEQ ID NO: 5426662 - DNA, 20 bp, Homo sapiens
gctttgactctataagcaaa

SEQ ID NO: 5426663 - DNA, 13 bp, Homo sapiens
gctttgagacagg

SEQ ID NO: 5426664 - DNA, 21 bp, Homo sapiens
gctttgagacaggtgcctggg

SEQ ID NO: 5426665 - DNA, 22 bp, Homo sapiens
gctttgagacaggtgcctgggg

SEQ ID NO: 5426666 - DNA, 19 bp, Homo sapiens
gctttgagcccacaggagc

SEQ ID NO: 5426667 - DNA, 18 bp, Homo sapiens
gctttgaggacaaagaga

SEQ ID NO: 5426668 - DNA, 15 bp, Homo sapiens
gctttgaggccgaag

SEQ ID NO: 5426669 - DNA, 23 bp, Homo sapiens
gctttgaggccgaagctgctgtg

SEQ ID NO: 5426670 - DNA, 22 bp, Homo sapiens
gctttgaggtggaagagggctg

SEQ ID NO: 5426671 - DNA, 15 bp, Homo sapiens
gctttgagtccccca

SEQ ID NO: 5426672 - DNA, 16 bp, Homo sapiens
gctttgataaaatatt

SEQ ID NO: 5426673 - DNA, 19 bp, Homo sapiens
gctttgataaaatatttta

SEQ ID NO: 5426674 - DNA, 14 bp, Homo sapiens
gctttgataatgtc

SEQ ID NO: 5426675 - DNA, 14 bp, Homo sapiens
gctttgatggagga

SEQ ID NO: 5426676 - DNA, 15 bp, Homo sapiens
gctttgatggaggag

SEQ ID NO: 5426677 - DNA, 19 bp, Homo sapiens
gctttgatgttccttccag

SEQ ID NO: 5426678 - DNA, 21 bp, Homo sapiens
gctttgattaatccagaataa

SEQ ID NO: 5426679 - DNA, 21 bp, Homo sapiens
gctttgattagttttcttgtt

SEQ ID NO: 5426680 - DNA, 16 bp, Homo sapiens
gctttgattccatctc

SEQ ID NO: 5426681 - DNA, 21 bp, Homo sapiens
gctttgcaaattcaagagcct

SEQ ID NO: 5426682 - DNA, 17 bp, Homo sapiens
gctttgcacccctttcc

SEQ ID NO: 5426683 - DNA, 23 bp, Homo sapiens
gctttgcacccctttcctcccca

SEQ ID NO: 5426684 - DNA, 13 bp, Homo sapiens
gctttgcactttt

SEQ ID NO: 5426685 - DNA, 16 bp, Homo sapiens
gctttgcagaccgcat

SEQ ID NO: 5426686 - DNA, 16 bp, Homo sapiens
gctttgcagctgctgt

SEQ ID NO: 5426687 - DNA, 17 bp, Homo sapiens
gctttgcagctgctgtc

SEQ ID NO: 5426688 - DNA, 16 bp, Homo sapiens
gctttgcaggctctgg

SEQ ID NO: 5426689 - DNA, 18 bp, Homo sapiens
gctttgcaggctctgggc

SEQ ID NO: 5426690 - DNA, 12 bp, Homo sapiens
gctttgcagtgc

SEQ ID NO: 5426691 - DNA, 18 bp, Homo sapiens
gctttgcatgttccacta

SEQ ID NO: 5426692 - DNA, 14 bp, Homo sapiens
gctttgcatttctt

SEQ ID NO: 5426693 - DNA, 21 bp, Homo sapiens
gctttgcattttaaaaatgaa

SEQ ID NO: 5426694 - DNA, 23 bp, Homo sapiens
gctttgcattttgatattgctgt

SEQ ID NO: 5426695 - DNA, 18 bp, Homo sapiens
gctttgccaaaataccag

SEQ ID NO: 5426696 - DNA, 21 bp, Homo sapiens
gctttgccaaaataccagagc

SEQ ID NO: 5426697 - DNA, 13 bp, Homo sapiens
gctttgccagagc

SEQ ID NO: 5426698 - DNA, 15 bp, Homo sapiens
gctttgccagagcag

SEQ ID NO: 5426699 - DNA, 16 bp, Homo sapiens
gctttgccagagcagg

SEQ ID NO: 5426700 - DNA, 14 bp, Homo sapiens
gctttgccagctgc

SEQ ID NO: 5426701 - DNA, 19 bp, Homo sapiens
gctttgccatgggcctgct

SEQ ID NO: 5426702 - DNA, 20 bp, Homo sapiens
gctttgcccaacaccagccc

SEQ ID NO: 5426703 - DNA, 19 bp, Homo sapiens
gctttgccctgctgccctc

SEQ ID NO: 5426704 - DNA, 19 bp, Homo sapiens
gctttgcctcgaaagtgtc

SEQ ID NO: 5426705 - DNA, 12 bp, Homo sapiens
gctttgcctctt

SEQ ID NO: 5426706 - DNA, 14 bp, Homo sapiens
gctttgcctgcttg

SEQ ID NO: 5426707 - DNA, 20 bp, Homo sapiens
gctttgcctggttttgtctt

SEQ ID NO: 5426708 - DNA, 17 bp, Homo sapiens
gctttgccttgcagcca

SEQ ID NO: 5426709 - DNA, 19 bp, Homo sapiens
gctttgcgctggtggacca

SEQ ID NO: 5426710 - DNA, 16 bp, Homo sapiens
gctttgcgtgcccggg

SEQ ID NO: 5426711 - DNA, 22 bp, Homo sapiens
gctttgctacaaatttatgcat

SEQ ID NO: 5426712 - DNA, 15 bp, Homo sapiens
gctttgctccttcag

SEQ ID NO: 5426713 - DNA, 18 bp, Homo sapiens
gctttgctctagggaagc

SEQ ID NO: 5426714 - DNA, 13 bp, Homo sapiens
gctttgctctgcc

SEQ ID NO: 5426715 - DNA, 22 bp, Homo sapiens
gctttgctgcacaaacatgaaa

SEQ ID NO: 5426716 - DNA, 16 bp, Homo sapiens
gctttgctgctacagg

SEQ ID NO: 5426717 - DNA, 13 bp, Homo sapiens
gctttgctgctat

SEQ ID NO: 5426718 - DNA, 22 bp, Homo sapiens
gctttgctggagtcctgttctc

SEQ ID NO: 5426719 - DNA, 12 bp, Homo sapiens
gctttgcttctt

SEQ ID NO: 5426720 - DNA, 12 bp, Homo sapiens
gctttggaaaca

SEQ ID NO: 5426721 - DNA, 16 bp, Homo sapiens
gctttggaaagacctg

SEQ ID NO: 5426722 - DNA, 21 bp, Homo sapiens
gctttggaagcagcaaggtgg

SEQ ID NO: 5426723 - DNA, 14 bp, Homo sapiens
gctttggaagccat

SEQ ID NO: 5426724 - DNA, 14 bp, Homo sapiens
gctttggaagtttt

SEQ ID NO: 5426725 - DNA, 22 bp, Homo sapiens
gctttggaatattttatcctgt

SEQ ID NO: 5426726 - DNA, 18 bp, Homo sapiens
gctttggaatgctccagg

SEQ ID NO: 5426727 - DNA, 19 bp, Homo sapiens
gctttggacacacacagct

SEQ ID NO: 5426728 - DNA, 18 bp, Homo sapiens
gctttggacgcacacagc

SEQ ID NO: 5426729 - DNA, 19 bp, Homo sapiens
gctttggacgcacacagct

SEQ ID NO: 5426730 - DNA, 21 bp, Homo sapiens
gctttggatagtctcctacgc

SEQ ID NO: 5426731 - DNA, 18 bp, Homo sapiens
gctttggcagtgttttgg

SEQ ID NO: 5426732 - DNA, 12 bp, Homo sapiens
gctttggccttt

SEQ ID NO: 5426733 - DNA, 23 bp, Homo sapiens
gctttggcgaccccaatatatgt

SEQ ID NO: 5426734 - DNA, 14 bp, Homo sapiens
gctttggctgactg

SEQ ID NO: 5426735 - DNA, 19 bp, Homo sapiens
gctttggctgactgggaac

SEQ ID NO: 5426736 - DNA, 16 bp, Homo sapiens
gctttggctgagacct

SEQ ID NO: 5426737 - DNA, 15 bp, Homo sapiens
gctttggctgagggg

SEQ ID NO: 5426738 - DNA, 13 bp, Homo sapiens
gctttggcttctt

SEQ ID NO: 5426739 - DNA, 16 bp, Homo sapiens
gctttgggaaagccca

SEQ ID NO: 5426740 - DNA, 22 bp, Homo sapiens
gctttgggaacactggcctggg

SEQ ID NO: 5426741 - DNA, 15 bp, Homo sapiens
gctttgggagaatgt

SEQ ID NO: 5426742 - DNA, 18 bp, Homo sapiens
gctttgggaggccaaggc

SEQ ID NO: 5426743 - DNA, 18 bp, Homo sapiens
gctttgggatcccaccct

SEQ ID NO: 5426744 - DNA, 16 bp, Homo sapiens
gctttgggcagatttg

SEQ ID NO: 5426745 - DNA, 11 bp, Homo sapiens
gctttgggccc

SEQ ID NO: 5426746 - DNA, 12 bp, Homo sapiens
gctttgggccca

SEQ ID NO: 5426747 - DNA, 21 bp, Homo sapiens
gctttgggcccaagaactgca

SEQ ID NO: 5426748 - DNA, 13 bp, Homo sapiens
gctttgggccgaa

SEQ ID NO: 5426749 - DNA, 21 bp, Homo sapiens
gctttgggccgaatcccccag

SEQ ID NO: 5426750 - DNA, 14 bp, Homo sapiens
gctttgggctgccc

SEQ ID NO: 5426751 - DNA, 20 bp, Homo sapiens
gctttggggacagttggcag

SEQ ID NO: 5426752 - DNA, 15 bp, Homo sapiens
gctttggggctggtg

SEQ ID NO: 5426753 - DNA, 20 bp, Homo sapiens
gctttggggcttatcagaac

SEQ ID NO: 5426754 - DNA, 23 bp, Homo sapiens
gctttgggggagtgggcgcagtg

SEQ ID NO: 5426755 - DNA, 21 bp, Homo sapiens
gctttggggggtgtgctgaca

SEQ ID NO: 5426756 - DNA, 20 bp, Homo sapiens
gctttgggtcatttttaact

SEQ ID NO: 5426757 - DNA, 18 bp, Homo sapiens
gctttggtaaaacagttt

SEQ ID NO: 5426758 - DNA, 14 bp, Homo sapiens
gctttggtccccag

SEQ ID NO: 5426759 - DNA, 16 bp, Homo sapiens
gctttggtggccaggg

SEQ ID NO: 5426760 - DNA, 17 bp, Homo sapiens
gctttggtggccaggga

SEQ ID NO: 5426761 - DNA, 18 bp, Homo sapiens
gctttggtggcccctccc

SEQ ID NO: 5426762 - DNA, 15 bp, Homo sapiens
gctttggttatgaaa

SEQ ID NO: 5426763 - DNA, 16 bp, Homo sapiens
gctttggtttaaaaga

SEQ ID NO: 5426764 - DNA, 15 bp, Homo sapiens
gctttggtttatatt

SEQ ID NO: 5426765 - DNA, 21 bp, Homo sapiens
gctttgtaaaccggctggacc

SEQ ID NO: 5426766 - DNA, 16 bp, Homo sapiens
gctttgtacttgtgat

SEQ ID NO: 5426767 - DNA, 15 bp, Homo sapiens
gctttgtaggtgtct

SEQ ID NO: 5426768 - DNA, 16 bp, Homo sapiens
gctttgtaggtgtctc

SEQ ID NO: 5426769 - DNA, 13 bp, Homo sapiens
gctttgtagtttg

SEQ ID NO: 5426770 - DNA, 14 bp, Homo sapiens
gctttgtatagaac

SEQ ID NO: 5426771 - DNA, 20 bp, Homo sapiens
gctttgtatagaacctcttt

SEQ ID NO: 5426772 - DNA, 17 bp, Homo sapiens
gctttgtccatgatgtc

SEQ ID NO: 5426773 - DNA, 19 bp, Homo sapiens
gctttgtcccacagcttgg

SEQ ID NO: 5426774 - DNA, 15 bp, Homo sapiens
gctttgtcccctgct

SEQ ID NO: 5426775 - DNA, 16 bp, Homo sapiens
gctttgtcccctgctt

SEQ ID NO: 5426776 - DNA, 19 bp, Homo sapiens
gctttgtcgtatttggcac

SEQ ID NO: 5426777 - DNA, 20 bp, Homo sapiens
gctttgtctccaaagaagat

SEQ ID NO: 5426778 - DNA, 13 bp, Homo sapiens
gctttgtctctgt

SEQ ID NO: 5426779 - DNA, 16 bp, Homo sapiens
gctttgtctgtccagc

SEQ ID NO: 5426780 - DNA, 14 bp, Homo sapiens
gctttgtctgtcgt

SEQ ID NO: 5426781 - DNA, 12 bp, Homo sapiens
gctttgtcttga

SEQ ID NO: 5426782 - DNA, 14 bp, Homo sapiens
gctttgtgactatt

SEQ ID NO: 5426783 - DNA, 22 bp, Homo sapiens
gctttgtgagagaggacctcca

SEQ ID NO: 5426784 - DNA, 14 bp, Homo sapiens
gctttgtgcctttg

SEQ ID NO: 5426785 - DNA, 19 bp, Homo sapiens
gctttgtgcctttgggcac

SEQ ID NO: 5426786 - DNA, 22 bp, Homo sapiens
gctttgtggcactggggcaggg

SEQ ID NO: 5426787 - DNA, 18 bp, Homo sapiens
gctttgtgggctccaggc

SEQ ID NO: 5426788 - DNA, 18 bp, Homo sapiens
gctttgtgtcgtcttgaa

SEQ ID NO: 5426789 - DNA, 17 bp, Homo sapiens
gctttgtgtttactttt

SEQ ID NO: 5426790 - DNA, 20 bp, Homo sapiens
gctttgtgtttggtttacat

SEQ ID NO: 5426791 - DNA, 21 bp, Homo sapiens
gctttgtgtttggtttacatt

SEQ ID NO: 5426792 - DNA, 22 bp, Homo sapiens
gctttgtgtttggtttacattt

SEQ ID NO: 5426793 - DNA, 19 bp, Homo sapiens
gctttgttaccttaaaact

SEQ ID NO: 5426794 - DNA, 14 bp, Homo sapiens
gctttgttgtcctc

SEQ ID NO: 5426795 - DNA, 18 bp, Homo sapiens
gctttgttgtgagaatgg

SEQ ID NO: 5426796 - DNA, 15 bp, Homo sapiens
gctttgttgtgtgcc

SEQ ID NO: 5426797 - DNA, 17 bp, Homo sapiens
gctttgttgtgtgcctc

SEQ ID NO: 5426798 - DNA, 18 bp, Homo sapiens
gctttgttgtgtgcctct

SEQ ID NO: 5426799 - DNA, 19 bp, Homo sapiens
gctttgttgtgtgcctcta

SEQ ID NO: 5426800 - DNA, 21 bp, Homo sapiens
gctttgtttaacccaaaagat

SEQ ID NO: 5426801 - DNA, 20 bp, Homo sapiens
gctttgtttgtttgttttct

SEQ ID NO: 5426802 - DNA, 16 bp, Homo sapiens
gctttgttttccctgg

SEQ ID NO: 5426803 - DNA, 14 bp, Homo sapiens
gctttgttttgcac

SEQ ID NO: 5426804 - DNA, 23 bp, Homo sapiens
gctttgttttgcacactttgcca

SEQ ID NO: 5426805 - DNA, 16 bp, Homo sapiens
gcttttaaaaaatatt

SEQ ID NO: 5426806 - DNA, 15 bp, Homo sapiens
gcttttaaaaatttt

SEQ ID NO: 5426807 - DNA, 14 bp, Homo sapiens
gcttttaaaagatt

SEQ ID NO: 5426808 - DNA, 16 bp, Homo sapiens
gcttttaaaaggaaaa

SEQ ID NO: 5426809 - DNA, 14 bp, Homo sapiens
gcttttaaaatttt

SEQ ID NO: 5426810 - DNA, 16 bp, Homo sapiens
gcttttaaaattttaa

SEQ ID NO: 5426811 - DNA, 20 bp, Homo sapiens
gcttttaaactggagaggct

SEQ ID NO: 5426812 - DNA, 17 bp, Homo sapiens
gcttttaaccatctgat

SEQ ID NO: 5426813 - DNA, 18 bp, Homo sapiens
gcttttaaggaaaggcaa

SEQ ID NO: 5426814 - DNA, 15 bp, Homo sapiens
gcttttaagtttttc

SEQ ID NO: 5426815 - DNA, 23 bp, Homo sapiens
gcttttaataaaattgacaacat

SEQ ID NO: 5426816 - DNA, 17 bp, Homo sapiens
gcttttaataaactgca

SEQ ID NO: 5426817 - DNA, 14 bp, Homo sapiens
gcttttaatggatg

SEQ ID NO: 5426818 - DNA, 19 bp, Homo sapiens
gcttttaattctcatttgt

SEQ ID NO: 5426819 - DNA, 16 bp, Homo sapiens
gcttttaattgcacca

SEQ ID NO: 5426820 - DNA, 23 bp, Homo sapiens
gcttttaattttaatcctggagt

SEQ ID NO: 5426821 - DNA, 15 bp, Homo sapiens
gcttttaccatgccc

SEQ ID NO: 5426822 - DNA, 22 bp, Homo sapiens
gcttttaccctttttcttgaat

SEQ ID NO: 5426823 - DNA, 20 bp, Homo sapiens
gcttttacgtagtaaaagtc

SEQ ID NO: 5426824 - DNA, 19 bp, Homo sapiens
gcttttactgaactttctt

SEQ ID NO: 5426825 - DNA, 13 bp, Homo sapiens
gcttttactgttt

SEQ ID NO: 5426826 - DNA, 13 bp, Homo sapiens
gcttttactttat

SEQ ID NO: 5426827 - DNA, 16 bp, Homo sapiens
gcttttagaatgcagg

SEQ ID NO: 5426828 - DNA, 21 bp, Homo sapiens
gcttttagtattttagtgaac

SEQ ID NO: 5426829 - DNA, 20 bp, Homo sapiens
gcttttagttcatatataca

SEQ ID NO: 5426830 - DNA, 15 bp, Homo sapiens
gcttttagtttttct

SEQ ID NO: 5426831 - DNA, 16 bp, Homo sapiens
gcttttatagaggcta

SEQ ID NO: 5426832 - DNA, 19 bp, Homo sapiens
gcttttatagaggctagct

SEQ ID NO: 5426833 - DNA, 22 bp, Homo sapiens
gcttttatagaggctagcttct

SEQ ID NO: 5426834 - DNA, 12 bp, Homo sapiens
gcttttatctgc

SEQ ID NO: 5426835 - DNA, 14 bp, Homo sapiens
gcttttatgaggaa

SEQ ID NO: 5426836 - DNA, 14 bp, Homo sapiens
gcttttatggatga

SEQ ID NO: 5426837 - DNA, 19 bp, Homo sapiens
ggaaagacaactgttttaa

SEQ ID NO: 5426838 - DNA, 15 bp, Homo sapiens
ggaaagacactgcct

SEQ ID NO: 5426839 - DNA, 21 bp, Homo sapiens
ggaaagaccctaggtgctcat

SEQ ID NO: 5426840 - DNA, 15 bp, Homo sapiens
ggaaagaggagaagg

SEQ ID NO: 5426841 - DNA, 18 bp, Homo sapiens
ggaaagaggagaaggaga

SEQ ID NO: 5426842 - DNA, 20 bp, Homo sapiens
ggaaagaggaggcagaaaga

SEQ ID NO: 5426843 - DNA, 21 bp, Homo sapiens
ggaaagaggaggcagaaagat

SEQ ID NO: 5426844 - DNA, 17 bp, Homo sapiens
ggaaagagtaggaagac

SEQ ID NO: 5426845 - DNA, 19 bp, Homo sapiens
ggaaagagtgatgcctggg

SEQ ID NO: 5426846 - DNA, 20 bp, Homo sapiens
ggaaagatcccaagtcaaac

SEQ ID NO: 5426847 - DNA, 14 bp, Homo sapiens
ggaaagatggataa

SEQ ID NO: 5426848 - DNA, 17 bp, Homo sapiens
ggaaagatggggagctc

SEQ ID NO: 5426849 - DNA, 16 bp, Homo sapiens
ggaaagattgtgtctg

SEQ ID NO: 5426850 - DNA, 16 bp, Homo sapiens
ggaaagcaaaataaca

SEQ ID NO: 5426851 - DNA, 21 bp, Homo sapiens
ggaaagcaaagcacagagagt

SEQ ID NO: 5426852 - DNA, 22 bp, Homo sapiens
ggaaagcaacttcatcccagct

SEQ ID NO: 5426853 - DNA, 21 bp, Homo sapiens
ggaaagcacaagactggccca

SEQ ID NO: 5426854 - DNA, 16 bp, Homo sapiens
ggaaagcacaggtggg

SEQ ID NO: 5426855 - DNA, 19 bp, Homo sapiens
ggaaagcagcctggccaac

SEQ ID NO: 5426856 - DNA, 19 bp, Homo sapiens
ggaaagcagctcaaaggca

SEQ ID NO: 5426857 - DNA, 21 bp, Homo sapiens
ggaaagcaggtggcatctcta

SEQ ID NO: 5426858 - DNA, 18 bp, Homo sapiens
ggaaagcatttaggagaa

SEQ ID NO: 5426859 - DNA, 13 bp, Homo sapiens
ggaaagccagcct

SEQ ID NO: 5426860 - DNA, 19 bp, Homo sapiens
ggaaagccagcctgggggc

SEQ ID NO: 5426861 - DNA, 20 bp, Homo sapiens
ggaaagccagcctgggggct

SEQ ID NO: 5426862 - DNA, 18 bp, Homo sapiens
ggaaagccatgaccttgt

SEQ ID NO: 5426863 - DNA, 16 bp, Homo sapiens
ggaaagcccctgcccc

SEQ ID NO: 5426864 - DNA, 16 bp, Homo sapiens
ggaaagccctccccct

SEQ ID NO: 5426865 - DNA, 20 bp, Homo sapiens
ggaaagcctcaggagagagt

SEQ ID NO: 5426866 - DNA, 13 bp, Homo sapiens
ggaaagcctctgg

SEQ ID NO: 5426867 - DNA, 14 bp, Homo sapiens
ggaaagcctctggc

SEQ ID NO: 5426868 - DNA, 22 bp, Homo sapiens
ggaaagcctctggccgtcacac

SEQ ID NO: 5426869 - DNA, 19 bp, Homo sapiens
ggaaagcgcctccaaccct

SEQ ID NO: 5426870 - DNA, 15 bp, Homo sapiens
ggaaagctaggcttc

SEQ ID NO: 5426871 - DNA, 20 bp, Homo sapiens
ggaaagctatatctatttga

SEQ ID NO: 5426872 - DNA, 23 bp, Homo sapiens
ggaaagctcagctactgattttt

SEQ ID NO: 5426873 - DNA, 19 bp, Homo sapiens
ggaaagcttttcagtgttc

SEQ ID NO: 5426874 - DNA, 21 bp, Homo sapiens
ggaaagcttttctattttaat

SEQ ID NO: 5426875 - DNA, 15 bp, Homo sapiens
ggaaaggacccaccc

SEQ ID NO: 5426876 - DNA, 19 bp, Homo sapiens
ggaaaggacccacccatct

SEQ ID NO: 5426877 - DNA, 15 bp, Homo sapiens
ggaaaggaggaccag

SEQ ID NO: 5426878 - DNA, 16 bp, Homo sapiens
ggaaaggatattttct

SEQ ID NO: 5426879 - DNA, 15 bp, Homo sapiens
ggaaaggatctgtga

SEQ ID NO: 5426880 - DNA, 21 bp, Homo sapiens
ggaaaggatgatcaaaaataa

SEQ ID NO: 5426881 - DNA, 18 bp, Homo sapiens
ggaaaggcaaatgcccaa

SEQ ID NO: 5426882 - DNA, 15 bp, Homo sapiens
ggaaaggcaagcttg

SEQ ID NO: 5426883 - DNA, 21 bp, Homo sapiens
ggaaaggcaagcttgaggcca

SEQ ID NO: 5426884 - DNA, 12 bp, Homo sapiens
ggaaaggcaggg

SEQ ID NO: 5426885 - DNA, 18 bp, Homo sapiens
ggaaaggccggtgggaag

SEQ ID NO: 5426886 - DNA, 16 bp, Homo sapiens
ggaaaggctcatttaa

SEQ ID NO: 5426887 - DNA, 20 bp, Homo sapiens
ggaaaggctcatttaaaaca

SEQ ID NO: 5426888 - DNA, 17 bp, Homo sapiens
ggaaaggctccaggagc

SEQ ID NO: 5426889 - DNA, 19 bp, Homo sapiens
ggaaaggctccaggagcag

SEQ ID NO: 5426890 - DNA, 15 bp, Homo sapiens
ggaaaggctctgaaa

SEQ ID NO: 5426891 - DNA, 18 bp, Homo sapiens
ggaaagggatggtcaggc

SEQ ID NO: 5426892 - DNA, 21 bp, Homo sapiens
ggaaagggccctccttcctaa

SEQ ID NO: 5426893 - DNA, 22 bp, Homo sapiens
ggaaagggccctccttcctaaa

SEQ ID NO: 5426894 - DNA, 12 bp, Homo sapiens
ggaaaggggaga

SEQ ID NO: 5426895 - DNA, 21 bp, Homo sapiens
ggaaaggggagagcctgctgg

SEQ ID NO: 5426896 - DNA, 21 bp, Homo sapiens
ggaaaggggttggggtgacag

SEQ ID NO: 5426897 - DNA, 15 bp, Homo sapiens
ggaaagggtgctgct

SEQ ID NO: 5426898 - DNA, 23 bp, Homo sapiens
ggaaagggttcacataggctctc

SEQ ID NO: 5426899 - DNA, 17 bp, Homo sapiens
ggaaaggtcctgctgtg

SEQ ID NO: 5426900 - DNA, 20 bp, Homo sapiens
ggaaaggtgctcaaagatgt

SEQ ID NO: 5426901 - DNA, 18 bp, Homo sapiens
ggaaaggtgtaggctggg

SEQ ID NO: 5426902 - DNA, 21 bp, Homo sapiens
ggaaaggtttcaagacttgat

SEQ ID NO: 5426903 - DNA, 19 bp, Homo sapiens
ggaaaggttttgtattttt

SEQ ID NO: 5426904 - DNA, 23 bp, Homo sapiens
ggaaagtaagggaagcagaagga

SEQ ID NO: 5426905 - DNA, 21 bp, Homo sapiens
ggaaagtacattttttgaaat

SEQ ID NO: 5426906 - DNA, 14 bp, Homo sapiens
ggaaagtcacccaa

SEQ ID NO: 5426907 - DNA, 11 bp, Homo sapiens
ggaaagtcaga

SEQ ID NO: 5426908 - DNA, 23 bp, Homo sapiens
ggaaagtcaggctagctgtgctg

SEQ ID NO: 5426909 - DNA, 16 bp, Homo sapiens
ggaaagtcattggctt

SEQ ID NO: 5426910 - DNA, 20 bp, Homo sapiens
ggaaagtcctgaactcctgg

SEQ ID NO: 5426911 - DNA, 14 bp, Homo sapiens
ggaaagtgaatttg

SEQ ID NO: 5426912 - DNA, 18 bp, Homo sapiens
ggaaagtgctttccagaa

SEQ ID NO: 5426913 - DNA, 13 bp, Homo sapiens
ggaaagtgtaaag

SEQ ID NO: 5426914 - DNA, 14 bp, Homo sapiens
ggaaagtgtaaagc

SEQ ID NO: 5426915 - DNA, 15 bp, Homo sapiens
ggaaagtgtaaagca

SEQ ID NO: 5426916 - DNA, 17 bp, Homo sapiens
ggaaagtgtaaagcatt

SEQ ID NO: 5426917 - DNA, 19 bp, Homo sapiens
ggaaagtgtgtatttaact

SEQ ID NO: 5426918 - DNA, 14 bp, Homo sapiens
ggaaagttctatta

SEQ ID NO: 5426919 - DNA, 20 bp, Homo sapiens
ggaaagttgggcccctgagg

SEQ ID NO: 5426920 - DNA, 14 bp, Homo sapiens
ggaaagtttctttg

SEQ ID NO: 5426921 - DNA, 17 bp, Homo sapiens
ggaaagtttctttgaaa

SEQ ID NO: 5426922 - DNA, 12 bp, Homo sapiens
ggaaagttttta

SEQ ID NO: 5426923 - DNA, 15 bp, Homo sapiens
ggaaataaaaatgtt

SEQ ID NO: 5426924 - DNA, 16 bp, Homo sapiens
ggaaataaaacctttc

SEQ ID NO: 5426925 - DNA, 18 bp, Homo sapiens
ggaaataaacctggagat

SEQ ID NO: 5426926 - DNA, 23 bp, Homo sapiens
ggaaataaacctggagatgatga

SEQ ID NO: 5426927 - DNA, 13 bp, Homo sapiens
ggaaataaagaaa

SEQ ID NO: 5426928 - DNA, 14 bp, Homo sapiens
ggaaataaagaaaa

SEQ ID NO: 5426929 - DNA, 16 bp, Homo sapiens
ggaaataaagaaaatt

SEQ ID NO: 5426930 - DNA, 13 bp, Homo sapiens
ggaaataaatcta

SEQ ID NO: 5426931 - DNA, 14 bp, Homo sapiens
ggaaataacagaga

SEQ ID NO: 5426932 - DNA, 16 bp, Homo sapiens
ggaaataacagtattt

SEQ ID NO: 5426933 - DNA, 20 bp, Homo sapiens
ggaaataagcaaaaaactgc

SEQ ID NO: 5426934 - DNA, 20 bp, Homo sapiens
ggaaataataaagatgctct

SEQ ID NO: 5426935 - DNA, 20 bp, Homo sapiens
ggaaatacaaggagggcctc

SEQ ID NO: 5426936 - DNA, 18 bp, Homo sapiens
ggaaatacacttcttttg

SEQ ID NO: 5426937 - DNA, 13 bp, Homo sapiens
ggaaatacattta

SEQ ID NO: 5426938 - DNA, 15 bp, Homo sapiens
ggaaatacatttaga

SEQ ID NO: 5426939 - DNA, 17 bp, Homo sapiens
ggaaatactcgttttta

SEQ ID NO: 5426940 - DNA, 20 bp, Homo sapiens
ggaaatactttgcataaatt

SEQ ID NO: 5426941 - DNA, 13 bp, Homo sapiens
ggaaatagaaaga

SEQ ID NO: 5426942 - DNA, 14 bp, Homo sapiens
ggaaatagctaata

SEQ ID NO: 5426943 - DNA, 20 bp, Homo sapiens
ggaaatagtctgattttaat

SEQ ID NO: 5426944 - DNA, 22 bp, Homo sapiens
ggaaatatcagttactcagccc

SEQ ID NO: 5426945 - DNA, 12 bp, Homo sapiens
ggaaatatcata

SEQ ID NO: 5426946 - DNA, 14 bp, Homo sapiens
ggaaatatctgtga

SEQ ID NO: 5426947 - DNA, 14 bp, Homo sapiens
ggaaatatgaatgc

SEQ ID NO: 5426948 - DNA, 15 bp, Homo sapiens
ggaaatatgcactgc

SEQ ID NO: 5426949 - DNA, 15 bp, Homo sapiens
ggaaatattaaaaga

SEQ ID NO: 5426950 - DNA, 14 bp, Homo sapiens
ggaaatattatgca

SEQ ID NO: 5426951 - DNA, 22 bp, Homo sapiens
ggaaatcaaaagggccaaagaa

SEQ ID NO: 5426952 - DNA, 17 bp, Homo sapiens
ggaaatcaaatatgcaa

SEQ ID NO: 5426953 - DNA, 15 bp, Homo sapiens
ggaaatcaaatccca

SEQ ID NO: 5426954 - DNA, 19 bp, Homo sapiens
ggaaatcaaccctctcctg

SEQ ID NO: 5426955 - DNA, 23 bp, Homo sapiens
ggaaatcaccgaaaacgtggctg

SEQ ID NO: 5426956 - DNA, 18 bp, Homo sapiens
ggaaatcagccaagtttt

SEQ ID NO: 5426957 - DNA, 21 bp, Homo sapiens
ggaaatcaggtagaccatatt

SEQ ID NO: 5426958 - DNA, 18 bp, Homo sapiens
ggaaatcagtagaaagct

SEQ ID NO: 5426959 - DNA, 22 bp, Homo sapiens
ggaaatcagtagaaagctaaag

SEQ ID NO: 5426960 - DNA, 19 bp, Homo sapiens
ggaaatcatcgaaaattca

SEQ ID NO: 5426961 - DNA, 13 bp, Homo sapiens
ggaaatccagata

SEQ ID NO: 5426962 - DNA, 15 bp, Homo sapiens
ggaaatcccttcata

SEQ ID NO: 5426963 - DNA, 18 bp, Homo sapiens
ggaaatccctttctgcta

SEQ ID NO: 5426964 - DNA, 13 bp, Homo sapiens
ggaaatcctgtta

SEQ ID NO: 5426965 - DNA, 23 bp, Homo sapiens
ggaaatcgggttcagaacacttt

SEQ ID NO: 5426966 - DNA, 19 bp, Homo sapiens
ggaaatctggattttcagc

SEQ ID NO: 5426967 - DNA, 15 bp, Homo sapiens
ggaaatctgttttgt

SEQ ID NO: 5426968 - DNA, 20 bp, Homo sapiens
ggaaatctttcaacttattt

SEQ ID NO: 5426969 - DNA, 19 bp, Homo sapiens
ggaaatcttttacattttt

SEQ ID NO: 5426970 - DNA, 15 bp, Homo sapiens
ggaaatgaagcaggg

SEQ ID NO: 5426971 - DNA, 16 bp, Homo sapiens
ggaaatgaatgtgtgt

SEQ ID NO: 5426972 - DNA, 16 bp, Homo sapiens
ggaaatgacagcgggg

SEQ ID NO: 5426973 - DNA, 16 bp, Homo sapiens
ggaaatgagtggccag

SEQ ID NO: 5426974 - DNA, 21 bp, Homo sapiens
ggaaatgagtggccagcgcca

SEQ ID NO: 5426975 - DNA, 23 bp, Homo sapiens
ggaaatgagtggccagcgccagg

SEQ ID NO: 5426976 - DNA, 16 bp, Homo sapiens
ggaaatgcaagctctg

SEQ ID NO: 5426977 - DNA, 13 bp, Homo sapiens
ggaaatgcattta

SEQ ID NO: 5426978 - DNA, 14 bp, Homo sapiens
ggaaatgcatttat

SEQ ID NO: 5426979 - DNA, 22 bp, Homo sapiens
ggaaatgctattgttgtgggct

SEQ ID NO: 5426980 - DNA, 14 bp, Homo sapiens
ggaaatgctgattt

SEQ ID NO: 5426981 - DNA, 15 bp, Homo sapiens
ggaaatgctgggctg

SEQ ID NO: 5426982 - DNA, 15 bp, Homo sapiens
ggaaatggagggtgg

SEQ ID NO: 5426983 - DNA, 23 bp, Homo sapiens
ggaaatggccattgagctgtttc

SEQ ID NO: 5426984 - DNA, 13 bp, Homo sapiens
ggaaatggccttc

SEQ ID NO: 5426985 - DNA, 16 bp, Homo sapiens
ggaaatggccttcccg

SEQ ID NO: 5426986 - DNA, 23 bp, Homo sapiens
ggaaatgggaaaaaacttaaaaa

SEQ ID NO: 5426987 - DNA, 18 bp, Homo sapiens
ggaaatgggcagagcaga

SEQ ID NO: 5426988 - DNA, 16 bp, Homo sapiens
ggaaatggggagctgg

SEQ ID NO: 5426989 - DNA, 18 bp, Homo sapiens
ggaaatggtatccagaat

SEQ ID NO: 5426990 - DNA, 21 bp, Homo sapiens
ggaaatggtttccatctgtac

SEQ ID NO: 5426991 - DNA, 17 bp, Homo sapiens
ggaaatgtacacttttt

SEQ ID NO: 5426992 - DNA, 12 bp, Homo sapiens
ggaaatgtactt

SEQ ID NO: 5426993 - DNA, 19 bp, Homo sapiens
ggaaatgtcatctaaccat

SEQ ID NO: 5426994 - DNA, 16 bp, Homo sapiens
ggaaatgtctgctggt

SEQ ID NO: 5426995 - DNA, 15 bp, Homo sapiens
ggaaatgtggagaag

SEQ ID NO: 5426996 - DNA, 14 bp, Homo sapiens
ggaaatgttaagaa

SEQ ID NO: 5426997 - DNA, 15 bp, Homo sapiens
ggaaatgttaagaaa

SEQ ID NO: 5426998 - DNA, 14 bp, Homo sapiens
ggaaatgttactgt

SEQ ID NO: 5426999 - DNA, 18 bp, Homo sapiens
ggaaatgttgtgggggtg

SEQ ID NO: 5427000 - DNA, 14 bp, Homo sapiens
ggaaatgttttaat

SEQ ID NO: 5427001 - DNA, 18 bp, Homo sapiens
ggaaatgttttgtaaaca

SEQ ID NO: 5427002 - DNA, 12 bp, Homo sapiens
ggaaattaaagt

SEQ ID NO: 5427003 - DNA, 23 bp, Homo sapiens
ggaaattcaaagcataaaacttt

SEQ ID NO: 5427004 - DNA, 22 bp, Homo sapiens
ggaaattcaaccccagaaattg

SEQ ID NO: 5427005 - DNA, 23 bp, Homo sapiens
ggaaattcaggtgaaaatgttca

SEQ ID NO: 5427006 - DNA, 11 bp, Homo sapiens
ggaaattcagt

SEQ ID NO: 5427007 - DNA, 22 bp, Homo sapiens
ggaaattcccttcatctggaac

SEQ ID NO: 5427008 - DNA, 16 bp, Homo sapiens
ggaaattcctgtactg

SEQ ID NO: 5427009 - DNA, 21 bp, Homo sapiens
ggaaattccttgccccacagt

SEQ ID NO: 5427010 - DNA, 22 bp, Homo sapiens
ggaaattccttgccccacagtt

SEQ ID NO: 5427011 - DNA, 14 bp, Homo sapiens
ggaaattctgctgc

SEQ ID NO: 5427012 - DNA, 17 bp, Homo sapiens
ggaaattcttccctggg

SEQ ID NO: 5427013 - DNA, 19 bp, Homo sapiens
ggaaattgaagtgtcttct

SEQ ID NO: 5427014 - DNA, 20 bp, Homo sapiens
ggaaattgaagtgtcttctg

SEQ ID NO: 5427015 - DNA, 19 bp, Homo sapiens
ggaagagtgactctccagg

SEQ ID NO: 5427016 - DNA, 16 bp, Homo sapiens
ggaagataagttggaa

SEQ ID NO: 5427017 - DNA, 14 bp, Homo sapiens
ggaagatagctgtg

SEQ ID NO: 5427018 - DNA, 17 bp, Homo sapiens
ggaagataggctctgca

SEQ ID NO: 5427019 - DNA, 21 bp, Homo sapiens
ggaagatatgccactaacttc

SEQ ID NO: 5427020 - DNA, 15 bp, Homo sapiens
ggaagatattccttt

SEQ ID NO: 5427021 - DNA, 22 bp, Homo sapiens
ggaagatattcctttttaactt

SEQ ID NO: 5427022 - DNA, 22 bp, Homo sapiens
ggaagatcctgcgggtggggct

SEQ ID NO: 5427023 - DNA, 16 bp, Homo sapiens
ggaagatcctgtgagg

SEQ ID NO: 5427024 - DNA, 18 bp, Homo sapiens
ggaagatctacctgcaac

SEQ ID NO: 5427025 - DNA, 17 bp, Homo sapiens
ggaagatcttgagagct

SEQ ID NO: 5427026 - DNA, 23 bp, Homo sapiens
ggaagatcttgagagctgctgag

SEQ ID NO: 5427027 - DNA, 22 bp, Homo sapiens
ggaagatgaagagaagctgaga

SEQ ID NO: 5427028 - DNA, 17 bp, Homo sapiens
ggaagatgaggttctga

SEQ ID NO: 5427029 - DNA, 13 bp, Homo sapiens
ggaagatgccaag

SEQ ID NO: 5427030 - DNA, 22 bp, Homo sapiens
ggaagatggagacaccctctgg

SEQ ID NO: 5427031 - DNA, 17 bp, Homo sapiens
ggaagatgggaggtgga

SEQ ID NO: 5427032 - DNA, 18 bp, Homo sapiens
ggaagatggggaccagca

SEQ ID NO: 5427033 - DNA, 14 bp, Homo sapiens
ggaagatggtagca

SEQ ID NO: 5427034 - DNA, 18 bp, Homo sapiens
ggaagatggtagcagata

SEQ ID NO: 5427035 - DNA, 19 bp, Homo sapiens
ggaagatgtctcagagcct

SEQ ID NO: 5427036 - DNA, 20 bp, Homo sapiens
ggaagatgttcaatagaaca

SEQ ID NO: 5427037 - DNA, 14 bp, Homo sapiens
ggaagatgtttaca

SEQ ID NO: 5427038 - DNA, 14 bp, Homo sapiens
ggaagatttgaaaa

SEQ ID NO: 5427039 - DNA, 17 bp, Homo sapiens
ggaagatttggaagctc

SEQ ID NO: 5427040 - DNA, 16 bp, Homo sapiens
ggaagatttgtctact

SEQ ID NO: 5427041 - DNA, 18 bp, Homo sapiens
ggaagattttatgcacag

SEQ ID NO: 5427042 - DNA, 19 bp, Homo sapiens
ggaagattttatgcacagc

SEQ ID NO: 5427043 - DNA, 20 bp, Homo sapiens
ggaagattttatgcacagcc

SEQ ID NO: 5427044 - DNA, 18 bp, Homo sapiens
ggaagattttggtaatga

SEQ ID NO: 5427045 - DNA, 23 bp, Homo sapiens
ggaagcaaaatcccttaatctat

SEQ ID NO: 5427046 - DNA, 18 bp, Homo sapiens
ggaagcaaaggggggagg

SEQ ID NO: 5427047 - DNA, 23 bp, Homo sapiens
ggaagcaactccgtgtgcctggg

SEQ ID NO: 5427048 - DNA, 18 bp, Homo sapiens
ggaagcaagacgtaaaga

SEQ ID NO: 5427049 - DNA, 18 bp, Homo sapiens
ggaagcaagacgtcctgg

SEQ ID NO: 5427050 - DNA, 23 bp, Homo sapiens
ggaagcaagacgtcctggaatga

SEQ ID NO: 5427051 - DNA, 14 bp, Homo sapiens
ggaagcaaggccag

SEQ ID NO: 5427052 - DNA, 24 bp, Homo sapiens
ggaagcaataggtagctggggagc

SEQ ID NO: 5427053 - DNA, 21 bp, Homo sapiens
ggaagcacaagaagtgggagt

SEQ ID NO: 5427054 - DNA, 23 bp, Homo sapiens
ggaagcacactgcagggctgctg

SEQ ID NO: 5427055 - DNA, 16 bp, Homo sapiens
ggaagcacagaaaact

SEQ ID NO: 5427056 - DNA, 14 bp, Homo sapiens
ggaagcacagcagg

SEQ ID NO: 5427057 - DNA, 16 bp, Homo sapiens
ggaagcacagcctcgg

SEQ ID NO: 5427058 - DNA, 22 bp, Homo sapiens
ggaagcacagcctcggggatgg

SEQ ID NO: 5427059 - DNA, 17 bp, Homo sapiens
ggaagcacagcttcatt

SEQ ID NO: 5427060 - DNA, 15 bp, Homo sapiens
ggaagcacagcttgg

SEQ ID NO: 5427061 - DNA, 13 bp, Homo sapiens
ggaagcacaggcc

SEQ ID NO: 5427062 - DNA, 13 bp, Homo sapiens
ggaagcacaggtc

SEQ ID NO: 5427063 - DNA, 13 bp, Homo sapiens
ggaagcacatgcc

SEQ ID NO: 5427064 - DNA, 15 bp, Homo sapiens
ggaagcacatgcctc

SEQ ID NO: 5427065 - DNA, 21 bp, Homo sapiens
ggaagcacatgcctctctcag

SEQ ID NO: 5427066 - DNA, 23 bp, Homo sapiens
ggaagcacatgcctctctcaggc

SEQ ID NO: 5427067 - DNA, 14 bp, Homo sapiens
ggaagcaccagcct

SEQ ID NO: 5427068 - DNA, 15 bp, Homo sapiens
ggaagcaccagcctc

SEQ ID NO: 5427069 - DNA, 18 bp, Homo sapiens
ggaagcaccagcctcagt

SEQ ID NO: 5427070 - DNA, 23 bp, Homo sapiens
ggaagcactgccattagactgaa

SEQ ID NO: 5427071 - DNA, 18 bp, Homo sapiens
ggaagcagaaatccaagc

SEQ ID NO: 5427072 - DNA, 12 bp, Homo sapiens
ggaagcagaata

SEQ ID NO: 5427073 - DNA, 13 bp, Homo sapiens
ggaagcagaataa

SEQ ID NO: 5427074 - DNA, 19 bp, Homo sapiens
ggaagcagaataaagcaat

SEQ ID NO: 5427075 - DNA, 22 bp, Homo sapiens
ggaagcagaataaagcaatttt

SEQ ID NO: 5427076 - DNA, 16 bp, Homo sapiens
ggaagcagagcctggg

SEQ ID NO: 5427077 - DNA, 14 bp, Homo sapiens
ggaagcagaggccc

SEQ ID NO: 5427078 - DNA, 18 bp, Homo sapiens
ggaagcagaggccctgcc

SEQ ID NO: 5427079 - DNA, 20 bp, Homo sapiens
ggaagcagaggccctgcccc

SEQ ID NO: 5427080 - DNA, 19 bp, Homo sapiens
ggaagcagcaaggtggggg

SEQ ID NO: 5427081 - DNA, 12 bp, Homo sapiens
ggaagcagcagc

SEQ ID NO: 5427082 - DNA, 18 bp, Homo sapiens
ggaagcagcagcctcgcc

SEQ ID NO: 5427083 - DNA, 12 bp, Homo sapiens
ggaagcagccag

SEQ ID NO: 5427084 - DNA, 15 bp, Homo sapiens
ggaagcaggacccag

SEQ ID NO: 5427085 - DNA, 14 bp, Homo sapiens
ggaagcagggaatt

SEQ ID NO: 5427086 - DNA, 13 bp, Homo sapiens
ggaagcagggaga

SEQ ID NO: 5427087 - DNA, 22 bp, Homo sapiens
ggaagcaggtgtcctttcccct

SEQ ID NO: 5427088 - DNA, 14 bp, Homo sapiens
ggaagcagtgccca

SEQ ID NO: 5427089 - DNA, 18 bp, Homo sapiens
ggaagcagtgcccaggtg

SEQ ID NO: 5427090 - DNA, 10 bp, Homo sapiens
ggaagcagtt

SEQ ID NO: 5427091 - DNA, 15 bp, Homo sapiens
ggaagcagttggggc

SEQ ID NO: 5427092 - DNA, 19 bp, Homo sapiens
ggaagcagttggggccctc

SEQ ID NO: 5427093 - DNA, 18 bp, Homo sapiens
ggaagcatggctgtctgc

SEQ ID NO: 5427094 - DNA, 22 bp, Homo sapiens
ggaagcattactttgtagatgt

SEQ ID NO: 5427095 - DNA, 22 bp, Homo sapiens
ggaagcattgtaaaataattct

SEQ ID NO: 5427096 - DNA, 12 bp, Homo sapiens
ggaagcattttt

SEQ ID NO: 5427097 - DNA, 16 bp, Homo sapiens
ggaagccaaaggcagc

SEQ ID NO: 5427098 - DNA, 13 bp, Homo sapiens
ggaagccaaagtt

SEQ ID NO: 5427099 - DNA, 18 bp, Homo sapiens
ggaagccaacttggcttt

SEQ ID NO: 5427100 - DNA, 20 bp, Homo sapiens
ggaagccacgtgctggagag

SEQ ID NO: 5427101 - DNA, 12 bp, Homo sapiens
ggaagccagagc

SEQ ID NO: 5427102 - DNA, 17 bp, Homo sapiens
ggaagccagcaggctct

SEQ ID NO: 5427103 - DNA, 20 bp, Homo sapiens
ggaagccagcaggctctcag

SEQ ID NO: 5427104 - DNA, 16 bp, Homo sapiens
ggaagccagctttccc

SEQ ID NO: 5427105 - DNA, 14 bp, Homo sapiens
ggaagccaggctga

SEQ ID NO: 5427106 - DNA, 15 bp, Homo sapiens
ggaagccaggctgag

SEQ ID NO: 5427107 - DNA, 12 bp, Homo sapiens
ggaagccaggta

SEQ ID NO: 5427108 - DNA, 17 bp, Homo sapiens
ggaagccagtcaccttc

SEQ ID NO: 5427109 - DNA, 20 bp, Homo sapiens
ggaagccagtcaccttctgg

SEQ ID NO: 5427110 - DNA, 17 bp, Homo sapiens
ggaagccagtcagggcc

SEQ ID NO: 5427111 - DNA, 18 bp, Homo sapiens
ggaagccagtggagctgg

SEQ ID NO: 5427112 - DNA, 12 bp, Homo sapiens
ggaagcccacac

SEQ ID NO: 5427113 - DNA, 14 bp, Homo sapiens
ggaagcccacccgc

SEQ ID NO: 5427114 - DNA, 15 bp, Homo sapiens
ggaagcccacccgcc

SEQ ID NO: 5427115 - DNA, 16 bp, Homo sapiens
ggaagcccacccgccc

SEQ ID NO: 5427116 - DNA, 23 bp, Homo sapiens
ggaagcccacccgccccagagac

SEQ ID NO: 5427117 - DNA, 16 bp, Homo sapiens
ggaagcccagctccag

SEQ ID NO: 5427118 - DNA, 13 bp, Homo sapiens
ggaagcccaggct

SEQ ID NO: 5427119 - DNA, 15 bp, Homo sapiens
ggaagccccaacggg

SEQ ID NO: 5427120 - DNA, 11 bp, Homo sapiens
ggaagcccccc

SEQ ID NO: 5427121 - DNA, 22 bp, Homo sapiens
ggaagccccctcttcctccctg

SEQ ID NO: 5427122 - DNA, 15 bp, Homo sapiens
ggaagccccgctcag

SEQ ID NO: 5427123 - DNA, 19 bp, Homo sapiens
ggaagcccgcggggagaga

SEQ ID NO: 5427124 - DNA, 14 bp, Homo sapiens
ggaagccctcggcc

SEQ ID NO: 5427125 - DNA, 22 bp, Homo sapiens
ggaagccctcggcctccagact

SEQ ID NO: 5427126 - DNA, 15 bp, Homo sapiens
ggaagccctggagac

SEQ ID NO: 5427127 - DNA, 12 bp, Homo sapiens
ggaagccgcgcg

SEQ ID NO: 5427128 - DNA, 17 bp, Homo sapiens
ggaagccggtgtccctg

SEQ ID NO: 5427129 - DNA, 15 bp, Homo sapiens
ggaagccgtcctggc

SEQ ID NO: 5427130 - DNA, 18 bp, Homo sapiens
ggaagccgtctgactcca

SEQ ID NO: 5427131 - DNA, 20 bp, Homo sapiens
ggaagccgtctgactccaga

SEQ ID NO: 5427132 - DNA, 21 bp, Homo sapiens
ggaagccgtctgactccagag

SEQ ID NO: 5427133 - DNA, 17 bp, Homo sapiens
ggaagcctccccttggc

SEQ ID NO: 5427134 - DNA, 22 bp, Homo sapiens
ggaagcctgaactgaggccttg

SEQ ID NO: 5427135 - DNA, 15 bp, Homo sapiens
ggaagcctgattaaa

SEQ ID NO: 5427136 - DNA, 14 bp, Homo sapiens
ggaagcctgcagtc

SEQ ID NO: 5427137 - DNA, 12 bp, Homo sapiens
ggaagcctgtcc

SEQ ID NO: 5427138 - DNA, 13 bp, Homo sapiens
ggaagcctgtcct

SEQ ID NO: 5427139 - DNA, 16 bp, Homo sapiens
ggaagcctgtgccagc

SEQ ID NO: 5427140 - DNA, 17 bp, Homo sapiens
ggaagcctgtgccagca

SEQ ID NO: 5427141 - DNA, 12 bp, Homo sapiens
ggaagcctgtgg

SEQ ID NO: 5427142 - DNA, 23 bp, Homo sapiens
ggaagccttcttagaactctgct

SEQ ID NO: 5427143 - DNA, 11 bp, Homo sapiens
ggaagccttgc

SEQ ID NO: 5427144 - DNA, 17 bp, Homo sapiens
ggaagcgaaatattaca

SEQ ID NO: 5427145 - DNA, 13 bp, Homo sapiens
ggaagcgagcaga

SEQ ID NO: 5427146 - DNA, 14 bp, Homo sapiens
ggaagcgccaggct

SEQ ID NO: 5427147 - DNA, 20 bp, Homo sapiens
ggaagcgcgagggcctcaaa

SEQ ID NO: 5427148 - DNA, 19 bp, Homo sapiens
ggaagcgtcgccccagtgg

SEQ ID NO: 5427149 - DNA, 23 bp, Homo sapiens
ggaagcgtcgccccagtggcact

SEQ ID NO: 5427150 - DNA, 21 bp, Homo sapiens
ggaagcgtgaaggccgagaag

SEQ ID NO: 5427151 - DNA, 22 bp, Homo sapiens
ggaagctacaggttacaacaga

SEQ ID NO: 5427152 - DNA, 15 bp, Homo sapiens
ggaagctagtctttt

SEQ ID NO: 5427153 - DNA, 19 bp, Homo sapiens
ggaagctagtcttttgctt

SEQ ID NO: 5427154 - DNA, 24 bp, Homo sapiens
ggaagctcacacatcctgtcagtg

SEQ ID NO: 5427155 - DNA, 11 bp, Homo sapiens
ggaagctccgc

SEQ ID NO: 5427156 - DNA, 12 bp, Homo sapiens
ggaagctccttc

SEQ ID NO: 5427157 - DNA, 14 bp, Homo sapiens
ggaagctccttcct

SEQ ID NO: 5427158 - DNA, 15 bp, Homo sapiens
ggaagctccttcctg

SEQ ID NO: 5427159 - DNA, 23 bp, Homo sapiens
ggaagctctccgagctctggtgc

SEQ ID NO: 5427160 - DNA, 20 bp, Homo sapiens
ggaagctcttggagctgtga

SEQ ID NO: 5427161 - DNA, 13 bp, Homo sapiens
ggaagctgagcag

SEQ ID NO: 5427162 - DNA, 14 bp, Homo sapiens
ggaagctgagcagg

SEQ ID NO: 5427163 - DNA, 15 bp, Homo sapiens
ggaagctgagcaggc

SEQ ID NO: 5427164 - DNA, 16 bp, Homo sapiens
ggaagctgaggcagga

SEQ ID NO: 5427165 - DNA, 14 bp, Homo sapiens
ggaagctgaggccc

SEQ ID NO: 5427166 - DNA, 16 bp, Homo sapiens
ggaagctgattaaaac

SEQ ID NO: 5427167 - DNA, 11 bp, Homo sapiens
ggaagctgcag

SEQ ID NO: 5427168 - DNA, 14 bp, Homo sapiens
ggaagctgcagctt

SEQ ID NO: 5427169 - DNA, 17 bp, Homo sapiens
ggaagctgccagcccag

SEQ ID NO: 5427170 - DNA, 19 bp, Homo sapiens
ggaagctgccagcccagaa

SEQ ID NO: 5427171 - DNA, 13 bp, Homo sapiens
ggaagctgctact

SEQ ID NO: 5427172 - DNA, 16 bp, Homo sapiens
ggaagctgctagggga

SEQ ID NO: 5427173 - DNA, 16 bp, Homo sapiens
ggaagctgctgaggcc

SEQ ID NO: 5427174 - DNA, 23 bp, Homo sapiens
ggaagctgctgaggcccccaagt

SEQ ID NO: 5427175 - DNA, 13 bp, Homo sapiens
ggaagctggaaga

SEQ ID NO: 5427176 - DNA, 17 bp, Homo sapiens
ggaagctggcagaacgg

SEQ ID NO: 5427177 - DNA, 18 bp, Homo sapiens
ggaagctggcagaacgga

SEQ ID NO: 5427178 - DNA, 22 bp, Homo sapiens
ggaagctggcaggagacactgg

SEQ ID NO: 5427179 - DNA, 12 bp, Homo sapiens
ggaagctgggcc

SEQ ID NO: 5427180 - DNA, 14 bp, Homo sapiens
ggaagctgggccca

SEQ ID NO: 5427181 - DNA, 19 bp, Homo sapiens
ggaagctgtactcagagca

SEQ ID NO: 5427182 - DNA, 20 bp, Homo sapiens
ggaagctgtgcgtgtgtgtg

SEQ ID NO: 5427183 - DNA, 20 bp, Homo sapiens
ggaagctgtgttgaaacaga

SEQ ID NO: 5427184 - DNA, 21 bp, Homo sapiens
ggaagctgtgttgaaacagaa

SEQ ID NO: 5427185 - DNA, 22 bp, Homo sapiens
ggaagctgtgttgaaacagaaa

SEQ ID NO: 5427186 - DNA, 23 bp, Homo sapiens
ggaagctgtgttgaaacagaaaa

SEQ ID NO: 5427187 - DNA, 13 bp, Homo sapiens
ggaagcttctgtc

SEQ ID NO: 5427188 - DNA, 20 bp, Homo sapiens
ggaagcttgagcctccccca

SEQ ID NO: 5427189 - DNA, 14 bp, Homo sapiens
ggaagcttggcttc

SEQ ID NO: 5427190 - DNA, 14 bp, Homo sapiens
ggaagcttggggaa

SEQ ID NO: 5427191 - DNA, 20 bp, Homo sapiens
ggaagctttcaccagccaca

SEQ ID NO: 5427192 - DNA, 17 bp, Homo sapiens
ggaagctttggaagcag

SEQ ID NO: 5427193 - DNA, 20 bp, Homo sapiens
ggaagctttggtgagaacct

SEQ ID NO: 5427194 - DNA, 18 bp, Homo sapiens
ggaatgatagcccagaac

SEQ ID NO: 5427195 - DNA, 18 bp, Homo sapiens
ggaatgatgggcttttgt

SEQ ID NO: 5427196 - DNA, 16 bp, Homo sapiens
ggaatgcaagagaagg

SEQ ID NO: 5427197 - DNA, 14 bp, Homo sapiens
ggaatgcagcagga

SEQ ID NO: 5427198 - DNA, 18 bp, Homo sapiens
ggaatgcagggaagaggg

SEQ ID NO: 5427199 - DNA, 23 bp, Homo sapiens
ggaatgcagtgggtggggctgta

SEQ ID NO: 5427200 - DNA, 21 bp, Homo sapiens
ggaatgcatcccaccttgcca

SEQ ID NO: 5427201 - DNA, 12 bp, Homo sapiens
ggaatgcctgga

SEQ ID NO: 5427202 - DNA, 13 bp, Homo sapiens
ggaatgccttgga

SEQ ID NO: 5427203 - DNA, 16 bp, Homo sapiens
ggaatgcggcaagaag

SEQ ID NO: 5427204 - DNA, 23 bp, Homo sapiens
ggaatgcggccgcattccctgag

SEQ ID NO: 5427205 - DNA, 22 bp, Homo sapiens
ggaatgcgggggagcaggcagt

SEQ ID NO: 5427206 - DNA, 20 bp, Homo sapiens
ggaatgcggttgggaggcag

SEQ ID NO: 5427207 - DNA, 23 bp, Homo sapiens
ggaatgctcccccatcctcccct

SEQ ID NO: 5427208 - DNA, 21 bp, Homo sapiens
ggaatgctgacaatgctgcca

SEQ ID NO: 5427209 - DNA, 22 bp, Homo sapiens
ggaatgctgggtatgctctgtg

SEQ ID NO: 5427210 - DNA, 13 bp, Homo sapiens
ggaatgcttctgc

SEQ ID NO: 5427211 - DNA, 17 bp, Homo sapiens
ggaatggaactactgta

SEQ ID NO: 5427212 - DNA, 15 bp, Homo sapiens
ggaatggaaggcttt

SEQ ID NO: 5427213 - DNA, 21 bp, Homo sapiens
ggaatggaaggctttgccatg

SEQ ID NO: 5427214 - DNA, 12 bp, Homo sapiens
ggaatggaataa

SEQ ID NO: 5427215 - DNA, 16 bp, Homo sapiens
ggaatggactgggtgc

SEQ ID NO: 5427216 - DNA, 12 bp, Homo sapiens
ggaatggagctg

SEQ ID NO: 5427217 - DNA, 16 bp, Homo sapiens
ggaatggaggggcaga

SEQ ID NO: 5427218 - DNA, 21 bp, Homo sapiens
ggaatggaggggcagagccag

SEQ ID NO: 5427219 - DNA, 19 bp, Homo sapiens
ggaatggatttttctttaa

SEQ ID NO: 5427220 - DNA, 22 bp, Homo sapiens
ggaatggatttttctttaactg

SEQ ID NO: 5427221 - DNA, 22 bp, Homo sapiens
ggaatggattttttttttcagg

SEQ ID NO: 5427222 - DNA, 12 bp, Homo sapiens
ggaatggcagca

SEQ ID NO: 5427223 - DNA, 16 bp, Homo sapiens
ggaatggcagcagggg

SEQ ID NO: 5427224 - DNA, 17 bp, Homo sapiens
ggaatggccctcattca

SEQ ID NO: 5427225 - DNA, 11 bp, Homo sapiens
ggaatgggaga

SEQ ID NO: 5427226 - DNA, 16 bp, Homo sapiens
ggaatggggacctggg

SEQ ID NO: 5427227 - DNA, 18 bp, Homo sapiens
ggaatgggggccaggctg

SEQ ID NO: 5427228 - DNA, 16 bp, Homo sapiens
ggaatgggggcctctt

SEQ ID NO: 5427229 - DNA, 21 bp, Homo sapiens
ggaatgggtctgcacagattc

SEQ ID NO: 5427230 - DNA, 22 bp, Homo sapiens
ggaatggtaaccgagccagcag

SEQ ID NO: 5427231 - DNA, 18 bp, Homo sapiens
ggaatgtacagtattttg

SEQ ID NO: 5427232 - DNA, 16 bp, Homo sapiens
ggaatgtagggcctgc

SEQ ID NO: 5427233 - DNA, 21 bp, Homo sapiens
ggaatgtatagtatttgaaaa

SEQ ID NO: 5427234 - DNA, 14 bp, Homo sapiens
ggaatgtgccacag

SEQ ID NO: 5427235 - DNA, 22 bp, Homo sapiens
ggaatgtgccacagaggcccca

SEQ ID NO: 5427236 - DNA, 15 bp, Homo sapiens
ggaatgtgccacctg

SEQ ID NO: 5427237 - DNA, 19 bp, Homo sapiens
ggaatgtgccacctgtccg

SEQ ID NO: 5427238 - DNA, 20 bp, Homo sapiens
ggaatgtggtagtacccagg

SEQ ID NO: 5427239 - DNA, 17 bp, Homo sapiens
ggaatgtgtccaagaca

SEQ ID NO: 5427240 - DNA, 19 bp, Homo sapiens
ggaatgtgtccaagacaca

SEQ ID NO: 5427241 - DNA, 18 bp, Homo sapiens
ggaatgtgtcctcctgct

SEQ ID NO: 5427242 - DNA, 14 bp, Homo sapiens
ggaatgtgtgcctt

SEQ ID NO: 5427243 - DNA, 17 bp, Homo sapiens
ggaatgtgtgccttgtt

SEQ ID NO: 5427244 - DNA, 15 bp, Homo sapiens
ggaatgtgtggcctg

SEQ ID NO: 5427245 - DNA, 21 bp, Homo sapiens
ggaatgttccctgcaccctgg

SEQ ID NO: 5427246 - DNA, 15 bp, Homo sapiens
ggaatgttctttctg

SEQ ID NO: 5427247 - DNA, 18 bp, Homo sapiens
ggaatgttgttttctgac

SEQ ID NO: 5427248 - DNA, 14 bp, Homo sapiens
ggaattaaaaagaa

SEQ ID NO: 5427249 - DNA, 16 bp, Homo sapiens
ggaattaaaaagaaga

SEQ ID NO: 5427250 - DNA, 13 bp, Homo sapiens
ggaattaaatagt

SEQ ID NO: 5427251 - DNA, 16 bp, Homo sapiens
ggaattaaatagtgtg

SEQ ID NO: 5427252 - DNA, 16 bp, Homo sapiens
ggaattaacctggtgc

SEQ ID NO: 5427253 - DNA, 19 bp, Homo sapiens
ggaattacatgtaaaacat

SEQ ID NO: 5427254 - DNA, 13 bp, Homo sapiens
ggaattacatttt

SEQ ID NO: 5427255 - DNA, 21 bp, Homo sapiens
ggaattacctgataagggaga

SEQ ID NO: 5427256 - DNA, 14 bp, Homo sapiens
ggaattagagggcc

SEQ ID NO: 5427257 - DNA, 20 bp, Homo sapiens
ggaattagatgtttatatca

SEQ ID NO: 5427258 - DNA, 22 bp, Homo sapiens
ggaattagcttggggccaggga

SEQ ID NO: 5427259 - DNA, 23 bp, Homo sapiens
ggaattagtgagacatcagggag

SEQ ID NO: 5427260 - DNA, 19 bp, Homo sapiens
ggaattattagcaccagct

SEQ ID NO: 5427261 - DNA, 20 bp, Homo sapiens
ggaattattagcaccagctt

SEQ ID NO: 5427262 - DNA, 22 bp, Homo sapiens
ggaattattgtaccattttcta

SEQ ID NO: 5427263 - DNA, 14 bp, Homo sapiens
ggaattattttaaa

SEQ ID NO: 5427264 - DNA, 18 bp, Homo sapiens
ggaattattttgaatgtc

SEQ ID NO: 5427265 - DNA, 16 bp, Homo sapiens
ggaattcagcaccctg

SEQ ID NO: 5427266 - DNA, 14 bp, Homo sapiens
ggaattcagtgcct

SEQ ID NO: 5427267 - DNA, 20 bp, Homo sapiens
ggaattcatctctctttaat

SEQ ID NO: 5427268 - DNA, 14 bp, Homo sapiens
ggaattccaacttg

SEQ ID NO: 5427269 - DNA, 23 bp, Homo sapiens
ggaattccaacttgaaggattgc

SEQ ID NO: 5427270 - DNA, 17 bp, Homo sapiens
ggaattccaatatttat

SEQ ID NO: 5427271 - DNA, 21 bp, Homo sapiens
ggaattccaatatttataatt

SEQ ID NO: 5427272 - DNA, 17 bp, Homo sapiens
ggaattccaattaaatt

SEQ ID NO: 5427273 - DNA, 12 bp, Homo sapiens
ggaattccacct

SEQ ID NO: 5427274 - DNA, 22 bp, Homo sapiens
ggaattccacctggaaagccag

SEQ ID NO: 5427275 - DNA, 22 bp, Homo sapiens
ggaattccacgcccgggagtgg

SEQ ID NO: 5427276 - DNA, 14 bp, Homo sapiens
ggaattcctggaac

SEQ ID NO: 5427277 - DNA, 19 bp, Homo sapiens
ggaattcctggaacctgga

SEQ ID NO: 5427278 - DNA, 20 bp, Homo sapiens
ggaattcgtgttatgaatct

SEQ ID NO: 5427279 - DNA, 16 bp, Homo sapiens
ggaattctaaataaat

SEQ ID NO: 5427280 - DNA, 16 bp, Homo sapiens
ggaattctactggaaa

SEQ ID NO: 5427281 - DNA, 12 bp, Homo sapiens
ggaattctgtat

SEQ ID NO: 5427282 - DNA, 17 bp, Homo sapiens
ggaattctgtatagatt

SEQ ID NO: 5427283 - DNA, 19 bp, Homo sapiens
ggaattcttacagccaagt

SEQ ID NO: 5427284 - DNA, 16 bp, Homo sapiens
ggaattcttcctcctc

SEQ ID NO: 5427285 - DNA, 19 bp, Homo sapiens
ggaattgacattctctatt

SEQ ID NO: 5427286 - DNA, 19 bp, Homo sapiens
ggaattgacttcagcaggg

SEQ ID NO: 5427287 - DNA, 19 bp, Homo sapiens
ggaattgagaggtggggga

SEQ ID NO: 5427288 - DNA, 18 bp, Homo sapiens
ggaattgatttgcattga

SEQ ID NO: 5427289 - DNA, 22 bp, Homo sapiens
ggaattggagctcgtgggacag

SEQ ID NO: 5427290 - DNA, 15 bp, Homo sapiens
ggaattgggctccgt

SEQ ID NO: 5427291 - DNA, 21 bp, Homo sapiens
ggaattggtggcagattttac

SEQ ID NO: 5427292 - DNA, 14 bp, Homo sapiens
ggaattggtgtata

SEQ ID NO: 5427293 - DNA, 23 bp, Homo sapiens
ggaattgtggctatcctgattat

SEQ ID NO: 5427294 - DNA, 23 bp, Homo sapiens
ggaattgtttttataaaaacatt

SEQ ID NO: 5427295 - DNA, 14 bp, Homo sapiens
ggaatttaaaatta

SEQ ID NO: 5427296 - DNA, 17 bp, Homo sapiens
ggaatttataacaaata

SEQ ID NO: 5427297 - DNA, 16 bp, Homo sapiens
ggaatttcaaggtgta

SEQ ID NO: 5427298 - DNA, 17 bp, Homo sapiens
ggaatttcccaggaccc

SEQ ID NO: 5427299 - DNA, 19 bp, Homo sapiens
ggaatttccctgtgtggat

SEQ ID NO: 5427300 - DNA, 11 bp, Homo sapiens
ggaatttcctc

SEQ ID NO: 5427301 - DNA, 23 bp, Homo sapiens
ggaatttctcccagtcatttaat

SEQ ID NO: 5427302 - DNA, 18 bp, Homo sapiens
ggaatttcttaacttctt

SEQ ID NO: 5427303 - DNA, 22 bp, Homo sapiens
ggaatttcttaacttcttgctt

SEQ ID NO: 5427304 - DNA, 20 bp, Homo sapiens
ggaatttgattgctttgctg

SEQ ID NO: 5427305 - DNA, 21 bp, Homo sapiens
ggaatttgcaagtcatggctg

SEQ ID NO: 5427306 - DNA, 14 bp, Homo sapiens
ggaatttggctgct

SEQ ID NO: 5427307 - DNA, 13 bp, Homo sapiens
ggaatttgggcag

SEQ ID NO: 5427308 - DNA, 15 bp, Homo sapiens
ggaatttgggcagat

SEQ ID NO: 5427309 - DNA, 16 bp, Homo sapiens
ggaatttggtataatt

SEQ ID NO: 5427310 - DNA, 20 bp, Homo sapiens
ggaatttgtacgtttatacc

SEQ ID NO: 5427311 - DNA, 14 bp, Homo sapiens
ggaatttgtatttt

SEQ ID NO: 5427312 - DNA, 13 bp, Homo sapiens
ggaatttgtcagc

SEQ ID NO: 5427313 - DNA, 18 bp, Homo sapiens
ggaattttataagctgaa

SEQ ID NO: 5427314 - DNA, 17 bp, Homo sapiens
ggaattttcattttcat

SEQ ID NO: 5427315 - DNA, 20 bp, Homo sapiens
ggaattttctccaatttttt

SEQ ID NO: 5427316 - DNA, 17 bp, Homo sapiens
ggaattttctgttcata

SEQ ID NO: 5427317 - DNA, 13 bp, Homo sapiens
ggaattttgtaaa

SEQ ID NO: 5427318 - DNA, 12 bp, Homo sapiens
ggaatttttaaa

SEQ ID NO: 5427319 - DNA, 15 bp, Homo sapiens
ggaattttttattct

SEQ ID NO: 5427320 - DNA, 17 bp, Homo sapiens
ggaattttttattcttg

SEQ ID NO: 5427321 - DNA, 13 bp, Homo sapiens
ggacaaaataaag

SEQ ID NO: 5427322 - DNA, 14 bp, Homo sapiens
ggacaaaataaagt

SEQ ID NO: 5427323 - DNA, 15 bp, Homo sapiens
ggacaaaataaagtg

SEQ ID NO: 5427324 - DNA, 11 bp, Homo sapiens
ggacaaaatgg

SEQ ID NO: 5427325 - DNA, 14 bp, Homo sapiens
ggacaaaggagcct

SEQ ID NO: 5427326 - DNA, 17 bp, Homo sapiens
ggacaaagtgccaaaga

SEQ ID NO: 5427327 - DNA, 16 bp, Homo sapiens
ggacaaataagttttt

SEQ ID NO: 5427328 - DNA, 23 bp, Homo sapiens
ggacaaatcaagcttcagtttcc

SEQ ID NO: 5427329 - DNA, 20 bp, Homo sapiens
ggacaaattagcatgcaagc

SEQ ID NO: 5427330 - DNA, 20 bp, Homo sapiens
ggacaaattgagacagtgca

SEQ ID NO: 5427331 - DNA, 17 bp, Homo sapiens
ggacaaatttaaaacaa

SEQ ID NO: 5427332 - DNA, 22 bp, Homo sapiens
ggacaacactttccctctctgg

SEQ ID NO: 5427333 - DNA, 19 bp, Homo sapiens
ggacaacagtgctttgtaa

SEQ ID NO: 5427334 - DNA, 20 bp, Homo sapiens
ggacaacagtgctttgtaaa

SEQ ID NO: 5427335 - DNA, 15 bp, Homo sapiens
ggacaaccagaaggc

SEQ ID NO: 5427336 - DNA, 13 bp, Homo sapiens
ggacaacccagaa

SEQ ID NO: 5427337 - DNA, 19 bp, Homo sapiens
ggacaacctgcccctcccc

SEQ ID NO: 5427338 - DNA, 20 bp, Homo sapiens
ggacaacctgcccctcccca

SEQ ID NO: 5427339 - DNA, 14 bp, Homo sapiens
ggacaacttattta

SEQ ID NO: 5427340 - DNA, 14 bp, Homo sapiens
ggacaactttatgt

SEQ ID NO: 5427341 - DNA, 16 bp, Homo sapiens
ggacaagaagagtcct

SEQ ID NO: 5427342 - DNA, 13 bp, Homo sapiens
ggacaagaagctg

SEQ ID NO: 5427343 - DNA, 16 bp, Homo sapiens
ggacaagaagctgcta

SEQ ID NO: 5427344 - DNA, 13 bp, Homo sapiens
ggacaagaccctc

SEQ ID NO: 5427345 - DNA, 20 bp, Homo sapiens
ggacaagaccctctcaggct

SEQ ID NO: 5427346 - DNA, 20 bp, Homo sapiens
ggacaagcagaggtggccag

SEQ ID NO: 5427347 - DNA, 14 bp, Homo sapiens
ggacaagcccagga

SEQ ID NO: 5427348 - DNA, 15 bp, Homo sapiens
ggacaagcccaggac

SEQ ID NO: 5427349 - DNA, 18 bp, Homo sapiens
ggacaagcttctgagacg

SEQ ID NO: 5427350 - DNA, 17 bp, Homo sapiens
ggacaaggaagtggggg

SEQ ID NO: 5427351 - DNA, 22 bp, Homo sapiens
ggacaaggatgatctaggaaga

SEQ ID NO: 5427352 - DNA, 21 bp, Homo sapiens
ggacaaggccttgctcactca

SEQ ID NO: 5427353 - DNA, 21 bp, Homo sapiens
ggacaaggctgtgccaggctg

SEQ ID NO: 5427354 - DNA, 22 bp, Homo sapiens
ggacaagggaaaataaaaaaag

SEQ ID NO: 5427355 - DNA, 14 bp, Homo sapiens
ggacaagggattct

SEQ ID NO: 5427356 - DNA, 14 bp, Homo sapiens
ggacaagggctgct

SEQ ID NO: 5427357 - DNA, 17 bp, Homo sapiens
ggacaaggtgcaggcag

SEQ ID NO: 5427358 - DNA, 16 bp, Homo sapiens
ggacaagtaggtaaga

SEQ ID NO: 5427359 - DNA, 13 bp, Homo sapiens
ggacaataaacct

SEQ ID NO: 5427360 - DNA, 18 bp, Homo sapiens
ggacaatacagaacccat

SEQ ID NO: 5427361 - DNA, 15 bp, Homo sapiens
ggacaatatgtgcca

SEQ ID NO: 5427362 - DNA, 19 bp, Homo sapiens
ggacaatgtccaaacccac

SEQ ID NO: 5427363 - DNA, 17 bp, Homo sapiens
ggacaatttaccacagg

SEQ ID NO: 5427364 - DNA, 17 bp, Homo sapiens
ggacacaaaactccgcc

SEQ ID NO: 5427365 - DNA, 18 bp, Homo sapiens
ggacacaaaactccgccc

SEQ ID NO: 5427366 - DNA, 20 bp, Homo sapiens
ggacacaacagcagtctcct

SEQ ID NO: 5427367 - DNA, 13 bp, Homo sapiens
ggacacaagcggc

SEQ ID NO: 5427368 - DNA, 18 bp, Homo sapiens
ggacacacattctgcctt

SEQ ID NO: 5427369 - DNA, 23 bp, Homo sapiens
ggacacaccccacaccccagccc

SEQ ID NO: 5427370 - DNA, 18 bp, Homo sapiens
ggacacacctctgctcca

SEQ ID NO: 5427371 - DNA, 21 bp, Homo sapiens
ggacacactaaactctggggc

SEQ ID NO: 5427372 - DNA, 18 bp, Homo sapiens
ggaccaaaaaacctcact

SEQ ID NO: 5427373 - DNA, 15 bp, Homo sapiens
ggaccaaaactgcct

SEQ ID NO: 5427374 - DNA, 12 bp, Homo sapiens
ggaccaaagcaa

SEQ ID NO: 5427375 - DNA, 19 bp, Homo sapiens
ggaccaaagccacctgctg

SEQ ID NO: 5427376 - DNA, 22 bp, Homo sapiens
ggaccaaagggagtctgccagg

SEQ ID NO: 5427377 - DNA, 15 bp, Homo sapiens
ggaccaaaggtcagg

SEQ ID NO: 5427378 - DNA, 13 bp, Homo sapiens
ggaccaaatagcc

SEQ ID NO: 5427379 - DNA, 15 bp, Homo sapiens
ggaccaaatgtaaaa

SEQ ID NO: 5427380 - DNA, 18 bp, Homo sapiens
ggaccaaatgtaaaatat

SEQ ID NO: 5427381 - DNA, 15 bp, Homo sapiens
ggaccaaattgcttc

SEQ ID NO: 5427382 - DNA, 17 bp, Homo sapiens
ggaccaaccctggggaa

SEQ ID NO: 5427383 - DNA, 15 bp, Homo sapiens
ggaccaacctgctct

SEQ ID NO: 5427384 - DNA, 18 bp, Homo sapiens
ggaccaagatgggcacat

SEQ ID NO: 5427385 - DNA, 16 bp, Homo sapiens
ggaccaagatttacca

SEQ ID NO: 5427386 - DNA, 19 bp, Homo sapiens
ggaccaagcgaccaaggat

SEQ ID NO: 5427387 - DNA, 19 bp, Homo sapiens
ggaccaagcttaaggagag

SEQ ID NO: 5427388 - DNA, 22 bp, Homo sapiens
ggaccaagcttaaggagaggag

SEQ ID NO: 5427389 - DNA, 15 bp, Homo sapiens
ggaccaaggacccct

SEQ ID NO: 5427390 - DNA, 16 bp, Homo sapiens
ggaccaaggtgaagca

SEQ ID NO: 5427391 - DNA, 21 bp, Homo sapiens
ggaccacacagtccccagact

SEQ ID NO: 5427392 - DNA, 23 bp, Homo sapiens
ggaccacacagtccccagactca

SEQ ID NO: 5427393 - DNA, 14 bp, Homo sapiens
ggaccacagctgct

SEQ ID NO: 5427394 - DNA, 22 bp, Homo sapiens
ggaccacagctgctggccaggg

SEQ ID NO: 5427395 - DNA, 17 bp, Homo sapiens
ggaccacagtgggtggc

SEQ ID NO: 5427396 - DNA, 21 bp, Homo sapiens
ggaccacagtgggtggcacct

SEQ ID NO: 5427397 - DNA, 16 bp, Homo sapiens
ggaccacatctgtcct

SEQ ID NO: 5427398 - DNA, 17 bp, Homo sapiens
ggaccacatctgtcctc

SEQ ID NO: 5427399 - DNA, 13 bp, Homo sapiens
ggaccacatgcca

SEQ ID NO: 5427400 - DNA, 15 bp, Homo sapiens
ggaccacatgccact

SEQ ID NO: 5427401 - DNA, 18 bp, Homo sapiens
ggaccacatgccactgcc

SEQ ID NO: 5427402 - DNA, 21 bp, Homo sapiens
ggaccacatgccactgcctgc

SEQ ID NO: 5427403 - DNA, 22 bp, Homo sapiens
ggaccacatgccactgcctgca

SEQ ID NO: 5427404 - DNA, 14 bp, Homo sapiens
ggaccacattttat

SEQ ID NO: 5427405 - DNA, 14 bp, Homo sapiens
ggaccaccctgcca

SEQ ID NO: 5427406 - DNA, 22 bp, Homo sapiens
ggaccacctcctctgccagcag

SEQ ID NO: 5427407 - DNA, 16 bp, Homo sapiens
ggaccacgccgccctc

SEQ ID NO: 5427408 - DNA, 14 bp, Homo sapiens
ggaccactcctgtc

SEQ ID NO: 5427409 - DNA, 16 bp, Homo sapiens
ggaccactcctgtccc

SEQ ID NO: 5427410 - DNA, 16 bp, Homo sapiens
ggaccactcgaggcct

SEQ ID NO: 5427411 - DNA, 15 bp, Homo sapiens
ggaccactcttctct

SEQ ID NO: 5427412 - DNA, 19 bp, Homo sapiens
ggaccactgggtacaagag

SEQ ID NO: 5427413 - DNA, 18 bp, Homo sapiens
ggaccactgtttcttgct

SEQ ID NO: 5427414 - DNA, 19 bp, Homo sapiens
ggaccactgtttcttgctt

SEQ ID NO: 5427415 - DNA, 21 bp, Homo sapiens
ggaccactgtttcttgcttgt

SEQ ID NO: 5427416 - DNA, 19 bp, Homo sapiens
ggaccagaagccaaagact

SEQ ID NO: 5427417 - DNA, 15 bp, Homo sapiens
ggaccagaagctccc

SEQ ID NO: 5427418 - DNA, 13 bp, Homo sapiens
ggaccagagactt

SEQ ID NO: 5427419 - DNA, 13 bp, Homo sapiens
ggaccagagccag

SEQ ID NO: 5427420 - DNA, 14 bp, Homo sapiens
ggaccagagctgcc

SEQ ID NO: 5427421 - DNA, 15 bp, Homo sapiens
ggaccagagggatgg

SEQ ID NO: 5427422 - DNA, 19 bp, Homo sapiens
ggaccagcagccccacacc

SEQ ID NO: 5427423 - DNA, 17 bp, Homo sapiens
ggaccagcatctggtct

SEQ ID NO: 5427424 - DNA, 15 bp, Homo sapiens
ggaccagccagcagc

SEQ ID NO: 5427425 - DNA, 15 bp, Homo sapiens
ggaccagcccacgct

SEQ ID NO: 5427426 - DNA, 17 bp, Homo sapiens
ggaccagcccagcctgc

SEQ ID NO: 5427427 - DNA, 18 bp, Homo sapiens
ggaccagccgcccagatc

SEQ ID NO: 5427428 - DNA, 22 bp, Homo sapiens
ggaccagcctggcccaccccac

SEQ ID NO: 5427429 - DNA, 15 bp, Homo sapiens
ggaccagcctgtacc

SEQ ID NO: 5427430 - DNA, 13 bp, Homo sapiens
ggaccagctcagg

SEQ ID NO: 5427431 - DNA, 18 bp, Homo sapiens
ggaccagctcaggacaga

SEQ ID NO: 5427432 - DNA, 14 bp, Homo sapiens
ggaccagctccccg

SEQ ID NO: 5427433 - DNA, 19 bp, Homo sapiens
ggaccagctggggcgtggg

SEQ ID NO: 5427434 - DNA, 21 bp, Homo sapiens
ggaccaggactatagcccagg

SEQ ID NO: 5427435 - DNA, 18 bp, Homo sapiens
ggaccaggcaccaggcag

SEQ ID NO: 5427436 - DNA, 13 bp, Homo sapiens
ggaccaggccaat

SEQ ID NO: 5427437 - DNA, 15 bp, Homo sapiens
ggaccaggcctggag

SEQ ID NO: 5427438 - DNA, 21 bp, Homo sapiens
ggaccaggcctggagggcact

SEQ ID NO: 5427439 - DNA, 22 bp, Homo sapiens
ggaccaggctggggccagggga

SEQ ID NO: 5427440 - DNA, 15 bp, Homo sapiens
ggaccaggctgtagg

SEQ ID NO: 5427441 - DNA, 12 bp, Homo sapiens
ggaccagggcat

SEQ ID NO: 5427442 - DNA, 15 bp, Homo sapiens
ggaccagggccaccg

SEQ ID NO: 5427443 - DNA, 18 bp, Homo sapiens
ggaccagggccaccgcag

SEQ ID NO: 5427444 - DNA, 18 bp, Homo sapiens
ggaccagggccctgggca

SEQ ID NO: 5427445 - DNA, 19 bp, Homo sapiens
ggaccagggccctgggcag

SEQ ID NO: 5427446 - DNA, 23 bp, Homo sapiens
ggaccaggtcctgctccgctgcc

SEQ ID NO: 5427447 - DNA, 22 bp, Homo sapiens
ggaccaggtcttgttcaagcag

SEQ ID NO: 5427448 - DNA, 15 bp, Homo sapiens
ggaccagtcccacac

SEQ ID NO: 5427449 - DNA, 15 bp, Homo sapiens
ggaccagtgagacag

SEQ ID NO: 5427450 - DNA, 12 bp, Homo sapiens
ggaccagtttat

SEQ ID NO: 5427451 - DNA, 18 bp, Homo sapiens
ggaccatacgcggaggag

SEQ ID NO: 5427452 - DNA, 17 bp, Homo sapiens
ggaccatcagtgactca

SEQ ID NO: 5427453 - DNA, 19 bp, Homo sapiens
ggaccatctgctgcagtta

SEQ ID NO: 5427454 - DNA, 21 bp, Homo sapiens
ggaccatctgctgcagttacc

SEQ ID NO: 5427455 - DNA, 23 bp, Homo sapiens
ggaccatgcgacactgggaggcc

SEQ ID NO: 5427456 - DNA, 16 bp, Homo sapiens
ggaccatgctgagaca

SEQ ID NO: 5427457 - DNA, 14 bp, Homo sapiens
ggaccattcctgtc

SEQ ID NO: 5427458 - DNA, 18 bp, Homo sapiens
ggaccattgacctcagct

SEQ ID NO: 5427459 - DNA, 19 bp, Homo sapiens
ggaccattgacctcagctg

SEQ ID NO: 5427460 - DNA, 21 bp, Homo sapiens
ggaccattgacctcagctgca

SEQ ID NO: 5427461 - DNA, 16 bp, Homo sapiens
ggaccattttcctgca

SEQ ID NO: 5427462 - DNA, 16 bp, Homo sapiens
ggacccaaaccccctg

SEQ ID NO: 5427463 - DNA, 21 bp, Homo sapiens
ggacccaaaccccctgcagcc

SEQ ID NO: 5427464 - DNA, 22 bp, Homo sapiens
ggacccaaaccccctgcagccc

SEQ ID NO: 5427465 - DNA, 23 bp, Homo sapiens
ggacccaagaaaccaaagtctgc

SEQ ID NO: 5427466 - DNA, 17 bp, Homo sapiens
ggacccacccagcccct

SEQ ID NO: 5427467 - DNA, 23 bp, Homo sapiens
ggacccacccatcttcctgctgc

SEQ ID NO: 5427468 - DNA, 11 bp, Homo sapiens
ggacccacccc

SEQ ID NO: 5427469 - DNA, 15 bp, Homo sapiens
ggacccaccccaact

SEQ ID NO: 5427470 - DNA, 21 bp, Homo sapiens
ggacccaccccaactctcccc

SEQ ID NO: 5427471 - DNA, 19 bp, Homo sapiens
ggacccacctccccctccc

SEQ ID NO: 5427472 - DNA, 20 bp, Homo sapiens
ggacccacctgtggggcctg

SEQ ID NO: 5427473 - DNA, 17 bp, Homo sapiens
ggacccactacccttct

SEQ ID NO: 5427474 - DNA, 18 bp, Homo sapiens
ggacccactacccttctc

SEQ ID NO: 5427475 - DNA, 22 bp, Homo sapiens
ggacccactccgactccccctc

SEQ ID NO: 5427476 - DNA, 21 bp, Homo sapiens
ggacccagaggaaggggccag

SEQ ID NO: 5427477 - DNA, 17 bp, Homo sapiens
ggacccagcaggggcag

SEQ ID NO: 5427478 - DNA, 23 bp, Homo sapiens
ggacccagccgccatcagcccaa

SEQ ID NO: 5427479 - DNA, 17 bp, Homo sapiens
ggacccagcgggcaggt

SEQ ID NO: 5427480 - DNA, 13 bp, Homo sapiens
ggacccagctact

SEQ ID NO: 5427481 - DNA, 22 bp, Homo sapiens
ggacccagctactctgtccagg

SEQ ID NO: 5427482 - DNA, 10 bp, Homo sapiens
ggacccagga

SEQ ID NO: 5427483 - DNA, 11 bp, Homo sapiens
ggacccaggcg

SEQ ID NO: 5427484 - DNA, 16 bp, Homo sapiens
ggacccaggcgctgca

SEQ ID NO: 5427485 - DNA, 17 bp, Homo sapiens
ggacccaggcgctgcat

SEQ ID NO: 5427486 - DNA, 17 bp, Homo sapiens
ggacccaggctccgccc

SEQ ID NO: 5427487 - DNA, 22 bp, Homo sapiens
ggacccagggaacagccactcc

SEQ ID NO: 5427488 - DNA, 16 bp, Homo sapiens
ggacccagggagaggc

SEQ ID NO: 5427489 - DNA, 14 bp, Homo sapiens
ggacccagggatga

SEQ ID NO: 5427490 - DNA, 18 bp, Homo sapiens
ggacccagggcctgactt

SEQ ID NO: 5427491 - DNA, 13 bp, Homo sapiens
ggacccaggtgtg

SEQ ID NO: 5427492 - DNA, 11 bp, Homo sapiens
ggacccagtgg

SEQ ID NO: 5427493 - DNA, 20 bp, Homo sapiens
ggacccatgaaacagcagct

SEQ ID NO: 5427494 - DNA, 22 bp, Homo sapiens
ggacccatgagttggggtctgg

SEQ ID NO: 5427495 - DNA, 23 bp, Homo sapiens
ggaccccactccggccctccaga

SEQ ID NO: 5427496 - DNA, 21 bp, Homo sapiens
ggaccccagagattcccaagc

SEQ ID NO: 5427497 - DNA, 21 bp, Homo sapiens
ggaccccagcaagtggtccta

SEQ ID NO: 5427498 - DNA, 17 bp, Homo sapiens
ggaccccagccatccag

SEQ ID NO: 5427499 - DNA, 16 bp, Homo sapiens
ggaccccagccttggt

SEQ ID NO: 5427500 - DNA, 11 bp, Homo sapiens
ggaccccagct

SEQ ID NO: 5427501 - DNA, 20 bp, Homo sapiens
ggaccccagctagggctgga

SEQ ID NO: 5427502 - DNA, 12 bp, Homo sapiens
ggaccccagctc

SEQ ID NO: 5427503 - DNA, 15 bp, Homo sapiens
ggaccccagctctgc

SEQ ID NO: 5427504 - DNA, 13 bp, Homo sapiens
ggaccccagctgc

SEQ ID NO: 5427505 - DNA, 14 bp, Homo sapiens
ggaccccagctggg

SEQ ID NO: 5427506 - DNA, 18 bp, Homo sapiens
ggaccccagctgggaggc

SEQ ID NO: 5427507 - DNA, 16 bp, Homo sapiens
ggaccccatctgctga

SEQ ID NO: 5427508 - DNA, 20 bp, Homo sapiens
ggaccccatctgctgagctc

SEQ ID NO: 5427509 - DNA, 23 bp, Homo sapiens
ggaccccatctgctgagctctga

SEQ ID NO: 5427510 - DNA, 15 bp, Homo sapiens
ggaccccattctggg

SEQ ID NO: 5427511 - DNA, 13 bp, Homo sapiens
ggacccccagaac

SEQ ID NO: 5427512 - DNA, 14 bp, Homo sapiens
ggacccccccagtc

SEQ ID NO: 5427513 - DNA, 17 bp, Homo sapiens
ggacccccgaggccccc

SEQ ID NO: 5427514 - DNA, 16 bp, Homo sapiens
ggacccccgccccctg

SEQ ID NO: 5427515 - DNA, 20 bp, Homo sapiens
ggacccccggcctccaggct

SEQ ID NO: 5427516 - DNA, 23 bp, Homo sapiens
ggacccccggcctccaggctggg

SEQ ID NO: 5427517 - DNA, 18 bp, Homo sapiens
ggacccccgtcagctgct

SEQ ID NO: 5427518 - DNA, 22 bp, Homo sapiens
ggacccccgtggggcagggagc

SEQ ID NO: 5427519 - DNA, 19 bp, Homo sapiens
ggaccccctcaccatccag

SEQ ID NO: 5427520 - DNA, 20 bp, Homo sapiens
ggaccccctcaccatccagt

SEQ ID NO: 5427521 - DNA, 17 bp, Homo sapiens
ggaccccctcaggattg

SEQ ID NO: 5427522 - DNA, 22 bp, Homo sapiens
ggaccccctcgccagcttggct

SEQ ID NO: 5427523 - DNA, 12 bp, Homo sapiens
ggaccccctgaa

SEQ ID NO: 5427524 - DNA, 22 bp, Homo sapiens
ggaccccctgagtcaactggag

SEQ ID NO: 5427525 - DNA, 14 bp, Homo sapiens
ggaccccctgcccg

SEQ ID NO: 5427526 - DNA, 18 bp, Homo sapiens
ggaccccctggccctgcc

SEQ ID NO: 5427527 - DNA, 12 bp, Homo sapiens
ggacccccttcc

SEQ ID NO: 5427528 - DNA, 14 bp, Homo sapiens
ggacccccttcccc

SEQ ID NO: 5427529 - DNA, 22 bp, Homo sapiens
ggaccccgagaaccctgagcag

SEQ ID NO: 5427530 - DNA, 18 bp, Homo sapiens
ggaccccgagggctgagg

SEQ ID NO: 5427531 - DNA, 23 bp, Homo sapiens
ggaccccgcctcccagccccagg

SEQ ID NO: 5427532 - DNA, 16 bp, Homo sapiens
ggaccccgcctgcccg

SEQ ID NO: 5427533 - DNA, 20 bp, Homo sapiens
ggaccccgtttcatttttac

SEQ ID NO: 5427534 - DNA, 19 bp, Homo sapiens
ggacccctcaccaccccca

SEQ ID NO: 5427535 - DNA, 21 bp, Homo sapiens
ggacccctcccttgctcagtg

SEQ ID NO: 5427536 - DNA, 12 bp, Homo sapiens
ggacccctgccc

SEQ ID NO: 5427537 - DNA, 13 bp, Homo sapiens
ggacccctgccct

SEQ ID NO: 5427538 - DNA, 22 bp, Homo sapiens
ggacccctgccttcctctgagg

SEQ ID NO: 5427539 - DNA, 21 bp, Homo sapiens
ggacccctggggtggccaggg

SEQ ID NO: 5427540 - DNA, 21 bp, Homo sapiens
ggaccccttaatcttgctttc

SEQ ID NO: 5427541 - DNA, 20 bp, Homo sapiens
ggacccgaagcccaggctga

SEQ ID NO: 5427542 - DNA, 21 bp, Homo sapiens
ggacccgccagccccgctccc

SEQ ID NO: 5427543 - DNA, 14 bp, Homo sapiens
ggacccgctctgga

SEQ ID NO: 5427544 - DNA, 14 bp, Homo sapiens
ggacccgctggggg

SEQ ID NO: 5427545 - DNA, 16 bp, Homo sapiens
ggacccgctgggggct

SEQ ID NO: 5427546 - DNA, 17 bp, Homo sapiens
ggacccgctgggggctg

SEQ ID NO: 5427547 - DNA, 20 bp, Homo sapiens
ggacccgctgggggctggca

SEQ ID NO: 5427548 - DNA, 21 bp, Homo sapiens
ggacccggccgccgccaggac

SEQ ID NO: 5427549 - DNA, 15 bp, Homo sapiens
ggactcttccctggg

SEQ ID NO: 5427550 - DNA, 20 bp, Homo sapiens
ggactcttctcggctcaggc

SEQ ID NO: 5427551 - DNA, 21 bp, Homo sapiens
ggactcttgagccctcctgga

SEQ ID NO: 5427552 - DNA, 18 bp, Homo sapiens
ggactcttgctctttcta

SEQ ID NO: 5427553 - DNA, 21 bp, Homo sapiens
ggactcttgctctttctactc

SEQ ID NO: 5427554 - DNA, 21 bp, Homo sapiens
ggactctttccgactgcccag

SEQ ID NO: 5427555 - DNA, 19 bp, Homo sapiens
ggactctttggtggctttg

SEQ ID NO: 5427556 - DNA, 21 bp, Homo sapiens
ggactgaaagaagaaaacagt

SEQ ID NO: 5427557 - DNA, 14 bp, Homo sapiens
ggactgaagaaaat

SEQ ID NO: 5427558 - DNA, 17 bp, Homo sapiens
ggactgaattatgaaac

SEQ ID NO: 5427559 - DNA, 20 bp, Homo sapiens
ggactgaccaaagactgcag

SEQ ID NO: 5427560 - DNA, 21 bp, Homo sapiens
ggactgaccaaagactgcaga

SEQ ID NO: 5427561 - DNA, 23 bp, Homo sapiens
ggactgaccaaatcacccaatcc

SEQ ID NO: 5427562 - DNA, 15 bp, Homo sapiens
ggactgaccagcagc

SEQ ID NO: 5427563 - DNA, 15 bp, Homo sapiens
ggactgaccctgcag

SEQ ID NO: 5427564 - DNA, 18 bp, Homo sapiens
ggactgaccgaagggacg

SEQ ID NO: 5427565 - DNA, 14 bp, Homo sapiens
ggactgacctgccc

SEQ ID NO: 5427566 - DNA, 21 bp, Homo sapiens
ggactgaccttgtaaaagaca

SEQ ID NO: 5427567 - DNA, 11 bp, Homo sapiens
ggactgactga

SEQ ID NO: 5427568 - DNA, 16 bp, Homo sapiens
ggactgactgcagccc

SEQ ID NO: 5427569 - DNA, 14 bp, Homo sapiens
ggactgactgtgtt

SEQ ID NO: 5427570 - DNA, 22 bp, Homo sapiens
ggactgactttccgagcctcca

SEQ ID NO: 5427571 - DNA, 23 bp, Homo sapiens
ggactgagactggcacttagccc

SEQ ID NO: 5427572 - DNA, 13 bp, Homo sapiens
ggactgagatttc

SEQ ID NO: 5427573 - DNA, 20 bp, Homo sapiens
ggactgagccaaggaggcct

SEQ ID NO: 5427574 - DNA, 21 bp, Homo sapiens
ggactgagccaaggaggcctg

SEQ ID NO: 5427575 - DNA, 17 bp, Homo sapiens
ggactgagccagtccca

SEQ ID NO: 5427576 - DNA, 15 bp, Homo sapiens
ggactgagccctctc

SEQ ID NO: 5427577 - DNA, 16 bp, Homo sapiens
ggactgagccctctca

SEQ ID NO: 5427578 - DNA, 21 bp, Homo sapiens
ggactgagcggccgcagagac

SEQ ID NO: 5427579 - DNA, 22 bp, Homo sapiens
ggactgagcggccgcagagact

SEQ ID NO: 5427580 - DNA, 23 bp, Homo sapiens
ggactgagcggccgcagagactg

SEQ ID NO: 5427581 - DNA, 14 bp, Homo sapiens
ggactgagggcagt

SEQ ID NO: 5427582 - DNA, 22 bp, Homo sapiens
ggactgagtcccctccaggaag

SEQ ID NO: 5427583 - DNA, 19 bp, Homo sapiens
ggactgatggttgctttga

SEQ ID NO: 5427584 - DNA, 18 bp, Homo sapiens
ggactgatgtcatcttga

SEQ ID NO: 5427585 - DNA, 17 bp, Homo sapiens
ggactgattctgtggct

SEQ ID NO: 5427586 - DNA, 20 bp, Homo sapiens
ggactgatttgatgcctctc

SEQ ID NO: 5427587 - DNA, 11 bp, Homo sapiens
ggactgcacaa

SEQ ID NO: 5427588 - DNA, 22 bp, Homo sapiens
ggactgcacagcgtcctgtcca

SEQ ID NO: 5427589 - DNA, 22 bp, Homo sapiens
ggactgcaccttgtgaaggaaa

SEQ ID NO: 5427590 - DNA, 21 bp, Homo sapiens
ggactgcagagggctccagag

SEQ ID NO: 5427591 - DNA, 22 bp, Homo sapiens
ggactgcaggggccactccaaa

SEQ ID NO: 5427592 - DNA, 20 bp, Homo sapiens
ggactgcagtcggcatgcca

SEQ ID NO: 5427593 - DNA, 20 bp, Homo sapiens
ggactgcatgcaagctcagg

SEQ ID NO: 5427594 - DNA, 11 bp, Homo sapiens
ggactgcatgg

SEQ ID NO: 5427595 - DNA, 20 bp, Homo sapiens
ggactgcatggggaggcagc

SEQ ID NO: 5427596 - DNA, 19 bp, Homo sapiens
ggactgcatggtaatttat

SEQ ID NO: 5427597 - DNA, 17 bp, Homo sapiens
ggactgccacctcccct

SEQ ID NO: 5427598 - DNA, 16 bp, Homo sapiens
ggactgccaggctgtt

SEQ ID NO: 5427599 - DNA, 11 bp, Homo sapiens
ggactgccccc

SEQ ID NO: 5427600 - DNA, 14 bp, Homo sapiens
ggactgcccccaga

SEQ ID NO: 5427601 - DNA, 15 bp, Homo sapiens
ggactgcccccagaa

SEQ ID NO: 5427602 - DNA, 22 bp, Homo sapiens
ggactgcccccagaaagcctcc

SEQ ID NO: 5427603 - DNA, 21 bp, Homo sapiens
ggactgccccgtgcagactgg

SEQ ID NO: 5427604 - DNA, 15 bp, Homo sapiens
ggactgcggaggaag

SEQ ID NO: 5427605 - DNA, 16 bp, Homo sapiens
ggactgctcaggaaac

SEQ ID NO: 5427606 - DNA, 13 bp, Homo sapiens
ggactgctcaggc

SEQ ID NO: 5427607 - DNA, 16 bp, Homo sapiens
ggactgctcaggctcc

SEQ ID NO: 5427608 - DNA, 13 bp, Homo sapiens
ggactgctgaccc

SEQ ID NO: 5427609 - DNA, 16 bp, Homo sapiens
ggactgctgctctccc

SEQ ID NO: 5427610 - DNA, 19 bp, Homo sapiens
ggactgctgctctcccaag

SEQ ID NO: 5427611 - DNA, 16 bp, Homo sapiens
ggactgctgctgcctg

SEQ ID NO: 5427612 - DNA, 17 bp, Homo sapiens
ggactgctgctgcctgg

SEQ ID NO: 5427613 - DNA, 18 bp, Homo sapiens
ggactgctgctgcctggc

SEQ ID NO: 5427614 - DNA, 21 bp, Homo sapiens
ggactgctgtgaacatgcctc

SEQ ID NO: 5427615 - DNA, 23 bp, Homo sapiens
ggactgctgtgaacatgcctcct

SEQ ID NO: 5427616 - DNA, 20 bp, Homo sapiens
ggactgctttcagtgcctgc

SEQ ID NO: 5427617 - DNA, 21 bp, Homo sapiens
ggactgctttcagtgcctgct

SEQ ID NO: 5427618 - DNA, 22 bp, Homo sapiens
ggactgctttcagtgcctgctg

SEQ ID NO: 5427619 - DNA, 21 bp, Homo sapiens
ggactggaaagcacaagactg

SEQ ID NO: 5427620 - DNA, 14 bp, Homo sapiens
ggactggaaccagg

SEQ ID NO: 5427621 - DNA, 15 bp, Homo sapiens
ggactggaaccaggg

SEQ ID NO: 5427622 - DNA, 17 bp, Homo sapiens
ggactggacacaaacag

SEQ ID NO: 5427623 - DNA, 16 bp, Homo sapiens
ggactggacagccagg

SEQ ID NO: 5427624 - DNA, 16 bp, Homo sapiens
ggactggaggctgggt

SEQ ID NO: 5427625 - DNA, 17 bp, Homo sapiens
ggactggaggctgggtg

SEQ ID NO: 5427626 - DNA, 23 bp, Homo sapiens
ggactggaggtgggcatgccacc

SEQ ID NO: 5427627 - DNA, 23 bp, Homo sapiens
ggactggagtcagatgagcaagg

SEQ ID NO: 5427628 - DNA, 16 bp, Homo sapiens
ggactggcagaagcat

SEQ ID NO: 5427629 - DNA, 19 bp, Homo sapiens
ggactggccatttttctgg

SEQ ID NO: 5427630 - DNA, 15 bp, Homo sapiens
ggactggcccctggg

SEQ ID NO: 5427631 - DNA, 18 bp, Homo sapiens
ggactggcccttgcccaa

SEQ ID NO: 5427632 - DNA, 22 bp, Homo sapiens
ggactggcgagtccagagagga

SEQ ID NO: 5427633 - DNA, 19 bp, Homo sapiens
ggactggctagagtcctca

SEQ ID NO: 5427634 - DNA, 23 bp, Homo sapiens
ggactggctagagtcctcactcc

SEQ ID NO: 5427635 - DNA, 14 bp, Homo sapiens
ggactggctcaccc

SEQ ID NO: 5427636 - DNA, 18 bp, Homo sapiens
ggactggctgtgcccctg

SEQ ID NO: 5427637 - DNA, 19 bp, Homo sapiens
ggactgggaagggggcagg

SEQ ID NO: 5427638 - DNA, 18 bp, Homo sapiens
ggactgggaccgtgcgag

SEQ ID NO: 5427639 - DNA, 20 bp, Homo sapiens
ggactgggagcccccagcct

SEQ ID NO: 5427640 - DNA, 22 bp, Homo sapiens
ggactgggagcccccagcctgt

SEQ ID NO: 5427641 - DNA, 19 bp, Homo sapiens
ggactgggaggagggggag

SEQ ID NO: 5427642 - DNA, 17 bp, Homo sapiens
ggactgggagtcagagc

SEQ ID NO: 5427643 - DNA, 21 bp, Homo sapiens
ggactgggccgggcccagggc

SEQ ID NO: 5427644 - DNA, 21 bp, Homo sapiens
ggactggggagcacaggtgtc

SEQ ID NO: 5427645 - DNA, 17 bp, Homo sapiens
ggactggggatgtggga

SEQ ID NO: 5427646 - DNA, 17 bp, Homo sapiens
ggactggggcttgccag

SEQ ID NO: 5427647 - DNA, 10 bp, Homo sapiens
ggactggggg

SEQ ID NO: 5427648 - DNA, 20 bp, Homo sapiens
ggactgggttgcgtcctgac

SEQ ID NO: 5427649 - DNA, 18 bp, Homo sapiens
ggactgggtttggacccc

SEQ ID NO: 5427650 - DNA, 21 bp, Homo sapiens
ggactgggtttggaccccagc

SEQ ID NO: 5427651 - DNA, 24 bp, Homo sapiens
ggactgggtttggaccccagctgg

SEQ ID NO: 5427652 - DNA, 15 bp, Homo sapiens
ggactggtccaggca

SEQ ID NO: 5427653 - DNA, 9 bp, Homo sapiens
ggactggtg

SEQ ID NO: 5427654 - DNA, 15 bp, Homo sapiens
ggactggtgccctcc

SEQ ID NO: 5427655 - DNA, 15 bp, Homo sapiens
ggactggttccttcc

SEQ ID NO: 5427656 - DNA, 16 bp, Homo sapiens
ggactggttccttcct

SEQ ID NO: 5427657 - DNA, 19 bp, Homo sapiens
ggactggttctgaggccag

SEQ ID NO: 5427658 - DNA, 14 bp, Homo sapiens
ggactggtttgaga

SEQ ID NO: 5427659 - DNA, 12 bp, Homo sapiens
ggactgtaaaca

SEQ ID NO: 5427660 - DNA, 15 bp, Homo sapiens
ggactgtaagggatt

SEQ ID NO: 5427661 - DNA, 18 bp, Homo sapiens
ggactgtaagttgggctt

SEQ ID NO: 5427662 - DNA, 13 bp, Homo sapiens
ggactgtacctgt

SEQ ID NO: 5427663 - DNA, 23 bp, Homo sapiens
ggactgtacctgtaggaaacaga

SEQ ID NO: 5427664 - DNA, 20 bp, Homo sapiens
ggactgtagggagggcggca

SEQ ID NO: 5427665 - DNA, 22 bp, Homo sapiens
ggactgtagtttaatacttttt

SEQ ID NO: 5427666 - DNA, 12 bp, Homo sapiens
ggactgtatttc

SEQ ID NO: 5427667 - DNA, 14 bp, Homo sapiens
ggactgtatttctg

SEQ ID NO: 5427668 - DNA, 18 bp, Homo sapiens
ggactgtatttctgtgga

SEQ ID NO: 5427669 - DNA, 21 bp, Homo sapiens
ggactgtcacggggttccctc

SEQ ID NO: 5427670 - DNA, 20 bp, Homo sapiens
ggactgtcattttggcatct

SEQ ID NO: 5427671 - DNA, 11 bp, Homo sapiens
ggactgtccta

SEQ ID NO: 5427672 - DNA, 14 bp, Homo sapiens
ggactgtcctaggt

SEQ ID NO: 5427673 - DNA, 14 bp, Homo sapiens
ggactgtcgctgct

SEQ ID NO: 5427674 - DNA, 19 bp, Homo sapiens
ggactgtcttcaaccctgc

SEQ ID NO: 5427675 - DNA, 11 bp, Homo sapiens
ggactgtgaag

SEQ ID NO: 5427676 - DNA, 20 bp, Homo sapiens
ggactgtgacaggcagcaga

SEQ ID NO: 5427677 - DNA, 14 bp, Homo sapiens
ggactgtgaccaaa

SEQ ID NO: 5427678 - DNA, 17 bp, Homo sapiens
ggactgtgaccaaagca

SEQ ID NO: 5427679 - DNA, 18 bp, Homo sapiens
ggactgtgacttgggctc

SEQ ID NO: 5427680 - DNA, 23 bp, Homo sapiens
ggactgtgaggccatacttgtga

SEQ ID NO: 5427681 - DNA, 15 bp, Homo sapiens
ggactgtgcctcagg

SEQ ID NO: 5427682 - DNA, 12 bp, Homo sapiens
ggactgtgcctg

SEQ ID NO: 5427683 - DNA, 14 bp, Homo sapiens
ggactgtgcctggc

SEQ ID NO: 5427684 - DNA, 19 bp, Homo sapiens
ggactgtggcacttgcctg

SEQ ID NO: 5427685 - DNA, 11 bp, Homo sapiens
ggactgtggcc

SEQ ID NO: 5427686 - DNA, 22 bp, Homo sapiens
ggactgtggcctcaggaggcag

SEQ ID NO: 5427687 - DNA, 22 bp, Homo sapiens
ggactgtgggtttgtgggggga

SEQ ID NO: 5427688 - DNA, 22 bp, Homo sapiens
ggactgtggtgactttggataa

SEQ ID NO: 5427689 - DNA, 21 bp, Homo sapiens
ggactgttcacggcagaccag

SEQ ID NO: 5427690 - DNA, 18 bp, Homo sapiens
ggactgttccaaagccag

SEQ ID NO: 5427691 - DNA, 21 bp, Homo sapiens
ggactgttccaaagccagtga

SEQ ID NO: 5427692 - DNA, 17 bp, Homo sapiens
ggactgttccaggccct

SEQ ID NO: 5427693 - DNA, 23 bp, Homo sapiens
ggactgtttcaaggtccatggag

SEQ ID NO: 5427694 - DNA, 21 bp, Homo sapiens
ggactgtttcatagttttcta

SEQ ID NO: 5427695 - DNA, 22 bp, Homo sapiens
ggactgtttcatagttttctaa

SEQ ID NO: 5427696 - DNA, 15 bp, Homo sapiens
ggacttaaactgctg

SEQ ID NO: 5427697 - DNA, 19 bp, Homo sapiens
ggacttaaccttgaaatgg

SEQ ID NO: 5427698 - DNA, 15 bp, Homo sapiens
ggacttaacggctcc

SEQ ID NO: 5427699 - DNA, 19 bp, Homo sapiens
ggacttaacggctccagga

SEQ ID NO: 5427700 - DNA, 20 bp, Homo sapiens
ggacttaacggctccaggat

SEQ ID NO: 5427701 - DNA, 16 bp, Homo sapiens
ggacttaatttagcag

SEQ ID NO: 5427702 - DNA, 19 bp, Homo sapiens
ggacttagaaaaccagctc

SEQ ID NO: 5427703 - DNA, 23 bp, Homo sapiens
ggacttagaaaaccagctcagca

SEQ ID NO: 5427704 - DNA, 17 bp, Homo sapiens
ggacttagaaagcaggg

SEQ ID NO: 5427705 - DNA, 17 bp, Homo sapiens
ggacttagctgggagaa

SEQ ID NO: 5427706 - DNA, 19 bp, Homo sapiens
ggacttcaaagcaagctgg

SEQ ID NO: 5427707 - DNA, 16 bp, Homo sapiens
ggacttcaactgccca

SEQ ID NO: 5427708 - DNA, 17 bp, Homo sapiens
ggacttcaactgcccag

SEQ ID NO: 5427709 - DNA, 20 bp, Homo sapiens
ggacttcaactgcccagcaa

SEQ ID NO: 5427710 - DNA, 18 bp, Homo sapiens
ggacttcacttaaaaaaa

SEQ ID NO: 5427711 - DNA, 23 bp, Homo sapiens
ggacttcccccaccccagaagat

SEQ ID NO: 5427712 - DNA, 20 bp, Homo sapiens
ggacttcctgtccagctcca

SEQ ID NO: 5427713 - DNA, 21 bp, Homo sapiens
ggacttcctgtccagctccaa

SEQ ID NO: 5427714 - DNA, 22 bp, Homo sapiens
ggacttctctaatagaaaagtc

SEQ ID NO: 5427715 - DNA, 18 bp, Homo sapiens
ggacttctgaagagacca

SEQ ID NO: 5427716 - DNA, 14 bp, Homo sapiens
ggacttctgtgggc

SEQ ID NO: 5427717 - DNA, 22 bp, Homo sapiens
ggacttctgtgggcccctcaac

SEQ ID NO: 5427718 - DNA, 18 bp, Homo sapiens
ggacttctttaattttgg

SEQ ID NO: 5427719 - DNA, 19 bp, Homo sapiens
ggacttgaactttcctgga

SEQ ID NO: 5427720 - DNA, 19 bp, Homo sapiens
ggacttgaatgctgcccgg

SEQ ID NO: 5427721 - DNA, 21 bp, Homo sapiens
ggacttgatgttccttccaga

SEQ ID NO: 5427722 - DNA, 19 bp, Homo sapiens
ggacttgctaaagcacttt

SEQ ID NO: 5427723 - DNA, 18 bp, Homo sapiens
ggacttggagacttggtg

SEQ ID NO: 5427724 - DNA, 22 bp, Homo sapiens
ggagcaaactgcatgcccagag

SEQ ID NO: 5427725 - DNA, 13 bp, Homo sapiens
ggagcaaagaagg

SEQ ID NO: 5427726 - DNA, 18 bp, Homo sapiens
ggagcaaagaaggagctg

SEQ ID NO: 5427727 - DNA, 13 bp, Homo sapiens
ggagcaaagcctg

SEQ ID NO: 5427728 - DNA, 15 bp, Homo sapiens
ggagcaaagcctgtt

SEQ ID NO: 5427729 - DNA, 17 bp, Homo sapiens
ggagcaaagtgagggcc

SEQ ID NO: 5427730 - DNA, 17 bp, Homo sapiens
ggagcaaagttaaaagc

SEQ ID NO: 5427731 - DNA, 20 bp, Homo sapiens
ggagcaaatatctaaataat

SEQ ID NO: 5427732 - DNA, 15 bp, Homo sapiens
ggagcaaatgtttct

SEQ ID NO: 5427733 - DNA, 23 bp, Homo sapiens
ggagcaagaaggaaggaggcaga

SEQ ID NO: 5427734 - DNA, 13 bp, Homo sapiens
ggagcaagccttc

SEQ ID NO: 5427735 - DNA, 23 bp, Homo sapiens
ggagcaagctctgccctggctgt

SEQ ID NO: 5427736 - DNA, 14 bp, Homo sapiens
ggagcaagctcttc

SEQ ID NO: 5427737 - DNA, 14 bp, Homo sapiens
ggagcaagtgaggc

SEQ ID NO: 5427738 - DNA, 17 bp, Homo sapiens
ggagcaatgggactgga

SEQ ID NO: 5427739 - DNA, 20 bp, Homo sapiens
ggagcacaaagaccctggct

SEQ ID NO: 5427740 - DNA, 22 bp, Homo sapiens
ggagcacacatccaagagggac

SEQ ID NO: 5427741 - DNA, 15 bp, Homo sapiens
ggagcacagaggggc

SEQ ID NO: 5427742 - DNA, 12 bp, Homo sapiens
ggagcacagcca

SEQ ID NO: 5427743 - DNA, 14 bp, Homo sapiens
ggagcacagccata

SEQ ID NO: 5427744 - DNA, 13 bp, Homo sapiens
ggagcacagccct

SEQ ID NO: 5427745 - DNA, 14 bp, Homo sapiens
ggagcacagccctg

SEQ ID NO: 5427746 - DNA, 15 bp, Homo sapiens
ggagcacaggtccca

SEQ ID NO: 5427747 - DNA, 20 bp, Homo sapiens
ggagcacatactacctagaa

SEQ ID NO: 5427748 - DNA, 21 bp, Homo sapiens
ggagcacatactacctagaag

SEQ ID NO: 5427749 - DNA, 16 bp, Homo sapiens
ggagcacatagccctg

SEQ ID NO: 5427750 - DNA, 23 bp, Homo sapiens
ggagcacatagccctgttgacct

SEQ ID NO: 5427751 - DNA, 14 bp, Homo sapiens
ggagcaccacggcc

SEQ ID NO: 5427752 - DNA, 19 bp, Homo sapiens
ggagcaccacggccagaag

SEQ ID NO: 5427753 - DNA, 19 bp, Homo sapiens
ggagcacccagagcacccc

SEQ ID NO: 5427754 - DNA, 23 bp, Homo sapiens
ggagcacccagagcaccccctgc

SEQ ID NO: 5427755 - DNA, 12 bp, Homo sapiens
ggagcaccccca

SEQ ID NO: 5427756 - DNA, 15 bp, Homo sapiens
ggagcacccccagcc

SEQ ID NO: 5427757 - DNA, 16 bp, Homo sapiens
ggagcaccctgagggc

SEQ ID NO: 5427758 - DNA, 22 bp, Homo sapiens
ggagcacctggaccccctgccc

SEQ ID NO: 5427759 - DNA, 22 bp, Homo sapiens
ggagcacctgggccccactgga

SEQ ID NO: 5427760 - DNA, 12 bp, Homo sapiens
ggagcacctgtc

SEQ ID NO: 5427761 - DNA, 12 bp, Homo sapiens
ggagcacgaggc

SEQ ID NO: 5427762 - DNA, 23 bp, Homo sapiens
ggagcacggctctgtccccagcc

SEQ ID NO: 5427763 - DNA, 22 bp, Homo sapiens
ggagcactgcacctgcctccag

SEQ ID NO: 5427764 - DNA, 21 bp, Homo sapiens
ggagcactgcatgtcagagca

SEQ ID NO: 5427765 - DNA, 13 bp, Homo sapiens
ggagcactggagt

SEQ ID NO: 5427766 - DNA, 18 bp, Homo sapiens
ggagcactggagtgcagg

SEQ ID NO: 5427767 - DNA, 13 bp, Homo sapiens
ggagcactgggct

SEQ ID NO: 5427768 - DNA, 14 bp, Homo sapiens
ggagcactgtgcag

SEQ ID NO: 5427769 - DNA, 19 bp, Homo sapiens
ggagcactgtgcagccggg

SEQ ID NO: 5427770 - DNA, 14 bp, Homo sapiens
ggagcactgttcac

SEQ ID NO: 5427771 - DNA, 21 bp, Homo sapiens
ggagcacttgcgtcctgcaga

SEQ ID NO: 5427772 - DNA, 23 bp, Homo sapiens
ggagcagaaaacccttgggccag

SEQ ID NO: 5427773 - DNA, 12 bp, Homo sapiens
ggagcagaaaga

SEQ ID NO: 5427774 - DNA, 16 bp, Homo sapiens
ggagcagaactgaacc

SEQ ID NO: 5427775 - DNA, 16 bp, Homo sapiens
ggagcagaaggcagga

SEQ ID NO: 5427776 - DNA, 23 bp, Homo sapiens
ggagcagaatcagtattgggagc

SEQ ID NO: 5427777 - DNA, 12 bp, Homo sapiens
ggagcagacaga

SEQ ID NO: 5427778 - DNA, 14 bp, Homo sapiens
ggagcagacagaga

SEQ ID NO: 5427779 - DNA, 15 bp, Homo sapiens
ggagcagacagagaa

SEQ ID NO: 5427780 - DNA, 18 bp, Homo sapiens
ggagcagacagagaaatg

SEQ ID NO: 5427781 - DNA, 15 bp, Homo sapiens
ggagcagaccacccc

SEQ ID NO: 5427782 - DNA, 16 bp, Homo sapiens
ggagcagagaaggcca

SEQ ID NO: 5427783 - DNA, 23 bp, Homo sapiens
ggagcagagacggcagccccatc

SEQ ID NO: 5427784 - DNA, 21 bp, Homo sapiens
ggagcagagagagccagacag

SEQ ID NO: 5427785 - DNA, 14 bp, Homo sapiens
ggagcagagaggtg

SEQ ID NO: 5427786 - DNA, 16 bp, Homo sapiens
ggagcagagaggtggc

SEQ ID NO: 5427787 - DNA, 16 bp, Homo sapiens
ggagcagagctctccc

SEQ ID NO: 5427788 - DNA, 21 bp, Homo sapiens
ggagcagagctctcccctcct

SEQ ID NO: 5427789 - DNA, 17 bp, Homo sapiens
ggagcagagctctgccg

SEQ ID NO: 5427790 - DNA, 23 bp, Homo sapiens
ggagcagagctgatggagaagga

SEQ ID NO: 5427791 - DNA, 14 bp, Homo sapiens
ggagcagagggcag

SEQ ID NO: 5427792 - DNA, 16 bp, Homo sapiens
ggagcagagggcaggg

SEQ ID NO: 5427793 - DNA, 12 bp, Homo sapiens
ggagcagagggg

SEQ ID NO: 5427794 - DNA, 22 bp, Homo sapiens
ggagcagcaagaagcagcctgt

SEQ ID NO: 5427795 - DNA, 22 bp, Homo sapiens
ggagcagcacgattttgcacaa

SEQ ID NO: 5427796 - DNA, 22 bp, Homo sapiens
ggagcagcacgccaaccccagc

SEQ ID NO: 5427797 - DNA, 12 bp, Homo sapiens
ggagcagcagcc

SEQ ID NO: 5427798 - DNA, 15 bp, Homo sapiens
ggagcagcagcgctc

SEQ ID NO: 5427799 - DNA, 18 bp, Homo sapiens
ggagcagcagctgaggcc

SEQ ID NO: 5427800 - DNA, 17 bp, Homo sapiens
ggagcagcagcttctcc

SEQ ID NO: 5427801 - DNA, 21 bp, Homo sapiens
ggagcagcaggaggggggagg

SEQ ID NO: 5427802 - DNA, 20 bp, Homo sapiens
ggagcagcatcattcagcaa

SEQ ID NO: 5427803 - DNA, 21 bp, Homo sapiens
ggagcagccacattcctgatg

SEQ ID NO: 5427804 - DNA, 19 bp, Homo sapiens
ggagcagccagagctgtgc

SEQ ID NO: 5427805 - DNA, 16 bp, Homo sapiens
ggagcagccaggaccc

SEQ ID NO: 5427806 - DNA, 19 bp, Homo sapiens
ggagcagccaggacccgcc

SEQ ID NO: 5427807 - DNA, 17 bp, Homo sapiens
ggagcagcccccaaaga

SEQ ID NO: 5427808 - DNA, 13 bp, Homo sapiens
ggagcagcctcag

SEQ ID NO: 5427809 - DNA, 17 bp, Homo sapiens
ggagcagcctccaagaa

SEQ ID NO: 5427810 - DNA, 20 bp, Homo sapiens
ggagcagcctccaagaaact

SEQ ID NO: 5427811 - DNA, 19 bp, Homo sapiens
ggagcagcctcgaggctgg

SEQ ID NO: 5427812 - DNA, 21 bp, Homo sapiens
ggagcagcctcgaggctggtg

SEQ ID NO: 5427813 - DNA, 21 bp, Homo sapiens
ggagcagcggattgctctgga

SEQ ID NO: 5427814 - DNA, 17 bp, Homo sapiens
ggagcagctggcactga

SEQ ID NO: 5427815 - DNA, 21 bp, Homo sapiens
ggagcagctgggcactgggcc

SEQ ID NO: 5427816 - DNA, 11 bp, Homo sapiens
ggagcagcttc

SEQ ID NO: 5427817 - DNA, 22 bp, Homo sapiens
ggagcagcttccttctgggact

SEQ ID NO: 5427818 - DNA, 17 bp, Homo sapiens
ggagcagcttcttgggc

SEQ ID NO: 5427819 - DNA, 18 bp, Homo sapiens
ggagcagcttcttgggct

SEQ ID NO: 5427820 - DNA, 20 bp, Homo sapiens
ggagcagcttcttgggctga

SEQ ID NO: 5427821 - DNA, 17 bp, Homo sapiens
ggagcaggaacagagac

SEQ ID NO: 5427822 - DNA, 21 bp, Homo sapiens
ggagcaggaacagagactctg

SEQ ID NO: 5427823 - DNA, 22 bp, Homo sapiens
ggagcaggaacagagactctgg

SEQ ID NO: 5427824 - DNA, 17 bp, Homo sapiens
ggagcaggaagcaaggc

SEQ ID NO: 5427825 - DNA, 19 bp, Homo sapiens
ggagcaggaagcaaggcca

SEQ ID NO: 5427826 - DNA, 22 bp, Homo sapiens
ggagcaggagattgagaaggag

SEQ ID NO: 5427827 - DNA, 19 bp, Homo sapiens
ggagcaggaggaggaaagg

SEQ ID NO: 5427828 - DNA, 19 bp, Homo sapiens
ggagcaggaggccaataaa

SEQ ID NO: 5427829 - DNA, 20 bp, Homo sapiens
ggagcaggaggccaataaaa

SEQ ID NO: 5427830 - DNA, 19 bp, Homo sapiens
ggagcaggcagtggggctg

SEQ ID NO: 5427831 - DNA, 13 bp, Homo sapiens
ggagcaggcccaa

SEQ ID NO: 5427832 - DNA, 21 bp, Homo sapiens
ggagcaggcggtggggagaga

SEQ ID NO: 5427833 - DNA, 17 bp, Homo sapiens
ggagcagggaaggcctg

SEQ ID NO: 5427834 - DNA, 15 bp, Homo sapiens
ggagcaggggcgtgg

SEQ ID NO: 5427835 - DNA, 13 bp, Homo sapiens
ggagcaggggtgg

SEQ ID NO: 5427836 - DNA, 14 bp, Homo sapiens
ggagcaggtctctg

SEQ ID NO: 5427837 - DNA, 17 bp, Homo sapiens
ggagcaggtctctggca

SEQ ID NO: 5427838 - DNA, 18 bp, Homo sapiens
ggagcaggtctctggcag

SEQ ID NO: 5427839 - DNA, 21 bp, Homo sapiens
ggagcaggtctctggcagaga

SEQ ID NO: 5427840 - DNA, 19 bp, Homo sapiens
ggagcaggtgcccccaggt

SEQ ID NO: 5427841 - DNA, 18 bp, Homo sapiens
ggagcaggttccccaagg

SEQ ID NO: 5427842 - DNA, 16 bp, Homo sapiens
ggagcagtccatgcat

SEQ ID NO: 5427843 - DNA, 17 bp, Homo sapiens
ggagcagtgagtgacaa

SEQ ID NO: 5427844 - DNA, 14 bp, Homo sapiens
ggagcagtgcaggc

SEQ ID NO: 5427845 - DNA, 17 bp, Homo sapiens
ggagcagtgggccctgg

SEQ ID NO: 5427846 - DNA, 18 bp, Homo sapiens
ggagcagtgggccctggc

SEQ ID NO: 5427847 - DNA, 19 bp, Homo sapiens
ggagcagtgggccctggct

SEQ ID NO: 5427848 - DNA, 22 bp, Homo sapiens
ggagcagtgggccctggctctg

SEQ ID NO: 5427849 - DNA, 12 bp, Homo sapiens
ggagcagtgtct

SEQ ID NO: 5427850 - DNA, 13 bp, Homo sapiens
ggagcagttggcc

SEQ ID NO: 5427851 - DNA, 17 bp, Homo sapiens
ggagcagttggcctgtg

SEQ ID NO: 5427852 - DNA, 18 bp, Homo sapiens
ggagcagttggcctgtgc

SEQ ID NO: 5427853 - DNA, 19 bp, Homo sapiens
ggagcagtttggggcaggg

SEQ ID NO: 5427854 - DNA, 20 bp, Homo sapiens
ggagcagtttggggcagggg

SEQ ID NO: 5427855 - DNA, 21 bp, Homo sapiens
ggagcagtttggggcaggggg

SEQ ID NO: 5427856 - DNA, 16 bp, Homo sapiens
ggagcagttttcccct

SEQ ID NO: 5427857 - DNA, 22 bp, Homo sapiens
ggagcataactggagggtgggt

SEQ ID NO: 5427858 - DNA, 20 bp, Homo sapiens
ggagcatagaagccacatcg

SEQ ID NO: 5427859 - DNA, 20 bp, Homo sapiens
ggagcatagcagaggggcca

SEQ ID NO: 5427860 - DNA, 22 bp, Homo sapiens
ggagcatagcagaggggccagg

SEQ ID NO: 5427861 - DNA, 14 bp, Homo sapiens
ggagcatcagccag

SEQ ID NO: 5427862 - DNA, 18 bp, Homo sapiens
ggagcatccacctccttc

SEQ ID NO: 5427863 - DNA, 19 bp, Homo sapiens
ggagcatccacctccttct

SEQ ID NO: 5427864 - DNA, 15 bp, Homo sapiens
ggagcatcccaggcg

SEQ ID NO: 5427865 - DNA, 16 bp, Homo sapiens
ggagcatctgactcac

SEQ ID NO: 5427866 - DNA, 20 bp, Homo sapiens
ggagcatgtatgtctgcagg

SEQ ID NO: 5427867 - DNA, 21 bp, Homo sapiens
ggagcatgtcctatccctgga

SEQ ID NO: 5427868 - DNA, 15 bp, Homo sapiens
ggagcattaagccca

SEQ ID NO: 5427869 - DNA, 19 bp, Homo sapiens
ggagcattaagcccaatct

SEQ ID NO: 5427870 - DNA, 21 bp, Homo sapiens
ggagcattctgcctgcctggg

SEQ ID NO: 5427871 - DNA, 22 bp, Homo sapiens
ggagcattctgcctgcctggga

SEQ ID NO: 5427872 - DNA, 15 bp, Homo sapiens
ggagcattgcagcct

SEQ ID NO: 5427873 - DNA, 19 bp, Homo sapiens
ggagcattggctgagagac

SEQ ID NO: 5427874 - DNA, 20 bp, Homo sapiens
ggagcatttaatggcagcta

SEQ ID NO: 5427875 - DNA, 22 bp, Homo sapiens
ggagcatttatgtagacattgt

SEQ ID NO: 5427876 - DNA, 16 bp, Homo sapiens
ggagcatttttcagag

SEQ ID NO: 5427877 - DNA, 22 bp, Homo sapiens
ggagccaaaggcatccaggcca

SEQ ID NO: 5427878 - DNA, 22 bp, Homo sapiens
ggagccaaatgaccgagccctg

SEQ ID NO: 5427879 - DNA, 20 bp, Homo sapiens
ggagccaacagaagcttcca

SEQ ID NO: 5427880 - DNA, 15 bp, Homo sapiens
ggagccaactgctgc

SEQ ID NO: 5427881 - DNA, 16 bp, Homo sapiens
ggagccaagggatgga

SEQ ID NO: 5427882 - DNA, 16 bp, Homo sapiens
ggagccaatgaacagc

SEQ ID NO: 5427883 - DNA, 15 bp, Homo sapiens
ggagccacaggcaga

SEQ ID NO: 5427884 - DNA, 17 bp, Homo sapiens
ggagccacatttacata

SEQ ID NO: 5427885 - DNA, 17 bp, Homo sapiens
ggagccaccactcctgc

SEQ ID NO: 5427886 - DNA, 14 bp, Homo sapiens
ggagccaccagttc

SEQ ID NO: 5427887 - DNA, 15 bp, Homo sapiens
ggagccaccagttct

SEQ ID NO: 5427888 - DNA, 16 bp, Homo sapiens
ggagccacctgtccca

SEQ ID NO: 5427889 - DNA, 18 bp, Homo sapiens
ggagccacgcctatgccc

SEQ ID NO: 5427890 - DNA, 20 bp, Homo sapiens
ggagccactcctgtcccgcc

SEQ ID NO: 5427891 - DNA, 15 bp, Homo sapiens
ggagccactgccact

SEQ ID NO: 5427892 - DNA, 23 bp, Homo sapiens
ggagccactgggagggggacccg

SEQ ID NO: 5427893 - DNA, 17 bp, Homo sapiens
ggagccactggggtggg

SEQ ID NO: 5427894 - DNA, 18 bp, Homo sapiens
ggagccagaaatgggcag

SEQ ID NO: 5427895 - DNA, 19 bp, Homo sapiens
ggagccagaaatgggcagt

SEQ ID NO: 5427896 - DNA, 17 bp, Homo sapiens
ggagccagactgtccag

SEQ ID NO: 5427897 - DNA, 19 bp, Homo sapiens
ggagccagactgtccaggg

SEQ ID NO: 5427898 - DNA, 11 bp, Homo sapiens
ggagccagaga

SEQ ID NO: 5427899 - DNA, 12 bp, Homo sapiens
ggagccagaggc

SEQ ID NO: 5427900 - DNA, 15 bp, Homo sapiens
ggagccagaggccag

SEQ ID NO: 5427901 - DNA, 17 bp, Homo sapiens
ggaggaaggcctttctt

SEQ ID NO: 5427902 - DNA, 15 bp, Homo sapiens
ggaggaaggctctgt

SEQ ID NO: 5427903 - DNA, 14 bp, Homo sapiens
ggaggaagggccag

SEQ ID NO: 5427904 - DNA, 11 bp, Homo sapiens
ggaggaaggtc

SEQ ID NO: 5427905 - DNA, 14 bp, Homo sapiens
ggaggaaggtccca

SEQ ID NO: 5427906 - DNA, 20 bp, Homo sapiens
ggaggaagtatgagtgctga

SEQ ID NO: 5427907 - DNA, 21 bp, Homo sapiens
ggaggaagttctccagcttca

SEQ ID NO: 5427908 - DNA, 18 bp, Homo sapiens
ggaggaatagtgcttgct

SEQ ID NO: 5427909 - DNA, 18 bp, Homo sapiens
ggaggaatcactggggat

SEQ ID NO: 5427910 - DNA, 19 bp, Homo sapiens
ggaggaatcgaggaaccag

SEQ ID NO: 5427911 - DNA, 23 bp, Homo sapiens
ggaggaatcgaggaaccagagcc

SEQ ID NO: 5427912 - DNA, 18 bp, Homo sapiens
ggaggaatcttttactgt

SEQ ID NO: 5427913 - DNA, 16 bp, Homo sapiens
ggaggaatgctccccc

SEQ ID NO: 5427914 - DNA, 17 bp, Homo sapiens
ggaggaatgctccccca

SEQ ID NO: 5427915 - DNA, 16 bp, Homo sapiens
ggaggaatgctggact

SEQ ID NO: 5427916 - DNA, 14 bp, Homo sapiens
ggaggaattcagct

SEQ ID NO: 5427917 - DNA, 14 bp, Homo sapiens
ggaggacaaaactt

SEQ ID NO: 5427918 - DNA, 23 bp, Homo sapiens
ggaggacaaaggtgattttcctg

SEQ ID NO: 5427919 - DNA, 19 bp, Homo sapiens
ggaggacaattcatgaact

SEQ ID NO: 5427920 - DNA, 21 bp, Homo sapiens
ggaggacacagcacaagggca

SEQ ID NO: 5427921 - DNA, 19 bp, Homo sapiens
ggaggacagacggccggcc

SEQ ID NO: 5427922 - DNA, 12 bp, Homo sapiens
ggaggacagagc

SEQ ID NO: 5427923 - DNA, 14 bp, Homo sapiens
ggaggacagagccg

SEQ ID NO: 5427924 - DNA, 18 bp, Homo sapiens
ggaggacagagtgccctg

SEQ ID NO: 5427925 - DNA, 22 bp, Homo sapiens
ggaggacaggcgggaggaggtg

SEQ ID NO: 5427926 - DNA, 13 bp, Homo sapiens
ggaggacagggag

SEQ ID NO: 5427927 - DNA, 14 bp, Homo sapiens
ggaggacagggagg

SEQ ID NO: 5427928 - DNA, 14 bp, Homo sapiens
ggaggacaggtgga

SEQ ID NO: 5427929 - DNA, 23 bp, Homo sapiens
ggaggacatgcgtgtgtcaggga

SEQ ID NO: 5427930 - DNA, 22 bp, Homo sapiens
ggaggaccagggctggggcagc

SEQ ID NO: 5427931 - DNA, 22 bp, Homo sapiens
ggaggaccagtcaggatgaggc

SEQ ID NO: 5427932 - DNA, 14 bp, Homo sapiens
ggaggacccaggac

SEQ ID NO: 5427933 - DNA, 17 bp, Homo sapiens
ggaggaccccgagggct

SEQ ID NO: 5427934 - DNA, 23 bp, Homo sapiens
ggaggaccccgagggctgaggag

SEQ ID NO: 5427935 - DNA, 14 bp, Homo sapiens
ggaggaccgaggct

SEQ ID NO: 5427936 - DNA, 17 bp, Homo sapiens
ggaggacctgagcctgc

SEQ ID NO: 5427937 - DNA, 18 bp, Homo sapiens
ggaggacctgagcctgcc

SEQ ID NO: 5427938 - DNA, 19 bp, Homo sapiens
ggaggacctgagcctgccg

SEQ ID NO: 5427939 - DNA, 12 bp, Homo sapiens
ggaggacctggc

SEQ ID NO: 5427940 - DNA, 21 bp, Homo sapiens
ggaggacctggcgtgctcaga

SEQ ID NO: 5427941 - DNA, 23 bp, Homo sapiens
ggaggacctggcgtgctcagacc

SEQ ID NO: 5427942 - DNA, 18 bp, Homo sapiens
ggaggaccttaaatgcta

SEQ ID NO: 5427943 - DNA, 16 bp, Homo sapiens
ggaggacgctctctgg

SEQ ID NO: 5427944 - DNA, 21 bp, Homo sapiens
ggaggacgctctctggccttc

SEQ ID NO: 5427945 - DNA, 16 bp, Homo sapiens
ggaggactagaacctg

SEQ ID NO: 5427946 - DNA, 19 bp, Homo sapiens
ggaggactagaacctggag

SEQ ID NO: 5427947 - DNA, 14 bp, Homo sapiens
ggaggactaggacc

SEQ ID NO: 5427948 - DNA, 21 bp, Homo sapiens
ggaggacttggagggtctggg

SEQ ID NO: 5427949 - DNA, 12 bp, Homo sapiens
ggaggagaaata

SEQ ID NO: 5427950 - DNA, 18 bp, Homo sapiens
ggaggagaaggggagtga

SEQ ID NO: 5427951 - DNA, 13 bp, Homo sapiens
ggaggagaatgag

SEQ ID NO: 5427952 - DNA, 16 bp, Homo sapiens
ggaggagaccagctca

SEQ ID NO: 5427953 - DNA, 17 bp, Homo sapiens
ggaggagaccagctcag

SEQ ID NO: 5427954 - DNA, 16 bp, Homo sapiens
ggaggagactcaggcc

SEQ ID NO: 5427955 - DNA, 13 bp, Homo sapiens
ggaggagagaaga

SEQ ID NO: 5427956 - DNA, 12 bp, Homo sapiens
ggaggagagaga

SEQ ID NO: 5427957 - DNA, 16 bp, Homo sapiens
ggaggagagagggtct

SEQ ID NO: 5427958 - DNA, 13 bp, Homo sapiens
ggaggagagccac

SEQ ID NO: 5427959 - DNA, 19 bp, Homo sapiens
ggaggagagccactgggcc

SEQ ID NO: 5427960 - DNA, 15 bp, Homo sapiens
ggaggagagcctggt

SEQ ID NO: 5427961 - DNA, 14 bp, Homo sapiens
ggaggagaggagac

SEQ ID NO: 5427962 - DNA, 22 bp, Homo sapiens
ggaggagattaacacactgaac

SEQ ID NO: 5427963 - DNA, 20 bp, Homo sapiens
ggaggagcaacggccccagc

SEQ ID NO: 5427964 - DNA, 20 bp, Homo sapiens
ggaggagcacccccagcctc

SEQ ID NO: 5427965 - DNA, 14 bp, Homo sapiens
ggaggagcagcctc

SEQ ID NO: 5427966 - DNA, 21 bp, Homo sapiens
ggaggagcagcctcgaggctg

SEQ ID NO: 5427967 - DNA, 22 bp, Homo sapiens
ggaggagcagcctcgaggctgg

SEQ ID NO: 5427968 - DNA, 12 bp, Homo sapiens
ggaggagcaggg

SEQ ID NO: 5427969 - DNA, 17 bp, Homo sapiens
ggaggagcagtgcaggc

SEQ ID NO: 5427970 - DNA, 21 bp, Homo sapiens
ggaggagcctgggggctcctc

SEQ ID NO: 5427971 - DNA, 12 bp, Homo sapiens
ggaggagcctgt

SEQ ID NO: 5427972 - DNA, 16 bp, Homo sapiens
ggaggagcctgtcctg

SEQ ID NO: 5427973 - DNA, 13 bp, Homo sapiens
ggaggagcctgtg

SEQ ID NO: 5427974 - DNA, 14 bp, Homo sapiens
ggaggagctgaggg

SEQ ID NO: 5427975 - DNA, 23 bp, Homo sapiens
ggaggagctgccgcaaggccctg

SEQ ID NO: 5427976 - DNA, 14 bp, Homo sapiens
ggaggagctggcct

SEQ ID NO: 5427977 - DNA, 15 bp, Homo sapiens
ggaggagctggcctg

SEQ ID NO: 5427978 - DNA, 15 bp, Homo sapiens
ggaggaggaaatccc

SEQ ID NO: 5427979 - DNA, 12 bp, Homo sapiens
ggaggaggaagg

SEQ ID NO: 5427980 - DNA, 15 bp, Homo sapiens
ggaggaggaaggcaa

SEQ ID NO: 5427981 - DNA, 15 bp, Homo sapiens
ggaggaggagatggc

SEQ ID NO: 5427982 - DNA, 13 bp, Homo sapiens
ggaggaggagcct

SEQ ID NO: 5427983 - DNA, 15 bp, Homo sapiens
ggaggaggagccttg

SEQ ID NO: 5427984 - DNA, 17 bp, Homo sapiens
ggaggaggagccttgct

SEQ ID NO: 5427985 - DNA, 13 bp, Homo sapiens
ggaggaggagctg

SEQ ID NO: 5427986 - DNA, 17 bp, Homo sapiens
ggaggaggagctgccgc

SEQ ID NO: 5427987 - DNA, 14 bp, Homo sapiens
ggaggaggaggagc

SEQ ID NO: 5427988 - DNA, 15 bp, Homo sapiens
ggaggaggaggagga

SEQ ID NO: 5427989 - DNA, 14 bp, Homo sapiens
ggaggaggaggcaa

SEQ ID NO: 5427990 - DNA, 17 bp, Homo sapiens
ggaggaggcagagaaga

SEQ ID NO: 5427991 - DNA, 14 bp, Homo sapiens
ggaggaggcatgga

SEQ ID NO: 5427992 - DNA, 16 bp, Homo sapiens
ggaggaggccacctct

SEQ ID NO: 5427993 - DNA, 12 bp, Homo sapiens
ggaggaggcctg

SEQ ID NO: 5427994 - DNA, 19 bp, Homo sapiens
ggaggaggcctgtcccaat

SEQ ID NO: 5427995 - DNA, 23 bp, Homo sapiens
ggaggaggctgccctgaggggct

SEQ ID NO: 5427996 - DNA, 15 bp, Homo sapiens
ggaggagggatgctg

SEQ ID NO: 5427997 - DNA, 20 bp, Homo sapiens
ggaggagggcaggcatcggg

SEQ ID NO: 5427998 - DNA, 19 bp, Homo sapiens
ggaggagggcggggggcac

SEQ ID NO: 5427999 - DNA, 17 bp, Homo sapiens
ggaggaggggaagctgg

SEQ ID NO: 5428000 - DNA, 18 bp, Homo sapiens
ggaggagggggcccggct

SEQ ID NO: 5428001 - DNA, 22 bp, Homo sapiens
ggaggagggggcccggctgggc

SEQ ID NO: 5428002 - DNA, 15 bp, Homo sapiens
ggaggagggggccgg

SEQ ID NO: 5428003 - DNA, 17 bp, Homo sapiens
ggaggaggtgccaacag

SEQ ID NO: 5428004 - DNA, 23 bp, Homo sapiens
ggaggaggtgtctggggtgaggg

SEQ ID NO: 5428005 - DNA, 23 bp, Homo sapiens
ggaggaggtttaggtcaagaaga

SEQ ID NO: 5428006 - DNA, 16 bp, Homo sapiens
ggaggagtcagatgag

SEQ ID NO: 5428007 - DNA, 18 bp, Homo sapiens
ggaggagtcagatgaggc

SEQ ID NO: 5428008 - DNA, 20 bp, Homo sapiens
ggaggagtcagatgaggccc

SEQ ID NO: 5428009 - DNA, 21 bp, Homo sapiens
ggaggagtcagatgaggccct

SEQ ID NO: 5428010 - DNA, 22 bp, Homo sapiens
ggaggagtcagatgaggccctg

SEQ ID NO: 5428011 - DNA, 19 bp, Homo sapiens
ggaggagtcaggggctctg

SEQ ID NO: 5428012 - DNA, 15 bp, Homo sapiens
ggaggagtgagacag

SEQ ID NO: 5428013 - DNA, 22 bp, Homo sapiens
ggaggagtggattcctccccac

SEQ ID NO: 5428014 - DNA, 14 bp, Homo sapiens
ggaggagtggcatc

SEQ ID NO: 5428015 - DNA, 17 bp, Homo sapiens
ggaggagttagccaaac

SEQ ID NO: 5428016 - DNA, 21 bp, Homo sapiens
ggaggatcactggagcccagg

SEQ ID NO: 5428017 - DNA, 14 bp, Homo sapiens
ggaggatcacttga

SEQ ID NO: 5428018 - DNA, 21 bp, Homo sapiens
ggaggatctcttgagcctggg

SEQ ID NO: 5428019 - DNA, 19 bp, Homo sapiens
ggaggatgccacagcccca

SEQ ID NO: 5428020 - DNA, 22 bp, Homo sapiens
ggaggatgccacagccccacag

SEQ ID NO: 5428021 - DNA, 14 bp, Homo sapiens
ggaggatggagaga

SEQ ID NO: 5428022 - DNA, 17 bp, Homo sapiens
ggaggatggtgtcctga

SEQ ID NO: 5428023 - DNA, 16 bp, Homo sapiens
ggaggatgtaaggcct

SEQ ID NO: 5428024 - DNA, 13 bp, Homo sapiens
ggaggatgtgaat

SEQ ID NO: 5428025 - DNA, 16 bp, Homo sapiens
ggaggatgtgggcagc

SEQ ID NO: 5428026 - DNA, 17 bp, Homo sapiens
ggaggattcgagcatca

SEQ ID NO: 5428027 - DNA, 19 bp, Homo sapiens
ggaggattctttccccaga

SEQ ID NO: 5428028 - DNA, 20 bp, Homo sapiens
ggaggcaaagctggctcacc

SEQ ID NO: 5428029 - DNA, 15 bp, Homo sapiens
ggaggcaaaggcctg

SEQ ID NO: 5428030 - DNA, 16 bp, Homo sapiens
ggaggcaaaggcctgg

SEQ ID NO: 5428031 - DNA, 17 bp, Homo sapiens
ggaggcaaaggcctgga

SEQ ID NO: 5428032 - DNA, 20 bp, Homo sapiens
ggaggcaaatggcactgcag

SEQ ID NO: 5428033 - DNA, 16 bp, Homo sapiens
ggaggcaacactgctg

SEQ ID NO: 5428034 - DNA, 12 bp, Homo sapiens
ggaggcaagaac

SEQ ID NO: 5428035 - DNA, 20 bp, Homo sapiens
ggaggcaagagactgggagc

SEQ ID NO: 5428036 - DNA, 15 bp, Homo sapiens
ggaggcaagagggag

SEQ ID NO: 5428037 - DNA, 16 bp, Homo sapiens
ggaggcaagagggagg

SEQ ID NO: 5428038 - DNA, 17 bp, Homo sapiens
ggaggcaagagggaggg

SEQ ID NO: 5428039 - DNA, 17 bp, Homo sapiens
ggaggcaagcgtgttct

SEQ ID NO: 5428040 - DNA, 18 bp, Homo sapiens
ggaggcacaaagggcagg

SEQ ID NO: 5428041 - DNA, 15 bp, Homo sapiens
ggaggcacactttct

SEQ ID NO: 5428042 - DNA, 15 bp, Homo sapiens
ggaggcacagcagtt

SEQ ID NO: 5428043 - DNA, 12 bp, Homo sapiens
ggaggcaccagc

SEQ ID NO: 5428044 - DNA, 16 bp, Homo sapiens
ggaggcacctccaggc

SEQ ID NO: 5428045 - DNA, 23 bp, Homo sapiens
ggaggcagaaagatttggaaaat

SEQ ID NO: 5428046 - DNA, 14 bp, Homo sapiens
ggaggcagagacct

SEQ ID NO: 5428047 - DNA, 13 bp, Homo sapiens
ggaggcagcagga

SEQ ID NO: 5428048 - DNA, 13 bp, Homo sapiens
ggaggcagccccc

SEQ ID NO: 5428049 - DNA, 12 bp, Homo sapiens
ggaggcagcgtg

SEQ ID NO: 5428050 - DNA, 17 bp, Homo sapiens
ggaggcaggagtttcgt

SEQ ID NO: 5428051 - DNA, 17 bp, Homo sapiens
ggaggcagggaggcagc

SEQ ID NO: 5428052 - DNA, 14 bp, Homo sapiens
ggaggcagggctgg

SEQ ID NO: 5428053 - DNA, 15 bp, Homo sapiens
ggaggcagggctgga

SEQ ID NO: 5428054 - DNA, 13 bp, Homo sapiens
ggaggcaggggct

SEQ ID NO: 5428055 - DNA, 17 bp, Homo sapiens
ggaggcaggggcttcct

SEQ ID NO: 5428056 - DNA, 15 bp, Homo sapiens
ggaggcaggtcgggc

SEQ ID NO: 5428057 - DNA, 14 bp, Homo sapiens
ggaggcatctgcac

SEQ ID NO: 5428058 - DNA, 15 bp, Homo sapiens
ggaggcatctgcatg

SEQ ID NO: 5428059 - DNA, 22 bp, Homo sapiens
ggaggccaaactgtccctccct

SEQ ID NO: 5428060 - DNA, 23 bp, Homo sapiens
ggaggccaaactgtccctccctt

SEQ ID NO: 5428061 - DNA, 14 bp, Homo sapiens
ggaggccaaccagc

SEQ ID NO: 5428062 - DNA, 21 bp, Homo sapiens
ggaggccaaccagcccgacag

SEQ ID NO: 5428063 - DNA, 18 bp, Homo sapiens
ggaggccaaggtgggagg

SEQ ID NO: 5428064 - DNA, 19 bp, Homo sapiens
ggaggccaaggtgggcgga

SEQ ID NO: 5428065 - DNA, 17 bp, Homo sapiens
ggaggccaataaaaagt

SEQ ID NO: 5428066 - DNA, 19 bp, Homo sapiens
ggaggccaataaaaagttc

SEQ ID NO: 5428067 - DNA, 23 bp, Homo sapiens
ggaggccaccccaaaccccagcc

SEQ ID NO: 5428068 - DNA, 13 bp, Homo sapiens
ggaggccacctcc

SEQ ID NO: 5428069 - DNA, 22 bp, Homo sapiens
ggaggccacgggggaggccgag

SEQ ID NO: 5428070 - DNA, 11 bp, Homo sapiens
ggaggccagcc

SEQ ID NO: 5428071 - DNA, 13 bp, Homo sapiens
ggaggccagcctt

SEQ ID NO: 5428072 - DNA, 12 bp, Homo sapiens
ggaggccagcta

SEQ ID NO: 5428073 - DNA, 20 bp, Homo sapiens
ggaggccagctatctgcctg

SEQ ID NO: 5428074 - DNA, 22 bp, Homo sapiens
ggaggccagctatctgcctgac

SEQ ID NO: 5428075 - DNA, 11 bp, Homo sapiens
ggaggccaggc

SEQ ID NO: 5428076 - DNA, 12 bp, Homo sapiens
ggaggccaggcc

SEQ ID NO: 5428077 - DNA, 14 bp, Homo sapiens
ggaggccaggccct

SEQ ID NO: 5428078 - DNA, 15 bp, Homo sapiens
ggaggccaggccctc

SEQ ID NO: 5428079 - DNA, 14 bp, Homo sapiens
ggaggccaggccgg

SEQ ID NO: 5428080 - DNA, 23 bp, Homo sapiens
ggaggccaggccggcgagccctg

SEQ ID NO: 5428081 - DNA, 21 bp, Homo sapiens
ggaggtctccaggggcctgca

SEQ ID NO: 5428082 - DNA, 22 bp, Homo sapiens
ggaggtctccaggggcctgcag

SEQ ID NO: 5428083 - DNA, 14 bp, Homo sapiens
ggaggtctggctga

SEQ ID NO: 5428084 - DNA, 22 bp, Homo sapiens
ggaggtctggctgagcccctgg

SEQ ID NO: 5428085 - DNA, 22 bp, Homo sapiens
ggaggtcttggccgactcaggg

SEQ ID NO: 5428086 - DNA, 22 bp, Homo sapiens
ggaggtgaaaagggcagaggca

SEQ ID NO: 5428087 - DNA, 23 bp, Homo sapiens
ggaggtgaaagaaagggacccac

SEQ ID NO: 5428088 - DNA, 18 bp, Homo sapiens
ggaggtgaagaggctgct

SEQ ID NO: 5428089 - DNA, 21 bp, Homo sapiens
ggaggtgagatcacagcctcc

SEQ ID NO: 5428090 - DNA, 13 bp, Homo sapiens
ggaggtgagggat

SEQ ID NO: 5428091 - DNA, 15 bp, Homo sapiens
ggaggtgaggggggc

SEQ ID NO: 5428092 - DNA, 19 bp, Homo sapiens
ggaggtgccagcaaagccc

SEQ ID NO: 5428093 - DNA, 22 bp, Homo sapiens
ggaggtgcctgagctggggcct

SEQ ID NO: 5428094 - DNA, 13 bp, Homo sapiens
ggaggtgctggtt

SEQ ID NO: 5428095 - DNA, 17 bp, Homo sapiens
ggaggtgcttgaggccc

SEQ ID NO: 5428096 - DNA, 20 bp, Homo sapiens
ggaggtggaagaagggagaa

SEQ ID NO: 5428097 - DNA, 15 bp, Homo sapiens
ggaggtggaagcaga

SEQ ID NO: 5428098 - DNA, 16 bp, Homo sapiens
ggaggtggaagcagag

SEQ ID NO: 5428099 - DNA, 18 bp, Homo sapiens
ggaggtggaagcagaggc

SEQ ID NO: 5428100 - DNA, 20 bp, Homo sapiens
ggaggtggaagcagaggccc

SEQ ID NO: 5428101 - DNA, 21 bp, Homo sapiens
ggaggtggaagcagaggccct

SEQ ID NO: 5428102 - DNA, 20 bp, Homo sapiens
ggaggtggagcttgcaatga

SEQ ID NO: 5428103 - DNA, 19 bp, Homo sapiens
ggaggtggaggttgcagtg

SEQ ID NO: 5428104 - DNA, 20 bp, Homo sapiens
ggaggtggaggttgcattga

SEQ ID NO: 5428105 - DNA, 12 bp, Homo sapiens
ggaggtggcagc

SEQ ID NO: 5428106 - DNA, 17 bp, Homo sapiens
ggaggtggcagccctgt

SEQ ID NO: 5428107 - DNA, 12 bp, Homo sapiens
ggaggtggcagg

SEQ ID NO: 5428108 - DNA, 14 bp, Homo sapiens
ggaggtggcaggga

SEQ ID NO: 5428109 - DNA, 13 bp, Homo sapiens
ggaggtggctggg

SEQ ID NO: 5428110 - DNA, 19 bp, Homo sapiens
ggaggtgggagcaggagat

SEQ ID NO: 5428111 - DNA, 16 bp, Homo sapiens
ggaggtgggaggccag

SEQ ID NO: 5428112 - DNA, 23 bp, Homo sapiens
ggaggtgggatcctccaggtgca

SEQ ID NO: 5428113 - DNA, 16 bp, Homo sapiens
ggaggtgggcatgcca

SEQ ID NO: 5428114 - DNA, 19 bp, Homo sapiens
ggaggtgggccgtggccct

SEQ ID NO: 5428115 - DNA, 20 bp, Homo sapiens
ggaggtggggagggcctctg

SEQ ID NO: 5428116 - DNA, 22 bp, Homo sapiens
ggaggtggggagggcctctgga

SEQ ID NO: 5428117 - DNA, 19 bp, Homo sapiens
ggaggtggggcgaggcagg

SEQ ID NO: 5428118 - DNA, 15 bp, Homo sapiens
ggaggtgtcaggctg

SEQ ID NO: 5428119 - DNA, 13 bp, Homo sapiens
ggaggtgtctcag

SEQ ID NO: 5428120 - DNA, 22 bp, Homo sapiens
ggaggtgtctggggtgagggag

SEQ ID NO: 5428121 - DNA, 16 bp, Homo sapiens
ggaggtgtctgtatca

SEQ ID NO: 5428122 - DNA, 16 bp, Homo sapiens
ggaggtgtgaatgcac

SEQ ID NO: 5428123 - DNA, 22 bp, Homo sapiens
ggaggtgtggagtggaggggtc

SEQ ID NO: 5428124 - DNA, 14 bp, Homo sapiens
ggaggtgttcactg

SEQ ID NO: 5428125 - DNA, 18 bp, Homo sapiens
ggaggttcaatgagatgg

SEQ ID NO: 5428126 - DNA, 9 bp, Homo sapiens
ggaggttcc

SEQ ID NO: 5428127 - DNA, 18 bp, Homo sapiens
ggaggttccagtgagccg

SEQ ID NO: 5428128 - DNA, 15 bp, Homo sapiens
ggaggttctcagagc

SEQ ID NO: 5428129 - DNA, 16 bp, Homo sapiens
ggaggttgaagccaag

SEQ ID NO: 5428130 - DNA, 20 bp, Homo sapiens
ggaggttgagaatgcagtga

SEQ ID NO: 5428131 - DNA, 14 bp, Homo sapiens
ggaggttgagtgag

SEQ ID NO: 5428132 - DNA, 19 bp, Homo sapiens
ggaggttgagtgagccggg

SEQ ID NO: 5428133 - DNA, 12 bp, Homo sapiens
ggaggttgataa

SEQ ID NO: 5428134 - DNA, 19 bp, Homo sapiens
ggaggttgatcagatctga

SEQ ID NO: 5428135 - DNA, 12 bp, Homo sapiens
ggaggttgcagg

SEQ ID NO: 5428136 - DNA, 14 bp, Homo sapiens
ggaggttgcagtga

SEQ ID NO: 5428137 - DNA, 20 bp, Homo sapiens
ggaggttgcagtgagctgag

SEQ ID NO: 5428138 - DNA, 17 bp, Homo sapiens
ggaggttgcattgagct

SEQ ID NO: 5428139 - DNA, 21 bp, Homo sapiens
ggaggttgccgtgagccaaga

SEQ ID NO: 5428140 - DNA, 16 bp, Homo sapiens
ggaggttggtgactga

SEQ ID NO: 5428141 - DNA, 14 bp, Homo sapiens
ggaggttggttcct

SEQ ID NO: 5428142 - DNA, 18 bp, Homo sapiens
ggaggttggttccttggg

SEQ ID NO: 5428143 - DNA, 13 bp, Homo sapiens
ggaggttgtggat

SEQ ID NO: 5428144 - DNA, 14 bp, Homo sapiens
ggaggttgtggatg

SEQ ID NO: 5428145 - DNA, 18 bp, Homo sapiens
ggaggttgtgtcactgac

SEQ ID NO: 5428146 - DNA, 15 bp, Homo sapiens
ggaggtttggggggc

SEQ ID NO: 5428147 - DNA, 19 bp, Homo sapiens
ggaggtttggggggcatca

SEQ ID NO: 5428148 - DNA, 14 bp, Homo sapiens
ggaggtttgtcggg

SEQ ID NO: 5428149 - DNA, 16 bp, Homo sapiens
ggagtaaacggcccag

SEQ ID NO: 5428150 - DNA, 16 bp, Homo sapiens
ggagtaaatattggga

SEQ ID NO: 5428151 - DNA, 21 bp, Homo sapiens
ggagtaacagggcagaaatga

SEQ ID NO: 5428152 - DNA, 22 bp, Homo sapiens
ggagtaagaaatgggcctcagc

SEQ ID NO: 5428153 - DNA, 19 bp, Homo sapiens
ggagtaagtagaggtggct

SEQ ID NO: 5428154 - DNA, 14 bp, Homo sapiens
ggagtaagtgtaca

SEQ ID NO: 5428155 - DNA, 18 bp, Homo sapiens
ggagtaatcaggcagcct

SEQ ID NO: 5428156 - DNA, 11 bp, Homo sapiens
ggagtactttc

SEQ ID NO: 5428157 - DNA, 14 bp, Homo sapiens
ggagtactttcctt

SEQ ID NO: 5428158 - DNA, 12 bp, Homo sapiens
ggagtagagttt

SEQ ID NO: 5428159 - DNA, 13 bp, Homo sapiens
ggagtagctagtt

SEQ ID NO: 5428160 - DNA, 15 bp, Homo sapiens
ggagtagctgagctc

SEQ ID NO: 5428161 - DNA, 19 bp, Homo sapiens
ggagtaggctccagacagg

SEQ ID NO: 5428162 - DNA, 23 bp, Homo sapiens
ggagtaggctccagacaggagga

SEQ ID NO: 5428163 - DNA, 15 bp, Homo sapiens
ggagtatgctggagg

SEQ ID NO: 5428164 - DNA, 20 bp, Homo sapiens
ggagtatgctggaggcagag

SEQ ID NO: 5428165 - DNA, 20 bp, Homo sapiens
ggagtatgttgtcataacat

SEQ ID NO: 5428166 - DNA, 16 bp, Homo sapiens
ggagtattgaatggtg

SEQ ID NO: 5428167 - DNA, 17 bp, Homo sapiens
ggagtatttgaacacag

SEQ ID NO: 5428168 - DNA, 18 bp, Homo sapiens
ggagtatttgaacacagt

SEQ ID NO: 5428169 - DNA, 15 bp, Homo sapiens
ggagtcaagtgtgga

SEQ ID NO: 5428170 - DNA, 22 bp, Homo sapiens
ggagtcaccttcccttgccact

SEQ ID NO: 5428171 - DNA, 14 bp, Homo sapiens
ggagtcactgagac

SEQ ID NO: 5428172 - DNA, 15 bp, Homo sapiens
ggagtcactgagacc

SEQ ID NO: 5428173 - DNA, 18 bp, Homo sapiens
ggagtcagatgagcaagg

SEQ ID NO: 5428174 - DNA, 15 bp, Homo sapiens
ggagtcagatgaggc

SEQ ID NO: 5428175 - DNA, 19 bp, Homo sapiens
ggagtcagatgaggccctg

SEQ ID NO: 5428176 - DNA, 15 bp, Homo sapiens
ggagtcagccaggag

SEQ ID NO: 5428177 - DNA, 19 bp, Homo sapiens
ggagtcagccaggagctgt

SEQ ID NO: 5428178 - DNA, 13 bp, Homo sapiens
ggagtcaggacct

SEQ ID NO: 5428179 - DNA, 14 bp, Homo sapiens
ggagtcaggcccgg

SEQ ID NO: 5428180 - DNA, 12 bp, Homo sapiens
ggagtcaggcct

SEQ ID NO: 5428181 - DNA, 18 bp, Homo sapiens
ggagtcaggcctgggcag

SEQ ID NO: 5428182 - DNA, 16 bp, Homo sapiens
ggagtcagggacctgc

SEQ ID NO: 5428183 - DNA, 18 bp, Homo sapiens
ggagtcagggacctgctg

SEQ ID NO: 5428184 - DNA, 19 bp, Homo sapiens
ggagtcagggagccctggg

SEQ ID NO: 5428185 - DNA, 17 bp, Homo sapiens
ggagtcagtagccagag

SEQ ID NO: 5428186 - DNA, 20 bp, Homo sapiens
ggagtcagtagccagagttg

SEQ ID NO: 5428187 - DNA, 19 bp, Homo sapiens
ggagtcagtcatgtcactg

SEQ ID NO: 5428188 - DNA, 18 bp, Homo sapiens
ggagtcagtctctttctg

SEQ ID NO: 5428189 - DNA, 18 bp, Homo sapiens
ggagtcagtgccaggtcc

SEQ ID NO: 5428190 - DNA, 17 bp, Homo sapiens
ggagtcatctcaaccat

SEQ ID NO: 5428191 - DNA, 23 bp, Homo sapiens
ggagtcatctcaaccatcccctc

SEQ ID NO: 5428192 - DNA, 14 bp, Homo sapiens
ggagtcatggtcag

SEQ ID NO: 5428193 - DNA, 22 bp, Homo sapiens
ggagtcattgccttgggcctgg

SEQ ID NO: 5428194 - DNA, 21 bp, Homo sapiens
ggagtcattttgtgttgaaga

SEQ ID NO: 5428195 - DNA, 14 bp, Homo sapiens
ggagtccactgcct

SEQ ID NO: 5428196 - DNA, 15 bp, Homo sapiens
ggagtccactttcct

SEQ ID NO: 5428197 - DNA, 16 bp, Homo sapiens
ggagtccactttcctc

SEQ ID NO: 5428198 - DNA, 13 bp, Homo sapiens
ggagtccagaccc

SEQ ID NO: 5428199 - DNA, 14 bp, Homo sapiens
ggagtccagacctg

SEQ ID NO: 5428200 - DNA, 23 bp, Homo sapiens
ggagtccagacctgggccctggt

SEQ ID NO: 5428201 - DNA, 20 bp, Homo sapiens
ggagtccagcccctcctccc

SEQ ID NO: 5428202 - DNA, 22 bp, Homo sapiens
ggagtccagcccctcctccctc

SEQ ID NO: 5428203 - DNA, 13 bp, Homo sapiens
ggagtccagctct

SEQ ID NO: 5428204 - DNA, 16 bp, Homo sapiens
ggagtccaggcacagg

SEQ ID NO: 5428205 - DNA, 20 bp, Homo sapiens
ggagtccaggcccccagccc

SEQ ID NO: 5428206 - DNA, 20 bp, Homo sapiens
ggagtccagggtttctctgc

SEQ ID NO: 5428207 - DNA, 20 bp, Homo sapiens
ggagtcccaccttggctgca

SEQ ID NO: 5428208 - DNA, 22 bp, Homo sapiens
ggagtcccaggggcagccacac

SEQ ID NO: 5428209 - DNA, 13 bp, Homo sapiens
ggagtcccctccc

SEQ ID NO: 5428210 - DNA, 21 bp, Homo sapiens
ggagtcccctccccggcccta

SEQ ID NO: 5428211 - DNA, 16 bp, Homo sapiens
ggagtcccgtcaggac

SEQ ID NO: 5428212 - DNA, 16 bp, Homo sapiens
ggagtcctgttctcag

SEQ ID NO: 5428213 - DNA, 17 bp, Homo sapiens
ggagtcctgttctcaga

SEQ ID NO: 5428214 - DNA, 19 bp, Homo sapiens
ggagtccttacctcgggga

SEQ ID NO: 5428215 - DNA, 21 bp, Homo sapiens
ggagtccttacctcggggaga

SEQ ID NO: 5428216 - DNA, 13 bp, Homo sapiens
ggagtcgagctgg

SEQ ID NO: 5428217 - DNA, 15 bp, Homo sapiens
ggagtcggttagtca

SEQ ID NO: 5428218 - DNA, 22 bp, Homo sapiens
ggagtcgtggggtgtgctggga

SEQ ID NO: 5428219 - DNA, 21 bp, Homo sapiens
ggagtctccagtggttgctgt

SEQ ID NO: 5428220 - DNA, 14 bp, Homo sapiens
ggagtctccctccg

SEQ ID NO: 5428221 - DNA, 21 bp, Homo sapiens
ggagtctccctccgactccag

SEQ ID NO: 5428222 - DNA, 23 bp, Homo sapiens
ggagtctcgctctgtcgcccagg

SEQ ID NO: 5428223 - DNA, 19 bp, Homo sapiens
ggagtctctgccacccact

SEQ ID NO: 5428224 - DNA, 22 bp, Homo sapiens
ggagtctctgccagttacttgg

SEQ ID NO: 5428225 - DNA, 17 bp, Homo sapiens
ggagtctgaaatggggc

SEQ ID NO: 5428226 - DNA, 14 bp, Homo sapiens
ggagtctgaagcag

SEQ ID NO: 5428227 - DNA, 16 bp, Homo sapiens
ggagtctgaagcctgc

SEQ ID NO: 5428228 - DNA, 13 bp, Homo sapiens
ggagtctgaggac

SEQ ID NO: 5428229 - DNA, 23 bp, Homo sapiens
ggagtctgaggactgtcctccca

SEQ ID NO: 5428230 - DNA, 20 bp, Homo sapiens
ggagtctgaggcctgagtga

SEQ ID NO: 5428231 - DNA, 16 bp, Homo sapiens
ggagtctgaggtcctg

SEQ ID NO: 5428232 - DNA, 19 bp, Homo sapiens
ggagtctgaggtcctgagc

SEQ ID NO: 5428233 - DNA, 20 bp, Homo sapiens
ggagtctgaggtcctgagca

SEQ ID NO: 5428234 - DNA, 23 bp, Homo sapiens
ggagtctgaggtcctgagcactg

SEQ ID NO: 5428235 - DNA, 18 bp, Homo sapiens
ggagtctgattgcaggaa

SEQ ID NO: 5428236 - DNA, 13 bp, Homo sapiens
ggagtctgccact

SEQ ID NO: 5428237 - DNA, 14 bp, Homo sapiens
ggagtctgggctcc

SEQ ID NO: 5428238 - DNA, 19 bp, Homo sapiens
ggagtcttcactgctctgc

SEQ ID NO: 5428239 - DNA, 16 bp, Homo sapiens
ggagtcttcagaccca

SEQ ID NO: 5428240 - DNA, 20 bp, Homo sapiens
ggagtcttcagacccagaga

SEQ ID NO: 5428241 - DNA, 21 bp, Homo sapiens
ggagtcttcagacccagagaa

SEQ ID NO: 5428242 - DNA, 23 bp, Homo sapiens
ggagtcttctaatgtaaatttta

SEQ ID NO: 5428243 - DNA, 21 bp, Homo sapiens
ggagtcttgggtggcgctggt

SEQ ID NO: 5428244 - DNA, 18 bp, Homo sapiens
ggagtcttgtgaaagtgt

SEQ ID NO: 5428245 - DNA, 22 bp, Homo sapiens
ggagtgaaacctttagggcagc

SEQ ID NO: 5428246 - DNA, 23 bp, Homo sapiens
ggagtgaaacctttagggcagct

SEQ ID NO: 5428247 - DNA, 18 bp, Homo sapiens
ggagtgaagaggggcagc

SEQ ID NO: 5428248 - DNA, 19 bp, Homo sapiens
ggagtgaagaggggcagcc

SEQ ID NO: 5428249 - DNA, 23 bp, Homo sapiens
ggagtgaagaggggcagcccttg

SEQ ID NO: 5428250 - DNA, 13 bp, Homo sapiens
ggagtgaagccac

SEQ ID NO: 5428251 - DNA, 17 bp, Homo sapiens
ggagtgaagtaattgac

SEQ ID NO: 5428252 - DNA, 16 bp, Homo sapiens
ggagtgaagtggtgtg

SEQ ID NO: 5428253 - DNA, 16 bp, Homo sapiens
ggagtgaatgtggcag

SEQ ID NO: 5428254 - DNA, 16 bp, Homo sapiens
ggagtgacagaggcag

SEQ ID NO: 5428255 - DNA, 19 bp, Homo sapiens
ggagtgaccgggcactggc

SEQ ID NO: 5428256 - DNA, 20 bp, Homo sapiens
ggagtgacgggagcctcctc

SEQ ID NO: 5428257 - DNA, 20 bp, Homo sapiens
ggagtgactctggctgccaa

SEQ ID NO: 5428258 - DNA, 17 bp, Homo sapiens
ggatgcctggtggcagc

SEQ ID NO: 5428259 - DNA, 18 bp, Homo sapiens
ggatgcctggtggcagct

SEQ ID NO: 5428260 - DNA, 20 bp, Homo sapiens
ggatgcctggtggcagctgc

SEQ ID NO: 5428261 - DNA, 17 bp, Homo sapiens
ggatgccttttctgtga

SEQ ID NO: 5428262 - DNA, 17 bp, Homo sapiens
ggatgcgagcttggcct

SEQ ID NO: 5428263 - DNA, 18 bp, Homo sapiens
ggatgcgagcttggcctt

SEQ ID NO: 5428264 - DNA, 20 bp, Homo sapiens
ggatgcggatcctgctgggg

SEQ ID NO: 5428265 - DNA, 21 bp, Homo sapiens
ggatgcggatcctgctggggc

SEQ ID NO: 5428266 - DNA, 14 bp, Homo sapiens
ggatgcggggcaga

SEQ ID NO: 5428267 - DNA, 13 bp, Homo sapiens
ggatgcgtgggag

SEQ ID NO: 5428268 - DNA, 16 bp, Homo sapiens
ggatgcgtgggaggca

SEQ ID NO: 5428269 - DNA, 17 bp, Homo sapiens
ggatgcgtgggaggcag

SEQ ID NO: 5428270 - DNA, 14 bp, Homo sapiens
ggatgcgtgttcca

SEQ ID NO: 5428271 - DNA, 16 bp, Homo sapiens
ggatgctaacatctaa

SEQ ID NO: 5428272 - DNA, 17 bp, Homo sapiens
ggatgctagccccagag

SEQ ID NO: 5428273 - DNA, 19 bp, Homo sapiens
ggatgctatttcagccaat

SEQ ID NO: 5428274 - DNA, 16 bp, Homo sapiens
ggatgctccagggcag

SEQ ID NO: 5428275 - DNA, 18 bp, Homo sapiens
ggatgctccagggcagcc

SEQ ID NO: 5428276 - DNA, 15 bp, Homo sapiens
ggatgctccatttca

SEQ ID NO: 5428277 - DNA, 14 bp, Homo sapiens
ggatgctctttccc

SEQ ID NO: 5428278 - DNA, 18 bp, Homo sapiens
ggatgctctttcccagga

SEQ ID NO: 5428279 - DNA, 17 bp, Homo sapiens
ggatgctgacccaggaa

SEQ ID NO: 5428280 - DNA, 13 bp, Homo sapiens
ggatgctgagctg

SEQ ID NO: 5428281 - DNA, 14 bp, Homo sapiens
ggatgctgcagcag

SEQ ID NO: 5428282 - DNA, 17 bp, Homo sapiens
ggatgctgctgcccctg

SEQ ID NO: 5428283 - DNA, 12 bp, Homo sapiens
ggatgctgctgt

SEQ ID NO: 5428284 - DNA, 18 bp, Homo sapiens
ggatgctggccacagaaa

SEQ ID NO: 5428285 - DNA, 13 bp, Homo sapiens
ggatgctgggctg

SEQ ID NO: 5428286 - DNA, 16 bp, Homo sapiens
ggatgctgggctgggc

SEQ ID NO: 5428287 - DNA, 18 bp, Homo sapiens
ggatgctgggctgggccc

SEQ ID NO: 5428288 - DNA, 14 bp, Homo sapiens
ggatgctggggaga

SEQ ID NO: 5428289 - DNA, 20 bp, Homo sapiens
ggatgctgggttctggggct

SEQ ID NO: 5428290 - DNA, 22 bp, Homo sapiens
ggatgctgggttctggggctga

SEQ ID NO: 5428291 - DNA, 23 bp, Homo sapiens
ggatgctgggttctggggctgag

SEQ ID NO: 5428292 - DNA, 17 bp, Homo sapiens
ggatgctggtggctggt

SEQ ID NO: 5428293 - DNA, 18 bp, Homo sapiens
ggatgctggtggctggtg

SEQ ID NO: 5428294 - DNA, 22 bp, Homo sapiens
ggatgctgttgagggccaagag

SEQ ID NO: 5428295 - DNA, 14 bp, Homo sapiens
ggatggaaaaataa

SEQ ID NO: 5428296 - DNA, 19 bp, Homo sapiens
ggatggaaaaggaagacta

SEQ ID NO: 5428297 - DNA, 16 bp, Homo sapiens
ggatggaacgggcatg

SEQ ID NO: 5428298 - DNA, 22 bp, Homo sapiens
ggatggaacgggcatgggcctc

SEQ ID NO: 5428299 - DNA, 12 bp, Homo sapiens
ggatggaagaaa

SEQ ID NO: 5428300 - DNA, 13 bp, Homo sapiens
ggatggaagaaag

SEQ ID NO: 5428301 - DNA, 14 bp, Homo sapiens
ggatggaaggagag

SEQ ID NO: 5428302 - DNA, 20 bp, Homo sapiens
ggatggacactaatgcagcc

SEQ ID NO: 5428303 - DNA, 11 bp, Homo sapiens
ggatggacaga

SEQ ID NO: 5428304 - DNA, 12 bp, Homo sapiens
ggatggacagac

SEQ ID NO: 5428305 - DNA, 17 bp, Homo sapiens
ggatggacagacacctc

SEQ ID NO: 5428306 - DNA, 18 bp, Homo sapiens
ggatggacagacacctcc

SEQ ID NO: 5428307 - DNA, 19 bp, Homo sapiens
ggatggacagacacctccc

SEQ ID NO: 5428308 - DNA, 16 bp, Homo sapiens
ggatggacagatggac

SEQ ID NO: 5428309 - DNA, 20 bp, Homo sapiens
ggatggacagatggaccaaa

SEQ ID NO: 5428310 - DNA, 13 bp, Homo sapiens
ggatggacatctt

SEQ ID NO: 5428311 - DNA, 20 bp, Homo sapiens
ggatggaccaacctgctctg

SEQ ID NO: 5428312 - DNA, 19 bp, Homo sapiens
ggatggaccctcgcagcag

SEQ ID NO: 5428313 - DNA, 20 bp, Homo sapiens
ggatggacgctgccgggaga

SEQ ID NO: 5428314 - DNA, 11 bp, Homo sapiens
ggatggacttg

SEQ ID NO: 5428315 - DNA, 19 bp, Homo sapiens
ggatggagaaagaagtgga

SEQ ID NO: 5428316 - DNA, 20 bp, Homo sapiens
ggatggagaaagaagtggag

SEQ ID NO: 5428317 - DNA, 17 bp, Homo sapiens
ggatggagaggcggcct

SEQ ID NO: 5428318 - DNA, 14 bp, Homo sapiens
ggatggaggccaga

SEQ ID NO: 5428319 - DNA, 16 bp, Homo sapiens
ggatggatgagtcaga

SEQ ID NO: 5428320 - DNA, 13 bp, Homo sapiens
ggatggatggaca

SEQ ID NO: 5428321 - DNA, 15 bp, Homo sapiens
ggatggatggacaga

SEQ ID NO: 5428322 - DNA, 16 bp, Homo sapiens
ggatggatggacagaa

SEQ ID NO: 5428323 - DNA, 17 bp, Homo sapiens
ggatggatggacagaat

SEQ ID NO: 5428324 - DNA, 21 bp, Homo sapiens
ggatggattgcagtccccagt

SEQ ID NO: 5428325 - DNA, 19 bp, Homo sapiens
ggatggattggcctccagg

SEQ ID NO: 5428326 - DNA, 11 bp, Homo sapiens
ggatggcaccc

SEQ ID NO: 5428327 - DNA, 22 bp, Homo sapiens
ggatggcagacagtcaaggaga

SEQ ID NO: 5428328 - DNA, 14 bp, Homo sapiens
ggatggcagactct

SEQ ID NO: 5428329 - DNA, 21 bp, Homo sapiens
ggatggcaggacgtgggctgg

SEQ ID NO: 5428330 - DNA, 14 bp, Homo sapiens
ggatggcaggatcc

SEQ ID NO: 5428331 - DNA, 10 bp, Homo sapiens
ggatggcagt

SEQ ID NO: 5428332 - DNA, 20 bp, Homo sapiens
ggatggcatctccatgtaga

SEQ ID NO: 5428333 - DNA, 14 bp, Homo sapiens
ggatggccagtgtc

SEQ ID NO: 5428334 - DNA, 20 bp, Homo sapiens
ggatggcccagcaggcaggc

SEQ ID NO: 5428335 - DNA, 14 bp, Homo sapiens
ggatggccccagca

SEQ ID NO: 5428336 - DNA, 16 bp, Homo sapiens
ggatggccgatggggc

SEQ ID NO: 5428337 - DNA, 20 bp, Homo sapiens
ggatggccgcagggctgtgc

SEQ ID NO: 5428338 - DNA, 17 bp, Homo sapiens
ggatggccgggctgctg

SEQ ID NO: 5428339 - DNA, 13 bp, Homo sapiens
ggatggcctctgg

SEQ ID NO: 5428340 - DNA, 20 bp, Homo sapiens
ggatggcctctggggcagga

SEQ ID NO: 5428341 - DNA, 20 bp, Homo sapiens
ggatggcctgcagccacatg

SEQ ID NO: 5428342 - DNA, 20 bp, Homo sapiens
ggatggcgctaggggacttg

SEQ ID NO: 5428343 - DNA, 18 bp, Homo sapiens
ggatggcgggtgggggtg

SEQ ID NO: 5428344 - DNA, 13 bp, Homo sapiens
ggatggcggtgga

SEQ ID NO: 5428345 - DNA, 23 bp, Homo sapiens
ggatggcgtgtcccctgcctgtg

SEQ ID NO: 5428346 - DNA, 21 bp, Homo sapiens
ggatggctaggaaagggaagc

SEQ ID NO: 5428347 - DNA, 21 bp, Homo sapiens
ggatgggaaataaagaaaatt

SEQ ID NO: 5428348 - DNA, 12 bp, Homo sapiens
ggatgggaagat

SEQ ID NO: 5428349 - DNA, 13 bp, Homo sapiens
ggatgggacaggg

SEQ ID NO: 5428350 - DNA, 15 bp, Homo sapiens
ggatgggaccaggga

SEQ ID NO: 5428351 - DNA, 15 bp, Homo sapiens
ggatgggaggagagc

SEQ ID NO: 5428352 - DNA, 17 bp, Homo sapiens
ggatgggaggctcctgg

SEQ ID NO: 5428353 - DNA, 19 bp, Homo sapiens
ggatgggaggctcctggtg

SEQ ID NO: 5428354 - DNA, 15 bp, Homo sapiens
ggatgggagtgagac

SEQ ID NO: 5428355 - DNA, 18 bp, Homo sapiens
ggatgggcagcccaacag

SEQ ID NO: 5428356 - DNA, 22 bp, Homo sapiens
ggatgggcagtcattttgcaga

SEQ ID NO: 5428357 - DNA, 15 bp, Homo sapiens
ggatgggccacccac

SEQ ID NO: 5428358 - DNA, 22 bp, Homo sapiens
ggatgggccacccaccagggct

SEQ ID NO: 5428359 - DNA, 17 bp, Homo sapiens
ggatgggccagggttta

SEQ ID NO: 5428360 - DNA, 18 bp, Homo sapiens
ggatgggcctttgagcct

SEQ ID NO: 5428361 - DNA, 16 bp, Homo sapiens
ggatgggctgagctag

SEQ ID NO: 5428362 - DNA, 12 bp, Homo sapiens
ggatggggacac

SEQ ID NO: 5428363 - DNA, 11 bp, Homo sapiens
ggatggggagg

SEQ ID NO: 5428364 - DNA, 12 bp, Homo sapiens
ggatggggaggg

SEQ ID NO: 5428365 - DNA, 11 bp, Homo sapiens
ggatggggcag

SEQ ID NO: 5428366 - DNA, 14 bp, Homo sapiens
ggatggggccacag

SEQ ID NO: 5428367 - DNA, 15 bp, Homo sapiens
ggatggggccacagc

SEQ ID NO: 5428368 - DNA, 18 bp, Homo sapiens
ggatggggcccaggggct

SEQ ID NO: 5428369 - DNA, 17 bp, Homo sapiens
ggatgggggaactcaga

SEQ ID NO: 5428370 - DNA, 19 bp, Homo sapiens
ggatgggggatgggccagg

SEQ ID NO: 5428371 - DNA, 14 bp, Homo sapiens
ggatgggggctcct

SEQ ID NO: 5428372 - DNA, 15 bp, Homo sapiens
ggatgggggctctgc

SEQ ID NO: 5428373 - DNA, 16 bp, Homo sapiens
ggatgggtcagagcta

SEQ ID NO: 5428374 - DNA, 12 bp, Homo sapiens
ggatgggtcccc

SEQ ID NO: 5428375 - DNA, 19 bp, Homo sapiens
ggatgggtcccctccgcca

SEQ ID NO: 5428376 - DNA, 15 bp, Homo sapiens
ggatgggtgtgggag

SEQ ID NO: 5428377 - DNA, 17 bp, Homo sapiens
ggatgggttccagaggt

SEQ ID NO: 5428378 - DNA, 16 bp, Homo sapiens
ggatggtagttttttc

SEQ ID NO: 5428379 - DNA, 11 bp, Homo sapiens
ggatggtcagg

SEQ ID NO: 5428380 - DNA, 13 bp, Homo sapiens
ggatggtcaggcc

SEQ ID NO: 5428381 - DNA, 22 bp, Homo sapiens
ggatggtcatcgtgacagcagc

SEQ ID NO: 5428382 - DNA, 15 bp, Homo sapiens
ggatggtctccacct

SEQ ID NO: 5428383 - DNA, 16 bp, Homo sapiens
ggatggtctccacctg

SEQ ID NO: 5428384 - DNA, 20 bp, Homo sapiens
ggatggtctccacctgtgct

SEQ ID NO: 5428385 - DNA, 19 bp, Homo sapiens
ggatggtcttacagcaggc

SEQ ID NO: 5428386 - DNA, 21 bp, Homo sapiens
ggatggtcttgatctcctgag

SEQ ID NO: 5428387 - DNA, 18 bp, Homo sapiens
ggatggtctttgggcagg

SEQ ID NO: 5428388 - DNA, 20 bp, Homo sapiens
ggatggtgacttttgaagaa

SEQ ID NO: 5428389 - DNA, 23 bp, Homo sapiens
ggatggtgacttttgaagaacaa

SEQ ID NO: 5428390 - DNA, 13 bp, Homo sapiens
ggatggtgccctg

SEQ ID NO: 5428391 - DNA, 15 bp, Homo sapiens
ggatggtgggcttca

SEQ ID NO: 5428392 - DNA, 21 bp, Homo sapiens
ggatggtggggcccccagcac

SEQ ID NO: 5428393 - DNA, 12 bp, Homo sapiens
ggatggtgtctc

SEQ ID NO: 5428394 - DNA, 17 bp, Homo sapiens
ggatggtgtgccttcca

SEQ ID NO: 5428395 - DNA, 18 bp, Homo sapiens
ggatggtgtgccttccag

SEQ ID NO: 5428396 - DNA, 21 bp, Homo sapiens
ggatggtgttactgcagttga

SEQ ID NO: 5428397 - DNA, 18 bp, Homo sapiens
ggatggttccccaggagg

SEQ ID NO: 5428398 - DNA, 23 bp, Homo sapiens
ggatggttcccttgatgaagaag

SEQ ID NO: 5428399 - DNA, 20 bp, Homo sapiens
ggatgtaaacagtgcctgct

SEQ ID NO: 5428400 - DNA, 15 bp, Homo sapiens
ggatgtaaccaagct

SEQ ID NO: 5428401 - DNA, 20 bp, Homo sapiens
ggatgtaattagctctgggg

SEQ ID NO: 5428402 - DNA, 16 bp, Homo sapiens
ggatgtacatttccaa

SEQ ID NO: 5428403 - DNA, 21 bp, Homo sapiens
ggatgtacttaagagtggcat

SEQ ID NO: 5428404 - DNA, 12 bp, Homo sapiens
ggatgtagcatg

SEQ ID NO: 5428405 - DNA, 20 bp, Homo sapiens
ggatgtagtgattaaatata

SEQ ID NO: 5428406 - DNA, 21 bp, Homo sapiens
ggatgtatgaatacagcagca

SEQ ID NO: 5428407 - DNA, 13 bp, Homo sapiens
ggatgtcaacagc

SEQ ID NO: 5428408 - DNA, 15 bp, Homo sapiens
ggatgtcacagggcc

SEQ ID NO: 5428409 - DNA, 12 bp, Homo sapiens
ggatgtcacagt

SEQ ID NO: 5428410 - DNA, 14 bp, Homo sapiens
ggatgtcacagtcc

SEQ ID NO: 5428411 - DNA, 20 bp, Homo sapiens
ggatgtcagcagacacacat

SEQ ID NO: 5428412 - DNA, 21 bp, Homo sapiens
ggatgtcatagccaaagccag

SEQ ID NO: 5428413 - DNA, 18 bp, Homo sapiens
ggatgtccacagatgcct

SEQ ID NO: 5428414 - DNA, 13 bp, Homo sapiens
ggatgtccagagc

SEQ ID NO: 5428415 - DNA, 14 bp, Homo sapiens
ggatgtccagagct

SEQ ID NO: 5428416 - DNA, 20 bp, Homo sapiens
ggatgtccagagctggccag

SEQ ID NO: 5428417 - DNA, 21 bp, Homo sapiens
ggatgtccagagctggccagg

SEQ ID NO: 5428418 - DNA, 13 bp, Homo sapiens
ggatgtccccagc

SEQ ID NO: 5428419 - DNA, 16 bp, Homo sapiens
ggatgtccccagcaga

SEQ ID NO: 5428420 - DNA, 23 bp, Homo sapiens
ggatgtccctattctgccatggg

SEQ ID NO: 5428421 - DNA, 12 bp, Homo sapiens
ggatgtcccttc

SEQ ID NO: 5428422 - DNA, 20 bp, Homo sapiens
ggatgtctgccaatttttgc

SEQ ID NO: 5428423 - DNA, 14 bp, Homo sapiens
ggatgtctgtagca

SEQ ID NO: 5428424 - DNA, 14 bp, Homo sapiens
ggatgtctgttgaa

SEQ ID NO: 5428425 - DNA, 13 bp, Homo sapiens
ggatgtcttcctt

SEQ ID NO: 5428426 - DNA, 17 bp, Homo sapiens
ggatgtcttccttggag

SEQ ID NO: 5428427 - DNA, 14 bp, Homo sapiens
ggatgtgaagaaat

SEQ ID NO: 5428428 - DNA, 15 bp, Homo sapiens
ggatgtgacagtggc

SEQ ID NO: 5428429 - DNA, 16 bp, Homo sapiens
ggatgtgagcagaaga

SEQ ID NO: 5428430 - DNA, 15 bp, Homo sapiens
ggatgtgagccccag

SEQ ID NO: 5428431 - DNA, 16 bp, Homo sapiens
ggatgtgagccccagg

SEQ ID NO: 5428432 - DNA, 16 bp, Homo sapiens
ggatgtgcatctggcc

SEQ ID NO: 5428433 - DNA, 18 bp, Homo sapiens
ggatgtgctggaggggtg

SEQ ID NO: 5428434 - DNA, 23 bp, Homo sapiens
ggatgtggctgcagcagcggtgg

SEQ ID NO: 5428435 - DNA, 23 bp, Homo sapiens
ggatgtgggagggagcagacagg

SEQ ID NO: 5428436 - DNA, 21 bp, Homo sapiens
ggatgtgggtaagaggagcag

SEQ ID NO: 5428437 - DNA, 18 bp, Homo sapiens
ggatgtgggtctttttct

SEQ ID NO: 5428438 - DNA, 17 bp, Homo sapiens
ggcaaggggcagccagc

SEQ ID NO: 5428439 - DNA, 15 bp, Homo sapiens
ggcaaggggccagga

SEQ ID NO: 5428440 - DNA, 15 bp, Homo sapiens
ggcaagggggcgggg

SEQ ID NO: 5428441 - DNA, 17 bp, Homo sapiens
ggcaaggggtgcctggg

SEQ ID NO: 5428442 - DNA, 15 bp, Homo sapiens
ggcaagggtgcctca

SEQ ID NO: 5428443 - DNA, 17 bp, Homo sapiens
ggcaagggtgcctcagg

SEQ ID NO: 5428444 - DNA, 21 bp, Homo sapiens
ggcaagggtgcctcaggacct

SEQ ID NO: 5428445 - DNA, 19 bp, Homo sapiens
ggcaagggttaaggcctga

SEQ ID NO: 5428446 - DNA, 14 bp, Homo sapiens
ggcaaggtggggga

SEQ ID NO: 5428447 - DNA, 18 bp, Homo sapiens
ggcaaggtgggggagcct

SEQ ID NO: 5428448 - DNA, 19 bp, Homo sapiens
ggcaaggtgggggagcctg

SEQ ID NO: 5428449 - DNA, 20 bp, Homo sapiens
ggcaaggtgggggagcctgg

SEQ ID NO: 5428450 - DNA, 22 bp, Homo sapiens
ggcaaggtgggggagcctggag

SEQ ID NO: 5428451 - DNA, 20 bp, Homo sapiens
ggcaaggttggcgactgtca

SEQ ID NO: 5428452 - DNA, 21 bp, Homo sapiens
ggcaaggtttacactgcggaa

SEQ ID NO: 5428453 - DNA, 17 bp, Homo sapiens
ggcaagtagcaggacta

SEQ ID NO: 5428454 - DNA, 22 bp, Homo sapiens
ggcaagtcgagagggctgttgg

SEQ ID NO: 5428455 - DNA, 21 bp, Homo sapiens
ggcaagtcggggcctgggaca

SEQ ID NO: 5428456 - DNA, 14 bp, Homo sapiens
ggcaagtgagaggg

SEQ ID NO: 5428457 - DNA, 19 bp, Homo sapiens
ggcaagtgatatcacctct

SEQ ID NO: 5428458 - DNA, 22 bp, Homo sapiens
ggcaagtggatggcccagcagg

SEQ ID NO: 5428459 - DNA, 12 bp, Homo sapiens
ggcaagtggggc

SEQ ID NO: 5428460 - DNA, 13 bp, Homo sapiens
ggcaagtgtgggc

SEQ ID NO: 5428461 - DNA, 16 bp, Homo sapiens
ggcaagttttccctga

SEQ ID NO: 5428462 - DNA, 17 bp, Homo sapiens
ggcaataaatgccctct

SEQ ID NO: 5428463 - DNA, 20 bp, Homo sapiens
ggcaataaatggctcgtggg

SEQ ID NO: 5428464 - DNA, 22 bp, Homo sapiens
ggcaataaatgtcccaaataaa

SEQ ID NO: 5428465 - DNA, 16 bp, Homo sapiens
ggcaataaattttgaa

SEQ ID NO: 5428466 - DNA, 18 bp, Homo sapiens
ggcaataatattttctgt

SEQ ID NO: 5428467 - DNA, 16 bp, Homo sapiens
ggcaatagggtagaat

SEQ ID NO: 5428468 - DNA, 18 bp, Homo sapiens
ggcaatagtgtgttctga

SEQ ID NO: 5428469 - DNA, 21 bp, Homo sapiens
ggcaatatagcaagatcccat

SEQ ID NO: 5428470 - DNA, 17 bp, Homo sapiens
ggcaatatctacagctt

SEQ ID NO: 5428471 - DNA, 14 bp, Homo sapiens
ggcaatattaacct

SEQ ID NO: 5428472 - DNA, 21 bp, Homo sapiens
ggcaatcaacaaacgtttctt

SEQ ID NO: 5428473 - DNA, 15 bp, Homo sapiens
ggcaatcagcaatca

SEQ ID NO: 5428474 - DNA, 17 bp, Homo sapiens
ggcaatctctctctgtg

SEQ ID NO: 5428475 - DNA, 14 bp, Homo sapiens
ggcaatgactgtga

SEQ ID NO: 5428476 - DNA, 17 bp, Homo sapiens
ggcaatgcagtgcagca

SEQ ID NO: 5428477 - DNA, 22 bp, Homo sapiens
ggcaatgcagtgcagcatggga

SEQ ID NO: 5428478 - DNA, 17 bp, Homo sapiens
ggcaatgccacagccct

SEQ ID NO: 5428479 - DNA, 16 bp, Homo sapiens
ggcaatgccatcagcc

SEQ ID NO: 5428480 - DNA, 21 bp, Homo sapiens
ggcaatgccatcagcccctgg

SEQ ID NO: 5428481 - DNA, 18 bp, Homo sapiens
ggcaatgccctgcggctc

SEQ ID NO: 5428482 - DNA, 20 bp, Homo sapiens
ggcaatggccaggggccagg

SEQ ID NO: 5428483 - DNA, 21 bp, Homo sapiens
ggcaatgggagctgaggccac

SEQ ID NO: 5428484 - DNA, 15 bp, Homo sapiens
ggcaatggggagagg

SEQ ID NO: 5428485 - DNA, 17 bp, Homo sapiens
ggcaatggggagaggca

SEQ ID NO: 5428486 - DNA, 17 bp, Homo sapiens
ggcaatgtgggatctca

SEQ ID NO: 5428487 - DNA, 11 bp, Homo sapiens
ggcaattagtg

SEQ ID NO: 5428488 - DNA, 20 bp, Homo sapiens
ggcaattatatctattatgt

SEQ ID NO: 5428489 - DNA, 18 bp, Homo sapiens
ggcaattattttggatct

SEQ ID NO: 5428490 - DNA, 22 bp, Homo sapiens
ggcaattcagtcctgggcaaag

SEQ ID NO: 5428491 - DNA, 14 bp, Homo sapiens
ggcaattctggaag

SEQ ID NO: 5428492 - DNA, 15 bp, Homo sapiens
ggcaattctggaagc

SEQ ID NO: 5428493 - DNA, 16 bp, Homo sapiens
ggcaattcttcttctc

SEQ ID NO: 5428494 - DNA, 13 bp, Homo sapiens
ggcaattgtctat

SEQ ID NO: 5428495 - DNA, 14 bp, Homo sapiens
ggcaatttcctggc

SEQ ID NO: 5428496 - DNA, 15 bp, Homo sapiens
ggcacaaaatgtgac

SEQ ID NO: 5428497 - DNA, 18 bp, Homo sapiens
ggcacaaaatgtgacatc

SEQ ID NO: 5428498 - DNA, 22 bp, Homo sapiens
ggcacaaaattctagaagcaga

SEQ ID NO: 5428499 - DNA, 22 bp, Homo sapiens
ggcacaaactgcagctgtgagt

SEQ ID NO: 5428500 - DNA, 16 bp, Homo sapiens
ggcacaaagggcaggc

SEQ ID NO: 5428501 - DNA, 17 bp, Homo sapiens
ggcacaaagttggtgcc

SEQ ID NO: 5428502 - DNA, 15 bp, Homo sapiens
ggcacaaatgcacct

SEQ ID NO: 5428503 - DNA, 21 bp, Homo sapiens
ggcacaacgctctaccctgca

SEQ ID NO: 5428504 - DNA, 22 bp, Homo sapiens
ggcacaactgcaataacttctg

SEQ ID NO: 5428505 - DNA, 17 bp, Homo sapiens
ggcacaacttcagcagg

SEQ ID NO: 5428506 - DNA, 20 bp, Homo sapiens
ggcacaagctccctggtgag

SEQ ID NO: 5428507 - DNA, 22 bp, Homo sapiens
ggcacaagtttttttgttcata

SEQ ID NO: 5428508 - DNA, 14 bp, Homo sapiens
ggcacaatctcagc

SEQ ID NO: 5428509 - DNA, 22 bp, Homo sapiens
ggcacaatctcggctcactgca

SEQ ID NO: 5428510 - DNA, 18 bp, Homo sapiens
ggcacaatgaatgtatat

SEQ ID NO: 5428511 - DNA, 20 bp, Homo sapiens
ggcacaatggctaattccca

SEQ ID NO: 5428512 - DNA, 23 bp, Homo sapiens
ggcacaatgttggagcagcaggc

SEQ ID NO: 5428513 - DNA, 21 bp, Homo sapiens
ggcacacaaggggcccttgga

SEQ ID NO: 5428514 - DNA, 18 bp, Homo sapiens
ggcacacaatgctattga

SEQ ID NO: 5428515 - DNA, 21 bp, Homo sapiens
ggcacacacctgtagtcccag

SEQ ID NO: 5428516 - DNA, 16 bp, Homo sapiens
ggcacacactgaccac

SEQ ID NO: 5428517 - DNA, 21 bp, Homo sapiens
ggcacacactgtgccccacaa

SEQ ID NO: 5428518 - DNA, 21 bp, Homo sapiens
ggcacacactgtgctttctat

SEQ ID NO: 5428519 - DNA, 18 bp, Homo sapiens
ggcacacagagattctgg

SEQ ID NO: 5428520 - DNA, 20 bp, Homo sapiens
ggcacacagagattctggat

SEQ ID NO: 5428521 - DNA, 17 bp, Homo sapiens
ggcacacagcagccccc

SEQ ID NO: 5428522 - DNA, 22 bp, Homo sapiens
ggcacacagcagccccccagca

SEQ ID NO: 5428523 - DNA, 14 bp, Homo sapiens
ggcacacagctact

SEQ ID NO: 5428524 - DNA, 14 bp, Homo sapiens
ggcacaccactgcc

SEQ ID NO: 5428525 - DNA, 20 bp, Homo sapiens
ggcacaccactgccctgcct

SEQ ID NO: 5428526 - DNA, 17 bp, Homo sapiens
ggcacaccctctctgtc

SEQ ID NO: 5428527 - DNA, 23 bp, Homo sapiens
ggcacaccgccatcctctgcctc

SEQ ID NO: 5428528 - DNA, 20 bp, Homo sapiens
ggcacacctcctcccactgc

SEQ ID NO: 5428529 - DNA, 22 bp, Homo sapiens
ggcacacgcacaaacacacaca

SEQ ID NO: 5428530 - DNA, 20 bp, Homo sapiens
ggcacacgcctgtagtccca

SEQ ID NO: 5428531 - DNA, 23 bp, Homo sapiens
ggcacactacagagcagctcccc

SEQ ID NO: 5428532 - DNA, 15 bp, Homo sapiens
ggcacactctgccag

SEQ ID NO: 5428533 - DNA, 12 bp, Homo sapiens
ggcacactgcca

SEQ ID NO: 5428534 - DNA, 14 bp, Homo sapiens
ggcacactgccaaa

SEQ ID NO: 5428535 - DNA, 20 bp, Homo sapiens
ggcacactgccaaataaaca

SEQ ID NO: 5428536 - DNA, 21 bp, Homo sapiens
ggcacactgccaaataaacag

SEQ ID NO: 5428537 - DNA, 16 bp, Homo sapiens
ggcacactttctggca

SEQ ID NO: 5428538 - DNA, 20 bp, Homo sapiens
ggcacagaaaatggaagaca

SEQ ID NO: 5428539 - DNA, 17 bp, Homo sapiens
ggcacagaaagggcagc

SEQ ID NO: 5428540 - DNA, 22 bp, Homo sapiens
ggcacagaaagggcagcttcag

SEQ ID NO: 5428541 - DNA, 22 bp, Homo sapiens
ggcacagacacgctcgcgggca

SEQ ID NO: 5428542 - DNA, 23 bp, Homo sapiens
ggcacagacacgctcgcgggcag

SEQ ID NO: 5428543 - DNA, 21 bp, Homo sapiens
ggcacagacactacatatcta

SEQ ID NO: 5428544 - DNA, 16 bp, Homo sapiens
ggcacagaccaggcct

SEQ ID NO: 5428545 - DNA, 17 bp, Homo sapiens
ggcacagaccaggcctt

SEQ ID NO: 5428546 - DNA, 21 bp, Homo sapiens
ggcacagacttcacacagcac

SEQ ID NO: 5428547 - DNA, 19 bp, Homo sapiens
ggcacagaggaggtcagca

SEQ ID NO: 5428548 - DNA, 13 bp, Homo sapiens
ggcacagatgacc

SEQ ID NO: 5428549 - DNA, 17 bp, Homo sapiens
ggcacagatgaccaaag

SEQ ID NO: 5428550 - DNA, 15 bp, Homo sapiens
ggcacagatgctcca

SEQ ID NO: 5428551 - DNA, 20 bp, Homo sapiens
ggcacagcagtttcaccatc

SEQ ID NO: 5428552 - DNA, 12 bp, Homo sapiens
ggcacagccagc

SEQ ID NO: 5428553 - DNA, 13 bp, Homo sapiens
ggcacagccagcc

SEQ ID NO: 5428554 - DNA, 14 bp, Homo sapiens
ggcacagccagccc

SEQ ID NO: 5428555 - DNA, 15 bp, Homo sapiens
ggcacagcccctgga

SEQ ID NO: 5428556 - DNA, 17 bp, Homo sapiens
ggcacagcccctggagc

SEQ ID NO: 5428557 - DNA, 22 bp, Homo sapiens
ggcacagcccctggagcctcag

SEQ ID NO: 5428558 - DNA, 14 bp, Homo sapiens
ggcacagccctccg

SEQ ID NO: 5428559 - DNA, 12 bp, Homo sapiens
ggcacagccctg

SEQ ID NO: 5428560 - DNA, 21 bp, Homo sapiens
ggcacagccgcgggccaggag

SEQ ID NO: 5428561 - DNA, 23 bp, Homo sapiens
ggcacagccgcgggccaggaggc

SEQ ID NO: 5428562 - DNA, 15 bp, Homo sapiens
ggcacagctgccctg

SEQ ID NO: 5428563 - DNA, 18 bp, Homo sapiens
ggcacagctgccctgctg

SEQ ID NO: 5428564 - DNA, 19 bp, Homo sapiens
ggcacagctgggatacaca

SEQ ID NO: 5428565 - DNA, 13 bp, Homo sapiens
ggcacagctgtct

SEQ ID NO: 5428566 - DNA, 16 bp, Homo sapiens
ggcacagctgtctgcc

SEQ ID NO: 5428567 - DNA, 12 bp, Homo sapiens
ggcacagctgtg

SEQ ID NO: 5428568 - DNA, 22 bp, Homo sapiens
ggcacaggaaacagcaaacagt

SEQ ID NO: 5428569 - DNA, 13 bp, Homo sapiens
ggcacaggactga

SEQ ID NO: 5428570 - DNA, 16 bp, Homo sapiens
ggcacaggaggcaggc

SEQ ID NO: 5428571 - DNA, 20 bp, Homo sapiens
ggcacaggaggcaggcatgg

SEQ ID NO: 5428572 - DNA, 23 bp, Homo sapiens
ggcacaggaggcaggcatggccc

SEQ ID NO: 5428573 - DNA, 13 bp, Homo sapiens
ggcacaggcactg

SEQ ID NO: 5428574 - DNA, 23 bp, Homo sapiens
ggcacaggcactgaacaggctgg

SEQ ID NO: 5428575 - DNA, 16 bp, Homo sapiens
ggcacaggcaggaaga

SEQ ID NO: 5428576 - DNA, 13 bp, Homo sapiens
ggcacaggcaggg

SEQ ID NO: 5428577 - DNA, 15 bp, Homo sapiens
ggcacaggcagggca

SEQ ID NO: 5428578 - DNA, 21 bp, Homo sapiens
ggcacaggcagggcaggacca

SEQ ID NO: 5428579 - DNA, 23 bp, Homo sapiens
ggcacaggccatggatggaaaac

SEQ ID NO: 5428580 - DNA, 18 bp, Homo sapiens
ggcacaggccgaggcagg

SEQ ID NO: 5428581 - DNA, 19 bp, Homo sapiens
ggcacaggccgtcaccctg

SEQ ID NO: 5428582 - DNA, 16 bp, Homo sapiens
ggcacaggctcctgta

SEQ ID NO: 5428583 - DNA, 20 bp, Homo sapiens
ggcacagggcaccagaggcc

SEQ ID NO: 5428584 - DNA, 22 bp, Homo sapiens
ggcacagggcaccagaggccga

SEQ ID NO: 5428585 - DNA, 23 bp, Homo sapiens
ggcacagggcccgcagtgctggg

SEQ ID NO: 5428586 - DNA, 14 bp, Homo sapiens
ggcacagggcctgg

SEQ ID NO: 5428587 - DNA, 18 bp, Homo sapiens
ggcacagggtctgctctt

SEQ ID NO: 5428588 - DNA, 17 bp, Homo sapiens
ggcacagtatgtcccat

SEQ ID NO: 5428589 - DNA, 13 bp, Homo sapiens
ggcacagtccaga

SEQ ID NO: 5428590 - DNA, 15 bp, Homo sapiens
ggcacagtccaggaa

SEQ ID NO: 5428591 - DNA, 19 bp, Homo sapiens
ggcacagtgcagcaagcct

SEQ ID NO: 5428592 - DNA, 23 bp, Homo sapiens
ggcacagtgcagcaagcctggcc

SEQ ID NO: 5428593 - DNA, 13 bp, Homo sapiens
ggcacagtgctgc

SEQ ID NO: 5428594 - DNA, 16 bp, Homo sapiens
ggcacagtgctgcccc

SEQ ID NO: 5428595 - DNA, 18 bp, Homo sapiens
ggcacagtgctgcccctt

SEQ ID NO: 5428596 - DNA, 22 bp, Homo sapiens
ggcacagtgctgccccttgcaa

SEQ ID NO: 5428597 - DNA, 16 bp, Homo sapiens
ggcacagtgggagctg

SEQ ID NO: 5428598 - DNA, 19 bp, Homo sapiens
ggcacagtgggagctgagc

SEQ ID NO: 5428599 - DNA, 21 bp, Homo sapiens
ggcacagtgggagctgagctg

SEQ ID NO: 5428600 - DNA, 23 bp, Homo sapiens
ggcacagttgtctattctgagcc

SEQ ID NO: 5428601 - DNA, 20 bp, Homo sapiens
ggcacatagcataggctggg

SEQ ID NO: 5428602 - DNA, 20 bp, Homo sapiens
ggcacatgaacagcttgcca

SEQ ID NO: 5428603 - DNA, 16 bp, Homo sapiens
ggcacatgcaggtagt

SEQ ID NO: 5428604 - DNA, 19 bp, Homo sapiens
ggcacatgctgagtctccc

SEQ ID NO: 5428605 - DNA, 14 bp, Homo sapiens
ggcacattaactgt

SEQ ID NO: 5428606 - DNA, 15 bp, Homo sapiens
ggcacattaactgtt

SEQ ID NO: 5428607 - DNA, 19 bp, Homo sapiens
ggcacattcctttgggtat

SEQ ID NO: 5428608 - DNA, 15 bp, Homo sapiens
ggcacattgaaatac

SEQ ID NO: 5428609 - DNA, 18 bp, Homo sapiens
ggcacattgagctgtgca

SEQ ID NO: 5428610 - DNA, 14 bp, Homo sapiens
ggcacattgcccat

SEQ ID NO: 5428611 - DNA, 18 bp, Homo sapiens
ggcacattgcccctctgc

SEQ ID NO: 5428612 - DNA, 20 bp, Homo sapiens
ggcacatttccccagacctg

SEQ ID NO: 5428613 - DNA, 21 bp, Homo sapiens
ggcacatttccccagacctga

SEQ ID NO: 5428614 - DNA, 22 bp, Homo sapiens
ggcagcctcaacctccctggct

SEQ ID NO: 5428615 - DNA, 16 bp, Homo sapiens
ggcagcctcaaggccc

SEQ ID NO: 5428616 - DNA, 23 bp, Homo sapiens
ggcagcctcaaggccctcggagc

SEQ ID NO: 5428617 - DNA, 15 bp, Homo sapiens
ggcagcctcagaggc

SEQ ID NO: 5428618 - DNA, 15 bp, Homo sapiens
ggcagcctcagggct

SEQ ID NO: 5428619 - DNA, 22 bp, Homo sapiens
ggcagcctccaccttgctcttc

SEQ ID NO: 5428620 - DNA, 16 bp, Homo sapiens
ggcagcctccagagcc

SEQ ID NO: 5428621 - DNA, 16 bp, Homo sapiens
ggcagcctccagcctg

SEQ ID NO: 5428622 - DNA, 15 bp, Homo sapiens
ggcagcctcctttgt

SEQ ID NO: 5428623 - DNA, 12 bp, Homo sapiens
ggcagcctctgg

SEQ ID NO: 5428624 - DNA, 13 bp, Homo sapiens
ggcagcctctggg

SEQ ID NO: 5428625 - DNA, 19 bp, Homo sapiens
ggcagcctctggggggtgg

SEQ ID NO: 5428626 - DNA, 16 bp, Homo sapiens
ggcagcctcttcaaaa

SEQ ID NO: 5428627 - DNA, 13 bp, Homo sapiens
ggcagcctgcaga

SEQ ID NO: 5428628 - DNA, 22 bp, Homo sapiens
ggcagcctgccgccgtctctgt

SEQ ID NO: 5428629 - DNA, 22 bp, Homo sapiens
ggcagcctgcgtggctgacccc

SEQ ID NO: 5428630 - DNA, 20 bp, Homo sapiens
ggcagcctggacatagagag

SEQ ID NO: 5428631 - DNA, 22 bp, Homo sapiens
ggcagcctggatccctgccctt

SEQ ID NO: 5428632 - DNA, 11 bp, Homo sapiens
ggcagcctggt

SEQ ID NO: 5428633 - DNA, 14 bp, Homo sapiens
ggcagcctgtgcct

SEQ ID NO: 5428634 - DNA, 18 bp, Homo sapiens
ggcagcctgtgggagaag

SEQ ID NO: 5428635 - DNA, 16 bp, Homo sapiens
ggcagccttgcccatt

SEQ ID NO: 5428636 - DNA, 12 bp, Homo sapiens
ggcagcgacccc

SEQ ID NO: 5428637 - DNA, 14 bp, Homo sapiens
ggcagcgaccccag

SEQ ID NO: 5428638 - DNA, 12 bp, Homo sapiens
ggcagcgcaggg

SEQ ID NO: 5428639 - DNA, 17 bp, Homo sapiens
ggcagcgcatgtgtgca

SEQ ID NO: 5428640 - DNA, 18 bp, Homo sapiens
ggcagcgcatgtgtgcat

SEQ ID NO: 5428641 - DNA, 18 bp, Homo sapiens
ggcagcgccaagtgcgtg

SEQ ID NO: 5428642 - DNA, 14 bp, Homo sapiens
ggcagcgccaggct

SEQ ID NO: 5428643 - DNA, 18 bp, Homo sapiens
ggcagcgcccagcctggc

SEQ ID NO: 5428644 - DNA, 15 bp, Homo sapiens
ggcagcgccccacca

SEQ ID NO: 5428645 - DNA, 16 bp, Homo sapiens
ggcagcgcccttcctc

SEQ ID NO: 5428646 - DNA, 21 bp, Homo sapiens
ggcagcgcccttcctctccac

SEQ ID NO: 5428647 - DNA, 17 bp, Homo sapiens
ggcagcgcctcccgccg

SEQ ID NO: 5428648 - DNA, 15 bp, Homo sapiens
ggcagcgcctcgccc

SEQ ID NO: 5428649 - DNA, 20 bp, Homo sapiens
ggcagcgcctcgccccagcc

SEQ ID NO: 5428650 - DNA, 18 bp, Homo sapiens
ggcagcgcctgtcccctc

SEQ ID NO: 5428651 - DNA, 14 bp, Homo sapiens
ggcagcgctcctgg

SEQ ID NO: 5428652 - DNA, 19 bp, Homo sapiens
ggcagcgggatctcgtatc

SEQ ID NO: 5428653 - DNA, 16 bp, Homo sapiens
ggcagcgggccaggcc

SEQ ID NO: 5428654 - DNA, 23 bp, Homo sapiens
ggcagcgggcggaggggatccag

SEQ ID NO: 5428655 - DNA, 17 bp, Homo sapiens
ggcagcggggctggcca

SEQ ID NO: 5428656 - DNA, 20 bp, Homo sapiens
ggcagcgtgccgagccagca

SEQ ID NO: 5428657 - DNA, 16 bp, Homo sapiens
ggcagcgtgggctctg

SEQ ID NO: 5428658 - DNA, 18 bp, Homo sapiens
ggcagcgtgggctctgcc

SEQ ID NO: 5428659 - DNA, 19 bp, Homo sapiens
ggcagcgttagggctgctt

SEQ ID NO: 5428660 - DNA, 15 bp, Homo sapiens
ggcagctagactgga

SEQ ID NO: 5428661 - DNA, 18 bp, Homo sapiens
ggcagctaggcagggagg

SEQ ID NO: 5428662 - DNA, 19 bp, Homo sapiens
ggcagctaggcagggaggg

SEQ ID NO: 5428663 - DNA, 13 bp, Homo sapiens
ggcagctagtgcc

SEQ ID NO: 5428664 - DNA, 15 bp, Homo sapiens
ggcagctagtgcctt

SEQ ID NO: 5428665 - DNA, 15 bp, Homo sapiens
ggcagctcaaagact

SEQ ID NO: 5428666 - DNA, 16 bp, Homo sapiens
ggcagctcacccctgg

SEQ ID NO: 5428667 - DNA, 19 bp, Homo sapiens
ggcagctcacccctgggca

SEQ ID NO: 5428668 - DNA, 22 bp, Homo sapiens
ggcagctcacctctcccttgga

SEQ ID NO: 5428669 - DNA, 21 bp, Homo sapiens
ggcagctcagagagggtggga

SEQ ID NO: 5428670 - DNA, 21 bp, Homo sapiens
ggcagctcctccctgtgcccc

SEQ ID NO: 5428671 - DNA, 14 bp, Homo sapiens
ggcagctcctctcc

SEQ ID NO: 5428672 - DNA, 18 bp, Homo sapiens
ggcagctcctctccttgg

SEQ ID NO: 5428673 - DNA, 22 bp, Homo sapiens
ggcagctcctctccttgggctc

SEQ ID NO: 5428674 - DNA, 13 bp, Homo sapiens
ggcagctcctctg

SEQ ID NO: 5428675 - DNA, 21 bp, Homo sapiens
ggcagctcctctgtctcgagc

SEQ ID NO: 5428676 - DNA, 12 bp, Homo sapiens
ggcagctcctga

SEQ ID NO: 5428677 - DNA, 15 bp, Homo sapiens
ggcagctcctgacct

SEQ ID NO: 5428678 - DNA, 13 bp, Homo sapiens
ggcagctcctgtt

SEQ ID NO: 5428679 - DNA, 15 bp, Homo sapiens
ggcagctcctgtttg

SEQ ID NO: 5428680 - DNA, 22 bp, Homo sapiens
ggcagctcgagcatgccctgag

SEQ ID NO: 5428681 - DNA, 16 bp, Homo sapiens
ggcagctcgaggcccc

SEQ ID NO: 5428682 - DNA, 14 bp, Homo sapiens
ggcagctctccagt

SEQ ID NO: 5428683 - DNA, 21 bp, Homo sapiens
ggcagctctccagtcaggagg

SEQ ID NO: 5428684 - DNA, 15 bp, Homo sapiens
ggcagctctgagccg

SEQ ID NO: 5428685 - DNA, 20 bp, Homo sapiens
ggcagctctggacagcccca

SEQ ID NO: 5428686 - DNA, 16 bp, Homo sapiens
ggcagctcttctggag

SEQ ID NO: 5428687 - DNA, 18 bp, Homo sapiens
ggcagctcttctggagtt

SEQ ID NO: 5428688 - DNA, 24 bp, Homo sapiens
ggcagctcttctgggcagagcctg

SEQ ID NO: 5428689 - DNA, 20 bp, Homo sapiens
ggcagctgaaaagtaaattg

SEQ ID NO: 5428690 - DNA, 21 bp, Homo sapiens
ggcagctgaactattggaggg

SEQ ID NO: 5428691 - DNA, 17 bp, Homo sapiens
ggcagctgaccatggaa

SEQ ID NO: 5428692 - DNA, 16 bp, Homo sapiens
ggcagctgagaccagg

SEQ ID NO: 5428693 - DNA, 18 bp, Homo sapiens
ggcagctgagaccagggt

SEQ ID NO: 5428694 - DNA, 23 bp, Homo sapiens
ggcagctgaggacacaccccaca

SEQ ID NO: 5428695 - DNA, 19 bp, Homo sapiens
ggcagctgatccaggcaat

SEQ ID NO: 5428696 - DNA, 22 bp, Homo sapiens
ggcagctgcagttagcacagag

SEQ ID NO: 5428697 - DNA, 11 bp, Homo sapiens
ggcagctgcca

SEQ ID NO: 5428698 - DNA, 17 bp, Homo sapiens
ggcagctgccagagaag

SEQ ID NO: 5428699 - DNA, 12 bp, Homo sapiens
ggcagctgcccc

SEQ ID NO: 5428700 - DNA, 21 bp, Homo sapiens
ggcagctgcccctcctggagc

SEQ ID NO: 5428701 - DNA, 17 bp, Homo sapiens
ggcagctgcccctggca

SEQ ID NO: 5428702 - DNA, 12 bp, Homo sapiens
ggcagctgcctc

SEQ ID NO: 5428703 - DNA, 16 bp, Homo sapiens
ggcagctgcctcccct

SEQ ID NO: 5428704 - DNA, 14 bp, Homo sapiens
ggcagctgcctctg

SEQ ID NO: 5428705 - DNA, 16 bp, Homo sapiens
ggcagctgcctctgct

SEQ ID NO: 5428706 - DNA, 18 bp, Homo sapiens
ggcagctgcctctgctcc

SEQ ID NO: 5428707 - DNA, 22 bp, Homo sapiens
ggcagctgcctctgctccctct

SEQ ID NO: 5428708 - DNA, 13 bp, Homo sapiens
ggcagctgcctgg

SEQ ID NO: 5428709 - DNA, 14 bp, Homo sapiens
ggcagctgcctggc

SEQ ID NO: 5428710 - DNA, 15 bp, Homo sapiens
ggcagctgcctggcc

SEQ ID NO: 5428711 - DNA, 16 bp, Homo sapiens
ggcagctgcctggcca

SEQ ID NO: 5428712 - DNA, 19 bp, Homo sapiens
ggcagctgcggtccaccca

SEQ ID NO: 5428713 - DNA, 11 bp, Homo sapiens
ggcagctgcta

SEQ ID NO: 5428714 - DNA, 12 bp, Homo sapiens
ggcagctgctct

SEQ ID NO: 5428715 - DNA, 23 bp, Homo sapiens
ggcagctggaagtggctctgggg

SEQ ID NO: 5428716 - DNA, 22 bp, Homo sapiens
ggcagctggaccatctctgtag

SEQ ID NO: 5428717 - DNA, 12 bp, Homo sapiens
ggcagctggcag

SEQ ID NO: 5428718 - DNA, 11 bp, Homo sapiens
ggcagctggcc

SEQ ID NO: 5428719 - DNA, 13 bp, Homo sapiens
ggcagctggctct

SEQ ID NO: 5428720 - DNA, 22 bp, Homo sapiens
ggcagctggctctgaatgtagc

SEQ ID NO: 5428721 - DNA, 19 bp, Homo sapiens
ggcagctgggcccaaccct

SEQ ID NO: 5428722 - DNA, 20 bp, Homo sapiens
ggcagctgggcccacagccc

SEQ ID NO: 5428723 - DNA, 23 bp, Homo sapiens
ggcagctgggcccacagccccca

SEQ ID NO: 5428724 - DNA, 14 bp, Homo sapiens
ggcagctgggcccc

SEQ ID NO: 5428725 - DNA, 19 bp, Homo sapiens
ggcagctgggccccaccta

SEQ ID NO: 5428726 - DNA, 19 bp, Homo sapiens
ggcagctggggagcagctg

SEQ ID NO: 5428727 - DNA, 16 bp, Homo sapiens
ggcagctggggggctg

SEQ ID NO: 5428728 - DNA, 13 bp, Homo sapiens
ggcagctgtagct

SEQ ID NO: 5428729 - DNA, 21 bp, Homo sapiens
ggcagctgtcatggaaaagcc

SEQ ID NO: 5428730 - DNA, 22 bp, Homo sapiens
ggcagctgtcccctctccctgg

SEQ ID NO: 5428731 - DNA, 13 bp, Homo sapiens
ggcagctgtgtct

SEQ ID NO: 5428732 - DNA, 18 bp, Homo sapiens
ggcagctgtgtctgagcc

SEQ ID NO: 5428733 - DNA, 19 bp, Homo sapiens
ggcagctgtgtctgagccc

SEQ ID NO: 5428734 - DNA, 20 bp, Homo sapiens
ggcagctgtttctcatgaag

SEQ ID NO: 5428735 - DNA, 17 bp, Homo sapiens
ggcagcttagggccctg

SEQ ID NO: 5428736 - DNA, 19 bp, Homo sapiens
ggcagcttagggccctgga

SEQ ID NO: 5428737 - DNA, 22 bp, Homo sapiens
ggcagcttagggccctggaggc

SEQ ID NO: 5428738 - DNA, 18 bp, Homo sapiens
ggcagcttcaagtgcctt

SEQ ID NO: 5428739 - DNA, 20 bp, Homo sapiens
ggcagcttctgttggcagag

SEQ ID NO: 5428740 - DNA, 21 bp, Homo sapiens
ggcagcttctgttggcagagc

SEQ ID NO: 5428741 - DNA, 13 bp, Homo sapiens
ggcagcttgctgg

SEQ ID NO: 5428742 - DNA, 15 bp, Homo sapiens
ggcagcttgggctgg

SEQ ID NO: 5428743 - DNA, 16 bp, Homo sapiens
ggcagcttgggctggc

SEQ ID NO: 5428744 - DNA, 23 bp, Homo sapiens
ggcagcttgggctggcgggccct

SEQ ID NO: 5428745 - DNA, 15 bp, Homo sapiens
ggcagctttgctcat

SEQ ID NO: 5428746 - DNA, 16 bp, Homo sapiens
ggcagctttttctgtg

SEQ ID NO: 5428747 - DNA, 11 bp, Homo sapiens
ggcaggaaaag

SEQ ID NO: 5428748 - DNA, 13 bp, Homo sapiens
ggcaggaaagcca

SEQ ID NO: 5428749 - DNA, 20 bp, Homo sapiens
ggcaggaaccatggacctgc

SEQ ID NO: 5428750 - DNA, 21 bp, Homo sapiens
ggcaggaaccatggacctgca

SEQ ID NO: 5428751 - DNA, 16 bp, Homo sapiens
ggcaggaagagagaga

SEQ ID NO: 5428752 - DNA, 21 bp, Homo sapiens
ggcaggaaggaactcaaggtg

SEQ ID NO: 5428753 - DNA, 15 bp, Homo sapiens
ggcaggaaggagagc

SEQ ID NO: 5428754 - DNA, 17 bp, Homo sapiens
ggcaggaagggaagcgt

SEQ ID NO: 5428755 - DNA, 10 bp, Homo sapiens
ggcaggaagt

SEQ ID NO: 5428756 - DNA, 15 bp, Homo sapiens
ggcaggaagtccctg

SEQ ID NO: 5428757 - DNA, 18 bp, Homo sapiens
ggcaggaatcaaggagcc

SEQ ID NO: 5428758 - DNA, 20 bp, Homo sapiens
ggcaggaatcaaggagcctc

SEQ ID NO: 5428759 - DNA, 18 bp, Homo sapiens
ggcaggaatgggggtcag

SEQ ID NO: 5428760 - DNA, 20 bp, Homo sapiens
ggcaggacaacgaggaagcc

SEQ ID NO: 5428761 - DNA, 12 bp, Homo sapiens
ggcaggacacat

SEQ ID NO: 5428762 - DNA, 14 bp, Homo sapiens
ggcaggacaggaaa

SEQ ID NO: 5428763 - DNA, 22 bp, Homo sapiens
ggcaggaccactagctaagcaa

SEQ ID NO: 5428764 - DNA, 16 bp, Homo sapiens
ggcaggaccagaaggc

SEQ ID NO: 5428765 - DNA, 19 bp, Homo sapiens
ggcaggaccagaaggcaat

SEQ ID NO: 5428766 - DNA, 13 bp, Homo sapiens
ggcaggaccagcc

SEQ ID NO: 5428767 - DNA, 14 bp, Homo sapiens
ggcaggaccagccc

SEQ ID NO: 5428768 - DNA, 16 bp, Homo sapiens
ggcaggaccagcccac

SEQ ID NO: 5428769 - DNA, 17 bp, Homo sapiens
ggcaggaccagcccacg

SEQ ID NO: 5428770 - DNA, 16 bp, Homo sapiens
ggcaggaccctgtcag

SEQ ID NO: 5428771 - DNA, 17 bp, Homo sapiens
ggcaggaccctgtcagg

SEQ ID NO: 5428772 - DNA, 17 bp, Homo sapiens
ggcaggaccgccatggt

SEQ ID NO: 5428773 - DNA, 20 bp, Homo sapiens
ggcaggaccgccatggtgct

SEQ ID NO: 5428774 - DNA, 21 bp, Homo sapiens
ggcaggacctcagagtccagg

SEQ ID NO: 5428775 - DNA, 22 bp, Homo sapiens
ggcaggacctgcctagcatggg

SEQ ID NO: 5428776 - DNA, 19 bp, Homo sapiens
ggcaggacgagactcctcg

SEQ ID NO: 5428777 - DNA, 18 bp, Homo sapiens
ggcaggacgtgggctggg

SEQ ID NO: 5428778 - DNA, 18 bp, Homo sapiens
ggcaggactcctggcagg

SEQ ID NO: 5428779 - DNA, 19 bp, Homo sapiens
ggcaggactgcagagcaga

SEQ ID NO: 5428780 - DNA, 23 bp, Homo sapiens
ggcaggagaagaacaagaaatgg

SEQ ID NO: 5428781 - DNA, 18 bp, Homo sapiens
ggcaggagagagccttgg

SEQ ID NO: 5428782 - DNA, 16 bp, Homo sapiens
ggcaggagaggctggg

SEQ ID NO: 5428783 - DNA, 16 bp, Homo sapiens
ggcaggagcctagagg

SEQ ID NO: 5428784 - DNA, 17 bp, Homo sapiens
ggcaggagcctagagga

SEQ ID NO: 5428785 - DNA, 22 bp, Homo sapiens
ggcaggagcctcgtgtcctgct

SEQ ID NO: 5428786 - DNA, 12 bp, Homo sapiens
ggcaggagctca

SEQ ID NO: 5428787 - DNA, 13 bp, Homo sapiens
ggcaggagctcac

SEQ ID NO: 5428788 - DNA, 14 bp, Homo sapiens
ggcaggagctcaca

SEQ ID NO: 5428789 - DNA, 18 bp, Homo sapiens
ggcaggagctcacaccgc

SEQ ID NO: 5428790 - DNA, 15 bp, Homo sapiens
ggcaggagctcctgg

SEQ ID NO: 5428791 - DNA, 14 bp, Homo sapiens
ggcaggagctgctg

SEQ ID NO: 5428792 - DNA, 19 bp, Homo sapiens
ggcaggaggaaaaggcttg

SEQ ID NO: 5428793 - DNA, 17 bp, Homo sapiens
ggcatatgtttccccat

SEQ ID NO: 5428794 - DNA, 17 bp, Homo sapiens
ggcatatttttcacata

SEQ ID NO: 5428795 - DNA, 21 bp, Homo sapiens
ggcatcaagaggtgggagggc

SEQ ID NO: 5428796 - DNA, 21 bp, Homo sapiens
ggcatcacacttatattttat

SEQ ID NO: 5428797 - DNA, 14 bp, Homo sapiens
ggcatcacagaccc

SEQ ID NO: 5428798 - DNA, 18 bp, Homo sapiens
ggcatcaccttaggcagg

SEQ ID NO: 5428799 - DNA, 23 bp, Homo sapiens
ggcatcaccttaggcagggaagt

SEQ ID NO: 5428800 - DNA, 20 bp, Homo sapiens
ggcatcactgattccctctc

SEQ ID NO: 5428801 - DNA, 22 bp, Homo sapiens
ggcatcagctttccctggctca

SEQ ID NO: 5428802 - DNA, 23 bp, Homo sapiens
ggcatcagctttccctggctcag

SEQ ID NO: 5428803 - DNA, 12 bp, Homo sapiens
ggcatcaggcac

SEQ ID NO: 5428804 - DNA, 18 bp, Homo sapiens
ggcatcaggcactggtgg

SEQ ID NO: 5428805 - DNA, 19 bp, Homo sapiens
ggcatcaggcactggtggc

SEQ ID NO: 5428806 - DNA, 21 bp, Homo sapiens
ggcatcagggcctttctcctc

SEQ ID NO: 5428807 - DNA, 14 bp, Homo sapiens
ggcatcaggtctgg

SEQ ID NO: 5428808 - DNA, 17 bp, Homo sapiens
ggcatcaggtctgggca

SEQ ID NO: 5428809 - DNA, 19 bp, Homo sapiens
ggcatcaggtctgggcaag

SEQ ID NO: 5428810 - DNA, 20 bp, Homo sapiens
ggcatcatcaataaaacagt

SEQ ID NO: 5428811 - DNA, 14 bp, Homo sapiens
ggcatcatcctcag

SEQ ID NO: 5428812 - DNA, 16 bp, Homo sapiens
ggcatcatcctcagca

SEQ ID NO: 5428813 - DNA, 23 bp, Homo sapiens
ggcatcatctcagctcactgcaa

SEQ ID NO: 5428814 - DNA, 23 bp, Homo sapiens
ggcatcatgcatcttactgaagg

SEQ ID NO: 5428815 - DNA, 14 bp, Homo sapiens
ggcatcatggtgga

SEQ ID NO: 5428816 - DNA, 15 bp, Homo sapiens
ggcatcattctcctt

SEQ ID NO: 5428817 - DNA, 23 bp, Homo sapiens
ggcatcatttcccctcccgcttc

SEQ ID NO: 5428818 - DNA, 14 bp, Homo sapiens
ggcatcattttcac

SEQ ID NO: 5428819 - DNA, 21 bp, Homo sapiens
ggcatccaaaggctcctgaga

SEQ ID NO: 5428820 - DNA, 17 bp, Homo sapiens
ggcatccaaatggctgc

SEQ ID NO: 5428821 - DNA, 18 bp, Homo sapiens
ggcatccaaatggctgct

SEQ ID NO: 5428822 - DNA, 20 bp, Homo sapiens
ggcatccacccagtgctgcc

SEQ ID NO: 5428823 - DNA, 22 bp, Homo sapiens
ggcatccacccagtgctgccat

SEQ ID NO: 5428824 - DNA, 18 bp, Homo sapiens
ggcatccaccttcctgcc

SEQ ID NO: 5428825 - DNA, 16 bp, Homo sapiens
ggcatccagagtccct

SEQ ID NO: 5428826 - DNA, 18 bp, Homo sapiens
ggcatccagagtccctgc

SEQ ID NO: 5428827 - DNA, 18 bp, Homo sapiens
ggcatccagcagtctctg

SEQ ID NO: 5428828 - DNA, 17 bp, Homo sapiens
ggcatccaggccagggc

SEQ ID NO: 5428829 - DNA, 14 bp, Homo sapiens
ggcatccagggctg

SEQ ID NO: 5428830 - DNA, 18 bp, Homo sapiens
ggcatccagggctgccag

SEQ ID NO: 5428831 - DNA, 22 bp, Homo sapiens
ggcatccatggggtctctcaca

SEQ ID NO: 5428832 - DNA, 19 bp, Homo sapiens
ggcatcccagcctgggggc

SEQ ID NO: 5428833 - DNA, 18 bp, Homo sapiens
ggcatcccagtggcctca

SEQ ID NO: 5428834 - DNA, 17 bp, Homo sapiens
ggcatccccagccccct

SEQ ID NO: 5428835 - DNA, 19 bp, Homo sapiens
ggcatccccagtgccagct

SEQ ID NO: 5428836 - DNA, 17 bp, Homo sapiens
ggcatccctcctggtac

SEQ ID NO: 5428837 - DNA, 12 bp, Homo sapiens
ggcatccctggg

SEQ ID NO: 5428838 - DNA, 16 bp, Homo sapiens
ggcatccgagcccctg

SEQ ID NO: 5428839 - DNA, 16 bp, Homo sapiens
ggcatccgcagcccag

SEQ ID NO: 5428840 - DNA, 19 bp, Homo sapiens
ggcatccgtgaggcaggga

SEQ ID NO: 5428841 - DNA, 12 bp, Homo sapiens
ggcatcctctga

SEQ ID NO: 5428842 - DNA, 15 bp, Homo sapiens
ggcatcctctgactc

SEQ ID NO: 5428843 - DNA, 17 bp, Homo sapiens
ggcatcctctttttcca

SEQ ID NO: 5428844 - DNA, 13 bp, Homo sapiens
ggcatcctgaaag

SEQ ID NO: 5428845 - DNA, 18 bp, Homo sapiens
ggcatcctgaaagccagc

SEQ ID NO: 5428846 - DNA, 13 bp, Homo sapiens
ggcatcctgcctg

SEQ ID NO: 5428847 - DNA, 16 bp, Homo sapiens
ggcatcctgcctgggt

SEQ ID NO: 5428848 - DNA, 20 bp, Homo sapiens
ggcatcctgcctgggtggga

SEQ ID NO: 5428849 - DNA, 12 bp, Homo sapiens
ggcatcctggat

SEQ ID NO: 5428850 - DNA, 15 bp, Homo sapiens
ggcatcctggctggc

SEQ ID NO: 5428851 - DNA, 16 bp, Homo sapiens
ggcatcctggctggct

SEQ ID NO: 5428852 - DNA, 20 bp, Homo sapiens
ggcatccttcctcacaccag

SEQ ID NO: 5428853 - DNA, 19 bp, Homo sapiens
ggcatccttctgccttttt

SEQ ID NO: 5428854 - DNA, 15 bp, Homo sapiens
ggcatccttgcctgt

SEQ ID NO: 5428855 - DNA, 18 bp, Homo sapiens
ggcatccttgcctgtcta

SEQ ID NO: 5428856 - DNA, 21 bp, Homo sapiens
ggcatccttgcctgtctaaag

SEQ ID NO: 5428857 - DNA, 18 bp, Homo sapiens
ggcatccttgtcttttga

SEQ ID NO: 5428858 - DNA, 20 bp, Homo sapiens
ggcatcgaccacaccagcct

SEQ ID NO: 5428859 - DNA, 18 bp, Homo sapiens
ggcatcgcaccattctga

SEQ ID NO: 5428860 - DNA, 14 bp, Homo sapiens
ggcatcgcaggagt

SEQ ID NO: 5428861 - DNA, 19 bp, Homo sapiens
ggcatcgcatccgtcctgg

SEQ ID NO: 5428862 - DNA, 10 bp, Homo sapiens
ggcatctaag

SEQ ID NO: 5428863 - DNA, 20 bp, Homo sapiens
ggcatctacacagcctggac

SEQ ID NO: 5428864 - DNA, 22 bp, Homo sapiens
ggcatctacacagcctggactt

SEQ ID NO: 5428865 - DNA, 16 bp, Homo sapiens
ggcatctatctgtgct

SEQ ID NO: 5428866 - DNA, 14 bp, Homo sapiens
ggcatctccaggaa

SEQ ID NO: 5428867 - DNA, 23 bp, Homo sapiens
ggcatctcccccaccctgtgccc

SEQ ID NO: 5428868 - DNA, 15 bp, Homo sapiens
ggcatctcccctagc

SEQ ID NO: 5428869 - DNA, 17 bp, Homo sapiens
ggcatctcccctagctc

SEQ ID NO: 5428870 - DNA, 15 bp, Homo sapiens
ggcatctcctgtcct

SEQ ID NO: 5428871 - DNA, 16 bp, Homo sapiens
ggcatctcctgtgcat

SEQ ID NO: 5428872 - DNA, 23 bp, Homo sapiens
ggcatctctccccatatataaat

SEQ ID NO: 5428873 - DNA, 16 bp, Homo sapiens
ggcatctctggagtgt

SEQ ID NO: 5428874 - DNA, 20 bp, Homo sapiens
ggcatctctgggctgagcct

SEQ ID NO: 5428875 - DNA, 21 bp, Homo sapiens
ggcatctctgggctgagccta

SEQ ID NO: 5428876 - DNA, 16 bp, Homo sapiens
ggcatctctgggctgg

SEQ ID NO: 5428877 - DNA, 22 bp, Homo sapiens
ggcatctctgtcccattccctg

SEQ ID NO: 5428878 - DNA, 19 bp, Homo sapiens
ggcatctgagtccagctcc

SEQ ID NO: 5428879 - DNA, 19 bp, Homo sapiens
ggcatctgatttgcatatt

SEQ ID NO: 5428880 - DNA, 15 bp, Homo sapiens
ggcatctgcaccctc

SEQ ID NO: 5428881 - DNA, 13 bp, Homo sapiens
ggcatctgctttt

SEQ ID NO: 5428882 - DNA, 15 bp, Homo sapiens
ggcatctggccctgc

SEQ ID NO: 5428883 - DNA, 16 bp, Homo sapiens
ggcatctggccctgct

SEQ ID NO: 5428884 - DNA, 20 bp, Homo sapiens
ggcatctggccctgctgccc

SEQ ID NO: 5428885 - DNA, 22 bp, Homo sapiens
ggcatctggccctgctgccccc

SEQ ID NO: 5428886 - DNA, 13 bp, Homo sapiens
ggcatctgtctgt

SEQ ID NO: 5428887 - DNA, 13 bp, Homo sapiens
ggcatctgtgtgc

SEQ ID NO: 5428888 - DNA, 16 bp, Homo sapiens
ggcatctgttagcaga

SEQ ID NO: 5428889 - DNA, 16 bp, Homo sapiens
ggcatcttgctgctaa

SEQ ID NO: 5428890 - DNA, 16 bp, Homo sapiens
ggcatctttgccttgg

SEQ ID NO: 5428891 - DNA, 16 bp, Homo sapiens
ggcatctttggggagg

SEQ ID NO: 5428892 - DNA, 17 bp, Homo sapiens
ggcatgaaatgaacaca

SEQ ID NO: 5428893 - DNA, 18 bp, Homo sapiens
ggcatgaaccccaggctg

SEQ ID NO: 5428894 - DNA, 12 bp, Homo sapiens
ggcatgaaccct

SEQ ID NO: 5428895 - DNA, 14 bp, Homo sapiens
ggcatgaagctgca

SEQ ID NO: 5428896 - DNA, 23 bp, Homo sapiens
ggcatgaagtttccttggctggt

SEQ ID NO: 5428897 - DNA, 22 bp, Homo sapiens
ggcatgacacgaatattgctga

SEQ ID NO: 5428898 - DNA, 14 bp, Homo sapiens
ggcatgacactcta

SEQ ID NO: 5428899 - DNA, 15 bp, Homo sapiens
ggcatgacactctag

SEQ ID NO: 5428900 - DNA, 18 bp, Homo sapiens
ggcatgaccatcctgtcc

SEQ ID NO: 5428901 - DNA, 20 bp, Homo sapiens
ggcatgaccctggagcccgg

SEQ ID NO: 5428902 - DNA, 18 bp, Homo sapiens
ggcatgagccactgtgct

SEQ ID NO: 5428903 - DNA, 17 bp, Homo sapiens
ggcatgagctcttggca

SEQ ID NO: 5428904 - DNA, 13 bp, Homo sapiens
ggcatgaggaggt

SEQ ID NO: 5428905 - DNA, 17 bp, Homo sapiens
ggcatgagtctgtttcc

SEQ ID NO: 5428906 - DNA, 22 bp, Homo sapiens
ggcatgagtctgtttcccaagc

SEQ ID NO: 5428907 - DNA, 20 bp, Homo sapiens
ggcatgatcatagctcactg

SEQ ID NO: 5428908 - DNA, 15 bp, Homo sapiens
ggcatgatgcgggcc

SEQ ID NO: 5428909 - DNA, 19 bp, Homo sapiens
ggcatgatgggccgagcca

SEQ ID NO: 5428910 - DNA, 21 bp, Homo sapiens
ggcatgatttatatatggcat

SEQ ID NO: 5428911 - DNA, 15 bp, Homo sapiens
ggcatgcacacggct

SEQ ID NO: 5428912 - DNA, 17 bp, Homo sapiens
ggcatgcacacggctgg

SEQ ID NO: 5428913 - DNA, 18 bp, Homo sapiens
ggcatgcacacggctggt

SEQ ID NO: 5428914 - DNA, 21 bp, Homo sapiens
ggcatgcacctgcaatcccag

SEQ ID NO: 5428915 - DNA, 18 bp, Homo sapiens
ggcatgcagctgcctggg

SEQ ID NO: 5428916 - DNA, 19 bp, Homo sapiens
ggcatgcagctgcctgggg

SEQ ID NO: 5428917 - DNA, 21 bp, Homo sapiens
ggcatgcagctgcctggggcc

SEQ ID NO: 5428918 - DNA, 13 bp, Homo sapiens
ggcatgcagcttg

SEQ ID NO: 5428919 - DNA, 13 bp, Homo sapiens
ggcatgccaggac

SEQ ID NO: 5428920 - DNA, 20 bp, Homo sapiens
ggcatgccccggccacctct

SEQ ID NO: 5428921 - DNA, 15 bp, Homo sapiens
ggcatgccgagtgcc

SEQ ID NO: 5428922 - DNA, 15 bp, Homo sapiens
ggcatgcctggcctg

SEQ ID NO: 5428923 - DNA, 24 bp, Homo sapiens
ggcatgcgaatgagctgggccctg

SEQ ID NO: 5428924 - DNA, 19 bp, Homo sapiens
ggcatgcgcacaaggctga

SEQ ID NO: 5428925 - DNA, 17 bp, Homo sapiens
ggcatgcggtcgggcag

SEQ ID NO: 5428926 - DNA, 11 bp, Homo sapiens
ggcatgctaaa

SEQ ID NO: 5428927 - DNA, 17 bp, Homo sapiens
ggcatgctaaagccttc

SEQ ID NO: 5428928 - DNA, 14 bp, Homo sapiens
ggcatgctcagccc

SEQ ID NO: 5428929 - DNA, 22 bp, Homo sapiens
ggcatgcttattagcagctggg

SEQ ID NO: 5428930 - DNA, 19 bp, Homo sapiens
ggcatgcttctcaccgtgc

SEQ ID NO: 5428931 - DNA, 16 bp, Homo sapiens
ggcatggacagggcca

SEQ ID NO: 5428932 - DNA, 18 bp, Homo sapiens
ggcatggacagggccagg

SEQ ID NO: 5428933 - DNA, 14 bp, Homo sapiens
ggcatggacttctg

SEQ ID NO: 5428934 - DNA, 15 bp, Homo sapiens
ggcatggcaggagtc

SEQ ID NO: 5428935 - DNA, 19 bp, Homo sapiens
ggcatggcagggccaggcc

SEQ ID NO: 5428936 - DNA, 20 bp, Homo sapiens
ggcatggcagggccaggcct

SEQ ID NO: 5428937 - DNA, 18 bp, Homo sapiens
ggcatggccaggtggcca

SEQ ID NO: 5428938 - DNA, 12 bp, Homo sapiens
ggcatggccctg

SEQ ID NO: 5428939 - DNA, 13 bp, Homo sapiens
ggcatggccctgg

SEQ ID NO: 5428940 - DNA, 16 bp, Homo sapiens
ggcatggccctggggt

SEQ ID NO: 5428941 - DNA, 17 bp, Homo sapiens
ggcatggccctggggtc

SEQ ID NO: 5428942 - DNA, 17 bp, Homo sapiens
ggcatggctcagagctt

SEQ ID NO: 5428943 - DNA, 13 bp, Homo sapiens
ggcatggctccct

SEQ ID NO: 5428944 - DNA, 18 bp, Homo sapiens
ggcatgggaatgaatgtc

SEQ ID NO: 5428945 - DNA, 22 bp, Homo sapiens
ggcatgggaatgaatgtcagtg

SEQ ID NO: 5428946 - DNA, 17 bp, Homo sapiens
ggcatgggacaggggga

SEQ ID NO: 5428947 - DNA, 16 bp, Homo sapiens
ggcatgggcctctctg

SEQ ID NO: 5428948 - DNA, 19 bp, Homo sapiens
ggcatgggcctctctgggg

SEQ ID NO: 5428949 - DNA, 21 bp, Homo sapiens
ggcatgggcctctctggggga

SEQ ID NO: 5428950 - DNA, 22 bp, Homo sapiens
ggcatggggaggggagagaagg

SEQ ID NO: 5428951 - DNA, 18 bp, Homo sapiens
ggcatggggcatgtcctt

SEQ ID NO: 5428952 - DNA, 16 bp, Homo sapiens
ggcatgggggaggctc

SEQ ID NO: 5428953 - DNA, 20 bp, Homo sapiens
ggcatgggggaggctctgaa

SEQ ID NO: 5428954 - DNA, 17 bp, Homo sapiens
ggcatgggggcccaaag

SEQ ID NO: 5428955 - DNA, 19 bp, Homo sapiens
ggcatgggggcctcagggc

SEQ ID NO: 5428956 - DNA, 20 bp, Homo sapiens
ggcatggggtgggcctctgg

SEQ ID NO: 5428957 - DNA, 16 bp, Homo sapiens
ggcatgggtccagggc

SEQ ID NO: 5428958 - DNA, 17 bp, Homo sapiens
ggcatgggtccagggcc

SEQ ID NO: 5428959 - DNA, 24 bp, Homo sapiens
ggcatgggtccagggcctgacacc

SEQ ID NO: 5428960 - DNA, 14 bp, Homo sapiens
ggcatgggtcggga

SEQ ID NO: 5428961 - DNA, 18 bp, Homo sapiens
ggcatgggtggaattaga

SEQ ID NO: 5428962 - DNA, 15 bp, Homo sapiens
ggcatgggtggaggg

SEQ ID NO: 5428963 - DNA, 16 bp, Homo sapiens
ggcatggtaccagccc

SEQ ID NO: 5428964 - DNA, 19 bp, Homo sapiens
ggcatggtaccagccctgg

SEQ ID NO: 5428965 - DNA, 20 bp, Homo sapiens
ggcatggtggcacgtgcctg

SEQ ID NO: 5428966 - DNA, 19 bp, Homo sapiens
ggcatggtggcgcaagcct

SEQ ID NO: 5428967 - DNA, 21 bp, Homo sapiens
ggcatggtggcgcaagcctgt

SEQ ID NO: 5428968 - DNA, 21 bp, Homo sapiens
ggcatggtggctcatgcctgt

SEQ ID NO: 5428969 - DNA, 16 bp, Homo sapiens
ggcatggtgttctcct

SEQ ID NO: 5428970 - DNA, 22 bp, Homo sapiens
ggccacaaggaaaaggaggagg

SEQ ID NO: 5428971 - DNA, 23 bp, Homo sapiens
ggccacaaggaaaaggaggaggt

SEQ ID NO: 5428972 - DNA, 21 bp, Homo sapiens
ggccacaagttctttcccagc

SEQ ID NO: 5428973 - DNA, 18 bp, Homo sapiens
ggccacacagcagcgcag

SEQ ID NO: 5428974 - DNA, 14 bp, Homo sapiens
ggccacacagctgc

SEQ ID NO: 5428975 - DNA, 16 bp, Homo sapiens
ggccacacaggcaggg

SEQ ID NO: 5428976 - DNA, 18 bp, Homo sapiens
ggccacacaggcagggcc

SEQ ID NO: 5428977 - DNA, 20 bp, Homo sapiens
ggccacacaggcagggcctg

SEQ ID NO: 5428978 - DNA, 15 bp, Homo sapiens
ggccacacccagagt

SEQ ID NO: 5428979 - DNA, 15 bp, Homo sapiens
ggccacacccaggaa

SEQ ID NO: 5428980 - DNA, 13 bp, Homo sapiens
ggccacaccccag

SEQ ID NO: 5428981 - DNA, 19 bp, Homo sapiens
ggccacacccctctgctgc

SEQ ID NO: 5428982 - DNA, 21 bp, Homo sapiens
ggccacacccctctgctgcaa

SEQ ID NO: 5428983 - DNA, 22 bp, Homo sapiens
ggccacacgcactggtgccaaa

SEQ ID NO: 5428984 - DNA, 22 bp, Homo sapiens
ggccacacgctgcccaggctct

SEQ ID NO: 5428985 - DNA, 18 bp, Homo sapiens
ggccacacgtggctggcg

SEQ ID NO: 5428986 - DNA, 14 bp, Homo sapiens
ggccacactgggct

SEQ ID NO: 5428987 - DNA, 14 bp, Homo sapiens
ggccacagaaaggc

SEQ ID NO: 5428988 - DNA, 22 bp, Homo sapiens
ggccacagaaaggccactcagg

SEQ ID NO: 5428989 - DNA, 19 bp, Homo sapiens
ggccacagacccccagggc

SEQ ID NO: 5428990 - DNA, 12 bp, Homo sapiens
ggccacagcacc

SEQ ID NO: 5428991 - DNA, 13 bp, Homo sapiens
ggccacagcaccc

SEQ ID NO: 5428992 - DNA, 23 bp, Homo sapiens
ggccacagcactagagtcacccc

SEQ ID NO: 5428993 - DNA, 11 bp, Homo sapiens
ggccacagcca

SEQ ID NO: 5428994 - DNA, 12 bp, Homo sapiens
ggccacagccag

SEQ ID NO: 5428995 - DNA, 17 bp, Homo sapiens
ggccacagccagaaccc

SEQ ID NO: 5428996 - DNA, 22 bp, Homo sapiens
ggccacagcccccttgccctcc

SEQ ID NO: 5428997 - DNA, 19 bp, Homo sapiens
ggccacagcccctggcact

SEQ ID NO: 5428998 - DNA, 22 bp, Homo sapiens
ggccacagcccctggcactgca

SEQ ID NO: 5428999 - DNA, 13 bp, Homo sapiens
ggccacagccttc

SEQ ID NO: 5429000 - DNA, 17 bp, Homo sapiens
ggccacagctgctggag

SEQ ID NO: 5429001 - DNA, 20 bp, Homo sapiens
ggccacagggcgagactccg

SEQ ID NO: 5429002 - DNA, 23 bp, Homo sapiens
ggccacagggcgagactccgtct

SEQ ID NO: 5429003 - DNA, 13 bp, Homo sapiens
ggccacagggcgg

SEQ ID NO: 5429004 - DNA, 20 bp, Homo sapiens
ggccacagtagtcttgatga

SEQ ID NO: 5429005 - DNA, 21 bp, Homo sapiens
ggccacagtgtcactggtcag

SEQ ID NO: 5429006 - DNA, 14 bp, Homo sapiens
ggccacagttgttt

SEQ ID NO: 5429007 - DNA, 19 bp, Homo sapiens
ggccacatcaaagaggctg

SEQ ID NO: 5429008 - DNA, 14 bp, Homo sapiens
ggccacatcagccc

SEQ ID NO: 5429009 - DNA, 20 bp, Homo sapiens
ggccacatcattctgtgtct

SEQ ID NO: 5429010 - DNA, 12 bp, Homo sapiens
ggccacatggcg

SEQ ID NO: 5429011 - DNA, 16 bp, Homo sapiens
ggccacatggcggaga

SEQ ID NO: 5429012 - DNA, 20 bp, Homo sapiens
ggccacatgggagcagtcca

SEQ ID NO: 5429013 - DNA, 18 bp, Homo sapiens
ggccaccaaagctgccca

SEQ ID NO: 5429014 - DNA, 24 bp, Homo sapiens
ggccaccacctttggctggtagca

SEQ ID NO: 5429015 - DNA, 22 bp, Homo sapiens
ggccaccagccatcctccctcc

SEQ ID NO: 5429016 - DNA, 22 bp, Homo sapiens
ggccaccagctccactggcctg

SEQ ID NO: 5429017 - DNA, 16 bp, Homo sapiens
ggccaccaggaagcac

SEQ ID NO: 5429018 - DNA, 23 bp, Homo sapiens
ggccaccaggaagcacaggtcca

SEQ ID NO: 5429019 - DNA, 12 bp, Homo sapiens
ggccaccaggct

SEQ ID NO: 5429020 - DNA, 14 bp, Homo sapiens
ggccaccaggctgg

SEQ ID NO: 5429021 - DNA, 18 bp, Homo sapiens
ggccaccaggtgcctttc

SEQ ID NO: 5429022 - DNA, 12 bp, Homo sapiens
ggccaccatccc

SEQ ID NO: 5429023 - DNA, 18 bp, Homo sapiens
ggccaccatgaccccttc

SEQ ID NO: 5429024 - DNA, 17 bp, Homo sapiens
ggccaccatgtctggct

SEQ ID NO: 5429025 - DNA, 19 bp, Homo sapiens
ggccacccaaatgtgtaca

SEQ ID NO: 5429026 - DNA, 16 bp, Homo sapiens
ggccacccaccagggc

SEQ ID NO: 5429027 - DNA, 19 bp, Homo sapiens
ggccaccccaaaccccagc

SEQ ID NO: 5429028 - DNA, 18 bp, Homo sapiens
ggccaccccttgctctct

SEQ ID NO: 5429029 - DNA, 17 bp, Homo sapiens
ggccacccgggctgcct

SEQ ID NO: 5429030 - DNA, 18 bp, Homo sapiens
ggccacccgggctgcctg

SEQ ID NO: 5429031 - DNA, 22 bp, Homo sapiens
ggccacccgggctgcctgcccc

SEQ ID NO: 5429032 - DNA, 20 bp, Homo sapiens
ggccacccggggcctggacc

SEQ ID NO: 5429033 - DNA, 21 bp, Homo sapiens
ggccacccgttctgctggcct

SEQ ID NO: 5429034 - DNA, 23 bp, Homo sapiens
ggccacccgttctgctggcctgg

SEQ ID NO: 5429035 - DNA, 15 bp, Homo sapiens
ggccaccctccttcc

SEQ ID NO: 5429036 - DNA, 16 bp, Homo sapiens
ggccaccctccttccc

SEQ ID NO: 5429037 - DNA, 14 bp, Homo sapiens
ggccaccctgctgc

SEQ ID NO: 5429038 - DNA, 16 bp, Homo sapiens
ggccaccctgctgcac

SEQ ID NO: 5429039 - DNA, 18 bp, Homo sapiens
ggccaccctgtgcagaag

SEQ ID NO: 5429040 - DNA, 20 bp, Homo sapiens
ggccaccgcaggggactgtc

SEQ ID NO: 5429041 - DNA, 24 bp, Homo sapiens
ggccaccgcaggggactgtctcag

SEQ ID NO: 5429042 - DNA, 16 bp, Homo sapiens
ggccaccgccttgccc

SEQ ID NO: 5429043 - DNA, 20 bp, Homo sapiens
ggccaccgccttgcccagcc

SEQ ID NO: 5429044 - DNA, 19 bp, Homo sapiens
ggccaccgctctcctgcct

SEQ ID NO: 5429045 - DNA, 19 bp, Homo sapiens
ggccaccgggacagacctg

SEQ ID NO: 5429046 - DNA, 20 bp, Homo sapiens
ggccaccgggggtggctctg

SEQ ID NO: 5429047 - DNA, 21 bp, Homo sapiens
ggccaccgggggtggctctgt

SEQ ID NO: 5429048 - DNA, 19 bp, Homo sapiens
ggccaccggtgggcagtgg

SEQ ID NO: 5429049 - DNA, 21 bp, Homo sapiens
ggccaccgtagggcctgactc

SEQ ID NO: 5429050 - DNA, 23 bp, Homo sapiens
ggccacctagaagtctccctgca

SEQ ID NO: 5429051 - DNA, 17 bp, Homo sapiens
ggccacctatgccagtg

SEQ ID NO: 5429052 - DNA, 19 bp, Homo sapiens
ggccacctcaccctctccg

SEQ ID NO: 5429053 - DNA, 20 bp, Homo sapiens
ggccacctccaaggactcta

SEQ ID NO: 5429054 - DNA, 20 bp, Homo sapiens
ggccacctcccactcctgct

SEQ ID NO: 5429055 - DNA, 22 bp, Homo sapiens
ggccacctcccactcctgctgc

SEQ ID NO: 5429056 - DNA, 23 bp, Homo sapiens
ggccacctcctaaaaggcccaga

SEQ ID NO: 5429057 - DNA, 13 bp, Homo sapiens
ggccacctcctac

SEQ ID NO: 5429058 - DNA, 16 bp, Homo sapiens
ggccacctcctacccc

SEQ ID NO: 5429059 - DNA, 21 bp, Homo sapiens
ggccacctcctaccccttcct

SEQ ID NO: 5429060 - DNA, 23 bp, Homo sapiens
ggccacctcctaccccttcctgt

SEQ ID NO: 5429061 - DNA, 13 bp, Homo sapiens
ggccacctcctcc

SEQ ID NO: 5429062 - DNA, 15 bp, Homo sapiens
ggccacctcctcccc

SEQ ID NO: 5429063 - DNA, 17 bp, Homo sapiens
ggccacctcctccccct

SEQ ID NO: 5429064 - DNA, 19 bp, Homo sapiens
ggccacctcctccccctgt

SEQ ID NO: 5429065 - DNA, 11 bp, Homo sapiens
ggccacctctc

SEQ ID NO: 5429066 - DNA, 12 bp, Homo sapiens
ggccacctctgc

SEQ ID NO: 5429067 - DNA, 13 bp, Homo sapiens
ggccacctctgcc

SEQ ID NO: 5429068 - DNA, 23 bp, Homo sapiens
ggccacctctgcggaccccagct

SEQ ID NO: 5429069 - DNA, 20 bp, Homo sapiens
ggccacctcttcctggccgg

SEQ ID NO: 5429070 - DNA, 16 bp, Homo sapiens
ggccacctgaggtggg

SEQ ID NO: 5429071 - DNA, 22 bp, Homo sapiens
ggccacctgaggtgggcccagg

SEQ ID NO: 5429072 - DNA, 13 bp, Homo sapiens
ggccacctgcagg

SEQ ID NO: 5429073 - DNA, 11 bp, Homo sapiens
ggccacctgcc

SEQ ID NO: 5429074 - DNA, 12 bp, Homo sapiens
ggccacctgcca

SEQ ID NO: 5429075 - DNA, 21 bp, Homo sapiens
ggccacctgccacccccaggt

SEQ ID NO: 5429076 - DNA, 16 bp, Homo sapiens
ggccacctgccaggcc

SEQ ID NO: 5429077 - DNA, 20 bp, Homo sapiens
ggccacctgccaggcctccc

SEQ ID NO: 5429078 - DNA, 13 bp, Homo sapiens
ggccacctgcccc

SEQ ID NO: 5429079 - DNA, 14 bp, Homo sapiens
ggccacctgccccc

SEQ ID NO: 5429080 - DNA, 14 bp, Homo sapiens
ggccacctgcctgc

SEQ ID NO: 5429081 - DNA, 15 bp, Homo sapiens
ggccacctgcctgcg

SEQ ID NO: 5429082 - DNA, 16 bp, Homo sapiens
ggccacctgcggtgct

SEQ ID NO: 5429083 - DNA, 18 bp, Homo sapiens
ggccacctgtagccatct

SEQ ID NO: 5429084 - DNA, 16 bp, Homo sapiens
ggccaccttggaggag

SEQ ID NO: 5429085 - DNA, 14 bp, Homo sapiens
ggccacctttgtgc

SEQ ID NO: 5429086 - DNA, 15 bp, Homo sapiens
ggccacgcagccagg

SEQ ID NO: 5429087 - DNA, 16 bp, Homo sapiens
ggccacgcagccagga

SEQ ID NO: 5429088 - DNA, 22 bp, Homo sapiens
ggccacgcaggggctctgagcc

SEQ ID NO: 5429089 - DNA, 22 bp, Homo sapiens
ggccacgccggccacacccctc

SEQ ID NO: 5429090 - DNA, 14 bp, Homo sapiens
ggccacgctccctc

SEQ ID NO: 5429091 - DNA, 13 bp, Homo sapiens
ggccacgctcctc

SEQ ID NO: 5429092 - DNA, 15 bp, Homo sapiens
ggccacgctcctctg

SEQ ID NO: 5429093 - DNA, 17 bp, Homo sapiens
ggccacggagcgggagg

SEQ ID NO: 5429094 - DNA, 15 bp, Homo sapiens
ggccacggcccaggg

SEQ ID NO: 5429095 - DNA, 13 bp, Homo sapiens
ggccacggcctgg

SEQ ID NO: 5429096 - DNA, 15 bp, Homo sapiens
ggccacggctgagcc

SEQ ID NO: 5429097 - DNA, 14 bp, Homo sapiens
ggccacgggggagg

SEQ ID NO: 5429098 - DNA, 23 bp, Homo sapiens
ggccacgggggaggccgaggcag

SEQ ID NO: 5429099 - DNA, 16 bp, Homo sapiens
ggccacgggggcagtg

SEQ ID NO: 5429100 - DNA, 16 bp, Homo sapiens
ggccacgtgccaggcc

SEQ ID NO: 5429101 - DNA, 17 bp, Homo sapiens
ggccacgtgccaggccc

SEQ ID NO: 5429102 - DNA, 23 bp, Homo sapiens
ggccacgtgggcaaacaggcagt

SEQ ID NO: 5429103 - DNA, 19 bp, Homo sapiens
ggccacgtgtgctgtggcc

SEQ ID NO: 5429104 - DNA, 14 bp, Homo sapiens
ggccactaaagctt

SEQ ID NO: 5429105 - DNA, 14 bp, Homo sapiens
ggccactagtgaca

SEQ ID NO: 5429106 - DNA, 18 bp, Homo sapiens
ggccactcaacagagagg

SEQ ID NO: 5429107 - DNA, 16 bp, Homo sapiens
ggccactcagaggccc

SEQ ID NO: 5429108 - DNA, 13 bp, Homo sapiens
ggccactccctgc

SEQ ID NO: 5429109 - DNA, 15 bp, Homo sapiens
ggccactccctgcca

SEQ ID NO: 5429110 - DNA, 17 bp, Homo sapiens
ggccactccctgccaac

SEQ ID NO: 5429111 - DNA, 13 bp, Homo sapiens
ggccactcctcca

SEQ ID NO: 5429112 - DNA, 14 bp, Homo sapiens
ggccactccttcct

SEQ ID NO: 5429113 - DNA, 17 bp, Homo sapiens
ggccactccttcctgcc

SEQ ID NO: 5429114 - DNA, 20 bp, Homo sapiens
ggccactctcccctccctct

SEQ ID NO: 5429115 - DNA, 21 bp, Homo sapiens
ggccactctcccctccctctt

SEQ ID NO: 5429116 - DNA, 22 bp, Homo sapiens
ggccactctcccctccctcttc

SEQ ID NO: 5429117 - DNA, 20 bp, Homo sapiens
ggccactctgcctctgcctg

SEQ ID NO: 5429118 - DNA, 18 bp, Homo sapiens
ggccactctgtttgctca

SEQ ID NO: 5429119 - DNA, 13 bp, Homo sapiens
ggccactgagctg

SEQ ID NO: 5429120 - DNA, 16 bp, Homo sapiens
ggccactgagctggct

SEQ ID NO: 5429121 - DNA, 18 bp, Homo sapiens
ggccactgcagcacctgc

SEQ ID NO: 5429122 - DNA, 17 bp, Homo sapiens
ggccactgcagtcaccc

SEQ ID NO: 5429123 - DNA, 20 bp, Homo sapiens
ggccactgcagtcacccctg
